United States Patent 11,078,247 (RNA ENCODING A THERAPEUTIC PROTEIN) - sequence listing, part 36

SEQ ID NO: 60916 - RNA, 1728 nt, Artificial Sequence
  derived and/or modified sequence opt3 from POC5__Homo_sapiens__NP_001092741
augagcuccgacgaggaaaaguacucucugcccgugguccagaacgauucaaguagaggcagcuccguuucuucgaaucuccaagaggaauaugaggaacuucugcacuacgccaucgugaccccuaacauugagccaugcgcuucacagagcagucauccgaaaggggaguugguacccgacgugaggauauccacaauccacgauauuuuacauucucagggaaauaacagcgaaguccgggagacugcaaucgaaguggguaagggcugugacuuccacauuuccucacauaguaaaacggaugagagcucuccuguucuguccccacgcaagcccucacacccugugauggacuuuuucagcagucaccuacucgccgauucuuccagcccagcgaccaauucgucucauacagacgcucacgagauccuggucuccgauuuucuugugucagacgaaaaccugcagaaaauggagaauguauuggaucucuggaguagcgggcugaagacuaacauaaucuccgaacugucuaaguggcgacucaauuucauugacuggcaucguauggagaugagaaaagaaaaggagaaacacgccgcacacuuaaagcaacugugcaaccagaucaaugagcuuaaagaauugcagaagaccuuugagauuagcaucggaaggaaggaugaaguuauaucaagucugucccaugccauuggcaaacagaaggagaaaaucgaacuaaugcggacauucuuucacuggcgcauuggucaugugagagcuaggcaagacgucuaugaggggaagcucgcagaccaguacuaucagcggacccugcuuaaaaagguguggaaaguguggcgcagcgucguucagaagcaauggaaggaugugguagagcgagccugucaggcuagagccgaagaggugugcauccagaucucuaacgacuacgaagcgaaagucgcaaugcugucaggagccuuggagaaugcuaaggccgaaauucaaaggaugcagcacgagaaagagcauuucgaagauaguaugaagaaagcauuuaugcggggcgugugugcucucaaccuggaggccaugacuauauuccagaaucguaacgacgcgggcaucgauagcacaaacaauaagaaggaagaguaugggcccggaguucaggguaaagagcacuccgcccacuuagacccuucugcaccaccgaugccccugccugugaccucgccacuccuucccagcccuccagcugccgucggcggggcuuccgccacggcagugcccucagccgcuaguaugacuucuacccgcgcggcaagcgccuccucaguacauguuccggugagcgcucugggagccggcucugcagccacagcugccuccgaagagauguacgucccuagaguggucaccagugcacaacagaaggcggguaggacuauuacagcucggaucaccgggcgaugcgauuuugccagcaaaaaccgcauaucuuccucauuggcaauuaugggagugagucccccaaugagcucgguugugguagaaaagcaccauccugucacggugcagacuaucccccaggccacagcugccaaauacccaagaaccauccaccccgaguccucuacuagcgcaucaaggagucuaggcacacgguccgcucacacccaaucucugacgagcguucauuccauuaagguggucgacuga

SEQ ID NO: 60917 - RNA, 1677 nt, Artificial Sequence
  derived and/or modified sequence opt3 from PODXL__Homo_sapiens__NP_001018121
augagaugcgcccuggcucucagcgcacuucuguuguuacuguccacacccccucuacucccaucuucaccgagucccagcccuuccccaucucagaacgccacccaaacuacgaccgacucgucaaauaagacagcgcccacuccugcuagcagugugaccaucauggccacagauaccgcacagcaguccacugucccaacaucuaaagccaacgagauucuggcuagcguuaaggcaaccacgcuuggcguguccucagacagucccgggacuaccacacuggcccagcaaguaagcggaccugugaauacuaccgucgcuagggguggcgggucuggaaacccaacaaccacgauagaauccccgaaaucaacuaagagcgccgauacaaccacuguggcgacaaguaccgcaacggccaaacccaauaccacaucuucccagaacggcgcugaggacacuaccaauagcggugggaagucgucucacuccguuacaacugauuugaccucaacaaaggccgaacaucucaccacuccucacccaacgaguccccugagcccucggcagccaacauccacccaucccguggcaacuccgaccucuagcggacacgaccaucugaugaaaaucucaaguuccagcucuacagucgcuauuccuggcuacaccuucacuucacccggcaugacaacgacccucuuagagacuguguuucaccacguaagucaggccgggcuggaacuuuugacaagcggagaucugccaacccuagcgucccaaucugccgguaucacagcaucgagcguuauuucccagcgcacucagcagaccucaagucaaaugccugcuucuagcacggcccccuccucacaggagaccgugcagccaacaagccccgcuacugcccuccgaaccccuacacugccagagacuaugucuuccaguccgaccgcagccagcacgacacaucguuaucccaagaccccuucuccaacugucgcucacgaauccaacugggcgaaaugugaggaccuugaaacacaaacccagucagagaagcagcugguguugaaucucacuggcaacacccugugcgcagggggagccagugaugagaaauuaaucagccugauauguagagcugugaaggccacauucaaucccgcacaggacaagugcggcaucaggcucgccucggucccugguucccaaacgguugugguaaaagaaauuaccauccauacuaaacuuccagcuaaggauguguacgagcggcugaaggacaaaugggaugaauugaaggaggccggggucucugacaugaaacuaggagaccaggggcccccggaagaggcagaggaucgcuuuagcaugccucugauuaucacaauaguguguauggcgucauuccuccugcuuguugcugcccuguauggcugcugucaccagagauugagucagaggaaggaccaacagcggcucaccgaggaacugcagacaguggaaaacggcuaccacgauaauccaacuuuagaggucauggaaaccuccucugagaugcaggagaagaaagugguaagccugaacggagaacuaggugacuccuggauuguuccccucgauaaucugacgaaggacgaucuugacgaggaagaggauacacauuuguga

SEQ ID NO: 60918 - RNA, 1770 nt, Artificial Sequence
  derived and/or modified sequence opt3 from POF1B__Homo_sapiens__NP_079197
augagcuccucuuacuggucagagaccaguagcuccucuugcggcacacagcaacugcccgaagugcuccagugucagccucagcacuaucauugcuaccaccaaucgucacaggcccagcagccaccggagaagaacgucguuuaugaaagagugaggacuuacagcgggcccaugaauaaaguagugcaagcucuugacccuuucaacagucgggagguccuguccccauugaagacgaccucuagcuaucagaauuuagugugguccgaucauucacaggaacugcacagucccacacuaaaaaucagcacuugugcaccuucuacccuccauauuacacagaacaccgagcaagagcugcacuccccaacuguuaaacuuacaaccuacccccagacgacuauacgcaaauaugugguccagaauccugaacaagagccacugucacaguuuuugcgaggaagccacuucuuuccggguaacaaugugaucuacgaaaagaccauucguaagguagagaaacucaacacagaccagggcugccauccccaggcccaaugucaccaucacaucauucagcagccucagguuauccacagugcgcauuggcaacagccagauucuucccagcagauacaagcuaucacugggaauaaccccauuagcacccacaucggaaaugagcugugccauucggguucuucccagauuugugaacaggugaucauacaggacgauggcccugagaagcuggacccaagauacuucggggaacucuuagccgaucugucaaggaaaaacacagaccuuuaucacugcuugcuggagcaucuacaacggauuggaggcaguaagcaggauuuugaaagcaccgacgaguccgaggauaucgaaucucucauucccaaaggccugagcgaguucacgaagcagcaaauccgcuacauccuucagaugagagggaugucagacaagagucugagguugguccucuccacuuuuagcaauauucgggaggaacugggacacuuacagaacgauaugacaucucuggaaaaugacaaaaugcgccucgagaaggaccuuucauucaaagauacccagcugaaggaguaugaagaguugcuagcaagugugcgagccaacaaccaccaacagcagcagggucugcaagacagcuccucuaaaugucaggcucucgaagagaauaaccugucgcuuagacauacucugagcgauauggaauacagguugaaggagcucgaguauugcaaacggaaucuggaacaggagaaccagaauuuacguaugcaaguguccgaaacauguaccggcccgaugcugcaggcaaagauggacgagauagggaaccacuacacggagauggucaagaaucuacgcauggaaaaagauagagagaucugcaggcuccggucacagcugaaccaauaucauaaggacguuaguaaacgagaaggaucuugcagcgauuuucaguucaaacuucacgaguugaccucccugcucgaagagaaggacucacugauuaagcgccagagcgaggaacuuucuaagcugagacaggagaucuacuccagucacaaucaaccuagcacaggcgguaggacuaccauaacaacuaaaaaguaccggacccaguaucccauuuuggggcuccuguacgaugacuaugaauacaucccaccuggaucugagacacagaccaucgugauugaaaagacugaggauaaguauacgugucccuga

SEQ ID NO: 60919 - RNA, 1167 nt, Artificial Sequence
  derived and/or modified sequence opt3 from POFUT1__Homo_sapiens__NP_056167
augggcgccgcugcaugggccagaccccugagcguguccuuccuccuucuguuguuaccucugccagggaugccggcgggaucuugggaccccgcugguuaccuacucuauugcccuuguaugggcagguuugggaaccaggccgaucacuuccugggaucacuugcauuugccaagcuguugaaucggacccucgcugucccacccuggaucgaguaccaacaucacaaaccuccauucacaaaccugcauguuaguuaucagaaguacuuuaaacuggaaccccuccaggcauaucaccgcgugauuagcuuagaggacuucauggaaaagcuggccccuacucauuggccaccggagaaacgaguagcuuacugcuuugaaguggccgcgcagcguucccccgauaagaagacguguccuaugaaagagggcaauccauucggucccuuuugggaccaauuccacgucucuuuuaacaagucggagcuuuucaccgggauaucauuuagcgcaaguuauagagaacaguggucccagagguucucuccuaaagagcacccaguguuggcccugcccggagcuccggcccaguucccuguucuagaggaacaucggccccuccaaaaguacaugguguggagcgaugagauggucaaaacaggcgaagcacagauccacgcucaucuggugcgcccauacguaggcauucaccuuagaaucggguccgacuggaagaaugccugcgcgaugcugaaggauggaacugccgguucacacuuuauggcaaguccucaguguguuggcuauagcaggucuaccgcugcccccuugacaaugaccaugugccucccagaccugaaagagauucagcgggcugugaaguuauggguccgcucccuggaugcccaaucaguguacguggcaacugacagcgaaaguuauguccccgagcuccagcagcuuuucaaagggaagguuaaagugguaucucugaagccugaaguggcccaagucgauuuguacauccuaggacaggcugaccauuuuauaggcaacuguguguccagcuucacagcguuuguuaaacgagagagagaucugcaggguaggccaucgucuuucuuugggauggaccggccgcccaagcuccgugacgaguucuga

SEQ ID NO: 60920 - RNA, 1275 nt, Artificial Sequence
  derived and/or modified sequence opt3 from POFUT2__Homo_sapiens__NP_056042
auggccacccugagcuucguguuucuccuucugggcgcugucuccuggcccccugcaucugccucagggcaggaguucuggccaggacaaagugcggcugacaucuugagcggugccgcauccagaaggcgguacuuacuguaugauguuaacccgcccgaaggcuuuaaucuacgccgagacguguacauucguauagccucucuccugaagacacuucugaaaacugaggaauggguauuggugcucccuccaugggggagacuguaucacuggcagucgcccgauauccaucaggucaggauuccuuggucagaguucuuugaccugccaagccucaacaagaauauccccgugauugaauacgagcaguucaucgcugagaguggaggcccuuuuauagaucaaguuuauguguuacaguccuacgcagaagguuggaaagaggggacgugggaagagaaggucgacgagcggccaugcaucgaucagcugcuuuauucucaggacaaacacgaauacuaccgcggaugguucuggggcuaugaggaaaccagaggcuugaacgugagcugucuguccguacaagggucagccaguauuguugcuccgcuacuccugaggaauacaagcgcccggucugugaugcuugaucgcgcggagaaccuguugcaugaccacuacggagguaaggaauauugggauacucgaagauccauggucuuugcaaggcaucuccgggaggugggcgacgaguuccguucacgccaccugaauagcaccgaugacgccgacagaauccccuuucaggaagauuggaugaagaugaaagugaaguuagggagugcucugggaggcccuuaccucgguguccaccuuaggcggaaagacuucauuugggggcaucgacaggauguuccaucucuggagggagccgugcgcaagaucagauccuugaugaaaacacacaggcuagacaagguauuuguggcaaccgaugcuguccggaaggaauaugaggaacugaaaaagcuccugcccgagauggugcgcuucgagccuacuugggaggaacuugaacuguacaaagacggcggcguugccauaauugaucaguggaucugcgcgcaugccagauguuugccaacaagccucucggcagagucuggguccggagguuuccaaagguuuuucugccccaaguauucagugagugaacagauggucgcuugugugcacagcggccacuuucauaccguaugccuguuaguuuga

SEQ ID NO: 60921 - RNA, 1830 nt, Artificial Sequence
  derived and/or modified sequence opt3 from POGK__Homo_sapiens__NP_060012
auggagagcaccgccuacccccugaaccucucccuuaaggaagaggaagaggaagaggagauccagucuagagaacuggaggacggcccugcugauaugcaaaaagugaggauuugcucagaagggggaugggucccagcauuguucgacgagguugccauauauuuuagugaugaggaaugggagguguuaacagaacagcagaaggcgcuguaccgggagguaaugcgcaugaauuaugaaacugugcuaagccucgaguucccguuucccaaaccugacaugaucacgcgacuggagggugaagaggaaucccagaacucugaugaguggcaacuucagggcgggaccucggcugaaaaugaggagucagacgucaagccacccgauuggccuaacccaaugaaugccacaagccaguucccccagccucaacacuuugacaguuucggacugcguuugccaagagauauuacugaacucccggagugguccgaaggcuaccccuuuuauauggcaauggguuucccuggguacgaccugucugccgaugacaucgcuggaaaauuucaguucagcaggggcaugcggcgcuccuaugaugcaggcuuuaagcugauggugguugaguacgccgaaucaaccaacaauugucaggcugccaagcaguucggggugcucgagaaaaacgucagagacuggaggaaggugaaaccacaauuacagaaugcgcaugcaaugcggcgcgccuuucgaggacccaagaacgguagauucgcucugguagaccagaggguugccgaguacgugcgguauaugcaagcaaaaggcgauccuauuacacgugaagcuaugcagcuuaaggccuuggagaucgcgcaggaaaugaauauaccagagaagggguucaaagccagucugggauggugccgcagaaugaugaggcgguacgaccuaagccuccgacacaagguccccgugccgcagcaucugccugaggaucuuaccgaaaaacuggugacuuaucaacgcucugucuuggcacucagaagggcucacgacuacgagguugcccagaugggcaacgcugaugaaacacccaucugucuggaggugccaucccggguaaccguggacaaucagggugaaaagccugucuuagugaaaacgcccgggcgcgagaagcugaaaauuacugccaugcucggaguucuugcagauggcagaaagcugccacccuauaucauuuugaggggcaccuacaucccuccagggaaguuuccgucaggaauggagauacguugccaucgguaugguuggaugacagaagaccuaaugcaggauuggcuggagguggucuggcgaagaaggacuggcgccgugcccaaacaacgcgggaugcucauucugaacggauuccggggccacgcuaccgacagcguaaagaauaguauggaaucuaugaacacagauaugguuaucauuccuggugggcuuaccucccagcugcaaguguuggacgucguggucuacaaaccacucaacgacagcgugagagcgcaguacucgaauuggcuguuagcaggcaaccuggcccuaucucccacgggaaaugcuaagaaaccuccacucggccuguuucuugaguggguuaugguggccuggaacuccaucucaagugaaagcaucguacagggguucaagaagugucacauuuccucuaauuuggaggaggaagaugacguccugugggagauagaaagcgagcuccccggagguggcgaaccgccuaaagauugcgacacugagucaauggcagagaguaacuga

SEQ ID NO: 60922 - RNA, 1179 nt, Artificial Sequence
  derived and/or modified sequence opt3 from POGLUT1__Homo_sapiens__NP_689518
auggaguggugggccagcucuccccugagacucuggcuucuguuguucuuacugccuuccgcucagggcaggcaaaaggaaucagggaguaaauggaagguguuuaucgaccagauuaaccggagccuagagaauuacgaaccaugcuccucucagaacuguucgugcuaucacggagucauagaggaagaucucaccccguuccgcgguggcaucucacgaaaaaugauggcagagguugugcguagaaagcuggggacacacuaccagauuacuaaaaauaggcuuuaucgggagaacgacuguauguuucccagccgcugcaguggaguagaacacuucauccuggaggugauuggcagauugccugauauggaaauggucaucaaugugagggacuacccacaaguucccaaguggauggagccugccauaccaguguuuuccuucucuaagacgagcgaguaucaugauaucauguaccccgcguggaccuuuugggaaggugggccugcugucuggccaauuuauccgacaggacucggccggugggaccuguuccgcgaggaucuggugcgauccgccgcacaguggcccuggaaaaagaaaaacucaacugccuacuuuagaggcaguaggaccagcccugaacgggacccacucaucuuacugucucguaagaaucccaaacuuguagaugcugaguacacaaagaaccaggcauggaaguccaugaaagacaccuuggggaagccugccgcuaaagauguucaccugguggaccauuguaaguauaaauaccuauucaauuuucgcggagucgccgcgucauucagauuuaagcaccucuuccugugcgguagccuuguguuccacgugggcgaugaauggcuggaguuuuucuauccacaguugaaacccuggguccauuacauuccgguuaagacugaccucaguaacgugcaagagcuguuacaguuuguaaaggcaaaugacgauguggcccaggaaaucgcugagagggggucucaguucauacggaaccaucugcaaauggacgauauuacauguuauugggaaaaucuccuuuccgaguacagcaaauuucugucguauaacgucacccgacgcaagggauacgaccagaucauuccuaaaauguugaagacggaacuauga

SEQ ID NO: 60923 - RNA, 4389 nt, Artificial Sequence
  derived and/or modified sequence opt3 from POLA1__Homo_sapiens__NP_058633
auggcccccgugcacggcgacgauagccuguccgacucugggucauucgugaguagcagagcuaggcgggagaagaaauccaagaaaggacgccaggaagcacucgagcgacuuaagaaagccaaggcgggugaaaaguacaaauaugagguugaagauuuuaccggcguguacgaggagguagacgaagaacaauauucuaagcuggugcaggcucgucaggaugacgauuggaucgucgacgaugacgggauuggauacguggaagauggcagagagauauucgacgaugacuuggaggacgaugccuuagacgcagaugaaaaagguaaggacgggaaagccaggaacaaggauaagcggaauguuaaaaagcuggcugugacaaaaccuaacaauaucaagucgauguuuauugcaugcgccggaaagaagacugcugacaaagccgucgaucuaucaaaggacggccuccugggcgauauccuucaggaccugaacacggagaccccacaaauuacaccgcccccugugaugaucuugaagaaaaagcgcagcauaggggcgaguccaaaucccuucuccguacacacugcaaccgccguuccuucuggaaaaaucgcuagcccaguguccagaaaggaacccccucucacaccagucccgcugaaaagggccgaguuugcuggugaugacguccagguggaaucaaccgaggaggaacaggagaguggcgcaauggaguucgaggacggggauuuugacgaacccauggagguggaggaaguugaucuggagccuauggccgcgaaggccugggacaaggaaagcgagccagcagaagaggugaaacaggaggcugauucuggaaagggcacuguauccuaucucgguucauucuuacccgacgugagcuguugggauauugaccaagaaggggauaguucuuuuuccguccaggaggugcagguugacagcucgcaucugccucuugugaaaggagccgaugaagaacaggucuuccacuuuuacugguuggacgcuuaugaggaucaauacaaccagccaggcgugguauuccuguuuggcaagguuuggaucgaaucugccgagacacacguguccugcugugucauggugaaaaauauugaacggacccuauacuuccucccccgcgagaugaagaucgaccugaacacggggaaggaaacuggaaccccgauaucaaugaaagacgucuaugaggaguucgaugaaaagauugcaacaaaauacaagaucaugaaauuuaagaguaagccuguggagaaaaauuaugccuucgaaauucccgacguuccagaaaagagcgaauaccuugaggugaaauauuccgcugagaugccucagcugccccaagauuugaagggugaaacuuuuucucauguauucggcaccaacacaagcucacucgagcuguuuuuaaugaaucgaaaaaucaaggggccaugcuggcuggaagucaaaaguccccagcuccuuaaccagccuguguccugguguaagguugaggcgauggcacugaagccagacuuggugaaugucaucaaagaugugagcccgcccccucuaguagugauggccuucucuaugaagaccaugcagaacgcuaaaaaucaccaaaacgaaauuauagccauggcagcccugguucaccauucauuugcucucgacaaggccgcaccaaaacccccuuuccagagucacuuuugcgucgugagcaagccaaaggauuguaucuuccccuacgcguuuaaagaggugauugagaagaaaaacgucaagguugaaguggcugccacggagagaacucugcuuggauucuuucuggcaaaagugcauaagaucgacccggauauaauuguaggccacaauaucuaugguuucgaauuggagguccuccugcagaggaucaacgugugcaaggccccucacugguccaaaauugggcgguuaaagcguucuaauaugccaaaacugggcggacgcucgggcuucggggagagaaacgcuacauguggaaggaugaucugcgacguugaaauuagcgccaaggagcuaauacgguguaaauccuaccaucucucagaacuggugcagcaaauccuuaagaccgagcgagucgugauucccauggaaaauauccagaacauguacagugagucuagccaguugcuguaucuccuggagcacacuuggaaggaugcaaaauuuauccuucagauuaugugcgaacugaauguuuugccucucgcucugcaaauaacaaacaucgccgguaauauuaugucccgcaccuuaaugggcgggagaucagagaggaacgaguuccugcuacuccaugcguuuuacgagaauaacuauaucgugcccgacaagcagauuuuccggaaaccacagcagaagcugggagaugaagacgaggagaucgacggcgauacgaauaaauacaagaaaggucgcaagaaggccgcuuaugcagggggccuuguauuggacccuaaagucggauuuuacgauaaguucauacugcuccuggacuuuaacagcuuauaucccucuaucauucaagaguucaauaucugcuuuaccacagugcagagaguggccuccgaggcucagaaagucacugaagauggcgagcaagaacagauuccagagcugccggacccuagucuugagauggggaucuugcccagggaaauacguaagcucguugagcggcgaaaacaggugaagcagcugaugaagcaacaggaucuaaacccagaccugauucuccaguacgauaucagacagaaagcccugaaacuuaccgcaaacagcauguacggauguuuggguuucucuuauuccagguuuuacgcgaaaccccuggccgcuuuaguaacauauaagggccgcgaaauucucaugcacacuaaagagauggugcaaaagaugaaucuggaggucaucuacggggacaccgauucaauaaugaucaacacaaauaguaccaaccuugaagagguguucaagcugggaaauaaaguuaagagcgaagugaacaaauuguauaagcuccuggagauugacaucgacggcgucuuuaaaucgcuacugcuccugaagaagaaaaaguacgccgcacuugugguugaaccuacuuccgaugguaauuaugugacgaaacaggaguugaaggggcuggacauuguccggagagauuggugcgacuuagcuaaagauacaggcaacuucguaaucggacagauacucucugaccagagcagggauaccauuguggagaauauccaaaagcgccugaucgaaauuggcgagaacguucuuaaugggucagugccagucagucaguucgaaaucaacaaggcccugacuaaagacccccaggauuacccugacaagaaaucccuaccgcaugugcacguagcacucuggauuaauucucaaggaggccgaaaggugaaagccggugauaccgucagcuacguuauaugucaggacggguccaaccugacagcuucacagcgggcguaugccccagagcaguugcaaaagcaggauaaucugaccaucgacacucaguacuauuuagcacagcaaauucaccccgugguggcucguaucugcgaaccuauugacggaaucgaugccguccucauagccacauggcugggccuugacccaacgcaguuuagagugcaucacuaccauaaagaugaggagaacgacgcucuguuggguggccccgcacagcucaccgaugaagagaaguauagggacugugaacgcuucaagugcccuuguccgacuugcgggacagagaacaucuacgauaauguuuuugacggaagcggcaccgauauggaacccagucuguaucgguguucuaacauugacugcaaagccuccccacuaacauucacuguacagcugagcaauaaacuuaucauggauauuagaagguuuaucaagaaguacuacgacggguggcucauaugugaggagccuaccugccgaaaccgcacgcggcaucugcccuugcaauucucgagaaccggaccacugugcccugcguguaugaaagcuacauuacagcccgaauauucagauaagucucucuacacucagcugugcuuuuauagguacauuuucgacgccgagugugcacuugaaaagcugaccacagaccacgagaaagauaaguugaaaaagcaguuuuucacuccaaaagugcuccaagacuaucguaagcugaagaauaccgccgagcaguuucuaagucgcuccggcuacagcgaagucaaccugucuaaacuuuucgcugguugcgcagucaagagcuga

SEQ ID NO: 60924 - RNA, 1797 nt, Artificial Sequence
  derived and/or modified sequence opt3 from POLA2__Homo_sapiens__NP_002680
augagcgccuccgcucagcaacuggcagaggaacuccagaucuucggccuugacugcgaggaagcccugauugagaaguugguggaauuauguguccaguacgggcagaacgaggagggaaugguuggugaacugauagcguuuugcaccucuacacacaaagugggccuaacuucagagauccucaauaguuucgaacaugaguuucugagcaagagacuuuccaaagcuaggcacucuacguguaaggauucggggcaugccggagcacgggacauuguaucaauccaagagcugauugaaguggaggaagaggaagagaucuugcucaacagcuauaccacacccaguaaaggcucccagaagcgcgccauaucuacuccugagaccccacugacaaagcgaagcgucuccacccguucaccgcaccagcugcucagucccagcucuuucuccccuucagcuacuccaagccagaaauacaauaguagaucuaacaggggugaagugguuacauccuuuggguuagcacaaggagugagcuggucgggccggggcggggccggaaauaucucucugaagguccuugguugccccgaggcuuugaccggcuccuauaaaucaauguuccagaagcugccugauauucgcgaagugcuaacguguaaaaucgaggaacucgggagugagcugaaggagcauuacaagauugaagccuuuacuccacuucuggcgcccgcacaggagccuguaaccuugcucggacagaucggcugcgacagcaacgguaaacugaauaacaaguccguuauauuagaaggggauagagagcacucuagcggagcccaaauuccaguggaccugucagaacucaaagaguauagucuuuucccgggccaggucgugaucauggagggcauuaauacaacugggaggaagcugguggcuaccaaauuguacgaaggagucccccuaccuuuuuaucagccaacagaggaagaugccgacuucgagcaauccaugguucugguggcauguggucccuacaccacgagcgauucuaucacuuacgacccucuccuggaucuuaucgcuguaauuaaccacgaccggccagaugugugcauacuguuuggccccuucuuggacgccaagcaugagcaggucgaaaauugucuccugacaucaccguuugaggacaucuucaaacagugcuuacgcaccauuaucgaagggacucgaaguagcggaucccaccugguguucguuccuucucuaagagaugugcaucacgagcccgucuauccacagccucccuuuucguacagcgaccucuccagggaagauaagaagcaagugcaguucguaucagagccauguagucugucuauaaacggcguuauuuuuggucuuacaagcaccgacuugcuguuccaccucggggcggaggaaaucuccucaagcucuggcacguccgaucgguuuagucguauccugaaacauauucuuacccagcgcagcuauuacccccuguauccuccacaggaggacauggccaucgauuacgaaucuuucuauguguacgcacaauugccggucacacccgacgugcucauuauaccuuccgagcugagauacuuugucaaggauguguuaggaugcguuugcgugaauccaggcaggcugacuaaagggcagguaggagguaccuucgcucggcuauaucuccgacgccccgccgcugacggcgccgaaagacagucaccuuguaucgcaguccaggugguuaggauuuga

SEQ ID NO: 60925 - RNA, 1008 nt, Artificial Sequence
  derived and/or modified sequence opt3 from POLB__Homo_sapiens__NP_002681
augagcaagagaaaagcuccccaggagacccugaacggcgggaucacagacaugcucacugaacuugccaauuucgagaagaacgugucccaagcaauucacaaauacaaugccuauaggaaggcggcuucugucauagccaaauacccucauaagaucaagucaggagcagaagccaaaaagcugccagguguuggcacgaaaauugcugagaagaucgaugaauuuuuggcaaccgggaaauuacggaagcuggagaagauucgccaggacgauacaaguagcuccaucaacuuccuaacucgagugucuggaauaggcccgucggccgcucguaaauuuguagacgaggguaucaagacccucgaagaucugagaaagaaugaggacaaacuuaaccaccaucagaggauugggcugaaauauuucggagauuuugaaaagcggaucccccgcgaggagauguugcagaugcaagacauugugcucaaugaagucaaaaagguggauucagaguacaucgccacaguuugcggcagcuucagaaggggcgcggaaaguuccggggacauggaugugcugcugacccacccuucuuuuacuagcgaguccacaaagcagccaaaacucuuacaucaggucguggaacagcugcaaaagguacacuucauaaccgacacgcuuucaaaaggagagacuaaguuuauggguguuugucaguugcccaguaaaaacgaugagaaggaauauccucaccggcgcauugacauccgacugauuccaaaggaccaguacuauugcggcgugcuauacuucaccgggagcgauaucuuuaauaaaaacaugagagcacaugcccucgagaagggauucacaaucaaugaauacacuauuaggccccugggcgucaccgguguggcuggggagccucuuccaguggacucugaaaaagauauauuugacuauauccaguggaaguaccgggagccgaaagaucguuccgaguga

SEQ ID NO: 60926 - RNA, 3324 nt, Artificial Sequence
  derived and/or modified sequence opt3 from POLD1__Homo_sapiens__NP_001243778
auggacggcaagagaaggcccgggccuggaccaggugugccgcccaaacgggcccgcggcgggcugugggaugacgaugacgcuccucgaccaagccaguucgaggaagaucucgcacuuauggaggaaauggaggccgaacaccgucugcaagagcaggaggaagaggaauugcaguccgucuuagagggaguugcggacggccaggugcccccuucugcuaucgauccaagauggcugaggcccaccccuccagcccuagacccgcaaacagagccccucauuuuucagcagcuggaaauagaucauuacguagguccugcacagccagugcccgggggaccuccacccucacggggcagugucccggugcuucgcgccuucggcguuacugacgagggguuuagcgugugcugucacauccauggauucgcuccuuauuuuuacacgcccgcaccaccugguuucggccccgaacacaugggggaucugcaaagagaguugaaccucgccauuuccagggacucucggggaggccgcgaacugaccgguccagcuguccuggccguggagcucugcucgcgagagucaauguuuggguaucauggacacggccccagcccuuucuuaagaaucacaguagcgcugccaaggcuuguugcaccggcccggcguuugcuggaacagggcauucgcguggcugggcuaggaacucccaguuuugccccuuacgaggcaaaugucgauuucgaaaucagauuuaugguggacaccgacauaguggguuguaacuggcucgagcugccagcuggcaaguaugcccuuaggcugaaagaaaaggcgacacagugccaguuggaggccgauguccucugguccgacguugugucucaucccccugaggggccauggcaacggaucgcaccccugcgaguacugagcuucgauauugaaugugcuggacgcaaaggcaucuuuccggagccugaaagagacccagugauucagaucugcuccuuaggucucagguggggcgagcccgaaccuuuccuucggcuggccuugacccuacgccccugugcuccaauacugggggccaagguccagucauacgagaaggaggaagaucuccugcaagcauggaguacuuucauuagaaucauggacccugaugugauuacaggauauaauauccagaacuuugaccuucccuaccugaucagcagggcccagaccuugaaaguucagacguucccauuucucggccguguggcugggcugugcucuaauauucgggauuccucauuccaaagcaagcagacuggacgaagagacaccaaagucgugaguaugguagguaggguucagauggauauguuacaggugcugcuacgcgaguacaagcuccggucuuauacacugaacgcggucuccuuucacuuccuuggcgaacaaaaagaggacgugcagcacagcauaaucacugacuugcagaaugggaacgaucagaccagaaggcgccuggcagucuacugucucaaggacgccuaucugccgcuucgacuguuggagcggcucauggugcugguuaaugcuguggaaauggcccguguaacaggagucccuuuaucguaccugcuaucuagaggccaacaggugaagguugugucccagcuccugaggcaggcaaugcaugagggucuuuugaugcccgucgugaaaucagaagggggcgaggauuauaccggagccacgguaauugaaccacugaagggcuacuaugacgugcccaucgcuacucucgauuuuaguagccuguacccuuccauaaugauggcccacaacuuaugcuacacaacccugcuucgcccagggacugcacaaaaauugggacucacagaggaccaguucauucggacccccacgggugaugaguuuguuaagaccucugucagaaaaggccugcuaccucagauccuggaaaaucuccugagcgcgaggaagcgagcuaaagccgagcuugcaaaggaaacagacccguugcgccggcaagugcuggaugggagacaguuagcccucaaggugucagcuaacagugucuauggauucacuggcgcccagguugguaaacugccaugucuugagaucucccagagcgugaccggguuuggcaggcaaaugauugaaaagacaaaacagcugguggagucuaaguacacuguagagaauggauauucaaccagugcaaaagucguguacggcgacacagauagcguuaugugccguuucgggguguccucugucgcugaagccauggcguugggacgcgaggccgcugacugggugucgggccacuuucccagcccuauccggcucgaguucgagaagguuuauuucccauaccugcuaauuuccaagaaaagauaugcaggucugcucuuuucaaguaggcccgaugcccaugaccgaauggacugcaaggggcuggaagcugugcggcgcgauaacuguccucuuguagccaauuuggucaccgcaucucugagaagguuacucauagaccgggauccggagggagcgguggcccacgcucaggacgugaucagcgaucugcuuugcaaccgaauugacaucucccagcuggucaucacuaaagagcuaacgagagccgcaucagauuacgcuggcaagcaagcccauguugaacucgcagagcgcaugaggaaacgugaccccgguagcgccccaucucugggcgaucgggugccuuacguaauuauauccgcugcgaaggggguggccgcauauaugaagagugaagaccccuuguucguccuggagcacagcuuaccaaucgauacacaguacuaucucgagcagcagcuggcuaaaccucuucugagaauuuuugaacccaucuugggagagggcagggccgaagccgugcuccugcgcggggaccauacccgauguaagacuguucuaaccggaaaagugggcggucugcuugcuuucgcaaagagacggaacugcuguauugggugcaggacaguccucucucaccaaggagccgugugugaguuuugccagccacgcgaauccgagcuguaccagaaagagguuucacacuugaaugcgcuggaagaacguuucaguagauuauggacccaaugucagcggugccagggcagccuccaugaagaugugaucuguacuucgagggacugcccgauauuuuauaugcgcaagaagguccgaaaagaccuggaggaucaggaacaacuucugagacgguucgguccucccggcccagaggcuugguga

SEQ ID NO: 60927 - RNA, 1410 nt, Artificial Sequence
  derived and/or modified sequence opt3 from POLD2__Homo_sapiens__NP_001243808
auguucagcgagcaggccgcucaaagagcacacacccugcucucucccccuuccgccaacaaugcgacauuugcuagggugccagucgccacuuacacgaacucaagucagccguuccggcuuggcgaacgcagcuuuucccgacaguaugcacauaucuacgccacccgucugauucagaugagacccuucuuggagaauagggcucaacagcacugggggucuggaguuggugugaagaaauuaugcgaacugcagccugaggaaaaguguugcguagugggcacacuauuuaaagcaaugccacuccagcccucgauacugcgggaggucucagaggaacauaaccuucugccucaaccaccccgcagcaaguauauccacccugacgaugaguuggugcucgaagacgagcugcagagaauuaaacugaaggggacuaucgauguuaguaagcucgugaccggaacagucuuagccguguucggcuccguaagggacgaugguaaauuucugguugaggacuacuguuucgcugaucuugccccacagaagccggcgcccccuuuggacaccgaucgguuugugcugcuagucucugggcucggacugggcggcgggggaggugaaagccuucugggcacucaguugcucguggacguggucacagggcaacugggagaugagggcgaacagugcuccgcagcccauguuucacgcgugauuuuagcugguaaucugcucagucacagcacccagucucgagacuccaucaacaaagccaaguaucuuacgaaaaagacucaagcagcuucaguagaggccgugaagaugcuggaugaaauauugcuacagcugagcgcgagugucccaguggacguuaugcccggggaguucgacccuaccaauuacacacucccacagcagccccugcacccguguauguuuccucuugccacugcauauucuacccugcaauuggugacaaaccccuaccaggcuaccaucgauggagucagauuccucggcacguccggccagaaugugagcgacauuuuuagguacucgucuauggaggaucaucuggaaaucuuagaguggacucugcggguacgucacauuuccccaacagccccugacacccuagggugcuaucccuucuacaaaacugauccauucaucuuucccgaauguccucauguuuauuucugcggaaacacaccaucauuugguaguaagauaauucgcggcccggaggaccagaccgugcuccuggucacggugcccgauuucagcgcuacccaaacagccugucuugucaauuugagaucccuggcaugccagccuaucucuuuuagcggguucggagccgaagacgaugaccucggcggucuggggcuuggcccauga

SEQ ID NO: 60928 - RNA, 1401 nt, Artificial Sequence
  derived and/or modified sequence opt3 from POLD3__Homo_sapiens__NP_006582
auggccgaccagcuguaccucgagaacaucgaugaauuugugaccgaccaaaauaagauugucacauauaaauggcuuagcuacacucugggcguucacgugaaccaggcuaagcagauguuguaugauuacguagagagaaaaaggaaggaaaauuccggggcacaguuacaugugacguaucuggucucuggaucacuaauacaaaacggucacaguugccauaaaguggccguugugcgggaggacaagcucgaagcggucaagagcaaacuggcugugaccgccuccauccacguauacucuauucagaaggcaaugcuuaaagauucgggcccccuguuuaauacagacuaugauaucuugaagucaaaccuccagaauuguagcaaauucagugccauucagugcgcugcagccguuccucgcgcuccagccgaguccucuagcuccucaaagaaguuugagcaaagucaucugcacaugagcucugaaacucaggcgaacaaugagcugaccacaaacgggcacggaccgcccgcauccaaacaggugucacagcaaccuaagggcaucauggguauguucgccagcaaagcugccgcaaagacccaggaaacuaauaaagagacaaagaccgaggcuaaagaagucacgaacgccagugcggccgggaauaaggcaccaggaaagggcaacaugaugucuaauuucuucggcaaagcugccaugaacaaguuuaaagugaaccucgacuccgagcaggcugugaaggaagagaaaauagucgaacaacccacuguuagcgugaccgagccuaaguuagccacaccagcagggcugaagaaaucgucuaagaaagccgagcccguaaaggugcuucagaaagaaaagaagcgaggaaaacgugucgcuuuguccgaugacgagacuaaggaaaccgagaauaugaggaaaaagagacggcgcaucaaacugccugaaucagauaguagcgaggacgagguguucccagauuccccgggugcguacgaagcagagucucccagcccuccacccccuccaucacccccgcuagaaccuguucccaagacagagccagaaccucccagugugaaguccagcucuggcgagaacaaaagaaagaggaaacggguccucaagucaaaaaccuaccuggacggggagggauguauugugacggaaaagguauaugagagugaaagcugcacugacuccgaggaggaacuuaauaugaaaacaucuucgguucaucgcccacccgccaugaccgugaagaaggagccucgagaagagagaaaaggcccaaagaaagguacugcugcccuggggaaggcaaacaggcaggucagcaucacaggauuuuuccagcggaaauga

SEQ ID NO: 60929 - RNA, 240 nt, Artificial Sequence
  derived and/or modified sequence opt3 from POLD4__Homo_sapiens__NP_001243799
augggcagaaagaggcugaucacugacagcuaccccguggucaaacggcgcgaggggccugccggacacuccaagggugaacucgcuccagagcuuggcgaggaaccgcagccccgagaugaagaggaggcagaacuggaguuguuacgucaauucgaccuggccuggcaguaugggccuugcacaguuucuggaauuucaauaccauacgaagcgcccagaaaaaccaguuguccuuga

SEQ ID NO: 60930 - RNA, 1317 nt, Artificial Sequence
  derived and/or modified sequence opt3 from POLDIP3__Homo_sapiens__NP_001265586
auggccgacaucagccuggaugagcucauuagaaagaggggcgcugcagccaaagggcggcuuaacgcgcgccccggaguggguggcguccgaucccguguugggauacagcaaggacuguugucucagucaaccagaacagcuacuuuccagcagagguuugacgcccggcaaaagaucggcuuaagugaugcacgccugaaacuaggugugaaggacgccagagaaaaacuccugcagaaggaugcuagguuccggauuaaggggaaaguacaggacgcacgcgagaugcuuaauagccgaaagcagcaaacgaccgugccucagaaaccaagacaggucgccgaugcuagggaaaagaucucccugaaacggucuucgccggccgcguuuauuaaucccccuaucggaacagugacuccagcauugaagcucaccaagacaauacagcguaugcacguugaccccgugggcuggauccugaccacugagugcuuccaagucccucagcagaaagccauggcuccacugcauccccacccugccggcaugcgcauuaacgugguaaacaaucaucaagcaaagcagaaccucuacgauuuagacgaagaugacgaugggaucgcuucaguuccaacaaaacagaugaaguuugccgcgagcggagguuuccugcaccauauggccggccuuaguuccucuaaauugagcauguccaaggcacugccgcuaaccaaagugguccagaaugacgcuuauacggcccccgcucucccuucaaguauuagaacuaaggcccugaccaacaugagcaggacacuugugaauaaggaggagccacccaaagaacugccugcagccgagccaguguugucuccccucgaagggacuaagaugaccgucaacaaucugcacccgcggguuacagaggaggacaucguggaauuauuuuguguaugcggagcucugaaacgagcgcgccucgugcacccuggcgucgcagaggugguuuucgugaagaaagaugacgccauaaccgcuuacaagaaguauaacaauagaugucuugauggucaacccaugaaaugcaaccugcauaugaaugggaacgucauuacguccgaccagccaaucuugcuaaggcugucagauagcccuaguaugaagaaagaaucugagcucccccggcgcgugaacuccgccagcucgucuaauccacccgcagaaguagacccugauacuauucugaaggcccuuuuuaaauccucaggagcuaguguuacaacccagccaacugaguucaagaucaagcuguga

SEQ ID NO: 60931 - RNA, 1506 nt, Artificial Sequence
  derived and/or modified sequence opt3 from POLE2__Homo_sapiens__NP_001184259
auggcccccgagagacugaggagccgggcucucuccgcauucaaacuucgcggccuguuguuacgaggggaagccaucaaauaccugaccgaggcgcuacagucuauuucagaacucgagcuggaagacaaacuugagaagauaaucaacgcuguggagaagcaaccucugaguagcaauaugauugaacguuccgucguugaggccgcagugcaggaaugcucucagucgguagaugagacaaucuugcucaugacuaaccacccagccccgaaucuguuuggaacgcccagagacaaagcugagauguucagggaacgguauaccauucugcaucagcgcacacacagacaugagcucuuuacuccuccagugaucgguucacaccccgaugaaagcggcaguaaguuccaauuaaagaccauagagacacugcuuggguccaccacuaaaaucggagacgcaauugucuugggcaugaucacacagcugaaggaagguaaauuuuuccuagaggauccuaccgggacggugcagcucgaccugucuaaggcccaguuucauagcggacuuuacacugaggcuuguuucguucuggccgaaggcugguuugaggaucaaguguuccacgucaacgcguuuggcuucccacccaccgaaccuuccucaacaacuagggcauauuacgggaauauuaacuuuuucggagguccaaguaauaccagcgugaaaacaucugccaaguugaagcagcucgaggaagagaacaaagacgcuauguucguauuucuguccgauguuugguuagaccagguggagguccuggaaaagcuccggaucauguucgccggcuauucaccggcacccccuaccugcuuuauacuuugugggaauuucagcagugcuccauacggaaagaaccaggugcaagcccugaaggauucuuugaaaacgcuagcggacauuaucugcgaguaucccgauauucaccaguccagccgcuuuguguucgucccuggcccagaagaccccgguuuugggucgauccugccgcgaccuccccucgccgagucuaucacuaaugaauuuagacagaggguuccauuuuccguguucacaaccaacccuugucggauucaauacugcacucaggagauaacaguauuucgugaggaccuggugaauaagaugugucgcaacugcgucagauuccccucaaguaaucuugcaaucccaaaccauuuugugaaaaccauucugagccagggacacuugacgccccucccucuguacguuuguccaguguauugggcuuacgauuaugccuuaagggucuacccggugcccgaccugcuaguaaucgcugauaaguaugacccuuucaccacaacuaacaccgaaugccucuguauaaauccaggcuccuucccccggucuggcuuuagcuucaagguuuucuacccuucaaacaaaacaguggaggauaguaagcugcagggguucuga

SEQ ID NO: 60932 - RNA, 444 nt, Artificial Sequence
  derived and/or modified sequence opt3 from POLE3__Homo_sapiens__NP_059139
auggccgagagacccgaagaccugaaccucccuaaugcugugaucaccaggauuauaaaggaggcacuuccagauggcgucaacaucagcaaagaagcccgguccgcgauuucucgcgcugccucaguuuucgugcuguacgcaacaaguugcgccaauaacuuugcuaugaaggggaaacgaaagacuuugaaugcaagcgacguauuauccgccauggaggaaauggaguuccagcguuuugugacgccgcugaaagaggcucuagaagccuauagaagggagcaaaagggaaagaaagaagcgucugagcagaagaaaaaggauaaagacaagaagaccgauucggaggaacaggacaaaucacgggaugaggacaacgaugaagacgaggaacgccucgaggaggaggaacagaaugaagaggaagaggucgauaacuga

SEQ ID NO: 60933 - RNA, 354 nt, Artificial Sequence
  derived and/or modified sequence opt3 from POLE4__Homo_sapiens__NP_063949
auggccgcugcagccgcggcuggcagcgggacccccagagaggaagagggaccugccggugaagcagccgcuucccagccacaagcaccgacaucugugcccggcgccaggcugucacggcucccucuugcucgcgucaaggcccugguuaaagcggacccagaugugacuuuggcagggcaggaggccaucuucauuuuagcucgagccgcagaacuguuuguagagacgauagcuaaggacgccuacugcugugcgcagcagggaaaacguaagacccuacaaagaagggaucucgacaacgccaucgaggcaguggaugaguucgcuuuucuggaaggcacacuugacuga

SEQ ID NO: 60934 - RNA, 6861 nt, Artificial Sequence
  derived and/or modified sequence opt3 from POLE__Homo_sapiens__NP_006222
augagccugagauccggcgggaggcggcgcgccgaccccggagcugauggugaagccucucgagacgauggcgccaccucaagugugagcgcgcucaagcgucuugaacggucccaguggacagacaaaauggaucugagguucggguuugaacgguugaaggaaccuggagagaaaacuggcugguuaaucaacaugcacccaacggaaauucuggacgaggauaagcgccuggguucugcugucgacuacuauuucauacaagaugacgggucgagauuuaaaguugcccucccguacaagcccuauuucuacaucgcaaccaggaagggaugcgagcgggaagugucaucauuccugaguaaaaaguuccagggcaaaauugccaagguagagacagugccuaaagaagaucuugaccugccaaaucacuuggucggccucaagcgcaacuauauccgacuguccuuucacacuguggaggaucugguuaaggugagaaaagagauuucucccgcugucaagaaaaauagggaacaggaccaugcaagcgacgccuacaccgcucucuuauccucagugcugcagagagggggaguaaucacagaugaggaagagaccaguaagaaaauagccgaccaacuugauaacaucguugacaugcgugaauaugaugugccuuaccacauucgcuugagcaucgaccugaagauucaugucgcgcacugguacaaugugagauauagggguaacgcauucccaguggagaucacucggcgagaugaccuagucgagcgccccgauccuguugugcucgccuuugacauagaaacaaccaaacugccacuuaaguucccggaugcugagacggaccagauuaugaugaucucuuacaugauugacggccagggguaucugaucacuaauagagaaaucguauccgaggauauugaagacuuugaguucacccccaagccugaguacgaaggaccauuuuguguguucaacgagcccgaugaagcccacuugauacagaggugguucgagcauguccaagaaacaaaaccuacuaucauggugaccuauaauggcgacuuuuucgauuggccauuuguugaggcacgggcugccgugcacggucucucaaugcagcaggagauuggguuccagaaggacagccaaggagaauacaaagcgccccagugcauccauauggauugucugcgcugggucaagagagacaguuauuuaccggugggcucucacaaccugaaagccgcagcuaaggccaagcucggcuacgauccuguagagcuugaccccgaagauaugugcaggauggcuacagagcagccacaaacccuggccacguacuccguuagcgacgcaguggccacuuauuacuuguauaugaaauacguccacccuuuuauauucgcucuauguacaauuauccccauggagccagaugaagugcugcguaaggggucgggaacccucugcgaggcgcugcuuaugguccaggcauuucaugccaauaucauuuuccccaacaaacaggaacaggaguuuaauaagcugacugacgacggucacguguuggauucugaaacauauguuggcgggcauguggaggcucucgaguccggaguauuccggucagacaucccuugucgauuuagaaugaacccagccgcauucgauuuucuguuacaaagggucgagaagacccugcgccacgcccuagaggaagaggaaaaggugccgguugaacaggugacgaauuucgaggaagucugcgacgagauuaagaguaaacucgcuagccugaaggaugugcccucccggauagaauguccucuuaucuaccauuuggacguaggcgccauguauccaaacauuauccugaccaacagacuccagcccucugcaaugguggaugaggcgacaugcgcugccugugacuucaauaaaccuggugcaaacugccagaggaagauggccuggcaauggcgcggggaauuuaugccagcuagccgaucagaguaccaccggauccagcaccagcuggagagugaaaaauuuccaccgcuuuuuccugagggcccagcccgugcauuccaugaacuguccagagaggagcaggcuaaguacgaaaagaggcgcuuggccgauuauugccggaaagcguacaagaaaauucacauaacuaagguugaggaaagacucaccacaaucugucaaagggagaauagcuuuuaugucgacacugugcgagccuuccgcgaucggagauacgaauuuaaaggacugcauaagguguggaaaaagaaguuaucugcugcagucgagguuggcgacgccgcugaggugaaaaggugcaagaacauggaagugcuguaugauucacuacagcucgcccacaaauguauucugaauaguuucuacggguauguaaugcguaagggagcacgcugguacagcauggagauggcggguaucgucugcuuuaccggcgccaacauuaucacacaggcucgggaacuuauagagcagaucgggagacccuuggaacuggacaccgacggaauuuggugugugcucccuaauuccuuccccgagaacuuuguuuucaaaacuacgaaugugaagaagccaaaagucacaaucucuuacccuggcgccaugcugaacauuauggugaaggaggguuuuaccaaugaucaauaucaggaauuagcagagcccucgagccugacuuacguuaccagguccgaaaacucaaucuucuucgagguggacgggccauaucuugcuaugauauugccggccaguaaagaagagggcaagaaacucaagaagcgauacgcaguauuuaaugaggauggaucucuggccgaacuaaaaggcuucgaggucaagcggcgcggggaacugcagcucauuaaaaucuuucaaagcuccguguucgaggcuuuucugaagggaucaacacuugaggaaguguaugguagcgucgcgaaaguugccgacuacugguuggaugugcuguauucuaaggcagcuaacaugccugacuccgaguuauucgaacucauuagugagaauagaagcaugucuaggaagcuggaagauuacggcgagcagaaauccaccucaaucaguacugccaagcggcuugccgaguuucugggggaccagaugguaaaagaugcuggauugagcugccgauacauaaucucgagaaagcccgaaggcuccccagugacagagcgcgcaauuccccucgccaucuuccaggcggaaccuacggucaggaaacacuuucugcguaaguggcuaaaaucuagcucacugcaagacuucgauauucgggcuauccucgacugggacuauuacauagagagacuggguagugccauucagaagaucaucaccauuccagcagcccuucagcaagugaagaaccccguuccuagggugaaacauccggauugguugcacaagaaacuguuagaaaagaacgacgucuauaaacaaaagaagaucuccgagcucuuuacucuggaggggcgccgacaggugacaauggcugaagcaucugaggauagcccaagacccuccgccccugacauggaagauuucggccuuguuaaacugccacaucccgcggcuccugugaccgucaagcggaaaaggguacuaugggagucacaggaagagagccaggaccucacaccgacugugcccuggcaagagauucugggacagcccccugccuugggcaccagucaggaagaguggcugguuugguuacgcuuccacaagaaaaaguggcaacuccaggcacgucagagacuggcccggaggaagcgccagcgacuugaaucugcugagggggugcugagacccggagccauacgggauggcccagcaacggguuugggguccuuucucaggcgcaccgcuagaagcauccuggaccuaccuuggcaaauuguccagaucucggagacaucacaggccggacuguucaggcuuugggcgcucgugggcucugaucugcauuguauucgguugaguaucccccguguauuuuacgugaaucagcgcgucgccaaagcagaagagggugcuuccuaucgaaagguuaacagagugcugccaaggagcaauaugguguacaacuuauaugaauacucugucccggaggacauguaccaagaacacauaaaugagaucaacgccgagcucagcgcuccugauauugaaggcguguaugagacucagguuccccugcuuuuccgggcacugguacacuuggggugcgugugugucgugaauaaacagcucguucgccaucuguccggaugggaagccgagaccuuugcccuagaacaccuggagaugagaucacuugcucaguucaguuaccucgagccaggcagcaucaggcauauuuaucuguaccaccaugcgcaagcacacaaggccuuguuugggaucuucauacccucucagcggcgagcuuccguguuugucuuagacacagugagaucaaaccagaugccuagucugggagcccucuauagcgcagaacacggccugcuucuggagaaaguagguccagaauugcuacccccuccgaagcauacuuucgagguccgcgccgaaaccgaucugaagacgauuugcagggcuauccagcgguuucuccuggcguacaaagaggagcguagagggccaacacuuaucgccgugcaauccucuugggaauuaaagaggcuggcaucggagauucccguucucgaagaguucccuuuggugcccauaugugucgcugacaaaaucaauuauggagugcuggacuggcagcgccacggcgcccggcgaaugauuagacauuaccucaaccuggauaccugccuuagccaggcauuugagaugucaagguacuuccacaucccaauugguaaucugccugaagacaucuccacuuucggcagugauuuguuuuucgcccgccaccuacaacggcauaaccaucugcucugguuaucucccacagcuagaccagaccuagggggaaaggaggccgaugacaauugccuuguuauggaauuugaugaccaggcgaccguggagauaaacagcuccggcuguuauucaacugucugcguggaacuggaucuccagaauuuggcaguaaacaccauccugcagucucaucacgugaacgacauggagggggccgauagcaugggaauuaguuucgacguuauccaacaggcuucccucgaggauaugauuacaggcggucaggccgcuagcgcuccugcaucuuacgacgaaacggcacuguguucaaauaccuuucguauccuuaaauccauggucguggggugggugaaggagauaacucaguaucauaacauuuacgccgacaaucaagucaugcacuucuauagguggcuacggaguccgagcucgcuguugcacgaucccgcauuacaucgcacacugcacaacaugaugaagaaacucuuucugcagcuuaucgcggaguucaagcgacugggaucuuccguaaucuacgccaauuuuaacagaauuauccucugcaccaaaaagaggcggguggaggacgcuauagccuauguugaauacauuacaagcucaauccauaguaaagagacuuuccacucuuugaccauuuccuuuagccgcuguugggaguuccugcuauggauggauccaucaaauuacggcgguaucaagggcaaagugaguagcagaauacacugcgggcugcaggacucccagaaggcaggaggcgcugaagaugagcaagaaaacgaggacgaugaagaggagagggacggggaagaggaagaggaggccgaagagucuaaugucgaagaucuccuugagaacaauuggaacauucugcaguuuuuaccucaggcagccagcugucaaaauuauuucuugaugaucguguccgcuuacaucguugcgguguaucauugcaugaaggacggacugcgacggucagcccccggcucuacgccaguccguagacgcggugcaagucagcucucgcaggaagcugagggggccgugggagcccugccuggcaugauuacauucagccaggauuacguagcaaacgagcuuacccaauccuuuuucacuaucacccagaaaauucagaagaaagugacaggcucuaggaauagcacugaacugagcgagauguuucccguucucccggggucccacuugcuguuaaacaacccagcucuagaguucauaaaguaugucuguaaagugcugagucucgacaccaauaucacaaaccaggugaauaaacuuaaccgggaccuguugagacuggucgauguuggagaguuuucugaagaggcccaauuccgcgacccuugcaggagcuacgugcuccccgagguaauuugucgaucaugcaauuuuugccgggaucuggaccuuuguaaggauuccaguuucagcgaagacggugcggugcucccacaguggcugugcucuaacugucaggcucccuaugauuccucagccaucgagaugacguuggucgaagugcugcagaaaaaguuaauggcauuuacccuacaagaccugguuugccucaaauguagaggcgugaaggagacuagcaugccugucuacugcucgugugccggggauuucgcucuuacaauccauacccagguauuuauggaacagauuggaauauucaggaauaucgcacagcacuacggcaugucuuaucuguuggagacucuggaguggcuccugcagaaaaacccgcagcuuggucauuga

SEQ ID NO: 60935 - RNA, 1458 nt, Artificial Sequence
  derived and/or modified sequence opt3 from POLG2__Homo_sapiens__NP_009146
augagaagcaggguggccguccgggcuugccacaagguuugucgcugccugcucuccggcuucgggggacgaguggacgcaggucagcccgagcuucugaccgaacguucuucaccuaaaggcgggcauguaaagagucacgccgaguuggaaggaaacggcgagcauccagaagcgccggguagcggggagggauccgaggcuuuacuggaaaucugucaaagaaggcacuuucuaucuggcucgaaacagcagcucucacgggauagccugcuuaguggcugccaucccggguucggaccucuggguguggaguugcgcaagaaucucgccgcagaaugguggacauccgucgugguuuuuagagaacagguguucccagucgacgcccugcaccacaaacccggcccucugcucccaggggauucugcuuuuagguuagugagcgcagagacucugcgggagauucuucaagacaaggaguuguccaaggaacagcugguagccuuccuagagaacguucucaaaacgucaggaaagcugcgcgaaaaucuucugcauggcgcuuuggagcacuacgugaacugucucgaucuggucaauaaacgauuacccuauggucuggcccagauaggggugugcuuucauccuguguucgacaccaagcagaucagaaacggagucaaaaguauuggcgagaagacagaagcgagccucguuugguuuacuccaccgaggaccucuaaucaauggcuugauuucuggcugcggcaccguuugcagugguggcgcaaguuugcaaugucccccucaaacuucagcaguucugacugucaggaugaggaaggcagaaaagggaauaagcuauacuauaacuuuccuuggggaaaagagcugaucgaaacacucuggaaucugggugaccacgagcuucugcauauguacccaggcaacguguccaaguugcacgggagggauggacggaaaaauguagugcccugcguccucagcgugaacggcgaccuggaucgagguauguuagccuaucuguacgacucguuccagcuaaccgaaaauucuuucacucgcaagaaaaaccuccauagaaagguucugaaacuucacccuuguuuggcuccaauuaagguggcccuggacgucgggaggggccccacacucgagcugcggcaagugugccagggacuuuuuaacgagcuguuggaaaauggcaucuccguauggccgggguaucucgagaccaugcagucaagucuggaacaauuauacagcaaguacgaugagauguccauacuguucacgguucuagugacugagaccacacucgaaaacggacugauccaucuucgcucuagagacacuaccaugaaagagaugaugcacauuagcaaguugaaagauuuucugaucaaguauauuucaagugcaaagaaugucuga

SEQ ID NO: 60936 - RNA, 3720 nt, Artificial Sequence
  derived and/or modified sequence opt3 from POLG__Homo_sapiens__NP_002684
augagcagacugcucuggaggaagguggccggcgcuaccgucgggcccggaccuguuccagcaccgggucgguggguguccucuucaguacccgccagugacccuagcgauggccagcgccgacgucaacagcagcagcaacagcagcagcaacagcagcagcaaccacagcagccccaagugcuuuccucugaagggggacagcugagacacaacccuuuggacauccagauguuaucgaggggccugcaugaacagauuuucggucaagggggagagaugccaggcgaagcggcuguccggcgcucaguggagcaccuacagaaacauggccucugggggcagcccgccguuccucugccagauguggaacuuagacugccgcccuuguacggagacaaucucgaucagcacuuuaggcugcuggcacaaaagcagagccucccuuauuuagaggccgcuaaccugcuuuugcaggcacagcugccacccaaaccuccagccugggcuugggccgaggguuggacacgguacggccccgaaggggaggcggucccgguggcaauaccugaggagcgcgcccuaguauucgacguugaggugugccucgcugaaggaacuugucccacgcuggccgucgcaaucaguccauccgcuugguauucuuggugcagccaacgacuuguggaggaaagauacuccuggaccucacagcugaguccugccgauuugauuccccucgaggugccaacaggcgcgagcucucccacucagagggacuggcaggaacaacuggucguuggucauaauguguccuuugaucgggcccacauccgugagcaguauuuaauucaggggucacgcaugagauuccuggacaccaugagcaugcacauggcaaucaguggacucucuuccuuucaaaggagccuuuggauagcugccaagcagggcaaacauaagguacagccuccaacaaagcagggccaaaaaucgcagcggaaggcucgacgcgggccggccaucucuuccugggauuggcuggacauuucaagugugaacagcuuggcagagguccacagacuauacgugggaggucccccucuggaaaaagagccaagggaacucuucguuaagggcaccaugaaagauauccgggagaauuuucaggaccugaugcaguauugugcccaagacgugugggcuacucaugaagucuuccagcagcagcuuccccuguuuuuggagcgcugcccucacccagugacacucgcggggaugcuggagaugggaguauccuacuuacccguuaaccaaaauugggaaagauaccuggcagaggcccagggcaccuaugaggaacuacagagggaaaugaagaagucucucauggaucuggcuaacgacgccugucaacuuuugagcggugagcguuacaaagaggauccguggcugugggaccucgaaugggaucugcaggaguucaagcagaaaaaggccaaaaaggugaaaaaggaaccugccacggcuucaaaacuuccaauugagggggccggcgcacccggagacccuauggaucaggaggaccugggccccugcagugaagaggaagaguuucaacaggaugucauggcgcgggcuuguuugcagaagcucaaggggacuaccgaacuguuaccaaaacgaccucagcaucugcccggacacccagguugguauagaaagcuaugcccgaggcucgacgauccugccuggacacccggcccaucccugcuuagcuugcaaaugcgcgugacucccaaacugauggcacucaccugggacggguucccucugcacuacucugagcggcauggauggggcuauuuagucccagguagaagggacaaucuggccaaacuucccacagggaccacguuggagucagcuggcgugguuuguccuuaccgcgccaucgaaagucucuaucgaaagcacugccuggagcagggaaagcagcagcuaaugccgcaagaagcaggccuggcugaggaauuucuccugacugauaacagcgccauauggcagacaguggaggagcuugacuacuuggaaguagaggcggaagccaagauggagaaucugcgggcugcagucccagggcagcccuuagcccucaccgcucguggagguccuaaagauacucagccauccuaccaucacggcaacgggcccuauaaugacguggauauuccuggauguugguucuucaagcugccgcacaaagacggcaacucuugcaauguugguucgcccuuugccaaggauuuccuuccaaagauggaagacgggacacugcaagcaggcccuggaggcgcgagcgggcccagagccuuggagaucaacaaaaugauuuccuuuuggaggaacgcucauaagcgcaucucaagucagaugguggucuggcucccacggucugcccugccuagagcagugaucaggcaccccgauuacgacgaggaaggacuauauggcgcuauucugccacagguagugaccgccgguacgauaacccgacgcgcaguugagccgacauggcucacugccagcaaugcucggccugauagagucggguccgaacugaaagcgauggugcaagcacccccaggauacacccuugugggcgcagacgucgauucacaggaguuguggaucgcugccguucugggugacgcccauuucgcuggcaugcacgggugcacagcauuuggauggaugacuuuacagggccguaagagcagggggaccgaccuccacucuaaaacagccaccacugugggaauuucccgcgagcaugcgaagaucuucaacuauggccggauauacggugcugggcagcccuuugccgaaagacugcuuaugcaauucaaucacaggcugacgcagcaggaggcagccgaaaaggcucagcaaauguaugcagccacaaaaggacuacgaugguaccggcucagugaugagggcgaauggcuggugcgcgaguugaaccugccuguagacagaaccgaggguggcuggauuagcuuacaggaucucaggaagguccagcgggaaacugcgcgaaaaucucaguggaagaaaugggaggugguugcugaaagagccuggaagggaggaaccgaguccgaaauguuuaauaaacuggagucaaucgcaacaagugacaucccacgcacccccgugcuuggcuguugcauuagcagggcccuggagccuucggcuguccaagaagaguucaugacuucccgugugaacuggguugugcagucuagcgccguagauuacuugcaucucaugcuggucgcaaugaaguggcuauuugaagaguucgcuaucgacgggcgguuuuguauuucaauacacgaugaagugagauaucuggugagggaggaggaccgcuaccgagccgcgcuugcccuccagaucacaaaucuguugacgagaugcauguucgcauauaagcugggauuaaacgaucucccgcaaagugucgcuuucuuuuccgccguugacauugaucggugucugaggaaagaagugaccauggacugcaagacuccaucuaaucccacaggcauggagcgccguuacgguaucccucagggggaagcucuugauaucuaucagauuauagagcugaccaaagggagcuuggagaagagaucccagcccggcccauga

SEQ ID NO: 60937 - RNA, 1245 nt, Artificial Sequence
  derived and/or modified sequence opt3 from POLH__Homo_sapiens__NP_001278899
auggccaccggccaggacagaguggucgcucugguugauauggacugcuucuuugugcaaguagagcagaggcagaacccccaccuccggaauaagccuugugcagugguccaguacaaaagcuggaaagggggagguaucauugccguguccuaugaagcgcgcgcuuucggcguuacacgaucuaugugggccgaugacgcaaagaagcuaugcccagaucuguuguuagcccaagugcgugagucaagagggaaagcuaaccugacuaaguacagggaagcaagugucgaggugauggaaauaaugagccgguuugccguaaucgagcgcgcuuccauugacgaggccuauguugaucuaacgucugcggugcaggaaagacuccagaagcugcagggacaaccgaucucggcagaccuucugcccucaaccuacauugagggcuugccucaggguccaacaacugccgaagagaccguccagaaagaggggaugaggaagcagggacucuuccaauggcuggauagccugcagaucgacaaucucacaagucccgauuuacagcugaccgugggcgcugugauagucgaagagaugcgggccgcaaucgaacgcgagacuggcuuucaauguuccgcugggauuucucauaacaaaguucuugccaaguuggcgugcggacugaauaaaccuaaccgacagacacuugugagccacgguuccguaccacagcuuuucucacagaugcccaucagaaagauuaggagucugggcgggaagcucggagccagcgugaucgaaauacugggcauugaguauaugggugaguugacccaauuuacggaaucucagcuccagucccauuucggggagaaaaauggaucauggcuguacgcaaugugucggggcaucgaacacgacccugucaagccacgucaguuaccgaaaacuauuggcugcagcaagaacuuucccgggaaaaccgcucuggccacacgcgagcaagugcagugguggcuccuucagcuggcucaggaauuggaggagagacuaacuaaggauaggaaugacaacgaccggguugccacccaacugguggucaguauccgagugcagggagauaaacgccucucuucccugagaagguguugcgcacuuacacgguaugacgcccauaagaugagccacgaugcuuucaccguaaucaagaauuguaacacgucggguauucagacugaauga

SEQ ID NO: 60938 - RNA, 2223 nt, Artificial Sequence
  derived and/or modified sequence opt3 from POLI__Homo_sapiens__NP_009126
auggagaagcugggcguggaacccgaggaagaagggggaggugacgaugacgaggaggaugccgaggcuugggcaauggaacucgccgacgucggcgcggcugccagcucccaggggguucacgaucaagugcuuccuaccccaaacgcaucuucaagaguaaucgugcaugucgaccuggauugcuucuacgcccagguggagaugauuaguaauccggaauugaaagacaagcccuuaggaguucagcagaaauaucugguggucacauguaacuacgaggcuaggaagcuaggcgugaaaaagcucaugaauguacgggaugcaaaggagaaaugcccucaacugguucuugugaacggugaagaccugacucgcuaucgagagaugagcuacaaggucacggaauugcucgaggaauuuuccccagugguggagcgucugggguucgaugagaauuuugucgaccugaccgaaaugguugagaaaagacuccagcaguuacagucugaugaacugucggccgugacaguaucaggacacguguauaacaaucaaagcauaaaccuuuuggacguccugcauaucaggcuacucgugggcagucagauugcugccgagaugcgggaagcgauguacaaucagcugggccuuacugggugugcaggaguugccuccaacaagcuguuggcuaaacucgugucuggugucuucaagcccaaucagcaaaccgugcuguuaccugagagcugccagcaccugauccauucccucaaccacauuaaggagaucccaggcauaggguauaaaacagccaagugucuugaagcacugggaaucaauucaguacgcgacuugcagaccuuuagucccaaaauucuagagaaggaacugggcaucagcguugcucaaaggauucagaaacucucuuucggugaggauaacuccccugugauccugucagggccaccgcagagcuuuagugaagaggacucuuucaagaaaugcuccagcgaggucgaagccaagaauaagauagaggaacuucuggcgucguugcucaacagagugugucaggauggacggaaaccccacacuguccgccugauuauccgaagauacucuuccgagaagcauuacggcagggagucacggcaaugcccuauuccaagucacgugauccagaaauuaggcacagggaacuaugacguuaugacccccaugguggauauccugaugaagcuauuucguaauaugguaaacgucaaaaugccuuuccaucucacgcugcuuagcguguguuuuugcaauuugaaggcccugaacacugcaaagaaaggacucauugacuacuaucugaugccaucccuuucuaccacaagccgcucagguaagcacaguuucaaaaugaaggauacucacauggaagacuuucccaaagauaaggagaccaauagagacuuccugccguccggcaggauagaaagcacacggacccgagagucuccuuuggauacgacuaacuucucaaaggaaaaagacaucaaugaguuuccccucuguagucugccagaggggguugaccaggaaguguucaagcaguuaccugucgauauucaagaggaaauccugagcggaaaaucccgcgagaaguuucagggcaaagguucugugucgugcccccuacaugcuagcagagggguacucuccuucuuuucaaagaagcagaugcaggacauaccaauuaaccccagggaucaccugaguucuagcaaacaaguguccucaguuagcccuugcgaaccaggcacaucuggauucaauuccaguucuagcuccuacaugucaagucagaaggacuauagcuacuaucuugauaaccgguugaaagacgagcgcaucucgcagggcccgaaggagccccagggguuucauuucaccaauuccaacccugccgucucugcuuuucacagcuucccaaaucugcaaucagaacagcucuuuaguagaaaccauacuacagauucccacaaacagaccguggccacggacucucacgagggacugaccgaaaauagggagcccgauagcguggacgaaaagaucacauucccuuccgauauugacccacaagucuuuuacgaguuacccgaggcaguucagaaagaacugcuugccgaguggaagcgugcugguucagauuuccauaucggccacaaguga

SEQ ID NO: 60939 - RNA, 2613 nt, Artificial Sequence
  derived and/or modified sequence opt3 from POLK__Homo_sapiens__NP_057302
auggacagcaccaaggagaaaugcgauuccuacaaggacgaucugcuccuuagaaugggccugaacgacaauaaagccgggauggaaggauuggauaaggagaaaaucaacaagauuauaauggaagcuacaaaggguucuagguucuauggcaaugagcugaaaaaggaaaaacaggugaaccaacggaucgagaauaugaugcagcagaaggcacagauuacuucacaacagcugcgcaaagcccagcuacaggucgaccgauuugcgauggagcucgaacaaagucguaaccugagcaauacgaucguucacauugauauggacgcuuucuacgccgcaguggagaugagagauaaccccgaacuuaaggacaagccuaucgccguaggguccaugucuaugcugucgaccucaaauuaucaugcuaggcgguuuggagugcgcgcagccaugccaggcuucauagcuaaaagauuguguccgcagcucaucauugugcccccuaacuuugauaaguacagggccgucagcaaagagguuaaggagauccuggcggacuaugauccaaauuucauggcaaugagucuggacgaagccuaccucaacauuacaaaacacuuagaggaacggcagaauuggcccgaggacaagcgccgauauuuuaucaaaauggguuccucuguggaaaacgauaauccugggaaggaggucaacaagcugagcgagcaugaaagauccauaucaccacuuuuguucgaggaaagucccagcgacgugcagccuccaggagauccguuucaaguaaacuucgaggaacagaauaacccccagauucugcaaaauucuguuguguuuggcacuuccgcucaggaggucgugaaagagaucagguuccggauugaacagaagaccacacuaaccgccucagcaggcaucgcuccuaacacuaugcucgccaaagugugcagcgacaagaauaaaccaaacgggcaguaccaaauccugcccaaucgucaggcggucauggauuuuauuaaggaccuuccuauacgcaagguuaguggaaucgguaaagugacagagaagaugcugaaagccuugggcauuaucaccuguacggaacucuaccagcagagagcacuguuaucuuuacucuucuccgagacuagcuggcacuauuuccuucauauaucgcugggguugggaucuacccaccuaacaagggauggcgaacggaaguccaugucaguagagcgaacuuuuagugagauuaacaaagcugaggaacaauacagccugugccaggaacucuguuccgagcuggcccaggaccuucagaaggagcgccugaaggguagaaccgugacaaucaaauugaagaaugucaacuucgaagugaaaaccagggcuucuacgguuagcucaguggucaguacugccgaggaaaucuuugcaauugccaaggagcuccugaaaacagaaaucgaugcugacuucccacaccccuuacggcugcgccuaaugggggugagaauuuccagcuuuccgaaugaggaggauaggaagcaucaacagcguucuauaaucggauuccuccaggcgggcaaccaggcacugucagccaccgaaugcacucuugagaagacagacaaagacaaguuuguaaaaccuuuggaaaugagucacaagaaaucauucuuugauaagaaacgguccgagcgaaaguggucucaucaagacaccuucaagugugaagcuguuaauaaacagucguuucagacgagccaacccuuccaggugcugaagaaaaagaugaacgagaaucucgagauuuccgaaaacucagaugacugccagauccugaccuguccagucugcuuuagagcccagggcuguaucagucuugaggcacugaacaaacacguggaugaaugcuuggacgggccuucuauuagcgagaauuucaagauguucuccugcucacacgucagcgccacaaaggugaacaaaaaggaaaauguucccgcuucuucccucugugagaaacaagauuaugaggcccauccaaagauaaaagaaaucaguagcguggacugcauugcacugguagauacuaucgacaacucuuccaaggcggagucaauugaugcuuuaaguaauaagcacagcaaagaagaguguucgucccugcccucuaagagcuuuaacaucgagcauugccaccagaauagcaguuccaccgucucucuagaaaacgaggacguggguagcuucaggcaggaauaccgccagccuuaucucugugagguuaaaacaggacaagcccuggugugcccagucuguaauguggaacagaagacuuccgaucuuaccuuguuuaacguacauguggacguuugccugaauaaaucauucauacaggagcuccggaaggacaaguuuaacccggucaaucagcccaaagagagcaguagaucuacaggcuccagcucgggggugcaaaaggcagugaccaggacuaaacgcccuggacugaugacgaaguacucaacaucuaaaaagaucaaaccaaacaaucccaagcacaccuuagauauuuucuuuaaguga

SEQ ID NO: 60940 - RNA, 1728 nt, Artificial Sequence
  derived and/or modified sequence opt3 from POLL__Homo_sapiens__NP_001167555
auggaccccagaggcauccugaaggccuucccuaaaaggcagaagauucacgcugaugcaagcuccaaagugcucgccaagauaccacggcgcgaggaaggggaggaagcggaggaauggcuuucuucacugcgagcucaugucguucguaccggaaucgguagagccagggcagaguuguuugagaaacaaauugugcagcacggcgggcaguuaugcccggcccagggacccggcguaacacauaucguggucgacgaagguauggauuacgagcgggcucugcgccuacucagacugccucaacuuccacccggggcacagcuggugaagagugccugguugagccucugucugcaggaaaggcggcugguugacguggcuggauucuccauuuuuaucccuucucgcuaucucgaucacccacagcccucgaaggccgagcaagacgcgucaauaccuccaggcacucaugaggcauuacugcagacggcccuuagcccgcccccuccacccacccgaccugucaguccaccccagaaagcuaaggaagccccgaacacacaggcacaaccuaucuccgaugacgaggcuucugauggcgaagagacucaggugagcgccgcggacuuggaagcccugauuuccgggcacuaccccaccucacuagagggagauugcgagccaaguccugcacccgcuguacucgacaaauggguuugugcccagccaagcucucaaaaggcuacaaaucacaaccugcauaucaccgaaaaacuugaggugcuggccaaggcauauuccguccagggugauaaguggagagccuugggcuacgcuaaagcgauuaaugcacucaagucauuccacaaacccgugacuagcuaucaggaagccugcaguaucccugggauaggaaagaggauggcugagaaaauuaucgaaauucuggagucuggccauuuacggaagcuggaccacaucuccgagagcgugccaguccucgaacuguuuucgaacaucuggggugccgggacaaaaaccgcacagaugugguaccaacagggauuccguucucuugaggacauucgcucccaggccucauugacgacucagcaagcuauaggccuaaagcacuauagugauuuucuggaaagaaugccgagggaggaagccaccgagaucgagcagacaguucagaaggcagcgcaggcuuucaauagcggccuccuguguguggccugcggguccuaccggcgaggaaaagcaacuuguggugacguagaugugcuuauuacccaucccgacggccgcucucacagagggaucuuuagcaggcuguuggauucacuccggcaagaaggauuccugacagacgauuuagucagucaggaggaaaacggccagcagcaaaaguaccugggugugugccgccuaccugggccaggcagaaggcaucgucggcucgacauaauuguugugcccuauuccgaguuugccugugcucugcuuuacuucaccggaagcgcccacuuuaaucgaucuaugagagcauuggcuaaaacgaagggcaugucacugagugagcaugcccucagcacugcggucgugaggaacacacacgggugcaaaguaggaccuggucgcguucugccaacccccacugaaaaggauguguuccggcuucugggcuugccguauagagagccugccgaaagggacugguga

SEQ ID NO: 60941 - RNA, 1527 nt, Artificial Sequence
  derived and/or modified sequence opt3 from POLM__Homo_sapiens__NP_001271259
augcugcccaagagaaggcgggcccgcgugggcagcccuuccggggacgcugcaucuucaaccccaccgaguacacgauuccccggagucgccaucuaccucguugagccucguauggguagaagcaggcgggcguuucuuacuggccuggcucgcuccaaaggguucagaguguuggaugccuguucuucggaagcaacgcacguagugauggaggaaaccucagccgaggaagcugucagcuggcaggagaggcggauggcagccgcuccacccggaugcacaccuccagccuuacuggacauuaguuggcuaacugagucccucggcgcgggucaacccgugccuguugaaugccgccaucgacuggagguggcagggccaagaaagggaccgcuuucucccgccuggaugccugcuuaugccugucagaggccaacaccccugacccaccauaacaccggcuugagcgaagcacucgagauacuggcugaggccgcgggcuuugaaggguccgagggacggcugcucacuuucugccgugccgcaucagucuuaaaagcucugccuaguccagugacaacccuuagccaguugcagggucugccccacuuuggcgaacauucuucccgcguaguucaagagcuacucgaacacggggugugugaggaggucgaaagagugaggcggucagagcgagccccggcuccucccggaccagaacacccuagccccgccgugcgcugcagauguccagcagccggcggugggggaaguugcggcgcuggccccgcgugggggcauaggcacgcagaucggcgccugccucagggacuuauccuguaccaucagcaccagcacucuuguugcgaguccccaacgagauuggcccaacagagccauauggacgcuuucgaaaggucguuuuguauuuuccgucucccgcagcccccuggugccgcagucggcgggucuacucggccaugccccuccuggaaggccguucgaguggaucugguaguggcuccugucucacaguuuccauucgccuuacugggauggaccggcaguaaacucuuucaaagagagcuuaggcgcuucagccggaaggagaagggucuguggcuaaauucccacggguuguuugaccccgaacagggcucuagcucaggaaaaacaccgagaaguaggaaguccugcuucuguugccgccgacauuucagcaaacggcugcagcguaagacuucuucagauaccugggcacucaguacauuucugcaaagcagagagaccccugaaccagcgugugugccccacuuccauuccggcaacugggcugccccuaaucuugcaacggagugccugcaggccgacauguugcccccagauccucaccuccaccccucuccaccgaggccugggucgagcggaggucagcuguguuuacaggaccaacugucccccugcuggugugcugccggcugcgaugaaguuggggcacuaucagcuagucucaucacuguguga

SEQ ID NO: 60942 - RNA, 2703 nt, Artificial Sequence
  derived and/or modified sequence opt3 from POLN__Homo_sapiens__NP_861524
auggagaacuacgaagcccuggugggcuucgaccucugcaauacaccccuuagcuccgucgcucagaagaucaugucugcaaugcacucaggggaucugguugacaguaaaaccuggggaaagagcacugagacgauggaagugauuaacaaauccucuguaaaguauucggugcaauuggaggauagaaaaacccagucaccugaaaagaaggacuuaaaaagccugaggagucagacaucccgggguucugccaagcuaagcccacaguccuuuucaguccgccucacugaucaacugagugcggaccagaaacagaagucgauaucuucccuuacccugucaagcuguuugaucccgcaguacaaucaagaggcuagugugcuccagaaaaagggccauaagcgaaaacacuuccugauggagaacauuaauaacgaaaauaaggggucuaucaaccugaaacguaagcauauuacauauaauaaccucuccgagaaaaccagcaagcagauggccuuagaagaggauacugacgaugcagagggauaccugaauagcggcaacucuggugcccuuaaaaagcacuuuugcgacaucagacauuuggaugacugggcuaagucccagcugauagaaaugcuaaaacaagcagccgcucucguuaucacagugauguauaccgaugggucaacgcagcugggagccgaccagacucccgucaguagcgugaggggcauuguaguucuugugaagcggcaagcggagggcgggcacggauguccugacgcaccagccugcggucccguccuggaaggcuucguguccgaugacccuuguaucuacauucagaucgagcacucugcuauaugggaucaggaacaggaggcccaucaacaguuugcacgcaauguguuguuccagaccaugaaaugcaaguguccagucauuugcuuuaacgcuaaagacuucguuagaaucgugcuccaguuuuucgggaaugauggaagcuggaagcacguagccgacuuuauuggccuggaucccaggaucgcggccugguuaaucgacccuucagaugcaacaccaaguuucgaggaccugguggaaaaguauugugagaaauccauuacugucaaggugaacagcaccuacgguaacucuucacggaauauaguuaaccaaaaugugcgcgaaaaccucaaaacacuuuaccgacugaccauggauuugugcaguaagcuaaaagacuaugggcuguggcagcucuuuagaacgcuggagcuuccgcugauccccauuuuggcugucauggaaagccaugccauccaggugaauaaggaggagauggaaaagacuuccgcucuccugggagccagguuaaaagagcuggaacaggaggcacacuucguagccggcgaacgguuccuaauaacaucuaacaaucaacuccgugagauucuguuuggcaagcugaaauugcaccuucucucgcagcgcaacagccugccuagaaccgggcuucagaaguacccauccacuucagaggcuguucugaaugcguugagggaccuccauccccugccuaaaaucaucuuagaauaucgacaggugcacaagauuaagaguacauucgucgauggacugcuagcauguaugaaaaaggguucuaucagcuccaccuggaaccaaacgggcaccgugacagggcggcucucagccaaacauccaaauauucagggaauaagcaagcaccccauccagauuacuaccccgaaaaacuuuaagggcaaagaggacaagauccugacaaucucuccucgcgcuauguucgucuccaguaagggucauacuuuucuugccgcagauuucagccaaauugaauugagaauacugacccaccucucuggggaccccgagcuguuaaaacuguuucaggaguccgaaagggaugacguguucucaacacuuaccagucaguggaaggauguuccaguggagcagguaacucacgccgaccgggaacaaacgaaaaaggucguguacgcuguuguguauggcgccggaaaagagcgcuuggcagcgugccucggcgucccuauccaggaagcugcccaguuucuggagagcuuccuacagaaguacaagaaaauuaaggauuuugcaagagccgcuaucgcccaaugccaucagacagggugugugguaucgauuaugggaaggcgucggccccugccacgaauccacgcacaugaccagcagcucagagcucaagccgagaggcaggcggugaauuucguuguccaggguuccgccgcugaucugugcaaacuugcaaugauacacguguuuaccgccguggcugccucucacacuuugaccgcacgccuggucgcgcaaauccaugacgaauuacucuucgagguugaagauccccagauuccugagugugccgcucuggugcggagaacaauggaaagccuugaacaggugcaggcccuggaguugcaacuccagguaccacugaaggucucacuaagugcaggcagguccugggggcaccuggugccgcuccaggaggcuuggggacccccuccaggccccugccgcaccgagucuccuagcaacucccuggccgcaccagguucacccgccagcacucagccgccuccacuucauuucagucccucuuuuuguuuguga

SEQ ID NO: 60943 - RNA, 7773 nt, Artificial Sequence
  derived and/or modified sequence opt3 from POLQ__Homo_sapiens__NP_955452
augaaccugcucagaaggagcggcaagcggcgccgauccgagucugggucagacaguuucagcggauccgguggcgauucuucggccucaccccaguuucuuagcgggagugugcuguccccuccaccgggauugggccguugcuuaaaagcugcagccgcgggugaauguaagcccaccgucccugacuacgagagagauaaacugcuacucgcuaauugggggcugccaaaggccguucuugaaaaauaucacucuuucggagugaagaagauguuugaguggcaagcagaaugccuguugcucggccagguacuggagggcaaaaaccugguguacagcgcccccacauccgcugggaagacucucgucgcagaguuacugauccuuaaaaggguguuggaaaugcggaagaaagcccuguucauucuaccuuuuguuucaguggcuaaggagaagaaauauuaccuccagagucuguuccaggaagucggaauaaagguggacgguuauaugggcagcacgucuccaucccgccauuuuucaagccuugauaucgccguauguaccauugagagagcgaaugggcugaucaacagguugauugaggaaaauaaaauggaccuccugggaaugguuguggucgaugaguuacacaugcugggcgacagucaucgggguuaccuccuugaacuguugcuaacaaagaucugcuauauaacucgcaaaucugcauccugucaagccgaucuggcuagcucgcucucuaacgccgugcagaucguggggauguccgcaacccugcccaaucuugagcuggucgcuucaugguugaacgccgaacucuaccacacagacuuccgaccuguuccacuguuagagagugugaagguaggaaauagcauuuacgauuccucuaugaaacuggugagagaguuugaaccgaugcuacaggucaagggcgacgaggaucaugugguuagccucugcuaugaaaccaucugugacaaccacucagugcugcuuuucugccccaguaagaaauggugugagaaguuggcggacauuaucgccagggaauuuuacaaucugcaccaucaggcagagggccucgucaaaccuuccgagugcccacccgugauacuggaacaaaaggagcuucuggaaguaauggaucaguugcggcgucucccuagcgggcuggacucuguuuuacagaaaacugugccauggggagucgcuuuccaccaugccggucugacauuugaggaacgcgauauuaucgagggcgcuuucagacaggggcuaauuagggugcucgccgcaaccucaacgcugaguagcggagucaaccuucccgcccggcgagugaucauccgcacuccgauuuucggcgguagaccuuuggacauacugaccuauaagcaaaugguugggagggcuggccggaagggaguggauacaguaggcgaguccauccucauuuguaaaaauucugaaaagucgaaagggaucgcgcuguuacagggaagccugaagcccguccgcuccugccuucagagaagggagggugaagaggugacuggcucaaugauacgugcaauuuuggagaucaucguugggggaguggccaguaccucucaagacaugcacacauacgcugccugcaccuuucucgcagccagcaugaaagaaggcaagcaggguauucagcggaaccaggaguccguccaacugggggcuaucgaagccugugugauguggcuacuggagaaugaauucauucagucaacggaggcaagcgauggcacugagggaaagguauaucacccaacacaucucggcucugcgacccuguccaguagccuuucuccugcugacacuuuggauauauuugccgaccugcagcgagcaaugaaaggguucguguuagaaaacgaucuccacauccuguaccuuguuacacccauguuugaggacuggaccacgauugacugguauagauucuuuugccugugggaaaaguugccaaccuccaugaaaagggucgccgagcucgugggaguggaagaggguuuccuggcucgcugugucaagggcaaaguuguggcccggacagagagacagcauaggcaaauggcaauccacaagcgcuuuuucacuucacuagugcugcucgaucugaucagugaaguaccccuucgagagauuaaccagaaguacgggugcaaucggggacagauacagagcuugcaacagucggcugccgucuacgcgggcaugaucaccguguuuuccaaccgucuggguuggcauaauauggaauuacuccugucucaguuccagaaaagacuuacauuugggauucaaagggagcugugugaccuaguucgcgugagccuccugaacgcccagcgggcuagagucuuguaugcaucaggcuuccacacuguggccgaucuggcuagggccaauaucguugaaguggagguaauuuuaaagaacgcagucccuuucaaaagugcgcgaaaggccguggacgaggaagaggaagcuguggaggagcgccggaauaugagaaccaucugggucacaggaaggaaaggccucaccgaacgugaggccgcagcucugauaguugaagaggcccgcaugauccuucagcaagaucugguggaaauggggguacaguggaacccaugcgcauugcuccacuccucuacuuguagccugacgcauuccgagucagaggugaaggaacacacauuuauuagccagaccaaaaguucuuacaagaagcuaacuuccaaaaauaagagcaacaccaucuucucggacucauauauuaaacauucuccgaauaucguccaggaucugaacaagagucgggagcacacauccagcuuuaauugcaacuuccaaaauggaaaccaggaacaccagaccuguucuauauuuagagccaggaaacgagcuagccuugacauuaacaaggagaagcccggcgcgucccagaaugaagguaaaacuucagauaagaaagugguucaaacauucagucagaagacgaaaaaggccccucucaacuuuaauagcgagaagaugucucgguccuuccgcucauggaaaagaaggaagcaucugaaacggagucgagacagcuccccauugaaggauucuggggcaugcagaauccaccugcagggacagaccuuaucgaaccccagccucugugaggacccuuuuacucuggaugaaaaaaagacagaguuccgcaauucaggcccauuugcuaagaacgugucccuuagugguaaagaaaaggacaauaaaaccucuuucccccugcaaauuaagcagaacugcagcuggaauaucacauugacuaacgacaauuuugucgagcauauagugaccggcucccagucaaaaaacguuacgugccaagccaccucuguggucagcgaaaaggggaggggaguagccguggaggcugagaaaaucaaugaaguucucauucagaacggcaguaagaaucagaacguguacaugaagcaccaugauauccacccgauuaaccaguaucugcguaaacaaucccacgagcagacaagcacuaucaccaagcagaaaaauauaauugaacggcagaugccuugugaggcagucucuucauacaucaacagagacuccaaugugacaaucaacugcgagaggauuaagcuaaauacugaagagaacaaaccaagucauuuccaagcccugggggaugacaucagccgcaccguaauucccucggaagugcuuccuucugcgggagcuuucuccaagagcgagggccagcacgaaaauuuucucaacauaucacgacugcaggagaagacggguacauauaccacuaauaaaacaaagaacaaucaugucagugauuugggguuaguucugugugacuucgaggauucuuuuuaccucgacacccaguccgaaaaaaucauucaacagauggccacugagaacgcaaagcugggagccaaagauaccaaucuugcugcaggcaucaugcagaagagccuggugcagcaaaacucaaugaauaguuuccagaaggaaugccacauucccuuuccagccgagcagcauccuuugggugcgacaaaaaucgaccaccuagaucugaagacggugggcaccaugaaacaaagcuccgacucucacggggucgauauacucacucccgaaagcccaaucuuccauuccccgauucugcuugaggagaacggauuauuucugaagaaaaacgaagugucaguuacagacucucagcucaauaguuucuugcagggcuaccagacccaagagacaguaaagccugugauccugcucauuccccagaagagaacuccaaccggggucgaaggagagugucugcccgugccugaaacgucgcuuaacaugagcgacucccuguuguuugauucuuucucagacgauuaucuaguuaaagagcagcugccagacaugcagaugaaggagccccucccuagcgaagugacauccaaucacuuuagugauucuuuaugccugcaagaggaccuuaucaaaaagagcaacgucaaugaaaaccaggauacccaucagcagcugacuuguucaaaugacgaguccauaauuuucagugagauggauagcgugcaaaugguagaagcucucgacaacgucgauaucuucccggugcaggagaaaaaucacaccguugugucuccacgggccuuggaacuguccgaccccguccucgacgagcaccaucagggcgaucaagacgguggggaucaggacgaaagggcagagaagucaaagcugacaggaacucgccagaaccacagcuuuaucuggucgggcgccucuuucgaucuuaguccuggucuacagcguauucuggacaaaguguccagcccauuggagaaugaaaaguuaaaaucaaugaccauaaacuuuuccucucugaauagaaagaacacagagcucaaugaagagcaagaaguuaucagcaaccuggagacgaaacaggugcagggcauuaguuucuccagcaauaacgaggucaagucuaaaaucgaaaugcuugagaacaaugcuaaccaugaugaaaccucaagucugcucccccggaaggaguccaauauuguggacgauaacggguugaucccuccgacucccauaccaacaagcgccucuaagcugaccuuuccuggaauccuagaaacucccguaaauccauggaaaacaaacaaugugcugcagccuggcgagucguaccucuucgggucacccagcgacauuaagaaccacgaucuuuccccaggaaguaggaauggcuuuaaagacaacucuccgaucagcgauaccuccuucucacugcaauuaagucaggacgguuugcagcugacgccugcaucuagcuccucagagagccucucuauuaucgacguugcuuccgaucagaaucuguuucaaacuuucauaaaggaauggcgcugcaaaaagcgauuuaguauuagccuugccugugagaagaucagaucgcugaccuccucuaaaacagcgaccaucgggucacgguucaagcaggccagcaguccccaggaaauuccaaucagggacgauggauuucccauaaaaggcugcgacgauacucucgucgugggcuuggcaguguguugggggggacgcgacgcuuauuacuucucccugcagaaggagcaaaaacauucugagauuagcgccucauuagucccuccaucccuagaucccagucugacacucaaggacagaaugugguaucuucagagcugccugaggaaggaaucugauaaagagugcucaguagugaucuacgacuucauucaguccuauaagaucuugcugcucagcugugguauaucucuggaacaaaguuacgaggauccuaaaguugcuugcuggcuucucgacccggauucgcaggaaccaacccugcacuccauugugacaagcuuuuugccccacgagcugccuuuacuagagggcauggaaacuucacaggggauccagucucugggacucaacgcaggcagcgagcauuccggucgguaccgugccagugucgaaucaauccuuauuuucaauucuaugaaccaacugaauagcuugcugcagaaggagaaccuccaggacguguuucgcaaaguugaaaugcccucccaguauugucuggcccuuuuagagcugaacgggaucggauucaguaccgcugagugcgaaagccaaaagcacauuaugcaggcgaagcucgacgcaauagagacgcaggccuaccaguuggcuggccauuccuuuucuuucacaucaagcgaugacaucgccgaagugcuguuucuagagcugaaacucccaccuaaucgagaaaugaagaaccaaggcucgaaaaagacccuuggguccacuagaaggggaauugauaauggucggaaacugcgcuugggcagacaguucaguaccucuaaggacguccugaacaaacucaaggcacugcaccccuuaccagggcuuauccuggaguggaggcggaucacaaaugccauuacuaaggugguauuuccucuccagcgagagaaaugucuaaacccguuccugggaauggaaagaauauaucccgugagccaaucacacaccgcuacgggccgcaucacauuuaccgagccaaauauucagaacguuccuagggauuucgaaaucaagaugcccacuuuggucggugaguccccaccuucucaggcgguggggaaaggacugcuccccaugggccggggcaaguacaaaaagggguuuagugugaauccgcguugccaggcccaaauggaggaaagagcagcugacaggggaaugccauucagcauuuccaugcgccaugccuucgucccuuuucccgguggcucaauccuugcagccgauuauagccagcuggaguugcggauacuggcucaccucucucaugaccgaagauuaauccagguucugaacacaggggccgauguguucaggaguauugcggcagaauggaagaugaucgagccagaauccguaggagacgaucuucgccagcaagccaaacagauuuguuacggcaucauauaugguaugggggcuaagagccugggagagcagaugggcauuaaagagaaugacgccgcuugcuacaucgacucauuuaagucucgguacaccggcauuaaccaguucaugacugaaacagugaaaaauuguaagagagauggguuuguccaaaccauccuaggacguaggcgguaucuccccgguauaaaggacaacaauccuuaccgcaaagcacacgccgagcgacaggcuaucaacacgauugugcagggcuccgccgcagauaucguuaagauugcgacugugaacauccaaaaacagcuggaaaccuuccauucgacauuuaagagccacgggcacagagagggaauguugcagagugaccagaccggccugucuaggaaacggaagcuccaagguauguucugcccgauacgcgggggauuuuucauucuucagcugcaugaugaauuacuguaugaggucgccgaggaagacguagugcagguugcucagaucgugaagaaugagauggaauccgccgucaaauugagcgugaagcucaaagucaaggugaaaaucggcgcaucauggggcgagcugaaggauuuugacguuuga

SEQ ID NO: 60944 - RNA, 5163 nt, Artificial Sequence
  derived and/or modified sequence opt3 from POLR1A__Homo_sapiens__NP_056240
augcugaucagcaagaacaugcccuggagaaggcuccagggcauuuccuucgggauguacucugccgaggaacuuaaaaagcugucagugaaaaguauaaccaauccucgguauuuggacagcuuaggaaacccauccgcuaauggucuguacgaucuagcacucggcccggccgacucuaaggaggucugcucgacauguguucaagauuuuucaaacugcagcgggcaccugggacauaucgaacuuccccugacuguguauaauccuuugcucuucgacaaacuguaccugcucuuacgcggcaguugucugaacugccacaugcuuacguguccacgagcgguaauucauuugcugcuaugccagcuccgugugcuggaggucggugcucuucaggccguguaugaacuggagagaaucuugaauagguuucucgaggaaaaccccgauccuuccgcaucugagauucgggaagagcuggagcaguacaccacagaaaucguucaaaauaacuuacuggggagccagggagcccacgugaagaaugucugugaguccaagucaaaacucauagcucuuuucuggaaggcacauaugaacgccaaacgcugcccacacuguaagacuggcagaagugugguaaggaaagaacacaauagcaagcugaccaucacauuucccgcuaugguucaucggaccgccggccagaaggacucugagccuuuggggauugaagaggcgcagaucggaaaacgcgguuaucuaacuccaacauccgcacgagagcaccugucagcccucuggaagaacgaaggcuucuuucugaauuaccuuuucagcgggauggaugacgauggaauggagaguagauuuaacccgucuguguucuuucuggacuucuuggucgugcccccuuccagguaccggccagugagccgucucggcgaucaaauguuuaccaacggucagacggucaaucugcaggcuguuaugaaagacgugguauuaauucgcaagcugcuagcccucauggcacaggaacaaaaacugcccgaggaaguggcuacuccuaccacagaugaggagaaggacucgcuuaucgccauagacagaucuuucuuguccacucugccagggcagucacucauugauaaacuguauaacaucuggauuaggcuucagagucaugucaauaucguguucgacagcgaaauggauaagcugaugauggacaaguaccccggaauccggcaaauuuuggagaaaaaggaaggccucuuucgaaaacacaugaugggcaagcgcguugauuaugcggccagauccgugauaugcccggacauguacaucaacaccaaugagauugggaucccuauggucuucgcaacaaaacugaccuauccccagccagugacgccuuggaacguacaggaauuaaggcaggcuguuauaaauggacccaacgugcacccaggugccucuauggucauuaaugaggauggcagccggacugcucugucagccguggacaugacacaacgcgaggcagucgccaagcagcuacucacccccgcuacuggggcgccuaagccacagggaacaaaaaucguguguagacauguuaagaacggcgauauccugcuuuugaauaggcagccgacccugcaccgucccaguauucaagcacaucgggcccgaauccucccugaagagaaagugcugagauuacacuacgcuaacugcaaggccuauaaugcagacuuugauggugacgaaaugaacgcccauuucccacaguccgagcuggggagggcugaggccuacguacuugcaugcacggaccagcaguacuugguccccaaagauggccaaccucucgcgggacugauucaggaccacauggugagcggcgcuucuaugaccacacgcggguguuuuuucacucgggaacacuauauggagcuaguuuacagaggacugaccgauaagguggguagggucaagcuccugucaccaaguauacuuaaacccuuuccguuguggacaggcaagcaggugguaagcacucuguuaaucaauauuaucccugaagaccauaucccacucaaccuguccgggaaagccaagauuaccggaaaagcaugggugaaggagacaccccgcucuguuccuggcuucaaccccgauucgaugugcgaaagccaggucauaauccgagagggugagcuucugugugggguguuggacaaggcccacuauggcuccucagcuuacggacucgugcauugcuguuaugaaauuuacggcggggagaccaguggaaaaguccugacuugccuagcccggcuguuuacggcauaucuccaacuguaccgugguuucacacuuggcguugaagauaucuuggugaagccaaaagcugacgugaagagacagaggauuaucgaggaaucuacccacugugggccucaggccguacgcgcggcccugaauuuacccgaggcugcaagcuacgaugagguccggggaaaauggcaagacgcccaccucggcaaggaucagagagacuuuaacaugauagaucugaaauucaaggaagaggugaaucauuauuccaacgaaaucaauaaggcuugcaugccauuuggucuucacaggcaguucccggagaacucacugcagaugaugguucaaagcggggccaaaggcucuacugugaauaccaugcagauuuccugucuacucggacagaucgaacuggagggccgacgcccucccuugauggcaagugggaagagccugccaugcuucgagcccuacgaauuuacaccucgggcgggaggcuucgucaccgguagauuuuuaacugggauuaaaccacccgaguucuuuuuccauuguauggccggaagggaaggccucguggacacagcuguuaagacgucucguuccgguuaucugcagcgcugcaucauaaaacaccuugagggccuggugguacaauacgacuugaccguccgggauucagacgggaguguggugcaguuucucuauggagaggauggccuggacauuccuaagacucaguuccuacagccgaagcaauuuccauuccuggccagcaacuacgaagucaucaugaaaucgcagcaucuucacgagguucucuccagagcagaucccaagaaagcucugcaccauuuuagggccauuaagaaauggcagucuaagcacccuaauacauugcugcgacggggggcauucuuaagcuauucacaaaagauccaggaagccgugaaagcucucaagcuggagagugaaaaccgcaauggaagauccccaggcacccaggagaugcuuaggaugugguacgagcuggacgaagagucucggcgaaaauaccagaagaaagcggccgcaugccccgauccuagcuuguccguauggagaccggacauauauuuugcuucagugagcgaaacauucgagacuaaggucgaugacuacagucaagaaugggccgcccagaccgagaagucuuaugagaaauccgaacucagccuggaucgccuaaggacgcugcuucagcucaaguggcagcguucgcugugugagcccggugaagcugugggguuguuagcagcccaaucaaucggagagccaucuacccagaugacacugaacacuuuccauuuugcgggccggggugaaaugaauguuacccucggcauuccuagacugagggagauccuuaugguggcuagugccaacauuaaaacacccaugauguccgucccagugcugaauacuaagaaagcauugaagcgcguuaaaagccuaaagaagcagcugacccgagugugccucggggagguccugcagaaaaucgacguacaagaaucuuucuguauggaggaaaagcagaacaaauuucagguguaccagcuuagauuccaauuuuuaccucacgccuauuaccagcaggagaagugccugcggcccgaggauauacucagguucauggaaacgcgcuuuuucaaauugcugauggagagcauuaagaagaaaaacaauaaggcuuccgcauuucguaacguuaauacaagacgggccacccaaagggaccucgacaacgcgggagaacugggccgcucacgaggggagcaggaaggagaugaggaggaagagggccauaucguggacgcugaagccgaggaaggugaugcagacgccagugaugcuaaaagaaaggagaaacaggaggaagaggucgacuaugaaagcgaggaagaggaggaacgggagggggaagagaaugaugacgaggauaugcaggaagagaggaacccacaccgcgaaggagccagaaagacucaagagcaggacgaagaggugggccuugguacagaggaagauccgucucugccugcauugcuaacccagcccaggaagccaacucacucccaggagccccaaggcccugaagcuauggagcggcguguacaggccgugcgcgaaauccauccauucauugacgacuaccaguacgauaccgaggagucacuguggugucaggucacaguuaaacuccccuuaaugaagaucaauuuugacaugaguagccugguggugucccuugcgcacggggccgucauuuaugcaacgaaaggaauaacccgaugccugcucaacgaaacuacaaauaacaagaaugagaaagaauuggugcugaacaccgagggcaucaaucucccugaacuguucaaguacgcugagguucuugaucuaagaaggcuguauucuaacgacauucaugccaucgcuaauacauacgggauugaggcagccuugcggguaaucgaaaaggagauaaaagauguguucgccgucuauggaaucgcuguggacccgcgccacuuaucgcugguugcggauuacauguguuuugaaggcguguauaagccacucaacagauucgguauuaggagcaacucauccccccugcaacagaugacuuuugagaccaguuuccaguuucuuaaacaagcaacgaugcuggggucucacgacgagcuccggagcccuuccgccugcuuggucgugggaaagguaguccgaggcggcacagggcuguucgaacuaaaacagccccugagauga

SEQ ID NO: 60945 - RNA, 3240 nt, Artificial Sequence
  derived and/or modified sequence opt3 from POLR1B__Homo_sapiens__NP_001131076
auggaccccggcagcagauggaggaaccugccuuccgggccaucucucaagcaccuuaccgauccgucauacggaaucccccgggagcagcaaaaagccgcucugcaggaauugacacgcgcacauguggagaguuucaauuaugccguccacgaagguuuaggccuggcgguucaggcugacauuaacugggccgugaaugggauaagcaagggaaucauuaaacaguuucuaggcuacguaccuaucauggugaaguccaaacucugcaaccugcgaaaucuuccaccccaagcacugauugagcaucacgaagaggccgaggaaauggguggguauuucaucauaaacggaaucgagaaggucauucguauguugaucaugccuagaaggaauuuuccaauugcuaugauccggcccaaguggaaaacucgcggcccuggcuacacgcaguauggggugucuaugcauuguguuagagaggaacacucggcagugaacaugaaucuccacuaccuggagaacggaaccgucaugcugaauuucauauauaggaaggaacucuuuuucuuaccacuggguuuugcccuuaaagcucuugugucauucagcgauuaccagauuuuucaggagcugaucaagggcaaagaagacgauaguuuccuacggaacuccguaucucaaaugcuccgcauuguuauggaggaagggugcagcacacagaaacaggugcugaauuaccuuggagaguguuuucgagucaagcugaacgugccggacugguaucccaaugagcaggccgcggaguucuuguuuaaccaaugcaucuguauccaucucaaauccaacacugaaaaguucuacaugcugugcuuaaugaccagaaaacuguucgcacucgccaagggcgaauguauggaggauaauccugacucacuugugaaccaggaaguccugacaccaggucaguuguuucuaauguuccugaaagagaagcucgagggguggcugguuaguauuaaaauagcuuuugauaagaaggcccagaaaaccagcgugucuaugaauacugacaaccuuaugaggaucuucacaaugggaauugaucugaccaagcccuuugaauauuuguucgcaacgggcaaucuccgguccaaaacuggccugggguuacugcaggacucaggacuaugcguaguggcugauaagcucaacuuuauccguuaccugagccacuuccgcuguguccauagaggugccgacuuugcgaaaaugaggaccacaacugugcggcgacuuuugccugagaguuggggcuuccugugcccaguucacacccccgacggggaaccguguggacucaugaaucaccugacagccgugugcgaggucgugacccaguuuguauauacggcaucuauaccugcccuucugugcaacuugggcguuacucccauugauggugcuccacaucgcuccuacagcgaauguuauccugugcuccuggacggggucauggugggcugggucgauaaggacuuagcucccggaaucgccgauucgcugagacacuucaaggugcuaagggagaaacggaucccacccuggauggagguugugcucauuccuaugacaggcaagccaucucuguacccgggguuguuuuuguucaccacucccugccgccugguaagaccuguccagaaucucgcacugggaaaagaagaguuaaucgguacaauggaacaaauuuucaugaacguggccauauuugaggacgagguuuucgcuggcgugaccacgcaucaggaacuguuuccacacucccuuuugucagucaucgcgaauuucauucccuuuagugaucauaaccagagcccuaggaauauguaccagugucaaauggggaagcagaccaugggauucccacuccugacauaucaggaccguuccgauaacaaacuauaccggcugcagacuccccaaucuccgcucgugcgaccuagcauguaugacuacuaugauauggacaauuacccaaucggcaccaacgcaaucguagccgugauuucauauacagguuacgacauggaggaugcuaugauaguuaacaaggccaguugggaaagaggguuugcacacggcuccgucuacaagagcgaguucaucgaccugucugaaaagauuaagcagggagauucaagucuuguguuuggcaucaaacccggggacccuaggguguugcagaagcuggaugacgauggauuacccuucauuggugccaaacuccaguauggcgacccauacuauagcuaccugaaucuuaacacuggggaguccuuugucauguauuacaagucuaaggagaauugcguuguggauaacaucaaaguguguucgaaugacaccggaagcggcaaguucaaaugcguauguauaacaaugcgcgucccucggaaccccaccaucggugauaaguuugcuuccagacacgggcaaaaaggcauucugucaagguuguggccagccgaagacaugccguucacugagaguggaauggugccugauauccucuucaauccccauggcuuuccaucucgcaugacgauugggaugcugaucgaaagcauggcaggaaaguccgcggcucuacacggccugugccaugacgccacacccuucauauuuucagaggaaaacagcgcacucgaguauuucggugagaugcugaaagccgcuggguacaauuuuuacggaaccgaacgacuuuauucuggcauuuccgguuuggagcuggaagccgacaucuucauuggcguuguguacuaucagcgguuacgucacauggucagugauaaguuucaggugagaacuaccggggcaagggaccgcguuacaaaccaaccuaucggaggccggaaugugcaagggggaauaagauucggcgagauggaaagggaugcucuccuggcccacgguaccagcuuucuucugcaugaccgacuauucaacuguucugaucgcuccguagcgcacgucugcgugaagugugggucacuccugaguccauugcuggagaaacccccuccgagcuggucggccaugcggaauagaaaguacaacugcacuuuaugcuccaggucugacacaaucgauacggugagcgucccauauguuuuucguuacuucguggcugagcucgcagccaugaauauuaaaguaaagcuggacguggucuga

SEQ ID NO: 60946 - RNA, 1041 nt, Artificial Sequence
  derived and/or modified sequence opt3 from POLR1C__Homo_sapiens__NP_976035
auggccgcuagccaggcaguggaggaaaugagauccagggucguucugggcgaguucggggugcggaacguacacaccacagacuuucccggaaauuacucugguuaugaugacgccugggaucaagaccgcuucgaaaagaacuuucgaguggaugucgugcauauggacgaaaauucacucgaguucgauaugguuggcaucgacgcggcuauugccaacgcauuucguagaauacuucuggccgaggugccuacuauggcugucgagaaaguguugguauacaauaacacgaguaucguucaggaugaaauuuuagcacacaggcuggggcuaaucccaauucaugccgacccgcggcucuuugaguaucgcaaucagggagaugaagagggcaccgagaucgacacacugcaguuuagacuucaagugaggugcacucggaacccccacgcugccaaggauagcuccgacccuaaugaacuguacgucaaccauaaaguguauacccgccacaugacauggauaccauuggguaaucaggcggaccucuuccccgaggggaccauccgaccugugcacgaugacauucugaucgcacagcugagaccaggacaggaaauugaucucuuaaugcauugugucaagggcaucggcaaagaccacgccaaguuuucucccguugcuacugccucguacaggcugcuuccugauauaacauugcuggagccaguggaaggggaggcagcugaggaacuaucacggugcuucagcccgggaguaauugaggugcaagaaguccaggguaagaaaguggcccguguugcgaacccccgccucgacaccuuuaguagagagaucuucaggaaugaaaagcugaaaaaggugguccggcuugcccgagugcgcgaucauuauauuuucuccguagagucuacgggcguucugccuccagacguguuggucagcgaggcaaucaaagugcucauggggaaguguagaagguuccuggaugaauuagacgcuguccagauggauuga

SEQ ID NO: 60947 - RNA, 402 nt, Artificial Sequence
  derived and/or modified sequence opt3 from POLR1D__Homo_sapiens__NP_057056
auggaggaagaccaggagcuggaaagaaagaucagcggccucaaaaccuccauggccgagggggaaaggaagacagcucuugagauggugcaagcagccggaacugaucggcacugcgucacguucguucugcaugaggaagaccacaccuuggguaacucuuuacgcuacaugauuaugaaaaaucccgagguggaauuuuguggcuauacaacuacccauccuucagagaguaagauaaaccugcgaauccagacacgugggacccuaccagcgguagagccguuccagagaggacucaaugaacugaugaacgugugccagcacguccuugauaaauuugaggcuagcauuaaggacuacaaggaucaaaaagccuccaggaaugaaucuacuuucuga

SEQ ID NO: 60948 - RNA, 5913 nt, Artificial Sequence
  derived and/or modified sequence opt3 from POLR2A__Homo_sapiens__NP_000928
augcacggagggggacccccuagcggugacuccgccugcccacugagaaccaucaagagggugcaguucggcguccucucuccggaugaacuuaaacggaugucaguuacugaagggggaauuaaguaccccgagacuacggaaggcggucgcccuaaacuaggcggguugauggacccacgacaaggggugauagagcguaccggcagaugucagacuugcgcugggaacaugacugaaugucccggacacuuuggucacaucgaguuagcaaagccuguauuccaugugggcuuucuggucaaaaccaugaaggugcugaggugcguuuguuucuuuugcaguaagcuccugguggauagcaauaacccaaaaauuaaggacauccuugccaaauccaaggggcagcccaaaaagcggcugacccacgucuaugauuuguguaagggcaaaaauauuugcgagggcggugaagagauggacaacaaguucgggguggaacagccugagggagaugaggaccucaccaaagaaaagggccauggcggguguggacgcuaccaaccaagaaucaggcggucuggucuggagcuguaugcggaauggaaacacguaaaugaggauucgcaggaaaagaaaauacucuuaucaccggagcgcguucacgagaucuuuaagcgaauuagcgacgaagagugcuucgugcugggcauggaacccagauacgcuaggccugaguggaugaucgucacugugcuuccagugcccccuuugaguguccggccagccguugugaugcagggguccgcacguaaccaggaugaccugacacauaagcuagccgauauuguaaaaaucaauaaccaacuccgcagaaaugaacagaacggagcugcagcccacgugauagcugaggacgucaagcugcuucaguuucauguggccaccaugguugacaaugagcugcccggcuugccgagggcgaugcagaaaucuggucggccucucaagagccugaaacaacgauuaaaggggaaggaaggccgcgugagaggaaaccugaugggcaaaagggucgauuucuccgcacggacggugauuacucccgacccaaaucucucaaucgaucagguagggguuccucgcaguauugccgcuaacaugaccuuugccgagaucgugacacccuucaauaucgacagacuucaggaacuggucaggcguggaaacagccaauauccaggugcaaaguacauuauacgggauaacggcgaccgaaucgauuugagauuucaccccaaaccuucugaccuacaucugcagacuggguauaagguggagaggcauaugugugauggagacauugucaucuucaaucgccagccaacccuccacaaaauguccaugaugggccaucgggugagaauacugccguggucaacauucaggcuuaaccugagcguuaccacgcccuacaaugcugauuuugacggugacgaaaugaacuugcaccucccucagagucuggagacucgcgccgagauucaagaauuagcgauggugccacgaaugaucguaacaccccagucuaaucggccugucauggggaucgugcaggauacccugacugccguucguaaguucacaaagagagacguguuucuagagaggggcgaagucaugaaccuccugauguuccuuuccaccugggauggaaaagugccacagcccgcaauuuugaagccgcgcccucuguggacgggcaaacaaaucuuuagccucauuauaccagggcauaucaauugcauucggacccacucgacacaccccgacgaugaggacucuggaccuuacaagcauaucucccccggugauacuaaaguagugguugagaacggcgaacugaucauggggauucuuugcaagaagucacugggaaccagugcuggcagcuugguccacauauccuaucucgagaugggucaugacaucacaagacuguucuacucuaauauucagacugugaucaacaauugguuacugauugaagggcacaccaucggcauaggagauagcaucgccgacucaaaaacauaucaggauauucagaacaccaucaagaaagcuaagcaagacgugauugaggucaucgaaaaagcccacaauaacgagcuagagccaacuccuggcaauacgcucaggcagacauuugaaaaccagguuaaccgaauacugaaugaugcacgcgacaagaccgggaguuccgcccagaaaagccuuucugaguacaacaauuucaagucaaugguggugaguggagcuaagggcagcaaaauuaacaucucccaaguaauugcggucgugggucagcagaauguugaagggaagcggauccccuuuggauucaaacauagaacuuugccacacuuuauaaaggacgauuauggcccggagucuagggguuucguggaaaacucguaccuggcaggccucaccccuacagaguuuuucuuccaugccaugggagggcgugagggccugaucgacaccgcugucaaaacugccgaaacaggguauauucaacgccgguuaaucaagagcauggaguccgugaugguuaaguacgaugcaacggugagaaauucaauuaaccagguaguccagcugagguacggagaagacggccuugccggugagaguguggaauuucagaauuuggcuacccucaaacccucuaacaaggccuucgagaaaaaguuucgauucgauuauacuaaugagcgggcacugcgcagaacacuacaagaagaccuggugaaagauguccucagcaacgcgcacauccagaaugagcuggaaagggaguuugagcggaugcgagaagacagagagguucuucgcgugauauucccaaccggggauuccaagguaguguugcccuguaaccuguuaaggaugauuuggaaugcucagaagaucuuucauaucaacccucgucucccaucagaccugcaccccauuaaagucguggaaggaguuaaggagcuuagcaaaaagcuggugaucgucaacggcgaugacccuuugucucggcaggcccaagaaaaugcaacacuccuguucaacauucaccuaagauccacucugugcaguaggcgcauggccgaggaguuucgacucagcggugaggcuuucgauuggcugcuuggcgagauagaaucuaaauuuaaucaggccaucgcacauccgggggagauggugggagcuuuggccgcgcagucccugggcgaaccagccacccagaugacguuaaacaccuuccacuacgcugggguuucagcaaagaaugugacacucggaguccccagacugaaggagcuuauuaacaucaguaaaaagccuaaaacuccaagccugaccguauuucuacucggccaaucggcccgggacgcugagagggccaaggacauucugugucgcuuggaacauacaacucugcguaaagugaccgcaaauacggcgaucuauuacgaucccaacccucaguccacaguuguggccgaggaccaggaaugggucaauguguauuacgagaugccggauuucgacguagcuagaauaucucccugguuacuccggguggaacuggauaggaagcacaugaccgaccgcaaacuuacuauggagcaaaucgccgagaagauuaacgcagguuucggggaugaccugaauugcaucuuuaacgaugacaaugcugaaaaguugguccuccgaauuagaaucaugaacagcgaugagaauaaaaugcaggaagaggaggaaguuguggacaagauggacgaugacguguuccugcgguguauagagucaaacaugcuaacagauaugacccugcagggaauugaacagaucaguaaagucuauaugcaucuuccacaaacugacaacaagaaaaagaucauuauaaccgaggauggcgaauuuaaggcccuccaggaguggauccuggagacagacgguguguccuugaugaggguucugucugaaaaagauguagacccugugcgcacgaccagcaaugauauugucgagaucuucacuguguuaggcauugaagcaguuagaaaggcccucgagagggaacuguaccacgugaucuccuuugacgggucauacgucaacuaucggcaccuugcucuguugugcgauacaaugaccugucguggacaucucauggcgauaacacgccacggcgugaaucgacaggacacugggccccugaugaaaugcagcuucgaggagaccguagauguccuaauggaagccgcagcucauggagagagugacccaaugaagggcgugucugaaaacaucaugcugggucagcuugccccugccgggacgggauguuuugaccuccuguuggaugcugagaaaugcaaguacggcauggaaauucccacaaauaucccaggcuuaggggcagccggaccgaccgguauguucuuuggcuccgcgccuagccccaugggaggaauuucgccagcuaugacucccuggaaccaaggcgccaccccugcauauggugccuggucaccaucuguugggaguggaaugacacccggcgcugcaggcuucuccccuagcgccgcgucugacgcuagcggguuuuccccgggauacucaccagccuggagucccacuccugguagccccggcucuccagggccuuccucacccuauaucccaaguccuggaggcgcaaugagcccguccuacucucccaccucgccagccuaugagccuagaagccccgguggguacacaccacagucaccuuccuacagucccacgucuccgagcuauuccccaaccucaccuucuuacagccccacaaguccaaauuauucccccacaagcccuucuuacucaccgaccucccccaguuauagcccaacuucgccuucuuacucccccacaagcccuucauauaguccaaccucucccuccuacagcccuacgucaccaaguuacagccccacuuccccgucuuauagcccuaccuccccaucauacucucccacaaguccuucguauagcccaaccucccccucuuacucaccgacuagcccuuccuauagucccacaucuccaagcuacucaccuaccucccccaguuauagcccaacaucucccuccuacucaccuacuagcccaucguacucuccgaccagucccaacuauuccccuacgagcccaaauuacacacccaccucaccuuccuauucuccaacuagccccaguuacuccccuaccagcccgaacuauacaccaacuucucccaauuacucaccuaccagucccuccuauagcccaacgucuccuucguacucacccacaagcccauccuacaguccgucuagcccuagguauacaccccaguccccaacuuacacacccucaaguccuucuuauagcccauccucacccagcuacucuccuaccuccccgaaguauacuccaacaagucccagcuacucgccuuccucuccagaguauacccccacgucaccuaaauacagccccacaaguccaaaguacuccccgaccucuccuaaauauagccccacaucaccaaccuacuccccuacaacucccaaguauaguccaaccagcccuacguacucucccacaucaccgguguauacuccaaccuccccuaaauacagccccacaucuccaaccuauagucccacuucgccuaaguacuccccgaccagcccaacauacucacccacgucuccuaagggaagcacuuauucccccaccaguccaggcuacucaccuacaucucccaccuauagccugacuuccccagcuauaaguccugaugacagcgaugaagagaacuga

SEQ ID NO: 60949 - RNA, 3525 nt, Artificial Sequence
  derived and/or modified sequence opt3 from POLR2B__Homo_sapiens__NP_000929
auguacgacgccgaugaggacaugcaguaugaugaagacgaugacgagaucacccccgaucuguggcaagaggcuugcuggauugugauaagcuccuacuucgacgagaagggccucgucagacagcagcuugauucuuuugacgaguucauccagaugucaguucaaaggauuguggaagaugcaccuccaaucgaccugcaggccgaggcgcagcacgcuaguggggaaguagaggaaccgccccgguauuuguuaaaauuugagcagauuuaccugagcaagccuacacauugggagcgcgauggagccccaucccccaugaugccuaacgaagcacgacuacguaaucucacuuauucugccccacuguacguggacaucacgaaaaccgucauaaaggagggugaagaacaacuucagacacagcaccagaaaacuuucaucggcaagauucccaucaugcugagaucgaccuauuguuugcucaacgggcugacagacagggaucugugcgaacucaaugaguguccuuuagacccaggaggcuacuuuauuaucaacgguucagagaaggugcugauagcucaagagaaaauggcaaccaauacuguuuacguguucgccaagaaagauagcaaguaugcuuacacaggggaaugccggaguugucuugaaaacuccucucgcccgaccagcacgauuugggucuccauguuggccagaggaggccagggcgcgaaaaagucagcaaucgggcagaggauuguggccacucugcccuauaucaagcaagagguaccuaucauuauaguuuuucgggcucuaggauucgugagugaccgcgauauccucgaacauauuaucuacgacuuugaggauccagagaugauggaaauggucaaacccagccuggacgaggccuucgugauacaggaacagaauguggcacuuaacuuuauugguucucgaggcgcuaagccuggggucaccaaagagaagagaaucaaauaugccaaggaaguucugcagaaagagauguugccacacgugggaguauccgauuucugcgagacaaagaaggcguacuuucucggcuauauggugcauaggcuguuacuggccgcacucggucggcgugaacuugacgaucgcgaccacuacgggaauaaaagacuggacuuggcuggaccccuacuggccuuccucuucaggggcauguuuaagaaccugcuuaaagagguccggaucuacgcucaaaaguucauugaucgaggcaaagacuuuaaucuggaauuggccaucaagacucgcauuauaucagaugggcucaaguauagccuggcaaccggaaacuggggugaccagaaaaaggcccaccaggcuagagcgggcgugagucagguuuuaaauaggcugacauucgcaucuacccuaucccaucuccggcgccugaacagcccgaucgggagagauggaaaacuugccaagccuaggcaauugcacaauacgcuguggggcauggugugucccgcugagacuccagagggucaugccgucgggcucgugaaaaaccuggcacuuauggccuacauuucgguaggcucucagccuucccccauccuggaauuuuuggaggaauggucaauggagaaccucgaagagaucaguccagcugccauugcagacgcgacaaagauauucguuaauggaugcugggugggcauccacaaggaucccgagcagcugaugaacaccuuacguaaacugcggcgacagauggacauuaucgucagcgaaguguccaugauuagagauaucagggagcgcgaaauacggaucuauacugacgcugggagaauuuguaggccucuacucaucgucgagaagcaaaaacugcuuuugaagaaacgccacauugaucagcugaaggaacgagaguacaauaacuauucuuggcaggaccucguggccagcggaguuguggaguacaucgauacacuggaagaggaaaccguaauguuagcaaugacgccagacgaccugcaggagaaggaagucgccuauugcucaaccuacacacauugugagauacacccgaguaugauucuuggugugugcgcuuccaucauucccuuuccugaucauaaucaaagcccacggaacacuuaccagucugccaugggcaaacaggcaauggggguuuauaucaccaauuuccacgugcguauggacacauuggcucauguccucuacuauccccaaaagccucuggugacuaccagaucaauggaguaccuaagguuucgcgaacugccagccggaauaaacaguaucguagcgauugccagcuauacaggcuacaaucaggaggauuccgugaucaugaaccggucugcuguugacagagguuucuuuaggucggucuucuaucgaagcuacaaagaacaggaguccaagaaaggguuugaucaggaggaaguguucgagaagcccacccgcgaaacuugccaaggcaugcggcacgcaauuuacgacaaacucgaugacgauggacugaucgccccgggcgugagagucucaggggacgauguuauaauuggaaagacggugacacuuccugagaaugaagacgaguuggagaguaccaacaggcguuauacuaagcgcgauuguucuaccuuccugcggacaagcgaaaccgguaucguggaccagguaauggucacuuuaaaucaggagggcuacaaauuuugcaagaucagagugagguccguucggauuccacagaucggggacaaauucgcuucacgacacggacaaaagggcacaugugguauucaguaucgccaggaagauaugcccuuuacgugcgaggggauaaccccugacaucauuaucaacccccaugccauuccaagcagaaugacuaucggccaccucauagaaugucugcagggaaaagugucugcaaauaagggcgagaucggggaugcgacaccuuucaacgacgccgucaacgugcaaaagauuuccaaucuucugagugauuacggauaucauuugaggggcaacgagguucucuacaaugguuuuaccgggcggaaaaucacaagccagauuuucaucggacccacuuauuaccagcgacugaagcacaugguggacgauaaaauacacucuagagcucgcggcccaauucaaauccuaaacaggcagccgauggaaggucguucccgggacggcgggcugagauuuggagagauggaaagggauugccagaucgcccauggcgcagcucaguuccuccgcgagcgacuguuugaagccucagacccuuaccaaguacacgucuguaaucuuugcgggauuauggcaauagccaacaccagaacgcauaccuaugagugucggggaugcaggaauaagacacagaucaguuuggugcgcaugcccuacgcuuguaaacuguuauuccaggagcucaugagcaugucgauugcgccacguaugauguccguguga

SEQ ID NO: 60950 - RNA, 828 nt, Artificial Sequence
  derived and/or modified sequence opt3 from POLR2C__Homo_sapiens__NP_116558
augcccuacgccaaccagccuaccgugagaaucacagagcugacugacgaaaaugucaaguucauuauagagaacacggaucucgcuguugcaaauagcaucaggcggguguuuauugccgaaguaccaaucauugcgaucgacugggugcaaauagaugcuaacuccucuguccuucacgacgaguucaucgcccaucgccugggcuugauuccguuaaucucagaugacauuguggauaaacugcaguauagucgagacugcaccugugaagaguuuugccccgaguguagcguugaguucacacuagaugugcguugcaaugaagaccagacuagacacgucaccuccagggaucucaucucuaacucgccucgggugauaccaguaacaucacgcaauagagacaacgaucccaaugacuacguugaacaggacgauauucugaucgugaaacuuaggaaggggcaagagcugcgguugcgcgcauaugccaagaaaggauuugguaaggagcaugcuaaguggaacccuaccgcaggcgucgccuucgaauacgacccagauaaugcucuccgacacacuguguaucccaaaccugaggaauggccaaagagcgaguacagugaacuggacgaggaugagucccaggccccguaugaccccaacgggaaaccugaaagauuuuacuacaauguggagucuuguggaagccugaggccagaaacaauuguccucuccgcguuaucaggccugaagaaaaaguugagugaucuucagacccagcugagccaugagauccaaucugacguucuaacgaucaacuga

SEQ ID NO: 60951 - RNA, 429 nt, Artificial Sequence
  derived and/or modified sequence opt3 from POLR2D__Homo_sapiens__NP_004796
auggccgcuggcgggagcgaccccagagcaggagauguggaggaagacgccucccagcugaucuucccuaaggaguuugaaaccgcggagacacuccuuaacucugaaguccacaugcuguuggagcauaggaaacaacagaaugagucagcugaagaugagcaggaauuaagugagguuuucaugaagacucugaacuacacggcccgguuuagccgcuucaaaaaucgagagaccauugcauccgugcguucucuacuccugcagaagaaacuucacaaguuugaacuggccugcuuggcuaaccucuguccagagacagcagaagagucgaaggcccugauaccgucacuggaagguagauucgaggacgaggaacuccaacagaucuuagaugacauucagacuaaaaggagcuuucaguauuga

SEQ ID NO: 60952 - RNA, 633 nt, Artificial Sequence
  derived and/or modified sequence opt3 from POLR2E__Homo_sapiens__NP_002686
auggacgaugaggaagagaccuacagacuguggaagaucaggaaaacaauuaugcagcucugccacgaccggggcuaucuugugacucaagaugaacuggaccagacguuggaggaguucaaggcccaguuuggggauaaacccagcgaaggacgcccucgacguaccgacuuaacaguccugguugcucauaacgaugacccaacugaucagauguucguguuuuucccggaggaacccaagguagguauaaaaaccaucaagguguacugucaaagaaugcaggaggaaaauauuacaagggcacuaaucgucgugcagcagggcaugaccccuuccgccaagcaaucucucguugacauggcgccaaaauauauucuggagcaguuucuucagcaggagcuguugaucaacauaacugaacacgagcucgugcccgaacaugucgugaugacaaaggaggaaguaaccgagcugcuggcucgguacaaacuccgcgagaaucaauuaccuagaauccaggccggggauccaguugcaagguauuucggaauuaagcggggccagguggucaaaaucauucgccccucagaaacggccggucgauacaucacuuauagacuggugcaauga

SEQ ID NO: 60953 - RNA, 357 nt, Artificial Sequence
  derived and/or modified sequence opt3 from POLR2F__Homo_sapiens__NP_001288058
auggugagcaucuccugccuggucauuagacccccuaggccaccgaagguucucggccuucaggaggggcaagaaaacguggagauacugcccucuggagaacggccucaggccaaucagaaacgcaucaccacaccauacaugacuaaguaugagcgagcucguguauuggguacgagagcauuacagauugccaugugugcgcccgugauggucgaacuggagggcgagaccgacccucuacucaucgcuaugaaagaacugaaggccaggaaaauuccaaucauaauccggcgcuaccuucccgaugggucauaugaggacuggggaguggaugaacugauuaucacagacuga

SEQ ID NO: 60954 - RNA, 519 nt, Artificial Sequence
  derived and/or modified sequence opt3 from POLR2G__Homo_sapiens__NP_002687
auguucuaccacaucagccuggagcaugaaauucuccuucaccccagauauuuuggcccuaaccuguugaauaccgugaagcagaaauuauucacagaggucgaagggacuugcacgggaaaguacgguuuuguuauagccgugaccacaaucgacaacauuggcgcugggguaauccaaccaggaaggggcuucgugcuguauccggucaaauacaaggcaauuguguuucggcccuucaaaggugagguuguggaugccgucgugacucagguaaauaagguugggcuauuuaccgaaaucggaccuauguccuguuucauaucucgccauucaaucccaagugagauggaguuugaccccaacagcaauccuccaugcuauaagacaauggaugaagacauugugauccagcaggaugacgagauucgacucaaaaucgucggcacccguguggauaagaacgacauauucgcgauuggcucccugauggaugacuaccuugggcuggugucuuga

SEQ ID NO: 60955 - RNA, 369 nt, Artificial Sequence
  derived and/or modified sequence opt3 from POLR2H__Homo_sapiens__NP_001265643
auggccggcauccuguucgaggacauuuuugaugugaaggacauagaucccgaagggaaaaaguucgacagagucagcaggcuccacugcgaguccgaaucuuuuaaaauggaucuuauccuggacguuaacauucagaucuacccuguggauuugggagacaaguuccgguuaguaauugcuucaacccuguaugaggaugguacacuagacgauggcgaauacaauccaacugacgaucgcccgaguagcuccgcauaugugucuuacgggggacuccugaugcgacuucaaggcgacgccaacaaucugcaugguuuugaggucgacucgcguguguauuugcucaugaaaaagcuggcguucuga

SEQ ID NO: 60956 - RNA, 354 nt, Artificial Sequence
  derived and/or modified sequence opt3 from POLR2J__Homo_sapiens__NP_006225
augaacgcucccccugccuucgagagcuuucuccuguucgaaggcgagaagaaaaucaccauuaauaaggacacaaaagugccaaacgcaugccuuuuuacuauaaauaaggaagaucacacgcuggggaacaucauuaaaucccaguuguuaaaggacccgcaaguccuguucgccggauacaagguuccccauccucuagagcacaaaaucauuaucagagugcagaccacaccagauuauucuccccaggaagcguuuacuaaugcuauaaccgaccucaucucagagcugagucuucuggaggaaagguuccggguagccauuaaggauaaacaggaggguaucgaauga

SEQ ID NO: 60957 - RNA, 177 nt, Artificial Sequence
  derived and/or modified sequence opt3 from POLR2K__Homo_sapiens__NP_005025
auggacacccagaaggaugugcaacccccuaaacagcagccaaugaucuacauuugcggcgagugucacacagaaaacgagauaaagagcagagacccgaucaggugccgggaauguggguaucgcauuauguacaaaaagcgaacuaaacgucuggucguuuucgaugccagauga

SEQ ID NO: 60958 - RNA, 636 nt, Artificial Sequence
  derived and/or modified sequence opt3 from POLR2M__Homo_sapiens__NP_001018112
augugcagccugcccagaggcuucgagccucaggccccagaagaccucgcucaaaggucccuuguggagcugcgggaaauguugaagcgccaggagcgauuacugcguaacgaacuacagagaaucaccauugcagaucagggggagcaacagucugaggaaaaugccucaacuaaaaaccucacaggacugaguagcgguacggagaagaaaccgcacuacauggaaguccuugagaugagggcgaagaaucccguuccucagcugcggaaauuuaagaccaacguguugccauuccgccagaaugacuccucuucgcauugucaaaagucaggcagccccauaaguuccgaggaaagaaggcggcgcgauaaacagcaccucgacgauaucacagcugcccgacugcugccucuccaucacaugccaacucaguuacugucuauugaggaaagccuugcauugcagaagcaacagaaacagaacuaugaggaaaugcaagccaagcuggcugcacagaaacuagccgagagacucaauaucaagaugagguccuacaaccccgagggggaaucaaguggacgguaucgugagguacgcgacgaagaugacgauuggagcucugacgaguuuuga

SEQ ID NO: 60959 - RNA, 4173 nt, Artificial Sequence
  derived and/or modified sequence opt3 from POLR3A__Homo_sapiens__NP_008986
auggugaaggagcaguucagagaaaccgacgucgccaaaaagaucagccacauuugcuuuggcaugaaaucccccgaggaaaugaggcaacaggcucauauacagguugugucuaagaaccuguacucacaggauaaucaacacgcaccucuccuuuaugggguacuggaccaucggaugggaacaagugagaaagaucgcccaugugaaacuugcgguaagaacuuggccgacuguuuaggccacuacggguauaucgaucuggagcuaccgugcuuccaugugggauacuuucgagcggucauuggcauccuccagaugauuuguaagacgugcugucacaucaugcugagccaggaggagaaaaagcaguuccuugacuaucugaaacgucccgguuugaccuaccuccaaaagagagggcugaaaaagaagauauccgauaaaugcaggaagaaaaauaucugucaccauugcggagcuuuuaacggcacagugaagaaauguggccugcucaagauuauccacgaaaaauauaagacuaauaagaaaguuguggacccuauugucucuaacuucuuacagucguuugaaaccgccaucgagcauaauaaggagguggaaccacugcuugggcgggcacaggagaacuugaauccccugguaguucuaaaccucuucaaacgcauaccugccgaagaugugccacugcuucugaugaaucccgaggcuggaaagccuucagacuugauucucacaagacuguuagucccaccgcugugcaucaggcccagcguggugagugaucucaaauccgguaccaacgaagacgaucuuacuaugaagcugacagagauuaucuuuuugaaugacgucaucaagaaacaccggauuucuggcgcaaagacccagaugauaauggaggacugggauuuccuacaacugcagugcgcccucuacaucaacagcgaacuguccgggauuccucuuaauauggcucccaaaaaguggacgcgcggauuuguucagcgacugaaaggcaagcaagguagauucagggggaacuugucaggaaagcggguggacuuuaguggccguacuguaaucagcccagauccuaaccuccgcauagacgagguggccgucccagugcacguugcgaaaauucugaccuuccccgaaaaggugaauaaagcaaacaucaauuucuuaagaaagcugguccagaacggcccggaggugcauccuggggccaauuuuauccagcagaggcacacacaaaugaaacgguuccuaaaguacggaaaccgagaaaagauggcucaggagcucaaauauggugauauuguagagcgccaucugaucgacggcgauguugugcuuuuuaauagacagcccucuuugcacaagcuguccauuauggcccaucucgcaagggucaaaccacaccggacuuuccgcuuuaacgaaugugugugcaccccuuacaaugcugacuucgauggggacgagaugaaccugcaccuuccccagacagaagaggccaaggcggaagcccuggucuugaugggaaccaaagcaaaucucgugacgccaagaaacggcgagccccugauagcugccauccaagacuuuuuaacuggugcuuaucugcuaacacucaaggauaccuucuuugacagggccaaagcaugucagauuaucgccucaauccugguugggaaggaugagaagauuaaagugcgucuuccuccaccgacuauauugaagcccguaacacuguggaccggcaaacagaucuucagcgucauucuccggccuagugacgauaauccagugcgagcuaaccugagaacgaagggaaaacaguacugcggcaagggggaagacuuaugugcgaaugauucuuauguuaccauccaaaacuccgagcugaugagcggaucgauggacaaggguacacuuggcucuggguccaaaaacaauaucuuuuacauuuugcucagggauuggggacagaacgaagcagccgacgcuaugucacgccuggcccggcuagcacccguguaucugaguaauagaggcuucagcauagguaucggggaugucacuccuggccagggacuccugaaggccaaauacgagcuuuugaacgcuggcuacaagaaaugcgacgaguauauugaagcccugaauaccgggaaguuacagcaacagccaggauguacagcagaggaaacucucgaggcgcugauccuuaaggaacuguccgugauuagggaucaugcugguucugccugcuugcgcgagcucgacaaaagcaacucaccccugaccauggcacuauguggcaguaagggguccuuuaucaauauaagccagaugauugccugcguaggacaacaggcuaucucuggcucacgagugccggaugguuucgagaaccggagucugccucacuucgaaaaacauagcaagcucccagccgcaaaaggguuuguugcuaauuccuucuacucuggccugacacccaccgaguuuuucuuucacacuauggccggacgugaaggccuugucgacacggcggugaagacagccgagaccggguauaugcagagaagguuggugaagucgcuggaagacuuauguagccaguacgaucucacuguccgcuccucaaccggagacauuauccaauucauauauggcggugaugggcuggacccugcugcaauggagggaaaagaugagccccuugaauuuaagcggguucuggacaacaucaaagccguguucccaugcccuagugagcccgcucuaucuaagaaugaacucauucugacaaccgagagcaucaugaaaaaguccgaauuuuugugcugucaggauucauuccugcaggagauuaaaaaguuuaucaagggcgugagcgagaaaauaaagaaaacuagagacaaguacgguauuaacgauaauggcacaacggaaccaaggguauuauaucagcucgaccgaaucaccccgacucaagucgagaaauuccuggaaacaugccgcgauaaguacaugcgggcccagauggagccugggucugcagugggagcgcuuugugcccaguccaucggcgagcccgggacccagaugacacugaagacuuuucacuucgcuggaguugccaguaugaacauuaccuugggcgugccaagaaucaaagaaauuauaaaugcaagcaaggcuaucucuacgcccauuaucaccgcccaacucgacaaagaugacgacgcagauuacgccaggcuggucaagggucguauugagaaaacacuacugggggaaaucuccgaguauauagaagagguguuccuuccugacgauugcuuuauccucguuaagcugucauuggagcgcauucggcuguuaagacucgaagugaacgcugagacuguaagguacaguaucuguaccagcaagcugcgagucaaaccaggagacguggcggugcauggcgaagccgucguuugcgugacaccccgggagaacucgaaguccucuauguauuacguacuucaguuccugaaagaagauuugccuaagguggucgugcaggguauuccggagguuagccgcgcagugauccacauagacgagcaaucaggcaaagaaaaguauaagcuccuggucgagggggauaaucuaagagcugugauggccacucauggaguuaaaggcaccaggacgacaaguaacaauaccuacgaaguggagaagacucuggggauugaagccgcucggacaaccaucaucaacgagauucaguauacuauggucaaucacggaauguccauagaccgaagacauguaaugcuucucucugaucugaugaccuacaaaggcgagguguuggguaucacacgcuuuggguuagcaaagaugaaagaaagcguucugaugcucgccuccuucgagaagacggcggaccaccuguuugaugcugccuacuucggacagaaggacucaguguguggcgucagcgaaugcauuaucauggguauuccaaugaacaucggcaccgggcuuuuuaaacuguugcacaaggcagacagggaucccaauccuccaaaacguccccuaauauucgacacuaacgaguuucauaucccucuggugacauga

SEQ ID NO: 60960 - RNA, 3228 nt, Artificial Sequence
  derived and/or modified sequence opt3 from POLR3B__Homo_sapiens__NP_001154180
augaaggccaacgagaaagugaccagcgacgcugaucccaugugguaccugaaguaucucaauaucuacgucggccuuccugacguugaagaguccuucaacgugacaagaccaguaucuccgcacgaaugcaggcugcgggauaugacuuauucagcacccauuacgguggacauagaguacacccgcgggagucagcgaaucauucguaaugccuugccuaucggaagaaugccaauuauguuaaggagcuccaacuguguccugacagguaaaacucccgcggaauuugcuaagcuaaaugagugcccucucgauccaggcggguauuucaucgugaaaggaguugagaaggugauacugauccaagaacagcuuucuaagaaccggauuaucgucgaggccgaccgcaaaggcgcagugggugccucgguaaccucaagcacacaugaaaagaaaaguagaaccaauauggcuguuaagcaggggagguuuuaccugcggcacaacacuuuguccgaggauauucccaucgugauaauuuucaaagcaaugggagucgagucugaccaggaaaucgugcaaaugauuggcacagaggaacaugugauggccgcuuuuggcccuagccucgaggaaugucagaaggcccagaucuucacccagaugcaagcgcugaaguauaucgggaauaaaguccgccgacagagaauguggggagguggcccaaagaaaacgaagauugaggaggcaagggaacugcucgccuccacuauauuaacccacguuccggugaaagaguuuaacuuccgggcuaagugcaucuacacagccguaauggugcgucgcgucauucuggcacagggggauaauaaaguggacgauagagacuacuauggaaacaagaggcuugaauuggcuggccagcugcuaucacuccuguuugaggaucuuuucaagaaauuuaauagugaaaugaagaaaaucgccgaccaaguuauacccaagcagcgggcggcccaguucgacguggucaaacauaugcgacaagaucagauuacuaacgguauggugaaugcaaucagcaccgggaacuggucucugaagcgcuuuaagauggacagacagggaguaacacagguuuuguccaggcucucauacaucagcgcucugggcaugaugacccggauuaguucucaauucgagaaaacgcgcaagguguccggcccuaggagcuuacagccaucgcagugggggaugcugugucccucugauacuccugagggagaagccugcggucucgucaaaaaccuugcucugaugacacacaucaccacugacauggaggauggcccaauugugaaguuggccuccaaucuaggggucgaagacgugaaccugcucuguggagaggaacugucauaucccaauguuuuccuuguguuucugaacggcaauauauuggguguaaucagagaucacaaaaagcucgucaacacauuccgucugaugcggcgagcaggguacauuaaugaguuugugaguaucagcaccaacuuaacggacagaugcguuuauaucuccucugauggcggaaggcugugucgcccguacauuauagugaagaaacagaagccugccgucaccaauaaacauauggaggaacuagcucaaggcuaucggaacuucgaggacuuucuccacgaaagccugguggaguaccuugauguaaaugaggaaaacgacugcaauaucgcguuguacgagcauacaauuaacaaggacacuacccaccuggaaaucgagcccuucacacuccugggggugugugcaggacuuauuccauauccucaccauaaucagucacccagaaacacuuaccagugcgccauggguaaacaggcuaugggcaccaucggguauaaccaaaggaaucgcauagauacacugauguacuugcucgccuauccacagaagcccaugguuaagaccaaaacuaucgaacugauugaguuugagaaguuaccugcaggacagaacgccacggucgcugugaugaguuacuccggcuaugacaucgaagaugcccuggugcuaaauaaagcaagccucgaccgagguuucgggcggugccuggucuacaagaacgcgaaauguacacuuaagcguuacaccaaucagacuuuugauaaaguuaugggcccaauguuggacgcugccaccagaaagccgauuuggaggcacgagauccuggaugcagacggaauaugcucucccggcgaaaagguggagaacaaacaagugcucguaaauaagucaaugccuacagucacccagauuccacuggaagggaguaacgugccccagcaaccucaguauaaagauguuccaaucacuuacaagggagccacagacagcuauauugagaaagugaugaucuccucuaaugcugaggaugccuucuuaauaaagaugcugcuucgccagacgcggagacccgaaaucggugacaaguuuucgagcaggcauggccagaaaggggucuguggauugauugugccgcaagaggauaugccuuucugcgacuccggcaucuguccagacauuaucaugaacccccacgguuuuccuucacgaaugaccguugggaagcucauagaacugcuagcaggcaaagcuggagugcuggauggccgcuuccauuacgggacugccuucggaggcaguaagguaaaagacgucugcgaggaucucgugcggcacgguuauaauuaccuggggaaggacuaugugacaucuggaauuaccggcgaaccccuugaggcguacaucuacuuugguccagucuauuaccagaaguugaaacacaugguucuggauaagaugcaugccagagcuaggggcccucgugcaguguuaacacgccagcccacugaggggcggagcagagacggaggccucaggcugggggaaauggagcgagauugucuuaucggauauggcgccuccaugcuguugcucgaacggcugaugauuucaagcgacgcuuucgagguagaugugugcggucagugugggcuacugggauacucuggcuggugccacuauuguaaauccaguugccaugucagcucucuccgcaucccauacgccugcaagcugcuuuuucaagaguugcaguccaugaacauuauaccgagacugaaauuaucaaaguauaaugaauga

SEQ ID NO: 60961 - RNA, 2064 nt, Artificial Sequence
  derived and/or modified sequence opt3 from POLR3E__Homo_sapiens__NP_001244962
auggccaacgaggaagacgaucccgugguccaggagaucgacguuuaccuggcuaagagccucgcagaaaaacuuuaucuguuccaauacccugugagaccagccuccaugaccuaugaugacauuccgcacuugucugcgaagauaaaacccaagcagcagaaaguagaguuagaaauggcuaucgauacacugaauccuaacuacugcaggucaaagggcgagcagauugcccuaaauguggacggggcaugugccgaugagacuucuacguauagcuccaagcucauggacaaacaaaccuuuugcaguucgcagacaacuucaaacaccagccgguacgcugcagcccuguaucgccagggagaacuucaucugacaccauugcacgguauccuccagcugcgacccaguuucuccuaccuggauaaggcugacgccaaacaucgugagagagaagcggcaaaugaggccggcgauucuagccaagacgaggcugaagaugacgucaagcagauuaccgugagguuuucccggccugagucagaacaggcccgccagagaaggguucaaaguuacgaguuccuccagaaaaagcacgcagaggaaccaugggugcauuuacacuauuacgggcugcgggacagccgcucugagcacgaacgacaguaucuuuugugucccggauccucaggcgucgagaacacugaacuggucaagagcccuagugaguaccuaaugaugcucaugccaccgucucaagaagaggagaaagauaagcccguagcuccuuccaauguucugagcauggcccagcuuagaacacugccauuggcggaccagaucaaaauacucaugaagaacgugaaagucaugcccuuugccaaucugaugucguuacuggguccuucuaucgauuccguggcagugcucagggggauucagaaggucgcuaugcuuguucaaggaaacugggugguaaaaucagacauccuguauccaaaggauaguagcuccccacauucuggcgugccggccgaagucuugugccggggccgugacuucgugauguggaaguuuacccagagccgcuggguugugagaaaagaggucgcuacggugacuaagcuaugugccgaagauguaaaagacuuccuggagcacauggcaguugugaggauuaauaaggggugggaauuuauccucccuuacgauggagaguucauuaaaaagcaucccgacgucgugcagcggcagcacaugcuguggaccgguauacaagccaaacuugagaaagucuauaaccuggugaaggaaacaaugcccaaaaagccugaugcucagucaggccccgcgggguugguuugcggagaccagcgaauccagguggcaaaaacuaaggcccaacagaaucacgcucuccuggagcgcgaauuacagagaaggaaggagcagcugcggguaccagccgugcccccuggcgugcgcauuaaagaggaaccaguuagugaggaaggugaggaagacgaggagcaagaagcagaggaggaaccgauggauaccucccccagcgggcuacauucuaagcucgccaacggacugccucuuggcagagcugccggcacagacucauuuaaugggcacccaccccagggaugugcaaguaccccuguggcgagggaauugaaggcuuucgucgaggccacguuucagcgucaauucgugcugacucucagcgagcugaagcggcuuuucaaccugcauuuggcaucccucccacccggucacacacuguuuucuggcaucucggaucgaauguuacaggacaccguacuggccgcugggugcaaacagauccuagugccguucccuccacagacugccgcaagccccgaugaacaaaagguuuuugcucucugggaguccggagacaugucagaucagaguagacugacacaggaauguggcgaggaccuuucuaagcaggaagucgauaaaguguugaaggacugcugugugagcuacggugggaugugguaccugaaaggcaccguccaauccuga

SEQ ID NO: 60962 - RNA, 327 nt, Artificial Sequence
  derived and/or modified sequence opt3 from POLR3K__Homo_sapiens__NP_057394
augcuccuguucugccccggcugugggaacggacuuaucguggaggaaggucagagaugccacagguuugccuguaauaccugcccuuacguccauaacauuacacggaagguuacuaaucgcaaauauccaaagcugaaagagguggacgauguauugggcggggcugcagccugggaaaacguggacagcacggcggaguccuguccgaagugcgaacacccccgagcuuacuucaugcaauuacagacccguucugccgaugagccuaugacaacuuuuuauaaauguugcaaugcacaguguggacauagauggagggacuga

SEQ ID NO: 60963 - RNA, 3693 nt, Artificial Sequence
  derived and/or modified sequence opt3 from POLRMT__Homo_sapiens__NP_005026
augagcgcccugugcuggggcagaggggcugcaggacucaagagggcccuucggcccuguggucgcccuggccugccagggaaagagggaaccgcgggcggugugugcgggccgcgacguuccucuucagcuaguccccaggaacaagaccaggauagaaggaaggacuggggacacgucgaguuguuagaaguucugcaggcccgggugcgccagcuacaagcagagagcguauccgaaguggucgugaacagaguugauguggccaggcucccugaguguggcucuggcgacgggucgcugcagccaccccggaaaguccagaugggagcuaaggaugcaacaccugugccaugcggucgcugggccaaaauccuugagaaggacaagcgaacucagcaaaugagaaugcagaggcugaaagcuaaguugcagaugcccuuccagucaggcgaauuuaaagcccucacgcggcgucugcaaguagagccucgccugcucagcaagcagauggcgggguguuuagaagauugcaccagacaggcaccagagaguccgugggaggaacaacuggccaggcuuuugcaggaggcucccggaaaacugucccuagacguugaacaggccccuucuggccagcauagccaagcacagcucuccggucagcagcaacggcugcuugcuuucuuuaaguguugccuguugacagaucagcucccacuggcccaccauuuacuggugguccaccaugggcagcgacagaagcgcaaacuccuuacucuggacauguacaaugcggugauguugggaugggccagacaaggcgcauucaaggagcuaguguauguccuguuuaugguuaaagaugcuggccucacccccgaccugcuuucauacgccgcugcccugcaguguauggggaggcaggaucaggacgcaggaacaauugaacggugcuuggagcaaaugagucaggagggucucaagcugcaggccuuauucaccgcugugcugcuaagcgaagaggaccgcgcgacuguacucaaagcagugcacaaggucaaaccuacauuuucucugccaccccaacuuccgccucccgugaacaccuccaaguugcugagagauguuuaugccaaggacggcagggugucauacccaaaacuccaucugccucuuaagacgcugcaguguuuguucgaaaaacagcuccacauggagcuggcuagccgugucugcgugguaaguguugaaaagcccacuuuaccaucuaaagaggugaagcacgcccggaagacccugaaaacacuacgagaucagugggagaaggcacucugcagagcccugagggaaacuaaaaaucgccuugagcgggaagucuaugaggggagauuuuccuuguaccccuuccugugucuccuggacgaaagggaggugguccgcauguuacugcaagugcuucaggcuuugccugcccagggagagagcuuuaccacacucgcacgagaacugucggcgcggaccuucucucgucauguugugcagagacaaaggguauccggccagguccaggcucuacagaaccacuaucgcaaguaccugugccuccuggccucagaugcagaggugccagaaccgugucuuccccggcaauacugggaggaguugggugccccugaagcucugagagagcagccauggcccuuaccuguucagauggaacucgggaaacugcuugccgagaugcuggugcaagcaacgcagaugccaugcaguuuggacaagccccacaggagcucccgacucgucccggugcuguaucauguauacucuuuucgcaaugugcagcagauaggcauccuaaagccucacccagcuuauguucaacugcucgaaaaagccgcggagcccacucugacauucgaggccgucgaugugccuaugcuuugucccccauugccuuggaccagcccccauucaggagcuuuccuguuaaguccaacuaagcucaugcggacaguggaaggcgcaacccagcaccaggagcugcuugaaacgugcccgccuaccgcccugcauggggcucuagacgcccucacacagcugggaaacugugcauggagagucaaugguaggguuuuggaucugguguuacaacucuuucaggcgaaaggcugcccccagcugggggugccagcucccccuuccgaggccccacagcccccugaagcccaccuuccgcacagcgcagcuccagcccguaaggcagagcugcgccgggaguuggcccauugucaaaaaguagcuagagaaaugcacucucucagggcggaggcccuguaccgacuaucacuggcacagcaucuucgggaccgcgucuucuggcucccccacaacauggauuuuagaggaaggacuuauccuugcccaccccacuucaaucaucugggcagugacguggcucgggccuugcuggaauuugcccagggucgaccuuuagggccgcacggccucgacuggcugaagauucaucuuguuaaccugaccggauugaagaaaagagagccccuccgcaagaggcuggcuuucgcagaagaggugauggaugacauccuagauagcgccgaccagccacugacaggccguaaaugguggaugggggcggaggaaccuuggcaaacucuugcuuguugcauggaggucgccaaugcagugcgggccuccgaucccgcugcauacguuucucaccucccagugcaucaggacggaucgugcaacggucugcagcacuaugccgcguugggcagagauagcguaggggcugccuccgucaauuuagaaccuucagacgugccccaagauguguacaguggagucgcagcccagguugagguguuuaggcgccaggacgcucagcgaggcaugagaguagcccaagugcuggaggguuucauuacccggaaggucgugaaacagacaguuaugaccguggucuacggggugacuagguauggcggacgccuccagaucgaaaagcgucugagagagcuuucugauuuuccacaggaauuuguuugggaggcaagccacuaccuggugcggcaagucuuuaaauccuugcaggaaauguucucaggcacgagggcuauacagcauuggcuaacagagagcgcccgccugaucucucacaugggguccguaguggaguggguuaccccgcucggagugccugucauucagcccuaucgacuggacaguaaggugaagcaaaucggcggugggauucagagcaucacuuacacccauaacggagauauaucuagaaaaccaaauacacggaagcagaaaaacggcuuucccccuaacuucauucacucccuugacucaagucauaugauguuaaccgcgcugcacuguuauaggaagggucucacuuucguaagcgugcacgacugcuacuggacacaugccgcagaugucucgguuaugaaucaagugugucgcgaacaguuugugagauugcacuccgagccaauccugcaggaccucucuagguuccuggucaaacgguuuugcagcgaaccccagaagauucuugaggcuucacaacugaaggaaacguugcaggccgugccuaaaccgggcgcuuucgaucuagagcagguuaagcguaguaccuauuucuucuccuga

SEQ ID NO: 60964 - RNA, 3000 nt, Artificial Sequence
  derived and/or modified sequence opt3 from POM121__Homo_sapiens__NP_001244119
auggugugcagccccgucaccguuagaaucgccccuccagacaggcgguucucccgcucugcuauuccggagcagauaaucucaaguacacugagcucccccucuucgaacgcaccugauccaugugccaaggaaacugugcucucagcgcuuaaagagaaggagaaaaagcgaacgguagaagaagaggaccaaauuuuucuggauggccaggagaauaaacguagaaggcacgacagcaguggguccggacauucugcuuucgaacccuugguggccaacggugucccugcaaguuuugugccaaagcccggcuccuuaaagcgggggcuaaauucacagaguagcgaugaccaccugaacaaacgcucuagauccucaagcaugaguucucucaccggagccuacgcuuccggcaucccuagcucgucuaggaaugcaauuacauccucauauaguagcacucgggguaucucccagcuguggaagcgcaacgggccaucuagcucaccguucaguucccccgccagcucucgaucacaaaccccugagagaccagcuaaaaagauaagggaagaggagcuuugccaucacaguagcuccucuacaccccuggccgcggaucgggaaucgcagggagagaaagcagccgacaccacuccucguaagaagcagaauagcaacucccagucaacaccaggcaguucuggccaacgcaaaagaaagguucaguugcuccccagcaggcgaggggaacagcugacccugccgccucccccacagcucggauacuccaucacggcugaggauuuagaccuggagaaaaaggccucacuucaaugguuuaaucaggcauuggaagauaaaagcgacgcugccucuaacuccgugacugagaccccucccauuacacagccaaguuucacuuuuacccugcccgcggccgccccugcuagcccaccgacaucucuacucgcccccuccaccaauccucugcuugaaucacugaagaaaaugcaaacgccacccaguuugccuccaugucccgagagcgcuggugccgcaacuacagaagcccucucgccgccuaagaccccaucccuguuacccccucugggccucucucagagcgggcccccaggacuucugccuucacccaguuucgauuccaagccaccgacuacauugcuaggccugaucccugcucccucuauggucccagcgaccgacacgaaagcacccccuacccuccaggccgagacagcuacuaagccacaggccaccagcgcacccuccccugccccgaaacaaucauuucuguucgguacacagaacacuagcccaaguucucccgcugccccugcagcguccagcgcuccacccauguuuaagccuauuuucaccgccccgcccaaaucggaaaaggaggggccaacaccucccggaccaucagugaccgcaacugccccuucuaguuccagccuucccacgacaaccucuacuaccgcuccaacauuucagccgguauucagcuccaugggcccucccgccucaguuccacugcccgcaccuuucuuuaagcagaccacuacaccagcuacggcccccaccacuacagcgccuuuguucaccggccucgccagugcuacaagcgcaguggccccgaucacuucugcuuccccaucaaccgacagugccagcaaacccgcauuuggguucggaauaaauuccgucucuucgagcucaguguccacgaccacaaguacugcgaccgccgcuucucaaccuuuucuguucggugcaccccaggcaagcgcugccuccuuuacaccagcaaugggcucaauuuuccaguuugggaagccucccgccuuaccaacuaccacgacagugaccacuuucucucagagccugcauacagcugucccuaccgcgacuagcuccagcgccgcagauuuuucuggauucggcucaacccuagcuacauccgccccggccacgaguagccaacccacccucacuuuuucgaacacaucuaccccaacauucaauaucccuuucgguuccagcgcuaaaucaccccugccaaguuauccuggggcaaacccccagccggccuuuggcgcggcugagggacagccaccuggcgccgcaaagcccgcccuugcuccaucuuucggguccagcuuuacuuucggaaacucagcagcccccgcggcugccccuaccccggcacccccaaguaugauuaaaguugugccugccuacguacccacgccuauccacccaaucuuugguggcgcuacacacagcgccuucggguugaaggcaaccgcuuccgccuuuggagcgcccgccucuagccagccugcauucggcgguuccacugcuguguuuuucggggccgcuaccucaucuggcuuuggagcaacaacucaaaccgccaguucgggcagcuccucuucagucuucgggagcacaacgccaucccccuuuaccuucggagguagugccgcuccggcgggcucugggagcuucggaauuaauguggcaacuccuggcucauccacaaccacuggugccuuuaguuucggggcuggccagagcggaucuacagccaccuccacgccauuugcaggcgggcugggacagaacgcccucggcacuaccggucaaucaacacccuucgcuuuuaauguuagcucgaccacugaaucuaagccuguguucgggggaacagcgaccccaacauuuggccugaacacucccgccccgggugucggcaccaguggguccagccuuucauucggagcauccucugcuccugcccagggcuuuguggggguagcacccuucggaaauacguuugcccaucagcaggagcacagcccacggaaaggcccuaacaaucugaguaagcgcaaauugcuccccgcuguuagagcccaaggucugccaaggcgggggcaggcguccagcuuccccacacgcaaggaauga

SEQ ID NO: 60965 - RNA, 804 nt, Artificial Sequence
  derived and/or modified sequence opt3 from POMC__Homo_sapiens__NP_001306134
augcccagaagcugcuguuccaggucuggcgcccugcuccuugcucuguuguuacaggcaucaauggaggugcggggguggugccuggaaaguagccaaugucaggaccuaaccacagaguccaaccuccuggaaugcauccgcgccuguaagccugaucuuucugcggagacuccaauguucccgggaaauggugacgaacagccccugacggagaacccucgaaaauacgucaugggccacuuucguugggauagauucgggaggcgcaauucgucaagcaguggauccucuggcgcuggucagaagcgggaggacguuagcgccggggaagauugcggaccauugcccgagggcggcccugaaccaagauccgacggggcaaaacccggaccuagggaggguaagcggucauauaguauggagcauuuucgcuggggcaaaccaguggggaagaagcgaagaccgguaaaaguguaccccaacggagccgaagaugagagcgcugaagcauucccucucgaguuuaagagggaacugaccggccaacggcugcgugagggugacgggccagauggacccgccgacgauggcgcuggcgcccaggcggaccucgagcacucuuuacuggucgcagccgagaaaaaggaugaggggccuuaucgcauggaacauuucagauggggauccccacccaaagacaagagguacgguggcuuuaugacaucagaaaagagccagacuccgcuugugaccuuguucaaaaaugcuauuauaaagaacgccuauaaaaagggggaauga

SEQ ID NO: 60966 - RNA, 1554 nt, Artificial Sequence
  derived and/or modified sequence opt3 from POMGNT1__Homo_sapiens__NP_001277059
auggccaagagaguguucgacaccuacagcccccacgaggaugaagcuaugguccuguuucucaacaugguugcaccuggcagggugcuuaucugcacaguaaaagacgagggguccuuccaucugaaggauacugccaaagcguuguuacggucucugggaucacaggcugguccagcccuaggcuggcgcgacacgugggcauuuguggggcgaaagggaggcccggucuucggugaaaaacacaguaagagccccgcccucuccucuuggggagauccugugcugcuuaagaccgacguuccacugucgucagcugaggaagcagagugucauugggccgauacagaguugaaucguagaaggcggcgcuuuugcagcaaaguggaaggguauggcagugucuguuccugcaaggaccccacuccuauugaguucucuccagauccccucccugacaacaaagugcugaauguaccaguugcugugauagccggcaacagaccgaauuaccuguauaggaugcuccggagcuuacuguccgcgcaaggggucucaccccagaugaucaccguguuuauugauggauacuaugaagaaccuauggacguggucgcacuuuucgguuugcgcggcauccagcacacaccaauuaguaucaagaacgcccgaguuagccagcauuacaaggcuucucugaccgccacuuuuaaucuauuccccgaggcaaaauuugcugugguacucgaagaggaucuggacauagccguggacuucuuuuccuuccuuucacaaagcauccaccuguuggaagaggaugacagucucuauuguauuucugcguggaacgaucagggguacgaacacacagccgaggacccugcacuguuauacagagucgagaccaugccaggacugggcugggugcucaggcggucccuuuauaaggaggagcuggaacccaaauggccgacgccugagaaguugugggauugggacauguggaugcguaugcccgaacagcgcagagguagggagugcaucauuccagauguuagccggucguaccauuucgggaucgugggacuaaauaugaacggcuauuuucacgaggcuuacuucaaaaagcauaaauuuaauacugucccuggcgugcagcugcgaaacguagacucucucaagaaagaagccuaugagguugaagugcaccgccugcuuuccgaggcugaaguccuggaucacucaaagaaucccugugaggacaguuucuugccagauaccgaggggcauacauacguggccuuuauaagaauggaaaaggacgacgauuucacuaccuggacacaacucgcaaaaugccugcacauuugggacuuagaugucaggggaaaccaucggggucuguggcgccuauuuagaaagaaaaaucacuuccucgugguuggcgugcccgccagcccuuauuccguaaagaaaccaccgucugucacccccaucuuucuggagccuccacccaaggaagagggggcuccuggagcgccagagcagacguga

SEQ ID NO: 60967 - RNA, 1743 nt, Artificial Sequence
  derived and/or modified sequence opt3 from POMGNT2__Homo_sapiens__NP_116195
augcaccugagcgccguguucaacgcucuccuugucuccguucuggcagccguguuguggaagcauguaagauuaagggagcacgcggcuacccuggaagaggaacuagcccucucucggcaggcaacagagcccgccccugcucugcgcaucgacuacccaaaagcacuucaaauucugauggaaggcgggacucauauggugugcacgggacgaacccacacagaucguauauguagauuuaagugguugugcuauucaaaugaggccgaggaguucaucuuuuuccaugguaacaccagugucaugcucccgaaucugggcagcaggcgguuucagcccgcucugcucgacuuauccacuguggaagaucacaacacacaguacuucaauuuuguugaacugccugccgcggcacuucgcuucaugccaaaacccguguuugucccugacguggccuugauugcuaacagauucaauccagauaaccugaugcacguauuucaugacgaucuacucccccuguucuauacccuuaggcaguuuccugggcuggcccacgaggcacgguuguucuucauggagggauggggcgaaggugcucauuuugaccucuacaagcuguuaucuccaaaacaaccgcugcuccgcgcccagcuuaagacucuggggcgauugcuauguuucucgcacgcguuuguuggacugucaaagaucacaaccugguaucaguacggcuucgugcagccccaaggcccuaaagccaauauucucgucagcgggaacgagaucagacaguuugcaagguucaugacggaaaagcugaaugugagucacacuggagugccacuuggugaggaauauauacuggucuuuucccggacccagaaccguuugauccucaaugaggcugagcuguuacuggcccuagcucaggaguuccaaaugaaaacaguuacugugucucucgaagaucauaccuuugccgacguagugcgccuggucagcaacgcauccaugcuugugucaaugcacggcgcccaguugguuacaacccuguuccuccccagaggggcuacgguggucgaacuguuuccuuacgcggugaauccagaucauuacacucccuauaagacacuugcaaugcugccgggaauggacuugcaguacguagccuggaggaacaugaugccugagaacaccguuacucaccccgaacggccaugggaucaaggcgguauuacacaucucgaccgagcugagcaggcccgcauccugcagaguagagaggugccuaggcacuuaugcugucggaaucccgaauggcuguuccgcauuuaucaggacaccaaagucgauaucccaagccuaauacaaacgauuagaaggguggucaaggggcgucccggaccucggaagcagaaauggaccgugggccucuacccaggcaagguucgagaggcaagaugccaggccucugugcacggggcuuccgaagccaggcugacaguaucauggcagaucccguggaaccuuaaauauuugaagguccgcgaggugaaauacgaaguuuggcugcaagagcagggagagaauacuuaugugcccuacauucucgcacugcagaaccauaccuuuacagaaaauaucaagccuuucacuaccuacuuagucugggugcgguguaucuucaacaaaauucugcuugguccauuugcggacguauuggugugcaauacauga

SEQ ID NO: 60968 - RNA, 1053 nt, Artificial Sequence
  derived and/or modified sequence opt3 from POMK__Homo_sapiens__NP_115613
auggagaagcagccccaaaacagcagaaggggccuggccccucgggaagugccaccggcugucgggcuccuucugaucauggcauugaugaauaccuuacuguaccuaugccucgaccacuucuuuauugcgccccgccaguccacaguugauccuacucauuguccauauggacacuuccgaauaggucagaugaaaaacugcucucccuggcugucaugugaggaacuucguacggaggugagacagcugaagaggguaggcgaaggggccgugaaacgggucuuuuugagugaguggaaggagcauaaaguggcucucagccaacugaccucccuggaaaugaaggacgauuuccuccacggauuacagaugcugaagucucuucagggcacacauguugugacuuugcuggguuacugcgaggacgauaauaccaugcuaacagaauaucacccucucgggucgcugucaaaccuugaggagacccugaauuugagcaaauaccagaacgucaauacuuggcaacaccgccucgaacuggccauggacuaugugaguaucauuaacuacuuacaucacuccccaguaggaacaagaguuaugugugauucuaaugaccugcccaagacccucagccaguaucuucugacguccaacuuuucaaucuuggcaaaugaucuagacgcccugccucucgugaaccauaguagcggcaugcuggucaaaugcggccacagggagcuucacggggauuucguggcuccagaacagcuguggccguacggagaggacgugcccuuucaugaugacuugaugccuucuuacgacgaaaagauugauaucuggaaaauaccagacaucuccucauuccuccugggucacauugagggcagcgauaugguccgguuucauuuauucgacauccacaaggcauguaagagucagacucccucugagcgcccuaccgcccaagauguucuggaaacauaucagaaagugcuagacacucuccgagaugcuaugaugucccaggccagagagaugcuguga

SEQ ID NO: 60969 - RNA, 426 nt, Artificial Sequence
  derived and/or modified sequence opt3 from POMP__Homo_sapiens__NP_057016
augaacgccagaggccuggggagcgagcucaaggacuccauccccgugaccgaacuuucugcuucaggaccuuucgagagucacgaucuguugaggaaagguuuuagcugcgucaagaaugaauuacugccaucccauccgcuagagcucucugagaaaaacuuccagcugaaucaagacaagaugaacuuuucgacacuucggaauauucagggccuguucgcacccuugaaacuccagauggaauuuaaggccguucagcaagugcagcgccugccuuuccugucaagcaguaaccucuccuuagauguacugcgagggaaugacgagacuauaggauuugaagauauccuuaacgacccaucucagagcgaggugaugggcgaaccccacuugauggucgaguacaagcugggucuacucuga

SEQ ID NO: 60970 - RNA, 2016 nt, Artificial Sequence
  derived and/or modified sequence opt3 from POMT1__Homo_sapiens__NP_001070834
augaagcagaucuucuuucuggacgauagcggcccuccuuucgggcacauggugcucgcccuuggagguuaccugggcggguuugacggaaacuucuuguggaauagaauuggcgcugaguauuccucuaacgucccaguuuggucauuaaggcugcuaccggcacucgccggugcgcugagugugcccauggcuuaccaaauaguacuugaacugcauuuuagccacugcgccgcaaugggggccgcuuugcucaugcugaucgagaaugcacugauuacccagucccggcucauguuacuggaaucugugcuuaucuucuuuaacuugcuggccguccuaucguaucucaaauucuuuaauugucagaagcauucaccuuucagccugaguuggugguuuuggcuuacacugacuggaguggcuugcuccugugccguuggcauuaaauacaugggcguguucacguaugucuuggugcucgggguagcggcaguucacgccuggcaucuguuaggagaucagacccugucuaacgugugcgucuuuugucaccuccuugcucgcgccguggcacuguuggugaucccagucguucuauaccuccuguucuucuaugugcaccugauacuuguauuucgaagcgguccccaugaccaaaucauguccucagcuuuccaggccagucuggagggcggguuggcgcguauuacacagggacagccucucgaaguggccuuuggcagccaagucacucugagaaauguguucgguaagccaguucccugcugguuacacucucaucaggauaccuacccuaugaucuacgagaacgggaggggauccucacaccagcagcaagugacauguuauccauuuaaagacgucaauaacugguggauugugaaggauccgcggcgccaccagcugguaguuagcagucccccuagaccagugaggcauggcgacaugguccagcuagugcacggcaugaccacucggucucucaauacacaugaugucgcagcuccccuguccccucacagccaagaggugucgugcuacaucgacuauaacauaucuaugccagcccagaaucuuuggcgcuuggaaauuguuaaccgaggguccgauaccgacguguggaagacgauccugucagagguaagauucguccaugugaauaccagugcuguucucaaacugagcggagcccaccuucccgauugggguuacaggcagcuggaaauugugggcgagaaguugucccggggguaucacggaucuacugucuggaacguggaggaacaucguuacggcgcaagccaggagcaacgcgaaagagagagggaacuccacucaccggcccagguagacgugagucggaaccuguccuuuauggcucgauucagcgaguuacaguggcgcaugcuggcgcuaagaucugacgauucagagcauaaauauaguagcuccccucucgaauggguuacacuggacacuaauaucgcauacuggcuucaccccaggaccucugcccagauccacuugcuggguaacauugucauaugggugucggggagccucgcucuggccaucuacgcauuacugucccuuugguauuugcuccggcgcagaaggaaugugcaugaucugccacaagacgccuggcuacguuggguccuggcuggcgcccucugugcaggaggcugggcgguuaacuaccugcccuuuuuccuuauggagaagacauuguuucuguaucacuacuuacccgcucucaccuuccagauucugcuucugccagugguguugcagcauaucucagaucaccucugccggagucagcugcaacgaucuauauuuagcgcccuaguagucgcaugguauuccucagccugucaugugagcaauacgcugagaccccucacuuacggggacaaaucucuguccccucacgaacuuaaggcuuugagguggaaggauaguugggacauucugauccgcaaacacuga

SEQ ID NO: 60971 - RNA, 2253 nt, Artificial Sequence
  derived and/or modified sequence opt3 from POMT2__Homo_sapiens__NP_037514
augcccccugccaccggcgggggacuggcugagagcgaacucagaccaaggcggggucgcugcggcccgcaggcagcccgagcggcugggcgugacguggccgcagaggccgucgcuagaucccccaagaggccugcauggggaucucggcgcuucgaagccguuggcuggugggcucugcuggccuuggugacauuacugucauuugcgacuagauuccacaggcuagaugagccaccccauaucuguugggacgaaacgcacuuugguaaaauggggaguuacuauauuaaccggaccuucuuuuucgauguacauccuccacucggaaagaugcugauaggccuugcaggcuaccugagcggguaugacggaacauuuuuguuccaaaaacccggugauaaguacgagcaccauuccuauaugggcaugcgcggguuuugcgccuuccucggaucuuggcuggugccuuuugcuuaccugacuguccucgacuuaucgaaaucacugagcgccgcacuuuugaccgcugcccugcuaacauucgauaccggcugucucacucugagucaguauauccuucuggacccaauuuugauguuuuucaucauggcggccaugcucuccauggugaaguacaauucuugcgcagaucgaccguucagcgcucccuggugguuuuggcuguccuuaacagguguuucacuggccggggcucucggagugaaguucgucggccuuuuuauuauccuucaggugggcuugaacaccauagccgaccuaugguaccuguucggggaucucagucugagccuuguaacgguuggaaaacaccugacugcaagaguguugugucucaucguccugccuuuagcccuguauaccgcuacauuugcggugcacuucauggugcuaucuaaguccgguccaggcgacggguuuuucucaagcgcauuucaggccaggcucaguggaaauaaccugcauaaugcuucuauucccgagcaccuugccuacggcuccgucaucacuguuaaaaacuugcggauggcaauugguuaucugcauagccaccgucaccucuacccugaagggaucggcgcccgccaacaacaggugaccacauaucugcauaaggauuacaauaaccuuuggauaauuaaaaagcacaauaccaacucggacccacuggaccccucuuucccgguagaguuugugagacauggagauaucauuagguuggaacacaaggagacgucccggaaucuccauucacacuaucacgaggcuccuaugacucgaaaacauuaccaggucacaggcuacgggaucaacggaaccggugacaguaaugauuucuggcgcaucgaagugguuaacagaaaguuuggcaauaggauuaaagugcugcggagccgcauaagauucauccacuuagucacugggugcgugcugggauccucuggcaagguacuacccaaaugggguugggagcagcucgaaguuacauguaccccauaucugaaggagacgcuuaacagcauuuggaacguggaagaccauaucaauccuaaauugcccaacauaucacuggauguccuccagccaaguuuccccgagauucuguuagagucccacauggugaugaucagggggaauagcggccugaagccuaaggacaacgaauuuaccucuaaaccauggcacuggccgaucaauuaccagggacuucguuucucaggcgucaacgauacagacuuucggguguauuugcucgggaaucccguugugugguggcugaaccuacugaguauugcccucuaccugcuuagcggauccaucauugcaguagcgaugcagcgaggugcuagauugccugccgaggucgcaggccugucucaaguguuacuccgcgggggaggccagguucugcuugguuggacucugcauuauuucccauuuuucuugauggggagggugcucuacuuucaccauuauuuccccgccaugcuguuuucgagcaugcuaaccggcauacugugggauacacuccugcggcuuugcgcuuggggauuggccuccuggccucuggcaagaggcauccacgucgcugggauuuuaucacuccugcuuggaacugccuacaguuucuaccuguuucauccacuagcguauggcaugguggguccccucgcccaggacccgcaaucuccuauggcugggcugaggugguuggauagcugggacuucuga

SEQ ID NO: 60972 - RNA, 564 nt, Artificial Sequence
  derived and/or modified sequence opt3 from POMZP3__Homo_sapiens__NP_036362
auggugugcagccccgucacccugagaaucgccccuccagacaggcgguucucccgcucugcuauuccggagcagauaaucucaaguacacucagcucccccucuucgaacgcaccugauccaugugccaaggaaacuguucuuucagcgcugaaagagaagaaaaagaaacgaacgguggaagaggaagaccaaaucuuuuuggauggccaggagaauaagcguagcugcuuaguagacgggcugaccgaugcuaguuccgccuucaaggugcccagaccuggaccagacacacuacaguuuacugucgauguguuccacuuugcaaacgacucuaggaauaugauuuacauuaccugucaucucaaaguuacacuggccgagcaggaucccgacgaacuuaacaaggcuugcagcuucuccaaaccuucaaauaguugguuuccaguggagggucuggcagauaucugucaaugcuguaacaagggcgacugcgggaccccgagccacucucggcgccagcccagagucgugucccaguggucaacuagcgccaguuuguga

SEQ ID NO: 60973 - RNA, 1068 nt, Artificial Sequence
  derived and/or modified sequence opt3 from PON1__Homo_sapiens__NP_000437
auggccaagcugaucgcucucacccuucugggcaugggguuggcauuauucagaaaccaccagagcuccuaccaaacaaggcugaaugcccuacgggaggugcagcccgucgaacucccuaacugcaaucugguuaaaggaauugagacugguucugaagaccuugagauacugccaaacggcuuggcguuuaucucaagugggcucaaguauccgggaauuaagagcuucaaucccaacuccccuggcaagauccugcugauggaucucaaugaagaggacccaacgguguuagagcuggguauuaccgggucuaaauuugauguaucgucauucaacccccauggaaucagcacauuuacugacgaagauaaugcuauguaccuuuugguggucaaccacccugacgccaagaguaccguggagcuguucaaguuucaggaagaggagaaaucccuacuccaucugaagacaauacgccacaaacuucugccaaauuugaacgauaucguugcagugggccccgaacauuucuauggcaccaaugaccacuacuuucucgauccuuaucugcagucuugggagauguacuuagggcuggccuggagcuaugucguguacuacuccccaucagaaguacgaguuguggcugagggauucgacuuugcaaacgguauuaauaucaguccggauggcaaguaugucuacauugccgaacuccuugcucacaaaauccauguguaugagaagcacgccaacuggacucugacacccuugaaaagccuagacuucaacacccugguggauaauauaucugucgacccugagacgggggaccucuggguuggaugucauccaaacggcaugaaaaucuuuuucuacgauuccgaaaaucccccugcgucagaggugcugcguauucaaaacauucuuacugaggaaccaaagguaacccagguguaugcagaaaaugguacaguccugcaggggagcacuguggccaguguuuacaaaggaaaguugcucaucggcaccguguuccacaaagcucuguauugcgaguuauga

SEQ ID NO: 60974 - RNA, 1065 nt, Artificial Sequence
  derived and/or modified sequence opt3 from PON2__Homo_sapiens__NP_000296
augggcagacugguggccgucgggcuccuuggaaucgcucuggcauuguuaggugagaggcugcuagcccuccggaaccgccugaaggcgagccgagaaguugaguccguggaccuuccccacugccaucugauuaaaggcauagaagcugggucugaggauaucgacauuuugccuaauggacucgccuucuuuucaguaggccugaaguucccaggucugcacaguuuugcaccggauaaacccgggggaauccucaugauggacuuaaaggaagagaaaccucgugccagagagcugaggauuagccggggcuucgaucuugcuuccuuuaacccacauggcaucucuaccuucauagacaaugaugacacaguguacuuguuugucgugaaccaccccgaguucaagaauacuguugaaaucuuuaaguucgaagaggcagagaacucgcugcuacaucucaaaacggugaagcacgaacugcuuccuucagucaaugauauuaccgccguggggccagcucacuuuuaugccacaaacgaccauuacuucagcgaucccuuucugaaauauuuggagacuuaccucaaucugcacugggcgaacguaguuuauuacaguccuaaugaagugaaggucguggcagagggauucgacuccgccaacgguaucaauauuucuccagaugacaaauauaucuacguggcugacauauuagcccaugaaauucacguccuggagaagcacaccaacaugaaucucacacagcuuaagguucuggaguuggauacccuaguggacaaccugagcaucgauccguccucaggcgacauuuggguagggugucaucccaacggacaaaaacucuucguguacgauccuaauaacccacccaguagcgaaguccugcgcauccagaauauccuuucugagaagccuacugugacaaccguuuaugcaaacaauggcuccgugcugcaggguucaagcgucgcuaguguguacgacgggaaauugcucauuggaacgcuguaucacagagccuuauacugcgaacuguga

SEQ ID NO: 60975 - RNA, 1065 nt, Artificial Sequence
  derived and/or modified sequence opt3 from PON3__Homo_sapiens__NP_000931
augggcaagcugguggcccucguccuucuggggguuggauugagcuuagugggugagauguuccuggcuuuuagagaaaggguaaacgcaucccgggagguggaacccgucgagccugaaaauugccaccuaaucgaggagcucgaaucuggcucagaggacauugauauacugccaagugggcuugccuucaucagcuccggacugaaauacccgggcaugcccaacuuugcgccugacgaaccagguaagauuuucuugauggaucucaaugagcagaacccccgcgcucaagcccuggagaucucugggggauuugacaaagaacuguucaauccucauggcauuucgaucuuuauagauaaggacaacaccguguaucucuacguugugaaucacccacauaugaaaucaacagucgagaucuucaaguuugaggaacagcagcgaagccuuguguaucugaagacuauuaaacacgaacuuuugaagaguguaaacgauaucguugugcugggccccgagcaguucuacgcaacgcgugaccauuauuuuaccaauucccuacucucuuucuuugagaugauucuggaucuuagauggacauacguccuguucuauagcccuagggaagugaaaguggucgccaagggguucuguuccgcuaacggaaucacuguuucagcagaccaaaaauacguguacguagccgauguggcugccaagaauauacacauuauggagaagcacgacaacugggauuugacccagcucaaagucauccagcuggguacauuaguggacaaucugaccguugacccagcgacuggcgauauucucgcagggugccauccgaaccccaugaaguuacugaauuauaacccugaagacccacccggaagugagguguugcggauccagaacguccuaagcgaaaaaccucgcgugucuacaguauacgccaauaacggcuccguucugcaagguaccucaguggcuagcgucuaucacgggaagauccucauuggaacgguguuucauaaaacucuguacugugagcuuuga

SEQ ID NO: 60976 - RNA, 3075 nt, Artificial Sequence
  derived and/or modified sequence opt3 from POP1__Homo_sapiens__NP_001139332
augagcaacgccaaggagagaaaacacgcuaagaaaaugaggaaucagcccaccaacgugacacuguccucuggcuucgucgcagacagagggguuaagcaucacucaggaggugaaaaaccuuuucaagcccagaagcaggagccacauccgggcacuucacgccagcgacaaacgcgugugaauccccacagccucccugauccagaaguaaacgagcaguccucuucgaaggggauguuccggaaaaagggaggcuggaaagcgggucccgaagggaccucacaggagaucccuaaguacauuacagcuagcacuuuugcccaggcaagggccgcugagauaagugcaaugcuuaaagccgugacccaaaaguccucuaauagccuggucuuccagacauugccacggcauaugcgcagaagggcuaugucccacaacgugaagcgguuaccccgccgacugcaggaaaucgcccagaaagaggcggaaaaggcaguucaccagaaaaaggagcauaguaaaaauaagugccacaaagccagaaggugucauaugaaccggacccuagaguuuaaucgucgccaaaagaagaacauuuggcucgaaacucacaucuggcacgcuaaaagauuccauauggugaagaaauggggauauugccugggcgagaggccuacagucaagagucaccgggccuguuaccgagcaaugaccaaucgcugccuucugcaggacuugagcuauuacuguugccucgaacugaaaggcaaggaggaagagauucugaaggcucucucugggauguguaacaucgauacgggauuaacuuuugccgcggugcauugccuguccgguaaaagacaaggcucacuuguauuguauaggguuaauaaguacccacgggagaugcuggggccggugaccuucauauggaaaagccagcgcacacccggagacccuagugaaucuagacagcuauggaucuggcuccacccaacucugaagcaggauauucuugaggaaaucaaagccgcaugucaaugcgucgagcccauuaaguccgcuguguguaucgccgacccucugccaacccccagccaggaaaagucgcagacagaguugccggaugagaaaauaggcaagaaaaggaagcguaaagacgauggugaaaacgcuaagccuauuaagaaaaucauuggggacggaacccgggaucccugccucccauauucuuggaucuccccuacgacuggcaucauuauaucagaccugacaauggagaugaaucgauuuagauuaaucggcccccugagucauagcauucucaccgaagccaucaaggcagccuccgugcacacugucggggaggauacagaagagaccccacacaggugguggauagagacgugcaaaaagcccgacucuguuagccuucauugucgccaggaagcuauuuucgagcuguugggagguaucaccaguccugcggaaaucccagcaggcacaauucuagggcugacugugggagacccgcggaucaaccucccccagaaaaagucaaaagcccugccuaacccagagaagugccaagauaaugagaagguaagacagcuucuguuggaaggcgugcccgucgaguguacccacuccuuuauuuggaaccaggacauaugcaaaagcgugacagaaaauaagaucucugaucaagaccucaacaggaugcgcucagagcuguuaguuccugguagucagcugauucuagggccacaugaaagcaaaauccccauccuccugauucagcagccgggcaaggugacuggagaggaucgacuuggcuggggguccggaugggacgucuugcugccuaaagguuggggcauggcuuucuggauaccauuuaucuaccguggggugcggguaggaggccucaaggagucugccguucacucgcaauacaagagaagccccaaugugccuggugauuuccccgacuguccagcagggaugcuguucgccgaggaacaggcuaaaaaccuucuggaaaaguauaaaaggcgcccucccgccaagcggccaaauuacgucaaauugggcacccucgcaccguuuugcuguccuugggagcagcugacacaagauugggaauccagagugcaggcguaugaggagcccucagucgcuaguucuccaaacggaaaggaaagcgacuuaaggcgauccgaggugcccugcgccccuaugccaaagaaaacccaccagcccucagaugaaguuggcacuagcauugagcauccucgcgaagcagaggaggugauggacgccgggugucaggaaucugcuggaccggagcggaucacggaccaagaagccuccgagaaucacguagcagcuacagguagucaucugugcguccuaagaagcaggaagcuccugaaacagcuuucugccugguguggcccauccucagaggauagucgugggggacgccgggcgcccggcagaggucagcagggguugaccagggaagccugccugagcauucucggccacuucccucgagcucugguguggguuucguuaucccugcuuucuaagggaagcccagagccccauacuaugaucugcgugccugcaaaagaagacuuuuugcaacuccacgaggauuggcacuacuguggcccgcaggaaucaaagcauagugaccccuuccgguccaagauacugaaacagaaggagaaaaagaaacgcgagaagagacagaaaccagggagggccucuagcgauggaccugcuggcgaggaacccgucgccggucaagaagcacuaacccuggggcucugguccggaccacugccucgggugacacuucacugcucacgaaccuugcugggcuuuguaacucagggugacuucagcauggcggugggcuguggggaggccuuaggauuuguuagucucacaggccugcuugauaugcugucuucccagcccgcugcccaaagaggguugguccuccugcgcccaccggcaagccuacaguauagguucgcucguaucgccauugaaguguga

SEQ ID NO: 60977 - RNA, 663 nt, Artificial Sequence
  derived and/or modified sequence opt3 from POP4__Homo_sapiens__NP_006618
augaaaagcgugaucuaccacgcccugucccagaaggaggcuaacgacucugauguccaacccucaggcgcacagagagccgaagcguucguuagggcuuuucucaagcggaguaccccucgcaugagcccacaggcccgagaggaccagcuucaacguaaagcagugguacuggaauauuucacaagacauaagaggaaagagaagaagaaaaaggccaaaggguuguccgcucggcagcgcagagaauuaaggcuguuugauauuaagccggagcagcagcgguacucucuauuccucccccugcacgagcuuuggaaacaauauauacgcgaccugugcucgggauugaagccugauacucagccacagaugauccaggcaaagcuccugaaagccgaccugcauggugcuauuaucucagugaccaagagcaaaugucccaguuacgucggcauuacggggauccucuuacaagaaacaaagcacauauuuaaaaucauuacuaaggaggaucgacugaaagugaucccuaaacuuaauugcguuuucaccguggaaacagacggauuuauuuccuauaucuacggcucuaaguuccaguugagaagcuccgagaggucagccaagaaguuuaaagcgaaggguaccauagaucuguga

SEQ ID NO: 60978 - RNA, 876 nt, Artificial Sequence
  derived and/or modified sequence opt3 from POPDC3__Homo_sapiens__NP_071756
auggagagaaacagcucccuguggaagaaucucaucgacgaacaccccgugugcaccacauggaaacaggaggccgaaggcgcuauuuaccaucuugcaucuauacuguucgucguuggguuuaugggagguucaggcuucuuuggguuguuauauguguucagucugcuaggacucggcuuucuguguagcgccguaugggcguggguggaugucugcgcugccgacaucuucuccuggaacuuugugcuuuucguuauuuguuuuaugcaguucgugcacaucgcauaccaggucaggucuauuacuuuugcccgggaguuccaggugcuguauucgucauuguuucagccucucgguaucagccugccaguauuccgcacgauagcucugaguuccgaaguugugacccucgagaaggagcauugcuacgcaaugcaagggaaaacaucuaucgauaaguuaagccugcuugucuccggacguauucgagugacuguggacggcgaguucuugcacuauaucuuuccgcugcaguuccuagauucacccgaaugggacagucucagaccuaccgaagagggcauuuuucaggucacacugaccgccgagacugauuguagguacguuagcuggcggcgcaaaaagcuguaucuuuuguucgcucagcauagauacaucucuaggcucuuuuccgugcugauagggucagacauugccgauaaguuauacgcgcugaaugaccggguauauaucggaaaacgcuaccacuaugauauucgacucccaaacuucuaccaaaugagcacacccgaaaucagaaggaguccucuuacccagcacuuucaaaauucucggcguuauugcgacaaguga

SEQ ID NO: 60979 - RNA, 1140 nt, Artificial Sequence
  derived and/or modified sequence opt3 from PORCN__Homo_sapiens__NP_001269096
auggugugggucguucugcucagccuucugugcuacuugguguuauuccuguguagacacuccucucauaggggcguauuucuaucagugaccauccucauuuaucugcuuaugggggagaugcacauggucgacacagugacuuggcauaagaugcggggagcccagaugauaguugcuaugaaagcagugagucuggguuucgauuuggaccgcggcgaagucgggacggugcccagcccuguagaguuuaugggauaccucuauuucguuggcaccaucguguuugguccauggauuuccuuccacucuuaccugcaagccguccaggggcgaccgcugucgugccguuggcuccagaagguggcgagaucauuagcucuggcccuuuugugucuggugcuaagcacaugcgucggacccuaucucuuuccuuacuucaucccacugaacggcgauaggcuucugcggaaaugguugcgcgcauaugaaagugccguuuccuuucauuucucuaauuacuuugugggcuuccucagcgaggcuacugcaacccuggccggggcuggauuuacagaagagaaggaccacuuagagugggaucugaccguauccaaaccccucaacguggaacuuccuagaucaauggucgaggugguuacaaguuggaaucugccaaugagcuacugguugaacaauuauguguucaagaacgcccuaaggcuggguacuuucucugcgguccucgugaccuacgcagccuccgcucugcuucacggcuuuucauuccaucuggccgcaguauugcucagccuggcuuuuauuacguauguugaacacguguuacggaagcgccuggcccgaauccuaagugcguguguccucucuaaaagaugucccccugacugcucccaucagcacaggcuggggcuuggagugcgggccuugaaucuccuguucggcgcacuggcuauauuucaccuugccuaccuggguagcuuguucgaugucgacguggaugacacuaccgaggagcaaggguauggaauggcuuacacaguucauaaguggucggaacucucuugggccucccacugggugacuuuuggcugcuggaucuucuaucgucugauuggcuga

SEQ ID NO: 60980 - RNA, 2043 nt, Artificial Sequence
  derived and/or modified sequence opt3 from POR__Homo_sapiens__NP_000932
augaucaacaugggcgacagccacguggauaccuccucuacagucucagaggccguugcugaagaggugagucuguucagcaugacugacaugauucucuuuucccuuauaguagggcuguugacguacugguucuuauuuagaaagaaaaaggaagaggugcccgaguucaccaaaauccagacacugacuucuucggucagggaaagcucauuuguggagaagaugaaaaagaccggacggaauauuaucguuuucuaugguagucaaacaggcaccgcagaagaguuugccaaccgccuauccaaggaugcgcaucgauacgggaugcguggaaugucugcugacccugaagaguaugaucucgccgaccugagcucccuuccagagauugauaaugcacugguggucuucugcauggccacuuacggcgaaggugacccgacagauaacgcucaggacuuuuaugauugguugcaggagaccgacguggaucucucagggguaaaauucgcaguuuuuggacugggcaauaagacguacgaacacuucaacgccaugggcaaauauguggacaagagacuggagcagcucggggcucaaaggaucuuugaauuaggacugggugacgaugacggcaaucuugaggaggauuucauaacuuggcgggaacaguucuggcccgccgucugugagcauuuugggguggaagcgaccggagaggaaaguagcauccgccaguacgaguuggugguccacacagacauugaugcagccaaaguuuacaugggcgagauggguagacugaagucuuaugaaaaccagaagccuccauucgacgcuaaaaaucccuuucuagccgcagugacuaccaacaggaagcucaaucaagggacagagcggcaucugaugcaccuugaacuggauaucuccgacucaaaaauucgcuacgagagcggagaucacguagcuguguauccugccaacgacagugcguuggucaaucagcucggcaagauccugggcgccgauuuagacgugguuaugucucugaacaaucucgacgaagaguccaacaaaaagcauccauuccccugcccuaccagcuaccgaacggcacuuacuuauuaccuggauauaacaaacccaccgagaaccaauguguuguaugagcuagcucaguacgccucggaacccucugagcaggaacugcucaggaaaauggcuuccucaaguggggagggaaaggagcuguaccuuagcugggucguggaagcccggcgucacauucuggcaaucuugcaagacuguccuucccuccgcccacccauugaucaucugugcgaguuacugccuagacuacaggccagguauuacucuaucgcuagcucaaguaagguacacccaaacuccguucacaucugugcgguggucguggaauaugagacuaaagcaggucggauuaauaagggcgucgccacaaacuggcuccgagcuaaagaacccgccggggagaauggaggccgcgcacuggugccgauguuuguuagaaagagccaguucaggcuuccuuuuaaagccaccacgcccgugauaaugguagguccagggaccggcgucgcuccuuucaucggauuuauucaagagcgggccugguugcgccagcagggcaaggaagugggggagacacugcucuacuauggaugcagaaggucugacgaagauuaccuguaucgugaggaacuugcacaguuccaucgggacggugcgcugacucaauugaacguugcuuuuucacgagagcagagucacaagguguacguccagcaucuccugaaacaggauagagagcacuuauggaagcugaucgaaggcggggcccauauauacguguguggagacgcaaggaauauggcccgcgauguacaaaacaccuucuaugacauuguggcugagcuaggcgccauggaacacgcacaggcuguugauuacaucaaaaagcucaugacaaaaggucgguauagccuggacgucugguccuga

SEQ ID NO: 60981 - RNA, 2340 nt, Artificial Sequence
  derived and/or modified sequence opt3 from POSTN__Homo_sapiens__NP_001129406
augauccccuuccugccuauguuuagccuccuucuguuguuaauugugaacccaauaaaugccaacaaucacuacgacaagauccuggcucauuccagaauuaggggccgggaucaggggccgaacgucugcgcacuacaacagauccucggaaccaaaaagaaauauuucucuacauguaagaauugguacaaaaagucaauuugcggucagaagacuacgguucuguaugaguguugccccggcuacaugcgcauggaagggaugaaaggauguccugccgugcuuccaaucgaccacguauauggcacccuggguauagugggggcgacaacuacccagcgauacagugaugcuagcaaguugcgugaggaaaucgagggaaaaggcuccuuuacauauuucgcccccucuaacgaagcaugggacaaucucgauucggacauuagaaggggccuggagucaaacgucaauguggagcugcucaacgccuuacauagccacaugaucaauaagcggaugcugaccaaagaucuuaagaacgggaugauuaucccuaguauguacaauaacuugggacuguuuauaaaucauuacccaaacgguguugugacugucaacugcgcucgcauuauccacggcaaucaaauugcaacaaacggggugguacacguuaucgacagagugcuaacccagaucggaacguccauucaggauuucauagaagccgaggacgaucucucuagcuuuagggcugccgcgaucacuuccgacauucuggaagcacuuggccgggauggucauuucacccuguuugcccccacaaaugaggcuuucgagaaguugccucgcgggguccucgaacgaaucaugggagacaaaguggccucagaggcacugaugaaguaucacauauuaaacacucugcaguguagugaaagcauuaugggcggcgcuguguuugagacccucgaagggaauacaaucgagaucggaugcgacggugauucuauuaccgucaacggcaucaaaaugguuaauaagaaagacauugugacgaacaaugggguaauacaucuuaucgaucaagugcugauuccagacuccgccaagcaggucaucgaguuggcgggaaaacagcagacuacauucaccgaucuaguggcccaacugggccucgcaucagcucugagaccggacggugaauacacucuucuggcccccguuaacaaugcuuuuagcgaugacacauugaguauggaucagaggcuccugaaguuaauccugcagaaccacauucuaaaggugaaagucgggcucaaugagcuguauaacggccaaauacuugaaaccaucggaggcaagcaguugcggguguucguauaccguacggccguuuguauugagaauagcugcauggaaaaaggguccaagcagggacgcaacggugcaauccacauuuucagagagaucauaaaaccugccgagaagucucugcaugaaaagcucaaacaggacaagagguuuucgaccuuccugucucuucuggaggcugcggauuugaaagaacuccugacacaaccaggcgacuggacuuuauuugugcccaccaacgacgcauucaaggggaugacauccgaggaaaaagagauccugauucgggauaagaaugcccuacagaacaucauucucuaucaccugacuccuggagucuuuaucggcaaggguuucgagccaggggugaccaauauacuuaaaacaacccagggcucaaagauuuuucuaaaagaagucaacgacacucugcucgugaaugagcugaagaguaaagaaagcgauaucaugacgacaaacggaguuauucaugugguagacaaguuacuguaccccgcugauaccccggucggcaaugaccagcuuuuggagauccucaacaagcugauaaaauauauccaaauuaaguucgugcgaggguccacuuuuaaagagaucccuguuaccguguacaagcccauuaucaaaaaguacacaaaaauaauugauggagucccaguggaaaucaccgagaaggaaacucgcgaggaaagaaucauuacagguccugagaucaaguauacgaggauuucuaccggcgggggagagacugaagagacauugaaaaagcugcuccaggaagagguaaccaaagugacaaaguucauagaaggcggugacgggcaccuguuugaggaugaggaaaucaaacggcuuuugcagggcgacacucccguucgcaagcugcaggccaauaagaaaguccaaggaagcagaaggcguuuacgggagggccgaucacaguga

SEQ ID NO: 60982 - RNA, 1905 nt, Artificial Sequence
  derived and/or modified sequence opt3 from POT1__Homo_sapiens__XP_006715980
augagccuggugcccgccaccaacuacaucuauacaccucucaaucagcuuaagggcgggacuauugucaacguuuacggagugguaaaauucuuuaagccaccguaucuguccaaagguacggacuacugcucuguggucaccauaguggaucaaacaaauguuaaguugacuuguuuacuguucucaggcaacuaugaggcucuacccaucauuuacaaaaauggggacaucgugagauuucacaggcucaagauucaggucuauaagaaagaaacccagggaaucacaaguagcggcuucgcaucccugaccuuugaggguacucuuggggccccuauaaucccacggacaucuucgaaguacuucaacuuuaccacggaagaucauaaaaugguggaggcgcugcgcguaugggcuucaacucacaugagccccaguuggaccuugcucaagcugugcgacguucagccuaugcaauacuucgaucugacaugucagcucuuaggaaaagccgaaguggacggcgcauccuuucugcuuaaggucugggauggcacucgaaccccauuccccucuuggcguguguugauucaggaccuggugcuagagggggaucucagccauauccacagacugcagaaucuuacaauugacauccuggucuaugauaaccauguucacguggccagguccuugaagguaggaucauuucuccggauauacagucugcacaccaaauuacaaagcaugaauagcgagaaccagacgaugcugucccucgaguuccaucuucacgguggcacuucauaugggcgcggaauuagagugcugccugaaagcaauagugacgucgaucaguugaagaaagaccuagaaucugcuaaccugacagcaaaucagcauuccgacgugaucugccaaagcgagccagaugacucguuuccgucuuccggcucaguuagucucuacgagguggaaaggugucagcagcugagcgccaccauucuuacugaucaccaauaucuggagcggacacccuugugcgcuauccucaagcagaaagccccucagcaguaccgcauccgagcgaagcugagauccuauaaaccaaggcgguuauuccaaucugucaagcugcacugucccaagugccaucuacuccaggaagugccucacgagggugaccuggauauuauauuccaggacggggcaaccaaaacgccagauguaaaacuucagaacaccagcuuguacgacucaaagaucuggacaacuaagaaucaaaaaggacguaagguugccgugcauuuugucaagaacaacggcauucugccccucaguaaugaaugucugcuucugaucgagggcgggaccuuguccgagauaugcaaacucagcaacaaguucaauucugugauuccgguccgcucaggacacgaagaucuggaguuacuggaccuaagugcuccuuuucucauccaggguacaauccaucacuacggcuguaaacagugcagcucccugagaucuauucagaaccuuaauucguugguggauaagacuagcuggauccccuccucaguugccgaagcacuggggauugugccacuccaauauguauucgucaugaccuuuacacuggacgacggaaccggcguguuagaggcuuaccugauggauagugacaaauucuuucagauaccugccucugaaguucuuauggaugacgauuugcagaagucuguggacaugaucauggauauguucugucccccagguauuaagaucgacgcguaucccuggcucgagugcuuuaucaaauccuacaacgucacuaaugggacggauaaccagauuugcuaucaaauauucgacacaaccguggccgaggauguaaucuga

SEQ ID NO: 60983 - RNA, 1755 nt, Artificial Sequence
  derived and/or modified sequence opt3 from POTED__Homo_sapiens__NP_778146
augguggccgaggucugcagcaugcccaccgcuuccacaguuaagaaaccuuucgaccugagaucuaagaugggcaaauggugucaccauagguuuccaugcugucgggggucaggaaagaguaacauggguacuagcggcgaucacgacgauuccuucaugaaaaugcuccgcucuaagauggggaagugcugucgacauugcuuuccguguugccguggaucgggcacgucaaauguggguaccagcggggaccacgaaaacaguuucaugaaaaugcuuagauccaagaugggaaaaugguguugccauuguuuucccugcugcaggggcucuggcaagagcaauguaggggcauggggagauuacgaccacuccgccuucauggagccucgguaucacauccgcagagaagaucuggacaaauugcauagggcggcuuggugggguaaggugccacggaaggauuuaauugucaugcugcgcgacacagauaugaacaaacgagacaaggagaaaagaacugcccuacaccucgcaucagccaauggcaacagugaagugguucagcugcuucuggauaggcggugucaauugaaugugcucgacaacaagaaacguaccgcucugauaaaggcaauccagugccaggaggacgaguguguccugaugcucuuagaacauggggccgaucgcaauauucccgacgaguacggaaacacagcucugcacuaugccaucuacaaugaagauaaacuuauggcgaaggcauugcugcuauauggcgccgacauugagagcaagaacaaaugcggucucaccccucugcuucugggggugcacgagcagaagcaacagguaguuaaauuuuugaucaagaaaaaggcuaaucucaacgugcuggauagauacggaaggacugccuuaauacuggcagucuguugcggcucugcuuccaucgugaaucuccuucuggaacagaacguggacgucucaagccaggauuugaguggccaaacagcccgggaguaugcgguuucuucccaucaccaugugauuugugaacuacugagcgacuacaaggagaaacagaugcucaagaucucgucugaaaacuccaauccagagcaggaucugaaacuuaccucagaggaagagagucagcgacugaagguaagcgaaaacucccaacccgagaaaaugucucaggaaccugagauuaauaaggacugcgaucgcgagguggaagaggaaaucaagaaacacgggagcaacccagucggauugccggagaaucucacgaacggugccucagcaggcaauggggacgacggacugauaccccagagaaggagucggaagccugaaaaccaacaguucccagauacugagaaugaggaauaccauuccgacgagcagaacgauacccgcaaacaguuaagcgaagaacaaaauacaggcauuucucaggacgagauccugacuaacaagcagaaacagauugaaguggcugagcaaaagaugaauagugaacuaucacucagccacaagaaagaggaagaucugcuuagagagaacuccguuuugcaggaggaaaucgccaugcugaggcucgagcuggacgaaaccaagcaccagaaucagcuucgugagaacaaaauccuggaagagauugagucugugaaggagaaaacagauaaguugcuccgggcuaugcaacugaacgaggaagccuuaaccaaaacgaauauauga

SEQ ID NO: 60984 - RNA, 3228 nt, Artificial Sequence
  derived and/or modified sequence opt3 from POTEF__Homo_sapiens__NP_001093241
augguggucgagguugacagcaugcccgccgcuuccucugugaagaaaccuuucggccugagaucaaagauggggaaauggugcuguaggugcuuuccauguugccgggaaaguggaaagagcaacguagguaccuccggcgaucacgacgauucugcaaugaaaacacuccgcucgaagauggggaaguggugucgacauugcuucccguguugccguggaucaggcaaaagcaaugugggugccaguggggaccacgaugacuccgcgaugaagacucuuagaaacaaaaugggaaagugguguugccauuguuuucccugcugcaggggcucuagcaaauccaaggucggcgcuuggggagauuacgacgauucagccuucauggagccucgguaucacgugcgcggggaagaccuggauaaguugcauagagcagccuggugggguaaaguuccaaggaaggacuuaaucgugaugcugcgggauacggacgucaauaaacaggacaagcaaaaacgcaccgcucuacaccucgcaagugccaacggcaauagcgaggugguaaagcugcuucuggaucgaagaugucaguugaacguucucgacaauaaaaagaggacagcucugauuaaggccgugcagugccaggaagaugagugugcgcugaugcucuuagagcacgggacugaccccaacauaccugaugaauacggaaauaccacacugcauuaugcaaucuacaacgaggacaaacuuauggccaaggcuuugcugcuauauggcgccgauauugaaucuaaaaauaagcacggucucaccccacugcuucuggggguccaugagcaaaaacaacagguggugaaguuuuugaucaagaaaaaggcaaaccucaaugcucuggaccgguacggacguacugccuuaauucuggcggucugcuguggcuccgccucaaucguuagccuccuucuggagcagaacauagaugugaguucucaggacuuguccggccagacagcacgcgaauaugcuguaagcucgcaccaccaugugaucugccagcuacugucugauuacaaagagaagcagaugcucaaaauuuccucagaaaauaguaaccccgagcaagaccugaaacuuaccagcgaagaggagucccagagauucaaggggucugaaaacagccagccugagaagaugucacaagaaccagagaucaauaaggacggagauagggaagucgaggaggaaaugaaaaagcacgagaguaacaaugugggucuguuggaaaaccucacgaauggcguuacugccgggaacggagacaauggccugauuccgcagcggaaaucccgaacccccgagaaccagcaguuuccugauaaugaaagcgaggaguaccaucgcaucugugaauuacugucugacuauaaggagaagcaaaugccaaaauacucaagugaaaacagcaaucccgagcaggaucuaaagcucacauccgaggaagagucucagagacugaaagguucggaaaacgggcagccugagaagaggagccaagaaccagagauaaauaaagacggcgaucgggagcuugaaaacuucauggcuauugaggaaaugaagaaacaccgcuccacucaugugggauuucccgagaauuugaccaacggcgccacagcagggaacggagacgauggucugaucccgccuagaaagucaaggacccccgaaagucagcaguucccagacacggagaaugaggaauaucacucugaugagcagaacgacacucaaaagcaguuuugcgaggaacagaauacaggcauucuccacgaugaaauccugauccaugaggagaaacagauugaagucguggagaagaugaacagcgaacuuucccugucauguaaaaaggagaaagacauauugcacgagaauagcacccuccgugaagagaucgccaugcugcgguuagaacuggacacuaugaagcaucaaucucagcuacgagagaagaaauaccucgaagauauugaguccguaaagaaaagaaacgacaaucugcuuaaggcuuugcagcugaacgagcucacaauggaugacgauaccgcgguucuggugaucgacaaugggaguggaaugugcaaagcaggcuucgccggugaugacgcuccuagggccgucuuucccagcauaguggggcgcccacggcaacagggcaugaugggaggcaugcaccagaaggaaucuuaugucgggaaggaggcacaguccaaaagaggaauuuuaacgcugaaguaccccauggaacacgguaucaucaccaacugggaugacauggagaaaauuuggcaucacacauucuauaaugaacuuaggguggccccugaggagcauccaguuuugcucacugaagcuacccugaacccgaaggccaaucgcgagaaaaugacacaaaucauguucgaaacuuuuaacacccccgcaauguacguggcgauucaggcuguacuaucacuguacacaaguggccgaaccacugggauagucauggauagcggagacggcgugacgcacacaguuccuaucuaugaggguaaugcccucccacaugcaacccugcggcuugauuuggccgggcgugaacugcccgacuacuuaaugaagauucucacugagcacggcuauagauucaccacaauggcugagagggaaaucgugcgcgacaucaaggagaaacuguguuacgucgcccuugauuuugaacaggagauggcaaccguggcuucguccucuagccuggagaagucauaugaauugccugacggacagguaauuacuauaggcaacgagcgguucagaugcccagaagcccucuuucaacccugcuuccuggggauggagaguuguggaauccacgaaacaacguuuaacuccauuaugaaaucugauguggacaucaggaaggaucuauacaccaauacuguucugagcggcgguacaaccauguauccggggauggcgcaucgaaugcagaaagagauugccgcucucgcaccuuccaugaugaagauccgcauaaucgccccacccaaacggaaguacucagucugggugggaggcagcauucuggcuagucuuucuacauuccagcagauguggaucuccaagcaagaguacgacgaaagcgguccuucgauugugcacagaaaaugcuuguga

SEQ ID NO: 60985 - RNA, 1527 nt, Artificial Sequence
  derived and/or modified sequence opt3 from POTEG__Homo_sapiens__NP_001005356
augguggccgaagcuggcagcaugcccgcagccuccucugucaagaaaccuuucgggcugagaucaaagaugggaaaauggugcaggcacuguuuuccauggugccgggguaguggcaagagcaacguugggaccuccggagaccaugaugacucugcgaugaaaacacuccgcucgaagaugggcaaguggugucgacacugcuucccguggugucgugguucaagcaaaaguaauguggggacuuccggagaucaugacgauucugcuaugaagacgcuuagaagcaaaaugggcaaguggugcugucacugcuuucccuguugcaggggcuccgggaaaucaaagguaggaccuuggggugacuacgaugacagugccuucauggaaccacgguaucaugugcgcagagaggaucuggacaaguugcacagggcagccugguggggcaaagucccccggaaggauuuaaucgugaugcugaaagacaccgauaugaacaagaaagacaagcagaaacgcacagcucuacaccucgcaagcgccaaugggaacucugaaguugugaagcugcuucuggaccgaagaugucaauugaauauucucgauaacaagaaaaggacugcucugaccaaggccguccagugccgggaggacgaaugcgcgcugaugcucuuagagcauggaacagauccuaauauaccagacgaguacggcaacaccgcacugcacuaugccaucuacaaugaagauaaacuuauggcuaaggccuugcugcuauauggugcagacauugaguccaaaaacaagcaugggcucacuccccugcuucugggagugcacgaacagaagcagcaaguaguuaaauuuuugaucaagaaaaaggcuaaucucaacgcccuggaucguuacggccgcacagcguuaauucuggccguguguugcggcucagcaagcaucgucagucuccuucuggagcagaauauagacgugucuucccaggauuugagcgggcagaccgcuagagaguaugccgugucgucucaccauaacgucaucugucaacuacuguccgacuacaaagaaaagcagaugcucaagguuucaagugagaauagcaacccugaacaggaucugaaacuuacguccgaggaagagucucagaggcugaagggaagcgagaacucacaaccagaagagaugagucaggaaccggagauuaauaaagguggcgaccggaagguggaagaggagaugaaaaagcacggguccacucauaugggauuccccgaaaacuugccuaauggcgcuaccgccgacaacggugaugacgggcucaucccaccccgaaagagccgcacaccugagucucagcaauuuccagauacugaaaaugagcaguaccacucagacgaacagaacgauacccagaaacaacugagugaggagcagaauacaggcauuuuacaggacgaaauccugauacaugaggaaaagcagauugagguagcagagaacgaguucuga

SEQ ID NO: 60986 - RNA, 1638 nt, Artificial Sequence
  derived and/or modified sequence opt3 from POTEH__Homo_sapiens__NP_001129685
augguggccgaggcuggcagcaugcccgcagccuccucugucaagaaaccuuucgggcugagaucaaagaugggaaaauggugcaggcacuguuuugcguggugccgggguaguggcaagagcaacguugggaccuccggagaccaugaugacucugcuaugaaaacacuccgcucgaagaugggcaagugguguugccacuguuucccauggugccgagguucagggaaaagcaaugugggaaccaguggcgaucaugacgauuccgccaugaagacgcuucguucuaaaaugggcaagugguguugccacuguuuuccgugcuguagagggagcggaaaauccaacguagguaccucaggcgaccaugaugacagugcaaugaagacacugaggagcaagauggggaaauggugcugccacuguuuccccugcugucggggaucuggcaagaauaaaguggguccuuggggagauuacgacgauuccgccuuuauggaaccacgcuaucacgucagaagggaggacuuggauaaguuacaucgggcugcauggugggggaaagugccccgcaaggaccugaucguuaugcuaaaagacacugauaugaacaagaaggacaaacagaagcgaaccgcccuccaccuggcuucagccaauggcaacagcgaaguggucaaacuucuguuggauagaaggugccaacucaauauucuggacaacaagaaacggacagcgcugaccaaggcagugcagugucaggaggaugaaugcgcccucauguuacuggagcauggcacugacccuaauauaccagaugaguacgggaacacagcccuucacuaugcuaucuacaaugaagacaaguugauggcaaaagcucugcuacucuauggagccgauauugagaguaagaacaaacacggucugacuccccuucuguugggcguacaugaacagaagcaacagguugugaaauuccucaucaagaagaaagcgaaucugaacgccuuagaccguuacgggcgcacggcacugauucucgcugucuguugcggaucugccuccaucgugagccuucuguuggagcagaauauagaugugucgucucaggaccuauccggccaaacugcuagagaguaugccgucucaaguaggcacaacguuaucugucagcugcucagcgacuacaaggaaaaacagauucugaagguguccucugagaacagcaauccugaacaggaucuuaaacugaccucagaggaagagagucaacgguugaaggguuccgagaacagccagccagaagagaugucucaggaaccggagaucaauaaagggggcgaccgaaagguagaagaggagaugaagaaacauggaucaacacacaugggcuuucccgaaaaccucacuaauggggcaaccgccgauaacggagacgauggucugauuccuccacgcaagaguagaacacccgagagccaacaguucccugacaccgaaaaugagcaguaccauuccgaugaacagaacgacacgcaaaaacaguuaucugaggagcagaauacuggcauccugcaggaugaaauacuaauucacgaggaaaagcaaaucgagguggcugagaacgaauuuuga

SEQ ID NO: 60987 - RNA, 1527 nt, Artificial Sequence
  derived and/or modified sequence opt3 from POTEM__Homo_sapiens__NP_001138914
augguggccgaagcuggcagcaugcccgcagccuccucugucaagaaaccuuucgggcugagaucaaagaugggaaaauggugcaggcacuguuuuccauggugccgggguaguggcaagagcaacguugggaccuccggagaccaugaugacucugcgaugaaaacacuccgcucgaagaugggcaaguggugucgacacugcuucccguggugucgugguucagggaaaagcaaugugggaacgaguggcgaucaugacgauuccgcuaugaagacucuuagaucuaaaaugggcaaguggugcugucacugcuuucccuguugcagggggagcggaaaauccaagguagguccuuggggcgacuacgaugacucagccuucauggaaccacgguaucaugugcgcagagaggaucuggacaaguugcacagggcagccuggugggggaaagucccccggaaggauuuaaucgugaugcugaaagacaccgauaugaacaagaaagacaagcagaaacgcacagcucuacaccucgcaagugccaauggaaacagcgaaguugugaagcugcuucuggaccgaagaugucaauugaauauucucgauaacaagaaaaggacugcucugaccaaggccguccagugccaggaggacgaaugcgcgcugaugcucuuagagcauggcacagauccuaauauaccagacgaguacgguaacaccgcacugcacuaugccaucuacaaugaagauaaacuuauggcuaaggccuugcugcuauauggggcagacauugagucuaaaaacaagcauggacucacuccccugcuucugggcgugcacgaacagaagcaacagguaguuaaauuuuugaucaagaaaaaggcuaaucucaacgcccuggaucgguacggccguacaguguuaauucuggcggucuguugcggguccgccucaaucgugagccuccuucuggagcagaauauagacgugaguucucaggauuuguccggacaaaccgcacgcgaguaugcugucagcucgagacacaacguuaucugucagcuacugucugacuacaaagaaaagcagauucucaagguguccucagagaauaguaacccugaacaggaucugaaacuuacgagcgaggaagagucccaaaggcugaaggguucugagaacagccagccagaagagaugucacaggaaccggagaucaauaaaggcggggaccggaagguagaagaggagaugaaaaagcauggaaguacucacaugggcuuccccgaaaacuugccuaauggugccaccgcugacaacggggaugacggccucauuccaccccgaaagucccgcacaccugagagccaacaguuuccagauacugaaaaugagcaguaccauucugacgaacagaacgauacccaaaaacagcugucagaggagcagaauacaggaaucuuacaggacgaaauacugauucacgaggaaaagcaaaucgagguggccgagaacgaguucuga

SEQ ID NO: 60988 - RNA, 876 nt, Artificial Sequence
  derived and/or modified sequence opt3 from POU1F1__Homo_sapiens__NP_000297
augagcugccaggccuucaccuccgcugacacauuuaucccccugaacucugaugcaucagccacucucccucuuauuaugcaccauagugcggcugagugucugccagugagcaaucacgccacgaacgucauguccaccgcaacaggcuugcauuacucuguuccgucgugccacuaugggaaucaacccucaacuuacggagugauggccgguagcuuaaccccuugucuguauaaguucccagaccauacacuaagucacggcuuucccccuauacaccagccacuccuggcugaagaucccaccgcagccgacuucaaacaggagcuuagaaggaaguccaaacugguagaagaaccuaucgauauggacucuccagaaauucgggaguuggagaaguuugcuaacgaguucaaagugcgccgaaucaagcucggguacacucagacaaaugucggagaggcccuggcggcagugcauggcagcgaauuuucccaaaccacgauuugccguuucgagaaccugcagcucucauuuaagaaugccuguaaauuaaaggcuauccugaguaaauggcuugaggaagccgagcagguuggugcauuguauaacgaaaaggugggggcuaaugagagaaaaaggaagcggcgcacuaccauaagcaucgccgcgaaggaugcccuggaaagacacuucggagagcagaacaaaccgucuucccaagagauuaugaggauggcagaagaacuaaaucucgaaaaggaggucgugcggguaugguuuugcaaccgccgacagagagagaaaaggguuaagacaucacugaaucagagccuuuucaguaucucuaaagagcaucuggagugucgguga

SEQ ID NO: 60989 - RNA, 771 nt, Artificial Sequence
  derived and/or modified sequence opt3 from POU2AF1__Homo_sapiens__NP_006226
augcuguggcagaagcccaccgccccugagcaagcuccagcaccggccagacccuaccagggcgugagggucaaagaaccuguuaaggagcuccuucggcgcaaacgagggcacgcgagcuccggagcugccccagcacccacagccgugguacugccucaucagccauuggcuacuuauacgaccgugggucccucuugcuuagacauggaaggcucagucagugcagugacagaggaagccgcucugugugccggguggcuaagccagccuacuccagcgacccuccaaccgcuggcacccuggacaccuuacaccgaguauguuccacacgaggccguguccugccccuacucugcugauauguauguccagccuguguguccaucguacacuguaguuggacccucaagcgugcuuacauaugccaguccgccucugaucaccaacgucacgacucguuccucugcaacccccgcugugggcccaccuuuggaaggucccgagcaucaggccccacucacauacuuccccuggccucagccacugagcacucugccgaccuccacacuccaauaccagcccccugcgccagccuuacccgggccucaguuugugcagcugccaauuucaauacccgaaccgguccuucaagacauggaggauccuagaagggcagcuaguagcuugaccaucgacaagcugcuacucgaggaagaggauucugacgccuaugcucugaaucacacgcuuuccguugaaggauucuga

SEQ ID NO: 60990 - RNA, 2268 nt, Artificial Sequence
  derived and/or modified sequence opt3 from POU2F1__Homo_sapiens__NP_001185712
augcuggacugcagcgauuacgugcucgacuccagaaugaacaaucccucugagaccucaaagccuaguauggaaagcggcgaugggaacacaggaacucagacgaauggucuugacuuccaaaaacagccagucccgguuggcggggccaucuccaccgcucaggcacaggccuuucugggacacuugcaucaagugcaguuagcgggcacaucucugcaggcugccgcacagucgcuaaacguacaaucaaagagcaaugaggaaaguggugauucccagcagcccucucagccuagccaacagccauccgugcaggccgcuauuccccaaacucagcucaugcuggcagggggacagauaaccggccuuacacugaccccugcccagcaacaguugcuccugcagcaggcucaagcccaggcgcagcugcucgcagccgcuguccagcaacacucagccagucagcagcauagcgcagcuggcgccacuaucucugcguccgccgcaacaccaaugacccagauucccuuaucacaaccuauccagauugcucaggaccugcaacagcuucagcaguugcaacagcagaaccugaaucuacagcaauucgugcucguucacccaacgacuaaccugcagccggcccaguuuaucauaagccagacaccccaagggcagcagggacuucugcaagcucagaauuugcucacccagcugccucagcaaagucaggccaacuuacugcagucucagccauccaucacucucaccagccaacccgcaacaccuaccaggacgauugccgcuacuccaauccagacacuuccccagucgcagucuaccccgaaacggauugauacuccuucccuggaggaacccucagacuuggaggagcuagaacaauucgcgaagacauuuaaacagcgccgaaucaagcuggguuucacccagggcgauguggggcucgcaaugggaaagcuguauggcaaugacuuuagucagacgaccauaagccguuucgaggcccuuaaccuguccuuuaaaaauauguguaaguugaaaccacuccuggaaaagugguuaaacgaugcugagaaucugucuagcgacucaagucuauccagcccuucugcccucaacucacccgguauugaggggcugaguagaaggcggaaaaagcgcacaagcaucgaaacuaacauuagagucgcacuugagaaguccuucuuggaaaaucaaaaaccaaccucugaggaaaucacaaugaucgccgaucagcugaacauggagaaggaggugauuaggguaugguuuugcaaucggcgccagaaagaaaagcgaauaaaucccccuucgagcggaggcacuuccucaaguccaaucaaagcuauuuucccgucucccaccagccucguugccacaaccccuucccuggugacuucaagcgcagcgacgacacuuaccgucucuccagugcugcccuugacuuccgcugccgugaccaaccucagugucacaggcaccagcgacacuacaucuaacaauacggcaaccguuaucuccacugccccuccagcuucaagugccgugacaagccccucgcuguccccgucuccuagcgcaucagcuaguaccuccgaggccucuagcgcguccgaaacaucaacuacccaaacgaccagcacaccauuaaguucuccccuggggacuucccagguaauggugaccgccagcggacuacagacagcugcagccgcugcccuccagggugcagcgcaacugccugccaacgcuucgcuugccgcaauggcugccgcagccggcuugaaucccucacugauggcuccaucucaguuugcggccgggggagcacuccugaguuuaaacccuggcacucuguccggugcucuuagccccgccuugaugucuaauagcacccucgccacgauacaggcucuggcauccgggggcucacuaccaauuacaagucuggacgccaccggaaaccucgucuucgcgaaugcuggcggggccccgaacaucgugacugcaccucuguuccuuaauccccagaacuugagccuguuaacaucuaacccaguuucccucgugucagccgcugcagccagugcgggaaauagcgcucccgucgccucccugcaugcaaccucuacuucggccgagagcauccaaaacucacuuuuuaccguggcuuccgccaguggugcagcuucuacaacgaccacugccagcaaggcgcaguga

SEQ ID NO: 60991 - RNA, 1440 nt, Artificial Sequence
  derived and/or modified sequence opt3 from POU2F2__Homo_sapiens__NP_001193954
auggugcacagcuccaugggcgcccccgaaaucagaaugucuaagccucuggaagcugagaaacaggggcucgacucaccaagugaacauaccgauacagagaggaacggaccggacacuaaucaccaaaacccccagaauaagacgagcccuuucuccgucucuccaaccggucccucgacaaaaauuaaggcagaagauccuucaggcgacagcgccccagcggcuccccuuccuccacagccggcccagccccaucugccucaagcacaguugauguuaacugggagucagcuggccggagauauacagcaacuacuccagcugcagcagcuuguucuggugccaggccaccauuugcaacccccugcucaguuucuccugccacaggcacaacagucccagcccggucugcucccgaccccuaacuuauuccagcugccccaacagacacagggggcccuuuugaccucucagccacgggcuggacugccuacucaagccguaacacgccccacccuaccagacccccaccucagccacccucagccaccgaaaugccuggagcccccuucccauccagaggaacccucagaucuugaggaacuggagcaguuugcgcgaacguucaagcagcguagaaucaaguugggcuuuacucaaggcgacguggggcucgcaaugggaaaacuguacgguaaugauuucagucagaccacaauuagcagguuugaggccuuaaaccugucuuucaagaauauguguaaacucaagccucuucuggaaaaaugguugaacgacgcugagacuauguccgucgauucaagccuaccaagucccaaucagcugucuuccccgagccucggcuuugacgggcugccuggacggcgcagaaagaagaggaccucgaucgaaacaaacgugcgguucgcccuugagaaaucuuuucuggcaaaucagaagccaaccuccgaagagauuuugcucaucgcugagcaacugcacauggaaaaagagguuauacgcgugugguucugcaaccgaagacagaaggagaaaaggaucaaucccuguucagccgcgccuauguuacccaguccaggcaagccugccagcuauucuccccauauggucacgccacaggguggggcaggaacucugccgcuaucccaagcuagcucaagucucuccacaaccgugacuacacugagcucugccguaggcacccuucacccuucacggacggcuggcgggggagguggcgggggaggcgccgcacccccauugaacaguauucccagcguuaccccuccacccccugccacaacuaauuccaccaacccgucuccacaggguucgcacagcgcuaucgggcuguccggccucaaccccucaacaggaccuggccugugguggaauccagcgcccuaccagccuuga

SEQ ID NO: 60992 - RNA, 1317 nt, Artificial Sequence
  derived and/or modified sequence opt3 from POU2F3__Homo_sapiens__NP_001231611
auggagagccccagaaccgccaagggcgggagggacaucaaaauguccggagauguggcugacucuacagaugcacggucaacucugagucaggucgaaccugguaacgaccgcaauggccucgauuucaaccgacaaauuaagacggaggaccuuagcgauucccugcagcagaccuugucucaccguccaugccauuuaucgcaggggccggccaugaugucaggaaaucaaaugagcggccugaacgcgagucccugucaggacauggcuucccuacacccucuccagcagcugguucuugugccaggucaucugcaaucuguaagccaguuuuugcucucccagacacagcccgggcaacagggacugcagccuaaucugcucccauucccccaacagcagucaggcuuacugcuuccucagacuggcccaggguuggccagucaagcauuuggacacccgggucugcccggcagcucucuagaaccucaucucgaggccucccagcaucugccagugcccaaacaccuuccuucaagcgggggagcugaugaaccaagugaccuggaggaguuggaaaaguucgcaaaaaccuuuaagcagagaaggauaaagcucggcuucacacagggugaugucgggcuggccaugggaaaauuauacggcaacgacuuuucucaaaccacuaucucccgguucgaggcucugaaucucagcuuuaagaacaugugcaaacuuaagccccuguuggaaaaauggcuaaaugaugccgagucgucuccguccgacccuucagugaguacacccagcuccuauccaucucugagcgagguuuucggccgcaagagaaagaaaaggaccucaauugaaacgaacauccggcucacucuggagaagcgcuuucaggacaauccuaaacccaguuccgaagagauuagcaugaucgcggaacagcuuucuauggagaaggaggugguccgagugugguucuguaacagaaggcagaaagaaaagcggauaaauugcccaguagcaacccccaucaaaccuccaguuuacaacucacgucuggugaguccgagcggguccuugggaccccucucugucccuccagugcacucgacaaugcccgguacugugaccagcuccuguucaccuggcaauaacagucgcccaucuagccccggguccggacugcacgccucaagcccgacagcuucucaaaacaauuccaaggccgcagucaacagugcuagcucuuuuaauuccucaggcaguugguauagauggaaccauagcaccuacuuacacuga

SEQ ID NO: 60993 - RNA, 1332 nt, Artificial Sequence
  derived and/or modified sequence opt3 from POU3F2__Homo_sapiens__NP_005595
auggccaccgcugcaagcaaccacuacucccugcucacaucuucagccaguaucgugcaugcggagcccccuggcgggaugcagcaaggagcugguggcuauagagaagcccagagccuuguccagggggacuacggagcacugcaguccaauggccacccauugucucaugcccaccaauggauuacugcuuuaucgcauggugggggaggcggcgggggagguggcgggggaggcggugggggaggcggcgggggagguggcgaugggucaccguggagcacgaguccccugggacagccugacauaaagccauccguugugguacagcagggcgguaggggcgaugagcuacacgggcccggagcacuccaacagcagcaccagcaacagcagcaacagcagcagcaacagcagcagcaacagcagcagcaacagcagcagcaacggccuccacaucuggugcaccaugccgcuaaccaccaccccggcccuggggccuggcgcucugcggcagccgcugcccaucuuccaccgagcaugggagcauccaaugguggccuguuguauucacagcccaguuucaccgucaacgggaugcucggagcuggcggucagccugccgggcugcaccaucacggccugcgagacgcgcaugaugaaccacaccacgccgaccaucacccccauccucacagccacccacaucaacagcccccgccucccccaccuccccagggaccacccggccacccuggggcacaucacgauccacauucugacgaggauacaccgacuuccgacgaucucgaacaguuugcuaaacaauucaagcagcguagaaucaaauuaggauuuacccaggccgacgugggucuggcucuuggcacauuguacgggaauguuuucucacagaccacuauuugcagguuugaggcccugcaacucagcuucaagaacauguguaaacuaaagccccugcuuaauaaguggcuggaggaagcagauaguucuuccggaagcccuacaucgaucgacaaaauugccgcucagggccggaagcgcaaaaagagaaccucuaucgagguguccgucaaaggugcguuggaaucacacuuucucaagugcccaaagcccagugcacaggagauaacgagccuggccgacuccuuacagcuggagaaagaagugguaaggguuugguucuguaaccggcgccaaaaggagaaacgaaugacuccuccagggggcacccuccccggagcugaagauguguauggcgggucuagagacacaccgccucaccauggaguccagacuccagugcaguga

SEQ ID NO: 60994 - RNA, 1503 nt, Artificial Sequence
  derived and/or modified sequence opt3 from POU3F3__Homo_sapiens__NP_006227
auggccaccgcugcaagcaaccccuaccugccuggcaauucccuccuugccgcggggucuaucgugcacucagacgcugccggagccgguggcgggggaggcggugggggaggcggcgggggagguggcgcagggggaggcggugggggaaugcagccaggcagugcugcagucacaagcggcgccuauagaggggauccguccucuguuaagauggugcaaucggacuucaugcagggagcuauggccgcgucaaacgguggccauaugcugagccacgcacaucaguggguaacugccuugccccacgcugccgcagcugccgcggccgcagcugccgcugccguggaggcaaguuccccuuggucugggagcgccgucggaauggcuggcuccccacagcaacccccucagccacccccuccaccgccccaggguccugaugugaaagggggcgcgggaagggacgauuuacaugcaggcacggcccugcaccaccgggggccaccccaucuaggaccuccacccccgccuccccaccagggucauccaggcggguggggagcugccgcagccgcugccgcagcggcugccgcagccgcugccgcagcucaccucccuucaauggccggcggucaacagcccccaccccagagucugcuuuacagccagccugggggcuuuaccguuaauggaaugcugucugcgccaccgggccccgggggagguggcgggggagccggcgguggggcucaauccuuggugcacccuggccucguccgcggagacacaccagaacuggcagagcaucaccaucaccaucaccaccaugcccacccccauccuccacacccccaccaugcucagggcccgccucaccaugggggaggcggugggggagccggcccaggucugaacucacacgauccccauagcgacgaagauacuccuaccagugacgaucucgagcaguucgcaaagcaauuuaaacagcgacguauuaaguuaggcuucacacaggcggacguggggcuggcccuuggaaccuuguauggcaauguauuuucucagacuacaauaugcagauucgaagcucugcaacuauccuuuaaaaacauguguaagcucaagccccugcuuaauaaauggcuggaggaggccgauagcucgaccgggucuccaacguccaucgacaagauugcagcucagggaaggaaacggaagaaacgcacuucaaucgaaguuagugugaagggcgccuuggagagccacuuccucaagugcccuaaacccuccgcacaggaaauuaccaaccuggccgacucuuuacagcuggagaaggaggucgugagagugugguuuuguaauaggcggcaaaaagaaaagcgcaugacaccaccggguauccagcagcagacuccugaugacgucuacagccaaguugggaccgugucagcugauacacccccaccccaccauggacuccagaccaguguacaguga

SEQ ID NO: 60995 - RNA, 1086 nt, Artificial Sequence
  derived and/or modified sequence opt3 from POU3F4__Homo_sapiens__NP_000298
auggccaccgcugcaagcaaccccuacuccauccugucuucaacaagucucgugcacgccgacagcgcgggcaugcagcaaggguccccuuucagaaauccacagaaacuucugcagucugauuauuugcagggagucccgucgaacggucaucccuuaggccaccauuggguuacuucacugagcgacgggggaccuuggaguuccacgcuagcuaccucuccacucgaucaacaggacgugaagcccggcagggaggaucugcagcuuggugccauuauacaccaucggagcccucacguagcacaccauuccccacacacaaaucaucccaacgccuggggagcuaguccugcaccaaauccgucaaucacuagcucugggcagccccugaacguguacucccaaccuggcuuuaccgucucaggcauguuggaacacgggggacucacaccacccccugccgcugccagcgcgcagagucugcacccagugcugcgcgagcccccggaccauggugaacucggcucucaccauugccaggaucacuccgacgaggaaaccccuacuagcgaugaguuagagcaguucgcaaagcaauuuaaacagcgacguauuaagcugggguucacacaggccgacguuggacuugcuuugggcacccuguaugguaauguguuuucgcaaacgacuaucuguagauucgaagcccuacagcucucuuuuaaaaacaugugcaagcugaagccccuucugaauaaaugguuggaggaagcagauuccucaaccgggaguccaacaagcauugacaagaucgcugcccagggaaggaaacggaagaaacgcacuuccauagaggucucugugaagggcguacucgagacccauuuccugaaguguccuaaacccgcggcccaggaaaucagcucauuagcagauagucugcaacucgagaaggaaguugugagagucugguuuugcaacaggcggcagaaagagaagcgcaugacaccacccggcgaccagcagccucacgaaguguacucccacaccgugaaaacggacacuagcugucaugaucuuuga

SEQ ID NO: 60996 - RNA, 1260 nt, Artificial Sequence
  derived and/or modified sequence opt3 from POU4F1__Homo_sapiens__NP_006228
augaugagcaugaacuccaagcaaccccacuucgccaugcauccuacccugccagagcacaaauacccgucucuccauucaaguagcgaagcuaucagaagggcaugccuucccacaccuccacugcaauccaauuuguuugccucuuuagacgagacucugcuagcgcgggcugaagcccucgcagccguggauauugcugucucgcagggcaagucacaccccuucaaaccugacgcaacguaucauaccaugaacagcguuccauguacaaguacuuccaccgugccccuggcccaccaccaucaccaucaccaccaucaccaggcucuugagccuggggaucuguuggaccauauaucuagcccaucccucgcccugauggcgggagccgguggcgcaggggcugccgcaggaggcgguggggcucacgauggaccgggcggcgggggaggucccggcgggggaggcgguccugggggaggcccaggcgggggagguggcgggggacccggcggugggggcggaggcccugggggaggucugcucggcgggucagcccauccacacccccacaugcauaguuuaggacaccugagccauccggcggccgcagcugccaugaauaugccuucuggccuuccccacccagguuugguagcugccgcagcccaccauggggcugcggcagccgcugccgcagccgcugccggccagguggcagcggcuuccgccgcagccgcugucgugggagccgcaggccuggcuucaaucugcgacagcgauacagacccucgcgaacuagaggccuuugcggagcgauucaagcaacguagaauuaaacucgggguuacccaggccgaugugggaagugcucuggcaaaccuuaagauccccggugucggcucucugucccagagcacuauuuguagguuugaaucguugacacucucucacaauaacaugaucgcccugaagccaauauuacaggcuuggcuggaggaagccgagggggcacaacgggagaaaaugaauaagcccgaacucuucaacggaggcgagaaaaagcgcaaaagaaccuccaucgcggccccugaaaagaggucacuugaggcuuacuuugccgugcagccacggccgaguagcgaaaagauugcagcuaucgccgagaaacuggacuugaagaaaaauguaguucgcgugugguucugcaaccagcgacagaagcagaaaagaaugaaguuuuccgcaacguauuga

SEQ ID NO: 60997 - RNA, 1230 nt, Artificial Sequence
  derived and/or modified sequence opt3 from POU4F2__Homo_sapiens__NP_004566
augaugaugaugagccugaacuccaagcaggccuucucuaugccccacggcgggucacuccauguggagccuaaauacagugcucuccacagcaccuccccaggaucuucggcaccgaucgcccccucagcgagcaguccuuccucuagcuccaaugcugguggcgggggaggcggugggggaggcggcgggggagguggcgggagaucaaguucuagcuccucaagcggaaguucuggcggugggggauccgaagccaugaggcgggcaugccugccaacacccccuagcaacauuuuuggcggcuuggacgagucguuacuggcccgcgcugaagcacuagccgcugucgauauaguuucucaauccaagucacaucaccaucacccaccccaccauaguccuuucaaaccagacgccacuuaucacacgaugaauaccaucccguguacaagcgcggcauccucuagcucagugcccauuagucauccuuccgcccucgcugggacucaccaccaucaccaucaccaucaccaccaucaccaucagccacaccaggcccuggagggagaacuucuggagcacuugagccccggucucgcacugggcgcuauggccgggccugauggagcgguagugucuaccccagcccaugcaccccacauggcuacaaugaacccgaugcaucaggccgcucugucaauggcccacgcacauggccucccuagucacauggguugcaugagcgacgucgaugccgacccccgagauuuagaggcuuuugcggaacguuucaagcaaagaaggaucaaacugggggugacccaggcagacguuggcuccgcccuugcuaauuugaagauuccaggagugggcucucugucgcagagcacuaucugucgguuugagucccuaacacucucacacaacaauaugauagcccugaagccuauccuucaggcauggcuggaagaggccgagaaaagucaucgcgaaaaguugaccaaacccgagcuuuucaacggggcugaaaagaaaagaaagaggacgucuauugccgcaccagagaagcggagccuggaagcguacuuugcuauccaaccccgcccuuccucagagaaaauugccgcaaucgccgagaaguuagaucugaaaaagaaugucgugcgaguaugguucugcaaccagagacagaaacagaagaggaugaaauauagcgcuggaauauga

SEQ ID NO: 60998 - RNA, 1017 nt, Artificial Sequence
  derived and/or modified sequence opt3 from POU4F3__Homo_sapiens__NP_002691
augauggccaugaacagcaagcagcccuucggcaugcacccugugcugcaagagccaaaauuuuccucucuccauucagggagugaagcuaugagaagggucugccuuccggcaccccagcugcagggaaauaucuucgguagcuuugacgaguccuuguuagcccgggcggaagcucuggccgcaguugauauugugucucacggcaagaaccauccuuucaaaccagacgccaccuaccacacaaugucgucaguacccuguacuagcacgaguuccaccgugccuauaucucauccagcugcacuaacaagccacccccaccaugccguccaccaggggcucgagggagaucugcuugaacauaucuccccuacucugucagugaguggcuugggugcuccagagcacagcguuaugccggcccaaauucacccccaucaccucggggcgaugggacaucugcaccaggcaaugggcaugucucauccucacaccguggccccacacuccgcuaugcccgccugccugucagacgucgagagcgauccucgcgaacucgaggcauuugcugaacgauucaagcagcguagaaucaaauuaggcgugacacaggccgacguaggggcggcccuggcaaaucuuaagauuccaggaguugguaguuugucucaauccaccaucuguagguuugagagccugacucuaucgcauaacaauaugauagcucucaagcccgugcugcaggccuggcuugaggaagcugaggccgcauaucgggagaaaaacucuaagccggaacuguucaauggcuccgaacgcaaaagaaagaggacaucaaucgccgcuccugagaaacggaguuuggaggcguacuuugcaauucagccccgcccaagcuccgaaaagaucgccgcuauugccgagaagcucgaucugaaaaagaacgucgugcgagugugguucugcaaucagagacaaaaacagaagaggaugaaauauucugcaguccacuga

SEQ ID NO: 60999 - RNA, 1080 nt, Artificial Sequence
  derived and/or modified sequence opt3 from POU5F1B__Homo_sapiens__NP_001153014
auggccggccaccuggcuagcgacuucgcauuuucucccccuccagggggagguggcgaugggccguggggagccgagcccggcuggguggacccucucaccuggcuuuccuuccaggguccacccgggggaccuggcaucggcccaggggucggacccgguucagaaguuuggggcauuccuccaugcccgcccccuuacgagcugugugggggaauggcguauugcggcccacaaguggguguaggguuggugccccagggaggcuuagaaacaagucagccugagagcgaagcuggcgucgggguggaguccaacucuaauggagccucgccagagcccuguacuguuccgccuggugcagugaagcuggaaaaagagaagcuagaacagaaccccgagaaaucacaagauauaaaggcccuccagaaagagcuggaacaguuugcuaaacuucugaagcagaagagaaucacguugggcuacacccaagcagacgucgggcucauucugggagugcuguucggcaagguauuuagccagaaaacaaucugcagguucgaggcccuccaguuaaguuuuaagaauauguguaaacugcggccacuuuugcagaaguggguugaagaggcugauaacaaugaaaaccugcaagagauuugcaaggccgagacucuaaugcaggcgcgcaaacgaaagcguaccuccaucgaaaauagagugagggguaaccucgagaaucuguuccuucaguguccuaaacccacacugcaaauaucucauaucgcacagcaguuggggcucgaaaaggacgucgugcgggugugguuuugcaaccgcagacagaaaggcaagaggagcuccucagauuaugcccaacgggaggacuucgaagcugccggaaguccauuuagcggcgggcccgucucuuucccuccagcaccgggaccccacuuugguaccccuggcuacggguccccacauuucacugcucuguauucaagcguucccuucccugagggagagguguuuccacccguaagugugauuacauuaggcucuccgaugcacuccaauuga

SEQ ID NO: 61000 - RNA, 495 nt, Artificial Sequence
  derived and/or modified sequence opt3 from POU5F1__Homo_sapiens__NP_001272915
augugcaagcugagaccccuccuucagaaauggguggaggaagccgacaacaaugagaaccugcaagaaaucuguaaggcugagaccuugguccaggcaaggaaacggaagcgcacaagcauugaaaaucgaguucguggcaacuuagagaaucuguuccuacagugcccuaaaccaacucuccagcaaauaucccacaucgcccagcagcuggggcuugagaaggaugugguaagagugugguuuuguaacaggcggcagaagggaaaaagaucuucaagugacuacgcgcaacgcgaagauuucgaggcugccgguagcccguuuuccggcgggcccgucucuuucccucuggcaccaggaccccauuuuggcacgccugguuaugggucgccacacuucaccgccuuguacucaagcgugcccuuuccugaaggagaggcuuucccaccgguuagugugacaacucucggcucccccaugcauucuaauuga

SEQ ID NO: 61001 - RNA, 906 nt, Artificial Sequence
  derived and/or modified sequence opt3 from POU6F1__Homo_sapiens__NP_002693
augcccggcaucagcucccagauucugaccaacgcccaaggacaggugauagggacacucccuugggucguuaauucugcuucaguggcagccccagcgccggcucagagucuucagguacaagccgugacuccccagcuguuguuaaacgcacagggucaggucaucgccacgcuggcuagcuccccucuaccacccccuguggcaguuagaaagccaucuacccccgagucgccugccaaaucagaagugcaaccaauucagccgacacccacugucccucagccagcugugguaaucgccagccccgcgccugcagccaagccaagugcuuccgcccccauuccgaucacaugcucugagacaccuaccguuagccagcucguguccaaaccccacacuccaucacuggacgaagauggcauaaaucuugaggaaaucagggaguucgcaaagaacuuuaaaauucggcgccugaguuuggggcucacacaaacccaggucggacaggcucugacggccacugagggcccugcguacagccaaucugccaucugucgauucgaaaagcuggacauuacccccaaguccgcacagaaacucaagccaguguuagagaaauggcugaaugaagcugagcuucguaaccaggagggucagcaaaauuugauggaauuugucgggggagagcccucaaagaaaagaaagaggcggaccagcuucacuccucaggccaucgaagcucugaacgccuauuuugagaagaauccacuaccgaccggccaggaaauaacagagauugcaaaagagcucaacuacgaucgcgaagugguuagagugugguucugcaauaggcggcagacccugaagaacacgaguaaacuuaauguauuucaaauccccuga

SEQ ID NO: 61002 - RNA, 1968 nt, Artificial Sequence
  derived and/or modified sequence opt3 from POU6F2__Homo_sapiens__NP_001159490
augagcgcccugcuccaggaccccaugaucgcuggccaaguguccaagccucuucugucugucagaucagagaugaacgcagaauugaggggagaggauaaagccgcgaccagugacagcgaauuaaaugagccacugcuagcuccgguugaauccaacgauucugaggacacacccucgaaacucuucggggcccgggguaauccugcacugucagauccaggcacucccgaccagcaccaggccagccagacgcauccuccauuucccguggggccucaaccacuucugaccgcucagcaguuggcaagugccguagcuggagugaugccgggcggucccccugcccucaaccagccaauucugauacccuucaauauggcggggcaacugggaggccagcagggccucgucuuaacacugccuacugcaaaccuuaccaauauccagggguugguggccgcugccgcagcuggagguauuaugacacugccacuacaaaaccuccaggccaccuccucucugaauagccagcuucaacagcugcaguugcagcuccaacagcagcagcaacagcagcagcaacagcccccgccuuccacuaaccagcacccccagccagcgccucaagcccccucacagagucagcaacagccacugcagcccacaccuccacagcaaccgcccccugcaagccagcagccacccgcuccuaccucucaguuacaacaggccccacagccccagcaacaucagccgcacucccauucacagaaucaaaaccagccuagcccaacgcagcagaguucuucucccccucaaaaacccagccagucgccaggccacgggcugccuucuccccucacuccaccgaauccucuucagcugguuaacaaucccuuggcuucccaggccgcagccgcugcggcagccaugucaaguaucgcuagcucccaagccuuuggaaacgcacuaucuagccugcagggcgugaccggucagcucgucacaaacgcccaggggcaaauuaucggaacuauaccacugaugcccaauccuggcccaucaagucaggcugccuccggcacccaggggcuucaggugcaacccaucacaccucagcuguugaccaacgcacagggacaaauuaucgcgacgguaauugguaaucagauccucccgguuauaaacacucagggcauuacacugagcccaaucaagcccgggcagcaauuacaccagccuucucagaccucagugggacaggcugccagucaaggcaaucugcuacaucucgcacacagccaggccuccaugucucagucgccaguccgccaggcuagcuccucaaguucuagcuccucaagcuccuccgcccugagugugggucaacuugugagcaacccccagacugcagcuggggaggucgauggcguuaauuuggaagagauucgagaguucgccaaagcguuuaagauccguagacugucucucggacugacacagacccaagugggccaggcccuuuccgcuacggaagggccugcauacucacagagugccaucugcagguucgagaagcuggacauuaccccgaaaagcgcucagaagauaaaacccguauuggaacgguggauggccgaggcagaagcgcgccauagagccggaaugcaaaaccucacagaguuuaucgguucggaaccauccaagaaaaggaagcggcgcacuucuuucaccccucaggcucuggagauuuuaaaugcccacuuugagaagaacacacaccccagcggccaggaaaugacugagaucgcagaaaaacugaauuaugaucgagagguggucagagugugguucuguaacaagaggcaggcucuaaagaauaccauaaagcggcucaaacaacaugaaccagccacagcaguuccucuggagccccuuaccgacucauuggaggaaaacaguuga

SEQ ID NO: 61003 - RNA, 870 nt, Artificial Sequence
  derived and/or modified sequence opt3 from PPA1__Homo_sapiens__NP_066952
augagcggcuucuccaccgaggaaagagccgcucccuuuucucuggaguacaggguguuccucaagaacgaaaaagggcaguauaucucaccuuuucacgacauuccaauauacgcagauaaggacgucuuccauaugguuguggagguaccgcgguggaguaaugccaaaauggaaaucgcgacaaaggauccccuuaacccuauuaaacaagacgugaagaagggaaaacugcgcuaugucgcuaauuuguuuccauacaaggguuauaucuggaacuacggcgccauuccccagacuugggaggauccugggcacaaugacaaacauacgggaugcuguggcgauaacgacccaaucgaugugugcgagauagguagcaagguuugugcacgaggggaaaucauuggagugaaagucuuaggcauccuggccaugauugacgagggcgaaaccgauuggaaggugaucgcuauaaauguagacgaucccgacgcagccaacuauaaugacauuaacgauguuaagcgucuaaaaccuggguaccucgaggcuacaguggacugguucagaagguacaaggucccagauggaaaaccggagaaugaauuugccuucaacgcggaguuuaaggacaaagauuucgcaaucgacauuaucaaguccacucacgaucauuggaaagcccuggugaccaagaagacaaaugguaaaggcaucucuugcaugaacaccacucuuucggaaucacccuuuaagugugacccugaugcugcccgggcaauuguggacgcucugccacccccuugcgagagcgccuguacagucccaaccgauguugacaaaugguuccaccaccagaagaauuga

SEQ ID NO: 61004 - RNA, 918 nt, Artificial Sequence
  derived and/or modified sequence opt3 from PPA2__Homo_sapiens__NP_008834
augagcgcccugcucagacuucugaggaccggcgcucccgcagccgcgugcuugcgguuagggacauccgcuggaacugguucucgccgagccauggcacuguaccacacggaggaacguggccagccuuguucacaaaacuauagacuauucuuuaagaaugugaccgggcauuacaucaguccauuccacgacauuccgcucaaagucaacagcaaggaggaaaauggaauacccaugaaaaaggccaggaacgaugaguaugaaaaucuguuuaacaugaucguugagauuccucgguggacaaaugcuaaaauggagaucgcaacuaaggaaccaaugaaccccauuaagcaguacgugaaagacggcaaacuucgcuauguagccaauaucuucccuuacaaggguuauauauggaacuacgggacccugccacagaucuuguccugcggagaggugauucaugucaagauccucggcauucuggcucugaucgaugaaggcgagacagacuggaaacucauagccauuaaugcgaacgaucccgaggcaucuaaguuucacgacaucgaugacgugaagaaauucaagccuggguacuuagaagccacccugaauugguuuagacuuuauaaaguuccagauggaaagccggagaaccaguucgcuuuuaauggugaguucaaaaacaaggccuuugcauuggaggugauuaaaucgacucaucaauguuggaaggcucugcuaaugaagaaaugcaacggcggggccaucaauuguacaaacguccagaucucagacagccccuucaggugcacccaggaagaggcgcggagucucguggaguccguaucuagcuccccuaauaaggaaucaaacgaggaagaacagguuuggcacuuucugggaaaauga

SEQ ID NO: 61005 - RNA, 855 nt, Artificial Sequence
  derived and/or modified sequence opt3 from PPAP2A__Homo_sapiens__NP_003702
auguucgacaagaccagacugcccuacguggcccucgauguccuuugcguucuguuggcuggcuuaccuuuugcaauccugacaagcaggcacacuccauuccagcgcgggguguuuuguaacgacgaguccauuaaauauccguacaaggaagauacgauacccuaugcccuacucggagguaucauuaucccuuucucuauuaucguaauaauccugggcgagacccuuucaguguacugcaaucuguugcauaguaacagcuuuauucggaauaacuauaucgcgacaauuuacaaagcuaucgggacuuuccucuuuggagccgcagccucccaaucucugaccgacauagcuaaguauucgauuggccgacugcguccacacuuccucgaugucugugaccccgauuggucaaaaaucaauugcagcgacgguuacauugaauacuauaucuguagagggaacgcagagagggugaaggaaggacgguuaaguuuuuacuccggccauucuagcuucuccauguauugcaugcuguuuguugcccuuuacuugcaggcucgcaugaagggcgauugggccagacugcuaaggccuacacuccaguucgggcugguggcggucucaaucuaugugggacuuagucggguaagcgacuacaaacaccauuggucugauguucugaccgguuugauucagggcgcacucguggccauacuggucgcuguguauguguccgacuuuuucaaggagcgcacuucauucaaagagcgaaaggaagaggauagccacacaaccuuacacgaaacgccaacuaccgggaaucauuaccccaguaaccaccaaccuuga

SEQ ID NO: 61006 - RNA, 867 nt, Artificial Sequence
  derived and/or modified sequence opt3 from PPAP2C__Homo_sapiens__NP_003703
augcagagaagguggguguucguccugcucgacguucuuugccuguugguggccagcuuacccuuugcuauccugacccuaguaaacgcaccuuacaagcggggcuucuauuguggggaugacuccauucgcuacccauaucgaccggauacaauaacucacggacucauggccggugugacgaucaccgcgacagucauucuggugucugcuggcgaggccuaccuuguuuauacugaccgucuguacucaagaagugauuuuaauaacuauguggcagccgucuacaaaguguuggggaccuuccucuuuggagcugcaguaagccaaucccugacagaccuggccaaguacaugaucggcaggcuccggcccaauuucuuagcuguuugcgauccugacuggucucgcgugaacuguucggucuaugugcagcuggaaaaagugugcagagguaauccagccgaugucaccgaggcgaggcuuucauuuuacagcgggcauaguuccuucggaauguauuguaugguguuuuuggcacuguacguucaggcccggcuaugcuggaagugggcucgccuccugcgacccacuguacaguucuuucuuguggccuucgcacuguaugucggcuacacaagagugucugacuauaaacaccauuggagcgauguuuuggugggccuccugcaaggggcuuuagucgccgcgcugaccguguguuacauuuccgacuuuuucaaggccaggccuccacagcacugccucaaggaagaggaacuugagcggaaacccucacugaguuugacgcuaacucugggagaggcagaucauaaccacuacgguuauccucacucuagcuccuga

SEQ ID NO: 61007 - RNA, 795 nt, Artificial Sequence
  derived and/or modified sequence opt3 from PPAPDC1B__Homo_sapiens__NP_001096029
augggcaaggccgcugcagccguggcguucggggcugaggucggaguuagacuggcccucuuugcagccuuccuugugaccgaacuguugcccccuuuucagagguuaauccaaccagaggaaauguggcuguaccggaacccguauguagaggcugaauacuuccccacaaaaccuauguuugugauugcauuccuaagcccacucucccugauauuucuugccaaguuccugaaaaaggcugacacucgcgauucucgacaggccugcuuggcggcaucacucgcccuggcucugaauggugucuuuacgaacaccaucaaacucauugugggccgucccagaccugacuucuuuuauagguguuucccagauggguuagcccacagugaccugaugugcacaggagauaaggacguugugaaugagggccgcaagagcuuucccuccggucauucuucguucgcauucgcugggcuugccuuugcgucauucuacuuggccggaaaacugcacuguuuuacuccucagggccggggcaagagcuggagauucugcgcauuucuaaguccacuccuguucgcugccgucaucgcucuuuccaggaccugugauuauaaacaucacuggcaggacgugcugguagggucuaugauuggaaugacauuugccuacguuugcuaucggcaauacuacccgcccuugaccgaugcagagugucauaagccuuuccaggacaaacucgugcugagcacugcccagaagccaggugauuccuauugcuuugacaucuga

SEQ ID NO: 61008 - RNA, 888 nt, Artificial Sequence
  derived and/or modified sequence opt3 from PPAPDC2__Homo_sapiens__NP_982278
augcccagcccuagaagguccauggagggccggccacugggggugucugccucaaguagcuccucuucgccgggaucacccgcucacgguggcgggggaggcgguagccgcuucgaauuucagagucuccuuuccucucgagcaaccgccgucgacccuacaugcgcgcgucugagagcuagcgaguccccaguucauaggcgggggucauuccccuuggccgcagccggaccuagucaaagcccagcucccccuuuaccagaagaggaucgcauggaccugaacccgucuuuucuaggcaucgcacucagaucccugcuugccauugaucugugguugucaaagaaacucggcgugugugcuggggaaagcaguucuuggggauccguaaggccccugaugaagcugcucgagauaagcggucacggcaucccuugguuacuggggacucuuuacugcuugugucggucggacucuugggccggacgcgaggugcugaugaaucuacucuucgcgcugcuucuggauuugcuccuggucgcauuaauuaaaggccuggugcgaagaaggcggccagcccauaaccagauggacauguuuguuacgcucuccguggauaaguauucauuccccaguggucacgcuacccgugccgcacuuaugagccgcuuuauccugaaucauuugguccuagcuauuccucugagagugcucguaguucugugggccuucgugcuugggcuguccagggucauguugggacggcacaacgugacagacguggcguuuggcuucuuucucggcuacaugcaguauucuaucgucgauuacugcuggcugagcccacacaaugcccccguuuuauuccugcuauggucacagcgauga

SEQ ID NO: 61009 - RNA, 816 nt, Artificial Sequence
  derived and/or modified sequence opt3 from PPAPDC3__Homo_sapiens__NP_116117
augcccgccagccaguccagagcuagggcacgggaccgcaacaaugugcugaaccgagccgaguuccucucucuuaaucaaccuccaaagggcgggccggaaccccguucaaguggaagaaaagcgagcgguccuuccgcucagccacccccugccggcgauggggcaagggagcggcgccagucucagcaacugccagaagaggacugcaugcaguugaaccccucguuuaagggaaucgccuucaauucauuacuggcuauugauauauguaugagcaaaagacuaggcgucugcgcagguagggccgcuaguugggccuccgcgcggucuaugguuaagcucaucgggauuaccggacacggcaucccuuggauuggcgggacaauccugugucuugugaaaagcuccacucuggcaggacaggaaguauugaugaaccuccugcuggcccucuuacuggacauaaugacgguggcugguguccagaaacuuaucaagcgccgaggcccauacgagaccucaccgaguuugcuggauuaucuaacaauggacauuuacgccuuucccgcagggcaugcuagcagagccgcgauggugucuaaguucuuucucucccaccugguucuugccgugccucugagggucuugcucgugcugugggcauuaugcguaggacugucacggguuaugaucggccgucaucacgugacugauguccucagcgguuucgugauuggguaucuucaauuucgccugguggaguuggucuggaugccaaguucuaccugucagaugcuaaucuccgcuugguga

SEQ ID NO: 61010 - RNA, 1407 nt, Artificial Sequence
  derived and/or modified sequence opt3 from PPARA__Homo_sapiens__XP_011528545
augguggacaccgagagcccccugugcccucucuccccacuugaagccggcgaucuggagucuccguugucagaagaguucuuacaggaaauggggaacauccaagagauuagucagagcauaggagaggacuccucugguucguuuggcuucacagaauaccaguaucuggggucaugucccggaagcgauggcagugucaucacugacacgcuauccccugcuucuagcccauccucaguuaccuaccccgugguaccugguaguguggaugagagcccaucuggggcacucaauauugaaugcagaaucuguggagacaaggccuccggcuaucacuacggcguccaugcgugcgagggguguaaaggauuuuucaggcggacaauucgccugaaacuuguguaugauaaaugcgaccgaucauguaagauccagaaaaagaaccguaauaagugccaauacuguagauuucacaaaugccugagcguugguaugagucauaacgcuauaagguucggccggaugccccgcucugagaaggccaaauugaaggcagaaauccucacuugugagcacgauauugaagacuccgagaccgccgaucugaaaagccuggcuaagagaaucuaugaagcauaccucaagaauuuuaacaugaauaaagugaaggccagggucauuuuaucggggaaggcuucuaacaauccuccauucgugauccaugacauggagacacugugcauggccgagaagacccuuguagcgaaauugguugcaaacggaauacagaauaaggaagccgaggugcggauuuuucacugcugucagugcacuuccgucgaaacagugaccgagcugacggaguucgcuaaagccaucccgggcuuugcaaaccuagaucucaaugaccaggugacucugcuuaaguacggugucuaugaagcuauuuucgccaugcugucaaguguuaugaacaaggacgggauguugguggcguacggaaauggcuuuaucacccgcgaguuccucaaaagccugcgaaagcccuucugugauaucauggaaccuaaauuugacuucgccaugaaguuuaacgcauuagagcuggaugacuccgauauuucucucuucguagcugccauaaucugcuguggcgacagaccagggcuucugaacgugggacacauugagaaaaugcaagaagguaucguccauguguugaggcuacaucugcagagcaaucaccccgaugacauauuucucuucccuaagcugcuucagaagauggcugaucugcggcaguugguuacagaacacgcccaacucgugcagauuaucaaaaagacugagucagacgcagcccugcacccauuacugcaggagaucuaucgugauauguacuga

SEQ ID NO: 61011 - RNA, 1209 nt, Artificial Sequence
  derived and/or modified sequence opt3 from PPARD__Homo_sapiens__NP_001165290
augcaccagagagaccugagcagguccucuucacccccuagucuccuugaucaacugcagaugggcugcgacggggccagcuguggauccuugaacauggagugccggguguguggugauaaggcuucuggcuuccauuacgggguccacgcaugcgaaggauguaaaggcuuuuuccgccgaaccauccguaugaaguuagaguaugaaaaaugcgagagaucguguaagauucagaaaaagaauaggaacaagugccaguacugucgguuucaaaaaugccuggcccuagguaugucacauaaugcgauacgcuucgggagaaugccagaagcugagaagaggaaacucguugccggacugacagcaaacgagggcagccaguauaauccccagguggccgaccuuaaggcuuuuaguaaacacaucuacaacgcauaucugaagaauuucaacaugacuaagaaaaaggcccgguccauuuugacgggcaaggcuucucauaccgccccguuuguaauccacgauauugaaacacucuggcaggcggagaaagggcugguguggaaacaacuggucaauggacucccuccauacaaggaaaucagcgugcacguuuucuaucgcugucagugcacuaccguggagacaguccgagaguuaaccgaauuugcaaaauccauacccucauucaguagccuguuucuuaacgaccaggugacuuugcugaaguacgguguacaugaggccaucuucgcuaugcuagccucuauuguuaauaaggauggccuccugguggcaaacggguccggauuugucacaagagaguuccuuaggucacugcggaaaccuuucagcgacaucauugaaccaaaguuugaguucgcugugaaauuuaaugccuuggaacucgaugacagugaucuggcguuauucaucgccgcaauaauucugugcggcgaccgucccggucucaugaacgugccucgcgucgaggcuauccaggauaccauucuuagagcccuggaauuucacuugcaagcuaaucauccagacgcccaguaccuauucccgaagcugcuccagaaaauggcagaccugaggcaacuuguuacggagcacgcccagaugaugcagcggaucaagaagacugaaaccgagacaucucugcaccccuugcuccaggaaaucuauaaagauauguacuga

SEQ ID NO: 61012 - RNA, 2397 nt, Artificial Sequence
  derived and/or modified sequence opt3 from PPARGC1A__Homo_sapiens__NP_037393
auggccugggacaugugcaaccaggauagcgaguccguguggucugacaucgaaugugcugcacuggucggcgaggaucaaccccucugcccugaccuuccagaacuggauuugucagaguuagacguuaaugaucuggacaccgauaguuuccuagggggacucaagugguguagcgaccaguccgaaauuauaucuaaccaguacaauaacgagccgucgaauaucuuugagaaaauugaugaagagaacgaagccaaucugcuugcggugcugacagagacuuuggacucacuccccguagaugaggacggucugccuagcuucgacgcucugacggauggcgacgugaccacagauaacgaagccaguccauccucuaugcccgacgggacuccuccaccccaggaggcagaggaaccuagccucuuaaagaaacugcuuuuggccccagcuaauacccaacuguccuauaacgaaugcucaggacuaaguacacagaaucacgcaaaccauaaucacagaaucaggaccaacccggccauugucaagacugagaauagcuggucuaacaaagcuaaguccaucugucagcagcaaaagccccagcggcgcccuugcucagagcuccugaaauaccuuacaaccaacgaugacccaccccauacgaagccuacugaaaaucgaaacagcagucgugauaaauguaccucuaagaaaaagucccacacacagagccagucgcaacaucugcaggccaagccaacuaccuugucucucccccugacaccggaguccccuaaugaccccaaaggcucaccauuugaaaacaagaccauagagagaacguuaaguguggaacugagcgguacugcggggcucacaccucccaccacuccaccccacaaagcaaaucaggauaacccuuucagggccuccccaaaacuuaaaucuagcugcaagacaguugugccgcccccuucaaagaagccacgguauagugaguccagcggaacccaaggcaauaacucuacgaagaaaggccccgagcagucagaacuguacgcucaguugaguaagagcuccguccuaaccgggggacacgaggaacgcaaaacaaagagaccuucucugaggcucuuuggugaccaugauuauugucagucgaucaauagcaaaacugagauucugaucaacauuucccaagaacuucaggacucacggcagcuggagaauaaggacgugaguucugauuggcagggccaaaucugcagcuccaccgacucagaucaguguuacuugcgcgagacacucgaagccagcaagcagguaucuccaugcuccacucgaaaacagcugcaagaccaggagauaagagcagaauuaaacaagcacuucgggcaucccagucaggcuguuuuugaugacgaggccgauaaaaccggagagcugagggacagcgauuucucuaaugaacaguuuuccaagcuaccgauguucauuaacucaggccucgcgauggacggucuguuugaugacagugaggaugaaagcgacaaacuuucguauccuugggacgggacacaauccuacucuuuguucaaugugagcccaucaugcaguuccuuuaacucucccugucgggauagcgucuccccucccaagucacuguucagccagcguccacagcgcaugagaaguaggucucgguccuucagccgacaccgcucgugcucaagaucuccuuacaguaggucccggagccgcucucccggaagcagauccucaaguaggagcuguuauuacuaugagucuucccacuaccgucaucggacccaccgaaacucaccacucuaugugagaaguaggagccgcuccccguacucucggagaccuagguaugacucguacgaagaguaccaacaugagcgccugaagcgagaagaguaucggcgugaauacgagaaaagagaaagcgagagggccaagcagcgcgagcggcagagacagaaagcaaucgaagagaggcgagugauuuaugucggcaagauccgccccgauacuacgcggacagaacuuagagacagguuugagguuuucggcgaaaucgaggagugcaccgugaaucugcgugaugacggggauucauacggauuuauuacuuaucgcuacaccugugacgcuuucgccgcuuuggaaaacgguuauacacuccggagauccaaugagaccgauuuugaacuguacuucugcggcaggaaacaauuuuucaagaguaacuacgccgacuuagauucuaauagcgacgauuuugacccagcauccacuaagucaaaauaugacucucuggauuucgacagccuacucaaggaggcccagcgaagucugcggcgcuga

SEQ ID NO: 61013 - RNA, 2955 nt, Artificial Sequence
  derived and/or modified sequence opt3 from PPARGC1B__Homo_sapiens__NP_001166169
auggccggcaacgacugcggggcucugcucgaugaggaacuuagcuccuucuuucugaauuacuuggcagacacccagggagguggcucuggggaggaacaauuauaugccgauuuccccgagcuggaccuaucacagcucgaugcgagugacuuugauagcgcuacauguuucggagaacugcaguggugcccugagaacuccgagacugaaccaaaucaguacucuccggacgauucggagcuuuuucaaaucgacucagaaaacgaggcccuguuggcagagcucacgaagacccuggaugacauucccgaagaugacgugggccuggccgcuuucccugcacucgacgguggggaugccuuaagcuguacaagugcuuccccagcccccucuagcgcgccuccaucccccgcaccugagaaaccaucagccccggcucccgaagucgacgagcugagucuugccgauagcacucaggacaagaaagcaccuaugaugcagucucaguccagaucaugcaccgaauugcacaagcaucugacaagcgcucaauguugccuacaggauaggggacuccagccacccugucugcagaguccucggcuuccagccaaagaggacaaggagcccggcgaagauugcccgucuccucaacccgcgccagccuccccucgcgacagccuggcauugggccgagcugaucccggggccccaguuucgcaggaggacaugcaggcuauggugcaacucauacguuauaugcacaccuacugucugccccagagaaaguuaccuccacagacuccggaaccccugccuaaagccugcucuaauccaucccagcaaguaaggucacggcccuggagucgccaucacagcaaggcauccugggccgaguuuucuauccucagagaacuucuggcucaggauguguugugugacgucagcaaaccuuauaggcuagcgacaccaguguacgcaucacugacgccccggagucgcccgcgaccuccaaaggacucccaggccagccccggaagaccuucuucaguugaggaggugaggauugcugccagucccaaaagcaccgguccacggccuucccuccguccccugcgccuugaagucaagagagaggugaggcggccagcacgacugcagcaacaggaagaggaagaugaggaggaagaggaagaggaggaagaggaagagaaggaagaggaggaagaguggggccgcaaaagaccggggaggggauugccuuggacuaagcucggccggaaacuggaaucuucgguaugccccguucgcagaagcaggcguuuaaacccagagcugggucccuggcuaaccuucgccgacgaaccucucgugccauccgagccccagggggcucugccuucacuuugcuuggccccgaaggcauaugaugucgagcgggaacugggaaguccaacagacgaggauucuggccaggaccaacagcuccugcgaggcccccagaucccugcgcuugaaagcccaugugaguccgggugcggagauauggacgaagaucccucauguccucagcugccgcccagagacagcccaaggugcuugaugcucgcucugucucaauccgauccuacuuuugguaaaaagaguuucgagcagaccuuaacaguggagcuguguggcaccgccgggcuaacgcccccaacuacaccucccuacaaaccaaccgaagaggacccguuuaagccugauauuaagcauagccucggaaaagaaaucgcacugucucuucccuccccagagggcuugucacugaaggccacucccggugcugcccacaaacucccuaagaaacacccagagcgcagugaacuguuaagccaucugcggcacgcaacagcucagcccgccucgcaagcggggcagaagagaccuuucuccugcucuuuuggcgaccaugacuacugucaggugcuuaggccggagggagucuugcagcgcaagguucuccgaagcugggaaccaucaggcgugcaccuggaggauuggccccaacagggggccccuugggcugaagcacaggcccccggacgggaggaggaccguaguugcgaugcuggugccccaccuaaagacuccacccuacugagagaucacgaaauaagggcaucucucacgaagcauuucggccugcuugagaccgcguuggaagaggaagaccuggccagcuguaaaucccccgaguaugauacaguauucgaggacucaagcaguucuuccggggaaagcucguuuuuaccagaggaagaggaagaggagggagaagaggaagaggaggaugacgaagaggaagauucaggcgugucuccuacuugcagugaccacuguccguaccaguccccacccagcaaggcuaaucgccaacucugcucucggagcagauccucaagugguagcucuccuugccauuccuggucacccgccaccaggcgaaacuuccgcugugagagucgggggccaugcagcgauagaacaccuuccaucaggcacgcacguaaacgccgggaaaaggcuauuggcgagggaagagucguguauauccagaaucugucuucggacaugagcucaagggagcuuaagcgacgguuugaaguuuucggcgagauugaagagugugaagugcugacucgcaacagaaggggagagaaauacggguuuaucaccuaucggugcuccgagcaugccgcauugagucucacaaagggugccgcucugcgaaaaagaaaugaacccucuuuccagcuaagcuacggcgggcugcgccacuuuuguuggccgagguauaccgacuacgauuccaacucagaggaagcgcucccagccucuggaaagagcaaauacgaggcaauggacuucgauagucugcuuaaggaagcucagcaauccuugcacuga

SEQ ID NO: 61014 - RNA, 1434 nt, Artificial Sequence
  derived and/or modified sequence opt3 from PPARG__Homo_sapiens__NP_005028
augaccaugguggacacagagaugcccuucuggccuacuaacuuuggcaucagcuccgucgaucugucuguuauggaagaccacucacauaguuucgauauuaagccauuuacgaccguggacuucagcuccauaucuacaccgcacuacgaggauauccccuuuacuagaaccgacccuguaguggccgauuauaaauacgaccucaaacuucaggaauaucaaucggcuauuaaggucgagccagcaucacccccuuacuauagcgaaaagacacagcuguacaauaaaccacaugaggagcccaguaacuccuugauggccaucgaaugcaggguguguggggauaaggcgucuggauuccacuaugguguucaugcuugcgagggcuguaagggguuuuuccggcgcaccauucgauuaaaacugaucuacgaccguugcgaucuaaauuguagaauacacaagaaaagcaggaacaagugccaguacugucgguuucagaaaugccucgccgugggaaugucccacaaugcaauccgcuucggcagaaugccucaagccgaaaaggagaagcugcuugcugagauuucaagugacaucgaucagcugaacccagaaagcgcagacuugagggcccucgcuaaacaucuguaugacucuuacauuaaguccuuuccgcugacuaaagccaaggcgcgggcaauccucacagguaaaaccacggauaagucacccuucgucauauaugacaugaauagcuuaaugaugggggaggauaaaauuaaguuuaagcacaucacuccucugcaggaacagaguaaagagguggccauucgcaucuuccaaggaugucaguuccgaucuguagaagcuguucaggagaucaccgaguacgccaaguccauuccaggcuuugugaaccuugacuugaaugaucaggucacacugcuaaaauauggcgugcaugaaauaaucuacacuaugcucgcaagccugaugaacaaggacggggugcuuauuucggagggacaagguuucaugaccagagaauuucugaaaucuuugaggaagcccuucggcgauuuuauggagccuaaguucgaauuugcugucaaauucaaugcccucgagcuggacgauuccgacuuagcgaucuuuauagccguuauuauccugucaggggaucggccaggacuccuuaacgugaagcccaucgaggacauucaggacaaucuguugcaggcacuagaacugcaacucaaacugaaccacccggagaguagccagcuuuucgcuaagcuguugcagaaaaugacagaucuccgucagaucguaaccgaacacgugcaacuguuacaggucauuaagaagacggagacugacaugucccugcauccucuacuccaggaaauauauaaagaucuguacuga

SEQ ID NO: 61015 - RNA, 1554 nt, Artificial Sequence
  derived and/or modified sequence opt3 from PPAT__Homo_sapiens__NP_002694
auggagcuggaggaacucggcaucagagaagagugcgggguguucggauguauugccagcggugaauggcccacccagcuugacgucccucacguuauaacacugggcuuggugggguuacaacauaggggacaggaguccgcuggcaucguaacuucugaugguucaagugugccaacguuuaagagccacaaagggaugggacuggucaaccauguguucaccgaggacaaucuaaagaaacucuacguuuccaaccugggcauuggccacacacgguaugcaacuaccgggaagugcgaacuugagaauugucagccguuuguggucgaaacacugcauggaaaaaucgccguggcgcacaacggugaguugguaaaugcugcccgccuccgaaagaagcugcugcgucacggcauugggcucucuaccucgucagauagcgagaugaucacucaguuacuggcauacacacccccucaagaacaggacgauaccccagacuggguugccagaaucaaaaaccuuaugaaggaggcucccacggcauauaguuugcugauaaugcauagggaugugauuuacgccguccgggacccuuauggaaaucgcccacuaugcaucggcagacucauucccguguccgauaucaacgacaaagaaaagaaaacuucugagaccgaagguuggguggucagcuccgagucauguaguuuccugagcauaggggcuagguacuaucgggagguucuuccuggagaaauuguggagaucucucgccacaauguacagacacuggauauuaucucccgaucagaaggcaacccaguggccuuuugcaucuucgaguacgucuacuuugcgagaccggacagcauguucgaagaucagaugguguauacuguuagguaccgguguggccaacaguuggcaauugaggcccccguggacgcugaccucgucaguaccgugccugagucugccacaccagcagcucuggccuaugcggggaagugcggauuacccuacguagaaguucuguguaagaaucguuaugugggucgcaccuuuauacagccuaacaugagacucaggcagcuuggcgucgccaaaaaguucggggugcuguccgauaauuuuaaaggaaagcggaucgucuugguggacgauagcauuguucgaggcaacacgaucucgccaauaauuaaacuacugaaggagucuggugcaaaagaagugcauauccgcguagcuucacccccgaucaaguacccuugcuucauggggauuaauauccccacuaaggaggaacucauugccaacaaaccagaguuugaccaccuggcugaguaucuuggcgccaacuccgucguguaccugaguguugaaggauuggugagcuccguccaagagggcauaaaguucaaaaagcagaaagaaaagaagcacgauaucaugauucaggagaaugggaacggacucgaguguuucgaaaaaucuggucauugcacagcaugccugaccggcaaguacccuguggaguuagaaugguga

SEQ ID NO: 61016 - RNA, 387 nt, Artificial Sequence
  derived and/or modified sequence opt3 from PPBP__Homo_sapiens__NP_002695
augagccugagacucgacaccacacccuccugcaacucugccaggccucuucacgcucugcaaguguuguuacugcuaucacuccugcuuacugcacuggccaguagcacgaagggccagaccaaacggaauuuggcgaaggggaaagaggaaucccucgauucugaccuguacgcugagcugcgcuguaugugcaucaagacaacuucggguauucauccgaaaaacauacagucacucgaagucaucggaaagggcacccacuguaaucagguugaggugauugccacauuaaaggaugggcgaaaaaucugccuggacccagaugcaccccguauuaagaaaaucguacagaagaaacuugccggagacgaaagcgcugauuga

SEQ ID NO: 61017 - RNA, 246 nt, Artificial Sequence
  derived and/or modified sequence opt3 from PPCDC__Homo_sapiens__NP_001288034
augagagccugggacaggagcaagccccuccuguucugcccugcuaugaacaccgcaaugugggagcacccaaucacagcccagcaaguggaucagcuuaaagcguuuggcuacgucgaaauuccguguguugcuaagaaacuggugugcggggacgagggauugggugccauggcagaaguaggcacuauaguggauaaggucaaagagguguuauuccagcauuccggguuucagcaaucuuga

SEQ ID NO: 61018 - RNA, 1776 nt, Artificial Sequence
  derived and/or modified sequence opt3 from PPEF1__Homo_sapiens__NP_689412
augggcugcagcuccucuucaaccaagacaagaaggagugacacuagccugcgggccgcucucaucauucagaacugguaccgcggguauaaagcacgacuuaaggcccgucaacacuacgcgcugacgauauuccaguccaucgaguaugcugaugaacagggacagaugcaauugucuaccuuuuucucguuuauguuagagaauuacacacauauucacaaagaggagcuggaacuaagaaaccagucacucgagagcgagcaggacaugagggaucggugggacuauguggauaguaucgacguccccgauuccuacaaugguccucgccugcaguucccacuuacuuguaccgacauugaucuguugcucgaagccuuuaaggagcaacagauccugcaugcacacuauguucuggaagugcuuuucgagaccaaaaagguauuaaagcagaugccgaacuuuacacauauacagacuucucccagcaaagaggugacaaucugcggcgaccugcacgggaaacuugaugacuuguuccugaucuuuuacaaaaauggacuaccuuccgaaagaaacccauacgucuucaauggcgauuuuguggacagggguaagaacucaauugagauucucaugauccuguguguuaguuuccuuguguaucccaaugaccugcacuugaaccgggggaaucaugaagauuuuaugaugaaccuccgcuacggauucaccaaagagauacugcacaaguauaaguuacauggcaaacgaauccugcaaauucucgaagaguucuacgccuggcuuccuauuggcacgaucgucgacaaugagauccuggugauucacgggggaauaagcgaaacuaccgauuugaaccuacugcacagaguagagaggaauaagaugaaaucuguucucaucccacccacagaaacuaaccgggaccaugauaccgacuccaagcacaacaaagugggugucacauuuaaugcucauggccguauuaagaccaacgggucaccuacggagcaccugacugaacaugagugggaacagguggugacaaucuucagcgcaaguaauuauuacgaagagggaucuaaccgcggcgccuauauaaaacuuugcuccgguaccacuccaagauuuuuccaguaccaagucacaaaggcuaccuguuuucagccgcugaggcagcggguugauacgauggaaaauagcgccauuaagaucuugcgagagcgcgugaucucgagaaaaucugaccucaccagggcguuccagcugcaagaucaccggaaguccgggaaauuaucaguaagucagugggcauuuugcauggaaaacauucugggacuaaaucuccccuggcgcagccuguccucuaaccuugugaauaucgaccagaacggcaaugucgaguacaugagcucauuccagaacauuagaauagagaagccugugcaagaagcccacaguacauugguugagacucuguauagguaccguuccgaucucgaaaucauuuuuaaugcuaucgacaccgaccauagcggccugaucucuguggaggaguuccgggccauguggaaacucuuuucaagucacuauaacguccauauugaugacagccaggugaauaagcuggcaaacauaauggauuugaacaaggacggguccaucgauuucaaugaauuucucaaggcuuucuacguaguucaccgauaugaggaccugaugaagccagaugugacaaacuuaggauga

SEQ ID NO: 61019 - RNA, 2262 nt, Artificial Sequence
  derived and/or modified sequence opt3 from PPEF2__Homo_sapiens__XP_011530341
augggcagcgggaccuccacacagcaccauuucgccuuucaaaacgcugagagagcauucaaggccgcggcucugauccagaggugguaccggcgcuauguggcccgacucgaaaugcguagaaggugcacuuggucuauuuuucagucaauagaguacgcaggacagcaagaccaggucaaacuucacgauuucuuuaguuaucugauggaccauuucauccccagcucccacaaugaucgggacuuuuugacgcgcauuuucaccgaagauagauuugcccaggacucugagaugaagaaauguucggauuacgaaucaaucgagguuccugacagcuauacagguccaagguuaaguuucccgcugcuacccgaucaugcuacugcacucguggaggccuuucggcugaagcagcaacuucacgcucgcuacguacugaacuugcucuaugaaaccaaaaagcaccuggugcagcugccuaauauuaaccgagucuccacaugcuacucugaggaaaucaccguguguggcgaccuccaugggcaguuagaugaccugauauucaucuuuuacaagaauggacuuccaagccccgagagauccuauguuuucaacggcgauuucguggacagggguaaagacucagucgagauuuugaugauccuguuugccuucaugcuaguguacccuaaggaauuucaccucaaucgggggaaccaugaggaucacaugguaaaucugcguuauggauucacuaaagaaguuaugaacaaguacaaagugcacggcaaggagauucuucgcacacugcaggacgucuuuugcugguugccacucgcgacccugaucgaugaaaagguguuaauacugcauggcggggugagugacauuacggaucucgagcuucuggacaaaaucgagagaagcaagauugucucuacuaugagguguaaaacccggcaaaaguccgaaaaacagauggaggaaaagcgacgcgcaaaucagaaaucaagcgcccaaggacccaucccuugguucuugccagagaguagaucucuaccguccagcccccugaggcucgguucguauaaggcucagaagacaucucgguccucaaguaucccuugcagcggcucccuggaugggcgcgaacuuucuagacagguuaggagcucaguggagcuggaguuggaacguugucggcagcaagccggacuccugguaacuggcgagaaagaggaaccaagucgauccgcaagcgaagcugacucugaggccggugaguuaagaaagcccacccaggaagaguggcgccagguggucgauauucuguggucagacccuauggcgcaggaagggugcaaagccaacacaauaaggggaggcggcuguuacuuugggccagaugugacccaacagcuacuccagaaguauaauaugcaguuccugauccggagucacgagugcaaacccgagggauacgaauuuugucauaacagaaagguucuuacgauuuucagcgcauccaauuacuaugagguggguucuaacaggggcgcuuacgucaaguuggggccggcccugacuccucacaucgugcaauaucaggcuaacaaaguaacacauacccucacuaugcgccagcgaauaucgcggguugaagagagcgcccugcgugcacuuagagaaaagcuguuugcccacuccucagacuugcucagugaguucaaaaagcacgacgcugauaaagugggacugauuacauuaucugacugggcggcagccgucgagagcgugcugcaucuaggccuccccuggaggaugcugcgcccacagcuugucaauuccucagcugauaacauguuggaauacaagagcuggcugaagaaucucgccaaagagcaacugucucgggaaaacauccaguccaguuuacuggagacccuuuauagaaauaggagcaacuuggaaacgaucuuucgaauuaucgacucugaucacuccgguuucauuucacucgacgaguuccgccagaccuggaagcuguuuaguagccauaugaauauagauaucacagacgauugcauuugcgaccuagcacggucgaucgauuucaacaaagacgggcacaucgauauuaaugaguuucuggaagccuucagacucguggagaaguccuguccugaaggcgacgcuucugagugcccccaagccacuaacgcaaaagacagcggauguucaaguccaggcgcgcacuga

SEQ ID NO: 61020 - RNA, 3609 nt, Artificial Sequence
  derived and/or modified sequence opt3 from PPFIA1__Homo_sapiens__NP_003617
augaugugcgaggugaugcccaccaucagcgaagccgagggcccuccagggggagguggcgggcacggauccggcucuccgucacagcccgacgcugauagucauuucgaacaacugauggucagcaugcucgaggaaagagacaggcuucuggauacauugcgggagacucaggagacguuagcacugacccaggguaagcuacacgaaguugggcaugagcgcgacucccuccagcgacaacugaacacagcccuuccucaggaauuugcggcucugacuaaagaguugaaugugugucgugagcagcuccuggaaagagaggaagagauugccgaacugaaggcagagaggaacaauacccggcucuuacuggagcaccuugaaugcuugguaucucgccaugagagaucgcugaggaugacaguggucaaacggcaggcccaaucaccagcuggagugagcagugaaguugaggugcuaaaggcacucaaaucccuguucgaacaccacaaggcccuugaugagaagguccgcgagcgacugagaguggcuuuggaaagguguucucuccuggaggaagaguuaggcgccacccauaaagaacugaugauacucaaggagcagaacaaucagaaaaagacucuuacagacggcguacuggauaucaaccacgagcaggaaaauacccccagcacguccgggaaacggucaagugacggauccuugucucaugaggaagaucuagcgaagguuauugagcugcaagagaucauuuccaagcagucacgugaacagagccaaaugaaagagcgccucgcaagucugucuucccacgugacugaacuugaggaagaccuggauaccgccagaaaggacuugaucaaaagcgaggagaugaacacaaagcuccagagggauguccgggaagcuauggcccagaaagaggacauggaagaacgaauaacuacccuggaaaagcgcuacuuagcagcucagagagaggccacaucggugcacgaccugaaugauaaacuagagaacgaaaucgcgaauaaggacucuaugcauaggcaaaccgaggauaagaaccggcagcuccaggaacgccuggagcuugccgaacagaaauugcaacagacgcugagaaaggcagagacucucccugagguggaagcugagcuggcccagagggucgcugcccuuuccaaagcagaggagcgucacgguaauauugaggaacggcugcgacagauggaggcccaauuggaagagaagaaccaggaacuccagagagcuaggcagcgcgagaaaaugaaugaggaacauaacaagcggcugucagacacaguugauaaguuacugagugagagcaacgaaagacuacaacuccaccugaaagagaggauggcggcacuugaagacaagaauagcuugcugcgcgagguggagucugccaaaaagcagcucgaagagacccagcaugauaaagaccaacugguauuaaacaucgaagcucugcgagccgagcuugaucacaugcgguugcguggcgcaagccuccaccaugggagaccacaccugggaucagugcccgacuuuagguucccuauggccgauggccauacugacaguuauuccacaagcgcuguccuacgccggccacagaaggguagacuggccgcacucagggacgaaccgucuaaggugcagacccugaaugagcaggauugggagcgagcgcaacaggcuucaguucuugccaacguggcacaggccuuugaaagugacgcugaugucagcgacggggaggaugaccgcgauacguugcuguccucuguggacuuacucucgcccagcggacaggccgaugcacacacccuggcuaugaugcuucaagaacagcuggacgccauuaauaaagagauccgguugauacaggaggaaaaggagaacacagaacagagagcggaggaaauugaguccaggguaggcucaggcagucucgauaaucuggggcguuuccgcucuaugagcuccaucccuccauaccccgccucaagccuagcuucuuccaguccuccaggaagcggucggucuacucccagaaggauuccgcacuccccugcacgagagguugaccggcugggcgugaugacccuccugcccccaucacgcgaagaggucagagaugacaaaacaacuaucaagugcgaaaccaguccucccagcucgccaagggcccuucgguuggaccgacugcauaaaggggcuuuacacacagugucccaugaggauaucagagacauucgcaacucuaccggaagccaagauggccccgucucaaauccuaguuccucuaacagcucccaggacucacuccacaaggccccaaagaaaaaggguauaaaaagcaguaucgggaggcuguuuggcaagaaagaaaagggacguccgggccagacugggaaagaggcacuuggacaagcgggugugucugagacggauaauuccagccaggacgcccugggccuaucgaagcucgggggacaggcugaaaagaaccggaaacugcagaagaaacaugaguugcuggaagaggccagaaggcaaggcuuacccuucgcacagugggaugguccuacaguugugguauggcucgaacugugggucgggaugccagcuugguauguggccgcaugucgcgccaauguuaagucaggcgcuauuaugucugcgcuuagugacaccgagauccagcgagagauaggaauuuccaacccccugcacagauugaaacuccggcuggccauccaggaaaucaugagccuaacuucuccuagcgcaccacccaccuccaggacaacccuggcuuacggcgauaugaaucacgaguggauugggaacgaauggcuuccgucacucggacugccucaauaucgcaguuacuuuauggagugcuugguggacgcccguaugcuggaucauuuaacuaagaaggaccucagaggucagcugaaaauggucgauagcuuccaccggaacucuuuucaguguggcaucaugugccuuaggcgccugaauuaugaccgaaaggaguuggaaagaaaacgggaggaaucccagucagagauuaaggacgugcucguauggaguaacgauagggugauacgcuggauccugagcauugggcuaaaagaauacgccaauaaccugaucgaguccggaguucauggcgcacuucucgcucuggacgagacauucgauuuuucugccuuggcguuacugcuccaaaucccaacgcagaauacccaggcuagagccguccuggaaagggaguucaacaaucuucuggugauggguacugaccggcguuucgaugaagacgaugacaagucguuucgccgagcacccagcuggagaaagaaauucaggccuaaggauauucggggguuggccgcuggcucagcagagacacuacccgccaacuuucgcgugaccuccaguaugucuagcccauccaugcagccuaaaaagaugcaaauggacggaaaugucucaggcacacagagacuggauucugcgacuguuaggaccuacagcuguuga

SEQ ID NO: 61021 - RNA, 3744 nt, Artificial Sequence
  derived and/or modified sequence opt3 from PPFIA2__Homo_sapiens__NP_001207402
augaugugcgaggugaugcccaccaucaacgaagacacaccuaugagccagagaggcucccaaucuucagggagugauagcgacucccacuucgagcagcugauggucaauaugcucgaugaaagggaccggcuucuggauacuuugcgcgagacgcaggaaucuuuaucgcuggcccagcaacgacuacaggacguuauuuacgaucgugacucacuccagagacagcugaacagcgcucuaccacaagauauagagagucugaccggagguuuggcaggcuccaagggggccgacccgcccgaguuugcggcucucacaaaagaacugaaugccuguagggagcagcugcucgaaaaggaggaggaaaucucugaguuaaaagcagaacggaacaauacucgccugcuuuuggagcaucuggaaugccuagugagcagacacgagaggucccuccggaugaccguagugaagcgccaggcccagucaccuaguggagucagcucugagguggaaguucugaaagcucuuaagucccuguucgagcaucacaaggcauuggaugaaaaagugcgagagagacucagggucucacuggaacgggugagcgccuuagaggaggaacuggcugccgcgaaccaagagauuguagcacuccgugaacagaauguucauauccagcgcaagauggccaguucugagggcuccacagaaagcgagcaccuugaggguauggaaccagggcaaaaagugcacgagaagagacugucgaacggaucuauugacuccaccgaugaaacuucacagaucgucgaguugcaggagcuacuggaaaaacagaauuaugagauggcucaaaugaaggaaaggcucgccgcacugaguagccgggugggcgagguggaacaggaggcugagacagcccgaaaggaccuuauaaaaaccgaagagaugaacacgaaguaccagcgcgacaucagagaagcgauggcccagaaagaggauauggaagagaggauuacuacccuggagaagcgguauuuguccgcacaacgcgaaucuacaagcauccaugacaugaaugauaaacucgagaacgaacuggcuaauaaggaggccauuuuaagacagauggaagagaaaaacaggcagcugcaggagcgucuagaacucgcugagcaaaagcugcagcagacuaugcggaaggccgaaacccuucccgaggucgaggcagaauuggcccagcgaaucgcugcgcugacaaaagcagaggaaagacacggcaauauagaggaaaggaugcgccaucucgaggggcaacuggaggaaaagaaccaggagcuucagcgggccagacaaagggagaaaaugaacgaagaacacaauaagcgccugucagacaccguugaucgauugcucacggagaguaacgagcggcugcaguuacaccugaaagaacguauggcugcccuagaggaaaagaaugugcucauucaggaguccgaaacuuuuagaaagaaccuggaggagagccuucaugacaaagaaagguuggcagaggaaaucgagaagcugcgcucugagcucgaucagcugaaaaugcggacaggaucauuaauugaaccuaccaucccaagaacucaccuggacacaagugccgagcuuagguacagcguagguuccuugguggauucucaaucggacuaucgaaccacgaaggucauccgccggcccagaaggggccguaugggggugcgccgggaugaaccuaaaguuaagagccucggagaccaugaguggaauagaacccagcagauuggcgugcuguccucacacccauucgaaagugacacagagaugucugauauagacgaugacgauagggagacuaucuuuagcuccauggaccuacugucaccgagcggucauucugaugcucagacccucgccaugaugcugcaagaacagcuugacgcaauuaacaaggagauccgauugauacaggaagagaaagaauccacagagcugcgggcggaggaaauugagaaucgcgucgcuagugugagcuuagaagggcucaaccuggccagaguacaccccggaacuucuaucaccgcauccguuacagccucaagucuugcuagcucguccccuccaucuggccacagcacccccaagcugacuccuaggucaccagcccgggagauggaucgaaugggcgugaugacguugcccagugaccucagaaaacaucgcaggaagaucgcagucguggaagaggaugggcgugaggacaaagcuacaauuaagugugaaaccuccccgccucccacuccacgggcccugagaaugacccacacacuaccuucuagcuaccauaaugaugcgagguccucacugagcgucagucucgagcccgaaucucugggacuugguuccgccaacagcucgcaggacucauugcacaaggcuccuaaaaagaaaggcaucaagucuaguauugggcgccuguucggcaaaaaggagaaagcacgauuaggacaacucagagguuuuauggagaccgaagccgcugcccaggagucccuggggcuuggcaagcugggaacucaggcagaaaaggaccggaggcuuaaaaagaaacacgagcuccuggaagaggcgcgccguaagggcuugcccuucgcccaaugggaugggccuacagugguugcuuggcuggaguuauggcucggaaugccagccugguauguggcagcuugcagagccaauguaaaaagcggugcaauaaugucugcccugagcgacacggaaauccagcgggagauuggcaucuccaacccgcuucauaggcugaaguugcgccucgcuauccaggaaauggucucacugaccagucccagcgcgccuccaacuucucgaacacccuccgggaauguguggguuacccacgaggaaauggagaaccuagccgcaccagcuaagacaaaagagucagaagagggaaguugggcccaguguccaguguuucugcaaacucuugccuacggcgauaugaaucaugaauggauugguaacgaguggcuccccagccugggguugccgcaguacagauccuauuucauggaaugccuggucgacgcucggauguuagaucaccucaccaagaaagaccugagggugcaucuuaagaugguagauucuuuucaccgcacgucgcugcaguacggcauaauguguuugaaaagacucaacuaugacaggaaggagcuggagcggcgucgcgaagcaagccagcacgagaucaaggaugugcuaguuuggucaaaugaccgagucauuagauggauccaagccauuggacugagggaauacgcgaacaauauccuugaguccggcgugcaugggagucucauagcucuggaugagaacuucgacuauucuagcuuggccuuacugcuccagaucccuacccagaauacacaggcacggcaaauucuggaacgcgaguacaacaaucuucuggccuugggaacugaaagaaggcuagaugaguccgacgacaaaaacuuucggcgagguucaaccuggagacgccaguucccacccagggaagugcacggcaucucuaugaugccugggagcagugagacacugcccgcuggauuccggcucacuaccacguccggccagagccguaagaugacaaccgaugacggugucuuuucuguuuauucaacuuga

SEQ ID NO: 61022 - RNA, 3624 nt, Artificial Sequence
  derived and/or modified sequence opt3 from PPFIA4__Homo_sapiens__NP_001291260
augugcgaggugaugcccaccaucaacgaaggcgacagacuggggccuccacacggagccgaugcugacgcaaauuucgagcagcucauggucaacaugcuugaugaaagggagaagcuguuggaaaguuuacgggagucccaagagacacuggccgcgacucagucucgccuacaggacgcuauucaugaacgagaucagcuccaacgucaccuuaauucagcccugccgcaggaguuugcaacgcugaccagagaauugaguauguguagggagcagcuccuggagcgggaagaggaaauaagcgagcugaaagccgaacgcaacaauacaagacucuuacuggagcaucuugagugcuugguuuccaggcacgaacggucucugcgcaugacugugguaaagcgacaggcucaaucgcccucaggugugagcagugaggucgaagugcuaaaagcacucaagucccuguucgagcaucacaaagcccuugacgaaaagguuagagagaggcugcgggcugccuuggagcgugugaccacacucgaagaacagcuggcgggcgcacaccagcaggucucugccuuacaacagggggcuggagugcgcgauggcgccgcagaagaggaagguaccguagagcuggggccuaagagacucuggaaagaggacacuggaaggguugaagaacuucaggaacuguuggagaagcaaaacuuugagcuaagccaggcucgggaacgacuggugacacucaccacgacugucaccgagcuggaagaggaucuuggcacagcccgcagagaccugaucaaauccgaagaguugucaaguaagcaucagagggaucuccgggaggcgcuggcccagaaagaagacauggaggaacgcauuacuaccuuagagaagagauaccuggcagcucaaagggaagccacaagcauccacgaucuaaaugacaagcucgagaacgagcuggcuaauaaagaaucucuucaucgucagugugaggaaaaggcccggcacuugcaggagcugcucgaaguggcagagcagaaacugcaacagaccaugcgaaaggccgagacgcuuccagaaguggaggcugaacuggcgcagagaauugcagccuugacuaaagcugaggagaggcacggcaacaucgaggagcaucuccgccagcuggaagggcaauuagaggaaaagaaucaggagcuggcccgggucagacagagggagaaaaugaacgaagaccacaauaagcgccuauccgauacaguugaccgacuccugucagagagcaacgaacggcuucaguugcaucugaaggagcguauggcagcccucgaagagaaaaauacccugauacaagaguuagaaaguucucagagacagaucgaggaacaacaccaucacaagggaaggcuguccgaggaaauugagaaacuucgccaggagguggaucaguugaagggucggggcgggcccuucguagacggagugcacagcagaucgcauaugggcucugcugccgaugucagguuuucccucgguacuacaacccacgcaccuccaggggugcaucgacgcuauucagcgcugcgggaagagagugcuaaagacugggaaacgagcccccuaccuggaaugcuggccccagcagccggcccggcuuucgauuccgaccccgagaucucugauguugacgaggaugaaccuggcgggcucgugggaagcgccgacgucgugucaccaaguggucacuccgacgcacagacccuggcuaugaugcuucaagagcaguuggaugccauuaacgaagagaucagaaugauacaggaagagaaggagagcacagaacugagggcggaggaaauugagacucguguaaccucuggcucaauggaagccuuaaaccucaagcagcugcgcaaacgggggaguauccccacaagccuuacugcucuguccuuggcaucugccucgccuccacucagcggaagauccacccccaagcugacaucaaggagugcugcccaagaccuagaucgaaugggcguuaugacccugccgucugaccuccggaaacaccgcagaaagcugcuuagcccuguguccagggaggagaaucgggaagauaaagcaacuauuaagugcgagacgucacccccaagcucuccucgaacauugagacuggaaaaguuaggucaucccgcgcucucccaggaggaagggaaaagugcccuggaggaccagggcagcaacccaucuuccucaaauaguagccaggauucgcuucacaagggagcuaaacgcaagggcaucaaauccucuaucgggaggcuguuuggaaagaaggagaaaggucgucuaauucaacucagccgggacggcgccaccgggcauguccuguugacugauucagaguucaguaugcaggagcccauggugccugcaaagcugggaacccaggcugaaaaagacagaagguuaaagaaaaagcaccaacuccuggaggaugcccgccgaaaaggcaugccauuugcacagugggacgguccgacagucguguccuggcuugagcuguggguugggaugcccgccugguacguggcugcguguagagccaacguaaagucuggcgcaauaaugagcgcuuuguccgauaccgaaauccagcgggagauuggaaucucaaaugcccuccauaggcugaagcuacgccuggccauacaggaaauggucagccuuacuagcccuucugcuccacccacaucccguacgagcucgggcaacguguggguuacccacgaggaaauggagacucucgagacaucaaccaaaacagacucugaagaggggaguugggcacaaacucuggccuauggagacaugaaucacgaauggauugguaacgagugguugccuucccugggcuuaccacaguacagaagcuauuucauggaaugccucguggaugcgcggaugcuggaccaucuuaccaagaaagaucugaggguccacuugaagaugguggacucuuuucaucgcacgagccuccaguacgggaucaugugucugaaacgacuaaauuaugauagaaaggagcuggagaagcggagggaagagucccagcacgaaaucaaagacguacuuguguggaccaacgaucaaguuguccauugggugcagucaauuggacuccgcgacuacgcuggcaaucugcacgagaguggugugcacggggccuuguuagcacuggaugaaaacuucgaccauaauacacucgcccugauccuucagauucccacucagaacacccaagcuagacaggucauggagagggaguuuaauaaccuguuggcacuaggcacagaucggaagcuggacgauggagacgacaaaguuuuccgucgcgccccgagcuggcgaaagagauucaggccucgggaacaccauggccgcgggggaaugcucucugcguccgcugagacucugccagccggcuuuagagugucaacccuugguacguuacagcccccucccgcaccaccuaaaaagauaaugcccgaagcccacagucacuaccuguaugggcauaugcucagcgcuuucagggauuga

SEQ ID NO: 61023 - RNA, 2577 nt, Artificial Sequence
  derived and/or modified sequence opt3 from PPFIBP1__Homo_sapiens__NP_001185844
augcugcagcaagagcuccuuagcagaaccucccuggaaacacagaaguuggacuuaauggccgagaucucuaaccugaaacuaaagcucacugcuguggaaaaagauaggcuggacuacgaggauaaguuccgggacacggaaggccuuauucaggagauaaaugaucugcgcuugaaagucucagagauggacagugaacgacuccaguaugagaagaagcugaaaagcaccaagucccugauggcaaaacucucuucgaugaagaucaaaguugggcaaaugcaguacgaaaagcagcguauggagcagaagugggagucauuaaaagaugaacuggccagccuuaaggagcaauuggaagagaaagaaagugaggugaagagacugcaggagaagcuaguaugcaaaaugaaaggagaagguguggagauugucgacagggauaucgaagugcagaagaugaagaaagcgguugagucccucauggcugccaacgaagagaaggaccggaaaauugaggaucugcgccagugucuuaauagauauaagaaaaugcaagacacagugguccuggcacagggcaaggauggggaauacgaggaauugcucaacucuagcuccaucucaagucuguuagacgcccagggauuuagcgaccuggagaagucucccuccccuacuccagugaugggcucaccgagcugcgaucccuucaauaccaguguaccugaagaguuucacacaaccauacuccaaguuucuaucccaucccuucugcccgcuacugugagcauggagacaucggaaaaaucuaaguugaccccuaaaccagagacguccuucgaagagaacgacgguaauauuauccuaggggcaacugucgauacccagcugugugacaagcuccugacaucaagucuucagaaaagcuccucucugggaaacuugaagaaggagacuagcgauggcgaaaaagagaccauucagaagacaucagaagacagggcccccgcugagagucggccuuuuggcacccucccaccgcgcccaccugggcaagauacguccauggacgauaauccauucggaacucgaaaagugagaagcucuuuugguaggggcuucuuuaagaucaaaucaaacaagcggacagccagugcgcccaaucuggcagaaaccgagaaggagacugccgaacauuuagaccuggcuggggccagcucccguccuaaagauucucagcgcaacucgccauuccagauacccccgccuagccccgacuccaagaaaaagucaagaggaauuaugaaacuauuuggcaagcucaggcggagucagucuacaaccuucaauccagacgauaugagcgagccugaauuuaaacgaggugggacgcgcgcaaccgcuggacccagacugggcugguccagggaccuuggccaaucaaacagcgauuuggacaugccauucgccaaguggacaaaggaacaggugugcaauuggcugauggagcaggggcucggaucuuaucugaacuccgguaaacacuggaucgcgaguggccagacucuucugcaagccagccagcaggauuuggagaaggagcucgggauuaaacauucucugcaccggaagaaauuacagcuggcacuacaagcucucggauccgaagaggaaaccaaccauggcaagcuggacuucaauugggucacacgcuggcuugaugacaucgguuugccccaguacaagacucaguuugaugaggggagaguugacggcaggaugcugcacuauaugaccguggaugaccuccugucauuaaaaguagugaguguccugcaccaucuuagcaucaagcgugccauucaaguguugcggauaaacaauuucgaaccuaacugucuccgaagaaggccaucggaugagaauacaaucgcuccguccgagguucagaaauggaccaaccaccgcgugauggaauggcugcggucugucgaccuagccgaguacgcacccaaucugagaggaagcggcgugcaugggggacucaugguacuggaaccuagguuuaacguugagacuauggcccagcuuuugaauauuccacccaacaagacgcuguuacgccgacaccucgcuacacacuucaaucugcuuaucggugcggaggcacagcaucaaaaacgggacgccauggaacugccugauuacguguugcucaccgcuacugccaaggucaagcccaaaaagcuggcauuuucaaacuucggcaaucuacguaaaaagaaacaggaggacggggaagaguaugugugccccauggaacugggacaggccaguggcuccgcuucuaagaaggguuuuaaaccggggcucgauaugagacuguacgaggaggacgaucuugacagguuggaacagauggaggauagcgaaggcaccguccgccaaauaggagccuucuccgagggcauuaacaaucugacacacauguuaaaggaagacgauauguuuaaagacuucgcagcgcggucaccuagcgcuaguaucaccgaugaggacucuaacguguga

SEQ ID NO: 61024 - RNA, 2295 nt, Artificial Sequence
  derived and/or modified sequence opt3 from PPFIBP2__Homo_sapiens__NP_001243497
augagcuccgagcaguggcccagacugccuggcaaggugucuguccucaccgaccaaguugaagcccagggggagaaaaucagggaucuugaagugugccuggagggacaccagguaaaguugaacgcugcagaagagauguuacagcaagagcugcuaucacggacaagucucgaaacucagaaacuggaccuuaugacggaggugagcgaacugaaguugaaacucgucgguauggagaaggagcagcgcgaacaggaggaaaagcaacgaaaagccgaggaacugcugcaggagcuccgucauuuaaagauuaaaguggaggaacuggagaaugaaagaaaccaguacgaguggaaacuuaaggcgaccaaggcugaaguugcccaguugcaagaacagguggcacugaaggaugccgagauagaaaggcuacacucccagcucucucggacagcugcacugcauucggagucacacacugaacgcgaccaagagauccagagacuuaaaaugggcauggaaacccuguugcucgccaaugaggauaaggacaggcggauugaggaacugacaggguuacugaaccaguaucgcaaagucaaggagaucgugaugguaacccagggaccaagcgaacgaacucucaguauuaaugaggaggaaccggagggcgguuucuccaaauggaacgcuacaaauaaggaucccgaggagcuuuuuaaacaagaaaugccuccaagauguucuagccccaccguugggccuccaccccugccucagaaguccuuggagacgagggcccagaagaaacuaucaugcagucuggaggaccuccggagcgaaucuguggauaaguguauggacggaaaccagccauucccgguccuggagcccaaagauuccccuuuucuugcggaacauaaguacccaacucugcccggcaaauugucaggcgcaaccccuaauggggaggccgcuaagagcccacccacaaucugccaaccggacgccacuggaaguucucuccugcguuuacgcgauaccgaauccgguugggacgacacagcaguggugaacgaucugagcucgaccucuuccggcacggagucagggccucagaguccccuaacuccagacggaaagagaaauccuaaaggcauaaagaaauucugggguaagaucaggcggacacagagcgggaacuuuuauaccgauacucucggaauggcugaguuccgacgcggcggccugagagccacagcggggcccaggcuuucccggacccgcgacucuaaaggacaaaagagcgaugccaaugcaccauuugcucaguggucaacggaaagagucugugccugguuggaggacuucggucuggcucaguacguuauuuuugccaggcagugggugaguuccggccacacccuccugacagcaacuccccaggauauggaaaaggagcuugggaucaaacacccucugcaucguaagaaauugguacucgccgugaaggcuauuaacaccaaacaagaagaaaagagcgcgcuguuagaccacaucugggucacacgguggcuggaugacauaggacuaccacaguauaaggaucaguuccaugagucucgaguggacggcagaaugcuccaauaccugacuguuaaugaccuuuuguuucugaaagugaccucacagcuccaccaccugaguauuaagugcgcaauccaugucuuacacgugaacaaauucaacccgcauugucugcacaggcgccccgccgaugagagcaaucuuuccccuucugagguaguucaguggucgaaccaucgggugauggaaugguugagaagcgucgaccucgcugaguaugccccaaaucugagggguuccggggugcacggcggacuaauuauccuggagccccgcuuuacaggcgauacccucgcaaugcugcuuaacaucccuccacagaagacuuugcugcgacggcacuuaacgacaaaauucaaugcccucauugggcccgaagcugagcaagaaaagcgugagaaaauggccucaccggcauacaccccucugacuaccacagcgaaggucagaccaaggaaacuuggauucagucauuuugguaacauacgcaagaagaaauucgacgaaucuaccgauuacaucugccccauggagccuagcgacggcguguccgauucacaccggguuuauagcggguacagaggacugucucccuuggacgcuccagagcucgauggccuggaccaggugggucagauuuccuga

SEQ ID NO: 61025 - RNA, 318 nt, Artificial Sequence
  derived and/or modified sequence opt3 from PPIA__Homo_sapiens__NP_001287910
augugccagggcggggacuucaccagacacaacggaacagguggcaagagcaucuacggggagaaauuugaagaugagaauuucauucugaagcauacuggacccggcauacucuccauggccaacgcugguccuaauacgaacgggucucaauuuuucaucuguaccgcaaaaacagaauggcuugacggaaagcacguggucuuuggcaaaguuaaggagggcaugaauauuguggaagccauggagagguucgggucacggaacggaaagaccaguaaaaagaucacuauugcggauugcggucagcuggaguga

SEQ ID NO: 61026 - RNA, 651 nt, Artificial Sequence
  derived and/or modified sequence opt3 from PPIB__Homo_sapiens__NP_000933
augcugagacucagcgagaggaacaugaaggugcuucuggccgcugcauugaucgccggcuccgucuucuuuuuacugcuacccgggccuucugcggcugacgagaaaaagaaaggaccaaagguuaccgugaaaguauacuucgaucuccggauuggugacgaagaugugggccgcgucauauuugggcuguucggaaagacagugccgaagacuguugacaauuuuguggcccuugcaacgggcgaaaaagguuucggguauaagaacucaaaauuucaccgagucaucaaggauuucaugauucagggaggcgacuuuacccguggcgaugggacaggagguaaaaguaucuacggcgagagauuccccgacgaaaauuuuaagcugaagcauuaugggccuggaugggugagcauggccaacgcuggcaaagauacuaaugguucccaauucuuuauuaccacaguaaagaccgcaugguuggacgggaaacacguuguguucggaaagguccucgagggcauggagguggugaggaaagucgaaucuacuaagacagauucgcgggacaaaccacugaaggauguuaucauagccgacugcggcaagaucgagguggaaaaacccuucgcuauugccaaggaguga

SEQ ID NO: 61027 - RNA, 639 nt, Artificial Sequence
  derived and/or modified sequence opt3 from PPIC__Homo_sapiens__NP_000934
augggccccgggccuagacugcuccuuccacugguguugugcgucggauuaggugcccugguuuucagcuccggcgcugagggguuuaggaagcggggaccgucugugaccgcaaaaguauucuuugacgugcgcaucggcgauaaggacgucggucgaauugugauagggcuauucggaaaaguugugcccaagacagucgaaaacuuuguggcccucgcgacuggcgagaaaggcuacggguauaagggaucaaaguuccaccguguaaucaaagauuuuaugauucaggguggcgacaucacgaccggggauggaacaggcgguguuaguauuuacggggaaacuuucccugacgagaauuuuaagcugaaacauuauggaaucggcugggugagcauggcuaacgccggcccagauaccaaugggucccaauucuuuauaacacuuaccaagcccacuuggcuggacggaaaacacgucguguucgguaaggugaucgauggcaugacagucguucauucuauugaauugcaggcaaccgacgggcacgauagaccucucacgaacuguucgaucauuaauucaggaaagaucgacgugaaaacuccauuuguaguggagauagccgauugguga

SEQ ID NO: 61028 - RNA, 1113 nt, Artificial Sequence
  derived and/or modified sequence opt3 from PPID__Homo_sapiens__NP_005029
augagccaccccuccccucaggccaagccaucuaacccgucaaaucccagaguguucuuugacgucgauaucggcggggagaggguuggacggauugugcuggaacucuucgcugacauaguaccuaaaaccgcagagaacuuucgcgcccuuugcacaggugaaaagggcaucgggcauacuacgggaaaaccacugcacuucaagggcugucccuuucaucgaauuaucaaaaaguucaugauucaagguggggauuuuaguaaucagaacggaaccggcggcgagagcaucuacggggaaaaguucgaggacgagaauuuucacuauaaacaugaucgugaaggauuguuauccauggcgaacgcugguagaaauacaaacggcucucaguucuuuauaacuaccgugccuacaccacaccuggacgggaagcacgucguguucggacagguuaucaaaggcauugguguggccaggauccuagagaaugucgaagugaagggggagaaacccgcaaagcucugcguaauugccgaguguggagaacugaaggagggcgaugacggcgggaucuuuccuaaagauggaucgggugacucacauccagauuucccggaagacgcugauauagaccuuaaggacguugauaaaauucuguugaucaccgaggaccucaagaacauuggcaauacuuucuuuaaaagccaaaacugggaaauggcaaucaagaaauacgccgaggugcugcgguaugucgauaguuccaaggcugugaucgagacagccgaccgcgcgaagcugcagcccauugcacucucuugcguguuaaauauaggggccuguaaacugaagaugagcaacuggcagggagcuaucgauuccugccuugaagccuuggagcuggacccuucaaauaccaaagcacuauacagaagggcucagggcuggcaaggucucaaggaauaugaucaggcccuggcggaccuuaaaaaggcccaggggauugcaccagaggauaaggcuauccaggccgaacuguugaaagucaagcagaaaauaaaggcucaaaaagacaaggagaaggccguuuacgcaaaaauguucgccuga

SEQ ID NO: 61029 - RNA, 624 nt, Artificial Sequence
  derived and/or modified sequence opt3 from PPIF__Homo_sapiens__NP_005720
augcuggcccucagaugcggcuccagguggcuugggcuguugagcgugccccggucugucccuuuacgccugccagcugcacgagccuguucaaagggaaguggugacccgagcuccucuucgucaagcggcaacccccuaguuuaccucgauguggacgcgaaugggaaaccucugggacguguagugcuugagcugaaggcugaugucgugccaaaaaccgccgaaaacuucagagcauugugcacaggcgagaaggguuuuggguauaaaggaaguacuuuccacaggguuauccccuccuuuaugugucaggccggcgacuucacgaaucauaacggcaccgggggaaagucuauuuacgguagccgguuuccugaugaaaauuucacacucaagcacgugggcccagggguccuguccauggcuaacgcaggacccaauacuaacggcucacaauuuuucauaugcaccaucaaaacagacuggcuggaugguaagcaugugguauuugggcacguuaaagagggaauggacguggucaagaaaauugaaaguuucggcagcaagucuggccgcaccuccaagaaaaucgugauuacugauugugggcagcucucauga

SEQ ID NO: 61030 - RNA, 2265 nt, Artificial Sequence
  derived and/or modified sequence opt3 from PPIG__Homo_sapiens__NP_004783
augggcaucaaggugcagagacccaggugcuucuuugacauugccauaaacaaucaaccugcugggcgggucguuuucgagcuguuuagcgauguguguccaaaaaccugcgaaaacuuccgcugucucugcacaggagagaaggguacuggcaaauccacgcagaagccgcuucacuacaaaucuugucuguuucaucgaguagugaaggacuucaugguccaagggggagauuuuucagaaggcaauggucgugggggagagaguaucuauggcggcuucuuugaagacgagagcuucgcagugaagcacaacaaagaguuuuuguuauccauggccaauagagggaaggauaccaacggaucucaguucuuuauuacaacuaaacccaccccucaucuggacggucaccauguuguguucggccaggucaucucggggcaggaagugguaagggagauugaaaaucagaagacagaugcggcuucaaaaccauucgccgagguucggauccuaagcugcggagagcucauacccaagaguaaggugaaaaaggaagagaaaaagcgccacaaauccucuagcuccucaaguucaucuuccucagacagcgauaguucuuccgacagccagucgucuuccgauucaagugacagcgaauccgcaaccgaggaaaagucuaaaaagagaaagaaaaagcacaggaaaaacagccggaagcauaaaaaggagaagaaaaagcgcaaaaagagcaaaaagagugccuccagcgagucugaagcugagaaucuggaagcacaaccucagucaacuguccgaccagaggaaauucccccuaucccagagaacagauuucuuaugaggaagaguccgcccaaagccgaugagaaggaacggaaaaaucgugagcgcgaaagagagagggaauguaacccuccaaauagccagcccgcuuccuaccagcggcgacuguuggugacacgcucuggcagaaagaucaaagguagggggccucggcgcuauagaaccccaucgaggagccguucccgggaccgauucagaaggucagagacgcccccgcacuggcgccaagagaugcagcgggcccagagaaugagggugaguucuggagaacgcuggauuaagggcgacaagagcgagcucaacgaaaucaaagagaaucaacgauccccuguccggguuaaggagcguaaaauaacugaucauagaaacgugucagaaagccccaacaggaagaaugagaaagaaaagaaaguaaaggaccacaagucuaacuccaaagagcgcgauauucggagaaauagugaaaaggacgauaaauacaagaacaaagugaagaagagggcgaaaagcaagucucgauccaaaucaaaggagaaaaguaagagcaaggagcgcgacucgaaacacaaucggaacgaagagaagagaaugaggucccguucuaaaggccgcgaucaugaaaaugucaaggagaaagaaaagcagagcgacucaaaggggaaagaucaggagcggaguagauccaaggagaaaucuaagcagcuggaaagcaaauccaacgagcacgaccauucaaagagcaaagaaaaggauaggcgagcacaaagucggucucgcgagugcgacaucaccaagggaaaacacuccuauaauagcagaacaagggaacggucgcgaucaagagaccgcucuaggcgugugcggaguagaacucaugauagggaccgcucccgaagcaaggaguaccacagauaucgggagcaggaauacaggcgccgugguagaucucggagcagggagcgccgaaccccaccuggcagaucccggucaaaagauaggcgcagaaggcggcgugacagucgcagcucugaacgagaggagucccagucaagaaacaaggauaaauacaggaaucaggaaaguaagagcucccaccggaaggagaacucugaaucggagaaacgcauguauagcaagucaagagaccauaauuccaguaacaauucuagggaaaagaaggccgaucgggaccaaagccccuuuuccaaaauuaagcagucaucucaggauaacgagcugaaaagcaguaugcucaaaaacaaggaggacgagaaaauccgauccagcguugaaaaggaaaaucagaaaucuaaggggcaagagaacgaucacgugcaugaaaagaauaaaaaguucgaccacgagucauccccaggaacagaugaggacaaaaguggcuga

SEQ ID NO: 61031 - RNA, 501 nt, Artificial Sequence
  derived and/or modified sequence opt3 from PPIL1__Homo_sapiens__NP_057143
auggccgcuauucccccugacagcuggcagccaccgaacguguaccuggagaccuccaugggcaucauaguccucgaacuuuauuggaagcacgcacccaaaacaugcaagaauuucgccgagcuggcgagaaggggguacuauaacggaacuaaauuucaucggaucauuaaggauuucaugauccaagguggcgacccuacggggaccggacgcggcggugcuucuauuuacgggaaacaguuugaagaugaguugcacccagacuuaaaguucacaggagccggcauccuggcaauggccaaugcuggccccgauacuaacgggucacaguuuuucguuacccuagcaccuacacaguggcucgacggaaagcauaccauauuuggucgagugugucaaggcaucgggaugguaaaucgugugggaauggucgaaacuaacagucaggauagaccaguggacgauguuaaaauuaucaaggccuaucccagcggcuga

SEQ ID NO: 61032 - RNA, 1563 nt, Artificial Sequence
  derived and/or modified sequence opt3 from PPIL2__Homo_sapiens__NP_680480
augggcaagagacagcaccaaaaagacaagauguacauuaccugcgccgaguauacacauuucuacgggggaaagaagcccgaucugccucagacuaacuuuaggcggcucccauucgaccacuguagccuuucccugcagccguuuguguaucccgucugcacgccugaugguaucguuuucgacuuguuaaauauagugccauggcugaaaaaguacggcaccaaccccucuaauggggaaaagcuagauggacgcucacucaucaaacugaacuuuaguaagaauagcgagggcaaauaucauuguccuguacuuuucacaguguuuacuaacaauacccacauugucgcugugcgaacaaccgguaacguuuacgcauaugaagccguggagcagcugaauaucaaggcgaaaaacuuccgugacuugcucacugaugaaccauuuuccagacaagacauuaucacacugcaggaucccaccaaucuggacaaguucaacgucucuaauuuuuaccaugugaagaacaauaugaaaauaaucgauccugacgaggagaaggcuaaacaggauccaucguacuaucucaagaacacgaacgccgaaacuagggagaccuuacaggaacuguacaaagaguucaagggggacgagauucuugcagccacaaugaaagcuccggaaaagaagaaaguagacaaguugaaugcagcccacuauucaacuggaaaaguuagcgcuaguuuuaccuccacagccauggugcccgagaccacgcacgaagcggcagccaucgaugaggacguccugcgguaccaauucgugaagaaaaagggcuaugugcgccuacauacuaacaagggcgaucucaaucuggaacuucacugcgaccugacaccuaaaaccugugagaacuucauuagauugugcaagaaacauuacuaugaugggacuaucuuucacaggucuauacggaauuucgucauucagggaggugacccaacaggcaccgggacgggaggcgagagcuacugggguaagcccuuuaaagaugaguuccgcccuaaccucucccacaccgggcgaggaauccugucaauggcuaauaguggcccaaacagcaauagaucucaguuuuucauuacauuuagguccugugccuacuuagacaagaagcauacuaucuucggccggguuguagggggauuugaugugcugaccgcaauggaaaacguggaaucagaccccaaaacagaucguccgaaggaggaaauccgcauugacgcuacuaccgucuucguggacccuuaugaggaggccgaugcgcagauagcccaagaaagaaaaacacagcucaagguugcacccgagaccaaagugaaaagcagucagccacaagcugguucucagggcccucagacuuuuaggcagggggucggaaaguacaucaaucccgccgcuacgaaacgggccgcagaagaggaaccauccacaagcgccaccgugcccaugucgaagaaaaagccuucucgaggcuucggugacuuuuccucaugguga

SEQ ID NO: 61033 - RNA, 498 nt, Artificial Sequence
  derived and/or modified sequence opt3 from PPIL3__Homo_sapiens__NP_115861
augagcgugacccugcacacagacgucggcgauaucaagauugagguuuucugcgaaagaacucccaagacgugugagauggaauccaggugcgugccucaggccgggguacaauggcgggaccucggaucucuucagccaccgcccccugguuuuaaacagguguucugucugucauugccacgcaccggccgagggggaaacaguauauggggcaaaaaguuugaggaugaauacagcgaguauuuaaaacauaauguccguggugugguuuccauggcuaacaaugggcccaacacaaauggaucucaguucuuuaucacuuacggcaagcaaccucaccuggacaugaaguauaccguguucggcaaagucauugaugggcuagagacacucgacgaacuggagaaacuuccagugaacgaaaagaccuacagaccccugaaugauguacauaucaaggacauuacuauccacgcaaacccuuuugcccaguga

SEQ ID NO: 61034 - RNA, 4302 nt, Artificial Sequence
  derived and/or modified sequence opt3 from PPIP5K1__Homo_sapiens__NP_001124330
auguggagccugaccgccuccgagggcgaaucuacaacugcucacuucuuucucggggcaggagacgagggucuuggcacgagagggaucggaaugaggcccgaagagucagauagugaacuguuggaggacgaggaagaugaggugccuccagaaccgcagauuauagucggcaucugcgccaugaccaagaaaagcaaguccaaacccaugacacaaauuuuagagcggcugugucgcuucgacuaccuaacuguugugauccucggugaggauguaauucugaacgaaccuguggagaauuggccaucuugccauugucuuaucucguuucacucaaagggguucccccuggacaaagcggucgcuuauagcaaguugcgaaacccuuuucucauaaaugaucuggccaugcaguacuauauccaggaccguagagaaguguacaggauucugcaggaggaaggaaucgaucucccacgguaugcaguuuuaaaccgcgaccccgccagaccugaggagugcaaucugauugaaggcgaggaucaaguggaagucaacggcgcuguguucccaaagccguuuguagagaaacccguuagugcagaagaccauaauguguacaucuauuacccuuccucugccgggggagguagccagaggcuuuuccggaagauaggcucccgcucaagugucuacagcccagagucuuccgugcgaaaaaccgggucauauauuuacgaggaauuuaugcccacagauggaaccgacgugaaggucuauacuguuggcccugacuacgcucacgccgaggcgagaaaaagcccagcauuggaugguaagguggaaagggacagugaggggaaggaaauccgguaucccguaaugcugacagccauggagaagcuaguggcucguaaagucuguguggccuucaaacagaccguuugcggauuugaucuccugcgcgcaaacggccauucuuucgugugugacgucaauggcuuuuccuucgugaagaacagcaugaaauacuaugaugacugcgcuaagauucuugggaauacgaucaugagagagcuggccccgcaguuccaaaucccuuggucgauucccacugaagcggaggauauaccaaucguaccuaccacaucuggaacuaugauggaauugagguguguuauugccaucauacggcacggugaccgaacccccaaacagaagaugaagauggaggugaaacacccacgcuuuuucgcacucuuugagaagcauggcggguacaaaacaggaaagcugaaauuaaagagacccgaacagcugcaggagguccucgauauuaccaggcuucuguuggcugaacuagagaaggaaccuggcggugagaucgaggagaaaacggggaagcuggagcaacucaaauccgugcuggaaauguacggccacuucucaggaaucaaccggaagguccagcuuacuuauuacccacauggcgugaaagccaguaaugaggggcaggacccgcaacgcgaaacacuggcucccagcuugcuccugguuuuaaaguggggaggugagcugaccccugccggcagagugcaggcagaggaacuagggagggccuuucguugcauguauccaggaggccagggugauuacgcuggguuccccggcuguggacuccugcggcuucacuccacuuuucgacacgacuugaagauuuaugcgucugacgagggcagaguacagaugacagcagccgcuuucgccaaagggcugcucgcacuggaaggagagcuuaccccuauccugguccaaaugguaaagagcgccaacaugaaugguuugcucgauucagacggcgauagucuguccagcugccagcauaggguuaaagcucgcuuacaccauauucugcagcaggacgccccauuugggcccgaagauuacgaccaacuagcaccgacgcggucuaccucacuccugaacaguaugacaauaauccagaacccugugaaggucugcgaucagguguucgcgcuuauugagaauuugacucaccagaucagagagaggaugcaagacccacgcagcguagaucugcagcucuaucauuccgaaacccuggaguuaaugcugcagcgauggucuaaacuugaacgggacuuucgucagaagucgggaagauacgauaucagcaagauucccgacauauacgauugugugaaauaugacguucaacacaacggcuccuugggucuccaggggacagcugagcugcuaaggcugucaaaggcccucgcagacgucgugaucccucaggaguacggcauuagucgcgaagagaaacuggaaaucgccgugggauucugccuucccuugcugcggaagauuuuacucgaucugcaaagaacucacgaggacgaaucugucaauaaacuucauccacuguguuauuugagguacagccgaggcguucucuccccugggcgccacgugcggaccagacuguauuuuacaucagagagccaugugcacucucuacuguccguauucagguacggaggccuccuggaugagacccaggacgcucaguggcagcgugcccuugauuauuugagugcaaucagcgaacugaacuacaugacucaaauagucaucauguuauacgaggacaauacgcaggauccccucucugaagaacgcuuccacguggaacugcauuuuuccccagguguuaaggggguggaggaggaaggaucagcuccggccggcugcgguuuccggccugcgaguagcgagaacgaagagaugaaaacaaaucagggcucgauggaaaaccuuugucccgggaaggccuccgacgagccagauagagcucugcagaccucuccccaaccuccagagggacccggccuaccuaggcgaagcccgcucauucggaaucgcaaggcagggucaauggaaguccugagugagacuuccucuagcagaccaggaggcuauagguuguuuuccucaagccggcccccuaccgaaaugaaacagaguggucuggggucucagugcacaggauuauucuccaccacugugcucggcgguagcucgucagccccaaaccugcaggacuacgcucgaucucacggcaagaaacuucccccugccagucugaagcauagagaugaguugcucuuuguuccggcagugaaacgcuucuccgugagcuuugcgaagcaccccacaaauggguucgagggauguucuauggucccaacgaucuauccucuggaaacccuacauaacgcccugagccuuaggcaaguguccgaguuucucucacgugugugccagcggcacacugacgcucaggcccaagcaagugcugcccuguucgauagcaugcacucuucccaggcaucagacaaucccuuuaguccaccuagaacauugcauagcccaccccugcaguuacagcaaagguccgaaaagccgccuugguacucuucgggccccagcucaaccgucuccagugccgggccaucuagccccacaacuguugacggaaacucccaguucggcuuuucagaucagccuucucucaauagccacguggcugaggaacaucagggucuggggcuucugcaagagaccccaggaaguggcgcgcaggaguuguccauugaaggugagcaggaacucuucgagcccaaccagagcccucaaguaccgccaauggaaacgucucagcccuaugaggaggugucacagccuugucaggaaguccccgacaucucccaaccaugccaggauauaagugaggcccugagccagccuugucaaaaagugcccgacauuucgcagcagugccaggaaaaccacgauaauggcaaccauaccugccaagagguuccacacaucucucagccuugucagaaguccagccagcuaugccaaaaagugucagaagaggucugucagcugugccuugagaauagugaagaggugucucagccgugucaggggguuuccguggaagucggaaagcucguacacaaauuccaugugggcguugggagccuggugcaagagacauuggucgaggugggaucacccgcagaagagauuccagaagagguaauccagccuuaccaggaauuuaguguggaggucggccgcuuagcucaagagacuagcgccauaaaccugcucucccaggguauccccgaaauugacaagccaucucaggaguucccugaagagaucgaucugcaggcccaagaaguucccgaggagauuaauuga

SEQ ID NO: 61035 - RNA, 5271 nt, Artificial Sequence
  derived and/or modified sequence opt3 from PPL__Homo_sapiens__NP_002696
augaacagccuguucagaaagaggaauaaaggaaaguacucccccaccgugcagacacggucuaucucaaacaaagagcucagugaacuuauugagcagcugcagaagaaugccgaccaggucgagaagaacauaguugauacugaggcuaagaugcagagcgacuuggcacgcuuacaggaagggcgacagccugagcaccgugaugugacgcugcagaagguacuagacuccgagaaacuccuguaugugcuugaagccgaugcggcuaucgccaagcauaugaaacacccgcagggagacaugauugcagaggauaucagacaacugaaggaaagggucaccaauuugcgggguaaacauaagcagauuuaccgccucgccgugaaggagguugacccacaggugaacugggcugcacuggucgaggaaaaacuggauaagcucaauaaccagucuuuuggcacagacuuaccccugguggaucaccaaguagaggaacauaauaucuuccacaacgagguuaaagccauagggccucaccuugcuaaggacggagauaaagaacaaaauucggaguugagagccaaguaucagaaacugcuagcggcaucacaagccaggcagcagcaucucagcagucugcaggacuacaugcaacggugcacuaacgagcuuuauuggcuggaccagcaggcuaagggccgcaugcaguacgauugguccgaccgaaauuuggauuauccaucuagaaggcggcaauacgaaaacuuuaucaaucguaaccucgaggccaaggaagaacgcauuaacaaacugcacagcgaaggugaccaguuacuggcagcugagcaucccgggagaaauuccaucgaggcccacauggaagcggugcacgccgauuggaaggaguaccucaaccuucugauuugugaagagucacauuugaaauauauggaagacuaccaccaguuccaugaggaugucaaggacgcacaggagcuacugaggaaaguggauagugaccucaaucaaaaguauggaccugauuuuaaggaccgguaccagaucgaacugcuucugcgagaguuggacgaucaggaaaaagugcucgacaaguaugaggaugucguucagggccugcaaaaacgcggccaacaggugguaccauuaaaguacagaagggagacaccccugaaaccuauaccaguggaagcucuaugcgacuucgagggggaacaaggacucauuagccgggguuauucuuacacccugcagaagaacaauggcgaguccugggaacuuauggauucagccgggaacaaguugaucgcuccggccgucuguuuugugauucccccuaccgacccagaggcacuggcccucgcugauagccugggaagucaguaccgcucuguuagacagaaagcggcaggcuccaagaggacucuucaacagcguuaugaggugcugaaaacagaaaaucccggugacgccagcgauuugcaggggcggcagcuccuggcuggauuagacaaggucgccucggaucuggaccgacaagagaaagcaaucaccggcauccuaagaccuccacucgaacagggcagggccgugcaggauucugcugagcgcgccaaggaccugaagaacauuacgaaugaacuuuugcggauagagcccgagaaaacuagauccaccgcagaaggggaggcguucauccaggcucugccgggaucagguacaacuccucuccugaggacccgcguagaagacacaaaccgaaaguacgagcacuuacugcaacuuuuggaucucgcccaggaaaaaguugacguggcaaaucggcuggagaagagucuacagcaaagcugggagcugcucgccacccaugaaaaccaccugaaucaggaugacacgguccccgaguccucucgugugcuugauagcaaaggccaggaauuggcugccauggcaugcgagcugcaggcucaaaagucauuacucggggaggucgaacagaaccugcaggccgcgaaacaguguaguuccacucuugccagcagauuucaagagcacugcccagaccuggaaaggcaggaggcugaagugcauaaguugggacagcgcuucaauaaccuccggcagcaaguugagagaagggcacagucucugcagucagccaaggcugccuaugagcacuuucaucgaggccacgaucacgugcuacaguuccugguaaguauuccuagcuacgaaccccaagagacagacucccucucucagauggaaaccaaacugaagaaccagaaaaaucuuuuggaugagaucgcaucgcgcgaacaagagguccagaagauaugugcgaacagccagcaguaucaacaggccgugaaagacuacgagcuggaagcugagaaguuacggucccuccuggaucuugaaaaugguagaucaagucauguuucuaagagggcccgucugcagagcccagcaacuaaagugaaggaggaagaggcugcccuagcagccaaauuuacagaggucuaugcuauuaaccgccagcggcuccaaaaucuggaguucgcguugaaccuguuaagacagcagcccgagguggaaguaacccacgagacgcuccagaggaaucgaccugacuccgggguggaggaagccuggaagauccggaaagagcuggaugaagagaccgaacgcagaaggcaacuugagaacgagguuaagucaacacaggaagagaucuggacucugcggaaucagggcccacaagaaagcgucgugcgaaaggagguguugaaaaaggucccggaccccguucucgaagagucuuuccagcagcugcagagaacccuagcagaggaacaacauaaaaaccagcugcuucaggaggaacucgaggcucugcaguugcaacugcgcgccuuagaacaggagacaagggacggaggccaggaguacguggugaaggaaguacuccguauugagccugaucgggcccaggcugacgaaguccugcaacuuagagaggagcuggaagcauugaggcgccagaaaggggcccgagaggcggaagugcuccugcuacagcagagaguugcugcccuggcagaggaaaagucccgggcccaagagaaggugacugagaaagaagucgugaaacuucagaaugauccacagcucgaggcugaauaccaacagcugcaggaggaccaccagaggcaagaucaguugcgcgaaaaacaggaggaggaauuaaguuuucugcaggacaagcucaaacgucuggagaaggaaagagcaauggccgagggaaaaaucaccguuaaggaagugcuuaagguagagaaagaugcggcuacagagcgggaagucagcgaccugaccaggcaauaugaggaugaagccgcaaaggcccgcgcuucucagcgagagaaaacugaguugcuaagaaagauuugggcccuggaagaggaaaacgcaaaaguggugguccaggagaagguucgggaaauagugaggcccgacccuaaggcugaguccgagguagccaaucuccgccuggaacuuguggagcaggaaagaaaauacaggggugcggaggaacaauuacggucauaucagagugagcuggaggcccuccgucgccgaggcccacaggucgaagugaaggagguuacgaaagaagugaucaaguacaaaacagaucccgagauggaaaaggaguugcaaagacugagggaggaaauugucgacaagacccggcucaucgagcgcugcgaccuggaaaucuaucagcuuaaaaaggagauucaggcacugaaagauacuaagccacaggugcaaaccaaagagguugugcaggaaauauugcaguuccaggaggacccucaaacaaaggaagaggucgcuagccuaagagccaagcugucggaagaacagaaaaagcagguagaucucgagagggaacgggcuucccaggaggaacaaaucgcacgaaaagaggaagaguuaucuagagugaaggagcgcguugugcagcaggaagucgugagguacgaggaggaaccggggcugcgggccgaagccagcgcuuuugcggagucaauugacguagagcuucgucaaaucgauaaacugagagcagaacucaggcgcuugcagcggcgaagaaccgagcuggaaaggcagcucgaggagcuggaacgcgagcggcaggccagacgugaagcugagagggaagugcaacggcuucagcagcgccuagccgcacuggagcaggaggaagccgaggcucgagaaaaggucacucauacacaaaagguuguguugcagcaggacccccagcaagcgagagagcacgccuuacugaggcuccagcuggaagaggagcagcaccggcgccagcuucuggaaggagagcucgaaacguugagaaggaaacuggcagcucuagagaaggccgaagugaaagagaaggucgugcugagugaguccguucaaguagaaaaaggcgauaccgagcaggaaauucagcgacucaagucuagccuugaggaggaaucccggucaaaacgugagcuggacguggaagucagcagauuagaggcacgcuugagugaacuggaguuccauaacucuaaguccagcaaggagcucgauuuucugagggaagagaaucacaaacuucaacuggaacggcagaaccuccaguuggagacuagacgccugcagucggaaaucaacauggccgcuacagagaccagggacuuacgaaauaugacaguggccgauucagguacuaaccaugacucucggcuauggagucuggagagagaacucgaugaccuuaagaggcuguccaaagacaaggauuuggagauagacgaacugcaaaaacgccucgggagcguugcggugaagcgugagcagcgggaaaaucaccugagaaggucuaucgucgugauucauccugauaccggccgcgagcuuagccccgaggaagcacaccgagccggacucaucgacuggaacauguucguaaagcugcggucccaggagugugauugggaagagauuucagucaaaggcccaaauggggagaguagcgugauccacgacagaaagucuggcaaaaaguuuuccauagaagaggcuuugcagucagguaggcugacgccugcccaauaugaucgcuacguuaacaaagacaugaguauucaggaauuagcugugcuagucagcggccagaaguga

SEQ ID NO: 61036 - RNA, 1149 nt, Artificial Sequence
  derived and/or modified sequence opt3 from PPM1A__Homo_sapiens__NP_066283
augggcgccuuccuggacaagcccaaaauggagaagcacaacgcucaggggcaaggaaauggucucagauacggccuuagcuccaugcagggguggaggguggaaauggaggaugcacauaccgccgucaucggacugccuucuggcuuggaaucauggagcuuuuucgcgguuuaugacggucacgcugggagucagguggccaaauacugcugugagcauuuacuggaucacauuacaaacaaucaggacuuuaagggauccgcaggcgccccaucuguagaaaacgugaaaaauggcauacggacuggguuccuagagaucgaugagcauaugcgcgucaugucggaaaagaagcacggagcugaccgaucagguagcacggcagugggcguucucauuaguccgcaacacaccuauuuuaucaacugcggggauucccguggacugcuuuguagaaauaggaaagugcauuucuuuacacaggaccacaagcccucuaacccucuggagaaagaacggauucagaaugccggcgguagcgucaugauccagcgcgugaacggguccuuggcuguaucaagagcccucggagauuucgacuacaagugcguucauggcaaaggcccaacugagcaacuggugagucccgagccugaaguccacgauauagagaggagcgaagaggacgaucaguuuaucauucuggcgugugacgggaucugggacgugaugggaaaugaggaacucugcgauuucgugcggucucgcuuagaggucaccgacgaucuggaaaagguuuguaacgaggugguagacacaugccuuuauaaggguucccgagauaauaugucagugauuuugaucuguuuuccaaacgcacccaaagucagcccugaagccgugaagaaagaggcugaacuggacaaguaccuagagugcagaguugaggaaauaauuaaaaagcagggcgagggggugccagaucucguccacgugaugaggacccuggccagugaaaauaucccgucucuucccccuggaggcgagcuggcauccaaacggaacguaauugaagcuguuuauaaccguuugaauccauacaagaacgacgauacugacagcacaucgaccgaugacaugugguga

SEQ ID NO: 61037 - RNA, 1143 nt, Artificial Sequence
  derived and/or modified sequence opt3 from PPM1B__Homo_sapiens__NP_001028729
augggcgccuuccuggacaagcccaaaaccgagaagcacaacgcucauggggcaggaaauggucucagauacggccuuagcuccaugcagggguggaggguggaaauggaggaugcccacacagcggucguuggaaucccucauggccuggaagacuggucuuucuucgcuguguaugauggucacgccgggucacggguagcaaacuacugcaguacucauuuguuagagcacauuacgaccaaugaagacuuucgcgccgcuggaaaaagcggcuccgcacuggagcuaucuguggagaacgucaagaauggcauacgaacaggguuccucaaaaucgaugaauauaugcguaacuuuucggaccugagaaauggaauggauaggucagguagcacugccgugggcguuaugauuaguccaaagcacaucuacuucauuaacuguggggacucccgggcugugcuuuaucgcaauggacaagucugcuuuucuacccaggaucauaagccguguaaccccagagagaaagaaaggauccagaaugccggcgguagcgugaugauacagcggguaaacgggucccuggcgguuucacgcgcauugggagacuacgauuauaagugcguggacggcaaaggcccuacagagcaacucgucaguccagagcccgaaguguacgagauccugcgagccgaagaggaugaauuuauuauccuggcuugugacgggauuugggacgugaugagcaaugaggagcucugcgaauacgucaagucuagauuagagguuuccgaugaccuggaaaacguguguaauuggguaguggauaccugccuucacaaaggaucaagggacaacaugagcaucgucuugguguguuuuaguaacgccccuaagguuucugaugaggcagugaagaaagacuccgaacuggauaagcaucuagagagccgggucgaggaaauaauggagaaaucgggugaagagggcaugccagaccucgcucacgugaugcguauucugucugccgaaaauauccccaaccuuccuccagggggaggccuggcggguaagcgcaauguaauugaggccguuuauuccagauugaacccgcacagggagucagaugggcagaaauga

SEQ ID NO: 61038 - RNA, 1818 nt, Artificial Sequence
  derived and/or modified sequence opt3 from PPM1D__Homo_sapiens__NP_003611
auggccggccuguacagccucgggguguccgucuucucugaccagggagguagaaaguauauggaggauguuacccaaaucgugguagaacccgagccuacagcugaagagaaaccaucaccgaggcggagucuuagccagccccugccuccacgccccuccccugcagccuugccaggcggggaagugucuggaaagggccccgcggucgcugcccgagaggcacgugacccuuuaccagaugccggugcuucgccggcacccucaagaugcuguaggcggcgcagcaguguggccuuuuucgcuguuugcgacgggcacggaggcagagaggccgcgcaguuugcaagggaacaucuguggggcuucauuaaaaagcagaaaggguuuacuuccucugagccugccaaggugugugcugccauacggaagggauuccuagcaugccaccucgcuauguggaaaaagcuggccgaauggccaaaaacgaugaccggucuucccagcacauccggcacuaccgcgucagucgugaucauucgcgggaugaagauguacguagcccauguuggagauaguggcgugguccuggguauccaagacgauccuaaagacgauuuugugcgagcaguggaggucacacaggaccacaagccagaguugcccaaggaaagagagaggauugaagggcucggaggcagcguuaugaacaaaucuggcgugaaucggguaguguggaagcguccgcgccugacccauaacgggccugucagaagguccacugugaucgaucagauacccuuccuggcuguugcccgggcucucggagacuuauggucauaugacuuuuucagcggugaguuuguggucaguccagaaccugauacaucugugcacacccuggacccccagaaacacaaguacaucauucuuggcuccgauggguuguggaauaugaucccaccccaagacgccauuagcaugugucaggaucaggaggagaaaaaguaucugaugggagaacauggccagucgugcgcaaaaaugcuaguaaaccgagcccucggucgcuggagacaaaggaugcugcgggcugacaauacgucugcgaucguuauauguauuuccccugagguggauaaccaggggaauuucacuaacgaagacgagcuuuaccugaauuugaccgauucaccaaguuauaacagccaggaaacaugcgucaugacuccgucccccuguucuaccccuccagugaaaagccucgaggaggaccccuggccucgcgucaauucaaaggaucacaucccagcacuggugagaaguaacgccuuuuccgaaaauuucuuagagguuagcgcugaaauugccagggagaacgugcaaggcguagucauccccucuaaggacccggaaccucuggaggagaauugcgcaaaggcccucacacuucguauccaugauucacugaacaacaguuugccaauuggccuagugcccaccaauagcacgaacacuguuauggaccagaaaaaucugaagauguccacaccuggacagaugaaagcucaggaaauagagcggacucccccaaccaacuucaagcgaacacucgaagagucuaauucggggccucugaugaagaaacacagaaggaacggacuuagccgcuccucaggugcccaacccgcaagucugccaaccacgucucagcggaagaauagcgugaaauugaccaugagaaggcgccuccgaggccagaagaaaaucgggaacccgcuguuacaccagcaucggaagacagucugugugugcuga

SEQ ID NO: 61039 - RNA, 2268 nt, Artificial Sequence
  derived and/or modified sequence opt3 from PPM1E__Homo_sapiens__NP_055721
auggccggcugcauccccgaggaaaagaccuacagaagguuccuggagcucuuucuuggggaguuccggggaccuugugguggcggggagccagaaccggagcccgagccugaaccagagcccgaaccugagagcgagccagaacccgagccugaacugguggaggcugaagcagccgaggcguccgucgaggaaccaggagaggaagcugccacaguugcagccacugaggaaggcgaccaggagcaagauccggagcccgaagaggaagcugcaguggagggugaagaggaggaagagggggccgcuacggccgcggcagccccuggacacucugcuguaccacccccuccaccccaguugccgccuuuacccccacugccucgcccccuaucagaacgaauuacccgugaggagguggaaggcgagagucucgaccugugccuucagcagcuguauaaauacaacugucccagcuuuuuggccgcagcucucgccagagcgacauccgaugaaguccugcaaucugaccugucggcccauuauauaccaaaggagacugauggcaccgaagggacaguggagaucgagaccguuaaacucgcaaggucaguguucagcaaguuacacgaaauuugcuguaguugggucaaagacuuuccucugcggcgcagaccacagcuuuacuaugagacuuccauccaugcuauuaagaauaugaggcggaagauggaagauaaacacgugugcaucccggacuucaacauguuguuuaaucuggaggaucaggaagaacaggccuacuucgcuguauuugacggacaugguggcguugaugccgcaauauaugccucuauccaccuacacgugaaccucguccgccaagagauguucccccaugacccugcugaagcgcugugucgagcauuuagagugacagaugagagguucgugcagaaggccgcucgggaaagccuucguugcgggaccacgggagucguuacuuuuauucgcggcaauaugcugcacguggccuggguaggugacucccaggugauguuggucagaaaagggcaggcaguggagcucaugaagccacauaaacccgacagggaagaugagaagcaacggaucgaggcccugggaggcuguguugugugguucggcgcuuggcgagucaacgggucauuaagugugagccgcgccauuggagacgcagaacacaagccuuacaucugcggugaugcggacucugcuuccaccguacuggauggcacagaggacuaccucauacuugccugugauggguucuaugacacuguuaauccagaugaagcagugaaagucgugucagaccaccugaaggagaacaauggagauagcaguauggucgcccauaaauugguggcuucugccagagacgcaggcuccagcgacaacauuaccguuaucgugguauuucuaagggauaugaauaaggcugucaacgugucggaggaaucugacuggacagaaaauuccuuccagggugggcaggaagauggcggagacgauaaagagaaccacggcgaaugcaagcggcccuggccgcaacaucagugcucagccccugcggaccugggguacgauggacgcguugacaguuuuaccgauagaacgagccucuccccagguucucagauuaaugugcuggaggaccccggcuaucuugaucugacucagaucgaggccagcaaaccucacucagcucaauucuugcuccccgucgaaauguuugggccaggagcaccuaagaaggccaaccugaucaacgaguuaaugauggagaaaaagagugugcaguccagccugcccgaguggucuggcgcuggugaguucccaacagccuuuaaucuagggucaaccggcgaacagauuuacaggaugcagagucucagcccgguauguuccggacuggagaacgaacaauucaaaucuccuggcaaucgugugucgcggcuuagccauuugcgacaccacuauuccaagaaauggcauagauuuagguucaaccccaaguuuuacucauuccugagugcacaggagccaucucacaagauagggacuagccucuccucacugacaggaagcgguaaacgcaaucggaucagaucuucccuucccuggaggcagaacaguuggaagggcuauagcgaaaauaugcgcaaacugcgaaagacccaugacauuccuugcccagauuugcccuggucuuacaaaaucgaguga

SEQ ID NO: 61040 - RNA, 1365 nt, Artificial Sequence
  derived and/or modified sequence opt3 from PPM1F__Homo_sapiens__NP_055449
augagcuccggcgcaccccagaagucuucaccuauggcuaguggggcagaggaaaccccaggauuccuggacacacuccuucaagauuuuccggcccuguugaaccccgaggacccuuuaccauggaaagcgcccgguacugugcugagccaggaagaggucgaaggcgagcuagcugagcucgccaugggguuccugggauccagaaaggcaccuccaccccuugccgcugcacuggcccacgaagcuguuucucaguugcuccagacggaucugucggaguuuaggaaacugccucgggaagaggaggaagaggaagaggacgaugacgaagaggagaaggccccagugacccucuuagaugcgcaaucacuggcacagagcuucuuuaaucgccuuugggaaguagccggccaguggcagaaacaagugccguuggcugcccgagcaagucagcgucaguggcuggucuccauccaugcuauuagaaacacaaggcggaagauggaggaccgccacgugucucuacccagcuucaaucagcucuuuggucuguccgauccuguuaacagagccuacuucgcgguguuugacgggcauggaggcgucgaugccgcaagguaugcugccgugcacguacauacuaaugcugcccggcaaccagaacuucccaccgacccugagggcgcacugcgcgaagccuuccgaagaacagaucagauguuuuugaggaaggcuaaacgggagcgucuccagucagggaccacuggaguuugcgcgcugauagccggugccacauuacacguggcuuggcugggcgacagucaagucauccucgugcagcagggacagguggucaagcugauggagccacaccgccccgaaagacaagacgagaaagccaggauugaagcacuugggggcuucguuagccauauggauuguuggcgggugaacgguaccuuggccguaucucgagcuaucggggacguguuucagaagccguacgucuccggagaggccgaugcagcgucacgcgcucuaacgggcagcgaagacuaucugcuccuggccugcgauggcuucuucgacgugguuccucaccaggagguggucgggcuugugcagagucaucugacuagacaacagggaucugguuugaggguagcagaggaacucguugccgcugcccgggagcgcggcucccacgauaauauuaccgugauggucguguuucugagagacccccaggaauuacuggaagggggaaaccagggcgagggugauccacaagcagaggggaggcgucaggaccuaccuagcucgcuccccgagccagaaacacaggcucccccucggucuuga

SEQ ID NO: 61041 - RNA, 1641 nt, Artificial Sequence
  derived and/or modified sequence opt3 from PPM1G__Homo_sapiens__NP_817092
augggcgccuaccugagccagcccaacaccgugaagugcuccggggacggagucggugcuccuagacucccacuuccguauggcuucucugcaaugcaaggguggaggguuucaauggaggaugcccacaauuguauccccgaacuggacagugagacagcgauguuuagcguguacgauggacauggcggugaagagguagcuuuguauugcgccaaauacuuaccugacauuauaaaggaucagaaagcauauaaggaagggaaacugcagaaggcccuagaggacgcuuuccucgcaaucgaugccaagcugacuacggaggaagugauuaaagagcuugcucagaucgccggacggccaaccgaagacgaggaugagaaggaaaaagucgcggacgaggaugacguggauaacgaagaggcagcccuguugcacgaagaggcuacaaugacuauugaggaacuccugacccgcuacggccaaaauugucauaaggggcccccucacuccaaaucuggcggagguacaggcgaggaaccagggucgcagggacugaacggcgaggccggucccgaagacucaacccgagagacuccuagccaggagaaugggccaacagcaaaggcuuauaccggauuuaguuccaacucugaacguggcacggaggccggccagguuggggaaccgggaauccccacuggugaggcgggcccuagcugcuccucagccagugacaagcucccaagaguggcaaaaagcaaguucuuugaagauucugaggacgaguccgaugaagcugaggaagaggaggaagacucagaggaauguagcgaggaagaggauggguacaguucugaggaagccgagaaugaagaggacgaagaugacaccgaggaggcugaagaggaugacgaagaggaagaggaggaaaugaugguccccggaauggagggcaaagaggaaccugguuccgauagcgggacaacugccgugguagcauuaauaaggggcaagcaacugaucguugccaacgcuggagacucgcggugcguggucucugaggcgggcaaagcacuugacauguccuacgaucauaagccagaagacgagguggaauuggcccgcauuaaaaaugcugggggaaaggugaccauggaugguagagucaacggcgggcugaaucuaucaagggccaucggagaccacuucuauaagcggaacaaaaaucugcccccggaggaacagaugauuagugcacucccugauaucaagguucuuacacugaccgacgaucacgaguuuauggugauagccugugacggcauuuggaacguaaugagcucccaggagguggucgauuucauccagucuaaaauuagccaacgcgacgaaaauggugaguugcgacuccugucaaguaucguggaagaguuacuggaucagugccucgcucccgacacguccggggauggcacuggaugugacaacaugacaugcaucauuauauguuuuaagccaagaaacaccgccgaacuucagccugagagcggcaaaaggaagcuggaggaaguuuugucuacugagggggcagaagagaauggaaacucagacaagaaaaagaaagcgaagcgggauuga

SEQ ID NO: 61042 - RNA, 1545 nt, Artificial Sequence
  derived and/or modified sequence opt3 from PPM1H__Homo_sapiens__NP_065751
augcugaccagagucaagagcgccguggcuaacuucaugggcgggaucauggcaggauccucugguucagagcacggcgggggaaguugcggcgguagcgaccucccccuuagguuuccuuacgggcggccagaguuccugggauugucccaggaugagguugaauguucugccgaccauauugcgcgcccgauauuaauccugaaagagacacgacgucuacccugggcuacuggcuaugccgaagugauuaaugcaggcaagucgacgcacaacgaggaucaagccucaugcgagguacucaccgugaaaaagaaagcuggggcagucacaagcacuccuaauagaaacaguuccaagaggcggucuagccugccaaauggagaaggucuucagcugaaggagaacuccgaaucagagggcgugaguugucauuacuggagcuuguuugacgggcacgccggaucuggcgcugccguuguggcgucccgccuccugcagcaucacaucaccgagcagcugcaagauauugucgacauccucaaaaauucagcaguguuacccccuacaugccugggugaagaaccagaaaacacccccgccaauagcagaacucuuacaagggcugccaguuugcgcgggggaguaggcgcaccuggcucuccauccaccccgcccacgcgguucuuuacugagaagaaaauaccucacgaaugucugguuaucggggcucuagagagcgccuucaaggagauggaucuccagauugaacgagagagaucgucuuauaacaucuccggagguugcaccgcgcugauugugaucugucuucugggcaaauuguacgucgccaaugcaggggacucaagggcuauaauuauccggaacggagaaauuaucccaaugaguagcgaguuuacacccgaaacugagcgucagcgccuccaguaucuggccuucaugcaaccucauuuacugggcaaugaguuuacccaccucgaguucccaagaagggugcagcggaaggaacuugguaagaaaaugcuguaccgagauuuuaacaugacagggugggcuuauaagaccaucgaagacgaggauuugaaauucccccuaauuuacggcgaaggaaagaaagcccgcgugauggcaacgauaggcgucacuagagggcugggagaccaugaucucaagguucacgacuccaauaucuacauuaaaccguuucugucuagcgccccugaggugaggaucuaugaccuuucaaaguacgaucacgguagugacgauguacugauauuggcuacagacggccucugggaugugcuguccaacgaggaagucgcggaggcaauuacccaguucuuacccaacugcgacccagaugacccucaucgguauacucuggccgcucaggaucuagugaugcgcgccagagggguucucaaggacaggggauggcguaucagcaaugaucggcugggcucuggugacgacaucucaguguacgucauuccccuuauccacgggaacaaauugaguuga

SEQ ID NO: 61043 - RNA, 1119 nt, Artificial Sequence
  derived and/or modified sequence opt3 from PPM1K__Homo_sapiens__NP_689755
augagcaccgccgcucugaucacacucgugagauccggcgggaaccaggucaggcggcgcguucuucugucuucacgauuguuacaagacgaucguagagugacucccacgugccacaguagcaccuccgagccuagguguucucgguucgacccagauggaucggguucaccggcaacaugggacaauuuuggcauuugggauaaccgcauagacgaacccauccugcuaccuccaagcauuaaguacgggaagcccaucccuaagauuagucucgagaauguaggaugcgccucccagaucggcaaaagaaaggaaaacgaggauagguucgacuuugcgcagcugacugaugaagugcuuuauuucgcugucuacgacggucaugggggaccagccgcagccgauuuuugucacacccauauggagaaaugcauaauggaccuguugcccaaggagaagaaucucgaaacacugcugacccucgcuuucuuagagaucgauaaagcauuuucuagccacgcccggcuguccgcugacgccacucuuuugacaucaggcaccacggcgacuguggcacugcuacgcgacggcauugaacucguuguggccagugucggggauagccgagcuauccuguguagaaagggaaaaccuaugaaacuuaccauugaccauacaccagagaggaaggaugagaaggaacggaucaagaaaugcgguggcuucguggccuggaacucucuggggcagccgcacguaaauggacguuuggcaaugacucgcuccauaggcgaccucgaucugaagaccucagguguuauugcugagcccgaaacaaaaagaaucaaguuacaccaugccgacgauagcuuucuggugcucaccacggacgggauuaacuucauggucaauagucaagagaucugugauuuugugaaccagugccacgacccuaaugaagcggcccaugcagugacugagcaggcuauccaguauggaacagaggauaacucuaccgccgucguugugccauucggcgcuuggggcaaauacaaaaauuccgaaauuaacuuuagcuucucgaggucuuucgccuccucagggcggugggcauga

SEQ ID NO: 61044 - RNA, 1083 nt, Artificial Sequence
  derived and/or modified sequence opt3 from PPM1L__Homo_sapiens__NP_640338
augaucgaggacaccaugacacugcucagccuucugggcagaauuaugagguacuucuuguuacggcccgaaacucuguuucuacucugcauaucccuggcccuuuggucuuauuucuuucacacggaugaggugaagaccaucgucaaaucaagucgcgacgcuguuaagauggugaaagggaagguagcagaaauuaugcagaacgaucgacugggagguuuggacgugcucgaggccgaguucagcaaaacaugggaguuuaagaaucauaacgucgcgguguacuccauccaaggccguagagaucacauggaggacagguucgaaguucugacugaucuggcuaauaagacccauccuucuauuuuugggaucuucgacggacacggcggugagacagccgcagaauaugugaaaucgcggcucccagaggccuuaaagcagcaucugcaggauuacgagaaagacaaggaaaacucaguccuuagcuaucagaccauauuggagcaacagauccugaguauugaucgcgaaaugcuagagaaacucacuguguccuacgacgaagcugggacaaccugucugaucgcacuucugucugauaaggacuugacgguagccaauguuggagacagcagaggcgugcucugcgauaaggacggcaacgcuauuccgcugucccacgaucacaaacccuaucaguuaaaggagaggaaacggaucaagcgcgccgggggauuuauaucauucaaugguaguuggcgaguccagggcauucuggcgaugagcagaucucucggggacuacccucuuaaaaaccugaauguggugaucccagaucccgacauuuugacuuuugaucuagacaagcugcaaccugaguucaugauccucgcauccgauggacugugggacgccuuuucaaacgaagaggcugucagguucaucaaagaacggcuugaugagccacauuucggcgccaagagcauuguucugcagaguuuuuaccgugguugucccgacaauauaaccgugaugguagugaaguuccgcaacucuuccaaaacagaagaacaguga

SEQ ID NO: 61045 - RNA, 744 nt, Artificial Sequence
  derived and/or modified sequence opt3 from PPM1M__Homo_sapiens__NP_001116342
augggcgggugcaccgcccugguggcugucagccuccagggaaaacuuuacauggcaaacgccggugacuccagagcgauccugguuaggcgggaugagauucgccccuugucuuucgaauuuacaccugagacugaacgacaacguauacagcaguuagcuuucguguauccagagcugcuagccggcgaauuuacgagacucgaguucccgaggcggcugaagggggacgaucuuggacagaagguacuguuucgcgaccaccauaugucaggcuggaguuacaaaagaguggaaaagagcgauuugaaauauccccucauccacggucaagggaggcaggcacggcugcugggaacccucgccgucucccgcggcuuaggcgaccaucagcugcgagugcuugauacaaauauucaguugaagccuuuccugcuaucuguuccacaagugacuguccucgacguggaucagcuggagcuucaggaggacgauguaguugugauggcuaccgacgggcugugggaugucuugucgaacgaacagguggcauggcucgugagaucauuucugcccggaaaucaagaggacccucacagguucagcaaguuagcccagaugcugauccauaguacacaggguaaagaggacucccucaccgaagagggccaagucucuuacgaugacguuagcguguuuguaauuccacuucacucccaggggcaggaaucaagugaucacuga

SEQ ID NO: 61046 - RNA, 1203 nt, Artificial Sequence
  derived and/or modified sequence opt3 from PPME1__Homo_sapiens__NP_001258522
augagcgcccuggagaaguccaugcaccucggcagacuucccucuaggccuccacugccggggucaggagguagucagagcggcgcuaaaaugcggauggggcccggacgcaagcgagacuucuccccugugccauggucucaauacuuugaaucgauggaggaugucgaaguugagaacgaaaccggcaaagacacauuccguguguauaagucagguagcgaggggcccguauuguuacugcuacauggaggcggccacagugcacucuccugggccguguuuacugcggcuaucauuucuagaguccagugcaggauaguggcccuggaucuucggagccauggggagacgaaaguuaagaauccugaagaccuguccgcagagaccauggccaaggaugugggaaacgucguggaagcuauguacggugacuugccacccccuaucaugcucauuggccacucaaugggaggggcaaucgccguacauacagcuaguagcaaucugguuccaucucugcucggcuuauguaugauugauguggucgaggguacugccauggacgcgcugaacuccaugcagaauuuccuucgcgggagaccgaaaaccuuuaagucauuggagaacgcaaucgaauggagcgugaaaaguggacagauaaggaaucuggagucugcccggguguccauggucggccaaguuaagcagugcgaaggcaucacaagccccgaggggucgaaaucuauuguggaaggaaucauugaggaggaagaggaagaugaggaagguuccgagucaaucaguaagcgcaagaaagaggacgauauggaaggccuaccuagcgagacccagaaccuccugcuuuuccugcagacuaagaaagaccacccauauacauggcgaauagaauuggcuaagaccgagaaauacugggaugggugguuuagaggacucuccaaucuguucuuaucuugucccauuccuaagcugcuccuucuggccggcguagacagguuggacaaagaucuaacgaucggucaaaugcaggggaaguuucagaugcaagugcugccacagugcggccacgcaguccaugaagacgcucccgauaagguggccgaggcgguugccacuuuccucauucggcaccguuuugcagagccgaucggaggcuuccaguguguguuuccugggugcuga

SEQ ID NO: 61047 - RNA, 1434 nt, Artificial Sequence
  derived and/or modified sequence opt3 from PPOX__Homo_sapiens__NP_001116236
augggcagaaccguggucguucucgggggagguaucagcggccucgccgcuuccuaccaccuuucuagggcacccugcccuccaaaggugguacugguggagucaagugaacggcuugggggauggauucgcagcguccgaggcccgaacggugccauauucgaguuagggccccguggaaucagaccugcgggcgcucugggcgccaggacacuacuccugguguccgaacuugggcuggacucugagguuuugccagugcggggagaucaucccgcagcccagaaucgcuuucucuaugucgguggcgcucugcacgcacugccuacugggcucagaggauuacugaggccaucgcccccuuucucaaaaccauuguuuugggccggcuugcgggaacugacgaagccgcgcgguaaagagcccgacgagaccgugcauagcuucgcucaacgaagacuagggccugaaguagccagucucgcgauggauucccuguguaggggaguuuuugcaggcaacucucgggagcuuagcauucguuccugcuucccaucacuguuucaggccgaacagacacaccgcaguaucuugcucggccuguuacugggggcuggaagaacuccccagccugacagcgcccucauuaggcaagcacuugcugagcgguggucucaguggucccugcgagguggcuuggagaugcuaccacaggcccuggaaacccaucucacaucacgcggggugagcguccugagaggacagcccguguguggccuuagucugcaagcggaggguagguggaaggugucuuugcgggauuccagccucgaagccgaccacgucaucucggcaauaccggcuucuguucuguccgaguuacugccugccgaagcugcaccccuagcccgcgcccucucagcuaucaccgcggugaguguagcaguggucaaucugcaguaccagggggcccaccuuccagugcagggcuucggacauuugguuccuagcuccgaggaucccggcgugcuggggauugucuaugacucuguggcuuuuccagagcaagauggaucacccccuggucucagaguaacuguuaugcugggcgggagcuggcuucagacacuggaagccaguggaugcguguugucccaggagcuguuccaacagagggcacaggaagccgcugccacccagcugggcuuaaaagagaugccaagccacugucugguccaucuacacaagaacugcaucccgcaauacacgcucggucacuggcagaagcuggaaucugcacgucaguuucuuacugcgcaucgguugccccugacccucgcuggggccucauaugagggcguggcagucaaugacuguauugagaguggacgacaggccgcugugagcguucugggcacagaaccuaacuccuga

SEQ ID NO: 61048 - RNA, 1026 nt, Artificial Sequence
  derived and/or modified sequence opt3 from PPP1CA__Homo_sapiens__NP_001008709
augagcgacuccgagaagcugaaccucgauucuaucauuggcagacuucuggaagggucaaggguguugacaccccacugcgccccuguccagggaagucggccagguaaaaauguucaauuaaccgagaacgaaauacgcggccugugucuaaagagccgagagaucuuccucucccagccgauucugcuugaacuggaggcucccuugaaaaucugcggggacauucauggacaguacuaugaucuccugcgucuguuugaguacggcgguuucccuccagaaucuaauuaucucuuuuuaggggacuacguggauagaggaaagcagucgcuggagaccaucugucuuuugcuggcauauaaaauaaaguaccccgaaaacuucuuucuacucaggggcaaucacgagugcgccucaaucaaccggauuuauggcuucuacgacgaguguaagcgcagauacaauaucaaacuguggaagacguuuaccgauugcuucaacugucuuccuauugcggcuaucguagacgagaaaauauuuugcugucaugggggacugagcccagauuugcaaaguauggaacagauuaggcggaucaugcgccccacagacgugccugaucagggucuccugugcgacuuacugugguccgauccagacaaggacguccagggcuggggagaaaaugaucgaggggugucuuucacuuuuggcgccgagguuguggcaaaauuccuccacaagcaugaccuugaucugauuuguagagcccaccaagucguggaagacgguuaugaguuuuucgcuaagaggcaguugguaacccuauucagcgcaccgaacuacugcggggaguuugauaaugccggagcuaugauguccguugacgaaacacugaugugcucauuccagauccucaaacccgccgauaagaacaaaggcaaguauggccaguuuagugggcugaauccuggaggucggccaaucacucccccucguaacagcgcgaaagcaaagaaauga

SEQ ID NO: 61049 - RNA, 1014 nt, Artificial Sequence
  derived and/or modified sequence opt3 from PPP1CC__Homo_sapiens__NP_001231903
auggccgaccuggauaagcucaacaucgacagcauuauacagagacuucuggaggugaggggcuccaaacccgggaagaauguccaauugcaggaaaacgagauccggggauuaugccugaaaucucgcgaaauuuuccuaucacagccuauccuccuggagcuugaagcuccacugaagauuuguggugauauccacggccaguacuaugacuugcuccgacuguuugaguacgggggauucccgcccgagaguaauuaucuguuucucggcgauuacguugaccgugguaaacagagcuuagaaaccauaugccugcuuuuggcauauaagaucaaguacccugagaacuucuuucugcuaagagggaaucaugaaugugccuccauuaacaggaucuauggauucuacgaugagugcaaacggcgcuacaauauuaagcucuggaaaacauuuacugacuguuucaacugccugccaaucgcggcuauaguggaugagaagaucuuuuguugccacggcggccuuucucccgaccugcaaucgauggaacagauuagaaggauuaugcggccuacggauguaccagaccagggguugcucugugaucuguuauggucagaccccgacaaagaugugcugggauggggugagaaugaccgcggcgucagcuucaccuuuggggccgaagugguugcaaaguuccuccauaagcacgaucuugaccugaucugccgagcccaucaaguggucgaggauggauaugaauuuuucgcuaaaagacaguuggugacacuauucagugcaccuaacuacuguggcgaguuugacaaugccggugcuaugauguccguagaugagacucugaugugcucuuuccagauccucaagccagccgagaaaaagaaaccgaacgcgaccaggcccguuacaccuccacggguggcaagcgggcugaaucccuccauucagaaggccucaaacuaucguaauaacaccguccuuuacgaauga

SEQ ID NO: 61050 - RNA, 2823 nt, Artificial Sequence
  derived and/or modified sequence opt3 from PPP1R10__Homo_sapiens__NP_002705
augggcagcgggcccaucgacccuaaggagcugcucaaaggacuugauuccuuccugaacagagacggugaagugaagucugucgauggcauuucaaaaauauuuaguuugaugaaggaggccaggaaaaugguuagccggugcaccuacuuaaauauccugcuacagacacgcuccccagaaauucucgugaaguucaucgacguagggggauauaagcugcuuaacaauuggcugacuuacucuaaaacgaccaacaauauuccguugcuccaacagauccugcugacacuccagcacuuaccccugacuguggaucaucuuaagcagaacaauaccgcuaaauuggucaagcaacugucgaaaucaagcgaggacgaggaacuacgaaagcucgcaagugugcugguuuccgauuggauggccgugauacguucucagagcuccacacagccugcggagaaggacaaaaagaaaagaaaggaugaaggcaaaucaaggaccacucuuccagagcggccccugacagaagucaaggcugagacccgcgccgaggaagcaccugagaaaaagagagaaaagccaaaaaguuugaggacgacugcccccagccacgcuaaguuucggucuaccggucucgagcuggaaacaccuuccuuagugccaguuaaaaagaacgcaucaacuguaguggucagcgacaaauauaaucugaagccgaucccccucaagcgccagaguaacguggccgcuccuggggaugccaccccacccgcggagaaaaaguacaaaccucuuaauacaaccccaaacgcaacgaaggagauuaaagugaagaucauucccccgcaaccuauggaaggacugggcuucuuggacgcccuaaauucugcucccgucccaggcaucaagauuaaaaagaaaaagaaaguucuguccccuacugccgcaaagcccagcccauuugaggggaagacaucgaccgaacccucuacugcuaaaccuuccucaccagagccggccccgccuagugaagcgauggaugccgaccgaccaggaacacccgugccuccaguagaggugcccgagcucauggacaccgcaagccuggaaccgggugcucuugaugccaagccugucgaguccccaggcgaccccaaccagcugacgagaaaagggaggaagcggaaaucugugaccuggccugaagagggaaaguugcgugaauauuucuacuuugagcucgaugagacagaacgcguuaaugugaacaaaauaaaggacuucggcgaggcugccaagagagaaauccugagcgauaggcaugcauuugagacugcccggcgauuaucacacgacaacauggaggaaaaaguccccuggguguguccacgcccucugguacuacccaguccacucguuaccccggguuccaauagccaggagagauauauucaggcugaaagggagaaggggauccugcaagaacuuuucuugaacaaagagucuccucaugagcccgauccagaacccuacgagccuaucccacccaagcugauuccucucgacgaagagugcucaauggaugaaacaccguacguggagacucuggagccaggaggcaguggcgggagccccgacggagcggguggcuccaaacuuccuccaguccuggcaaauuugauggggucuaugggagccggcaaggguccccaggggccuggcggaggcgggauaaacgugcaggaaauccucaccucgauuaugggaagccccaauucccaccccucagaggaacuguuaaagcaaccagauuauagugacaaaaucaagcagaugcuggucccucacggucuacucggccccgggccaauagcuaacggauuuccucccggcgguccagggggcccgaaaggaaugcagcauuucccucccggcccagggggacccaugccugguccacacggcgggcccggaggcccuguggguccgcggcugcuugggccacccccucccccacgcggcggagacccuuuuugggauggccccggggacccaaugagaggaggcccuaugaggggugggccgggacccggcccagguccuuaccaucguggccgagggggacggggcgggaaugagcccccaccucccccgccaccuuucagaggagccaggggcggucgcucugggggagggcccccaaacggucggggcgggcccggaggcgggaugguuggaggcggugggcacagaccucacgaaggaccgggcgguggcauggggaauagcuccggacauaggccccacgagggcccagggggaggcauggguucagggcaucgcccucacgagggacccggcggcagcaugggcggagguggcgggcaucgaccucacgaaggaccaggcggugggauuucuggaggcuccggccaccggccccaugaggggccuggagguggcaugggggcaggaggcggucaccguccacaugaagggcccggaggcaguaugggcgggagcggaggucacagaccgcacgagggcccugggcauggaggcccacacggucauaggccccacgaugugccugggcaucgcggacacgaccaccggggcccacccccgcaugagcacagaggccaugaugggccuggacacgguggcgggggacauaggggccacgacggugggcacucucauggaggcgauauguccaaccgacccguaugucgccacuucaugaugaagggcaauugccgguaugaaaacaauugugccuuuuaccauccaggggucaacggaccucccuugccauga

SEQ ID NO: 61051 - RNA, 381 nt, Artificial Sequence
  derived and/or modified sequence opt3 from PPP1R11__Homo_sapiens__NP_068778
auggccgaggcuggcgcagggcugagcgaaaccgugacagagacuacggucaccguuacaacugaacccgagaacagaucccucaccaucaaacuuaggaaacggaagccugaaaagaagguggaguggacaucugacaccguagauaaugagcacaugggacgccgaucaaguaaaugcuguugcauuuacgaaaagccacgugccuucggugagagcuccacugaaucugacgaggaggaagaggaaggcugugggcauacacacugcgugagaggacauaggaagggccggcgcagagcgacccuggguccgacgcccacuaccccuccacagcccccugauccaucgcaacccccuccagggccgaugcagcacuga

SEQ ID NO: 61052 - RNA, 3093 nt, Artificial Sequence
  derived and/or modified sequence opt3 from PPP1R12A__Homo_sapiens__NP_001137357
augaagauggccgacgcuaaacagaagagaaacgagcaacugaaaagguggaucggcagcgaaaccgaucucgagcccccuguggucaagcggcagaaaacaaagguuaaguucgacgauggggcaguguuucuugccgcgugcuccucuggagacacugaugaaguacugaaauuguuacaccgcggugcugacauuaauuacgccaacguggauggccugacggcacuacaucaggccuguauagacgauaaugucgacauggugaaguuccucguugagaacggggcuaauaucaaccagccagauaaugaaggauggauuccgcugcacgcagccgcuucaugcggcuaucuugacaucgccgaguuucugauuggucaaggggcgcaugugggagcagucaacagugagggcgauacccccuuggacaucgccgaagaggaagcuauggaggagcuccugcagaaugaagugaaccgacagggcguagacauagaggccgcacguaaagaagaggaaagaaucaugcugagggaugcucggcaguggcucaauagcgggcacauuaacgacguucgccaugccaaguccggagguacagcguuacacguggccgcagcuaaaggcuacacugagguccugaaacuuuugauccaagccggguaugaugugaauauuaaggacuacgauggauggaccccucugcacgcugccgcacauuggggcaaagaggaagccuguagaauccuaguggacaaccucugcgauauggagauggucaauaagguuggucagacagcuuucgacguggcggaugaagacauacugggguaucuugaggaacugcagaaaaagcagaacuugcuccacucugagaaaagggauaagaaaucgccacugauugagucaaccgcaaacauggacaauaaccaaagccagaagacuuuuaagaauaaagaaacauuaaucauugagcccgaaaagaacgccagucggaucgagucccuggaacaggagaaaguagacgaggaagaggaaggaaagaaagaugagucuagcuguuccucagaggaagacgaggaagaugacagugagagcgaagcugagaccgauaagacgaagccucucgccucugugacuaaugcaaacaccuccucaacacaagccgcuccagucgccgugacuacccccacaguuagcaguggccaggcaaccccuacgucuccaaucaaaaaguucccgacuacagcgaccaaaauuucccccaaggaggaggaacgcaaagacgaaagcccugcuacuuggcgacuuggccugagaaagacagggucguacggagccuuggcagagauaaccgccucuaaggaaggucagaaagagaaggauacggcuggcgugaccagguccgccucaaguccacggcuaagcuccucucuggacaauaaagagaaggaaaaagauagcaaggggacacgucucgcauaugucgcucccacuaucccucgcagacuggccucaaccagugacauugaggaaaaggagaacagggauuccagcucucuucggacaucaaguagcuacacucgacgcaaaugggaagacgaucugaagaaaaauuccucugugaacgagggaucgaccuaccauaagagcugcuccuuuggcagaaggcaggacgacuugaucucaaguucuguaccaagcacaaccuccacucccacgguuacaucagcggccggucuccaaaaaucucuguuaucuuccaccaguacuaccacaaagauaaccacugggagcagcuccgcuggcacacagucaaguacgagcaaucggcugugggcagaggauucgaccgaaaaagagaaggacuccgugccgacugccgucacaauuccuguggcucccaccgucgugaacgccgcagcgucuacaacuacccuaacgaccacaacugccggaaccguuagcucaacaacugaagugcgcgagagaaggcguaguuaucucaccccaguacgggaugaggaauccgagucucagcgaaaggcuagaagcaggcaggcccgccaaucccggagaucaacgcagggcgucacacugaccgaccuucaggaagcagagaaaacuaucgggaggagccgcaguacacgaacccgggaacaggagaaugaggaaaaggagaaagaagagaaggaaaaacaagauaaggagaagcaggaggaaaagaaggagucugaaacuucccgugaggacgaauacaaacagaaguauagcagaaccuacgaugagacauaucagagguaccgcccugugucgacgucaucuaguaccacucccuccagcucuuugagcacaauguccucaagucuguaugcuagcucucaacucaaccggccaaauucccugguuggaaucaccucagccuacaguagagguauuacaaaagagaacgaaagggagggcgaaaagcgagaggaggaaaaggagggggaagacaaaagccagcccaaguccauccgcgagcggagaaggccucgugaaaaacgccggucuacuggagugucguucuggacccaggauagcgacgagaacgagcaagaacagcagucagauacggaggaaggcuccaauaagaaagagacacagaccgacaguauuucuagauacgaaacuagcuccaccucagccggugauagguaugacucucuucuggggcgaagcggcaguuacuccuauuuggaggagcggaagccauacagcucucgccucgaaaaggacgauucaacagacuuuaaaaagcuguaugagcaaauauuagcagaaaacgagaaacugaaggcucagcuacacgauacuaauauggaacucaccgaccugaaacuucaguuggagaaggcgacacagagacaagagagguucgccgaucggucccugcucgaaauggagaaacgagaaagacgcgcacuggagaggcguaucagugagauggaagaggaauuaaagaugcugccggaccuuaaggcugauaaccagcgguugaaagacgagaauggagcccucauuagagucaucagcaagcugucgaaauga

SEQ ID NO: 61053 - RNA, 1548 nt, Artificial Sequence
  derived and/or modified sequence opt3 from PPP1R12B__Homo_sapiens__NP_001161329
auggccgagcuggaacaccucggcgggaagagagcugagagcgcaaggaugcggcgcgccgaacagcuucgacguuggagaggaucccugaccgagcaagaacccgcggagaggcggggugcuggccgccagccuuugacaagaagggggucuccacgggugcgcuucgaggacggagccgucuuuuuagcagccugcucaaguggcgauacugacgaaguucgaaaacugcuagcuagaggugcagauaucaacacggugaauguagacgggcucaccgcccugcaucaggcuuguauugaugagaaccuugacauggugaaguuccuggucgaaaauagggccaacgugaaucagcaagauaacgagggauggacaccguugcacgcggcagccagcugcggcuaccucaauauagcugaguauuuuaucaaccauggcgccuccguugggauugucaauucugaaggagaggugcccucggaccuggcagaagaaccugcuaugaaagaucugcucuuagaacaggugaagaaacaggguguagaccuggagcagucacggaaggaggaggagcaacagaugcuucaggaugcccgucagugguugaacagcggcaagaucgaagacguucgccaagcgagaaguggggccacugcacugcacguggcugccgcuaaaggauacuccgagguccuaaggcuccugauucaggccggcuaugaacuuaaugugcaggauuacgacgguuggaccccacugcaugcagccgcucacuggggagugaaggaggcguguucuaucuuggcagaggcccucugcgacauggauauacggaacaaacuggggcaaacacccuucgacgucgcugaugaaggcuuaguugagcaccuggaacuccuucagaagaaacagaaugugcugcgaagcgagaaggaaacccgcaacaaguugaucgaguccgaccuaaauucaaaaauucagaguggcuuuuucaagaacaaagagaagaugcuguaugaagaggaaacuccuaaaagccaagagauggaggaagagaacaaggaaucuuccucaagcaguucugaggaagaggagggggaagaugaggccuccgaaagcgagacagaaaaagaggcagacaagaagccagaggccuuuguaaaucauucgaacucugaauccaaaucaaguaucaccgagcagauucccgcuccugcccagaauacguucagcgcauccucugcgagaagguuuagcucaggacucuucaacaagccagaggaaccgaaagaugaaagucccuccagcuggcggcugggucuucgcaagacuggcucucacaauaugcugucagagguggcuaacaguagagagccuaucagggaccgugggagcuccauauaccggucuucgagcuccccacgaauuucagccuugcucgauaauaaagacaagguccaguuuggaagaguguggggcaacaguaaggcaguuuucuuuuuccaugaaaauucuauccuggguaccaacgagaauauuuucuga

SEQ ID NO: 61054 - RNA, 2349 nt, Artificial Sequence
  derived and/or modified sequence opt3 from PPP1R12C__Homo_sapiens__NP_060077
augagcggcgaggacgggcccgccgcuggaccuggugcagccgcggcugccgcaagagaaaggcggcgcgagcagcugcgacaauggggcgcccgugcuggggcagaaccaggaccgggcgagagaagggcccggaccgugcgcuucgaaagagcugccgaguuucucgcggcaugcgccgguggggaucuugacgaggcuaggcugauguugcgggccgcagaucccggaccuggcgcugaauuagacccagccgcgcccccuccagcccgcgcaguccuggauuccacaaacgcugacggcaucucugcccuacaccaggcuuguauugaugagaaucucgaaguugugcgauuccugguagagcagggggccacugugaaccaggcagacaaugagggauggacgccccuucaugucgccgcuucaugcgguuaccuggauauagcgagauauuugcucagucacggcgcaaacaucgccgcugugaauagcgacggggaucugccucuggaccucgccgaauccgaugcaauggagggauuacugaaggccgaaauugcuaggcggggcguugacguggaggccgcaaaacgugcggaagaggagcuuuugcugcaugacacccgcuguuggcuaaacgguggggcuaugccagaagccagacacccgaggacaggagcaucugcccuccaugucgcugccgcaaagggcuacaucgaggugaugcggcugcuucugcaagcuggcuaugaucccgaauugcgagacggggauggauggacuccucuccacgccgcggcccacugggguguagaggacgcuugccgccuguuagcagaacauggcgggggaauggauucgcugacccacgccggccagagaccaugugaccucgcugaugaggagguucuuucacuguuggaggagcuagccaggaaacaggaagaccugcggaaucagaaggaggcaagccaaagucgcggucaggaaccccaggcgccuuccucuagcaaacauagaagguccucagugugccgucucaguagccgggagaagauuucucugcaggaucuuuccaaggagcgaagaccagggggcgccggaggcccuccgauccaagacgaagaugagggggaagagggaccuacagagcccccacccgcugaacccaggacccugaacggugucucaagcccaccccacccuaguccaaaaucuccggugcaguuggaggaagcccccuuuucccgccgguucggccuccugaagacugggagcucgggagcauuaggcccuccagagagaaggacagcugaaggugcccccggggcaggccugcagcgcucugccuccucaaguuggcuagagggaaccagcacgcaagcuaaagagcuccgacuggcgcggauaacuccuaccccaucccccaaacuuccggaaccuucuguguugagcgaggucacaaagccacccccuugucuggaaaauucaagucccccaucccguaucccugagcccgaaagcccagccaagccgaacguuccuacugcaucuaccgcucccccagccgacucaagagacaggcgccggaguuaccagaugcccgugagagaugaggagagcgaaucccagaggaaggcccgaucucgccucaugcggcagucgagaaggagcacacaaggcguaacccugacggaccuuaaagaggcugaaaaggcagccgggaaagcgccugaguccgaaaagccagcucagucacuggaucccagucgucgcccucgggugccgggagucgaaaauucugacagcccagcccagagagcagaggcccccgauggucagggcccugggccacaagcugcaagggaacaccgaaaagugggaaaggaguggcggggccccgccgaaggugaggaggcggaaccugcugaccgcucccaggagucaagcacuuuggaagggggcccgucugccagaaggcagcgguggcagcgagaucucaaccccgagccagaaccugaguccgaggaacccgacggaggcuuuagaacacuguaugcagaguuacgcagggaaaaugagcgucugcgggaagcccuaaccgagacuacacucagacuggcucaacuuaaaguugaguuggaaagggccacccagcgccaggagcgauucgcagaaagaccagcucugcucgagcuggaacgguuugagaggcgcgccuuagagcguaaggcggccgaacuggaggaggaacuuaaggcauugagugaucucagagcugacaaccagcggcugaaagaugagaaugccgcucuaauuagggugaucagcaagcugucuaaauga

SEQ ID NO: 61055 - RNA, 3273 nt, Artificial Sequence
  derived and/or modified sequence opt3 from PPP1R13B__Homo_sapiens__NP_056131
augaugcccaugauccugaccguguuccucagcaacaaugagcagauucuuacagaagucccuauaacuccagagacgaccugcagagacguuguggaauuuuguaaggagccgggcgaaggguccugccaccuggccgagguauggaggggaaacgagcggcccaucccuuucgaucauaugauguacgaacacuugcaaaaaugggguccacgccgagaggaagugaaguuuuucuuacgucaugaggacucucccacagaaaauucagaacagggcgggagacagacucaggagcaaaggacccagcggaacgucauuaaugugccuggagaaaaacgcacagagaacggcguugguaauccaagaguggaacugacccuaagugagcuccaggauauggcugcaaggcagcaacagcagaucgagaaccagcaacagaugcuggucgccaaggaacagcggcuucacuuucugaaacaacaggagcgccgacagcagcaaagcauuuccgaaaaugagaaguugcagaagcucaaagaaagaguggaggcgcaggagaacaagcugaaaaagaucagggcuaugcgggggcagguagacuauucuaaaauaaugaauggaaaccugucggccgaaaucgagcguuucucagcaauguuucaagaaaagaagcaggagguucagacugccauucuccgcguggaucaguuaagccaacagcuggaagaccuuaaaaagggcaaauugaauggcuuccagaguuacaacgggaagcugacaggacccgcugcagucgagcuaaaaagacucuaucaggagcugcaaaucaggaaucagcuuaaccaggaacaaaacuccaagcugcagcagcagaaagaguugcucaauaagcggaacauggaaguggccaugauggauaagcgaauuucugagcugcgcgagagauuauacgguaaaaagauccaacugaauagggugaacggcaccagcuccccucagucaccacucaguacgagcgggcgggucgcugccguuggaccguauauacaggugcccucugcgggcuccuuuccuguacuuggugacccaauuaaaccccagucacugagcaucgcaaguaaugccgcucaugggcgcucuaaguccgccaacgauggaaauuggccuacuuugaaacaaaacagcucgucuuccgugaagccaguccagguggcaggcgcugacuggaaggaucccucaguugaaggcagugugaaacaggggaccgucagcucccagccggugccuuucucugcccuaggacccacagagaagccagguauugaaaucggcaaaguaccucccccaauccccgggguuggaaagcaacugccuccaagcuacggcacuuauccgucacccaccccucucgguccagggaguacauccagccuggagagaaggaaagaaggcucucuuccccguccuucagcgggacugccaagucggcagcgacccaccuugcucccggccacgggcagcacuccucagccaggguccucucaacagauucagcagagaauaucggugcccccuagccccacauacccgccugcaggacccccagcuuuuccggccggugacuccaagccugagcugcccuuaaccgucgcuaucaggccauuccuggccgauaagggcucacgcccccaaaguccucggaaagggccacagacugucaauucuagcuccauuuacucaauguaucuacagcaggcaacacccccuaagaacuaccaaccggccgcucacagcgcgcucaauaaaucugugaaggcaguguauggaaaaccaguucugcccuccggcaguaccagcccuucuccacuucccuuuuugcacgguucccugucaacggggaccccucagccgcagcccccaagugagagcacagaaaaggagccugaacaggacggccccgccgcuccagccgacggaucgacuguggagucccucccuagaccccugucuccaaccaaacuuacaccgaucguacauagcccucugagguaccaaucagaugcagacuuggaagcccuccgccgaaagcuggcuaacgcaccccggccauuaaagaaacguaguuccauaacugagcccgagggcccugggggaccaaauauucagaagcugcuauaucagagauucaacacccucgccgguggcauggaagggacacccuucuaccagccuucuccgagccaagauuuuaugggaacccuggcggacgucgauaauggcaacacuaacgcuaaugguaaccuugaggaauugccacccgcccagccuacggcaccccugccagccgagccugcucccuccucagacgccaaugauaacgaacucccaagcccugagccggaggaacugaucuguccccagacaacccaccaaacugcagagccagcugaagacaauaacaauaacguggccaccguuccuacaaccgagcagauccccaguccaguggcggaggccccuucucccggggaggagcaggucccgccagcuccuuuacccccagcaucccaucccccugccacuagcacaaauaaaaggacgaaccugaagaaaccaaauucggaacgcaccggccacggacuucgggugagauucaaccccuuggcucuccugcuagaugccucacuggagggcgaauuugaccucguacagaggauuaucuaugagguggaggauccaucuaagccuaaugacgaagggauuacuccccugcacaacgcaguuugcgcgggacaucaccauauagucaaguuccuuuuggacuuuggcgugaaugugaacgccgcugauagugacgguuggacaccucugcacugugccgcauccugcaacagcguccauuuauguaaacaacucguugagucuggggcugccaucuucgcaagcaccauuuccgauaucgaaacagccgcugacaagugcgaggaaauggaggagggauacauccaguguucacaguuucuguacggcgugcaggaaaaacuuggugugaugaauaagggcguagcguaugcccugugggauuacgaggcacaaaacagugacgaauugagcuuccacgagggggaugcucucacuauucugcgacgcaaagacgaaucugagaccgagugguggugggcccggcuaggagauagagaaggcuaugucccaaagaaucugcucgggcuguaccccaggauaaagccucgucagcgcacgcuugccuga

SEQ ID NO: 61056 - RNA, 2487 nt, Artificial Sequence
  derived and/or modified sequence opt3 from PPP1R13L__Homo_sapiens__NP_001135974
auggacagcgaggccuuccaguccgcuagagauuuucuggacaugaacuuccaaucucucgcaaugaagcacauggaucuuaaacagauggaacuggacaccgccgcggcuaagguggaugaguugacaaaacaguuagaaucacuguggagugacagccccgccccuccaggcccgcaggcagggcccccuuccaggccaccccgguacucuucgucaagcaucccugagccauuuggaagucgcgguucaccccgaaaggccgcuacugauggcgcagacacgccuuucgggcguucugaaagcgccccaacccuacauccguauucuccccucucaccuaaaggaagaccaaguagccccaggacaccucuguaccuucaaccagaugcuuauggcucucuggaccgggccacuagcccccgcccgagagcguuugauggugcaggguccuccuugggaagggccccuaguccccggccaggcccuggcccccuccgccagcaggggccacccaccccuuucgacuuucugggacgagcugguucuccaagaggcuccccgcuggccgaggggccccaggcauucuuuccugagaggggaccaagcccccggccuccagcuacagccuacgaugcgcccgccucggcauucggcuccucccucuuagguucagggggaagugcuuuugccccgccucugcgugcucaagacgaccuuaccuugcgcagaaggccacccaaggccuggaaugaaagcgaucuggacgucgcauaugagaagaaaccuucccagacugccucuuacgaacggcuagauguuuucgcucgacccgcgagcccaucacuccagcugcuuccuuggcgcgagaguucccuggacggcuugggcgggacaggaaaggauaaccucaccagcgcaacgcugcccagaaauuauaaagugucuccauuagccucagacaggcggagugaugcugguagcuaccgcagaucccugggcucugccgggccgucgggaacucucccuaggagcuggcagcccguaucccguauuccaaugcccccuucaaguccacaaccccggggcgcaccucgacagagaccgauaccacuuucuaugaucuuuaagcugcagaacgccuucugggagcacggugcuagcagggccauguugcccggguccccucuauucacccgcgcaccacccccuaaacugcaaccgcagccccagccacagccucaaccccagucacagccacagccucaacugcccccacagccgcagacacagccucaaacucccaccccagcgccccagcauccucagcagacauggccacccgugaaugaaggcccuccgaagccacccaccgagcucgaaccugagcccgaaauugagggacuucugacgccagucuuggaggcuggcgacguggaugaagggccuguugcccggccccucagcccaacuagacugcaaccugcauuaccgcccgaggcccagucugugccagaacuggaggaagucgcuagggugcuagccgagaucccucgcccccucaagcgacggggauccauggagcaggcaccagcuguagcccugccucccacacacaaaaagcaauaccagcagauuaucagucgucuuuuucauagacacgguggcccggggccaggaggcccugaacccgaguugagcccaauaaccgaagguucugaggcgagggccgggcccccugcuccggcacccccagccccuauucccccuccagcucccucccagucaaguccuccagaacaaccccagagcauggagaugcgcucgguucugcggaaagccggcuccccgagaaaggcaaggcgagcgcgccucaacccucuggugcuucuguuggacgccgcucucacuggagagcuggaagucgugcagcaggccgugaaagagaugaaugauccaucucaacccaacgaagagggcaucacagcauuacacaaugcuaucugcggggccaacuauagcauugucgacuuccugaucaccgcaggagccaauguuaacucaccugacagucaugguuggacgccacuacacugugcugcguccugcaaugauaccgugauauguauggcccucguacagcauggcgcagcuauuuuugccacaacucugucugacggggccaccgcuuucgagaagugcgaucccuaccgggaaggauaugcagacugugccacauaccuugcggauguggagcagagcaugggcuugaugaacuccggugcugucuaugcccugugggacuacucagcagaauuuggggaugagcucagcuucagagaaggcgagagugugacuguucugaggcgugacggaccggaggaaaccgauugguggugggccgcuuuacacggccaggagggguaugugccucgcaauuacuuuggacuguucccccgggucaaaccacaaagaucuaagguguga

SEQ ID NO: 61057 - RNA, 363 nt, Artificial Sequence
  derived and/or modified sequence opt3 from PPP1R14A__Homo_sapiens__NP_001230876
auggccgcucagagacugggcaagagggugcucagcaaacuucaaucccccucucgggcacgcgggccuggagguucaccaggcgggcugcagaagcgacacgcccgugucaccguuaaauacgacagaagggaguugcagcggcgcuuagauguggaaaaguggaucgacggaagacuggaggaacuauauaggggcaugggucuccugaaaaguugcgggaagccgguagaggauuucauucaggaacuucuggcgaaguugcaaggacuccaucggcagcccggccugcgccagccuagcccaucccacgacggcucucugucgccccuccaggaucgagcuagaacagcccauccuuga

SEQ ID NO: 61058 - RNA, 444 nt, Artificial Sequence
  derived and/or modified sequence opt3 from PPP1R14B__Homo_sapiens__NP_619634
auggccgacagcggcaccgcugggggagcagcccuggcggcucccgccccugguccaggcuccgggggaccgggccccagaguguacuuccaaucuccuccaggugcagccggggagggacccggcggcgcugaugacgaagggccugucaggcggcaaggaaagguuacagugaaauaugaucgcaaggagcuccgaaaacgucuuaaccuggaagaguggaucuuggaacaguuaacuagacuguacgacugccaggaggaggaaauuccagagcuagaaauagauguagacgagcuccuggauauggagucagacgaugcaagggccgcucgggugaaggaacuucuggucgacuguuauaaacccacggaggccuuuaucagugguuugcucgauaagauucgcggcaugcagaagcugagcaccccucagaaaaaguga

SEQ ID NO: 61059 - RNA, 498 nt, Artificial Sequence
  derived and/or modified sequence opt3 from PPP1R14C__Homo_sapiens__NP_112211
augagcguggccaccggcuccucugagacagcugggggagcaucagguggcggggccagagucuucuuucagagucccaggggaggcgcgggugggagcccuggauccucuucgggcucaggcagcagucgggaagacuccgcuccaguugccacugcagccgcugcagggcaagugcagcagcagcaacagcgccgacaccagcagggaaagguaacggugaaauacgaucguaaggagcugagaaaaaggcucguccuugaagaguggaucguggaacaacugggucaguuguauggcugcgaggaggaagagaugccggaaguugagauugacauagaugacuuacuggaugccgacucugaugaggaacgggcuagcaagcuacaggaggcccucguggacuguuacaaacccaccgaagaguucaucaaggaacugcuuucccgcauuagagggaugaggaagcugucaccuccacagaaaaagagugucuga

SEQ ID NO: 61060 - RNA, 2025 nt, Artificial Sequence
  derived and/or modified sequence opt3 from PPP1R15A__Homo_sapiens__NP_055145
auggcccccggccaggcuccucaccaagcaaccccauggagagacgcccauccguucuuucugcucagccccgugauggggcuucuguccagggcguggucucgguugcgcggauuagguccucuggagccauggcuagucgaagcuguuaagggcgccgcacucguggaggccgggcuggaaggagaggcucgaacaccccuugcaaucccucacacuccauggggccguagacccgaagaggaggccgaagauucaggugggccuggagaggacagggaaacgcugggcuugaaaaccaguagcucccucccagaggcuuggggccugcuggaugacgaugacgggauguacggagagcgggaagccacaucuguaccgcgcggucagggcucgcaguucgcggaugggcagagagcaccccucucaccuagcuuacugauuaggacucuucaaggaagugacaagaacccaggcgaggaaaaagccgaggaagaggguguggcugaggaagagggggucaauaaguuuuccuaucccccuucucaucgggaaugcuguccagccguggaggaagaggaugacgaggaagcaguuaaaaaggaggcucaccgcaccagcacauccgccuugucacccggaaguaagccgagcaccugggugucuugcccuggcgaagaggaaaaccaggcgacugaggauaaacgaacagagagauccaagggcgccaggaaaaccucagucagcccccggaguucuggguccgacccacguagcugggaauaccgcucgggagaggcaucugaagagaaggaggaaaaagcucauaaggagacggguaagggcgaagccgcuccugggccccaguccucagccccagcacagagaccccaacugaaaaguugguggugucagccuagcgaugaggaagagggagaggugaaggcccuaggcgcugcggaaaaagacggugaggcagaaugcccaccguguauacccccuccauccgccuuccucaaggcuuggguauauuggcccggggaggacacugaagaggaggaagaugaggaagaggacgaagauucugacagcggcucagaugaggaggaaggagaggccgaagcaaguuccagcaccccugccacaggcguuuuucugaaaucuuggguguaccagccaggggaggacacugaggaagaggaagaugaggacucagauaccggaagugcugaagacgagagggaggccgaaacaagcgcauccacgcccccggcgucugcuuuccuuaaggccugggucuaucggccuggugaggauaccgaagaggaagaggacgaggacguggauucggaagacaaagaggaugacagcgaagcagcccugggcgaggcugaauccgauccacaccccucacacccugaccagcgagcccauuuucgcggguggggauacagacccggcaaggagacugaggaagaggaagcagcugaggauuggggugaggccgaaccaugcccuuucaggguggcgaucuauguccccggggagaagccaccgccucccugggccccaccccgguugccucuccgccugcaaagaagguuaaaacguccagaaacacccacccacgacccugauccggagacuccacugaaggcucggaaaguucgauuuagugaaaaggugacaguacauuuccucgcagugugggccggccccgcucaggccgcaagacagggaccuugggagcaacuugcgagggaccgcucucgguuugccagaaggauuacccaggcucaggaggaacugagcccauguuugacgcccgccgcacgcgcucgagccugggcacggcuacguaauccuccgcuggcccccaucccagcucucacccagacacugccuuccucaagcguccccucuuccccagugcaaacuaccccucuuagucaggcgguugccacacccagcagaucuuccgcagcugccgccgcugcacuggauuugucaggcaggcgcggguga

SEQ ID NO: 61061 - RNA, 2142 nt, Artificial Sequence
  derived and/or modified sequence opt3 from PPP1R15B__Homo_sapiens__NP_116222
auggagcccggcaccgggggaagcagaaagaggcuggguccucgggccggcuuccgcuuuuggccaccguucuuuccccgacguucccaggcugggucuucaaaauucccuacaccacucggacccgaaaacaguggcaauccuacucuucugagcuccgcacaaccagagacgagagugucuuacuggaccaaguuguuaucgcagcugcuagcgccccucccuggucugcuucagaaaguccugaucuggucacaguuguuugggggaauguucccaacaagguggcucgacuuugccggcguuuauagcgcucugcgggcccugaagggccgcgaaaaaccggcagcccccacugcucaaaagagucucuccucuuuacagcuggauagcuccgacccuucagugaccaguccacuugauugguuggaggaagggauucacuggcaguacucucccccugaccugaagcuagagcucaaagcaaagggaucugcccuggauccagcugcccaggcguuccuucuggagcaacaguugugggguguagaacuccugcccuccucauuacagagcagacuguauaguaacagggagcucggcagcuccccgagcgggccucuuaauauacagcggaucgacaacuuuucgguggucucuuaccuguugaaucccuccuaucuagauugcuucccacgccuggaagugucauaccaaaacagugacggaaauagcgagguugugggcuuucagacacucaccccugaguccucuugucugcgagaagaucauugccacccccagccacuuagcgcagagcugauucccgccucauggcaagguuguccuccauugaguacugaagggcucccggagauccaucaccugagaaugaaaagguuagaguuccugcagcaggcuuccaagggacaggaccuacccacaccugaucaagacaacggcuaucauagccucgaggaggaacacucucugcuucggauggauccaaaacacugccgugacaaucccacccaguuugucccugccgcaggcgacauuccagggaacacgcaggagucaacugaagagaagaucgaauugcugaccacagaggugccccucgcucuggaggaagagaguccgagcgaaggauguccuuccucugagauaccaauggaaaaggagcccggugagggccgcaucucgguaguugauuacagcuaccuugaaggggaccugccuauuuccgccagacccgcgugcucaaauaaauugaucgauuauauucucggaggcgccaguucugaccuggagacuagcuccgauccagaaggugaggacugggaugaggaagcagaggacgauggguucgacucagauagcucuuuauccgacagugaccuggaacaggauccugagggccuacaucucuggaacagcuucuguucuguggaccccuacaauccacaaaacuuuaccgcuacaauccagaccgccgcuaggauagucccggaagaaccuuccgauucagagaaggaccugaguggaaaaagcgaucuugaaaauucgucccagucuggcagcuugcccgagacgccagaacacucaaguggggaggaagacgauugggaguccucugccgacgaggcagaaagccugaagcucuggaacuccuucugcaacucagaugaccccuauaauccucugaacuuuaaagccccauuccagacuagcggagagaaugaaaaggguugucgggauaguaaaacacccucugaguccauuguggcuaucagcgaaugccauaccuuacugucguguaaggugcaacuuuugggcucacaggagucugagugcccugacaguguccagcgagauguucucuccgggggacgccacacucacgugaagaggaaaaagguaacauuucuggaagaggugaccgaauacuauauuagcggcgacgaggacagaaaagguccgugggaggaguucgcgcgggaugggugccgcuuucagaagagaauccaagaaacggaagacgcaaucggcuacugucuaaccuucgagcauagggaacguauguuuaaccggcugcagggaacaugcuucaaaggccucaauguccugaagcaguguuga

SEQ ID NO: 61062 - RNA, 315 nt, Artificial Sequence
  derived and/or modified sequence opt3 from PPP1R17__Homo_sapiens__NP_001138595
augaugagcaccgagcagaugcaaccccuggaacucuccgaggacagacuugauaagcuggacccuaggugcucucacuugggcguguucucagaacauuuaaucaaacgguacgauguccaggagcgccacccaaaggggaaaaugauuccgguucugcauaacacagaccuagaacagaagaaaccccgacguaaggauacuccugcccuccacaugaguccauuugcugcaggagugacgcugcuuagagacgagaggcccaaggccauaguagaggaugacgaaaaagauggugacaagaucgcgauuuga

SEQ ID NO: 61063 - RNA, 1842 nt, Artificial Sequence
  derived and/or modified sequence opt3 from PPP1R18__Homo_sapiens__NP_001128342
auggccaccauccccgacuggaagcugcagcuccuugcuagaaggcggcaagaggaagcaagcgugcgcggccgagagaaagccgaacgugagagacugucccagaugccugcguggaagaggggguuguuagaacggcgcagagcuaaacugggacuaucuccaggugagccgucacccguccucggcacaguugaggccgggccuccagaucccgacgaaagugcagugcugcuugaggccauuggaccuguacaccagaacagguucauacggcaggaacgccaacagcagcagcaacagcagcagcgaagcgaggagcuguuggcugaaagaaagccaggcccccucgaggcaagggaacggcguccuuccccaggugagaugcgcgaucaaucuccgaaagggagagaaucgagggaggagcggcugucaccccgagaaacucgcgagagaaggcugggaaucggcggcgcccaggaacucagcuuacggccucuggaggcucgcgacuggagacagaguccaggggaagugggagauagguccucucgucuuagcgaggccuggaaguggcgguugucccccggugagacgccugaacgaucacugagacuagcggagaguagggaacaaagcccacgccggaaggaggucgaaucuagacucucccccggcgagucagcauaccagaaacuggggcuuaccgaggcccauaaguggaggccggacagccgcgaaagucaggagcagucucuggugcaauuggaagcuacagaguggcgacuccgguccggagaggaacgucaggauuauagcgaggaaugcggcagaaaagaggaauggccuguucccgguguggccccaaaggagacugcagagcugucggaaaccuuaacaagggaggcucaggggaauagcuccgccggagucgaagcggccgagcagcgcccuguggaagacggcgagcggggcaugaaacccaccgagggguggaaguggacucugaacucaggaaaggcaagagaauggacaccaagggauauugaggcucaaacccagaaacccgaaccuccagagagugccgaaaagcuccuugagagcccggguguagaggcuggcgaaggggaggccgaaaaagaggaggcaggagcccagggccgaccccugcgcgcuuugcagaauuguugcuccguuccuucuccacuacccccugaagacgcggguacgggaggccugcggcaacaggaggaagaggcaguggaacuccagccacccccgccugccccacugucucccccucccccagcuccuacugccccacagccaccgggagauccucuuaugucaagacuguuuuacggcgucaaggcagggcccggagugggugccccaaggcguaguggccacaccuucacagugaacccccgccgguccgucccuccagcuacucccgccaccccuacaagcccggcaaccguugacgcggcugugccaggggccgggaaaaagagauaucccacggcagaggagaucuugguacucggcgguuaccugagguuaucucgaucaugucuggccaaagggaguccugaacggcaucacaagcaacuaaagauuagcuuuuccgagacugcucucgaaacaaccuaucaguacccaucugagucgagcgugcuggaggaacuuggccccgagccugaagucccguccgcccccaaucccccugcagcucagcccgaugacgaggaagacgaggaagaguugcugcuccugcaaccagagcuucagggaggccugcgcacuaaagccuugaucguggaugaaucaugcagaagguga

SEQ ID NO: 61064 - RNA, 516 nt, Artificial Sequence
  derived and/or modified sequence opt3 from PPP1R1A__Homo_sapiens__NP_006732
auggagcaggacaacagccccagaaagauccaauucaccgugccucugcucgaaccacaccuugauccggaggccgcugaacagauuaggcggcgccgacccacuccugcaacacuggucuugacguccgaccagucuucaccagagauagaugaagaccguauccccaauccucauuuaaaaaguacccuggccaugagcccaagacagaggaagaaaaugacacggauuacucccaccaugaaggagcuacaaaugaugguugagcaccaucucggccagcagcagcaaggggaggaaccugaaggagcggcugaguccacagguacccaggagucucgcccaccgggcauccccgauacugaaguggagucgagacuggggacaucaggaaccgccaaaaagacggcagaaugcauuccuaagacucacgagaggggcagcaaagaaccaaguaccaaggagcccuccacacauaucccuccacuugacucuaaaggugccaacagcguauga

SEQ ID NO: 61065 - RNA, 615 nt, Artificial Sequence
  derived and/or modified sequence opt3 from PPP1R1B__Homo_sapiens__NP_115568
auggaccccaaggauaggaaaaagauccaguucagcgugccugccccaccgucccaacuggaccccagacaggucgagaugauucggcgccgacguccuaccccagcuaugcucuuuagacuuucugaacacucaagucccgaggaagaggcaagcccucaucagagggccuccggcgaagggcaccaucugaaaucuaagcggccaaaccccugcgcguacacaccuccaucguugaaagcuguucagcgcauagccgagucacacuuacaaagcaucaguaaucugaacgagaaucaggcauccgaagaggaagaugagcuaggagagcucagagaacuggguuauccgagggaggaagacgaggaagaggaggaagaugacgaggaagaggaagaggaggaagauucucaggccgaggugcuuaagguaauucggcagagcgcuggccaaaagacuacgugugggcagggacuggaaggccccugggagcgcccuccacccuuggacgaauccgagcgagauggugggucagaggaccagguggaagauccugcacucagugagccaggagaggaaccccagagaccgagcccuucugagcccggcaccuga

SEQ ID NO: 61066 - RNA, 618 nt, Artificial Sequence
  derived and/or modified sequence opt3 from PPP1R2__Homo_sapiens__NP_006232
auggccgcuagcaccgcaucccacagacccaucaagggcauucugaaaaacaagacaucuacuacgucaaguaugguggccagcgcggagcagccuagggggaaugucgacgaggaacucuccaaaaagucucaaaaaugggaugaaaugaacauacuugcuaccuaccauccagccgacaaggauuauggacugaugaagaucgacgagccgucgacacccuaccacucaaugaugggugaugacgaagaugcaugcagcgacacugaggccaccgaggcuauggcaccugauauuuuggcccggaaauuagcugccgcggaaggccuggagccaaaguaucgcauccaggaacaggagaguuccggggaggaagacucugaucuaagccccgaggaacgagagaaaaagcgucaguucgaaaugaaaagaaagcuccauuacaaugagggacugaacauuaaacuugcaaggcaacugaucuccaaggacuugcacgaugacgacgaggaugaagagaugcucgaaacagccgacggcgagucaaugaauaccgaagagaguaaccaggguagcacuccuucugaucagcagcaaaauaagcugcgguccucauga

SEQ ID NO: 61067 - RNA, 3369 nt, Artificial Sequence
  derived and/or modified sequence opt3 from PPP1R3A__Homo_sapiens__NP_002702
auggagcccagcgaagugccuucccagaucucuaaggacaacuuccuggaggucccaaaucucucagauagucuuugcgaagacgaggaaguuaccuuucaaccgggcuucagcccccagccuuccagaagggggucugauucgucagaggacauuuaccuggauacaccaagcaguggaacucggcgcguguccuuugccgacucuuucgguuuuaacuugguaagcgugaaagaguucgauuguugggaauuacccuccgcuucaacgaccuuugaccugggcacagauauauuccacacugaggaauauguccuagcaccucucuuugaccugccaaguagcaaggaggaucuuaugcagcagcugcaaauccagaaagccauuuuggagucuaccgaaucccuccuggggucaacaagcaucaagggaauuauccgagugcugaauguuaguuucgagaaacucguguacguccguaugucuuuagacgauuggcagacccauuaugacauacuggcggaauacgugcccaacuccugcgacggcgagacugaucaguuuagcuucaagaucguacuuguuccuccauaucaaaaggacgguucgaaaguggaauuuuguauuagauacgagacaucugucgggaccuucugguccaauaacaauggaacgaacuauacuuucaucugccagaagaaagagcaggaaccggagcccgugaagccuuggaaagaagugccaaauaggcagauuaagggcuguuugaaggucaaaucaaguaaggaggaaagcuccguuaccucugaggagaacaauuuugaaaaccccaaaaauacagauacuuacaucccuaccauaauuugcagccacgaggacaaggaagaucuggaggcuucaaaccggaaugugaaagacguaaaccgcgaacaugaugagcacaacgagaaggaacuagagcucaugaucaaucaacaucugauuagaacaaggaguaccgccucccgggacgaacgcaacacguucagcacugauccagugaauuuucccaacaaagcagagggccuugagaagaagcagauccacggggaaaucuguacagaccuguuccagcgaucuuugucaccgaguagcuccgccgagucuucggucaaaggagauuuuuacugcaaugaaaaguauagcuccggugacgacuguacccaccaaccuucagaggaaacuacaaguaacaugggcgagauuaaacccucucucggggauaccagcuccgacgagcuggugcaguuacauacgggaucaaaggaaguucuggaugacaaugcuaacccagcacacggcaaugguaccgugcagauaccuugccccagcucugaucagcucauggccgggaaccuuaauaaaaagcaugagggaggcgcuaagaacaucgaagucaaagaccugggcuguuugagaagggauuuccacuccgacacaagugccugccuaaaggagagcacugaagaggggucuuccaaagaggauuacuauggaaaugguaaggacgaugaagaacaacggauuuaccugggcgugaacgaaaaacagcguaagaauuuucagaccauccuccacgaccaggagcgcaagauggggaacccaaaaauaucaguagcgggaauuggcgcaaguaacagagaucuggccacacuucugagcgaacauacugcuauccccaccagggccaucacagcagacguuucgcacuccccucggaccaauuugucuugggaggaggcugugcucacuccagaacaucaccaucugacgagcgaggguucagccuuagggggcauuacaggacaagucugcaguucccgaaccggcaacgugcugcgcaaugacuaucuauuccaggucgaagagaagucugggggaaucaacagcgaggaucaggacaauuccccgcagcacaaacaaucauggaacgugcucgaaagccaggguaagaguagagagaauaaaacuaacauuaccgaacacauaaagggccagacagauugugaggacguuugggggaagagggauaauacccggucucugaaagcgacuacagaggagcuuuuuacgugccaggagaccguguguugcgaauuguccagccuggccgaccauggaaucacugagaaggcagaagcuggcacagccuacauuaucaaaaccacaucggagucaacucccgaaucuaugagugcucgcgagaaggccaucauugcaaaacucccucaagagaccgccagauccgauaggccaauagaaguaaaggagacggcuuucgacccccacgaaggucguaacgaugacagccauuauacccugugucagcgggauacagucggggugaucuacgacaaugauuuugagaaagaaucucgacuuggcauuugcaacguuagaguggacgagauggagaaggaagagacuaugagcauguacaauccuaggaagacccacgaccgcgaaaaauguggaacaggcaacaucacuuccgucgaggagucaaguugggugauuaccgaauaucagaaggcgacgagcaaacuggauuugcaacucgggaugcugccaacagacaagaccguauucucugagaaucgggauuuaagacaggugcaggaacuguccaaaaagacugacucagaugcaaucguucacagugccuuuaacagcgacacaaacagggcuccccagaauaguucuccguucucgaagcaucacaccgagauaagcgucucaacuaacgaacaagccaucgcaguggagaaugccgugaccacaauggcuucccagccuauuaguacgaaaucugagaacaucugcaauagcacccgcgaaauucagggaaucgagaagcauccauaccccgaauccaaaccugaggaagucucacgaucuagcgguauaguuacuuccggcucccggaaggagcguuguauugggcagaucuuccaaacagaggaauauagcguggagaaaucucuaggacccaugauucucaucaacaagccacuggaaaauauggaggaagccagacacgagaacgagggccuugugucauccggucagaguuuguacaccagcggggaaaaggagucggauucuuccgcaagcacaucacugccuguagaagagagucaggcgcagggcaaugagucucucuuuuccaaauauacuaacagcaagauacccuacuuccuguuauuucugaucuuccuuauuaccgucuaucauuacgacuugaugaucggacucacguuuuacgugcugucacuaaguuggcugagcugggaagagggcaggcaaaaagaauccguuaagaaaaaguga

SEQ ID NO: 61068 - RNA, 858 nt, Artificial Sequence
  derived and/or modified sequence opt3 from PPP1R3B__Homo_sapiens__NP_078883
augauggccguggacaucgaguacagauauaacugcauggcucccagccugaggcaggaacgguucgcauuuaagauuuccccuaaaccaucuaagccgcuccgccccuguauacaacuuucaaguaaaaaugaggccagcggcauggucgcgccugcuguucaggaaaagaaagugaagaagcgaguauccuucgccgauaaccaggggcuggcauugaccauggugaaagucuuuucugaguucgacgauccauuagacaugcccuuuaauaucacagaacugcuagauaacauugugucgcucacuacggccgagucagagagcuucguucuggacuuuagucagccuuccgcugauuaccuugacuuccguaauagacugcaagcagaucacgugugcuuggaaaacuguguccucaaggacaaagccaucgcuggaaccgugaagguacagaaucuggccuuugagaaaacaguuaagauuaggaugacuuucgauaccuggaagucuuauacagacuuuccaugccaguacgugaaagauaccuaugcggguagcgaccgggacacuuucuccuuugauaucucacugcccgaaaagauacagaguuacgagcgcauggaguucgcagucuauuacgaauguaacggccaaacauacugggacagcaauagagggaaaaacuauaggaucauucgggccgagcucaagucuacccagggaaugacgaaaccucauuccggcccagauuuagguaucucauucgaccaguuugggagcccgcgcugcaguuacggacuguuccccgaauggccuucuuaucuuggcuacgagaaguugggcccauauuacuga

SEQ ID NO: 61069 - RNA, 954 nt, Artificial Sequence
  derived and/or modified sequence opt3 from PPP1R3C__Homo_sapiens__NP_005389
augagcugcaccagaaugauccaggugcuggaccccaggccucucacauccucugucaugccaguugauguggccaugcggcuuugucuggcucacucaccgcccguaaagaguuucuugggcccuuacgacgaguuucaacgccgacauuucgugaacaaauuaaagccacugaaaagcugccuaaauauuaagcacaaagcaaagucccagaacgauuggaaguguucucauaaucaggccaaaaagcgugucguguuugcggacucgaaagggcucucacugacugcuauacacguuuucagcgaucuucccgaggaaccugccugggaccugcaguuugauuugcucgaccugaacgauaucaguuccgcacugaagcaucacgaagagaaaaaucucauuuuagacuucccacaacccucuacggauuaucugagcuuuagaucccacuuccagaagaacuuugugugccuugaaaauuguucauugcaggagaggaccgucacaggaacugugaagguuaaaaacguaaguuucgagaagaaagugcagauccggauuaccuuugacagcuggaagaauuacacagaugucgacugcguguauaugaaaaacguguacgguggcaccgacucugauacuuucuccuuugccaucgaccugccuccagucauaccgacagaacaaaagaucgaguucuguauuucauaucaugcuaaugggcagguuuucugggauaacaaugacggacagaacuaccgcaucgugcacguacaguggaaacccgauggcgugcaaacccagauggcaccucaggacugcgccuuucaucaaacgagcccaaagacugaacuagagaguaccauuuucgguucucccagacucgcuuccgggcuguuuccugaguggcagagcuggggaaggauggaaaaucuugccucguaucgguga

SEQ ID NO: 61070 - RNA, 687 nt, Artificial Sequence
  derived and/or modified sequence opt3 from PPP1R42__Homo_sapiens__NP_001013648
auggugagacugacccucgaccuuaucgccaggaacagcaaucugaagccccggaaagaagaaacaauuucccagugcuugaagaaaauaacucacaucaacuucucugauaagaauauugacgcuaucgaggauuuaucacuguguaaaaaccuaaguguccucuaccuguaugacaauugcauuagccaaaucacgaaccuuaauuacgcaaccaaccugacacauuuguaucuccagaauaacuguauauccugcaucgaaaaucugcgcucucugaagaagcucgagaaauuauaccugggcgggaacuauauugccguuaucgaaggacuugaggguuugggcgagcugcgagaacuacacguggagaaucagcgucucccucugggggaaaaacuucuguuugauccaagaacuuugcauucgcucgcgaagucacuguguauuuuaaacaucagcaauaacaacauagacgauauuaccgaccuggagcuccuugagaaucugaaccaguugaucgcuguagauaaucaacuacugcacgugaaggaccucgaguuccugcuuaacaaacugaugaaguuguggaagauugaucucaauggaaacccggucugccugaaacccaaguacagggaccgguuaauccuggugaguaaaucccuaggcacauaucucuacuga

SEQ ID NO: 61071 - RNA, 954 nt, Artificial Sequence
  derived and/or modified sequence opt3 from PPP1R7__Homo_sapiens__NP_001269338
auggccgcugagagaggcgcagggcagcaacagagccaggaaaugauggaggaggaacacgaacugcccguggacauggagaccaucaaccucgauagggacgccgaggaugucgaccuuaaucauuaccggauuggaaagauagaagguuucgagguucugaaaaaggugaaaacauugugcuuacgccagaaccugaucaaguguauugaaaaucuagaggagcuccaaucccugcgagaacuugaucuguaugacaaccagaucaaaaagauugagaauuuggaagcgcucacugagcuggaaauccuggauauaucuuuuaaccucuuacguaauaucgagggcguagacaagcugacgagacuuaaaaaguuguuccuggugaacaauaaaauuucaaagaucgagaaccuaaguaaucuccaccagcugcagaugcuugaacuggggagcaacaggauucgggcuaucgagaauauagauaccuugacaaaccucgaaucccuguuuuuaggcaaaaauaagauuacuaagcugcaaaaccucgacgcccuuaccaaccugacagucuugucuaugcagucgaaucgccuaaccaaaaucgagggacugcagaaccucgugaaucugagagaacuuuaccugucacauaacgguauugagguuaucgagggguuggaaaauaacaauaagcucacuaugcuggauaucgcaagcaacaggauuaaaaagauagagaauaucagucacuuaacagaacugcaggaguucuggaugaacgacaaucuacucgaauccuggucugaucuggacgagcuuaaaggagcccggagcuuggagaccguguaucuggaacgcaacccucuccaaaaggacccacaguaccgaagaaaagucaugcuggcacuuccguccgugaggcagauugaugcuacguuuguacgguucuga

SEQ ID NO: 61072 - RNA, 4125 nt, Artificial Sequence
  derived and/or modified sequence opt3 from PPP1R9A__Homo_sapiens__NP_001159632
augcugaagaccgagagcuccggcgaaagaacaacucucaggucugccucaccccaccggaacgcuuaccgcacggaguuccaggcacuuaaaaguaccuuugacaagccuaaaagcgauggggaacaaaagacaaaagagggagaagguucccagcagucucgaggccguaaguaugggucgaaugugaacagaaucaagaaucuguucaugcagaugggaauggagccaaacgagaaugccgcggucauugcuaaaacuaggggcaagggugggcauucaagcccgcaacggcgcaugaaacccaaggaauuuuuggagaaaaccgacggaaguguugugaaguuagaauccucuguaagcgagagaauauccagguucgauacaauguacgacggcccuucauauaguaaguuuaccgagacucggaaaauguucgaacgcagcgugcacgagucuggccagaacaaucgauacuccccaaagaaagaaaaggccgggggaucagagccccaggaugaaugggguggcagcaaaaguaacagagggucuacagacucccuggauagccuaucgucuaggaccgaggcagucuccccuacggugucacagcucagugccguuuuugagaauacugacagcccauccgcuaucauuucugaaaaggcagagaacaaugaauauagcgugaccggacauuacccccugaaccuuccuucagucacagugacuaaucuggauaccuucggccacuugaaagacaguaacuccuggccaccgagcaauaagcgggguguagauacagaggacgcccauaagucuaacgcuacccccguuccugaaguggccucaaaaaguacgagccucgcguccaucccaggggaggagauucaacagucuaaggaacccgaggauucgacuagcaaccagcagacaccugacuccaucgacaaagauggaccagaggaacccugcgcagaaucaaaggccaugccgaaaagugagauaccuucuccccaaagccagcugcuggaggacgcugaagccaaucucgucggccgugaggcagcuaagcagcaacgcaaggaauuagccggcggggauuuuaccuccccagacgcgucagccagcucuuguggaaaagaggugccugaggauuccaacaauuucgacgguagucacguguauaugcacagcgauuacaacgucuacagaguuaggucucgguauaauuccgacuggggcgaaacugggacagagcaggaugaagaggaagacucagaugagaacaguuacuaucagcccgacauggaguacagcgaaaucgugggacugccagaggaagaggaaauucccgcaaaucgaaagaucaaauuuucguccgcuccuauuaagguauucaacaccuauucuaaugaggacuacgaucgcagaaacgacgagguggauccagucgccgcuagcgccgaauaugagcuugagaaaaggguggaaaaguuggaacuguuuccgguugagcuagagaaggacgaagauggccucgguaucucaauaauugggaugggcgugggagcagacgccggccuggagaaacuugggaucuucgucaagacggugaccgaaggaggugcugcgcagcgggauggccgcauucaaguaaaugaccagaucguugagguggaugggaucagucuggucggagugacacagaacuucgcagccacugucuugagaaauaccaaaggcaacgugagguuuguuauuggucgugagaagcccggccagguguccgaaguagcucaacucauaucucagacacuggagcaggaacggcgacagagagaguuacuggaacaacauuacgcccaguacgacgcagaugacgaugagaauacugucgccgagcuccaggggaugagcggaaacugcaacaauaacaauaacuauuuccuuaaaaccggcgaauacgcuacagacgaggaagaggacgaaguggggccuguucugccaggauccgauauggccaucgagguguuugaguugcccgaaaaugaggacauguucucaccuagcgaacuagauaccaguaagcugucucacaaguuuaaagagcuccagauuaagcaugcagucacugaagcggagauccaaaaacugaagacgaaacuucaggcugccgagaacgaaaaggugaggugggagcuggagaaaacacaguugcaacagaauauagaagagaacaaggaacgcaugcucaagcuggaguccuauuggauugaagcacagaccuuaugucacacuguaaaugagcaccugaaagaaacccagagccaauaccaggcccuagagaagaaauauaacaaggcuaaaaagcucaucaaggacuuccagcagaaagagcuggauuuuaucaagcggcaagaagccgagcggaaaaagauugaagaccuugagaaagcacauuugguggaaguucagggucugcaggucaggauccgcgaucucgaggcugagguguuccgacugcuuaagcagaauggcacacaagugaacaauaacaauaacauuuuugaacggcguaccucgcugggggaggucucaaagggagacacuauggaaaacuuggauggcaaacagacaucuugccaggacggucucagucaagaucugaaugaggccguuccagaaacggagagauuagacuccaaggcgcugaaaaccagggcccagcuaagcgugaagaaccgccggcagagacccucuaggacucgacucuacgauagcguguccucaacagacggggaggacagucuggaacgcaaaccgagcaauucuuucuauaaccacaugcauauaaccaaacuuuugccuccaaagggccugcggacauccucacccgagagugauagcggaguaccuccccucacuccagucgacuccaaugugccuuuuucuucggaucacaucgcugaauuucaggaggagccccuggacccagaaaugggcccguuaagcucaauguggggagauaccucccuguucaguacgucuaagagcgaccaugauguugaggaauccccuugucaccaccaaaccacaaacaagaaaauucuuagagagaaggacgaugcaaaagaccccaagucauugagggccucuagcagucucgcugugcaagggggcaaaaucaagcguaaguucgucgaucugggugccccacuacgcagaaauuccagcaaagggaagaaauggaaggaaaaagagaaggaggcaucuagauucucagcgggauccaggaucuuucgaggccggcuggaaaacuggacucccaagccuugcaguaccgcccagacaagcacucgcucgccauguaugcccuucucuugguuuaaugacuccagaaaagguagcuacucauucaggaaccucccugcuccgaccaguucucugcagccaucccccgagacgcuuauuagcgacaagaaaggcucaaagguggaaaauacauggauaaccaaagccaacaagcggaauccuaacccaaguagcuccucuaucuuugggcgacauagccaguugauguccguuguguggauucaggagacuaauaacuucacauuuaacgaugacuucucacccucuaguaccucgagcgcagaucuguccggauuaggcgcugaaccuaagacuccggggcucucucagucacuggcccuuagcuccgacgagauccuggaugacggacagagucccaaacacucucaaugccagaauagagcaguacaggaguggagcguccagcaagugucacauugguugaugucccucaaccuggaacaguacgugagugaguuuagcgcccagaauauuaccggcgaacaacuacugcagcucgaugguaacaagcugaaagcucuugggaugacagcgucucaggaccgcgccgucguuaagaaaaaguugaaggagaugaaaaugucccuggaaaaggcaaggaaagcucaggagaagauggagaaacaacgugaaaaguuacggagaaaggagcaggaacagaugcagaggaaaucaaagaaaacggagaagaugaccagcacuacagccgagggagccggcgaacaauga

SEQ ID NO: 61073 - RNA, 930 nt, Artificial Sequence
  derived and/or modified sequence opt3 from PPP2CA__Homo_sapiens__NP_002706
auggacgagaagguguucaccaaagaacuggaucaguggaucgagcaacucaacgaaugcaagcagcuuagcgagucccaggucaaaucucugugugaaaaggccaaagagauuuugacaaaggagucaaauguucaggaagugagaugccccguaacuguguguggcgacguccacgggcaauuucaugauuuaauggagcuguucaggauaggagguaagaguccugacacgaacuaccuauuuaugggcgauuauguggaccggggguacuauagcguugaaaccgugacacuccuggucgcucuuaaagugcgcuaccgagagcguaucacuauucugagaggaaaucacgaguccaggcagaucacccagguauauggcuucuacgaugaaugcuugcggaaguaugguaacgcaaauguuuggaaauacuuuacagaccucuucgauuaccugccacugaccgcccucguggacgggcagaucuuuuguuuacauggaggccugucuccgucgauugauacucuugaccacauacgcgcguuggauagacugcaagaggucccccaugaaggcccuaugugcgaccuacucuggucagacccagaugacaggggagggugggguaucagcccccggggcgcuggguauacauucggacaggauauuagugagaccuuuaaccacgccaauggccugacgcuugugucccgcgcacaccagcuggugauggaagguuacaacuggugucaugaccgaaaugucguuacuaucuucucugccccuaacuauugcuacagaugugggaaucaggcugcaauuauggaguuggaugacacccucaaguauagcuuucugcaauucgauccagcccccaggcggggagagccucacgugacacgucgcacuccagacuacuuuuuauga

SEQ ID NO: 61074 - RNA, 930 nt, Artificial Sequence
  derived and/or modified sequence opt3 from PPP2CB__Homo_sapiens__NP_001009552
auggacgauaaggccuucaccaaagagcuggaccaguggguggaacaacucaacgagugcaagcagcuuaaugaaaaccaggucagaacacugugugagaaagcuaaggaaaucuugacuaaagagagcaauguucaggaggugaggugccccguaacgguguguggcgauguccacgggcaauuucaugacuuaauggaacuguuccggauuggagguaaguccccugauaccaacuaccuauuuaugggcgacuauguggaucgcggguacuauucuguugagacagugacucuccuggucgcacuuaaggugcgauacccagaacguauaaccauccugagaggaaaucacgagucaaggcagauuacacagguauauggcuucuacgacgagugcuugcggaaauaugguaacgccaauguuuggaaguacuuuaccgaucucuucgacuaccugccgcugacugcgcucguggaugggcagaucuuuuguuuacauggaggccugagucccagcauugacacacuugaucacauccgcgcuuuggacagacugcaagaagucccucaugagggcccaaugugcgaccuacucugguccgaucccgacgauaggggagggugggguauaucuccucggggcgccggguauaccuucggacaggacaucucggaaacguuuaaccacgcaaauggccugacucuugugucacgcgcccaccagcuggugauggaggguuacaacuggugucaugaucgaaaugucguuaccauuuucagcgcuccaaacuauugcuacagaugugggaaucaggcagccaucauggaauuggacgauacacucaaauauaguuuucugcaauucgaccccgcuccuaggcggggagagccacacgugacucgucgcaccccggauuacuuuuuauga

SEQ ID NO: 61075 - RNA, 1770 nt, Artificial Sequence
  derived and/or modified sequence opt3 from PPP2R1A__Homo_sapiens__NP_055040
auggccgcugcagacggcgaugacagccuguaccccaucgccgugcucauugaugagcuuagaaacgaagacguccagcugaggcuaaauuccauaaagaaauuaucuaccaucgcgcuggcucuagggguugagcggacacgcucagaacuccugccuuuccuuacugauacgauuuaugacgaggaugaagugcuguuggcccucgcagagcaacugggaaccuuuacaacucugguagguggcccagaguacgugcacugccucuuaccgccccuggaaagucuugccaccgucgaggaaacagugguucgagacaaggcuguggagagcuugcgugcaaucucccaugagcacucuccuucggaucuggaagcccauuucgucccauuggugaaaagacucgcugggggagacugguuuaccucaaggacuagcgccuguggccuguucaguguaugcuauccccggguuuccucugcggugaaggcagagcuucgccaguacuuuagaaaccuguguagcgaugacacaccuauggucaggcgggccgcugccuccaaauugggugaguucgcaaaggugcucgaacuggauaaugugaagucagaaauuaucccaauguuuaguaacuuagcuagcgacgagcaggacucuguccgccugcucgccguugaggcgugcgugaauauagcccagcuucugccccaagaagauuuggaggcucuaguaaugccuacccugcgacaggcagccgaagacaaauccuggagagugagguauauggucgcugauaaguucacggagcuccagaaagccguggggccagaaaucacuaagaccgaccugguuccggcauuucagaaccuuaugaaagauugugaggccgaggugcgggcugcggcaucacacaaggucaaggaguucugcgaaaaucugagcgccgacugucgugaaaacgugauuaugagucaaaucuugcccugcauuaaagagcucguaucugaugcuaaucagcauguuaaguccgcccuggcaagcgugaucaugggauuaucgccuauacugggcaaagacaacacaauugaacaccuacucccacuguuucuugcccaguugaaggaugagugucccgagguccgccugaauaucauuucuaaccucgacugcgugaaugaagucaucggcaucagacagcugucccaaucacuucugccugcuauuguggaguuggccgaagaugcaaaauggaggguucggcucgcgauaaucgaguacaugccacuguuagcugggcagcugggaguggaguucuuugacgaaaagcuaaacagucucuguauggccuggcugguagaccacgucuaugcaauucgagaggccgcuacuagcaaucuuaaaaaguugguggaaaaguucgguaaagagugggcccaugcaaccaucauacccaagguucuggcuauguccggcgauccgaacuaccuccaccgcaugacaacccuguucugcauuaacguguuaucugaagucugcgggcaggacaucacgacuaaacauaugcugccuacagugcuuagaauggccggagaucccguagcgaaugugagguuuaacguugccaagagcuugcagaaaaucggcccaauucucgacaauucaacccugcaaagugaggucaagccuauccuagagaagcugacucaggaucaggacguggaugugaaauacuucgcucaagaagcacucacaguccugucccuugccuga

SEQ ID NO: 61076 - RNA, 1671 nt, Artificial Sequence
  derived and/or modified sequence opt3 from PPP2R1B__Homo_sapiens__NP_001171033
auggccggcgcuagcgagcuggggaccggacccggugcagccggcggggacggagaugacucccucuacccuaucgcggugcuuauugaugaacugagaaacgaggacguccaguugagguuaaauucuauaaagaaacugucaacaaucgcucuagcccucggcguugaacggacucgcagugagcugcuuccauuccugacggauaccauuuaugacgaagaugagguguugcucgcacuggccgagcaacuggguaacuuuacagggcucguaggaggcccggacuucgcucacugcuuacugcccccucuugaaaauuuggcaacuguggaggaaaccgucgugcgagauaaggccguugagagccugcgucagaucucccaggagcauacaccaguggcucuagaagccuacuuugucccccucgugaaaagacuggcgucuggcgacugguucaccucgaggacuucagcaugugggcuuuuuagcguaugcuauccucgggccaguaacgcuguuaaggccgagauucgccagcaauucagaucccuguguucugaugacacaccaauggugaggcgggcagcugccagcaaauugggagaauuugcgaagguccucgagcuggauuccgugaagucagaaaucgugcccuuauucaccagucuggccagcgacgagcaggacucuguccgccuccuugcaguugaggcuugcguguccauagcccagcuguugucacaggaugaccuagaaacgcugguaaugccuacucuccgacaagcugccgaggauaaaagcuggagagugagguacauggucgcagaccgguuuagugaacugcagaaggccauggguccaaaaaucacccuuaaugaucugauuccggcuuuccagaacuugcucaaggacugugaggcggaagugcgugcagccgcugcccacaaaguuaaggagcugggcgagaauuuacccaucgaagaucgcgagacaauuaucaugaaccagauacugccuuauauuaagugcccagacgugagacuaaauaucauuucuaaccucgauugugucaaugaagugaucgggaucaggcaacugucccagagccuuuugcccgcaauuguagagcuggccgaagacgcuaaauggcggguucgacucgccauaaucgaguacaugccucugcuugcaggacagcugggcguggaguuuuucgaugaaaaguugaacucgcucugcauggcguggcuggucgaccauguguaugcuauucgcgaggccgcaacuaauaacuuaaugaaacugguccaaaaguuugguaccgaaugggcccagaauacaaucgugccaaaaguucuagugauggcuaacgaccccaacuaccuccacagaaugaccacgcuguucuguauaaaugcccuuucugaggcaugcgggcaggagauuacuacaaagcagauguugccgaucguacugaaaauggcuggagaucaagucgccaacgugagguucaauguugcgaagucccuccagaagaucggcccuauucuggacaccaacgccuuacagggcgaagugaaacccguccugcagaaacuugggcaagaugaggacauggaugugaaguacuuugcucaggaagcaaucucaguauuggcccucgcuuga

SEQ ID NO: 61077 - RNA, 1374 nt, Artificial Sequence
  derived and/or modified sequence opt3 from PPP2R2A__Homo_sapiens__NP_001171062
auguuccccaaguuuagccugagauccauguuccacggcgccgggggagguaacgacauccaguggugcuuuucucaagugaaaggcgcugucgaugacgauguugcagaggccgacauuauaucaaccguggaauuuaaucauaguggggagcuccuugcgacaggagauaagggcgguaggguagugaucuuucagcaggaacaggagaacaaaauucaaagccacucccgcggggaauacaaugucuauucuacuuuccagucgcaugagccugaguuugacuaccugaagucauuggaaaucgaggagaaaauuaacaagauccggugguuaccacagaagaaugcugcccaguuccugcuaagcacgaacgauaaaaccauaaagcucuggaaaaucagugagcgagacaagcguccggagggauauaaucugaaagaagaggauggcagauacagggaccccacaacugugaccacacuucggguuccuguguuucgcccaauggaucugauggucgaagcaucccccagaaggauuuucgccaacgcucacaccuaucauaucaauucuauuagcaucaacuccgacuacgagacuuauuugucagcagaugaccuccggauaaaucuguggcaccuggaaauuacagaccgcaguuuuaacaucguggauauuaagccugccaauauggaggagcucaccgaaguaaucacggcugccgaguuccacccaaacagcuguaauacuuuuguuuacucuuccucaaagggcaccauccgauuaugcgacaugagagcgagcgcacugugugauaggcauaguaaacuuuucgaagaacccgaagacccuucuaaccgguccuucuuuagcgagauuauaucgucuaucuccgaugugaaguucucacacagugggcguuacaugaugacacgcgacuauuugagcgucaaaauuugggaucugaacauggagaauagaccaguggaaacuuaccaagugcaugaguaucuaagguccaagcucugcucucuguacgaaaacgacuguaucuuugauaaauucgagugcuguuggaauggaagcgacucagucguuaugaccgguaguuauaacaauuucuuccggauguuugaucgaaacacaaagcgcgacauaacccuugaagccuccagagagaauaacaaaccgaggacggugcugaagccccggaagguaugcgcuagcggcaaacgcaagaaagacgagauuucuguggauucauuggacuucaauaagaaaauccuccacacugccuggcacccuaaggaaaacaucauugcagucgcuacaaccaauaaccuguacaucuuucaggauaaggugaauuga

SEQ ID NO: 61078 - RNA, 1350 nt, Artificial Sequence
  derived and/or modified sequence opt3 from PPP2R2B__Homo_sapiens__NP_001258828
augauccccggcauugggacccugacacaggacacucucuggugcuucagccaagugaagggaacgauagagaucgguaccacagaagccgauauuaucuccacugucgaguuuaaccacaccggcgaacuucuggcuacaggggacaaaggaggcagaguugugauuuuccagagggagcaggaaucuaagaaucagguacaucggcgcggugaguacaacguguauucaaccuuucaaagucacgagccugaauuugauuacuugaaauccuuagagaucgaagagaagauaaauaaaauccgauggcugccacagcagaacgcagccuauuuucuacucagcacuaaugacaagacagucaagcuguggaaagugucugagcgugauaagagaccggaaggguacaaccuuaaagacgaggaaggaaggcugcgggaucccgcgaccauuacgacuuugcgcguuccugugcucagaccaauggaccugauggucgaggcuacccccaggcggguguucgccaaugcacauacauaucacaucaacucgauuucaguaaauagcgauuacgaaacuuauaugagugccgacgaucugcgcaucaaccucuggaauuuugagauaaccaaccaguccuucaauauuguugacaucaagccugcuaacauggaggaauuaacagaggugauuaccgcagccgaauuucauccacaccacuguaauacguucgucuacucuagcuccaaaggcacuauccgacugugcgauaugagagcuucagcccuuugugacaggcauacaaaguuuuucgaggaacccgaggacccuaguaaccggagcuuuuucucugagaucauuuccucaauaagcgaugugaaguucagucacucuggccguuacaucaugacccgcgacuauuugacugugaaagucugggaucugaacauggaaaauagaccaauugagacauaccaaguucaugacuaucuaagguccaagcucugcagccuguacgaaaacgauuguaucuuugacaaauucgagugcguguggaaugggucggauucuguaauaaugaccggauccuauaacaauuucuuccggauguuugaccgaaacacgaagcgcgaugugacccuugaagcgucaagagagaauaguaaaccgagggcaauucugaagccccggaaagucuguguggguggcaagcgcagaaaggacgagaucagcguugauuccuuggacuucucuaaaaagauccuccacacagccuggcacccuagcgaaaacauuaucgcuguggccgcaacuaauaaccuguacauuuuucaggacaaagucaauuga

SEQ ID NO: 61079 - RNA, 1323 nt, Artificial Sequence
  derived and/or modified sequence opt3 from PPP2R2C__Homo_sapiens__NP_001193924
augagagaggccgacacccugaggcccccucagcucauggaagugagcgcugauaucauuuccacagucgaguucaaccacacuggcgaacuucuggcaacgggggacaagggaggucggguugugauauuucaacgcgagccagaaucuaaaaaugccccgcauucacagggcgaguacgauguauauaguaccuuccagagccacgagcccgaauuugacuacuugaaguccuuagagaucgaagagaaaauuaacaagaucaaauggcugccucagcaaaaugcggcucauucucuacucucgacaaacgauaagacuauuaagcuguggaaaaucaccgagcgagacaagcguccagaaggguauaaucuuaaagaugaggaaggaaagcugaaagacuugucaacagugaccagccuccagguccccgugcugaagccuauggaucugaugguugaggugaguccaagaaggauauucgccaacggccacacuuaccauaucaauuccauuucugucaacagcgacugcgaaacauauauguccgcagaugaccuccggaucaauuuauggcaccuggccauuaccgaucgcucauuuaacaucguggacauaaagcccgcuaauauggaggaccuuacggagguaauuacugcaagugaguuccacccucaucacuguaacuuguuuguuuacucuucuuccaaagguucacugagacuaugcgauaugagggccgcugcccucugugacaagcauagcaaacuguucgaagaaccagaggauccgaguaaucggagcuuuuucuccgaaaucauuagcucggugucugacgucaaguuuucccacucagggcgcuauaugcuuacccgagauuaccugacagugaaagugugggacuugaacauggaggcgagacccaucgagacuuaccagguccacgauuaucucaggaguaagcugugcagcuuauacgaaaaugacuguaucuucgauaaauuugagugcgcauggaacggauccgacucuguuauuaugaccggcgccuauaacaauuucuuccggauguuugaucguaacacaaagcgcgacgugacccuggaagcuagcagagagucaaguaagccuagggccguacucaaaccacggcgagugugugucggcgggaagcgcagaagggacgauauauccguggacagccuugauuucacgaaaaagauccugcauacugcauggcaccccgcugaaaauauuaucgccauagcggccacaaacaauuuguacauuuuucaggacaaaguuaacucugauaugcauuga

SEQ ID NO: 61080 - RNA, 1245 nt, Artificial Sequence
  derived and/or modified sequence opt3 from PPP2R3A__Homo_sapiens__NP_001177376
auggacaucgaggaacagaaggccgauauuuacgagaugggcaaaauagcuaaggugugcggguguccccuguauuggaaagcaccuauguucagagccgcgggaggugaaaagaccggcuuugucacagcucagagcuucaucgccauguggaggaaacuccuuaacaaucaccaugacgaugcauccaaguuuauuugccuguuggccaagccaaacuguucuucauuagagcaagaagacuucaucccgcugcuacaggauguuguggacacucaccccgggcucacguuucugaaagaugcuccugaguuccauagucgguacauuaccacaguaauccagcgcauauuuuauacugugaaucgaagcugguccggaaagaucaccucuacagagauucguaaaucgaacuuccuucaaacccuggcauugcucgaagaggaagaggacaucaaucagauuacugauuacuuuucauaugagcacuucuacgucaucuauugcaaguuuugggaacuggacacagaucaugaccuguacauaagccaggccgaucucaguagauacaacgaccaggcuuccucuagcaggauuaucgagcggauuuucuccggcgccgugacccgcgguaaaacgauccaaaaggaagggagaaugucauaugcggacuuuguuugguucuuaaucagugaggaagauaagaggaauccaacuagcauugaguacugguuccgguguauggacguggauggagacggcguccugucuauguaugagcuugaauacuuuuaugaggaacagugcgagcgcauggaagcaaugggcauagagcccuugccuuuccacgaucugcuaugucagaugcucgaccuggugaaaccagccguagaugggaagaucacccuucgagaccugaaaagaugcaggauggcucacauuuucuacgauacauucuuuaacuuggagaaguaucucgaccaugaacagcgggaucccuucgccguucaaaaagacguggagaaugacggaccugaaccauccgauugggaccguuuugcagcugaggaauacgagacucuggucgccgaggaaucagcgcaggcccaguuccaagaggguuuugaagauuacgagaccgacgagccggcaagccccagugaauuuggcaacaagucuaauaaaaucuuauccgcuagccugccugagaagugugggaagcuccagucgguggaugaagaguga

SEQ ID NO: 61081 - RNA, 1728 nt, Artificial Sequence
  derived and/or modified sequence opt3 from PPP2R3B__Homo_sapiens__NP_037371
augcccccuggcaaggugcugcagccaguccucaaaaugaagguugacgagcuuuuccuguacugguugagcgaagccuccacccaaagaauguuacaggauugccugaggcggaucaaagcuccggggcgcgaccagcccacaccuggagauggugagcagccaggcgcauggcccacugccccucuagcggcuccacgacccucugggcucgaaccuccaggaacgccgggccccgguccugcccugccacuuggggcagccucaaguccccguaacgcuccucacgugagaggaaccaggcggagcgcaggcacacgcguagugcaaacuagaaaggaggaaccacugcccccggccaccucccagucuauuccuacauuuuauuuccccaggggccggccacaggacucggucaauguggaugcuguuauaucaaaaaucgagagcaccuuugcccgcuucccucaugagcgagcgacuauggacgauaugggguugguggcaaaggccuguggaugcccccucuacuggaaggguccacuguuuuauggcgcugggggagaaagaacaggcagugucuccgugcacaaauucguagccauguggaggaagauucugcagaacugucaugacgaugcagcuaaauuuguucaccucuuaaugucucccgguugcaauuaccuggugcaagaggacuucgucccuuuucuucaggauguggugaacacccauccaggguugagcuuccugaaggaagccuccgaguuucacucacgguauaucacgacugucauucagcguaucuucuacgcgguuaaucgcaguuggagcggaagaauaaccugugccgagcuaaggcggucuuccuuucuccagaacguggcacugcuugaagaggaagcugacaucaaucaacugacagaguucuucucauaugaacacuuuuacguaauuuacugcaaauucugggaguuggauacugaccaugaccuccugaucgaugccgacgauuuagcucgacacaacgaccaugcccugagcaccaagaugauugaucgcaucuuuaguggcgcagugacaagaggcaggaagguccagaaagaggggaagauaucuuaugccgacuucgugugguuucucauuuccgaagaggauaaaaagaccccgacgagcaucgaauacugguuccgguguauggaccuugauggagacggugcucugucgauguuugaguuggaauauuucuacgaggagcagugccgcagacuagauucuauggcgauugaagcacugcccuuucaagacugucucugccagaugcuggaccuuguuaaaccuaggacugagggcaagaucacacugcaggauuugaaacguuguaagcucgccaauguguucuuugacaccuucuuuaacaucgaaaaguaucuggaucacgagcagaaagaacaaauuuccuuacugcgggacggggauucaggaggcccagagcuaagugacugggagaaguacgcugccgaagaguaugauauacucgucgcagaagagacugccggugagcccugggaagacggguucgaggcugaacugagcccuguggagcagaaacuuuccgccuugcgaucuccacuggcacagagacccuucuuugaagcgccgagcccucucggcgcuguagaucuguacgaguacgccugcggagacgaggaucuugaaccacuguga

SEQ ID NO: 61082 - RNA, 867 nt, Artificial Sequence
  derived and/or modified sequence opt3 from PPP2R4__Homo_sapiens__NP_001180326
augggcaaguggaaaagaagccaggccuacgcugacuauaucggguucauucugacccucaacgagggagugaaggguaaaaagcugacauuugaauacagggucuccgaggcaauagaaaaacuuguugccuuguuaaauacucuggaucgguggaucgacgagacgcccccuguggaucaaccaucucgcuucggcaacaaggcguaucgaaccugguacgcuaagcuagacgaagaggccgagaaucucguagcaacaguggucccgacucaccuggccgcugcagugcccgaaguugccguguaucuuaaagagucagucgggaacaguacccguauugauuacggaacaggccaugaagcugccuuugcggcauuccugugcuguuugugcaagaucggugugcucagaguagacgaucagauugccaucguuuuuaaaguguucaauagguaucuggaggucaugcggaagcugcagaaaaccuaccgcauggagccugcugggagccagggaguguggggccucgacgauuuucaauucuuaccauuuauauggggcuccucucagcugaucgaccaccccuaccuugaaccuagacauuucguggaugagaaggccgucaacgaaaaucacaaggacuauauguuuuuggaguguauucuguucaucacugaaaugaaaacagggccauuugcagagcauucgaaccagcuauggaauauuucagcuguucccagcuggaguaaggugaaccagggacucaucaggauguacaaagccgagugccuggaaaaguucccuguaauacaacacuucaaauuugguucccuucugccaauucacccggugaccucuggcuga

SEQ ID NO: 61083 - RNA, 1290 nt, Artificial Sequence
  derived and/or modified sequence opt3 from PPP2R5A__Homo_sapiens__NP_001186685
augaucaugaacgccaccagcaaugagcagcaagaacuguucugccagaagcuccagcaguguugcauucuuuuugacuucauggauuccgugucugaccugaaaucaaaggagauaaaaagagcuacauugaacgaauuagucgaguacguuaguacuaauaggggcgugaucguagaaagcgcauauuccgauauugugaagaugaucucugccaacauuuuucggacgcugcccccuucggacaauccagauuucgacccggaggaggaugaacccacccuagaggcgucauggccucacauccaacucgucuacgaauuuuuccugcgcuuucuugagagcccagacuuccagcccaguauagcuaaacgauauaucgaucagaaguuugugcagcaacuguuggaacucuucgacuccgaagauccucgugagagagacuuucugaagacaguucugcauaggauuuacgggaaauuccucggauuacgggccuuuauccgcaagcagauuaacaauaucuuccugagauucauauaugaaacugagcacuuuaacgguguggcagaacuuuuggagauucugggcucuaucauuaauggguucgcccuaccacucaaagcugagcauaagcaguuucugaugaaaguccuuauccccaugcacaccgcaaagggacuggccuuguuccaugcucagcucgccuacugugugguacaauuucuggaaaaggauacaaccuuaacugagccuguuaucaggggccugcucaaauucuggccaaagacaugcagccagaaagaagugauguuucuuggugagauugaagagauacuggacgucaucgagccgacccaguucaagaaaauugaagaacccuuguuuaagcaaaucuccaaaugugugucaaguagccacuuccagguggcggaacgggcacuauauuuuuggaacaaugaguacauacugucucucauugaagagaacaucgacaagauccugccuauuauguucgccucccuuuacaagaucucaaaagagcacuggaauccaacgauugucgcucugguuuauaacguguugaagacucucauggaaaugaaugggaaacuguuugaugacuuaaccagcaguuacaaggccgagcgccagcgagagaaaaagaaggagcuggagagagaggagcuauggaaaaagcucgaggaacugaaacuuaagaaagcauuggaaaagcagaacucugcuuauaacaugcauuccauacugagcaauacaucggccgaguga

SEQ ID NO: 61084 - RNA, 1494 nt, Artificial Sequence
  derived and/or modified sequence opt3 from PPP2R5B__Homo_sapiens__NP_006235
auggagaccaagcugcccccugccagcacaccaacuuccccgucuucacccggccucaguccugugccacccccugacaaagucgauggguucagcagaaggucccuucggcgcgcucgaccacguagaucucacucgucaagccaguuuagguaccaaaguaaccagcaggaacugacgcccuugccuuuacugaaggacguuccagcauccgagcuacaugaacuccugucucggaaacuugcccagugcggagugauguucgauuuucuggacuguguagcggauuugaaggguaaagaggugaagcgcgcugcccucaaugaacuggucgagugcgugggcagcaccagagggguucugaucgagccgguguaucccgacauuauaaggaugaucuccgucaacauuuuccggacacucccuccaucagaaaaucccgaguuugauccugaagaggacgagccaaacuuagaacccaguuggccgcaccuucaacuuguguacgaguucuuuuugcgcuuccuggaaagcccugauuuucagcccucuguagcaaagcgauauguugaccagaaauucgugcuaaugcuccuggagcuuuuugauuccgaagacccaagagagagggaguaccugaagacuaucuugcaucgggucuauggaaaauuccucggccugcgugccuacauucgcaagcaguguaaucacaucuuuuuaagauucauauaugaguucgaacauuuuaacgguguggcugaacugcucgagauccuugggucaauuaucaauggauucgcacugccuuugaaaaccgaacacaagcaauuucuagugaggguccugauuccccuccacagcguuaagagucugucuguguuccaugcccagcuugcuuacugcguagugcaguuucuggagaaagaugccacauugaccgagcacgucauccggggccuccugaaguacuggccaaaaacuuguacacagaaggaagugauguucuuaggcgagauggaagagauacuggacguuauugaacccucccaauuugugaaaauccaggagccucuauucaagcaggucgcgcgaugcgugagcucgccacauuuucaaguagcagagcgcgcccucuauuucuggaacaaugaauacauucugucucuuaucgaggacaacugucacaccguuuugccggcuguguuugggacgcuguaucaggucuccaaagaacacuggaaucagacuaucgugucacucauuuacaacguccugaagaccuucauggagaugaauggaaagcuguuugaugagcugacagccaguuauaaauuggaaaagcagcaagagcagcagaaagcacaggaaagacaagagcucuggcagggucuggaagaguuaaggcugcggcgccuacagggcacucagggggcuaaggaggcgccccuccaaagacugaccccucagguggccgccagcggaggccaguccuga

SEQ ID NO: 61085 - RNA, 1668 nt, Artificial Sequence
  derived and/or modified sequence opt3 from PPP2R5C__Homo_sapiens__NP_001155197
augcccaacaagaauaaaaaggagaaagaaagcccuaaggccggcaaauccgggaagucuucaaaggagggacaggacaccguggaaagugaggguacaagcccagaggaaccguccucucccaaagucccuccaccccugcucccugagcuucugguuuugaucuucggcggguuacaaggaagagaugugccacccgcugaccaggaaaagcuguuuauucagaaacuaaggcagugcuguguacucuucgauuuugugucggacccucugucagaucuuaaguggaaagaggucaagcgggcagcccugagcgaaaugguggaguacauaacucacaaccgcaauguuaucacggagccaauuuauccggaagugguccauauguucgcggugaacauguuucgaaccuugcccccuaguuccaauccaacaggcgcugaguucgaccccgaagaggaugaaccuacucucgaggccgcauggccacaucugcaacugguauacgaguuuuuccuccguuuucuugaaucucccgacuuccagccgaacaucgccaagaaauauauugaucagaaguuuguucugcagcuuuuggagcuguucgacagcgaagauccuagagagagggacuuucuaaaaaccacacuccaccggaucuacgguaaguuccuggggcuucgcgcuuauauaagaaaacaaaucaauaacauuuucuacagguuuaucuaugaaaccgagcaccauaauggaauugcagagcuguuggaaauccucggcuccauaauuaacggcuucgcccugcccuuaaaggaggaacacaaaaucuuucugcucaaggugcuucugccauugcacaaggucaaaucacuaaguguguaccauccucagcuggcuuacugcgugguccaguuccucgagaaggauagcacucugacagaacccguugugauggcccuucugaaauauuggccaaagacccacucucccaaagagguaauguuuuugaaugagcucgaagagauucuggacgugaucgaaccuuccgaguucgucaagaucauggagccauuauuucggcagcuggcgaagugugugucaagcccgcauuuccaaguugcagaacgcgcccuauacuauuggaacaaugaguacauuaugagucucauaucugacaacgcugccaaaauccugcccauuauguuuccuucccuuuaucgaaauagcaagacgcacuggaacaaaacuauccacggguugauauacaacgcacugaaacucuucauggaaaugaaucagaaacuguuugaugacugcacccagcaauucaaggcugagaaguuaaaagaaaagcugaaaaugaaggagagagaggaagccugggugaaaauugagaacuuggcgaaggccaauccacaguauacagucuacucgcaggcaucuacuauguccauccccguggcuauggaaaccgauggaccucucuuugaggacguacagaugcugaggaagacaguuaaagaugaagcccaucaagcucagaaggacccaaagaaggaucggcccuuagcccgucgcaaaucagagcugccgcaggacccucacaccaagaaagcacuagaggcccauuguagagcugaugaacucgcgagucaggacgguagguga

SEQ ID NO: 61086 - RNA, 1809 nt, Artificial Sequence
  derived and/or modified sequence opt3 from PPP2R5D__Homo_sapiens__NP_006236
augcccuacaagcugaaaaaggagaaagaaccuccaaagguggccaaaugcaccgcuaagccgagcuccucuggcaaggacgggggaggugagaacacagaagaggcacagccccaaccucagccacagccccagccucaagcccagucacagccacccaguagcaauaaaagaccuuccaacucuacuccaccgcccacgcagcucucgaagaucaaauauucaggcgggccucaaauugucaagaaagaaaggcggcagagcaguucccgcuucaaucuuucuaagaaccgagagcugcagaaguugccagcguuaaaagauagccccacccaggagcgugaagaacuguuuauacaaaagcuaagacaguguugcguucucuucgacuuuguguccgauccucugucagaccuuaaauucaaggaaguaaaaagggcuggacugaaugagaugguggaguacaucacacacagucgggaugucgugacugaagccauuuauccagaggcaguuaccauguuuagcgugaacuuguuccgcacacugcccccgucuuccaauccuaccggcgccgaauuugaccccgaggaagaugagccaacucucgaggcugcauggccucaucugcagcucgucuacgaguucuuuuuaagauuccuggagucacccgacuuucaaccaaacaucgccaagaaauauauugaucagaaguucgugcuugcuuugcuggaccuauuugauagcgaagaccccagggagcgggauuuccucaagacaauccugcaccgcauauacgguaaauuccuugggcugcgagccuauaucagaaggcagauuaaucauaucuuuuaccgguucauuuacgaaaccgagcaccauaacggaaucgcggaguugcucgaaauacugggcaguauuaucaauggcuuugcauuaccucugaaggaggaacacaaaauguuccucauucguguacuucugccauugcacaagguuaaaucucuauccguguaucauccgcagcuggccuacugugucgugcaauuucucgagaaggaaagcucgcugacggagcccgugaucgucgggcuucugaaguucuggccuaaaacucacucuccaaaggagguuauguuuuugaacgaacucgaggaaauccuggacgugauugagcccuccgaguucucaaaaguaauggaaccuuuauuucgccagcuggcuaagugcgugaguagcccacauuuccaggucgccgagagagcacuauauuacuggaauaacgaauauauaaugucccucaucucugacaaugcugccagggugcugcccauuauguuuccggcgcuuuaccggaacagcaaaucacacuggaacaagaccauccacggauugauauauaaugcccugaaacucuucauggagaugaaccagaagcuguuugaugacuguacacaacaguacaaggcagaaaaacagaagggucgauuccgcaugaaagagagagaggaaauguggcagaagauugaggaacuugcuaggcugaauccucaauacccaauguuccgggcucccccucccuugccaccuguuuauaguauggagacugaaacccccacagccgaggauauccagcuccugaagcgcaccguggagacggaagccguccagauguuaaaagacaucaagaaagagaaggugcugcuaagaaggaaauccgaacucccacaggauguauacacuauuaaggcacuggaggcccauaaacgugcugaagaguuucuuacagcgagccaagaggcauuguga

SEQ ID NO: 61087 - RNA, 1389 nt, Artificial Sequence
  derived and/or modified sequence opt3 from PPP2R5E__Homo_sapiens__NP_001269109
augagcuccgcccccaccacaccuccaucuguggacaaggucgauggcuucucaagaaaaaguguuaggaaggcucggcagaaacgcagccaauccucuucgcaguuucgaucacaggggaagccgaucgagcugacuccccucccucuucugaaagacgugccaagcagugaacagcccgaguuguucuuaaagaagcugcaacagugcuguguaauuuuugauuucauggacacgcuauccgaucucaaaaugaaggaauacaaacguucuacccugaacgagcuuguggacuauauaacaaucagcagaggaugccugacugaacagaccuacccugaggucgugaggaugguuuccuguaauauuuuucggacauugccacccucagauaguaacgaguucgacccugaagaggaugaaccaacccucgaggcaagcuggccgcaucugcagcugguguaugaguuuuucauccgcuuucucgaaucucaagaguuccagcccuccauugccaagaaauacaucgaccagaaguuugucuuacagcugcuugaauuguucgauucagaggacccuagagaaagggauuaucugaagacugugcuacaccggauauacgguaaauuucucggccugcgcgcguucauccgaaagcaaauuaauaacaucuuccuuagauuuguauaugagacagagcacuucaaugggguugcugaacuguuggagauucucggaagcaucauaaacggcuuugcccugccauuaaaagcagaacauaagcaguuccuggugaaaguccucauuccccuucacaccgugaggagucugucuuuguuucaugcccagcuagcuuacugcaucgugcaauuccuggagaaggacccuucccucacggaaccagucauucggggucugaugaaauuuuggcccaagacuuguagccagaaggagguuauguuccuuggggagcuggaagagaucuuggacgugaucgaaccgucgcaguuuguaaaaauucaggagccucucuucaagcaaauagcaaaaugcgugucuucaccccacuuucaggucgccgaacgugcucuguacuauuggaauaacgaguacaucauguccuuaauugaggaaaauaguaacgugauccugccaauaauguucagcucccuauaucgcauuucuaaggagcacuggaauccugccaucguugcgcucguguacaacguccugaaagcauuuauggaaaugaauagcaccauguucgaugagcuuacagccacuuauaacgagaagaagaaagaaaaggagagagaagaguuguggaaaaagcuggaagaccucgagcugaaaaggggacuucggcgagauggcaucauucccaccuga

SEQ ID NO: 61088 - RNA, 1566 nt, Artificial Sequence
  derived and/or modified sequence opt3 from PPP3CA__Homo_sapiens__NP_000935
augagcgagcccaaggccaucgacccuaaacuguccaccacagauagaguggucaaggcuguuccauucccgcccucucacaggcucacugcaaaagaaguguuugacaacgauggcaagccucggguagacauucuuaaagcccaucugaugaaggaggggcgcuuggaagagucaguggcguuacgaauaaucacggaaggagcuaguauucugcgucaggagaagaaucuacucgauaucgacgccccagucaccgugugcggugauauucacggccaauucuuugaccugaugaaacuuuucgagguugggggaagccccgcaaacacaagauaccuguuuuugggcgauuauguggacagggguuacuucuccaucgaauguguccucuaucugugggcccugaagauacucuacccuaaaacuuuauuucugcuucgggggaaucaugagugccgccacuugaccgaauauuucacauuuaagcaggaguguaaaaucaaguacucugagagaguguaugaugcuugcauggacgcauucgauugucugccacuagccgcucucaugaaccagcaguuucugugcguacauggaggccuuucgcccgaaauuaauacccuggacgacaucaggaaguuggaucgguucaaagagccuccagccuacggcccgaugugugacauucucuggucagauccccuggaagacuuugggaacgagaagacucaagaacacuucacacacaauaccguucgcggaugcagcuacuucuauaguuacccugcggugugugaguuuuuacagcauaacaaucugcucuccauccuucgagcacacgaggcccaggaugcugguuauagaauguacaggaaaucucagacgacuggcuucccaagccugauaaccaucuuuuccgcccccaacuauuuggacgucuacaauaacaaggcagcugugcuaaaauaugaaaauaacgugaugaauauucggcaauucaacugcucaccucauccauacuggcugcccaacuuuauggaugucuucacauggagucucccguuuguuggggagaaggugacugaaaugcugguaaaugugcuuaacauuuguagcgacgaugagcugggaucugaagaggacggcuucgauggugccaccgcggccgcacguaaagaggucauccgcaauaagaucagagcuauugggaagauggccaggguguuuuccguuuugcgggaagagucagaaagcgugcucacacugaaaggauuaaccccuacgggcaugcugcccaguggcguccuaucugggggaaagcagacucuccaguccgcuacaguggaggccauagaagcagacgaggccaucaaagguuucagcccacagcacaagauuaccucguuugaggaagcuaaaggccuggaccgaaucaacgagcgcaugccucccagaagggaugcgaugccaucugacgcaaaucuuaacuccauaaauaaggccuugacuucagaaacaaacgggaccgauaguaauggaagcaacuccucuaauauucaauga

SEQ ID NO: 61089 - RNA, 1578 nt, Artificial Sequence
  derived and/or modified sequence opt3 from PPP3CB__Homo_sapiens__NP_001135825
auggccgcucccgagccugcaagagccgcgccaccgcccccuccacccccuccacccccuccaggcgcugacaggguggucaaggccguuccguuucccccuacccaccggcugacaagcgaagagguguucgaucucgacgggaucccacgcguagaugugcuuaaaaaccaucuggucaaggaaggacgaguggacgaggaaauugcauugcguauaaucaaugagggugccgcuauuuuaagaagggagaaaacuaugaucgaaguugaggcacccauuacggugugcggcgauauccacgggcaguucuuugaccugaugaagcuauucgaagucggaggcuccccugccaacacccgguaccucuuucugggugauuauguggaccgcggguacuucucuauagaguguguacuuuaucuguggguuuugaaaauccucuacccaucaacacuguuucugcucagaggaaaucaugagugcaggcacuuaacugaauauuucaccuuuaagcaagaguguaagauuaaauacagugaacggguguaugaggcuugcauggaagccuucgauagccugccccuugcggcauugcugaaccagcaguuucuauguguccauggcggccucuccccggagauccacacacuggacgauauucgccgacuugacagauucaaggagccucccgccuuugggccaaugugcgaucuguuguggucugacccuucggaagacuucggaaaugagaaaucacaggaacacuucagccauaacaccgugagggguuguaguuacuuuuacaauuaucccgcugugugcgaguuccuccaaaacaauaaccuguuauccaucauacgggcccacgaagcacaggaugcuggcuaccguauguaucgcaagucucagacuacaggguuuccaagccugauuaccaucuucuccgcccccaauuaccucgacgucuauaacaauaaagcggccguucuuaaguacgagaacaaugugaugaacauuagacaguuuaacuguucaccucauccauauuggcugccgaauuucauggauguauuuacguggaguuugcccuucgugggagagaaggucacugaaaugcuagugaacguucugagcaucugcucugacgaugagcucaugaccgaaggcgaggaccaauuugauguggguuccgcagcugccaggaaagaaaucauucggaauaagauacgagcuaucgggaaaauggcccgcgucuucucagugcugagagaggagagcgaaaguguacuuacacugaagggauugacuccuaccggcaugcucccaucuggcguucuggcagggggaaggcagacauuacaguccgccaccguggaggcuauugaagcggagaaagcaauccgggguuuuucgcccccucaccgcauauguagcuucgaggaagccaagggccuggacagaauuaacgagaggaugccaccccguaaagaugcuguccagcaagacggguuuaauucucuaaacacggcccacgcaacugaaaaucauggaacaggcaaccacaccgcccaguga

SEQ ID NO: 61090 - RNA, 1566 nt, Artificial Sequence
  derived and/or modified sequence opt3 from PPP3CC__Homo_sapiens__NP_001230903
augagcggaagaagguuccaccuguccaccacagaccgggugaucaaggccguccccuuuccuccaacucagcgccucacguucaaagagguuuuugaaaacgggaagccgaaaguggauguacuuaagaaucaucuggugaaagagggacgauuggaagaggaagucgcuuuaaagauuauaaacgacggugcagccauccugcgucaagagaagaccaugauugagguggaugcgcccaucacaguuugcggcgacauucacgggcaguucuuugaucuaaugaaacucuucgaagugggaggcucuccuucaaauacuagauaccuguuucuuggugacuaugucgauaggggguacuucaguaucgagugugugcuguauuuguggagccucaagauaaaccauccaaaaacccuguuucugcuccggggaaaucacgaaugccgccauuuaacagacuacuucaccuuuaagcaggaguguagaaucaaauauuccgagcagguauacgaugcuugcauggaaacuuucgacugucugccccuugccgcauugcugaaccaacaguuucuaugcguucacggcggcaugucuccugagauuacaucgcucgaugacaucaggaagcuggaucgguucaccgaaccacccgccuucgggccugugugugaccuucuguggucagacccaagcgaggauuauggaaaugaaaagacguuggagcacuacacucauaacaccguccgcgguugcaguuacuuuuauuccuacccggcugugugugaguuccuccagaauaacaaucuguuaucuauuauccgagcacacgaagcccaggacgcuggcuauagaauguacaggaaaagccaagccacaggguuucccucccugauaacuauuuucucagcgccuaacuaucucgauguguacaauaacaaggcagccguccuuaaauaugagaauaacguuaugaacauccggcaguuuaauugcaguccacaucccuacuggcugccuaacuucauggacguguuuaccuggagcuugccauucguaggagaaaaggugacagagaugcuagucaaugugcugaacauuuguucugaugacgaacucaucuccgaugacgaggcugaggaucacuacauccccucauaucagaaaggcagcaccacgguucguaaggaaauuauacgcaauaaaaucagagccauugguaagauggcaaggguguuuaguauccugcggcaggagucugaauccguccuuacucugaagggguugacaccgaccggaacucucccucugggcguguuaagcggcgggaaacaaacaauagagaccgcuacgguagaagccguugaggcgcgagaggccauucgcggauucucgcugcagcacaagaucagaucuuuugaagaggcaaggggucuagaccggaucaacgaacgcaugcccccaagaaaagauuccauucaugcuggcgggccuaugaagucagugaccagugcccacagccaugcugcccacagguccgaccagggcaaaaaggcacauucuuga

SEQ ID NO: 61091 - RNA, 513 nt, Artificial Sequence
  derived and/or modified sequence opt3 from PPP3R1__Homo_sapiens__NP_000936
augggcaacgaggccagcuacccacuggaaaugugcucccacuucgacgcugaugagaucaagagacucgggaaaagguuuaagaaacuugaccuggauaauucuggaucauugaguguggaagaguucaugagcuuaccugaacugcagcaaaacccccuaguccagcggguuauugacauauuugauaccgacgguaauggcgagguggauuucaaggaguuuaucgaagggguaucccaguucucugugaaaggagacaaggagcagaagcuccgcuuugcauuccgaauuuaugauauggacaaagauggcuacaucucgaacggugaacuguuucaaguccuuaagaugaugguggggaauaaccugaaagacacacaguugcagcagauuguugauaagacuaucauaaaugccgacaaagacggagauggccguaucucauucgaggaguuuugugcgguggucggcgggcucgacauucauaagaagauggugguagauguuuga

SEQ ID NO: 61092 - RNA, 522 nt, Artificial Sequence
  derived and/or modified sequence opt3 from PPP3R2__Homo_sapiens__NP_671709
augagcaccaugggcaacgaggccuccuaccccgcugaaaugugcucucacuucgacaaugaugagaucaagagacuggggaggcgguuuaaaaagcucgaccuugauaaaucaggaagucugagcguggaagaguucauguccuugccugaauuacgccauaacccacugguccgacguguuauugacguguuugauacagacggugauggcgagguagacuucaaggaguuuauacuagggacuucucaguucucggugaaaggagaugaggaacaaaagcucagauuugcauucucaaucuaugacauggauaaggacggcuacauuagcaauggugaacuguuucagguccuuaaaaugaugguggggaacaaucugacggauuggcaguugcagcaacucguugacaagaccaucauuauccuggacaaagauggagacggcaagauaaguuucgaggaguuuuccgccguggucagggaucuggaaauccacaaaaagcucguguuaauuguauga

SEQ ID NO: 61093 - RNA, 924 nt, Artificial Sequence
  derived and/or modified sequence opt3 from PPP4C__Homo_sapiens__NP_002711
auggccgagaucagcgaccuggauagacagauugaacaacucaggcggugcgagcuuauaaaggaauccgaggugaaagcucugugugcaaaggcccgcgaaaucuuggucgaggagucuaacguucagcgaguggacucacccguaaccgugugcggcgauauucacgggcaguucuacgacuuaaaagaacuguuucgugucggaggugaugugccugagacaaauuaucuauucaugggcgacuuuguugauagaggguucuacaguguggaaacuuuucuccugcuucuggcguugaaggucagguauccagaccggaucacgcucauucgcggaaaccacgagagcagacagaucacccaaguguacggcuucuaugaugagugucugaggaaauacgguuccguaacaguuuggcgguauugcacugaaauauuugacuaccugucucucucggcuaucauugaugggaagaucuucugugugcacggaggcuuaucaccgagcauucagacccuggaccagauccgcacaauagaucgaaagcaggaggucccccaugacggcccuaugugcgaccuuuuguggagugauccagaagacaccacuggguggggagugucccccagaggugccggcuaccuguuugggucugauguggucgcacaauucaaugccgcuaacgacauugauaugaucuguagggcacaccagcuaguuauggagggauauaaauggcauuuuaaugaaacagugcucaccguauggagcgccccuaacuacugcuaucgguguggcaauguggcugccauucuggagcuugacgagcaucugcagaaggauuucaucaucuuugaagcggcaccacaggagacgcgugguauucccuccaaaaagccugucgccgacuacuucuuguga

SEQ ID NO: 61094 - RNA, 2853 nt, Artificial Sequence
  derived and/or modified sequence opt3 from PPP4R1__Homo_sapiens__NP_001035847
auggccgaccugagccuccuucaggaggaucugcaagaagacgcugauggcuucgggguggacgauuacuccucugagucagacgucaucauuauacccagugcauuggauuuuguuagccaggacgaaauguuaaccccucugggaagacuagauaaguaugccgcguccgagaacaucuucaauaggcagaugguggcucggucucuccuggacacacuucgcgaaguaugcgaugacgagcgagauuguauugccgugcuggagcguaucucgagauuggcagacgacucagaaccaacugucagggccgagcucauggaacaggugccgcacauugcucuguuuugccaagagaaccggcccagcaucccuuacgcauucaguaaauuucugcucccaauaguugugcgcuauuuagccgaucagaauaaccaggucagaaagacgucccaggcugcccugcuugcguugcuggagcaagaacuaaucgagagguucgacguggaaaccaaaguaugucccguucucauugagcugacagcaccugauucuaaugacgaugugaagacugaagccgucgcuaucaugugcaaaauggccccaaugguggguaaggacauuaccgagcggcuuauccugccccgcuuuugugagaugugcugugauugccgaauguuccaugugagaaaggucugugcagcuaacuuuggcgacauaugcagcguuguggggcagcaggccacagaagagauguugcucccuagguucuuucagcuguguuccgauaauguauggggagugcggaaagcgugcgccgaaugcuucauggcagucucaugugcuaccugccaagagauucgucgcacuaaguuaagugcccuguuuaucaaccucauuagcgacccaucuagaugggugaggcaggcugccuuccagucccuuggcccguucaucucaacauuugcaaaucccagcaguucuggucaauacuucaaagaagaguccaagagcucggaggaaaugucuguugagaacaaaaaucggacccgagaucaggaagccccugaggacgugcagguccgcccagaagacacgcccuccgaucugucagugaguaacagcuccguaaucuuggagaauacuauggaggaccacgcugcggaagcaucugggaagccucuaggagagauuagcguuccacuggauucaagucuccuguguacccuuuccagcgaaucucaucaggaggccgcuucaaacgagaaugacaagaaacccggcaacuauaagaguaugcugagaccggaagugggcacaacuagccaagauuccgccuugcucgaccaggagcuguacaacucuuuucacuucuggaggaccccuuuacccgaaauagaucuggacaucgagcuagaacagaauagcgggggaaaaccaucgccugagggucccgaggaagaguccgaaggcccaguccccucaaguccuaacauuacaauggcaacccggaaggagcucgaagagaugaucgagaaucuggaaccacauauagaugacccggaugugaaagcccaggucgaggugcuuucugcugccuugcgcgcaagcucccuggacgcgcacgaagagacgauuucaaucgaaaagagaagcgaucuccaagacgagcuggacaucaacgagcuucccaauugcaaaauuaaccaggaagauucuguuccucugaucuccgacgcuguggagaauauggauaguacuuugcacuauauucauagcgacucugaucucuccaacaauucaaguuuuagcccagacgaagagaggcguacaaagguacaggaugucgugccccaggcccuguuagaccaauaccugucgaugaccgauccuucccgggcacagacuguugacacagagauagccaagcacugugcuuacucucuaccagggguggcccucacccugggacgacagaacuggcauugccuuagagaaacguaugagaccuuggcaagcgauaugcaguggaaagucaggcgcacacuggcuuucucaauccacgaacucgccgugauucugggcgaccaauuaacugcggccgaucugguacccaucuuuaaugguuuccuuaaggacuuggacgaggugcggaucgggguucucaaacaucugcacgauuuucuaaagcugcuccacauugacaaaagaagggaauaccuguaucagcuucaggaguucuuggucaccgauaacagucgcaauuggcgauuucgggcugagcuggcagaacaauuaauacuccugcuugagcuguacuccccgcgugacguguaugauuacuugagaccuaucgcccucaaccugugugcugacaaggugucuagcgucagguggauuuccuauaagcuaguuucagaaauggugaaaaagcugcaugccgcaacaccacccacuuucggaguggaucucaucaaugagcugguagaaaacuuuggccgcugcccuaaauggagcggccggcaggcguucgucuucgugugucagaccguuauugaggacgauugccuucccauggaccaguuugccgugcacuugaugccacaucuguuaacacucgcuaacgauagagucccuaaugugaggguucugcuugccaagacccugcgacaaacucuacucgagaaagacuacuuccuggcaagugcuucuugucaccaggaagccguggagcagacgaucauggcauugcagauggaccgcgauuccgacguaaaguacuuugccagcauacaccccgcuucgacaaagaucucagaagaugcgaugucuaccgccaguuccacuuauuga

SEQ ID NO: 61095 - RNA, 1434 nt, Artificial Sequence
  derived and/or modified sequence opt3 from PPP5C__Homo_sapiens__NP_001191213
auggccauggcugagggcgaaagaaccgagugcgcagaacccccuagggacgagccaccggccgauggggcgcugaagcgggcugaggaacucaaaacacaggccaacgacuacuucaaggcaaaagauuaugagaaugccaucaaguuuuacagccaagcuauugaacuuaaccccuccaaugcaauauauuacggaaaccgcucucuggccuauuugcgaacugaguguuacgguuaugcuuuaggcgacgccacgcgugcgaucgaacuggauaaaaaguacauuaagggguacuauagaagggcagccucaaauauggcucuaggaaaauuccgggccgcacuccgcgacuacgagaccguggucaagguuaaaccucacgauaaggacgcuaaaaugaaguaucaggagugcaacaagaucgugaaacagaaggccuuugaaagagcgauugccggcgaugagcauaaaaggaguguaguggacagccuggauaucgaauccaugacaauagaggacgaauacucugguccaaaacuugaggaugggaaggucacuaucucguucaugaaggagcugaugcagugguauaaagaccaaaagaaguugcaccggaaaugugcauaccagaccgaaaagauuacagugugcggagacacccauggccaguuuuaugaucuccugaauaucuucgagcugaacggccuccccucagaaacuaauccuuacauuuuuaacggggacuucguugaucgcgguagcuuuaguguggaggucaucuuaacacuguucggauuuaaacuuuuguacccagaccacuuccaucugcuacgaggcaaucacgaaaccgauaacaugaaucagauauauggguuugagggagaggugaaggcuaaauacacggcccaaauguaugaacucuucuccgagguauucgaauggcugccccuugcucaguguauuaacggcaagguucugaucaugcacgguggguuguuuucugaggacggagugacucucgaugacauuagaaagaucgaaaggaaucggcagccuccagauagcggcccgaugugcgaccuguuaugguccgauccccagccucaaaacggccguucaaucaguaaacgcggggucagcugucaguucggaccagacgugaccaaggccuuucuggaggagaacaaucucgacuacauuauaagaucucaugaagugaaagcagaggguuaugaagucgcccacggcgggaggugcguuacaguguucuccgcucccaacuacugugaucagaugggaaauaaggcgucauauauccaucuucaaggcagcgaccugcggccucaguuucaccaguucacugcaguaccacaccccaacgugaaaccgauggccuacgcuaauaccuugcuacagcuggguaugauguga

SEQ ID NO: 61096 - RNA, 1029 nt, Artificial Sequence
  derived and/or modified sequence opt3 from PPP6C__Homo_sapiens__NP_001116827
auggcuccccuggaccucgauaaguacguggagaucgccagacuuugcaaauaucugccugaaaacgacuugaaggucagcccaauuuguggcuuagcaccguccgggugcggagcccccgcggguaggccuuuccugucuccagggcccccuccaguuuuucacuuccuacgguuucucaaagagcgccugugugauuacgugugcgaccuucuguuggaagagucaaauguacagcccgugaguaccccugucacaguguguggggauauacauggacaauucuaugaccucugcgaacuguuucgaacuggcggucagguuccagauacgaacuacaucuucaugggggacuuuguggaucguggauauuacagccuggagaccuucacauaucucuuagcucugaaggccaaauggccggacagaauuacucuuuugaggggcaaucacgagucccggcagaucacccaggucuacggcuuuuacgaugaaugucaaacaaaguaugggaacgcaaaugccuggcgcuacugcaccaagguguucgacaugcugacuguagcugcacuaauugaugagcagauccucuguguucauggaggucugucucccgacauaaaaacacuugaccagaucagaaccauugaaaggaaccaggagaucccucacaagggcgccuuuugcgaucugguguggucggacccagaggaugucgacacgugggcuauuucaccccggggcgccggaugguuguucggcgcgaaagugacuaaugaauuugugcauaucaacaaucucaagcugauaugucgcgcacaccaauuaguccacgaggguuauaaauucauguucgaugaaaagcugguuaccguguggagcgccccuaacuacugcuaucgaugcgggaauauugcuaguaucaugguauuuaaggacgugaacacaagagagccaaaacucuucagggccguccccgauuccgaacgggugauuccgccucguacuaccacacccuacuuucuuuga

SEQ ID NO: 61097 - RNA, 2802 nt, Artificial Sequence
  derived and/or modified sequence opt3 from PPP6R2__Homo_sapiens__NP_001229828
auguucuggaaguuugaccugaacaccacaagccacguggauaaacuccuugacaaggagcaugucacucugcaggaauugauggaugaggacgauaucuuacaagaaugcaaagcccagaaucagaagcugcuagacuuccucuguagacagcaaugcauggaggaacugguuucccuuauuacgcaggaucccccucuggacauggaggagaaagugagguuuaaguacccaaacaccgcuugugaauugcucacaugcgauguaccgcagauaucugaccggcugggcggggaugagucacugcucaguuuacuguaugacuuccuugaucacgaacccccuuugaauccacugcuagccagcuuuuucuccaagacuaucggaaaccucauugcccgcaaaaccgaacaggugaucacauuucugaagaaaaaggacaaauucauuucucuuguccugaagcauaucgguaccucggcguugauggaccuccuguuacgacuggugucauguguugagcccgcuggccuccgucaagaugugcuucacuggcugaaugaggagaaggucauacagagauugguggaacuaauccauccuagccaggacgaggauaggcagaguaacgccucccaaacucugugcgacauuguacggcucgggcgcgaucagggaucucagcugcaagaagcacuugagccagacccccuguugacagcccucgagagcagacaggauuguguugaacagcugcucaaaaauauguuugacggcgauaggaccgaguccugccuggugucagguacgcagguccuacucacucugcuugaaacccggcgcguggggacagagggauugguggacaguuucagccaaggccuggaacgaucuuacgcugucuccucaagcguucuccacggcaucgagccuagacugaaggauuuucaccagcuucuguugaacccaccgaaaaagaaagcaauucucacuaccaucggggugcuggaggaacccuuaggaaaugccaggcugcauggugcucggcuaauggccgcgcuccugcacacaaacaccccuaguauaaaucaggagcuuugucguuugaacacgauggaccugcuccuggacuuauucuuuaaguauacuuggaauaacuuccugcauuuccagguagaacuuugcauugcagccaucuugucucacgcugcccgcgaggaaagaacagaggcauccggcagcgagucgaggguggaaccaccccacgagaaugggaaccggucucucgaaaccccucaaccagcugccucccugcccgauaacacuauggucacacaucuauuucagaaauguugccuggugcagcgaauuuuagaggcgugggaggccaaugaccacacccaggcagcuggaggcaugcgcagagguaacauggggcaucugacgaggaucgccaaugcuguugugcaaaaccuugaacggggaccgguccagacccacaucucagaggugauucgcggcuugccugccgauugcagagggaggugggaaaguuucguagaggaaacacugacugagaccaaucgucggaacacaguugacuuagcauuuagcgauuaccagauacagcaaaugacugccaauuucguggaccaguuuggcuucaacgaugaggaauuugcugaccaggaugacaauaucaacgcgcccuucgaucgaauugcagagaucaauuuuaacauagacgccgaugaagacuccccaucugcugcccucuucgaggcauguugcagcgacaggauucaaccuuuugaugacgaugaagacgaggauaucugggaggacucagauaccagaugugccgcucgcgucauggcccggcccagauucggagcaccacaugcgagugaauccugcagcaagaauggucccgagaggggcgggcaggacggaaaggcuucucuggaagcccaccgcgaugcaccuggcgccggugcuccaccggcccccgggaaaaaggaggcaccuccaguggaaggcgacucagagggagcuauguggacagccgucuuugaugagcccgcgaacaguaccccuacugccccaggcgugguucgagacguggggagcuccguaugggcugcaggaacgucugcccccgaagagaaagguugggcuaaguucacagauuuccagccguuuuguugcucggaaagcggcccucgguguuccucaccagucgacaccgagugcagucacgccgaggggucucguagccagggacccgaaaaagcauucuccccugcgucacccugugccuggaaugugugcguuacuagaaaggcuccacuucuggccagcgacucuuccaguagcggcgguucucauuccgaggauggggaccaaaaggcagcuucagccauggaugcagugaguaggggcccuggacgcgaagcacccccauugccgaccgucgcucggacagaggaagcggugggcagaguagggugugccgacagcaggcuccugucgccugcaugccccgcuccaaaagaggugaccgccgcccccgcuguugcagucccuccagaggccacuguggcgaucacaacggcucuauccaaggccggacccgcaauuccuaccccggccgugucuagcgcucuggcagucgccguuccacucggucccaucauggcggugacugcugccccugcaaugguggccacacugggcaccguaacaaaagaugggaagacugacgcuccacccgaaggagccgcacuuaacggcccugucuga

SEQ ID NO: 61098 - RNA, 2640 nt, Artificial Sequence
  derived and/or modified sequence opt3 from PPP6R3__Homo_sapiens__NP_001157632
auguucuggaaguuugaccugcacagcuccucucauaucgauacccuccuugagagagaagacgugacacugaaagaguugauggaugaagaggacgucuuacaggaaugcaaggcccaaaacaggaaacugauugaguuccuacucaaggcugagugucuggaagaucuuguuucauuuauaaucgaggaacccccucaggacauggaugagaaaauucgguacaaguauccaaauaucaguugcgagcuguugacuagcgacgugucccagaugaacgaucgccucggcgaagacgagucucugcugaugaagcucuacucguucuuacugaaugauucaccgcuuaaccccuugcuggccagcuuuuucaguaaaguacuauccauucucaucucucgaaagccugaacagauaguggacuuucugaaaaagaaacacgauuucgucgaccuuaucauuaagcauaucgggacgagcgcaauuauggaccuguugcuccgucuguuaaccuguaucgagccaccccaaccuagacaggaugugcugaauuggcucaacgaagagaagauaauucagaggcuuguugagaucgugcacccaucccaggaagaggaccggcauucaaaugcgagucaaagccugugcgaaauuguccgcuugucuagagaucagaugcuacagauccagaacuccacagagcccgacccucugcucgcuacucuggaaaaacaagagaucauugagcagcuucugucaaauauauuucacaaggagaaaaacgagagcgccaucgugagugcaauucagaucuugcucacccuguuagaaacaaggcggccaaccuucgagggacacauagaaauuuguccgcccgguaugucucauuccgccugcagcguaaauaagucgguucuggaggcuauccgcggccgacuagggucuuuucacgagcuccugcuugaaccucccaaaaaguccgugaugaaaacuacauggggagucuuggauccaccugugggcaacaccagacugaaugugaucaggcucauuucaagucugcuucaaacgaacacuagcuccaucaauggugaccugauggaguugaacucuauuggggucauacucaacauguucuuuaaguauaccuggaauaacuuccugcauacacagguugaaaucuguauugcauuaauccuggccagcccauucgagaauacugagaacgcuaccaucacagaucaggacucaaccggagauaaucuacuccugaagcaccuuuuucagaaaugccaauugauugaacggauacuggaggccugggaaaugaacgagaagaaacaggcggaaggcggccgucgccacggguacaugggacaucucacgagaaucgcaaauuguauugugcacaguacugacaagggucccaacuccgcccugguacagcaguuaaucaaagaucugccggacgaggugagggagcggugggaaacauucugcaccagcucucuuggcgagacuaauaagcgaaacacagucgacuuggugaccacgugucauauucacucaaguagcgaugacgaaaucgauuuuaaggagaccggguucucccaagacucuucgcuccagcaggcuuuuagcgauuaucagaugcaacagaugacauccaauuucauagaccaguuuggauucaacgaugaaaaauuugccgaccaggaugacaucggcaauguuucauucgaucgcgugagugacauuaacuuuacucugaauaccaacgagucugguaacaucgcacuauucgaggcuugcugcaaggaaaggauucaacaguuugaugacgggggaagcgacgaggaagauaucugggaggaaaaacauauagccuucacaccugagucccagagacggucaagcucuggcuccacugacagugaggaaagcaccgauucugaggaagaggacggcgcgaagcaagaucuguucgagcccuccucagccaauacagaagacaaaauggaggucgaucucagugaaccaccuaacuggagcgcaaauuuugacgugcccauggagaccacucacggggcuccacuggauucgguaggauccgacguuuggucuacggaagaacccaugccuacaaaggagaccgguugggccagcuucucagaauuuaccaguucccuuucuacuaaggauagcuugcgcuccaacucaccaguggagauggaaacaagcaccgagccgauggacccccugacuccuagugcugccgcauuagccguccagccagaagcugcgggcucuguggcaauggaggccuccagcgauggggaggaagacgcugagucgacagacaaagucacggaaaccgugaugaauggaggcaugaaggagacucucucacugacaguugaugccaaaaccgaaacagcaguguucaagagaguacuuaaaucuuacagggaggaggguaagcugaguacuucccaggacgccgcuuguaaggaugccgaagagugccccgaaaccgcagaggcgaaaugugcugccccucguccacccagcucuagcccggagcagcggacggggcaaccuuccgcaccaggcgacaccucagucaacggacccguguga

SEQ ID NO: 61099 - RNA, 4203 nt, Artificial Sequence
  derived and/or modified sequence opt3 from PPRC1__Homo_sapiens__NP_001275656
auggccgcuagaaggggccggcgcgacgggguggcacccccuccaagcggagguccgggccccgauccugggggaggcgcccgagguuccggguggggaucucguucacaggcgccauacggcacccugggcgcugucagugggggagagcaaguucuccuucacgaagaggccggugacagcggcuucgugucccugucuagauuggggcccucguuaagggauaaggaccuggaaauggaggaacuaaugcuccaggaugagacacugcuuggaacuaugcagucauauauggacgcaagccugaucaguuugauugaggauuuuggcucccucggugaaucucggcugagccuggaggaccagaacgaaguaucccucuuaacggcccugaccgagauacuugauaaugcugacucagagaacuugaguccuuucgauagcaucccagacucugaacugcuagugagcccccgcgaggggucaagccuccauaaacugcuuacacugaguagaacuccuccagaaagggauuugauuaccccggucgacccccucggaccuucuacaggcuccagccggggcucggggguggagaugucucugccagaccccuccugggauuuuucaccuccaaguuucuuagaaaccagcucccccaagcugccgucuuggcgcccuccccgaagcagaccaagguggggacaaucaccucccccacagcagcggagugacggugaggaggaagaggaaguugcauccuuuagcggccagauccucgccggggagcuugauaauugcgugucuucaauucccgacuucccuaugcaccuggcuuguccagaagaggaggauaaagccacugcggcagaaauggccgucccggcugccggagacgagaguaucagcuccuugucugagcuagugcgugcaaugcaucccuacugccugccuaaccucacacaccuggcuucgcuugaggaugaacugcaagagcagccagacgauuugacccuccccgagggcuguguaguucuggaaauagugggucaggccgcgacggccggggacgauuuagagaucccugucguggugcgccaggucagcccaggccccagaccgguucugcuagacgacucccucgaaacuucaagugcacugcaacuuuugaugccuacccuggagucugagacagaagcugccgugccaaagguaacucucugcagcgagaaagaaggacugucccuuaauucagaggaaaagcuggauagcgcuuguuugcucaagcccagggagguggucgagccugugguucccaaagaaccacagaacccucccgccaaugcagccccaggcucucagcgggcucgaaaggggcgcaaaaagaaauccaaggagcaaccggcggcaugcguggaaggauaugccagaaggcugcggaguagcucucgcggucaguccaccgucggcacagaggugaccucacagguagacaacuuacagaagcaaccucaggaagaacugcagaaagagagugggccccuacagggaaagggcaaaccaagagcuugggccagggcaugggccgcugcccucgaaaauagcucgcccaagaaccuggagcguuccgcaggucaaucuagcccugcgaaagaagggccacuugauuuguaccccaagcuggcugacacgauucagacuaauccuaucccgacacaucucucacugguugauagugcccaggcauccccaaugcccguggacucugucgaggccgauccuaccgcugugggcccagucuuagccggacccgugccuguugacccgggccugguggaucuugcaagcacuuccucagaauugguagagccccucccagcugagccuguccugauuaaccccgugcuagccgacagcgcggccguugauccagcuguggucccuaucagugacaaucugcccccaguggaugcaguaccgucugggccugcccccguggaccucgcucugguugacccaguccccaacgaucuuacaccuguggacccaguguuggucaaaucccggcccaccgauccucgaagaggagccguuagcucggcacuggguggcucagcgccgcaguuacucguggaaucugagagucuggacccacccaagacgauaauuccugaagugaaggagguagucgauucccuuaaaaucgagagcgggaccucugccacaacucacgaagcuaggccccgcccacugagcuuguccgaguaucggagaaggcgccaacagcgacaggccgaaaccgaggaacggucaccucagcccccaacaggaaaguggccuagucucccggagacucccaccggccuggcagacauuccaugucuagugaucccucccgcuccagccaaaaagacagcacugcaacguagcccugagacuccccucgaaaucugccugguuccgguggguccaucuccugccucccccucaccagagcccccugucaguaaaccgguggcuagcucccccaccgaacagguuccaucucaggagaugccucuuuuggcgagacccucgccuccagugcaaagcguaucacccgccgucccuacgccacccuccaugagugcagcucugccguuuccugccgggggcuuaggaaugccacccucucucccuccacccccgcugcagccucccagccuuccacuguccaugggcccugugcuacccgauccauucacacacuacgcuccccucccuucauggccauguuauccgcaugugucucccagcggguacccuugccugccacccccuccaaccguccccuugguuaguggaacuccuggcgccuacgcagugccgccaaccuguuccguacccugggccccucccccagcgccugugagccccuauucuucaacaugcaccuacgguccacugggguggggaccgggcccucagcacgcucccuuuugguccacugucccacccccuccauuacccccugccaguauugguagggcagugccgcagccaaagauggaaagccgcggcacacccgccgggccuccagagaauguucucccccugucgauggcuccuccccuuucucugggauugccaggccauggggcaccgcaaacggagccuaccaagguggaagucaaacccgugccagccuccccucaccccaagcacaaaguuagcgcgcucgugcagucaccacagaugaaggcucuggccugcgucagugcagagggaguaacuguggaagaaccugccucugaacggcuaaaacccgagacacaggagaccagaccgagggaaaagccaccucugcccgcuacaaaggccguuccaacuccccgacaauccaccgugccuaaacuuccggcaguccauccagcucgccuccggaagcugagcuucuugcccacgccuagaacccagggcucagaggacgugguacaggccuuuauaagugaaaucgguauugaggcgagcgaucuguccucuuuacucgagcaguucgagaaaagcgaggccaagaaagaaugucccccuccagcacccgcugacucccuggccguggggaacucaggaucuaguugcucgagcuccggcaggucucgucgcuguucaagcuccaguucuagcucauccaguuccucuuccucaagcucgucuaguuccagcucacgguccagaucuaggagcccaaguccucgacggcgcuccgauagaaggcggcgauauagcucuuacagaucacacgaccauuaucaacgccagaggguccuucagaaggagcgugcuaucgaggaacggagaguuguguuuauagguaagauuccgggcaggaugacacgcagugagcugaaacaacgauucuccguguucggggaaaucgaggaaugcacuauccacuuuagaguccagggagauaacuacggcuucgugaccuaucgguacgcagaggaagccuuugccgcuauugagagcgggcauaaguugaggcaggcggacgagcagcccuucgaccucuguuuuggaggccgccgucaauucugcaaaagaucuuacucggaucuggacucaaaucgggaagauuuugacccagcaccuguuaagagcaaauucgauucccuagacuuugauacacugcuuaagcaggcccagaaaaaccucaggcgcuga

SEQ ID NO: 61100 - RNA, 909 nt, Artificial Sequence
  derived and/or modified sequence opt3 from PPT2__Homo_sapiens__NP_001191032
augcugggccucugcgggcagagacuucccgccgcuugggugcuguuguuacugccuuuccuaccacuccugcuucuggcagccccggcgccccacagggcuagcuacaagccugucaucguugugcauggauuguuugacuccucuuauucauuccggcaccuccuggaguacauuaacgaaacccauccagguacaguagugacuguccuggaucucuuugacggccgcgagaguuuacgaccccugugggaacaagugcagggguuccgugaggccguugugccuauaauggcaaaagccccacagggaguccaccuuaucuguuauagccagggcgguuuggugugcagagcucugcuauccguaauggaugaccauaauguugauucuuuuauuucgcucucaagcccccaaauggggcaguacggagacacggauuaucugaaguggcuuuucccuaccaguaugagguccaaccuguaccggaucuguuauucuccauggggccaggaauuuagcauuugcaauuacuggcacgacccgcaccaugaugacuuguaccucaacgcauccucauuccuggccuuaaucaauggcgagcgcgaucaccccaacgcuacaguguggaggaaaaauuuucugagagucgggcaucucgugcuuauaggagguccugacgauggcgugaucacuccauggcagaguagcuucuuuggguucuaugacgccaacgagaccguccuggaaauggaggaacaauugguuuaccuacgggacucuuuuggacugaagacacuccuggcgcgcggcgcaauugugcgaugucccauggccgguaucucccacaccgcuuggcacucaaauagaacucuuuaugagacaugcauugagccuuggcugagcuga

SEQ ID NO: 61101 - RNA, 288 nt, Artificial Sequence
  derived and/or modified sequence opt3 from PPY__Homo_sapiens__NP_002713
auggccgcugcaagacugugccucagccuucuguuguuauccaccuguguggcccugcuacuccagccccugcuuggcgcgcaaggggcuccucuggagccagucuacccgggagacaacgccacacccgaacagauggcacaguaugccgcugauuugaggcgguacaucaauaugcucacucgcccucgauaugguaagcgucacaaagaggacacgcuggcauucucugaauggggcucaccacaugccgcuguucccagagagcugaguccucucgauuuauga

SEQ ID NO: 61102 - RNA, 498 nt, Artificial Sequence
  derived and/or modified sequence opt3 from PQBP1__Homo_sapiens__NP_001161464
augccccugccuguggcccuccagaccagacuugcuaagaggggcauccugaaacacuuggagccagaaccggaggaagagauuauagcagaagacuacgaugacgaucccgucgacuaugaggccacacgguuagaggggcugccuccaagcugguacaagguuuucgaucccuccugcggacuaccuuauuacuggaacgcggaccgcgaagaggguaaagaacgacgucaucacagaagggaggagcucgcuccauaucccaagucuaaaaaggccgugucacggaaggaugaggaacuggacccuauggauccaaguagcuacuccgacgcaccgcgcggcacuuggucuacggggcuucccaaaagaaaugaagccaagaccggagcugauacaacugcagccggcccucuguuucaacagaggccauaucccucgccuggugcuguauugcgggccaacgcggaggcaucacgcaccaaacagcaggacuga

SEQ ID NO: 61103 - RNA, 567 nt, Artificial Sequence
  derived and/or modified sequence opt3 from PQLC3__Homo_sapiens__NP_001269639
auggaggccgcucugcucggccuuugcaacuggagcacccugggggugugugcagccuugaaguuaccccagaucuccgcgguccuggcugccagaucugcaaggggacuaucacucccuagucugcuucuggaauuggccgguuuccucguuuuucugcgguaccaaugcuauuacggcuauccaccgcugacauaccucgaguaucccauuuuaauagcucaggacgugauccugcuuuuguguauuuuccacuuuaaugggaacguaaaacaggcaacuccuuacaucgccgugcuggucagcuccugguucauucuagcucuccagaaguggaucauagaucuggccaugaaucuuugcacguuuaucucugcggcaucgaaauucgcccaacugcaguguuuguggaagacccgcgacucaggaacagugagcgcucucacuuggagucuguccucuuauaccugcgccauuuuacugcgauuuguuaucaugcucgcacuuaacauuugggugacagucaccgugcugcguuacagaaaaacugcuaucaaggccgaauga

SEQ ID NO: 61104 - RNA, 174 nt, Artificial Sequence
  derived and/or modified sequence opt3 from PRAC1__Homo_sapiens__NP_115767
augcugugcgcccacuucagcgaccagggccccgcucaucucaccacauccaagucugcauuucuuucaaacaaaaagacgaguacucugaaacacuuguuaggggagaccagaagcgauggauccgccuguaauucugguaucucgggcgggaggggacggaagauuccuuga

SEQ ID NO: 61105 - RNA, 273 nt, Artificial Sequence
  derived and/or modified sequence opt3 from PRAC2__Homo_sapiens__XP_011523050
auggacagaaggcggauggcccugcgccccggcagccgacguccuaccgcuuucuuuuuccacuccagauggcucgugccaaaccuucuggcauuuuucuugggguuaucuggagccgguccgauccaucugcccaugccuuggccaaauggcaggcggcaccgcguccuagauccccauacacagcucucaacucacgaggcgccugggagauggaagccaguugcucccaggacgaugaaagccugcccucaagugcugcuugaaugguga

SEQ ID NO: 61106 - RNA, 567 nt, Artificial Sequence
  derived and/or modified sequence opt3 from PRADC1__Homo_sapiens__NP_115695
auggugcccggcgccgcuggguggugcugucugguccucuggcuuccugcaugcguugccgcgcacggauucagaauccaugacuaccuguauuuucagguguugagcccaggugauauuagguacauauucaccgcuacaccggccaaggacuuuggcgggaucuuccacacucgguaugagcaaauucauuuaguacccgcagaaccuccagaggccuguggagaacuguccaacggcuuuuucauccaggaucagauugcucuaguggagcgcggugggugcucuuuucucucaaaaacgcgagucgugcaggaacacggaggccgugcaguuaucauaagugacaaugccguggauaacgacagcuucuacgucgagaugauccaagauuccacccagagaacagcugacauucccgcccuguuucuucugggcagggauggguauaugauccggcgcucuuuggagcagcauggacucccuugggcgauuaucucgauaccagugaauguaacuucaauucccaccuucgaacugcugcagccuccauggacauuuugguga

SEQ ID NO: 61107 - RNA, 537 nt, Artificial Sequence
  derived and/or modified sequence opt3 from PRAF2__Homo_sapiens__NP_009144
augagcgaggugagacugcccccucucagggcccuugacgauuucguccugggcuccgcucgguuggcagccccagacccgugcgauccccagcgcuggugucaccgaguuaucaacaauuuacuguacuaucaaaccaacuaccuacucugcuuugggauuggacuggcgcuugcugguuaugugcguccucugcauacauugcucucugcccugguaguggcagucgcccugggcgugcucguuugggcugcagaaacuagagccgcugugaggcggugucgcagaucacacccagccgcgugcuuagcagccguccuggcuguggggcuuuugguacuguggguugccggaggcgcauguacguuccuauuuaguauagcuggucccgugcuccugauccuuguccaugccagccugagguugcggaaucucaagaacaaaauugagaauaagaucgaauccauugggcugaaacgcaccccuaugggauuacugcucgaggcgcuuggccaggaacaggaggccggcucuuga

SEQ ID NO: 61108 - RNA, 2013 nt, Artificial Sequence
  derived and/or modified sequence opt3 from PRAM1__Homo_sapiens__NP_115528
auggcccaccaucugcccgcugcaauggagagccaccaggacuucagauccaucaaggccaaauuucaagcgucucagccugaaccaucagaucucccgaagaaacccccuaagccagaguucggcaaacuuaagaaguuuagucagcccgaacugagcgagcauccuaaaaaggcuccauugcccgaguucggggccguguccuuaaaaccuccaccgcccgaagucaccgaccugccuaagaaaccacccccuccagagguuacagaucuacccaagaagccgccucccccagaagugacugaccucccuaaaaagcccccacccccugagguaacggaucugcccaaaaagccgucuaaacuugaacugucggacuugucaaagaaauuuccccagcucggagcaaccccuuucccaaggaagccccugcaaccugaggugggugaggccccacugaaggcuagccuccccgaaccgggcgccccugcacggaaaccauuacagcccgaugagcugagucacccugcucgcccaccauccgaaccuaagucuggggccuuuccccgaaaacuuuggcagccagaggcgggagaagcaacaccgcguagcccucagcccgaguuguccacuuucccaaagaaacccgcccaaccugaguuuaacgucuacccaaagaagcccccucagccacaggugggcggucugccgaaaaagucaguuccccagccugaguucagugaagcugcccaaaccccacuauggaaaccccagagcucugaaccuaagagagacuccucagcauuuccgaaaaaggcuagccagcccccacucagugauuucccuaagaaacccccacaaccugagcugggggaccuuacaaggaccucuuccgaacccgaggugagcguccugccaaagcggccgcgcccugccgaguuuaaagcguugucgaagaaacccccacagcccgaacucggaggccugccuagaacuucuuccgagccagaguucaauucauuacccaggaagcugcuccagccugaacggcgcggcccgccacgaaaguucagucagcccgaaccuagcgccgugcuuaaaagacauccccaaccagaguuuuucggggaucugccuaggaagcccccauugccuuccucugcaagcgagucaagucuaccggcugccguagcuggauuuuccagccggcacccccugucuccagguuucggcgccgcagggacaccucguuggcgcucaggaggccucguucacagugguggggccagacccggacugaggccaagccauccuccccggcgacgcccgcuucccccugcuuccucucugggccacccaccagcgaaacccccuuugccgcccggcccaguggacaugcagucguuuagaaggccuagcgcagccuccauugaucuccggcgcaccagaucagcugccgggcugcauuuccaggacaggcagcccgaagacauaccucaagucccagaugagaucuaugaauuauacgacgauguggagccccgugacgauaguucuccuagcccaaagggacgggacgaggcacccuccgugcagcaggccgcucgaagaccgccucaggauccagcccugaggaaagaaaaggacccccaaccucagcagcuaccacccauggauccgaaacuccugaagcagcuucgcaaggcagagaaagcggaacgggaguuuagaaagaaauucaaguuugaaggugagauugucguucacacgaaaaugaugaucgacccuaacgcuaagacuaggcgcggcgggggaaagcacuugggcauucgacggggugagauccuggaagugauagaguucaccucaaaugaagagaugcucugccgugaucccaaagggaaguauggcuacguaccaagaacagcccugcuuccucuggaaacugagguguaugacgacgucgauuuuugugaccccuuggagaaccaaccacucccccugggaagguga

SEQ ID NO: 61109 - RNA, 1530 nt, Artificial Sequence
  derived and/or modified sequence opt3 from PRAME__Homo_sapiens__NP_996837
auggagagaaggcggcuguggggcagcauccagucccgcuacauuucuaugucaguguggaccaguccccgacgucucgucgaacuugccgggcaaagccuguugaaggacgaggcuuuagcaauagccgcgcuggaacuacucccuagagagcuguucccaccgcuuuuuauggcugccuucgauggaaggcacucccagacacugaaagcaaugguucaggccuggcccuuuacuugcuugccucucggugugcugaugaagggccagcaucugcaccucgaaacguucaaagcuguauuagacgggcuggaugugcuuuuggcacaagagguccggccacgcagauggaagcuacaggugcuggaccucaggaaaaacucucaucaggauuuuuggaccguuuggucgggaaaucgggccucacuguauagcuuccccgagccugaagcugcccagccaaugacaaagaagcgcaaaguggacggccuuaguacugaggcggaacaacccuuuaucccugucgaggugcugguagauuuguuccucaaggagggugcaugugacgaacuguuuuccuacuuaauugagaaaguuaagcgaaagaaaaacgugcugagacucugcuguaagaaacuuaagaucuucgccaugccaaugcaggauauuaaaaugauccugaagaugguccaguuggacucuauagaagaucuagaggugaccugcacauggaaacugccgacccucgcuaaguuuagccccuaucuggggcagaugaucaaucuuaggcggcuguugcucucccacauucaugccucaaguuacaucagcccugaaaaagaggagcaauauauugcacaguucacuucucaguuucuguccuuacaaugucugcaggcucuauacguggacucacucuucuuccugcguggacgccuugaucaguugcugagacacgucaugaacccacucgaaacacugagcaucaccaauugcaggcuuagugagggcgacguuaugcaccugucucagucccccagcgugucgcaauugucuguacucucccugucaggcgugauguuaacggacgucaguccugaaccacugcaggcccuacucgagcgggcgagcgccacucugcaggaucuuguguuugacgaaugugggauaaccgaugaccaguugcuggcacuccugcccuccuuaucucauugcagccaacugacaacucuuucauucuauggaaacaguauuuccaucagcgcuuugcagucucuccugcagcaccuaauuggucugucaaaucucacccauguucuguacccggugccucuugagaguuacgaggauauccacggcacauugcaccuggaacgauuagccuaucuccaugcucgccugagagagcuucugugugaauuggggaggcccagcauggucuggcucuccgccaacccaugcccucacuguggagaccggaccuuuuacgaucccgagccaauccugugccccugcuucaugccuaauuga

SEQ ID NO: 61110 - RNA, 429 nt, Artificial Sequence
  derived and/or modified sequence opt3 from PRAP1__Homo_sapiens__NP_001138673
augagaaggcugcuccuugugaccagccuggucguuguguuguuaugggaggccggcgcuguacccgcaccuaaagugccaaucaaaaugcaggucaagcacuggccguccgaacaagaccccgagaaagccuggggagcgcgggugguugaaccuccagagaaggaugaccagcuggugguccuauuccccgugcagaaaccuaagcuccugacaacugaagagaagccacgcgggacgaaggcuuggauggagaccgaagauacacuuggucauguacugucucccgagccugaccacgauucauuguaccauccaccgcccgaagaggaccagggcgaggaacgaccucgucucuggguuaugccaaaccaccaagugcugcuggggcccgaggaagaucaggaccauauuuaucacccucaguga

SEQ ID NO: 61111 - RNA, 996 nt, Artificial Sequence
  derived and/or modified sequence opt3 from PRB1__Homo_sapiens__NP_005030
augcugcucauccuucugagcguggccuuguuagcucuguccucugcacagaaccuaaaugaggacgucucacaagaagagagucccagccucauugccggcaacccucaggggccauccccgcagggagguaauaagccccagggcccuccacccccuccagggaaaccccaaggaccuccaccgcagggcgguaacaagccccaggggccuccacccccuggaaaaccacaggggcccccgccucaaggcgauaagucuagaucgcccaggucaccaccugggaaaccccagggaccacccccucaggguggcaaucagccacaagggccgcccccuccacccggaaagccucagggcccacccccgcagggugggaaccggccucaaggaccacccccucccggcaagccacagggcccucccccacagggggacaaaagccgcaguccgcgauccccucccggaaagccacagggucccccuccacaaggcgggaaucagccccagggaccuccgccacccccuggcaaaccacagggucccccuccgcaagggggcaagaaaccccagggaccaccucccccaggcaagccucaggggcccccaccgcagggagauaagucucguagcucccaaucaccucccgguaaaccacaggggcccccuccacagggcggaaaccagccccaaggcccuccgccacccccugguaagccccaggggccaccuccccagggcggaaauaaaccacaaggcccuccgcccccagggaagccucagggacccccagcgcaggguggcaguaaaagccagucugcuagauccccucccgggaagccgcaaggaccaccucagcaggaaggcaacaauccccaggguccacccccuccggccgggggcaacccccaacagccacaggcaccucccgccggacagccucaaggcccacccaggccuccacagggcggacggcccucacgcccgccucaguga

SEQ ID NO: 61112 - RNA, 1251 nt, Artificial Sequence
  derived and/or modified sequence opt3 from PRB2__Homo_sapiens__NP_006239
augcugcucauccuucugagcguggccuuguuagcucuguccucugcacagaaccuaaaugaggacgucucacaagaagagagucccagccucauugccggcaacccucagggggcgccaccgcagggagguaauaagccccagggcccuccaucucccccugggaaaccacaaggacccccuccacagggcgguaaccagccgcaggggcccccuccacccccuggaaagccacaagggcccccgccucagggcgggaauaaaccccagggaccaccucccccagguaagccccagggcccuccaccgcaaggggauaaauccagaucgcccaggucaccuccaggaaagccccagggcccuccaccccagggugggaaccaaccgcagggaccuccacccccucccggcaagccacagggcccucccccacagggcggaaauaaaccgcaagguccucccccacccggcaagccucaggggccacccccucagggagacaacaaaagccggaguucccgcucuccgccaggcaagccccaggguccuccaccccaagggggcaaucagccucagggaccgcccccaccucccggcaaaccacaggggccucccccacaaggagguaacaagccgcagggcccucccccacccgggaagccucagggaccacccccucagggcgauaauaaaagccaauccgcucgaucaccgccagguaagccccaggggccucccccacagggcggaaaccaaccucaggggcccccaccuccgcccggcaaaccacagggaccucccccacaggguggcaauaagccucaagggcccccgccaccuggaaaaccccagggcccacccccucagggugggaguaagagccguucuuccagaucaccgcccggcaaaccacagggaccucccccucaaggcgggaaccagccacagggacccccuccacccccgggcaagccucaggguccacccccucaagggggaaauaagccacagggucccccgccucccggcaaaccacagggcccucccccacaagggggaagcaagaguaggucugcccgguccccucccggcaaaccacaggggccgccccagcaggaaggaaacaacccucaaggcccacccccuccagccggugggaauccccagcagccucaggcaccgccagcuggacaaccccagggcccuccccgcccaccucaggguggcagacccagcaggccaccgcaguga

SEQ ID NO: 61113 - RNA, 930 nt, Artificial Sequence
  derived and/or modified sequence opt3 from PRB3__Homo_sapiens__NP_006240
augcugcucauccuucugagcguggccuuguuagcucuguccucugcacagucacuaaacgaggacgucagucaagaagagagccccuccguuauuucuggcaagccugaagggagaaggccacagggagguaaucagccgcagcggaccccacccccacccggcaaaccugaggggcgcccaccccaaggaggcaaccagucgcaggguccuccaccgcgacccgggaagccugaaggaccacccccucagggcggcaaucaaucacaggggccacccccgcguccuggaaaacccgagggucagccaccucagggcgggaaccaaagccagggacccccacccagaccuggcaagccagaggguccgcccccucagggcggaaaucaaagucagggcccacccccuaggccaggcaaacccgaagggccgccuccacagggagguaaccagucccaagggcccccuccccggccagggaagccugagggacccccaccgcagggcgguaaucagucucaggggccucccccacaccccggcaagccugaaggaccacccccucaaggcgggaaccagagccagggaccgccaccccgcccugguaaaccagaggggcccccuccgcagggcggaaaucaaucccagggucccccaccuagacccggcaagccagaggggccucccucacagggcggaaacaaaccacagggcccgccuccccauccagggaagccccaaggaccuccaccccaggaagguaauaaaccucagaggccgccacccccuggccggccccaagggccaccucccccaggaggcaacccucagcagccgcucccucccccugccgguaagccccaggggccaccucccccgccacaaggcggacgcccucaccgacccccacagggccagcccccucaguga

SEQ ID NO: 61114 - RNA, 537 nt, Artificial Sequence
  derived and/or modified sequence opt3 from PRB4__Homo_sapiens__NP_001248328
augcugcucauccuucugagcguggccuuguuagcucuguccucugcagagucaaguagcgaagacgucucccaggaggaaucucuauuccucauuucgggcaagcccgaggggagaaggccucaaggagguaaccagccacagcggccgcccccuccacccggcaaaccucaggggccacccccucaaggaggcaaucagucacaggguccaccgcccccuccagggaagcccgaaggacgcccuccacagggcggcaaccaaagccaggggcccccgccucaccccggaaaaccagagcgaccucccccacaggguggcaaucagagucaagggaagccccagggaccuccacagcaagagggcaacaaaccgcagggucccccuccacccgggaagccucagggaccacccccggccggcggcaauccucagcaaccacaggcgcccccugcugggaagccccagggaccaccucccccaccgcaggguggccguccucccagaccagcccaagggcagcagcccccucaguga

SEQ ID NO: 61115 - RNA, 1578 nt, Artificial Sequence
  derived and/or modified sequence opt3 from PRC1__Homo_sapiens__NP_001254509
augagaaggagcgaggugcuggccgaagaguccaucgucugccuccagaaggcucuuaaccaccuccgggaaauuugggaguugauaggcauccccgaagaccaacgcuuacagcgaaccgagguugugaaaaagcauauuaaagaggaaggggagacaacuauccugcagcuagaaaaggaucuccguacgcagguagagcugaugagaaaacaaaagaaggagaggaaacaggaacuuaagcuguugcaggagcaggaccaagaacucugugagauucugugcaugccucacuacgauaucgacucugcaucagugccaagucuggaagaacucaaucaguuccggcagcaugucaccacauuacgcgagacuaaagccagcagaagggaagaguuuguguccauaaagcggcagaucauucuguguauggaggagcuugaucacaccccggacacaucuuucgaacgcgauguugugugcgaggacgaggaugcguuuuguuugucgcuggaaaacaucgcuacccuacaaaaacuccugcgacagcuugagaugcagaagucacaaaaugaagccgucugcgagggacugagaacucagauuagggaauugugggaccggcuccagauccccgaggaggaacgugaggcaguggccacaauaaugagcgguaguaaggcuaaaguacgcaaggcacugcaguuagaaguugauagacuggaggagcucaaaaugcaaaacaugaagaaagugauugaagccaucagggucgagcuugugcaguauugggaccaguguuucuacucccaggaacaacggcaggcuuuugccccuuucugcgcggaggauuauaccgaaucucuguugcagcuacaugacgcagagauugugcgacugaagaauuacuaugagguccacaaagaacucuuugagggcguucagaagugggaagagacguggcgccuguuccuugaauuugagagaaaggccagcgacccaaacagguucacuaaucgcgggggaaaccuguugaaagaggaaaagcaacgggcuaaacuccagaagaugcugcccaaauuagaggaggaacugaaggccagaaucgaacuaugggagcaggagcacuccaaggcauuuauggugaauggccagaaauucauggaauacguagcugagcaaugggaaaugcauaggcucgagaaggagcgugccaaacaggaacggcagcugaagaacaaaaagcaaaccgagacagaaaugcuuuaugguucagcgccucgaacuccaaguaagagaaggggguuggcccccaauaccccuggaaaagcacgcaagcugaacacaaccacgaugagcaaugcuacugccaacucuuccauccggccaauuuuuggcggcacaguguaccacucaccggucagcagacugcccccuagugggucuaaaccaguggcugccuccaccuguagcggaaagaaaacucccaggacaggucgccauggcgcaaauaaggagaaccuggaacuuaacgggucgauacugucugcccgaaccuucaagggauuccagaucuga

SEQ ID NO: 61116 - RNA, 1476 nt, Artificial Sequence
  derived and/or modified sequence opt3 from PRCC__Homo_sapiens__NP_005964
augagccugguggccuacgcuuccucugacgagucagaacccgaugaggcagaaccugagccagaagaggaggaagccgucgcgccgaccaguggccccgcucucgggggacuuuucgccagccugccugcaccaaagggucccgccuuguuaccuccacccccucagaugcuggcuccagcauuuccgcccccucuacuccugccacccccuacaggcgacccaagacuucaacccccgccuccccugccauucggguugggaggcuuuccucccccacccgguguuuccccugccgaggcugccggggugggagaaggccucggccuggggcugccaucuccgaggggacccggucucaacuuaccuccacccaucggcggggcgggaccuccacugggccuucccaaaccgaagaaacggaaggagccuguaaaaauugcagccccagaguugcacaagggugauucggacucagaagaggaugaacccacuaagaaaaagacgauacugcaggggagcagugagggaaccggccuauccgcucuccugccucagcccaaaaaucuuacagugaaggaaacuaaccgccuguugcucccacaugccuucucucgaaaaccuagcgacggcucccccgauaccaagccaucacgucuggcaaguaagacaaaaaccagcucuuuagcuccggucguggggacuacaaccacgacuccuucccccucagccaucaaggcggccgcaaaaagcgcugcccugcagguuaccaagcaaauuacacaggaggaggacgauagugacgaagagguggcuccagaaaacuuuuucucucuccccgagaaagccgaaccuccaggagucgagcccuauccuuacccgaucccaacugugcccgaggaacuuccuccagguaccgagcccgaaccugcauuucaggaugacgccgcuaaugcgccgcuggaguucaagauggcagccggcuccagcggggcucccuggaugccaaaaccuggagaugacuauucguacaaucaguuuucuacauauggcgacgccaacgcagccggugcuuacuaucaagauuacuacuccgggggcuauuaccccgcccaggacccagcauugguaccuccccaggaaauugcgccagaugcuucauucaucgacgaugaggccuuuaagagacuacagggaaagaggaaucggggccgcgaggaaauaaacuucguugagaucaaaggggacgaucaacugaguggagcacagcaguggaugaccaagagccucacggaagagaaaacuaugaaguccuuuucuaaaaagaagggugagcaaccgacaggccagcagagaaggaaacaccagauuaccuaucugauccaucaagccaaggaacgggagcuugaacugaaaaauacuuggagcgagaacaaguugucacgccgacagacacaggcuaaauacggguucuga

SEQ ID NO: 61117 - RNA, 165 nt, Artificial Sequence
  derived and/or modified sequence opt3 from PRCD__Homo_sapiens__NP_001071088
augugcaccacacuguuccuccuuagcacucuggccauguuguggagaaggcgguuugcuaaccgcgugcagcccgagccuuccgacgucgauggcgcagcccgagggucuucauuagacgcggauccacaaaguagcggacgugaaaaggagccgcugaaauga

SEQ ID NO: 61118 - RNA, 1491 nt, Artificial Sequence
  derived and/or modified sequence opt3 from PRCP__Homo_sapiens__NP_005031
augggcagaagggcccugcuccuucuguugcucagcuuccuggcucccugggcaaccaucgcccuacggccugcgcuccgcgcucuggggucccuucacuugccaacaaacccgacuucuuugcccgccguggcaaagaauuacucaguccucuauuuucagcaaaaaguugaccauuucggauuuaacacggugaagaccuucaaucagcgauaccugguagccgauaaauauuggaagaaaaacgguggcaguauucuguuuuacacagggaaugagggagacauaaucugguucugcaacaauacuggcuuuaugugggauguggcugaagaguuaaaggcaauguuagucuucgccgaacaccguuauuacggugagagccugccuuuuggggacaacuccuucaaggauucuagacaucuuaauuuucugaccucggaacaggcucuggccgacuucgcggagcuaauuaaacaccucaagaggacaaucccaggagcagagaaccagcccgugauugccaucggcggcucauaugggggaaugcuggcugccugguuucggaugaaauacccucauaugguugugggugcacuugcugccagcgcgccaauauggcaauucgaagaucugguccccuguggcguguucaugaagaucguaaccacugacuuucgcaaaagugggccucacugcuccgagucuauucacagaagcugggaugccaucaauagguuguccaacacaggaucaggccuccaguggcugaccggugcauuacaucuguguaguccacucacgagccaggacauucagcaccuuaaggauuggaucucugaaacuuggguuaaucuggcuaugguggacuacccguaugccuccaacuucuugcaaccccuaccugcuuggccaauaaaggucgugugccaguaccugaaaaaucccaacgugucagauagccuccugcuucagaacauuuuucaggcccugaaugucuauuacaacuauagugggcaaguuaaguguuugaauaucucugagaccgcaacauccagccucggaacucugggcuggucguaccaggccugcaccgaggugguaaugccuuucuguacaaacggcguggacgacauguuugaaccacauucuuggaauuuaaaagagcuguccgaugacugcuuccagcaauggggaguccggccccgcccgucauggauuaccacgauguauggggguaagaacaucaguagccacacuaauaucguguuuuccaacggcgaacuagauccuuggucugggggaggcguuacaaaagacauuaccgauacucucguggcugucacaauaagcgagggugcgcaccaucuggaccuucgaaccaagaaugcauuggaucccaugucagugcugcucgccagaagucuggaaguaaggcacaugaaaaacuggauccgggacuucuacgauuccgcugggaagcagcauuga

SEQ ID NO: 61119 - RNA, 3483 nt, Artificial Sequence
  derived and/or modified sequence opt3 from PRDM10__Homo_sapiens__NP_064613
auggacagcaaggaugaguccucucacguguggcccaccucagccgaacaugagcagaacgcugcacaaguccacuucguuccugacacaggcacuguggcccagaucguauacacggaugaccaggugagaccaccgcagcaagucguguauaccgcggauggggcuaguuacacaagcguugacggacccgaacauacucugguguauauucacccugucgaggccgcacagacccucuuuacagauccaggucagguggccuacguacagcaagacgcuaccgcacagcaggccucccuucccguucauaaucaggugcugccuucuauagaaucggucgauggcucagacccauuggcuacuuuacaaacaccccuggggaggcuagaggccaaagaggaagaggaugaagacgaggaugaggacaccgaagaggacgaagaggaagauggagaggacacggaucucgacgauugggagccugacccaccgcggcccuucgauccucacgaccuguggugcgaagaguguaacaaugcgcacgcaagcgugugcccaaagcauggcccccuucacccuaucccaaaccgccccgugcugacucgagcccgugcuaguuugccgcucguccuguauauugauagauuucugggugggguuuucuccaaaaggcggaucccuaagcgcacccaguuuggacccguggaaggcccacucguaagaggcucugaguuaaaagacuguuacauucaucugaaggugagccuugauaagggggacaggaaagaacgggacuugcacgaggaucugugguucgagcuauccgacgaaacacucugcaauuggaugauguuuguccgcccugcccagaaccaccuggagcaaaaucuuguggcauaucaguacggacaucacguuuacuauacuaccaucaagaacguggaacccaaacaggagcugaaggucugguacgcugccucauaugcggaguucgugaaucagaaaauacaugauaucagugaagaggaacgaaagguauugagagagcaagaaaagaacuggccauguuacgagugcaauaggcgguuuauuagcucugagcagcuccagcagcaccugaacucccaugacgaaaaauuagauguuuucucacguacacgcgguagaggcagggggcggggaaagcgacgcuuuggccccgguagaaggccugggcggccaccgaaauucauccgccuggagauuaccagcgaaaauggagagaagagugacgauggcacgcaagaccuccuucacuuucccacuaaagaacaguucgaugaggccgagccugcaacacugaacggcuuggaccagccagaacagaccacuauccccauaccucaacuaccacaggagacacagucuucccuggaacacgagcccgaaacccauacgcuccaccuccagccgcaacaugaggagagcguggucccuacccagucgacacuuacugcugaugacaugagaagggccaagcguauucggcuggaauugcagaaugcugcccuccaacaccuguucauccgaaaaucuuuuagaccauucaaguguuuacagugcgggaaggcauuuagggagaaagauaagcuggaccagcaccuacgcuuccauggacgggaagguaacuguccccugaccugcgaccuguguaacaaaggcuuuauuuccucaacaagucuugagagccacaugaaguugcauuccgaucagaaaacuuauucuugcaucuucugcccugaaucauuugacagacuggaucuccugaaggaccacguggccauccauauuaaugauggguacuucaccugucccacaugcaagaaaagguuuccagacuucauacaagucaagaaacacgugcgcucauuucacagugagaagaucuaucaguguaccgagugcgauaaggcuuucugucgaccugacaaacuucggcugcauauguugcgucacuccgauagaaaggacuuucucugcagcacuuguggaaaacaguucaagaggaaagauaagcugcgcgaacauaugcagcggaugcacaaccccgagagagaagcgaaaaaggcagacaggauuucucgaucaaagacguucaaaccacgcaucacaaguaccgauuacgacagcuuuacuuucaagugccgguuauguaugaugggcuuuagaaggcgugguaugcugguuaaucaucuauccaaacgccacccggacaugaagauagaggaggugccugaacucacccugcccauuaucaaaccaaaccgggauuacuucugccaauauugugacaagguauacaaaucugccucgaagagaaaggcucacauccuuaaaaaucaucccggggccgaguugccuccaagcauuaggaagcugcgacccgcaggcccuggagaaccggauccaaugcucuccacacacacccagcugacuggcacaaucgccacgcccccugucugcugcccacauuguucaaaacaguauaguucuaagaccaaaauggugcagcacauucggaagaagcaccccgaguuugcucaauuaagcaacacuauacauacaccucugaccacagccguuaucuccgcaacuccggcggugcuuaccacggacucagcuaccggggaaacagucgugacuaccgauuugcucacacaggccaugacugagcugagccagacccuaacgacagacuaccgcacuccccaaggagauuaucagaggauucaguacaucccaguaucucaguccgcaaguggucugcaacagccucagcacauccagcuccaagugguucaggucgccagcgcuaccucuccccaucagucccagcaaucaacaguggacgugggccagcugcacgauccacagccuuauccccagcaugccauucaaguccagcacauacagguuagugagccaaccgcaagcgcuccgucguccgcccaagugucugggcagccucuuagccccucagcgcagcaggcccaacagggauugaguccaucccacauccagggcucuagcuccacucagggucaagcucugcagcagcagcaacagcagcaacagaauagcagcgugcagcauaccuacuuacccagugcauggaacucuuucagaggguacuccagcgaaauucagaugaugacacucccuccaggccaauuuguaaucacggacucgggagucgccacccccgugacuacaggccagguuaaagcugugaccucagggcacuauguccugucugagagucaguccgaacuugaggaaaagcagacaagcgcccugucuggaggugugcaaguugagccuccggcacauagcgauuccuuggacccacagacuaauucacagcagcaaaccacgcaguacauuaucacaaccacuaccaacggcaaugggaguagcgaggugcacauaacaaaacccuga

SEQ ID NO: 61120 - RNA, 1434 nt, Artificial Sequence
  derived and/or modified sequence opt3 from PRDM11__Homo_sapiens__NP_001243625
augaccgagaacaugaaggaaugccuggcccagacaaaugcugcagugggcgacauggucacuguugugaagacggagguauguagcccccucagagaucaagaauacgggcagccuugcuccaggcggccagacucuucagccauggagguggaaccgaagaaacuuaagggaaaacgcgaucugaucguccccaagaguuuccaacagguggacuuuugguucugugagagcugccaggaguauuuuguugaugaauguccuaaccacgguccacccguguucgucuccgacaccccugugccaguaggcauucccgaucgagcggcuuugacaauaccucaggggauggagguugugaaggacacuucuggagaaucggauguccguugcgugaaugaggugaucccaaaaggccauauuuuugguccguacgaggggcagaucucaacccaggacaagagcgccggauucuuuaguugguuaauugucgauaaaaacaauagauauaaguccaucgacggcucugaugaaacaaaagcaaacuggaugagguacguugugauaagccgggaggaacgcgagcaaaaucugcuagccuuccagcacuccgaaagaaucuauuuuagggcuugucgggacauucgccccggcgaguggcuccgaguaugguacucagaggacuauaugaagagacugcauaguaugagccaggaaaccauccacaggaaccuugcacguggggagaagcggcugcagcgcgaaaaaucugagcaaguguuggauaauccugaagaccucagaggaccaauucaucuguccguccugaggcaggguaagucacccuacaaacggggcuucgaugagggggacgugcacccucaggccaagaaaaagaaaaucgaucucauauuuaaggacguuuuagaggcuagccuggaaagugccaagguggaggcgcaccaacuugcauugucuacuucccuggucauucgaaaagugccaaaguaccaggaugacgccuauagccagugcgcuacaaccaugacgcauggaguacagaacaucggccaaacucagggugaaggggauuggaaaguuccccagggagugucgaaggagccgggccagcuagaagacgaggaggaggaaccuucuuccuucaaagccgauucacccgcagaagcuagucucgccagcgacccacacgagcugccuaccacauccuuuugucccaauugcauucgccuuaagaagaaagucagagagcugcaagcggaauuggacaugcucaagucuggcaaacugccagagcccccuguguuaccaccgcagguccuggaacuccccgaguucagcgauccugccgggaaacuuguguggaugaggcuguugucagaaggacggguucgcaguggucuauguggcggguga

SEQ ID NO: 61121 - RNA, 2124 nt, Artificial Sequence
  derived and/or modified sequence opt3 from PRDM13__Homo_sapiens__NP_067633
augcacggcgccgcuagagcacccgccaccagcguguccgcggacugcuguaucccugcugggcugaggcucggaccagucccggguacauucaaacuuggcaaauaccugucugaucggcgcgagcccgggccuaagaaaaagguucgaauggugcguggagaauugguagacgagucaggcgguaguccauuagaauggauugggcugauaagagccgcaaggaacagccaggagcaaacucuagaagccaucgcugaucuccccggaggccagauuuucuaucgggcacugcgcgacgugcagccuggcgaggagcuuacggucugguacuccaauucucuggcccagugguucgauaucccaaccacagcuacucccacccaugacgaaaaaggggaggaaagauauauuugcugguacuguuggaggacauuucgguauccuaacucguugaaggcccaccuccgcuuccauugcguguuuucaggagguggcgggggagcguuccugcaccaugagcacgcagcccgacaaggcgcuguuccagccgcagauggucuggggcucagcccgaagcccccugcuccagacuuugccgcgcccagucaggccggaaccuuaagaccucacccacuggggcccccgccugugcaggcauguggcgcuagggagggcaucaaacgggaagccuccucugcucccagcgccacuuccccaacaccuggaaaguggggucagcccaaaaagggcaaagagcaacuugaucgugcauuggacaugucaggggccgcucgcggacagggccauuuccuggguauagucgggggcaguagcgcgggagugggcucucuagcauuuuacccagggguaagauccgccuucaagcccgcuggacucgccagggcagccgcugccgcacacggugauccuuaucgggaagagucaagcaguaagcagggcgcggggcuggcucuuggacgacuguugggcggugggcgcgccugcggcagaccaggaucuggcgaaaauuccgcagccgggggagcuggucaucaccaccaucaccaugcccaccaucaccaccauccgaaaugucuccuggcaggcgaucccccuccacccccuccacccggguuaccgugcagcggagcucugaggggcuuuccucuccuuucgguuccacccgaggaggccucugcguucaagcacguggaacgggccccucccgcugcagccgcucugccaggugcccgcuacgcacaguugccucccgcgccagggcuaccgcuggagagaugugcccucccuccccuggacccaggcggacuuaaggcuuaccccggcggggaaugcucccaucugccugccgucaugccagcauuuaccguguauaacggagaguugcucuacggcucacccgcuacgacugccuauuacccucugaaguuacacuucggugggcugcuaaaauauccggaaaguaucagcuacuucuccggaccagcagccgcugcgcucucucccgccgagcugggcagccuugcaucaauugacagggagaucgcuaugcacaaucaacaguugagugaaauggccgccgguaagggccgugggcggcuggacuccggaacccucccuccagcuguggcagccgcgggcgggacaggaggcggugggagcggaggcucuggugcuggcaaacccaagacugggcaucugugucuuuauugcggaaagcuguacucacgaaaauacggcuugaagauucacaugagaacccauacaggguauaaaccucucaagugcaaagucugucugaggccguuuggagaucccaguaacuuaaauaagcacauccgccugcaugccgagggcaacaccccauaccggugcgaauuuugugguaagguucuagugagaaggcgcgaccucgagcgacacguaaaaagccggcacccugggcagucccugcuugcaaaggccggagauggccccggugcugaaccaggcuauccucccgagccaggggacccgaaaucugaugacucggauguggacgucugcuuuacggaugaccaaagcgauccugaggugggaggcgggggagaacgugacuuguga

SEQ ID NO: 61122 - RNA, 1716 nt, Artificial Sequence
  derived and/or modified sequence opt3 from PRDM14__Homo_sapiens__NP_078780
auggcccugcccagaccuagcgaggcugugccacaggacaaggucugcuacccgcccgaauccucuccucaaaaccucgcagccuauuacaccccauuccccucauauggccacuacaggaauagucuugcgacaguugaggaagauuuucagccuuuccggcagcuggaggcugccgcaagcgccgcuccagcaaugcccccuuuuccauuccgcauggccccgcccuuguuauccccugggcugggacuacagcgagaaccacucuaugaccugcccugguacucuaaacuuccuccaugguaucccaucccgcaugugccucgugagguacccccauuucugucgucaagccacgaguacgcuggugccaguuccgaagauuugggccaucaaauuauagggggagacaacgagucuggcccuuguugcggucccgauacucucaucccacccccuccagcggacgcaagccugcugccggaagggcucagaacgucccaguuacugcccuguucaccuaguaagcagagcgaggauggaccaaaacccucuaaucaggagggcaaguccccugccagguuccaauuuaccgaagaggaccuucacuucguguuguacggcgucacaccaucacuggaacaucccgcuagccuacaccacgccauuagugggcuccuggugccgccugauucuuccggaagcgacucgcuuccacagacucuggauaaagacucuuugcagcuccccgagggucugugcuuaaugcagaccguuuuuggcgaagugccucauuucggggucuuuuguuccucauucaucgcaaagggagugcgguuuggccccuuccaagguaagguaguuaacgcuagugaggugaaaacauauggggauaauagcgucaugugggagauuuucgaagacggacaccugucccauuuuaucgacggcaagggcgggaccggaaacuggaugucuuacgugaauugcgcccgcuucccaaaagagcagaaccucguggcgguccagugucaaggucacauauuuuaugaaagcugcaaggagauccaccagaaucaggaacuucugguuugguacggcgauuguuaugagaaauucuuggacauuccugugucacuacagguaacugagcccgggaagcaaccaaguggaccguccgaagagagcgccgaaggcuacagaugcgagaggugugguaagguguuuacauauaaauacuaccgggauaagcaucugaaauauaccccuugcgucgacaagggggaucgcaaauuccccugcucucucuguaagcgaucauuugagaaaagagacaggcugcggauccacauucuucaugugcacgaaaagcaucguccacacaagugcaguacguguggcaaaugcuucagccaguccucuucgcugaacaagcacaugcgcguucauagcggagauagacccuaccaguguguguauugcacuaaaagguuuaccgcauccucaaucuugcggacacacauacgacagcauaguggcgagaagccuuucaaauguaaguacugcgggaagucuuuugcuagccacgccgcucacgacucccauguccgcagaucacacaaagaagaugacggauguagcugcucuauuugugguaagaucuucuccgaucaagagacuuuuuauagucauaugaaauuccacgaagacuacuga

SEQ ID NO: 61123 - RNA, 2478 nt, Artificial Sequence
  derived and/or modified sequence opt3 from PRDM1__Homo_sapiens__NP_001189
augcuggacaucugccucgagaagagagugggcaccacacuugccgcucccaaauguaacagcuccacugucagguuccaggggcuggcagaaggaacgaaggguaccaugaaaauggauauggaggacgccgauaugacauuguggacugaagcggaguuugaagagaagugcaccuacauuguuaaugaccacccuugggauucuggcgcugacgggggaacaucagugcaagccgaggcaaguuuaccacggaaccugcuauucaaauaugccaccaauagcgaagagguaauaggcgugauguccaaggaauacaucccgaaggguacucgcuuugggccccucauuggagagaucuauacaaacgauaccgucccuaaaaaugcuaaccgaaaguacuucuggcguauuuauucuagaggcgagcugcaucacuuuaucgacggcuucaaugaagagaaaucgaacuggaugagguacgugaauccagcacauucaccccgggaacagaaccuugccgcuugucagaaugggaugaacauauauuuuuacacgaucaagccuauuccagccaaucaggagcuguugguuugguacugccgcgauuucgcggaaagacuccacuaucccuacccuggagagcugacuaugaugaaccugacccaaacacagagcagucucaaacagccauccacugagaagaaugaauuauguccgaagaacgugcccaaaagggaguauucugucaaggaaauccugaaacuugacagcaacccuuccaaggguaaagauuuguaccggucaaauauuaguccacugaccagcgagaaggaccuagaugacuuucgccgaagaggcucucccgaaaugccuuucuauccaagggugguauaccccauccgggcaccgcucccugaggacuuucugaaagccucccuugcuuaugggauagagcgucccacauacauuacccgcucaccaaucccuagcaguacgacucccucuccauccgccagaagcucgcccgaucagucucugaaguccucaaguccucauagcuccccaggaaacacaguuucuccggugggccccgguagccaagaacacagggacucauacgcauauuugaaugcuaguuacgggaccgagggacucggcuccuauccuggcuacgccccacugccccacuuaccuccagcguucauucccagcuauaacgcccauuacccgaaguuucugcucccuccauaugggaugaauugcaacggacuuucugcagucucaaguaugaaugguaucaacaauuucggccuguucccccgguuguguccuguguacagcaaccuacucgggggaggcucccugccccacccaaugcugaauccuacuucucuucccucgagccugccauccgauggugcucgacgcuugcuccagccggaacauccuagagaggugcugguccccgccccacacucagcuuuuaguuucacaggggccgcagccucuaugaaagacaaggcuugcagccccaccuccggcucaccuacggcgggaaccgcagccacagcugaacacguugugcagccaaaagccacuagcgcagccauggcugcccccucuuccgaugaggcaaugaacuuaaucaagaauaaaaggaacaugaccggcuacaagacacugccuuauccgcuaaagaaacagaaugggaagauuaaauacgaguguaacguaugcgcgaagacuuuuggacaacucaguaaccugaaagugcaucuucggguccacagcggugaacgcccauucaagugucagaccugcaauaagggcuuuacacaguuggcucaucugcaaaaacacuaucucgugcauaccggggagaagccccacgaaugccagguuugucacaaaagauucucuuccacuucaaaccugaagacgcaucuuaggcugcacaguggagagaaaccuuaccagugcaagguguguccagccaaguuuacacaguucguccauuugaaacuccacaagcgucugcacacccgggagcgaccccauaaaugcagccaaugucacaagaauuauauacauuuaugcucgcugaaagugcaccuaaagggcaacugugcagccgcuccugccccgggucucccccuggaagaccuuacuagaaucaaugaggaaauugagaaauuugauaucuccgacaacgcagauagguuggaagacguagaggaugacauaucuguuauuagcguggucgagaaggaaauccuggcugugguccgcaaggagaaagaagagaccgggcucaaggugucacugcagcggaauaugggcaacggauuacugaguuccggcugcucucuuuacgaaagcuccgacuugccacucaugaaacugccucccucaaauccacuaccucugguucccgugaagguaaaacaggagacagucgagccaauggauccguga

SEQ ID NO: 61124 - RNA, 2406 nt, Artificial Sequence
  derived and/or modified sequence opt3 from PRDM4__Homo_sapiens__NP_036538
augcaccauagaaugaacgagaugaaucugagccccgugggcauggaacagcucaccuccucuucagucaguaacgcccuuccuguuagcgggucccaccugggauuggcugcaucuccaacacauucggccaucccggcgcccgguuuaccuguggcuauuccaaaucugggccccucacuaagcagucucccuuccgcccugucucuuaugcugccaauggggauaggagacaggggcguaaugugcgguuugcccgagcggaacuacacucucccuccaccgcccuauccucaccuggaaagcuccuacuuccgcacgauccugccagggauucucucauauuuagcagaucgacccccuccacaauacauccaucccaauaguauuaacguggacggaaauaccgcccugagcaucacaaacaauccgucugcucuugauccuuaucaguccaacggcaaugucggcuuggagcccgggauagugucaaucgacagccguaguguuaacacucacggagcacagucucugcacccauccgauggucaugaaguggcccuagacaccgcuauuacaauggagaaugucagcagagugaccucgccuaucucuacugauggcauggccgaggaacucacaauggacgggguagcgggagagcacucccagauucccaacggcucaaggagucaugaaccacugagcguugauuccgugucuaauaaccuugcagccgacgcugucggucacgggggagugauccccaugcacggcaacggccuggaguugccuguggucauggagaccgaucauauagccagccggguuaaugggaugucagacagugcacucuccgauagcauucacacgguggcuaugucuacuaacucaguaaguguggcccugagcaccucccauaauuuagcgucucuggaaucggucagccuccacgaggugggacuuucccuggaaccaguugccgugucaaguaucacacaagaggucgcaauggguacuggccauguggacguaucuagcgacuccuugucauuuguuagcccgucucuacagauggaagauuccaacaguaauaaggagaacauggcuacccuguucacaauuugguguacccucugcgaccgcgccuaccccagcgauuguccugagcacgggccagugacguuuguccccgacacuccuaucgaaucuagagcuaggcugucccuuccaaaacagcugguguugcggcagucaaucgucggagccgaggugggcguuuggacaggugaaaccauucccgugcgcacuugcuucgggccgcucauaggccaacagagucacagcauggagguagcagaauggacagauaaggccgucaaucauaucuggaaaauuuaucacaacggagugcuggaguuuuguaucauaaccacggacgagaaugaaugcaacuggaugauguucguucgaaaggcuagaaauagggaggaacagaacuuaguggcguacccucaugauggcaaaauuuucuucuguaccucgcaggacaucccacccgagaaugaacugcuauuuuacuauucccgggauuacgcacaacagaucggggucccugagcaccccgacgugcaccucugcaacuguggaaaggagugcaauucuuauacagaauuuaaggcccaucugacuagccacauucauaaccaccuuccaacccagggucauucaggcagucacgggccuucccacucuaaagagcguaaguggaaauguagcaugugcccccaggcuuuuaucuccccaucaaaguugcauguacacuucaugggacauaugggcaugaaaccgcacaagugcgauuuuuguagcaaggccuucagugacccuucuaaccugcgcacacaucucaaaauucacacuggucaaaagaauuacagaugcacccugugugacaaauccuucacacagaaggcacaccuugaaagccauauggugauacacaccggggagaaaaaccugaagugcgauuauugugacaaauuguuuaugaggcggcaggaucucaagcaacauguucugauccacacucaggagcgacagauuaagugccccaaaugugacaaguuauuccugcgcacgaaucaccucaaaaagcaucuaaacucgcacgaaggcaaaagagauuacgucugcgagaaguguacaaaggccuaucugaccaaauaccaucuuacuaggcacuugaagaccugcaaaggaccaacaucaucuaguuccgcucccgaagaggaagaggaggacgauagcgaagaggaagaccuggccgauucugugggcaccgaggacugucggaucaauagcgcaguguacuccgcggaugaaucacucagugcucauaaguga

SEQ ID NO: 61125 - RNA, 1800 nt, Artificial Sequence
  derived and/or modified sequence opt3 from PRDM5__Homo_sapiens__NP_001287752
augcugggcauguacgugcccgacagauucagccucaaguccucuaggguccaggaugggaugggacuuuauaccgcccggcgcguucgaaaaggugagaaguuuggcccuuucgcuggggaaaaacguaugccagaggaccuggaugaaaacauggacuacagauugaugugggaggugaggggaucaaagggcgaaguauuauauauccuggaugcaacaaauccgcggcacaguaacuggcuacgcuuugugcaugaggcccccagccaagagcagaaaaaucucgcggcuauucaggaaggugagaacauauucuaccuggccgucgaagacaucgagacugauacggagcuucugauuggguauuuggacuccgauauggaagcagaggaagaggaacagcaaaucaugaccgugauuaaggagggagagguugaaaauucuagaaggcagucgacagccggccggaaggaccgccucggcugcaaagaggauuacgcuuguccucagugcgaaaguagcuuuacuucagaggacauccuggcagaacaucugcagacccuccaccaaaagccaacagaggagaaagaguucaaguguaaaaacugcgggaagaaguuucccgugaaacaggccuuacagcgacacuucgaacagcaucaagaaaccuguagaggagaugcuagguuugucugcaaggccgacuccugugguaaacggcugaagucuaaagacgcgcuuaagcgucaccaggagaaugugcacacuggcgauccuaaaaagaaguugauaugcagcguauguaacaaaaagugcuccucagcaaguagccugcaggaacaucgcaaaauccacgagauuuucgacugucaagagugcaugaagaaauuuaucucugccaaucagcuaaagagacauaugauuacacacuccgaaaagaggccauauaacugcgagaucuguaauaaaucauucaagcggcucgaucagguuggggcucacaaagugauacauagcgaagacaagcccuacaaaugcaagcuguguggaaagggcuuugcccaccgaaacgucuacaaaaaucauaagaaaacccacagugaggagcgcccuuuccagugcgaagaguguaaggcacuuuucagaacgccauuuucucugcaaaggcauuugcucauucacaacuccgaacggacuuucaaaugccaccauugugaugcuaccuuuaagcgcaaggacacacugaaugugcacgugcaggucguucaugagagacacaaaaaguauaggugcgaauuauguaacaaagccuucgugacuccgagcguacugcguucgcacaagaaaacccauacaggugagaaggagaaaaucugccccuacugugggcagaaguuugcgucuuccggaacccuccgggugcacauucgaucacauacgggcgaaagaccuuaucagugcccauacugcgagaagggcuucaguaaaaacgaugggcuuaagaugcacaucaggacucauacacgcgaaaaacccuauaaguguagcgagugcuccaaagccuuuucucaaaagcggggacuggacgaacacaagagaacccacacuggugagaaaccuuuccagugugaugucugcgacuuggcauuuagccuaaagaaaaugcugaucaggcauaagaugacacacaauccaaaccgcccccucgcugagugucaguucugccauaaaaaguuuacccgaaaugauuaccugaaggugcacauggacaacauucauggcguugccgacucauga

SEQ ID NO: 61126 - RNA, 1788 nt, Artificial Sequence
  derived and/or modified sequence opt3 from PRDM6__Homo_sapiens__NP_001129711
augcugaagcccggcgacccugggggaagcgccuuccucaaaguggauccagcuuaccuucagcacuggcaacagcuguuuccgcaugguggcgcagggcccuugaagggauccggcgccgcggguuuacugucugcuccucagccacuacagcccccuccacccccuccaccgcccgagagagccgaaccuccacccgacucacucaggccucggccagcaagucugagcuccgccucuucgacccccgcuucaagcaguacauccgcaucuagcgccuccucaugcgcugccgcggcagccgcugccgcacuugcugggcugagugccuugccggucagccaacucccuguuuucgcgccccuggccgcagcugccguggcugccgagccacugccucccaaagaacucuguuuaggagcaacuucuggcccaggccccguaaagugcgggggagguggcgggggaggcggugaggggcgcggagccccucgauuucguuguuccgcugaggaacuggauuauuaccuuuauggccagcagagaauggagaucauuccauugaaccagcacacgucagacccgaauaacaggugcgauaugugugcggacaaucggaacggcgaaugccccaugcaugggccucugcacagccuacgcagacucgugggaaccaguucugcagccgcugccgcaccacccccugagcugccagaauggcuuagggaucugccccgggaggucuguuugugcacauccacugugccgggucucgccuacggcauaugugcugcccaacgcauccagcaggggaccuggauuggaccuuuccagggcguucuguuaccacccgagaaagugcaagcgggugcaguccgaaauacacagcaucugugggaaaucuaugaccaggaugggacccuccaacacuuuauugacggcggagagccuagcaagucgucuuggaugagauacaucaggugcgcucggcacuguggcgaacagaaccuuacugugguacaguaucguuccaauauauucuaccgcgccugcaucgauauucccagagggacagagcuguugguuugguacaacgacucauauaccagcuuuuucggaaucccacuacagugcauugcacaagaugaaaaucugaacgugccuaguacggucauggaggccauguguaggcaggacgcucuccagcccuuuaauaaguccucuaaacuggccccaacuacccagcaacggagcgugguguucccgcagacaccuugcucacgaaacuuuagucuucuggacaaguccggucccaucgagagcggcuucaaucagauaaacgucaaaaaucagcgcguuuuggcaucuccaacuucaaccagucaacuccauagcgaauuuuccgauuggcaccuguggaagugugggcagugcuucaaaacauucacccagagaauuuuacugcagaugcauguguguacgcaaaaccccgacaggccuuaccagugcggacacuguucucagucguuuagccaaccauccgagcuacggaaccacguagugacucauucaagugaucgccccuucaagugcggcuauugugguagagcuuuugccggggcgacaacccucaauaaccacaucaggacucauacaggcgaaaagccuuucaaaugcgagcguugugaacggucuuuuacccaggccacgcagcugagccgacaccagagaaugccgaaugagugcaagccaauuaccgagucccccgaaucaaucgaggucgacuga

SEQ ID NO: 61127 - RNA, 1479 nt, Artificial Sequence
  derived and/or modified sequence opt3 from PRDM7__Homo_sapiens__NP_001091643
augagccccgagagaucccaggaagagucuccugaaggcgacaccgagaggacagaacggaagccaauggugaaagaugccuucaaggacaucucaauuuacuuuacuaaagaggagugggcugaaaugggggauugggagaagacgcgcuaucgaaacgucaaaaugaauuacaacgcacugauaaccguuggacuccgugccacaagaccggcguucaugugccacaggcggcaagcuaucaaacuucagguggacgauacugaagacagugaugaggaguggacuccccgccagcagguaaagccuccauggauggccuuuagaggugaacaaagcaagcaucagaagggcaugcccaaagcauccuucaauaacgagucuucgcugagggaauugucagggacaccuaauuuacugaacaccagcgacagugagcaggcccagaagccagugucucccccuggagaggcuuccacuagcggccaacacucccggcuaaaacucgaacugcgccgaaaggagacagaagguaagauguauucacuuagagagaggaaagggcaugcauacaaggaaauuagugagccacaggaugacgauuaucuguacugugaaaugugccagaacuuuuucaucgacagcugugccgcucacggaccgcccaccuuugucaaagauucugccguggacaagggccauccuaaucgguccgcguugucacucccacccggccugcguauugggccuagcggaaucccacaggcaggucugggcguuuggaaugaggccagugaccuccccuuagggcugcacuucggaccguaugagggccgcauaacggaagaugaggaagcugccaacucugguuacuccuggcuuaucacuaaagggagaaauugcuacgaguauguggacggaaaggauaaaagcucggcaaacuggaugagguacgucaauugugcucgggacgaugaggaacaaaacuugguggccuuucaguaucaccgacagauuuucuacagaaccugccgcguaaucaggccuggcugugagcugcuaguuuggucuggcgacgaauaugggcaagagcucgguauucgguccucaaucgaacccgcggagagucugggacaggccgugaauugcuggagcggcauggggauguccauggcacgcaacugggcuucuagcggagccgcuucaggcagaaagaguuccuggcagggugagaaccagagccaaaggucuauacaugucccacacgccguguggccuuuucaggugaagaauuucucagucaacauguggaaugcaauuacaccccuucguaccagucaggaucaucugcaggaaaacuuuagcaaucaacggaucccagcccaggggauucgaaucagauccggcaacaucuugauucacgcugcgguuaugaccaaacccaaggugaaaaggucuaagaaaggaccuaauucguga

SEQ ID NO: 61128 - RNA, 2070 nt, Artificial Sequence
  derived and/or modified sequence opt3 from PRDM8__Homo_sapiens__NP_064611
auggaggacaccggcauccagagagggauuugggauggagacgccaaggcugugcaacagugccugacagauauauucacuagcgucuacacgaccugugacauccccgaaaacgcaauuuuugguccuugcguucucucccacacaucucuuuaugauucaaucgccuucauugcgcugaaaaguacugacaagaggaccgugccauacaucuuucggguagauacaagcgcugccaauggcuccucugagggguugaugugguuacgccuggugcagucggcacgagacaaagaggaacagaaccuagaagccuauauaaagaauggacaacucuucuaccguucacugagaaggaucgcuaaagaugaggagcuucuggucugguauggcaaggaauugaccgagcuccugcugcucuguccgagccggagucauaacaagaugaaugguuccucucccuacacuugcuuagaauguagccagcgcuuucaguucgaguuuccuuauguggcacaccugagauucaggugcccaaaacggcuucauuccgccgacauuucaccccaggaugagcaagggggaggcguuggcacaaaggaccacgggggagguggcgggggaggcaaagaucagcagcagcaacagcaggaagcuccuuuggguccagggcccaaguuuuguaaagccggaccucugcaucacuacccaaguccgagccccgagucuuccaacccuucagcggcagccggcggcagcagugcuaagccaucuaccgacuuccacaaucuagcccgcgaacucgagaacucccgagggggaagcucgugcucucccgcacaaucccugucaagugguagcggcuccgggggaggcggugggcaucaggaagcugagcuuucuccugacggcaucgccacgggaggcgggaagggaaaaagaaaguuuccagaggaagcggccgaggguggcgggggagcaggccuggugggugggaggggccgguucgucgaacgucccuugccggcuagcaaagaggaucucguguguacuccucagcaguaccgcgccucaggaaguuauuuuggccuggaagagaaugggagauuauucgcucccccauccccugagaccggagaagccaagaggagcgcauucguagagguuaaaaaggccgcucgggcggcaucucugcaagaagaggguacagccgacggcgcugggguggccucagaagaucaggacgcaggaggcggugggggcaguagcacucccgccgcugccuccccagucggagcagagaaacuccuugcgccccgaccuggcgggccacugccgucucgcuuggagggaggcucgcccgcuagagguagcgccuuuaccuccgugccucagcuagggucagcaggaaguacaucuggcgguggcgggaccggagccggcgcugccgggggagcaggcggugggcagggagcugccagcgaugaaaggaaguccgcguucucacaaccagcccggagcuuuucucagcugagcccccucgugcugggccagaaacuuggugcucuggagccuugccacccagcagacggcgucgggcccacgcgcuuguacccggccgcugccgauccucucgcaguuaagcugcagggagcggccgacuuaaacggcggguguggaagucugccaagcggcggugggggacuacccaagcaaucuccuuuccucuaugcuacugccuuuuggcccaaauccucagcagcugccgcagccgcugcggccgcagcugccgccggcccacugcagcuucaguugccuagugcucugacacuccugcccccauccuucaccucgcuuugccugccggcacagaauuggugcgccaaguguaacgcguccuuuagaaugacuucugauuugguguaccauaugaggagccaccacaaaaaggaauaugcuauggagccucucguaaagcgucggcgagaggaaaaacugaagugccccauuuguaaugagucauucagagaaaggcaucacuuaagucgccauaugacaucccacaacuga

SEQ ID NO: 61129 - RNA, 2685 nt, Artificial Sequence
  derived and/or modified sequence opt3 from PRDM9__Homo_sapiens__NP_064612
augagccccgagaagucccaggaagagucuccugaagaggacaccgaaagaacagagaggaaaccaauggugaaggaugccuucaaagacaucucaauuuacuuuacuaaggaggaaugggcugagaugggcgauugggaaaagacgcgguaucgcaacgucaagcgaaauuacaacgcacugauaaccaucgggcuccgugccacaagaccggcguucaugugccacaggcggcaagcuauuaaacuucagguugacgauacugaggacagugaugaggaauggacaccccgccaacaggugaaaccuccauggauggcccugagaguagagcagaggaagcaucagaaaggaaugcccaaggccagcuuuuccaaugaaucuucguugaaagaguuaucacggaccgcaaaccugcuaaaugcuagcgguagugaacaggcacagaagccuguguccccaucuggcgaggccagcaccuccgggcaacacucacgccucaagcuggagcuucgaaagaaggaaacugagagaaaaauguauagucugagggaacggaagggacaugcuuacaaagaggucagcgaaccccaggacgaugacuauuuguacugugagaugugccagaacuucuuuaucgauucuugugccgcgcacggcccuccaacauucgugaaggacuccgcaguugauaaaggucauccgaaucguucagcccucagccugcccccugggcugcgcauuggaccaaguggcaucccccaggcuggccucgggguguggaacgaggccucugacuuaccucugggacuucacuuugguccauaugaaggcagaauaaccgaggacgaagaggcagcuaauaacggguacuccugguugaucacgaagggaaggaauugcuacgaauaugucgauggcaaggacaaaagcugggccaacuggaugcgguacgugaauugugcgcgagaugacgaggagcaaaaccugguagccuuccaguaucaccgccagaucuuuuacagaacuugcaggguuauucggcccgguugugaacuacucgugugguauggggaugaguacggacaagaacugggcauuaaguggggcucgaaauggaagaaagagcuuauggcagggcgcgagccgaagccugaaauccaucccugcccaucuuguugccuggcuuucuccucacagaaguuuuugagucagcacgucgagagaaaucauagcucccagaacuucccuggacccucugccaggaaacuccugcaaccagaaaaccccuguccuggugaccagaaucaggagcagcaauauccagauccgcacagccguaacgacaagaccaaaggccaggaaauaaaggagcggucaaaauuacugaauaagcgaacauggcagagagagauuaguagggcuuuuuccucucccccuaaggggcagaugggaagcugccgcgugggcaaacggaucauggaagaggaaucaagaacuggucaaaaggugaacccagggaauaccggcaaacucuucgucggaguuggcauuaguaggaucgccaaggugaaauacggggagugcggacaggguuucagcguaaaguccgaugugaucacacaccagcgcacccauacgggcgaaaaacuuuacgucugucgagagugcgggcggggauuuucuuggaaaucgcaccuguugauucaucagcguauacacacuggcgagaagcccuauguguguagagaaugcgguaggggguucagcuggcaauccguucuacugacacaucagcgcacccacacuggcgagaaaccuuacgugugucgggaaugcggaagaggcuuuucaaggcagaguguccuccugacacaccaacgacgccauaccggggagaagccauaugugugucgggaaugcggaagagguuucucuaggcagagcguacuucugacgcaccagcgucgccauaccggcgagaaacccuacguuugucgggagugcgggagaggauuuuccuggcagucaguguugcucacacaccaaaggacucacaccggcgaaaagccguaugucugucgagagugcggucggggguucagcuggcagucugugcuguuaacacaucagcgcacucacaccggcgaaaaaccuuacgucugcagagaguguggaaggggcuuuuccaacaagagucaucugcuacggcaccagcgaacacauaccggggagaagccauaugugugcagagaauguggacgcggcuucagggacaaaagccaccuccugcgucaccaacggacucauacgggugagaagcccuacguuugcagagaaugugggaggggauuucgcgauaaaucuaaucuuuugucccaccagcgaacacauaccggcgagaagccuuacgugugcagagaauguggucggggcuucucaaacaaaagucaucugcucaggcaccagcgcacucacaccggggagaagcccuauguaugccgugaguguggaagaggcuuucggaauaagagccaucugcuuaggcaccagcgcacacacaccggggaaaaaccauacgucugccgagaguguggaagaggcuucucggaccgguccucucugugcuaucaucaaaggacucacacaggugaaaagccuuacgugugccgcgaggacgaauga

SEQ ID NO: 61130 - RNA, 597 nt, Artificial Sequence
  derived and/or modified sequence opt3 from PRDX2__Homo_sapiens__NP_005800
auggccagcggcaacgcuagaaucgggaagcccgcaccugacuucaaagccaccgcgguggucgauggagcuuuuaaggagguuaaacuguccgacuacaaggguaaauaugugguacucuucuuuuacccacuugauuucacauuugugugcccgacugaaauuauagccuucucuaauagggcagaggacuuucggaagcugggcugugaagucuugggggugucaguugauagucaguucacgcacuuagccuggaucaacacaccccgcaaggagggaggccuggguccucuaaauauuccacuccuggcugacgugacccgacgucuuagcgaagauuaugggguccugaaaacugacgagggaaucgcauacagaggcuuguuuauuaucgauggcaagggggugcucaggcaaauaaccguaaacgaccugcccguuggacgguccguggaugaggcccugcgccucguccaggcuuuccaguauacagacgaacauggugaggugugcccugccggcuggaaaccagggucugauaccaucaagcccaauguggacgacucgaaagaauacuuuucaaagcacaacuga

SEQ ID NO: 61131 - RNA, 771 nt, Artificial Sequence
  derived and/or modified sequence opt3 from PRDX3__Homo_sapiens__NP_006784
auggccgcugcagugggcagacugcucagggccagcgucgcgcggcacguuuccgcuauccccugggggauuucugccaccgcagcccuucgcccugcugcaugcggacgaacaucacugacuaacuuguuauguagugguagcucccaggccaagcuguucucuacgucgucaagcugccaugcuccagccgugacccaacacgcgccguacuuuaaaggcacagcaguagugaauggggaguucaaggaccuaagucucgaugacuuuaaaggaaaguaucugguccuuuucuuuuacccccuggauuucacuuuuguguguccuaccgaaauaguugccuucuccgacaaagcuaacgaguuucaugaugugaauugcgaagucguggccguaucuguugacagccacuucucccauuuggcauggaucaacacaccacguaagaauggcggucucgggcacaugaacauugcucugcugucagaucucaccaagcagaucaguagagacuauggaguguuacuggagggcagcggccuugccuugagggggcuguuuauuaucgaucccaauggagucauaaaacaccuaucugugaacgaccucccugugggucgguccgucgaagagacucugcgccuuguuaaggcguuccaguacguggagacacauggcgaaguauguccagccaauuggacccccgauucaccuacgaucaaaccaagcccggcagcuaguaaggaguauuuucagaaagugaaccaauga

SEQ ID NO: 61132 - RNA, 816 nt, Artificial Sequence
  derived and/or modified sequence opt3 from PRDX4__Homo_sapiens__NP_006397
auggaggcccugccccuccuugcugcaaccacaccugaccacggcagacauaggcggcuguuguuacugccacuacuccuguuccuucugccggccggggcggugcagggaugggaaacugaggaacgcccccgaacgcgugaggaagagugccacuuuuacgcugguggccaagucuauccuggggaggccagcagaguuuccguggcagaucauucuuugcaccucucaaaggccaaaaucaguaagccagcucccuacugggaaggaaccgcaguaauugacggcgaguucaaagaacugaagcugacagauuauagggguaaauaccucguguuuuucuuuuauccuuuagacuucacuuuugucuguccaaccgagauaaucgccuucggggaucggcuggaggaauuucgcagcauuaacacagaggugguugcuugcuccguggacucucaguucacccaucuugccuggaucaauacucccagaaggcagggaggcuugggcccuauucggaucccacugcuaucggaucucacacaccagauaucaaaggacuacggggucuaucuggaagauagcggacacacccuucgcggucuguuuaucauugacgauaagggcaucuugcgacaaauuacgcucaacgaccugccgguggggagaaguguagaugagacuuuaaggcugguucaggcguuccaguacaccgacaaacauggagaagugugucccgcaggcuggaagccugguuccgagacaaucauaccagaccccgccgggaaacucaaguacuuugauaaacuuaauuga

SEQ ID NO: 61133 - RNA, 645 nt, Artificial Sequence
  derived and/or modified sequence opt3 from PRDX5__Homo_sapiens__NP_036226
augggccuggccggggugugcgcucucagaaggagcgcaggauacauccuugucgguggcgccgggggacaguccgcggcugccgcagcccggcgcuguucugagggcgaaugggcuucaggugggguucgaaguuucagccgugcagccgcugccauggcgcccauuaaggugggagacgcaauaccugccguagagguguuugaaggcgagccaggcaacaaagucaaucuggcugaauuguucaaggggaaaaagggaguguuauuugguguuccgggcgccuucacccccgggugcuccaaaacacaucugccuggauuuguggagcaagcagaggcucuaaaggccaagggcguccaggugguagcgugucucucuguuaacgaugccuucgugacuggugaaugggggagagcacacaaagcugagggaaaggucaggcugcuugccgacccaacgggcgcuuuuggcaaagaaaccgaucuguugcucgacgauucgcuggugucaaucuucgggaaucggcgccugaagagauuuagcauggugguccaggacggaauuguuaaagcccucaacguggagcccgaugguacaggcuuaacuugcagucuggcaccuaauaucauuucccagcuuuga

SEQ ID NO: 61134 - RNA, 675 nt, Artificial Sequence
  derived and/or modified sequence opt3 from PRDX6__Homo_sapiens__NP_004896
augcccggcgggcugcuccuuggagacguggccccuaacuucgaggcuaauaccacagucgguagaaucagguuucacgauuuccugggcgacagcugggggauuuuguuuucccauccacgggauuucacuccgguuugcacgaccgaauuaggacgcgcagccaagcuggcgcccgaguuugcuaaacgaaacgugaagcuaauagcccucucuaucgacucaguagaagaucaccuggcauggaguaaagacauuaaugccuacaacugugaggaaccuacagagaaacuuccauuccccaucauugaugaccguaauagagagcuggcuaucuugcucggcaugcuggauccugcagaaaaagacgagaaggguaugccagugacugccagggucguguuuguuuucgggcccgauaagaaacugaagcucagcauauuauauccugcuaccacaggacggaacuuugacgaaauccugcgcguggucauuucccuucaguugaccgccgagaaaagaguggcgacuccaguagauuggaaggacggcgacucuguuauggugcugccgacaauccccgaggaagaggcaaagaagcuauucccuaagggcgucuuuaccaaagaacucccaucggggaagaaauaccugagguauacgccccaaccuuga

SEQ ID NO: 61135 - RNA, 1254 nt, Artificial Sequence
  derived and/or modified sequence opt3 from PREB__Homo_sapiens__NP_037520
augggcagaaggcgggcccccgagcuguaccgcgcuccuuucccacucuaugcacuucagguggacccgagcaccgggcuguugaucgccgcgggagguggcggggcugccaagacaggaauuaaaaacggcguccacuuuuuacaacuggaacuaauaaauggucgacucuccgcaucucugcuucauucacacgauacugagacgcgugccaccaugaaccuggcuuuggcaggggacauccucgccgcuggacaggaugcccauugccagcugcugagauuccaggcgcaccaacagcagggcaauaaggcagaaaaagccggcaguaaggagcaggggcccaggcaacggaaaggagcugccccugcagaaaagaaguguggugcugagacacagcaugagggccucgaauuacgcguugagaaccugcaggccgugcagacugacuuuagcuccgauccacuucaaaaaguagugugcuucaaucacgacaacaccuugcuggcgacagggggaaccgauggcuacgucagaguguggaagguucccucucuagaaaaagugcucgaguuuaaggcccacgagggugaaauugaggaccuggcacuugggccugauggaaaacuggucacugugggcagggacuugaaggcuucgguauggcagaaggaucagcucguuacacaacugcauuggcaggaaaauggcccaaccuucucaagcacgcccuaucgguaccaggccugucgcuuuggacaggugccugaccaaccagcuggguuacgacuguucacuguccagaucccgcacaaaagacucaggcagcccccuccaugcuaucuuaccgccugggaugguaguaacuuucugcccuugcggacaaaguccuguggccaugagguggugucuugccuagacgucagcgaauccgggacuuuccugggacucggcaccguuacagguucaguggcaauuuacaucgccuuuagucugcagugucuuuauuacguacgugaggcucacgggauaguggucaccgacguggcguuccugccugagaaaggccgcggaccagaauugcucggcagccacgagacggcacuguuuucuguugccguggauuccagaugccaauuacaucugcuacccucaaggcggagcgucccgguguggcuccugcuuuugcuguguguagggcucaucauuguuacuauccugcuucugcagagugcuuucccuggauucuuguga

SEQ ID NO: 61136 - RNA, 1149 nt, Artificial Sequence
  derived and/or modified sequence opt3 from PRELP__Homo_sapiens__NP_958505
augagaagcccccugugcuggcuccuuccucuguugaucuuagccuccguggcucagggccaaccaaccaggcggccgcgccccgggacaggaccuggucgacguccaagacccaggccucggccaacucccucuuucccucagccagacgagccggcagaacccacggaucugccuccaccccuaccuccagggcccccgucaauuuuuccugacuguccccgcgagugcuacuguccaccugauuuccccagugcccucuauugcgacagcagaaaccugaggaaggucccaguuauacccccucggauccacuaccuuuaucugcagaauaacuuuauuaccgaauugccaguggaguccuuccagaaugcgacaggccuccgcuggaucaaccuggauaauaaccgaauuagaaaaaucgaccaaaggguacuggaaaagcucccgggauuaguguuucuguacauggagaaaaaucagcuugaggaaguccccucugcuuugccucggaaccuggagcagcuacgucucucgcagaaucauauaucacgcaucccacccggcguguucagcaagcuggaaaaccuucuguugcucgaucugcaacacaauagauuaagugacgguguuuuuaaaccugauacuuuccaugggcugaagaaccucaugcagcuuaaucuggcccacaacauuuugaggaagaugccaccccgggugccgaccgcaauccaucagcuauaucuggacuccaauaaaauugagacaaucccuaacggauacuuuaagucuuucccaaaccucgccuuuauacgacugaauuauaacaaacuuaccgaucgcggccugcccaagaauagcuucaacauuuccaauuugcucguccugcacuuaucacacaacagaaucaguagcgugccugcuauuaauaacaggcuggagcaucuauaccucaauaacaauucuaucgagaaaaucaacggcacucagauuugucccaaugaccugguagcauuucacgauuucuccucagaccuugaaaacguuccacauuugcgguaccugcgccucgacgggaauuaucugaagccucccauaccacuugaucugaugaugugcuucagauugcuccaaagcguggucaucuga

SEQ ID NO: 61137 - RNA, 2133 nt, Artificial Sequence
  derived and/or modified sequence opt3 from PREP__Homo_sapiens__NP_002717
augcugagccuccaguaccccgacguguauagagaugagaccgccguccaagacuaccacggccauaagaucugcgauccuuaugcuuggcuugaagacccagauuccgagcagacaaaagcauucguugaagcccagaacaagauuacugugccguuucuggagcagugucccauaaggggguuguacaaagaacggaugacggaguuauaugacuacccuaaguauucuugccacuucaaaaagggaaagcgcuacuuuuacuucuauaauaccggucugcaaaaccagcgaguacuauacgugcaggauucacucgagggcgaagcgcgugucuuucuggacccaaauauccuuagugaugacgggacaguggcucugagaggauaugccuucagcgaggauggcgaauacuuugcauaugguuuguccgccucugggucggacuggguuacuauuaaauucaugaagguggauggagcuaaagagcuccccgacguccuggagagggugaaguuuucauguauggcauggacccaugacggcaaaggcauguucuacaacagcuauccucagcaagaugggaagagugacggaacagaaaccuccacuaaucugcaccagaagcucuacuaccauguauuagguacagaucagucugaggacauccugugcgccgaauuuccagaugagcccaaauggaugggcggggcugaacuuagcgacgauggacgguauguuuugcuguccauucgcgagggcugugacccugugaacagacuaugguacugcgaucuccagcaagagucaagugguaucgccgggauacugaagugggucaaacuuaucgacaauuucgaaggagaguaugauuacgugaccaacgaaggcacgguguuuacuuucaagaccaauaggcagagcccaaacuaucgggucauuaauaucgacuuccgcgacccggaggaaucuaaauggaagguucuggugcccgagcacgagaaagauguauuggaauggauugcgugugugcgauccaacuuucucguccugugcuacuuacacgacgugaagaauauccugcagcuccaugaucuuacaacuggcgcacuguugaagaccuucccucuagacguugggucaauagugggauauagcggucaaaagaaggauacagagaucuuuuaccaguucaccaguuuucugucuccaggcauuauuuaccacugugaccucacgaaagaggaacuggaacccagagucuucagggaggugacuguaaaggggaucgaugccuccgacuaucagacaguucagaucuuuuacccuagcaaagauggaaccaagauuccaauguucauagugcauaagaaaggcaucaaacuugacgguucgcaccccgcuuuucuguauggguacggcggauucaacauuucuaucacuccgaauuauuccgucucacgguugauauuugugcgucacaugggcgggauucucgccgucgcaaacauccgcggagguggcgaguacggggaaacauggcauaaaggaggcauccuggcuaacaagcaaaauugcuucgaugacuuucagugugccgcggaguauuuaauuaaagaagguuacaccaguccuaagagacugacgaucaacgggggcagcaauggaggccuacucguggccgcaugcgcuaaccagaggcccgaucuguucgggugcguuauugcccaggugggaguaauggacaugcuuaaguuccacaaauacaccauaggucaugcuuggacaacugacuauggcuguuccgauucuaagcaacacuuugagugguuggucaaauacagcccacugcauaaugugaagcucccugaggccgacgauauccaguaucccucaaugcugcuucugaccgcagaccacgaugaccggguugugccauugcacagucucaaauucauugccacacugcaguacaucgucgggcgaucccgcaagcagagcaaccccuuacugauccauguggauacuaaggcuggacacggcgcggguaaaccuaccgcaaagguaauugaagaggugucugacauguuugccuucauagcuagaugccuaaauguugauuggaucccauga

SEQ ID NO: 61138 - RNA, 1998 nt, Artificial Sequence
  derived and/or modified sequence opt3 from PREPL__Homo_sapiens__NP_001035844
augcagcaaaagaccaaacuguuccuccaggcccuuaaguacagcaucccccaccugggcaaaugcaugcagaagcagcauuugaaccacuauaauuuugcugaccauuguuacaacagaauuaaauuaaagaaguaucaccugacaaaaugccuacaaaauaagccuaaaauauccgagcucgcaaggaacaucccaucucggucauucaguuguaaggaucugcagccggugaaacaggaaaaugagaagccccuuccugaaaacauggacgccuuugagaagguccgcacuaaacuggaaacgcagccacaagaggaguacgaaauuaucaauguugaggugaagcaugggggauucguauauuaccaggaagguugcuguuuggugcgaagcaaagaugaggaggcggacaacgauaauuaugaaguccucuuuaaccuggaggaacugaagcucgaccagcccuucauugauugcauccguguggcuccugacgagaaauacguugccgcaaagauaagaaccgaagauuccgaggccucuacaugugugaucauuaaauuaucggaccagccagucauggaggcuucauuucccaaugugagcaguuucgaauggguaaaggaugaggaagacgaggauguucuguuuuacacuuuccaaaggaaccuucggugccacgacguguaucgcgcaaccuuuggcgacaauaagagaaacgaaagguucuacacagagaaagauccuuccuauuuugucuucuuguaccugaccaaggacucucgguuccuaacuaucaauauuaugaacaaaacaaccagcgagguguggcucaucgaugggcuguccccaugggacccgcccgugcuuauacagaagcgcauucacggaguccuguauuacguugaacaucgagaugacgaguuguauauccucacgaacgugggcgaaccuacugaguuuaaacugccacccugggccugugguuucauuauggauaccaauucagacccuaagaacugcccauuucaguuauguagucccaucagaccgccuaaguacuacacauauaaauucgcugaagggaagcuguuugaggagacuggacacgaagaucccaucaccaaaacaagcaggguacuccggcuugaggccaagucuaaagacggcaagcuggugccaaugaccgucuuccauaagacggauuccgaagacuugcagaaaaagccucuacuggugcacguuuacggcgcguaugggauggaccucaaaaugaauuuucgucccgagcgcagagugcuggucgaugacggauggauucuugcauacugccacgugagggguggcggggagcugggauugcaauggcaugccgauggccggcucacuaagaaacugaacgguuuagcugaccuggaagccugcauaaagacacuacacgggcagggauucucacagccaagccucaccacucugacagcauuuagugcuggcggcguacuugccggggcguuguguaauucuaaccccgagcugguucgagccgugacccucgaagcaccuuuccuggauguccuuaauacgaugauggacaccacacugccauugacucucgaggaacuggaggaguggggaaacccguccagcgaugaaaagcauaaaaauuauaucaagcgcuacugccccuaucaaaacauuaaaccucagcacuacccaucgauccauauaaccgcuuacgagaaugacgaaagagugcccuuaaaggguauugucucuuauacagagaaacugaaggaagccaucgcugagcacgccaaagauacuggcgagggguaccagaccccuaacaucauucuagacauccagccaggaggcaaucacgugauugaagauucccauaagaagauaacagcacaaaucaaauuucucuaugaggaacugggucuugacucaaccaguguuuucgaggauuugaagaaauaccugaaguuuuga

SEQ ID NO: 61139 - RNA, 4980 nt, Artificial Sequence
  derived and/or modified sequence opt3 from PREX1__Homo_sapiens__NP_065871
auggaggcccccagcggcuccgaaccugggggagacggugcuggcgauugcgcacacccagacccgagagcccccggggcggcugccccuucuucaggaccaggccccugugcagccgcuagggagagugaacggcagcugcgccuccgacuuugcgugcugaacgagaucuuggguaccgaacgugauuacgucgggacauuaagauuccugcaaagcgcauuucuacauaggauucggcagaauguugccgacuccguggagaagggacucacugaggaaaacguaaaagugcuguucucuaauauagaggauauccuugaaguccacaaggacuuucuggcugccuuggaguauugucuccauccugagccacagucgcagcacgaacugggcaacguguuccugaaauuuaaggauaaauucugcguuuacgaggaauauuguucaaaucaugagaaggcgcuccgcuuacugguggaacuuaacaagauucccacggucagagcauuuuugcugagcugcaugcuacucggcgggaggaaaaccacagacaucccucuggagggauaccuucugaguccaauucaacggaucuguaaguauccguugcuccugaaagaguuagccaagcgcacucccgguaaacacccugaucacccagcugugcaguccgcccugcaggcaaugaagaccguaugcucuaauauaaacgaaacaaagcgacagauggagaaacucgaagcucuugagcaacugcagagccauaucgaaggcugggagggguccaauuugaccgacauuuguacucagcuacugcuccagggaacacugcuuaagaucucagccggcaacauucaagagagagcguucuuucuguucgauaauuugcucguuuacugcaaaaggaagagucgggugaccgguagcaaaaagucuacgaaacguacuaaguccaucaacgggucacuguauauauuucgcggaagaauuaauaccgaagucauggagguggaaaacguggaggacggcacagccgauuaccacagcaauggcuacacugucaccaacggguggaagauccauaacacagcuaaaaauaagugguucguuuguauggcuaaaaccgccgaagagaagcagaaaugguuagacgcuauuaucagggagcgggaacagcgagagagucugaagcuaggaauggaacgcgacgccuaugugaugaucgcagagaagggugagaaacucuaccacaugaugaugaacaagaaaguaaaucugauuaaggauagaaggcggaaacuuucuacggugcccaagugcuuuuugggcaacgaguucgucgccuggcugcucgagauaggggaaaucuccaagacugaggaaggagugaaucugggccaagcacuucuggagaacgguauuauccaccauguuagcgacaaacaccaguucaagaaugaacaggugauguaucgcuuuagauacgaugacgggacauauaaagcgaggucggaauuggaggauauaaugucuaagggcguccgucucuacugccggcugcauuccuuauauaccccugugauuaaagaccgagauuaccaccugaagacuuacaagucaguacuaccaggaaguaaacucguugacuggcugcuugcacagggcgauugucaaacaagagaagaggccguggcuuugggggucggacugugcaacaaugguuucaugcaucacgugcucgaaaagagcgaguuuagggacgagucccaguauuuccgcuuucacgccgaugaagagauggaaggcaccucuagcaaaaacaagcagcugcggaaugacuucaaauuagucgagaacauccuggcaaagagacuuuugauccucccccaggaagaggacuacggguuugauauugaggagaaaaauaaggccgugguugugaagucaguacaaaggggaagucuggcugaagucgccggccuacaggugggucgcaaaaucuauuccauuaacgaagaccugguuuuccuccgaccguuuagcgagguggagucuauacugaaucagucauucuguagucggcguccucuuagauugcuggucgcaacgaaggcgaaagaaaucauuaagauccccgaucagccagacaccuuaugcuuucaaauccgcggggcugccccucccuacguguaugcaguaggcaggggaagcgaggccauggcugccggccucugugcagggcagugcauucugaaagugaacggauccaacguuaugaaugauggugcuccagaaguccuugagcauuuccaggccuuucggucuagaagggaagaggcgcugggcuuguaccaguggauauaucacacacaugaggacgcccaagaagcucgagcaucgcaggaggccagcacugaagaucccuccggggagcaggcucaagaagaggaccaggccgauucagcauucccucuccugagucuaggaccacgccugucucucugugaggacagcccgauggugacccugacaguggauaacguccaccuugaacacggcguuguguacgaguacguguccacugcggguguacggugccaugucuuggaaaagaucguggagcccagaggguguuucggccugaccgccaagauuuuagaggcuuuugccgcaaaugacucaguuuucguggaaaacugcaggcgucucauggcucugagcucugccaucgucacaaugccucacuuugaguuccgcaauauuugugauaccaaacuugaauccaucggacagcggauagcaugcuaucaggaguuugccgcucaacugaagaguagagugagcccacccuucaaacaggcgccucuagaaccacauccccucugcggccuggacuuuuguccgacuaacugccacaucaauuugauggagguuucuuacccuaagacgacaccauccguggggaggucauucaguauucgauuuggacggaaacccagccugaucggcuuagacccugagcagggucaucucaaccccaugucguauacccagcacuguauuacuaccauggccgcaccauccuggaagugccugccugcugccgaaggggauccccaaggacagggccuucacgacgguucuuucggcccagccagcgggacacugggacaggaggaucgcggcuugucauuucuccugaagcaggaagacagagagauccaagaugcuuaccuacagcuguucaccaaacuugacguagcacucaaggaaaugaaacaguaugucacucaaauaaauaggcuguugaguacaauuacggagccgaccuccgggggaucuugugaugccagccuggcggaggaggcuuccucauuaccucucgugagcgaagaaagugagauggaccggucugaucauggcgguaucaagaaagugugcuuuaaggucgccgaagaggaccaggaggauuccgggcacgacacuaugagcuaccgagauucguauucagaauguaacucuaauagagacaguguucuguccuacacaagcgugcgcucuaacagcuccuaccuuggaucagacgagaugggcaguggugaugaacugcccugcgacaugaggauuccaagcgauaagcaggacaaauugcauggcugucucgagcaccuguucaaucagguagauucuaucaacgcacuacugaaggggcccgugaugucccgugccuucgaagagaccaaacauuuuccuaugaaucacucacuucaagaguucaagcagaaagaagagugcacaauacggggaagaagucucauccagauuagcauccaggaagacccauggaaccugcccaacuccauuaagacuuuggucgauaauauccaaagguauguggaggacggcaaaaaccaguuacugcucgcucugcuuaaguguaccgauacggagcugcaguugcgccgagacgcaauauuuugccaggcccuaguugcggcugugugcaccuucucugaacaacugcucgccgcacugggguacagauauaauaacaauggagaguacgaagagucgagccgggaugccucaaggaaguggcuugaacaggucgcugccacaggcguguuacugcacugucagucccucuugaguccugcaacuguuaaagaggagcgcaccaugcuggaagacauuugggugacacucucugagcuggacaacgucacuuuuagcuucaagcagcuugaugaaaauuauguagcuaacaccaauguguuuuaccauaucgaggguucccgucaagcccugaaaguuaucuucuauuuggacucauaccacuuuucuaagcuaccgagcagacuggaagggggagcgagucuccgguuacauacggcccuguucacaaaagugcuugagaacgucgagggccugccaucccccgguagccaggcagcugaagaucuccagcaagacauuaaugcccagucuuuggagaaggugcagcaguacuauaggaagcugcgcgcuuuuuaccucgaacgaucaaaccugccuaccgaugcauccacuacagccguaaaaaucgaccaacuuauuagaccaauaaaugcccuagaugagcugugccgguugaugaagaguuucgugcaccccaaaccuggcgcugcggggagcgucggagcaggcuuaaucccgauuucgucugaacuguguuauaggcucggggccugccagaugguuauguguggaaccggcaugcagcgcuccacucugagcgugucacuugagcaggcugccauccuggcaagaagucacggucucuugcccaagugcauuaugcaagccaccgacaucaugaggaaacaggggccacggguggagauacuggcuaagaaccuacgugucaaggaucagaugccucagggagcgccccgccuguaccgacucugucaaccaccuguggacggcgaucuuuga

SEQ ID NO: 61140 - RNA, 4821 nt, Artificial Sequence
  derived and/or modified sequence opt3 from PREX2__Homo_sapiens__NP_079146
augagcgaggacuccagaggcgauucuagggccgaaucagcuaaggaccuggagaaacagcuccggcuucgcgugugcguccugagugaauugcaaaagaccgagcgagauuacguugggacauuagaauuucuggugagcgcauuucuacaccguaugaaccagugugccgcguccaaaguagacaagaaugugacugaggagacggucaaaaugcuauucucuaacaucgaagauauucuggcugugcauaaggaguuucuuaagguuguggaagagugccugcaccccgagccuaaugcccagcaggaagucggaaccuguuucuugcauuuuaaagacaaguucagaauauaugaugaguacugcucgaaccacgaaaaagcacaaaagcuccugcuggagcucaauaaaaucaggacaauucggacauuuuuacugaacuguaugcuuuuggguggccgcaagaauaccgacgugccacuggaaggguaucuaguaacaccgauccagagaauuugcaaguacccccucauccugaaagagcuucugaagaggaccccucggaaacauucagauuaugccgcuguuauggaggcauugcaggccaugaaggcuguguguagcaacauaaaugaagccaaacgccagauggagaagcucgaaguccuggaggaauggcaaagucacaucgagggaugggagggcuccaacauuacugacacaugcaccgaaauguuaauguguggugugcugcucaaaaucucuagcgggaauauucaggagcgaguguucuuucuuuucgauaaccuguuggucuacugcaagagaaagcacaggcggcucaaaaauuccaaggcgucaacggacggacaucguuaucuguuucgcggcagaaucaacacugaaguuauggagguggaaaauguagaugacggcaccgcagacuuccacaguagcgggcauauaguggucaacggauggaaaauucacaacacagccaagaauaaaugguuuguguguauggcuaagacuccagaggagaagcacgaaugguucgaggccauccucaaagaaagggagcggcgaaagggucugaaacuuggcauggagcaggauaccuggguuaugauuucugaacagggggagaagcuguacaaaaugaugugccgccaaggaaacuugaucaaggacagaaagaggaaacucacaaccuuccccaagugcuuucugggcuccgaguucgugucaugguuacuggaaaucggugaaauucaucggccugaggaggggguccaccuaggacaggcacuccuggaaaauggcauaauccaucacgugacggauaaacaucaguuuaagccagagcaaaugcuuuaccgcuucagauaugacgauggcacuuuuuaccccaggaacgaaaugcaggacguaauuagcaaagggguucguuuguauugucggcugcacagucucuucacaccugugauccgagauaaggacuaccaccugagaaccuauaagucugucgugauggcuaauaaacuuauagauuggcugauugcccagggagacugcaggacucgcgaggaagcgaugaucuuuggugucggcuugugugauaacggguucaugcaucacgugcucgagaaguccgaguuuaaagacgaaccacuguuauuccgguuuuucagcgacgaggaaauggagggaucgaauaugaagcauagacugaugaaacacgaucuaaagguuguggaaaacguaaucgccaaaucucuccugauuaaguccaaugagggcucauacgguuuugggcuugaggacaagaacaaagucccgaucauuaaguugguggaaaaaggcaguaaugcagagauggcuggaauggaaguuggcaagaaaauauucgccaucaacggggaucugguguucaugaggcccuuuaaugaggucgacugcuuccucaagagcugucugaacucccgcaagccuuuacgagugcugguaucuacaaaaccacgggagaccgugaagauucccgauagcgcugacggacuugguuuucagauccguggcuucgggccuucaguuguccacgccgugggaagaggcacgguggcagccgcugcggguuugcauccagggcaaugcaucauuaaagucaauggcauaaacguuaguaaggaaacccacgcauccgugaucgcccaugugacagcuuguaggaaauaucgccggcccacuaagcaggauagcauucaguggguauacaacucuaucgagucagcccaggaagaccuccaaaagagucacagcaaaccgccuggagaugaggcaggcgacgccuuugauugcaaggucgaagaggugauugacaaauucaauaccauggcuaucauagaugggaagaaagagcauguuucccugacaguggacaacguccaccuagaauacggagugguuuaugaguacgacucuacugccgguaucaaguguaaugugguagaaaagaugauugagcccaaaggcuuuuucucgcugaccgcaaagauccucgaagcgcuggcuaaaagcgaugagcacuuuguccagaacugcacaucccuuaauucauugaacgaggugauuccaaccgaccugcagaguaaguucucugccuuauguagcgaaagaaucgagcaucucugccagaggauauccucauauaaaaaguuuagccgagugcugaaaaaucgcgcauggccuacuuucaagcaagccaagucuaaaauuaguccccuucacuccagcgauuuuugcccaacgaacugucaugucaauguuauggaagugucuuaccccaagacauccaccucacuggggagugcuuucggaguacaguuggacagccggaaacacaacucgcaugauaaggagaauaaauccucugaacagggcaagcucagcccuaugguguauauccagcacacuauuaccacaauggccgcaccaucaggucugagucuagggcaacaggacggccacggacugagauaccuccugaaggaggaggaucuugaaacccaggacaucuaucaaaaauugcugggcaaguuacagacugcucucaaagaggucgaaaugugcgugugucagauagaugaccugcuuuccucuaucacauacagcccgaagcuggagaggaaaacguccgaggggauuauccccaccgauucagacaacgaaaagggagagcguaauagcaagcgcguuugcuucaacguggccggcgaugaacaggaggacaguggucaugacacuauuucuaaucgggauuccuacagcgacuguaacucgaacagaaauucaaucgcgucuuuuacaaguauaugcuccagccaauguucuagcuauuuccacuccgaugaaauggacucaggggaugagcuaccucucagugucaggauuagccaugacaaacaggauaagauccacucuugccuggagcacuuguuuucccagguggacucaaucaccaaccuguuaaaaggacaggccguugugcgagcuuucgaucaaacaaaguaccucacuccaggccggggucugcaggaauuucagcaggagauggaacccaaacuuaguuguccuaagcgccugagauugcauauuaagcaagacccauggaaucuccccagcuccgucaggacccuggcacagaacauccggaaauucguagaggaagugaagugccgacuacugcuugcccuccuggaguauucugauucggagacgcaguugagacgcgacaugguuuucugucaaacccugguggcuacagucugcgccuucagcgaacaguuaauggcagcgcucaaucagauguuugacaacucaaaagagaaugaaauggagacuugggaagccuccaggcguuggcuggaucagauugcuaacgccggcgugcuuuuccacuuucaaagucuguugucuccgaaucucaccgacgagcaggcaaugcuggaggauacucuaguagcucuguucgaccuugaaaaggugagcuucuacuuuaaaccuuccgaggaggaaccacucgucgccaacguuccccugacuuaucaggcagaggggucacggcaggccuugaagguguacuucuauauagauucuuaccauuuugaacaauuaccucagagacugaagaauggaggcggguucaaaauccaccccgugcucuuugcucaggcgcuggagagcauggaaggauacuauuacagggacaacgucaguguggaggaguuccaggcccaaauuaaugcagcuucccuugaaaagguuaaacaguauaaccagaagcugcgcgccuuuuacuuggauaaaagcaauucuccaccuaacucaaccuccaaggccgcuuauguagacaaacuaaugcgaccccugaacgcacucgaugagcuguacagacuuguggccaguuucauccggagcaagaggacggcggcuugcgccaauacagcauguucggccucuggcgucgguuuacuguccgugagcucagaacucugcaaccgcuugggggcuugucauauuaucaugugcaguucuggaguucaccguuguacccuguccgugacucucgagcaggcaauaauccuggccagaagccacggccuuccaccgcgguauauuaugcaagcgacagacgucaugaggaagcagggugcucgcgugcagaauaccgccaaaaaccugggcguacgagauagaacuccucaaucagcaccccgguuguacaagcuaugcgaaccacccccuccagccggggaggaauga

SEQ ID NO: 61141 - RNA, 1668 nt, Artificial Sequence
  derived and/or modified sequence opt3 from PRF1__Homo_sapiens__NP_001076585
auggccgcuagacugcuccuucugggcaucuuguuacugcuacucccccugccugugccagcaccgugccacaccgccgcgaggagcgaguguaagcggucccauaaauucguccccggggcuuggcuugccggagaagguguugacgugacaucucugcgccgaucaggcaguuuuccuguagauacucagcguuucuugagaccagacgggacgugcacccucugugagaacgcacugcaagaaggaacacugcagaggcuccccuuagcccugacuaauuggcgggcucagggcagcgguugccagcgccacgugaccagagcaaaggucuccucuacagaggccguggcuagggaugccgcgcggucgauucgcaacgacuggaaaguugggcuugaugugaccccuaagccaacuucaaauguccaugugagcguagcaggaagucacucccaagccgcuaacuuugccgcacagaaaacacaucaggaccaguacucuuucagcaccgauacgguugaaugucgauuuuauuccuuccacgugguccacacucccccuuugcauccagacuuuaagagagcucugggcgaucuaccgcaccauuucaaugccucaacccaacccgcguaccucaggcugauaaguaacuauggcacacacuuuauccgggccguggagcuugggggacguauuagcgcacugacugcuuugagaaccugcgagcucgcccuggaagguuuaacagacaaugagguggaagauugucugaccgucgaggcucagguuaacaucggcauucacgggucuaucuccgccgaggcaaaggccugcgaagagaaaaagaaaaagcauaaaaugacggcuucauuccaccagacuuaccgcgaaaggcauagcgaggugguaggaggccaccauacaaguauaaaugaccuccuuuuugguauccaggcggggccugaacaauauucugcaugggugaacucccugccaggaagccccggcuuggucgauuacacccuagagccucugcacgugcuccuggacucgcaggacccacggcgagaggcccuucgcagagcucugucucaguauuugacugauagggcccgguggcgcgacuguuccagacccugcccgccuggcaggcaaaagucaccccgugauccaugucagugcguuugccacgggagugcagugacaacccaggacuguugcccucggcagcgaggacucgcccaacuggaagucacguucauucaggcuugggguuuauggggcgauugguuuaccgccacagacgcauacgugaagcuguucuucgggggacaggagcuaagaacuagcaccguaugggauaauaacaaucccaucugguccguuaggcucgacuuuggcgaugugcugcuugcgacaggugggccauugcgccugcaggucugggaccaagauucuggccgggacgacgaucuccugggaacuugugaccaggcucccaaaagcggcucacaugaagugagaugcaaccuuaaucacgggcaucugaaguucagguaccacgcccgcuguuugccucaccucggaggugggaccugccuggauuaugucccacagauguuacugggcgagccgcccggaaaccgaaguggcgcagugugguga

SEQ ID NO: 61142 - RNA, 636 nt, Artificial Sequence
  derived and/or modified sequence opt3 from PRG2__Homo_sapiens__NP_001230174
augaagcugccccuccuucuggccuuguuauucggcgcugugagcgcacugcaccuaagauccgagaccucuacauuugaaacuccucucggggccaaaacgcugccagaggacgaagagaccccggaacaggagauggaggaaacacccugcagggagcuugaagaggaggaagaguggggaucagguagugaagaugcgagcaagaaagacggcgcugucgaguccaucucuguuccugauaugguggacaagaaccugacuuguccagaagaggaggauaccguaaaaguggucgggauucccggaugccaaacaugucgguacuugcucuuuaccugccgccgauguuaucguggcaaucuggugucgauacauaacuucaauaucaacuacagaauccagugcucaguuagcgcccugaaucagggucagguguggauugggggaaggauuacuggcaguggccggugucgcagauuccaaugggucgacggguccagguggaacuuugcauauugggccgcucaccagccuuggucucggggaggucauugcguggcacucuguacacgcggcgggcacuggagacgagcccauugcuuaaggcggcugccauucaucuguagcuacuga

SEQ ID NO: 61143 - RNA, 4092 nt, Artificial Sequence
  derived and/or modified sequence opt3 from PRG4__Homo_sapiens__NP_001121180
auggccuggaagacccugcccaucuaccuccuucuguuguuaagcguguucgucauucagcaaguuuccucucaggagcugucaugcaaaggcagauguuuugaaaguuucgagagggggcgggaaugcgacugugaugcucagugcaagaaauaugacaaguguugcccugauuacgagagcuuuugugcagaagugcacaacccaacauccccgcccucuucgaaaaaggccccuccacccucaggagcgagccagacuauaaagaguacgaccaaacgcuccccuaagccacccaauaaaaagaaaacaaagaagguaaucgagucugaggaaauuacugaggaacauagcguguccgagaaccaagagucaaguucuagcuccucaagcaguucuuccagcucgaccauccgaaaaauuaagucuuccaaaaauucagcugccaaccgugaacuacagaagaaacucaaggucaaagacaauaagaagaacagaaccaaaaagaaaccuacaccaaagccgcccgugguugaugaggcagguaguggccuggacaauggggauuucaaagugacuacaccugacaccagcacgacucagcacaacaaggucuccaccucuccaaagaucacaacugccaaacccauaaauccuaggccaagccuucccccgaacucagauaccaguaaggaaacaucccugaccgugaauaaagagacgacuguagaaacaaaggagaccacuacaaccaacaaacagacgagcaccgacggaaaggagaagacaacuucugcuaaagaaacccaaucaaucgagaagacaagugcaaaagauuuggccccuacuagcaagguucucgcuaaacccaccccaaaggccgaaacaaccacuaagggcccugcgcugacgacacccaaagagccaacccccacuaccccuaaggaaccagcauccacaaccccgaaagagcccacuccuacaacgauuaagucugccccaaccacucccaaagagccugcuccaacaaccacaaagucggcccccacuaccccgaaagaaccugcaccaacgaccacaaaggagcccgcuccuacuacccccaaggaaccagccccuacaacuaccaaagagcccgcgccaacgacaaccaagagcgccccgacuacaccuaaagaacccgcaccaaccacucccaagaaaccugcuccaaccacacccaaggagccugccccgacgaccccaaaggagcccacuccuacaaccccaaaagaacccgcuccuacaacuaaggagccggcccccaccacgccaaaagaaccugcacccacagccccaaagaaaccugcucccaccacuccaaaggagccggcgccuaccacacccaaggagccagcacccacuaccacaaaagaaccuuccccaacgacccccaaggagccugccccgacuacaaccaaaucagcuccaacuacaaccaaggaacccgccccuacgacuaccaaaagugcacccacaaccccaaaggagccuucucccacuacaaccaaggaaccagccccuacaacuccgaaagagcccgcuccaaccacgccuaagaaacccgccccaacaaccccuaaggagcccgcaccgacuaccccaaaagaaccugcgcccacaacuaccaagaaaccagcucccacgacaccuaaggagccggcccccaccacuccaaaggaaacagcaccuaccacucccaaaaagcugacaccuaccacgccagagaaacucgcccccacuaccccugaaaagccagcucccacaaccccggaggaguuagccccuacaacuccagaagaacccaccccuacgacaccagaggagcccgcaccgacuaccccuaaagcugccgcgcccaauacaccaaaggaaccugcccccaccacuccaaaggagcccgcuccuaccacaccaaaagagccggcacccacgacuccuaaggaaaccgccccaacaacccccaaagguacugcuccuacaacccugaaggagccagcccccacgacuccuaaaaagccggcaccaaaggaacuugcgcccacaaccaccaaagagccuacuagcacaaccuccgacaagcccgccccaacaacuccuaaagggacggcucccaccacaccaaaggagccggccccuacuacccccaaagaaccagcacccacaaccccuaagggaacugcuccaacgaccuugaaggagcccgccccuacaacuccgaaaaagccagcacccaaagaacuggccccuaccacaaccaagggcccaacuucaacaacgagcgauaaacccgcuccuaccacucccaaggagacagcgccaaccaccccgaaggaaccugcccccacaacuccuaaaaagccagcacccacgaccccagagacaccucccccgacuaccucugagguguccacaccaaccacuacgaaagaaccuacaaccauccauaagagucccgacgagagcacuccagaacuaucugcugagcccaccccuaaagcccucgaaaacuccccgaaggagccaggcguccccacaacuaaaaccccugccgcuacaaagcccgagaugacgaccacugcaaaggacaaaacaaccgaacgggaucugcgcacuacaccagagaccacgaccgccgcgccuaagaugacaaaagaaacugcuaccacaacugagaagaccacagaaucaaaaauuaccgccacuacgacacaggugaccaguacuaccacacaggacacgacccccuuuaagaucacuacacuuaagaccacuacacuggcaccaaaagugaccacaacuaagaaaaccauaacgaccacagagauuaugaauaagccugaggaaacugccaaaccgaaggauagagcuaccaacagcaaggcaacaacucccaaaccacagaagccuaccaaagcccccaagaaaccaacgucgacaaagaagccuaaaaccaugcccaggguccggaagccgaaaacuacaccaaccccucgcaagaugacuuccaccaugcccgaguugaacccaacaucucgaaucgcggaagcuaugcuccaaacgaccacuagacccaaucagacaccuaacagcaaacugguugaggugaaucccaagucagaggacgccgggggagcagaaggugagaccccacacauguuacugaggccucauguauucaugccggaagugacucccgauauggacuaucucccacgggucccuaaccagggcauuaucaucaaucccaugcuuagugaugagacaaacauuugcaaugggaaaccaguggacggacugaccacguugcguaacggcacccuaguugccuuucgcggucacuacuucuggaugcuguccccuuuuucucccccgagcccugcuagaaggauaacagaagugugggggaucccaucccccauugauacugucuucacccgguguaauugcgagggaaagacauuuuucuuuaaggacucacaauauuggcgauucacuaacgauaucaaagacgccggcuacccuaagccaauauucaaaggcuuugggggacucaccggucagauuguggcagcucugagcacagccaaguauaaaaauuggcccgagaguguauacuucuuuaagcgcggcgggucuauccagcaguacaucuauaagcaagaaccuguucagaaauguccaggaagaaggcccgcgcuuaacuacccgguguauggcgagacgacucagguccggcgcagaagguucgaacgugccauugguccuucccagacccacacaauccggauucaauacagccccgcacgacuggcuuaucaggacaaggggguguugcauaaugaggucaaagugucgauacucuggagaggccugccaaacguugugaccucagccaucucuuuacccaauauuaggaagccugauggauacgacuauuacgcuuuuaguaaagaucaguacuauaacaucgacguaccaucccgcacugcacgggccaucacaaccagaagcggccagacgcugucuaaggucugguacaacugccccuga

SEQ ID NO: 61144 - RNA, 564 nt, Artificial Sequence
  derived and/or modified sequence opt3 from PRH1__Homo_sapiens__NP_001278243
augcugcucauccuucugagcguggccuuguuagcuuucuccucugcacaggaccugaacgaggaugucucacaagaagacguuccccuagugauuagugauggcggggacagcgagcaguuucucgaugaagagagacagggaccuccacuggguggccagcaaucccagccgucugccggggacggaaaucaggaugacggcccccagcaagguccuccacagcagggcggacagcaacagcaggggcccccuccaccccaaggcaagccucaggggccaccgcagcagggaggucaacagcagcaggggcccccuccaccccaaggcaaaccucagggaccaccccagcagggcggucacccgccucccccacaagggaggccucagggacccccacagcagggcggccauccccggccuccacgcgggcgaccgcaaggacccccucagcaggguggccaccaacaggggccacccccuccacccccgggaaagccucagggcccacccccucagggugggcguccccaaggcccaccucagggacagucgccccaguga

SEQ ID NO: 61145 - RNA, 501 nt, Artificial Sequence
  derived and/or modified sequence opt3 from PRH2__Homo_sapiens__NP_001103683
augcugcucauccuucugagcguggccuuguuagcuuucuccucugcacaggaccuggaugaggacgucucacaagaagauguuccccuagugauuagugacggcggggauagcgagcaguuuauagacgaagagagacagggaccuccacucgguggccagcaaucccagccgucugccggggauggaaaccagaaugacggcccccagcaagguccuccacagcagggcggacagcaacagcaggggcccccuccaccccaaggcaagccucaggggccaccgcagcagggaggucaucccccuccaccccaaggcaggccucaggggccaccccagcagggaggccacccgcggccuccccgcggucgaccacaagggccuccccagcagggaggccaccagcaaggcccacccccuccaccgcccgggaaaccucagggaccacccccucaggguggccguccacaggggcccccgcaaggacagucgccucaguga

SEQ ID NO: 61146 - RNA, 2496 nt, Artificial Sequence
  derived and/or modified sequence opt3 from PRICKLE1__Homo_sapiens__NP_001138354
augccccuggagauggaaccuaagaugagcaaacucgccuucggcugccagagauccucuaccucagacgaugacagugggugugcucuugaggaauacgcaugggugccaccgggacugaggcccgagcaaauccaguuguauuuugccugcuuaccugaagagaaggucccauacguuaacagccccggugagaaacaccggauuaagcagcugcuauaucagcucccuccacaugauaaugaagugcgcuacugucaaucccugucugaggaagagaaaaaggagcuucagguauucucggcgcagcgaaagaaagaagcucugggccgugggacaauaaaguugcucucaagagccgugaugcacgcagucugcgagcaguguggacugaaaaucaacggcggugaaguggccguuuuugcuagcagggcagggcccggagugugcuggcauccuaguuguuucgucugcuuuacuuguaaugagcugcucguggacuuaauuuauuucuaccaagauggcaagauccacugcggccggcaucacgccgaacugcuuaaaccacgcuguuccgcuugcgacgagauuaucuuugccgaugagugcacggaagcggaggggagacacuggcauaugaagcacuucuguugcuuggaaugugagaccguacugggaggucagagguauauaaugaaggacggccggccguuuugcugugggugcuucgaaucucuauacgcagaguacugugagacaugcggagaacauaucggcguugaucacgcccagaugacuuaugacggucagcacuggcaugcuaccgaggccuguuuuagcugcgcacaauguaaggcuucccuccuggggugccccuuccuuccuaagcagggacagauuuacugcucaaaaacauguagucugggcgaagaugugcacgccagcgacucuuccgauucagcguuucaaagcgcccgcagucgagacucuagaagguccguccggaugggcaagagcucgcguucugcagaccagugccgccaguccuugcuccugucaccagcuuuaaacuauaaauuccccgggcugaguggaaaugccgaugacacccucagcagaaaacuugaugaccuguccuugucuaggcaggguacuagcuucgcuucagaggaauuuuggaaaggccggguggagcaagagacaccugaagauccagaggaaugggccgaccaugaggauuacaugacccagcuacugcucaaguucggggacaagagucuguuucagccccagccgaacgagauggauauccgagcauccgaacacuggauuagcgacaauauggugaaaucuaagacggagcuuaaacaaaacaaucagucacuggccaguaagaaauaucagagcgauauguacugggcucagucccaagacggauugggcgacucugcguaugguucgcauccugggcccgcaagcucccgcagacuccaggaacuggaguuagaucacggcgccucaggauacaaccacgacgaaacucagugguacgaggauagucuggagugucuaucugaccucaagccagaacagagcgucagggauuccauggacucacuggcucuuagcaauaucaccggcgccucuguugauggggagaacaagccucggcccuccuuguauagucugcaaaauuucgaagagauggaaacagaggacugcgagaaaaugagcaacaugggaacucucaauucuuccaugcugcaucgcucagcagaaagucuuaagagccugucguccgaguuguguccagagaaaauacuccccgaggaaaagccugugcaucugccaguauuaagaaggucuaaaagccagucacguccgcagcaagugaaguuuagugaugacgucauugauaacgguaacuacgacaucgagauucggcagcccccuauguccgagcgaaccagaaggcgcguguauaauuucgaagaacggggcucuagaagccaccaccacaggcgccgacggucccguaagucaagaagcgauaacgcccugaaucuaguuacagaaaggaaauacaguccaaaggaccgccuccggcuguauacccccgacaacuacgagaaauuuauccagaauaagucugcuagagagauccaggccuauauucaaaacgcagaucuuuacgggcaguacgcgcaugcuacguccgacuauggauugcagaauccuggcaugaacagguuccugggucucuacggggaagaugacgauagcuggugcucgucaucuaguuccagcucugacagcgaggaagagggcuauuuucugggacagccaauaccccaaccgcgaccucagcgcuucgccuacuauacugaugacuuauccucaccacccagugcacugccuacaccccaguuuggccagcggaccacuaaaagcaagaagaaaaaggggcacaaaggaaagaauuguaucauuucuuga

SEQ ID NO: 61147 - RNA, 2535 nt, Artificial Sequence
  derived and/or modified sequence opt3 from PRICKLE2__Homo_sapiens__NP_942559
auggugaccgucaugccccuggagauggaaaagacaaucagcaaacucauguucgacuuucagagaaacuccacuucugaugacgauucaggcugcgcccuugaggaauacgcuuggguuccuccagggcugaagccggagcaagugcaccaguauuacaguuguuugcccgaagagaaaguaccuuaugugaauagcccaggagagaaguuaaggauuaaacagcugcuacaucagcugcccccucacgacaacgaaguccgguacugcaauucccucgaugaggaagagaagcgcgagcuuaagcuguucucuucgcaacgaaaacgugaaaacuuggguagaggcaaugugaggccauuucccguuacgaugaccggggcaauaugugagcagugcggaggccagaucaacgguggggacauugccguguucgcgucacgggcuggacauggcgucuguuggcacccuccaugcuuuguguguacaguaugcaaugaacuccugguugaucugaucuauuucuaccaggacggcaagauuuauugugggcgccaucacgccgagugccucaaaccgagaugugcagccugcgaugaaaucauauuugcugacgagugcacugaggcagaaggaaggcacuggcauaugaagcacuucuguugcuuugagugugaaaccguguuagguggccaacgguacaucaugaaagaggggcgccccuacugcugucauugcuucgaaagccuguaugccgaguacugugauacaugcgcucagcacauuggaaucgaccagggccagaugaccuaugauggucaacacuggcaugccacugagacauguuuuugcugugcgcacugcaagaagagucuuuuggggcgaccuuuccugccaaaacagggacagaucuuuugcuccagagcauguucugccggcgaagaccccaacggcagcgacuccucagauagugcuuuccaaaaugccagggcaaaggagagccggcguucugcuaaaauugggaagaacaaaggaaagaccgaggagccuaugcuaaaucagcauucccagcuccaggucucaagcaaccgccugagugccgacguggauccacuuucucugcaaauggacauguugucccucagcucgcagacgcccucucugaauagagauccgauauggaggucccgggaggaaccuuaccacuaugguaacaaaauggagcagaaucagacucaaucacccuuacagcugcucagucagugcaacauucgaaccagcuacuccccaggcgggcagggagcgggcgcccaaccugaaaugugggguaagcauuucucuaaccccaagcgcagcucaagucuugcaaugacagggcacgcuggcuccuuuaucaaagaguguagagaagacuauuacccaggaaggcugcggagccaggagucuuacucagauaugaguagccaguccuucucugagacucgcggcucgauucaggugcccaaguaugaagaggaagaggaagaggaagggggauugagcacccaacagugcagaacaaggcacccuaucuccucacuaaaauacaccgaagacaugacgccaacugagcagacaccgcgugguaguauggaaucucuggcccucagcaaugcuaccggccuguccgccgaugggggagcaaagcggcaagagcaucuuucacgauuuagcaugcccgaccugucuaaagauuccggcaugaacgucagugaaaaguugagcaauauggguacucucaacucuuccaugcaguucagaucagccgagaguguuaggagccuguuaucggcucagcaguaucaagagauggaagggaaucugcaccagcuauccaacccuaucggcuaccgcgaccuccagucucauggacggaugcaccagagcuuugacuucgauggcgggauggcgggaucaaagcugccaggucaagagggcgugaggauucagcccaugagugaaagaacacgccgacgggcaaccucccgugacgauaauagaagguuucgcccucaccggucuagaaggagccgacgcucccggucagacaacgcccuucauuuggcuagcgagagagaagccauaaguaggcugaaagaucguccaccccuccgcgcacgggaggacuaugaucaguucaugagacagaggucuuuucaagaguccauggggcacggaagccgacgggaccuguacggccaguguccgcgcacgguaucggaucuugcccugcagaaugcuuucggugacagaugggggccuuauuuugccgaauacgauuggugcucaaccuguucuaguuccagcgagucugacaacgaaggcuacuucuugggagagccaaucccccaaccugcaaggcuccgguaugugacaagcgaugagcuguuacauaaguacuccucauauggccugcccaaaaguagcacucuagggggacgaggccagcuccacucuagaaagcgccagaaauccaagaauugcauuaucucauga

SEQ ID NO: 61148 - RNA, 1155 nt, Artificial Sequence
  derived and/or modified sequence opt3 from PRICKLE4__Homo_sapiens__NP_037529
augagcgugcagaacuccggcuggccccaccaagaggacucuccuaagccacaggauccggggcccccugccaauucagacagugauagcggacaucugccaggugaagaccccgaggauacccacgcucagggcccugcagugcucucccuugggucucugugcuuggacacaaaccaggccccaaauuggacuggauuacaaacgcugcuacagcagcugcccccucaggauaucgacgaaagauacugucucgcgcuuggcgaggaagagagggcugagcugcaauuguucugcgcccggcgcaaacaggaagcacucggucaggggguugcccgacuggugcugccaaagcucgagggacauaccugugaaaaaugccgugaguuacugaagccgggcgaguauggcguauuugcugcaagagccggggaacagagguguuggcaccaacccugcuucgcuugucaggccugcggacaggcgcuuauuaacuugauauacuuuuaucaugauggucaacuguacuguggccggcaccacgcagagcuacuccgcccuagaugcccagccugugaccagcugaucuucucguggaggugcacagaagcugaggggcagcgguggcaugaaaaucacuuuugcugucaggauugcgccggaccccuuggcggugggcgcuaugcacugccuggaggcucaccauguugccccagcuguuucgagaaccgauacagugacgcuggcuccucuugggccggggcguuggagggacaagccuuucucggugaaacuggccuggauagaaccgaggggagggaccagacaagcgucaauuccgcaaccuuaucacggacucugcucgcugccgcuggaggcaguagccuucagacacagcguggucugccggggucuuccccucaacaggaaaaccgccccggcgacaaagccgaggcaccaaagggacaggaacagugcagauuggagaccauuagggauccuaaggacacgcccuucucaacuuguagcaguucuuccgauagcgagccagaaggcuuuuuccuaggggagcggcugccccaaucguggaaaaccccuggaucucuccaggccgaagacuccaaugcuucaaagacacauugcacuauguguuga

SEQ ID NO: 61149 - RNA, 1263 nt, Artificial Sequence
  derived and/or modified sequence opt3 from PRIM1__Homo_sapiens__NP_000937
auggagaccuucgaccccacagaacugccugagcuccuuaagcuguacuauagaagguuguuuccauacagccaguauuaccggugguuaaacuauggcggggugaucaaaaauuacuuccaacaccgcgaauuuuccuucacucugaaggaugacauuuauauacgauaccagucuuuuaacaaucagucagaucuagagaaagaaaugcagaagaugaacccguacaaaaucgacauuggagccgucuauagucaucgucccaaucaacacaacacgguuaagcucggugcuuuccaggcacaggagaaggagcugguguuugauaucgacaugaccgauuacgacgauguaagaaggugcuguagcuccgccgacauuugcccuaaauguuggacacuuaugacuauggcgauccggauaaucgaucgcgcucugaaggaagacuucggcuuuaaacauagauuguggguguauucugggaggcggggaguccacugcugggugugugaugagucgguucgcaagcucucaagcgccgugcgaaguggcauugucgaauaccugucccuggugaaaggugggcaggacguaaagaagaaaguucaucucucugagaagauccacccauucauuagaaaaagcaucaauauaauuaagaaauauuuugaggaauacgcauuagugaaccaagacauccuggagaauaaggaauccugggauaaaauucuugccuugguccccgagaccauccacgacgaacugcagcagucauuccagaagagucauaacagccuacaaaggugggagcaccucaagaaaguggcuucucgguaucagaauaacaucaagaaugauaaauacggaccuuggcuggagugggaaauuaugcuucaguacugcuuuccacgucuggacauaaacguguccaagggcaucaaucauuugcucaaaucacccuucagcguccacccuaagacaggccgcauuaguguuccaaucgaucugcaaaagguggaccaguucgauccguuuaccguacccacuauaucuuucauuuguagagaguuagacgcaaucuccacaaacgaagaggaaaaagaggagaacgaagccgagagcgaugugaagcacaggacccgggacuauaaaaagacgucgcuggcuccuuacgucaaaguguuugaacauuuccucgagaaucuugauaagucucgaaagggggaacuguugaaaaaguccgaccuacagaaagacuuuuga

SEQ ID NO: 61150 - RNA, 462 nt, Artificial Sequence
  derived and/or modified sequence opt3 from PRIMA1__Homo_sapiens__XP_011544946
augcugcucagagaccuugugcugaggcggggcugcuguuggagcuccuuguuacugcacugcgcccuacauccccucuggggguucguccagguuacccacggagagccucaaaagucuuguucaaaagugacagauaguugccgccauguaugucagugccgaccaccgcccccucugccacccccuccacccccuccaccgcccccucgucuucugagcgcuccagcacccaacuccacuucuuguccuacggaagagucgugguggucagguuuggugaucauuauagccgucugcugugcgagccucguguuucugaccguucuggugaucauuugcuacaaggcuaucaaaagaaagccacucaggaaagacgaaaauggcacaagugucgccgaguaucccauguccgcaucucagagcaacaaggggguggauguaaauaacgccguuguguga

SEQ ID NO: 61151 - RNA, 1683 nt, Artificial Sequence
  derived and/or modified sequence opt3 from PRIMPOL__Homo_sapiens__NP_689896
augaacagaaagugggaggccaaacugaagcagaucgaagagagggcuagccacuacgaacggaaaccccucuccucuguguaucgcccucgacuuucaaagccagaggaaccgcccaguauuuggcgucuguuccauagacaagcacaggccuuuaauuucgucaaaagcugcaaggaggacguucacguguuugcguuggaguguaagguaggcgaugggcagaggauauacuuagugaccacauaugcugaguucugguuuuacuauaaaucccggaagaaccugcuacauugcuacgaagucaucccugaaaaugccguguguaaacucuauuucgaccuggaguuuaacaagccagcaaaucccggagccgaugguaaaaagaugguugcacuucugauugaguacgugugcaaggcauugcaggaacucuacggcgucaacuguucugccgaggacgugcugaaucuggauucgucaacugacgaaaaauucagccgccaccucaucuuucaauuacaugauguagcuuucaaggacaacauucacguugggaauuuucugagaaaaauccuucagccugccuuggaucugcuaggaagugaggacgaugacuccgcgccagaaacgaccggccacgguuucccccauuuuucugaggcuccugccaggcagggguucagcuucaacaagauguuuacagagaaagcuacugaagaguccuggaccucaaauaguaagaaacucgaacggcugggaagcgccgagcagucuuccccagaucuuucauuccugguggucaagaacaauaugggcgaaaagcacuuguuuguggaccucggcguguauacacgcaaccgaaauuucagacuguacaaaagcaguaagauagggaaaagggucgcauuagagguuaccgaggacaacaaguuuuucccgauccaaucuaaagauguguccgacgaauaucaguacuuucugagcucgcucguaucuaacgugcgguucuccgauacucuucguauucugacaugcgagcccucacagaauaagcagaagggagucgguuauuuuaacaguaucggcaccagcguggaaacgauugagggguuccaauguuccccuuacccagaaguugaccauuuuguguugucucuagucaauaaagauggaaucaagggcgguauacgcagauggaacuauuucuuucccgaggagcugcucguguacgacauuugcaaauacagguggugugaaaauaucgggcgggcucacaagagcaacaauauuaugauccugguagaucuuaaaaacgagguuugguaucagaagugccacgacccuguguguaaggccgaaaauuucaaaucagauugcuucccacugcccgcggaggucugcuugcucuuucuguucaaggaggaagaggaauuuacuaccgacgaggccgaugaaacacgaaguaacgagacucagaauccgcauaaaccuucccccagccgcuuaucuaccggagcaucagcugacgccgugugggacaacggcaucgaugacgcuuacuuccuggaggccacagaagaugcagagcuagccgaagcugcggagaauagucuccugagcuauaacuccgaagucgacgagauuccagaugagcuuauaaucgaaguguugcaagaguga

SEQ ID NO: 61152 - RNA, 1680 nt, Artificial Sequence
  derived and/or modified sequence opt3 from PRKAA1__Homo_sapiens__NP_006242
augagaaggcugagcuccuggcggaagauggccaccgcugagaaacagaagcacgacggccgcgugaaaaucgggcauuacauucucggagauacacuuggugucggcacuuucgggaagguuaaagugggaaagcacgaacugacgggccauaagguagcagugaaaauauugaaccgacaaaagauccguucuuuagacgucguggguaaaauuagaagggagauccagaaucugaagcuauuucggcacccccauauuaucaaacucuaucagguuauaucaaccccuagugauaucuucauggugauggaauacgucagcgggggagagcuguuugacuauauuugcaagaacggccgccuugaugaaaaggaguccagaaggcuguuccagcaaaucuugucuggcguggacuacugucaccggcacaugguaguucaucgcgaucucaaaccagagaaugugcugcuggacgcccacaugaacgcgaagauugcugauuuugggcucucgaauaugaugucagacggagaauuuuuacgaacaagcugcgguaguccgaacuaugccgcacccgaggucaucuccggcagacuguacgccgggccugaaguggauauauggucuagcggagugauucuuuaugcuuugcuguguggcacucuaccauuugacgaugaccauguccccacccucuucaaaaagaucugcgacgguauuuucuacacaccucaguaccugaauccauccguuaucucacuucugaaacacaugcuccagguggaucccaugaagagggcaaccaucaaagacauucgggagcacgagugguucaagcaggauuugccuaaguaucuguuuccagaagacccgaguuacagcucuacuaugauagaugacgaggccuuaaaagaaguaugugagaaguucgaaugcuccgaggaggaagugcugucaugucucuauaaccguaaucaucaagauccccuugcugucgccuaccaccugaucauugacaaccgcagaaucaugaaugaggcgaaagauuuuuauuuggcaacaagcccuccagacaguuuccuagaugaccaucaccugaccaggccccauccugaacgggugccauuccucguugccgagacgccccgagcucgccacacucuggacgaacuuaacccgcagaagucuaaacaccagggggugagaaaggccaaguggcaucugggaauaaggucccagagccggccuaaugauauuauggcagaggucugccgcgcuaucaaacaauuggacuacgaguggaaggugguaaaccccuauuaccucagaguuaggcguaaaaauccagugaccucgacauacucuaagaugucccugcaguuauaucaggucgauucacggacuuaccugcuagacuuucgaaguaucgaugacgaaauuaccgaggccaaaagcggcacagcgaccccucaaagauccggcucugugagcaacuauaggucaugucagcgcagugauuccgacgccgaagcacagggaaagagcucugaggucucacucacgaguagcgugacuucccuggauucuucgcccguugaccuuacaccacggcccgggagccacaccaucgaguucuuugaaaugugcgcuaacuugauuaagauacuggcccaguga

SEQ ID NO: 61153 - RNA, 813 nt, Artificial Sequence
  derived and/or modified sequence opt3 from PRKAB1__Homo_sapiens__XP_005253966
augggcaacaccagcuccgagagagccgcucuggaaaggcacgggggacauaagacaccccggcgcgacucuucagguggcacuaaagauggggaccgaccuaagauccucauggauaguccagaggacgcagaucuuuuccacagcgaagagauuaaagccccggaaaaggaggaguuucuggcguggcagcaugacuuggaagugaaugauaaagcucccgcccaagcacguccuacggucuucagauggaccggaggcgguaaggagguuuacuuauccgggucuuuuaacaauuggucgaagcugccacuaacaaggucacacaacaauuucguggccauacucgaccugcccgaaggagagcaucaguauaaauuuuucguagauggccaguggacucacgacccuagcgagccaaucgugaccagucagcuuggcacagucaacaauauuauccaagugaagaaaaccgauuuugaaguuuucgacgcucugaugguggauucccagaagugcucugacgucagcgaguuguccucaagucccccugggccauaccaccaggaaccguauguguguaaacccgaggaacgguuucgcgcaccuccaauucugcccccucaucuccugcagguaauccucaacaaggacacuggaauaagcugcgauccagccuuacugcccgagccgaaucacguuaugcuuaaccauuuguacgcucugucuaucaaggacggugugaugguccuauccgccacacacagauauaaaaagaaauacgugaccacgcuccuguauaagccuauuuga

SEQ ID NO: 61154 - RNA, 1056 nt, Artificial Sequence
  derived and/or modified sequence opt3 from PRKACA__Homo_sapiens__NP_002721
augggcaacgccgcugcagccaagaaagggagcgagcaggaauccgugaaggaguuccuggcgaaagcuaaggaagacuuucucaaaaagugggagucucccgcccaaaauaccgcacaccuugaucaguucgaaagaaucaagacacugggaacugguucauuuggcagggucauguugguuaaacauaaggagacggggaaccacuacgccaugaaaauuuuagacaagcagaaagugguaaagcugaagcagauagagcauacccuaaaugaaaaacggauccuccaagcugugaacuucccuuuucuggucaagcuggaguucaguuuuaaagauaauagcaaccuguauauggugauggaauacguuccaggaggcgagauguucucccacuugcgccgaauuggucguuuuucugagccgcaugcaagauucuaugccgcucagaucgugcucacauuugaauaccugcacucgcuggaccucauuuauagggauuuaaagcccgagaaucugcuuaucgaccagcagggguacauacaagucacugauuucggauuugccaaacgggugaagggccgcaccuggacauugugcggcaccccugaauaucuggcgccagagaucauucuaucaaaaggguacaacaaggcaguagacuggugggcccucggaguucugaucuacgaaauggcugccgguuaucccccuuucuucgcagaucagccaauucagaucuacgagaagauagugagcggcaaagucagauuucccagucacuucuccucugaccuuaaggaucuguugaggaaucuccuucagguggacuuaacuaaacgguuugggaaccugaagaauggagugaacgauauuaaaaaucauaagugguucgcuacaaccgacuggaucgccauuuaucaacgcaaggucgaggcgccuuuuaucccaaaauucaagggcccgggugacacgagcaacuuugaugacuacgaagaggaagagauccgaguuuccauuaaugaaaaaugugggaaggaguucucagaguuuuga

SEQ ID NO: 61155 - RNA, 795 nt, Artificial Sequence
  derived and/or modified sequence opt3 from PRKACB__Homo_sapiens__NP_001287844
augagcgccagaaaguccucugacgcuucagcaugcaguagcuccgagaucucugauucguucgugaaagaauuucuggccaaggcgaaagaggacuuccucaagaaaugggaaaaccccacccagaauaacgcuggccuugaggauuuugaaaggaagaagacacuggggacuggaucauucggucgggucauguugguuaaacacaaggccacggagcaauacuaugcaaugaaaauuuuagacaagcagaaagugguaaagcugaagcagauagagcauacccuaaaugaaaaacgcauccuccaggccgugaacuuuccuuuccugguccgacuugaguacgcuuuuaaggauaauagcaaccuguauauggugauggaauacguuccaggcggggagauguucagucacuugcguagaauuggaagguuuuccgagccgcaugcacgguucuaugccgcucaaaucgugcucacauuugaauaccugcacucucuggaccucauuuaucgcgauuuaaaacccgagaaucugcuuaucgaccaucagggcuacauacaggucacugauuucgguuuugccaagagagugaaagggaggaccuggacauuguguggaaccccugaauaccuggcgccagagaucauucuaagcaagggcuauaacaaagcaguagacuggugggcccucggcguucugaucuacgaaauggcugccggguaucccccuuucuucgcagaucagccaauucaaaucuacgagaagauaguguccggaaagcagaauuuuuga

SEQ ID NO: 61156 - RNA, 1056 nt, Artificial Sequence
  derived and/or modified sequence opt3 from PRKACG__Homo_sapiens__NP_002723
augggcaacgcccccgcuaagaaagacaccgaacaggaagagagcgugaaugaguuccuggcaaaggccagaggggauuuucucuacagguggggaaacccugcgcaaaauacagcuuccucugaccaguucgagcggcuucgcacucuggguaugggcucauuugggcgagucauguugguucgucaccaggaaacgggaggccauuaugccaugaaaaucuuaaacaagcagaaagugguaaagaugaagcaaguggagcacauucugaaugagaaaagaauacuacaggcaaucgauuucccauuucucgucaagcugcaguucaguuuuaaagacaacagcuaccuuuaucuggugauggaauacguuccggguggggagauguucuccagguugcagcgggugggacgcuuuucugaaccccaugccugcuucuaugcugcacaagucgugcucgccguacaguaccugcacucgcuggaucucauucauagagacuuaaagccugagaaucugcuuaucgaucagcagggcuauuugcaaguuaccgacuuuggcuucgcuaaaagggugaaggggcggacauggacucuguguggaaccccagaguaccuagcccccgaaauuauccucucaaaggguuacaacaaagcggucgauuggugggcacugggcgugcuuauauaugagauggccgugggguuuccuccauucuacgcugaccagcccauccagauuuaugaaaagaucgucagcggacgcguucgauucccuaguaaacuguccucugauuugaagcaccuccugaggagcuuacugcaaguggaccucacaaaaagauuuggcaaucuucggaacgguguaggggauauuaagaaucacaaaugguucgccaccacuuccuggaucgcaauauacgagaagaagguggaagcuccauuuauuccgaaauauacaggacccggcgacgccucaaacuucgacgauuacgaggaggaagaacugcguaucaguauuaaugaaaagugcgcgaaagaguuuagcgaguucuga

SEQ ID NO: 61157 - RNA, 1023 nt, Artificial Sequence
  derived and/or modified sequence opt3 from PRKAG1__Homo_sapiens__NP_001193638
auggagaccgugaucagcuccgacucuucacccgccgucgaaaacgagcacccucaggaaacaccagagaguaauaacagcguuuacacuuccuucaugaagucucauagaugcuaugaucugauuccgacgucgucaaaacucgugguauuugacaccagccuucaagugaagaaagcauucuuugcucuggucacaaauggcgugagggccgcgcccuugugggauaguaagaaacaguccuucguuguguuacgggcucugucuuguccucuagggaugcucacuauaaccgacuuuaucaacauucugcaccgcuacuauaagagcgcccuuguccagaucuacgaacuggaggagcauaagauugaaacauggcgagagguguauuugcaggauuccuucaaaccacucguaugcaucucacccaaugcaagucuguuugacgccguuagcucucugauacguaacaagauccacagacucccugugauugauccagaauccggaaauaccuuauacauccugacucauaaaaggauucuuaaguucuugaaacuguuuaucacagaguuccccaagccugaguuuaugucaaagagccuagaggaacuccaaauagguaccuaugcuaacauugcaaugguccggacgacuaccccaguguacguggcccugggcaucuucguccagcaccgcguuagugcccuuccggugguagacgaaaaagggagaguggucgauauuuacucuaaguuugacgugaucaaucuggcugcggagaaaacauauaacaauuuggauguuuccgugacuaaggcacuccagcacaggagccauuacuucgaaggaguccugaaauguuauuuacacgagacccuggagacaaucauuaaccggcucguggaagccgagguacaucgccuuguuguggucgacgaaaaugauguggucaagggcauagugucgcugucugacaucuugcaggcucuaguucugaccgguggggagaaaaagcccuga

SEQ ID NO: 61158 - RNA, 1578 nt, Artificial Sequence
  derived and/or modified sequence opt3 from PRKAG2__Homo_sapiens__NP_001035723
augccccugcucgacggcgaucuugaggggagcggaaagcacuccucuagaaaaguggacucaccuuucgguccaggcaguccgagcaagggguuuuucuccaggggaccccagccucggccaucuucgcccaugucagccccuguccgcccaaaaaccagccccggcaguccuaagacaguuuuuccauucuccuaccaagaaucuccgccccgaagcccucguagaauguccuuuucagguaucuucaggaguagcucuaaagaguccucaccaaacagcaaucccgcuacgaguccugggggcauucgguuuuucucucgcuccagaaagacuagcggacugucgucuuccccaucaacccccacacaggugacuaagcagcauaccuuuccguuggaaaguuauaaacacgagccugaaagguuagagaaccggauauacgcaagcuccucucccccagauacaggccagcgcuucugcccuagcucauuucaaagucccacccgaccaccccuggccuccccuacucauuaugcgccaagcaaggcugccgcacuagccgcugcacucgggccggccgaggcuggaaugcuggaaaaacuugaguucgaagacgaggccguagaggauucugaaucagguguguacaugagauuuaugaggagucacaaguguuaugacaucguccccacaagcuccaaacuggugguuuucgauaccacgcuccaggugaagaaggcguucuuugcauuggucgccaauggcgugcgggcugccccucugugggagucuaaaaagcagucguucguagggaugcugacuauuaccgacuuuaucaacauucuccaucguuacuauaaaagcccaaugguucagaucuacgaauuagaggaacacaagauagagacauggcgcgagcuguaccuucaagaaacuuucaaacccuuggugaauaucuccccugaugcaucacuguuugacgcugucuauagucuaauuaagaacaaaauccacagacucccagugauugaucccaucucuggaaaugcccuguacauacuuacccauaagaggauucugaaguucuugcagcucuuuaugagcgacaugccgaaaccugcguucaugaagcagaaccuggaugaguuaggcaucgguacauaucacaauauugccuuuauccauccagacacccccaucauuaaagcacugaacauauucguggaacggcgaaucuccgcucucccugucguugacgagucagggaaggugguagauauuuacagcaaauuugacgugaucaaucuugccgcugaaaagacguauaacaaucuggauauaacugucacacaggccuugcaacaccgcucucaguacuucgagggagugguuaagugcaacaaacuagagauucuggaaaccaucguggacagaaucgucagggcagaggugcaccggcucguaguugugaaugaagccgauuccauugucggcaucauuagucugagcgacauacuucaggcucugaucuugacucccgcgggcgcaaagcaaaaagagacagaaaccgaguga

SEQ ID NO: 61159 - RNA, 1470 nt, Artificial Sequence
  derived and/or modified sequence opt3 from PRKAG3__Homo_sapiens__NP_059127
auggagcccggccuggaacacgcccucagaaggaccccuagcugguccucucuugggggaucagagcaucaggaaaugaguuuccuggagcaagaaaacagcuccucuuggccaucgccggcugugacaucaagcagugagcggauccgcgguaagcgacgugcaaaagccuugagauggacuaggcagaaguccgucgaggaaggcgagcccccugggcagggagaaggcccacggucucgccccgcggcugagagcacggguuuagaggccaccuuuccuaaaacaacuccacuggcacaggccgaccccgcugggguuggaaccccuccaacaggcugggauugccuaccguccgacuguaccgcaucagccgcuggcaguagcacugaugacguggaacucgccacagaguuccccgcgaccgaagcaugggagugcgaacuggaggggcuucuggaggaaagaccugccuugugucucucuccacaagcucccuuuccuaagcugggaugggaugacgagcugaggaaaccaggugcccagauuuacaugcgguucaugcaggaacacacgugcuaugaugcaauggcuacuuccucaaagcucguaauauuugacaccauguuagagaucaagaaagccuucuuugcgcugguggccaauggcguccgcgcagcuccccuuugggauagcaagaaacagaguuucguggggauguugacaauuacugacuuuauccugguucuacaucgauacuauagaucuccgcucgugcaaauuuacgaaaucgagcagcacaagauagagaccuggagggaaaucuaucugcagggauguuucaaaccucuugucuccauuagccccaacgauucgcuguuugaggccguguacacauugaucaagaaucggauucaucgucucccaguacuggacccuguuucuggcaacguguuacacauccugacccacaagcgccuccuuaaauuccugcauauauuugguuccuugcuacccagaccaucauuccuguauaggacgauucaggaucucgggaucggaacuuuccgggaccuggcugucgugcuugaaacagcccccauucugaccgcauuggacaucuuuguggaucgacgcgucagugcccucccuguugugaaugagugcggccaaguagugggccuguacagcagauucgacgucauccacuuagcugcgcagcagacuuacaaccaucuggauauguccgugggggaagcacuaaggcaacggacacucugucuggagggaguucuuucuugccagccacacgagagcuugggugaagugauugaccgcauagccagagagcagguccacaggcuggugcucguagaugaaacccagcaucugcuuggcguugugucacugagugacaucuugcaagcucucguccuguccccggccgggauugaugcauuaggagccuga

SEQ ID NO: 61160 - RNA, 1146 nt, Artificial Sequence
  derived and/or modified sequence opt3 from PRKAR1A__Homo_sapiens__NP_001263218
auggagagcggcuccaccgccgcuucugaagaggcaagaucacugagggaaugcgagcucuacgugcagaagcacaacauccaagcccuucugaaagacaguauuguccaguuguguacagcgcggcccgaacgcccuauggcuuucuuacgagaguauuuugagcgucuggaaaaggaggaagccaaacagauacagaaucuacaaaaggcagggacuagaacggauagcagggaggacgagaucuccccaccgcccccuaacccaguugugaaaggacggcgcagaaggggugccauuucugcugaaguauacaccgaggaagaugcagccucguaugugcggaaggucauccccaaggacuacaaaacaauggcugcccucgcgaaggcaauugagaaaaaugugcuguucucacaucuugaugacaacgaacgcagcgauaucuuugacgccauguucaguguuuccuuuauagcuggcgagacugugauccagcagggggaugagggagacaauuucuaugucauugaucagggcgaaaccgacguguacguaaacaaugagugggccacaucuguuggugaagggggcagcuuuggagagcuggcauugaucuauggcaccccucgagcugccacugugaaggcgaaaacaaacgucaagcucugggggauugauagagacuccuacaggcggauccugaugggaucaacccugcguaagcgcaaaauguacgaagaguuccucaguaaggugagcauauuagagucucuggacaaaugggaaagacuuacgguggccgaugcauuggagccaguccaauuugaagacggucagaagauuguugugcagggcgagcccggggaugaguucuuuaucauucuggaaggauccgcugccguacuacagaggcggucagagaaugaagaguucguggaagucggccgacucgguccuagcgacuauuuuggggagaucgcucugcuuaugaaccgcccaagagccgcaacugugguugccaggggaccgcugaaaugcgugaaguuggaucggccccgcuucgagagaguccucggcccuuguagugacauccugaaaaggaauauucaacaguacaacucuuucguguccuuaagcguauga

SEQ ID NO: 61161 - RNA, 1146 nt, Artificial Sequence
  derived and/or modified sequence opt3 from PRKAR1B__Homo_sapiens__NP_002726
auggccagcccucccgcuugcccauccgaggaagacgagucucugaagggcugugaacucuacgugcagcuucacgggauccaacagguccugaaagauugcauuguucauuuguguauaucaaagccggagagacccaugaaauucuuaagggaacacuuugagaagcuggagaaagaagagaaccggcagauccuagcacgccagaagaguaauagccaauccgacucucaugaugaagaggugucgccuaccccacccaacccuguagugaaggcccgacguagaaggggaggugucucagcggagguguauacagaagaggacgcuguuagcuacgugcggaaagucauuccaaaggauuauaaaacuaugacggcccucgcaaaggccaucaguaaaaaugugcuguucgcucaccuugacgauaacgaacgcuccgacauuuuugaugcaauguuccccguaacccauaucgccggcgagacaguuauacagcaggggaaugaaggagacaacuuuuacguggucgaucagggcgagguggacguguaugucaauggugaguggguuacuaacaucucugaagggggcagcuucggagagcuggcuuugauuuacggcaccccuagagccgcgacagugaaggcaaagaccgaucucaaacugugggggaucgacagggacuccuaucggcgcauucugaugggaucaacucuccgaaagagaaaaauguacgaagaguuuuuaaguaagguaagcauccuggaaucucuugagaaaugggagagguugacaguggccgaugcucuggaaccaguccaauucgaggacggugaaaagauagugguucagggcgagccgggggaugacuuuuacauuaucaccgaaggaacggccuccgugcuacagcggcguucacccaaugaggaguaugucgaagugggccgccucgguccuagcgauuacuucggggagauugcacugcuucugaacagaccaagggcugccacuguaguugcgcggggacccuugaaaugcgugaagcucgaccgaccucgcuuugaaagaguccugggcccauguagugagaucuuaaagaggaauauccagcgguauaacucuuucauuucccugaccguguga

SEQ ID NO: 61162 - RNA, 1215 nt, Artificial Sequence
  derived and/or modified sequence opt3 from PRKAR2A__Homo_sapiens__NP_004148
augagccacauccagauucccccuggccugaccgagcuccuucaaggguacacaguggaaguccugagacagcagccaccggacuugguugaguucgccguggaauauuuuacuagguuacgggaggcucgcgcacccgccuccguacugccugcggcuacgccacgacagucucuaggacaucccccuccagaacccgguccugaucguguggccgacgcaaagggcgauucagagagugaggaagacgaggaucucgaagucccagugccgagcagauucaacaggcggguuuccgugugcgccgagaccuacaaucccgacgaggaagaggaagauacagacccucgcgucauacacccaaaaacugaugagcaaagauguaggcugcaggaggcuugcaaggacauccuucuguuuaaaaacuuggaucaggaacagcucucucaagugcuggacgcaauguucgagcggauuguaaaggccgaugaacauguuaucgaccagggggacgauggagacaauuuuuaugugauugagcgcggcaccuacgauauccuggucacaaaagacaaccagacccgaucggugggucaguaugauaauagagggucauucggagaacucgcuuuaauguacaacacucccagggccgcgacaauaguggcaaccagcgagggcagucuguggggccuugaccgggucacguuucgucgcaucauuguuaagaauaacgccaagaaaagaaagauguucgaauccuuuaucgagucugugccuuugcugaaaagccuagagguauccgaaaggaugaagauuguggaugucaucggggagaaaauauauaaggacggagaacggauuaucacucaaggugagaaggcugauucauucuacauuaucgaaaguggcgaggugagcauccucauucgaucucgcaccaaauccaauaaggacgggggaaaccaggagguugaaauagccagaugucacaaaggccaguacuuuggugagcuggcacuugugacaaauaagccaagggcugccucagcguaugccgucggggaugugaaaugccugguaauggacguucaagcauucgaacgguugcucggacccuguauggacaucaugaagcgcaacauuagccauuacgaggagcagcuggugaaaauguuuggcaguucugucgauuuaggcaaucuggggcaguga

SEQ ID NO: 61163 - RNA, 1257 nt, Artificial Sequence
  derived and/or modified sequence opt3 from PRKAR2B__Homo_sapiens__NP_002727
augagcaucgagauucccgccggccugaccgaacuccuucagggguucacaguggagguccugagacaccaaccugcugacuuguuagaauuugcacugcagcauuucacuaggcuacagcaggagaacgaacggaagggaacggcccgcuuuggucacgagggccgaaccuggggagaucucggggcggcugccggcggugggacaccauccaaaggaguuaauuucgcagaggaaccgaugcaaucugacucagaggauggcgaagaggaggaagccgcucccgcagacgccggcgcuuuuaacgccccugugauaaaucguuucacuagaagggcgaguguaugcgcagaggccuacaacccagaugaagaggaagacgaugcugagagccggaucauucaucccaagaccgacgaucagcgcaauagacugcaggaggccuguaaagacauccuucuguuuaagaacuuggauccugaacagaugucccaagugcucgacgcaauguucgagaaacuggucaaggauggggaacacgugauugaccagggagacgauggugacaauuuuuauguuaucgauaggggcacauucgacauauacgugaagugcgauggggucggacggugugugggcaacuaugacaaucgcgguucuuuuggggagcuggcucucauguacaacaccccacgagccgcgacuaucacagccaccucgcccggagcauuauggggccuggauagaguaacguucaggcggauuaucguuaaaaauaacgcuaagaaacguaagauguaugaaucauuuauugagagccuuccuuucuugaaaagucuggaguucuccgaacgccuaaagguggucgacgugaucggcacuaagguguacaaugauggggagcagauaauugcccagggagacucugcugauagcuuuuucaucgucgaauccggugagguuaaaauuaccaugaagagaaaaggcaagucagaaguggaggagaacggggccguagaaaucgcaaggugcagucggggacaauauuuuggcgagcucgcccuggugacaaauaaaccacgagcugcgagcgcacaugccaucgguacugucaagugucuugcuauggacgugcaggccuucgaacgccuguuggggccgugcauggagauuaugaaaagaaacauagcaaccuacgaggaacagcucguugcccuguuuggcacaaacauggacaucguggagcccaccgcuuga

SEQ ID NO: 61164 - RNA, 2019 nt, Artificial Sequence
  derived and/or modified sequence opt3 from PRKCA__Homo_sapiens__NP_002728
auggccgacguguuccccggcaacgauagcaccgcuucccaggacgucgcaaauagauuugccaggaagggggcgcugcggcaaaagaacguucacgaggugaaggaucauaaauucaucgcucgcuuuuucaagcagccuaccuuuugcucucacuguacugacuucauuuggggauuugguaaacagggcuuccagugccaaguauguugcuuugugguccauaagcgaugucacgaguucgugacguuuucaugcccaggggccgauaagggaccggacaccgaugacccccguaguaaacauaaguucaaaauacacacauacggcagcccuacuuuuugugaucacugcgguucccuccuuuaugggcugauccaucagggaaugaagugugauaccugcgacaugaauguucacaaacagugugugauuaacgucccaucuuugugcggcauggaccauacagaaaagagaggcaggaucuacuuaaaggcagaaguggccgaugagaaacugcacguaaccguucgggacgcuaagaaucuaauucccauggacccuaacgggcucucggauccauaugugaaacugaaacuuauccccgacccuaaaaaugaaucaaagcagaaaacuaagacaauacgcagcacccugaacccacaauggaaugagaguuucacguucaaguugaaaccguccgauaaggacagaaggcucucugucgagaucugggauugggaccggacuacccgcaacgauuuuaugggaagccuguccuucggugugucagaacugaugaaaaugcccgcaaguggcugguacaagcucuuaaaucaggaggaaggggaguauuacaacgugccuauuccagagggagacgaagagggcaauauggaacugcgacagaaauuugagaaggccaaacuuggucccgcugggaacaaggucaucagcccuucugaagauagaaagcagccauccaauaacuuggacaggguuaaacugacagauuucaacuuucuaauggugcucggaaagggcucauucggcaaaguaaugcuggccgaccggaaggggacugaggagcuuuaugcgauuaagauccugaaaaaggacguggucauacaagaugacgauguggaaugcaccaugguugagaaacguguguuggcacuccuggacaagcccccguuuuuaacacagcugcacagcuguuuccagaccgucgaucgccucuacuuugugauggaauacguaaauggaggugaccuuauguaucauauucaacagguuggcaaauucaaggagccucaggccguguuuuacgcugccgaaaucaguauugggcuguucuuuuugcacaagagaggaaucaucuauagggaucuaaaacuggacaacgucaugcucgauucugagggccauauuaagauagcagacuucgguaugugcaaagagcacaugauggauggggugacgacucggacauucuguggcacccccgacuacaucgcuccagaaauuaucgccuaucagccuuacggaaaguccgucgauuggugggcguauggcgugcugcuuuacgagaugcuggccgggcaacccccauuugacggagaagacgaggaugaauuguuccagagcauaauggagcauaauguuucguaccccaaaucucucuccaaggaggcagugucaauuugcaaaggucugaugacuaagcacccugcuaagcgauuaggcugugggccagaaggagagcgcgacguaagagaacacgccuuuuucaggcggaucgauugggagaaacuggagaaccgcgaaauccagccgcccuuuaagccuaaagucugcggcaagggugcugagaauuucgacaaauuuuucacaagagggcagccagugcuaacacccccugaucaacucguuauugccaacaucgaccagagugauuuugaaggcuucagcuaugugaauccacaguuuguccaucccauucugcaguccgcaguguga

SEQ ID NO: 61165 - RNA, 2022 nt, Artificial Sequence
  derived and/or modified sequence opt3 from PRKCB__Homo_sapiens__NP_002729
auggccgaccccgcugcaggcccuccaccgagcgagggggaagaguccaccgugagauucgccaggaagggagcgcugcggcagaaaaacguccacgaaguuaagaaucauaaauuuacagcucgcuucuuuaagcaacccacuuucugcucucacuguacggauuuuaucugggguuucggcaaacagggguuucagugccagguguguugcuucguagugcauaagcgaugucacgaguuugucaccuucucaugcccuggagccgacaagggcccagcaagugaugacccccguagcaaacauaaguuuaaaauucacacauacuccucuccuacuuucugugaucacugcgguucgcuccuuuaugggcugauacaucaaggaaugaagugugauaccugcaugaugaacgugcacaaaagauguguuaugaaugugccaucauugugcggcacagaccauaccgaaaggcggggccgcaucuacauucaggcccacaucgacagagaugucuuaauugugcugguaagggacgcuaagaaccuaguucccauggauccuaaugggcucagcgacccauaugugaagcugaaacuuaucccggaucccaagagugaguccaaacagaagacuaaaacaauaaagugcucucugaacccugaguggaaugaaaccuuucgguuccaguugaaagagagcgacaaggaccgccgacucuccgucgaaaucugggauugggaccugacgucaagaaacgauuucaugggaagucugagcuuugguauuucugagcuccaaaaggcauccguggacggcugguucaaauuacugucacaggaggaaggggaguacuuuaaugugccaguucccccugaaggaagcgaggccaacgaggaacuuaggcagaaguucgagcgggcuaaaaucagucagggcacuaaggucccagaagagaaaaccacaaauacugugucuaaguuugauaacaaugguaaccgugaccgcaugaaguugaccgauuucaauuuucugaugguacuagggaaaggauccuucggcaaggugaugcucagcgaaagaaaaggcacagacgagcuguaugccgucaagauucuuaaaaaggaugugguuauccaagacgaugacguggaauguaccauggucgagaagagggugcuggcguugcccgggaaaccgccuuuucucacgcagcugcacucgugcuuccagacuauggaccgguuauacuuuguaauggaguauguuaacggaggugaucugauguaccauauacaacaggugggccgauucaaggaaccccacgcagucuuuuacgccgcugagauugccaucggacucuucuuccuucagucuaaagggauuaucuaucgcgaccugaaguuggauaacgugaugcuagacuccgaaggccauaucaaaauugcagauuuugguauguguaaggagaauauaugggacggggucacaaccaagacuuucugcggcacaccagauuacaucgcuccugaaauuaucgccuaucagcccuacggaaaaucaguggacuggugggcguuuggcguucugcucuaugagaugcuggccgggcaagcaccauucgagggagaagaugaggacgaacuuuuucagaguauaauggagcacaacguggcuuaccccaagagcauguccaaagaggccguagcuauuuguaagggucugaugaccaaacauccuggcaagagauuggggugcggaccagaaggcgagagggauaucaaagaacacgccuucuuucgguauaucgacugggagaagcucgaacgcaaggagauucagccgcccuacaaaccuaaggcaugugguagaaaugccgagaacuucgauagguuuuucacgcgucacccacccguccugaccccuccagaccaggaagugauccggaauauugaccaaucugaguuugaaggguucagcuuuguuaacucagaguucuuaaaacccgaagugaagaguuga

SEQ ID NO: 61166 - RNA, 786 nt, Artificial Sequence
  derived and/or modified sequence opt3 from PRKCDBP__Homo_sapiens__NP_659477
augagagagagcgcccuggaaaggggccccgugccugaggcuccagcagggggaccgguccacgccguuaccgugguaacacuccuugaaaagcuggcguccauguuggagacuuuacgggaacgccaggguggccuggcucgacgucaagggggacuagccggcucugugagaaggauccagucaggucucggggcacugagucggagccaugacacgaccuccaacacacuugcccagcuguuggcuaaagcagagcgcgucucuucgcacgccaaugcugcccaggagagagcggugaggcgggcagcccaaguucagcgccucgaagcuaaccauggacugcugguggcccgaggcaagcuccacgucuuacuguucaaagaggaaggcgaggugcccgcaucagcuuuucagaaggccccugagccacuugggcccgcggaucagagcgaauugggaccugagcaacuggaagccgagguaggugaaaguuccgacgaggagccaguugaaucuagagcacagaggcuacggcguacuggccuccagaaagugcagagccugcgcagagcucuuuccgggaggaagggacccgccgcuccuccaccgacccccgucaagccuccacggcugggccccggucgaucagccgaggcacaaccugaagcccagccagcuuuggagcccacacucgaaccggagccuccccaggauaccgaggaagacccagggcgcccuggagcggcagaggaagcccuguuacaaauggagaguguggcuuga

SEQ ID NO: 61167 - RNA, 2031 nt, Artificial Sequence
  derived and/or modified sequence opt3 from PRKCD__Homo_sapiens__NP_997704
auggcccccuuccugagaaucgcuuuuaacagcuacgagcucggcucccuucaggcagaagacgaggccaaucaaccuuucugcgcggugaagaugaaagaagcucugucuaccgagagggggaagacauugguccagaaaaagccaacuauguauccggaauggaaaucaacguuugaugcccacauuuacgagggacggguuauacagaucguguuaaugcgcgcagccgaggaacccguaagugaggugaccgucggugugagcguucuggcugaacgauguaagaagaacaauggcaaagcagaguucuggcuagaccuccagccucaagccaaggugcugauguccguccaguauuuucuugaggauguggacugcaaacagucuaugcguucggaagaugaggcuaaguucccaacaaugaacagaaggggagccauuaaacaggcgaagauccauuacauuaagaaucacgaauuuaucgcaacuuucuuugggcaacccaccuucuguucaguaugcaaagacuuuguuuggggccugaacaagcaggguuauaaaugucggcagugcaaugccgcuauacauaagaaauguaucgauaagauuaucgggcgcugcacaggaaccgccgcaaacagcagagacacuauuuuccagaaagagagguuuaauaucgauaugccucaccgguucaaggugcauaacuacaugaguccaacauucugugaccacugcggcuccuugcucuggggccuggucaagcaagggcugaaaugugaagauugcggaaugaaugugcaccauaagugccgcgagaaaguggcuaaccucugugguauaaaucagaaguuacuggccgaggcgcuuaaccaggucacccaacgagccucuagaaggagcgacuccgcaucaagugaacccguuggcauuuaucagggguuugagaaaaagacgggaguggcuggcgaagauaugcaggacaauagcgguacuuacgggaagaucugggagggaucuuccaaaugcaacauuaacaauuucaucuuucacaagguauugggcaaaggcucauucgggaaggugcugcuaggagaacucaaaggucggggcgaguacuuugccaucaaggcucugaagaaagacgucgugcuuauugaugacgauguugaguguaccaugguggaaaagcguguccugacauuggccgcagagaacccuuuccucacucaucugauaugcaccuuucagacaaaagaccacuuauucuuugugauggaauuucugaaugggggagaucucauguaucacauccaagacaagggccgcuuugagcuuuacagagccaccuucuaugcugcggaaauuauguguggucugcaguuuuugcauagcaaagggaucauauacagggaucuaaagcuggacaacguacuccuggaucgggacggccacauuaagaucgcagauuucggaaugugcaaagagaauaucuucggcgagagucgagccucuacguuuugugggacuccagacuauauugcuccggaaauccuucagggacugaaguacacauucuccguugacugguggagcuuugguguguugcucuaugagaugcugauuggccagucgcccuuccauggggaugacgaagaugaguuauuugagucuauacgcgucgacaccccucacuacccaagauggaucacuaaagaauccaaggauauucuggagaaacuauucgaaagggagcccacaaagcggcucggagugaccggcaacaucaaaauccauccuuucuucaagacgauuaauuggacccugcuugaaaagcgcagauuggagccacccuuuaggccgaaagucaagucaccucgugacuacaguaacuucgaucaagaguuucugaaugaaaaagcccggcucagcuauuccgacaagaaccugauagauucuauggaccagagcgcauucgccgguuuuucauucgugaaucccaaauucgagcaccuucuggaagauuga

SEQ ID NO: 61168 - RNA, 2214 nt, Artificial Sequence
  derived and/or modified sequence opt3 from PRKCE__Homo_sapiens__XP_005264485
augguggucuucaacggccugcucaagaucaaaauuugcgaggccguuagccuuaagcccaccgcuuggucccugagacacgcaguggggccuaggccacagacauuuuuguuagacccguacauagcccugaauguagaugacucucggaucggacaaacugcgacgaaacagaagaccaacucacccgcuuggcaugaugaguucgugacagacgucuguaauggucgcaaaauugagcuagccguguuucacgaugcaccuaucggcuaugacgauuucguugccaacugcacuauucaguuugaagaacuccugcagaaugggagucgacauuucgaagacuggaucgaucuugagccagagggacguguguacgucauaaucgaccugagcggcuccucuggugaagcucccaaggauaacgaggaaagaguguuuagggagcggaugcgcccuagaaagaggcaaggggcaguacggcgccgaguucaccaggugaauggacauaaauucauggccaccuauuugagacagccaacauacuguucgcacugcagggacuuuauuuggggcgucaucggcaagcagggguaucaaugucaggugugcaccugugugguccacaaacggugccaugagcucauuaucacuaagugugcuggacugaaaaagcaggaaacacccgaucagguugguucacaacguuucagcgugaacaugccucacaaguuuggcauacauaauuacaaaguaccaaccuucugcgaccacugugggagucugcucuggggauuacugcgccagggccuucagugcaaggugugcaaaaugaacguccacagaaggugugagacgaauguggccccgaacugcgguguugacgcgcgggggauugcaaagguguuggccgaucugggagucacucccgacaaaaucaccaauuccggccaacgacgcaagaaacuaauugcuggcgccgaaucuccucagccagcaagcggguccucacccagugaggaagauagaagcaagucugcuccuacauccccaugugaccaggagaucaaggagcucgaaaacaauaucaggaaagcccugucauuugauaaccggggagaggaacaucgcgcggccagcagucccgacggucagcuuaugucuccgggcgagaacggggaagugagacaaggacaggcaaagaggcugggcuuggaugaguucaauuucauuaaaguacucgguaagggguccuuuggcaaaguuaugcuggcugaguuaaagggaaaggacgaaguguaugccgucaaagugcugaagaaagaugucauacuccaggacgaugacguggacugcacuaugaccgagaagcguauccuugcucuggcccggaaacacccuuacuugacacagcuauacuguugcuuccaaaccaaggaucgacuguuuuucguuauggaauaugugaacggcggggaccucauguuucagauucagagaagcaggaaguucgaugagccccgcucgcgguuuuacgcagccgaaguaacgucugcucugauguuccuucaucagcacggagucaucuauagagaccugaaauuggauaauauacuccuggacgcggagggucauuguaaguuagcagauuuuggcaugugcaaagaggggauucugaacggagugacuacaaccacuuucuguggcacaccagacuacaucgccccugaaauccuacaagagcucgaauauggucccuccguugauuggugggcucugggggugcuuauguacgagaugauggccggccagccacccuuugaggcagacaaugaagaugacuuguucgagucaauucugcacgaugacguccucuauccuguguggcugaguaaggaagccguaagcauccuuaaggcuuuuaugaccaaaaacccacacaagaggcugggaugcguggccucccagaauggcgaggacgcaauuaaacagcauccguucuucaaggaaauagauuggguuuugcucgagcagaaaaagaucaaacccccuuuuaagccacgcauuaaaacgaagcgagacgucaacaauuucgaucaagacuuuacccgggaggaacccgugcugacauuaguggaugaggcgaucgucaagcagaucaaccaagaagaguucaaaggguuuucuuacuucggagaagaccugaugccuuga

SEQ ID NO: 61169 - RNA, 2094 nt, Artificial Sequence
  derived and/or modified sequence opt3 from PRKCG__Homo_sapiens__NP_002730
auggccggccuggggcccggagugggugacagcgagggcgggccuagaccacucuucugcaggaagggagcucuacggcagaaagucguucacgaagugaagucccauaaauuuacugcacgcuucuuuaagcaaccgacauucuguucucacugcacugauuuuaucuggggcauugguaaacaggggcugcagugucagguaugcucauucgugguccaucgacguugucacgaguuugugacguucgaaugccccggagccggcaagggcccucaaaccgacgauccaagaaacaagcauaaauuuagguugcacaguuacagcucccccacauucugugaccacugcgggucuuuacuguauggacuuguucaucaggguaugaaguguucgugcugugagaugaaugugcaccggcgcugcgucagaucagugccuagccucugcggcguagaucauacugaaaggcgggggcgccugcagcuugagauacgagcgccaaccgcugacgagauccacguuacagugggagaagccagaaaccugauucccauggauccuaauggcuugagugacccauacgucaaacucaagcugaucccggaucccaggaaccugaccaaacagaagacucggacagugaaggcaacccucaauccuguguggaacgagacguuugucuucaauuuaaaaccaggugacguugaacgucgccuguccguggagguaugggauugggacagaacuucuaggaacgauuuuaugggggccaugagcuucggaguguccgagcuuuugaaggcucccgucgacggcugguauaaacugcuaaaucaagaagagggcgaauacuauaacgugccuguugcagacgccgauaauuguucacuccugcagaaguucgaggcuugcaacuacccacuugaacuguaugagcgggugcgaauggggcccaguagcucuccgauuccuucccccucaccaagcccuaccgaccccaaacgcugcuuuuucggagccaguccagguagauugcacaucucugauuuuuccuuccucaugguccugggcaaggggagcuuuggaaaagugauguuagcggagaggcggggcucggacgaacuguacgcaauaaagauccucaagaaagauguaauuguucaggacgaugacguggauuguacacuugucgagaagcgcgugcuggccuugggugggagaggccccggaggcaggccucauuuccuaacucagcugcacucuaccuuucaaacaccagaccgucucuacuucgucauggaauaugugaccgggggagaucugauguaccauauccagcagcuugguaaauuuaaggagccgcacgcugccuucuaugcagcugaaauugccaucggccuguuuuucuugcauaaucaagggauaauuuaccgggaccucaaacuggacaacguuauguuagaugcggagggacacaucaagauuacggacuuuggcauguguaaggagaauguguuccccgguacuacaacccgaacuuucugcgggacaccugauuauaucgccccagaaaucauugcauaccagcccuauggcaaauccguagacugguggucauuuggaguccugcuauacgagaugcucgcuggccagccuccauucgauggggaagacgaggaggaacuguuucaggccauaauggagcaaaccgugacguaccccaagagucuuagcagagaagcuguugccaucuguaaaggauucuugaccaagcacccggguaaaaggcugggcuccgggccugauggagagccaacaauucgcgcacauggcuuuuuccgguggaucgacugggaaagacucgagaggcuggagauacccccucccuuucgcccacgaccuugcggucggucuggggaaaacuucgauaaguuuuucacucgugccgcucccgcgcuuaccccaccggacagacugguguuggcaagcauugaucaggccgacuuucagggcuucacauaugucaacccugauuuugugcaccccgacgcuaggucaccaaccagucccguaccugugccaguuauguga

SEQ ID NO: 61170 - RNA, 2052 nt, Artificial Sequence
  derived and/or modified sequence opt3 from PRKCH__Homo_sapiens__NP_006246
augagcuccggcaccaugaaguucaacggguaccugagagugaggaucggagaggccgucggucuccagcccacacgguggucucuucgccacucacuguuuaaaaagggccaucaauuguuagacccuuaucugacuguuaguguggaucagguacgaguggggcagacgagcaccaaacagaagacaaauaaaccaacuuacaacgaagaguucugcgcuaaugucaccgacggaggccaccuagaacucgcaguguuucaugagacaccgcuggguuaugaucacuucguugccaacuguacccuucaauuucaggaacuguugcguacuacaggggcguccgacaccuucgagggauggguggaucucgagcccgaaggcaaggucuuugugguaauuacgcugacuggcucuuucaccgaggcuacacugcagagagacaggauauuuaagcauuucacucggaaacgccagagagccaugaggcggcgcguucaccaaaucaaugggcacaaguuuauggcaaccuaccuccgacagccuacauauugcucgcauuguagagaguucauuuggggaguguuugguaaacagggcuaccagugccaagucuguaccugcguggugcacaagaggugucaucacuuaaucgucacggccugcacuugucagaacaauauuaacaaaguugauucaaagaucgcugaacagcgguucgggauaaauaucccacacaaguucagcauucauaacuauaaagugcccacauuuugcgaccacuguggaagucugcuuuggggcaucaugcgucaagguuugcagugcaagauuugcaaaaugaauguacauauccgcugucaggcaaacguggccccuaauugcggggucaacgcuguggagcuggccaagacccuagcgggaaugggccuccagccaggcaauauaucccccacuucuaaacugguuagcagauccacacuuaggcggcaagggaaggaaucaaguaaagagggaaacgguauuggcgugaacagcucuaaucgacuggggaucgauaacuucgaauuuauucgcgucuugggaaagggcuccuucgguaaggugaugcucgcaagaguaaaagagaccggggaccuguacgccguuaaggugcugaaaaaggaugucauccugcaggacgaugacguggaauguacgaugaccgagaaaaggauccucucacuugcucggaaucacccuuuucugacacaguuguucugcuguuuucagacuccagaccgccuauucuuugucauggaguucgugaacggcggagaucugauguuucauauucaaaagagcagaagguucgacgaagcccgugcacgguuuuacgcugccgagauaaucagugcgcucauguuccugcacgauaagggcauuaucuaucgagaccuuaaacuggauaauguuuugcucgaccacgaagggcauugcaagcuggccgauuucggaauguguaaagaggguauaugcaacggcgugaccacagcaacuuuuugugggaccccggacuacauugcucccgaaaucuuacaggagaugcuguauggaccugccguagauuggugggcuaugggcguccuacucuacgagaugcugugcggucacgccccauucgaagcagagaaugaagacgaucuuuuugaggccaucuugaacgacgaagugguuuaucccacauggcugcaugaggacgcuaccgggauucucaagucuuucaugacuaaaaauccuacgaugagacugggcucccuuacacagggaggcgagcacgcgauccugaggcacccauuuuucaaggaaauugauugggcacaguugaaccaucgccaaauagagcccccguuucggccuagaaucaagagcagggaagacgugucgaauuucgaucccgacuuuauuaaagaggagccaguccucaccccuaucgaugaagggcacuuacccaugaucaaccaggacgaguuccgcaauuuuucuuacguguccccagaauuacagcccuga

SEQ ID NO: 61171 - RNA, 1791 nt, Artificial Sequence
  derived and/or modified sequence opt3 from PRKCI__Homo_sapiens__NP_002731
augcccacccagagagacagcuccacaaugucucacacuguggccggcgggggaucaggugaucauagucaccaagucaggguuaaggcuuacuaucggggcgacaucaugauuacgcauuucgagccuagcauauccuuugaagggcugugcaacgaggugcgcgauauguguucuuucgacaaugaacagcucuuuaccaugaaauggaucgaugaggaaggagacccaugcacaguaucgucacagcuugagcuggaggaagcauuccgauuguacgaguuaaacaaggauagcgaacugcuaauucacguguuuccguguguccccgagcguccuggcaugccaugccccggugaggacaaaaguaucuauagaaggggagcccggcgcuggagaaagcucuacugugcgaaugggcauacuuuccaggcuaaaagguuuaaccggcgcgcccacugcgcaauuuguaccgaucgaaucuggggccugggcagacaaggguauaagugcauaaauuguaagcuacuggugcacaaaaagugccauaaauugguuacaaucgaauguggaaggcacucccucccucaggagccagugaugcccauggaccagucuagcaugcauuccgaucacgcccagaccgucauuccuuacaacccaucaagucacgaaagccuggaccaagugggugaggaaaaggaggcuaugaauacucgggagucuggcaaagcauccucaagccuggggcuccaggauuucgacuuacugcguguaaucggacgcggcaguuaugccaagguucuuuuggugagacugaagaaaacagacaggauuuacgcuaugaaggucgugaaaaaggaacuugugaacgaugacgaggauaucgacuggguccagaccgaaaaacauguuuuugagcaggccucuaaucacccguuccucgugggucugcauuccugcuuucaaacggaaagccggcuuuucuuuguaauagaguacgugaacgggggagaucugauguuccacaugcagcgacagcgcaaguugcccgaggaacaugcgagauucuauucggcagagauuucucucgcccugaauuacuuacacgaaaggggcaucauuuaucgggaccugaaacucgauaacguccuucuggacuccgagggccacaucaaguugacugauuacgggaugugcaaggaaggacuacgcccuggugacaccacaucaacuuuuuguggcaccccaaauuauaucgcucccgagauucugagaggggaggauuacggauucaguguggacuggugggcccucggcguucugauguuugaaaugauggcagguaggagcccuuucgacauagugggguccucugauaacccagaccaaaauacagaggauuaucuuuuucaggucauccuggaaaaacagauucguaucccccggagcuugucagugaaggcugccaguguacucaaauccuuccugaacaaggacccgaaagagcgauuaggcugccauccucagaccggauuugcggauauacaaggccaccccuucuuuagaaacguugacugggauaugauggagcagaaacagguggucccaccuuucaagcccaauauuagcggggaauuuggacuggacaacuucgauucucaguuuacgaaugagccagugcaacuaacucccgacgaugacgauaucgucaggaagaucgaccagucagaguucgaagguuucgaauacauuaacccucuccugaugagugccgaggaguguguguga

SEQ ID NO: 61172 - RNA, 1932 nt, Artificial Sequence
  derived and/or modified sequence opt3 from PRKCQ__Homo_sapiens__NP_001229342
augagccccuuccugagaaucggccucuccaacuuugacugcgggucuugucagucaugccaaggagaggccgugaauccuuacugugcuguccuuguuaaggaauauguggagagugaaaacggucagauguacauucagaaaaagccaaccauguauccgcccugggauagcacauucgacgcacacauaaauaaaggcaggguaaugcagaucauugugaaggggaaaaacgucgaucugaucuccgagacuacgguggaauuguacucuuuagccgagcggugccgcaagaauaacggaaagaccgagauuuggcuggaacuaaaaccucaaggccgaaugcucaugaaugcgcguuauuuucuggagaugucggacacaaaggauaugaacgaguucgagacugagggguuuuucgcccuucaucagagaaggggugcuaucaaacaggcaaagguucaccaugugaaaugucacgaauuuaccgccacauucuuuccacagcccaccuucugcucagucugucaugaguuuguguggggacugaauaagcaaggcuaccagugccggcaguguaacgcugcaauacacaagaaaugcaucgacaagguaauugccaaauguacuggcagcgcuaucaauagucgcgaaacaauguuccacaaggagagauuuaaaauugauaugccucauagguucaagguuuauaacuacaaauccccaaccuucugcgaacacugcgggacguugcucuggggacuggcccggcagggucugaagugugacgcgugcggcaugaaugugcaucaccgcugucaaacuaaggucgcaaaccucugcgggaucaaucagaaauuaauggccgaggcucuggccaugauagagucuacccagcaagcacgaugucuuagagauacagaacagauuuuuagggagggacccguggaaaucggcuugccuugcagcauuaagaacgaggcucggccaccgugucugcccacuccugguaaacgugaaccacaggggaucuccugggagucaccccuagacgagguggauaagaugugccaccucccugaaccagagcugaacaaagaacgccccagucuucagaucaagcugaagauugaggacuucauauugcauaaaaugcucggaaagggcagcuuuggcaaagucuuccuggccgaauuuaagaaaaccaaucaauucuuugcgaucaaggccuuaaagaaagauguugugcugauggacgacgauguagaguguacaaugguggagaagagaguccucucucuugcaugggaacacccguuccugacccauauguuuugcacguuccagacuaaagagaacuuguuuuucgugauggaauaccuaaaugggggagaccugauguaucacauucaguccugucauaaguuugaucucucaagggcuacauucuacgccgcugagaucauacugggucuucaguuccugcacagcaaaggcauuguuuaucgggacuugaagcucgauaacauccuguuagacaaggaugggcacaucaaaauugccgacuuuggaaugugcaaggagaauaugcugggcgaugcaaaaaccaacacuuucugcgguacaccugacuacaucgcccccgaacuauuugugcgagagccagaaaagcgccucggggucagaggcgauauuaggcaacauccucuguuccgggagauaaauugggaagaacuugagcgcaaagaaaucgaucccccauuuagacccaaggugaaaaguccuuucgacuguucuaacuuugacaaggaguucuugaaugaaaagccaaggcuguccuuugcugaccgugcgcucauuaacagcauggaucagaauauguuccggaacuuuucguucaugaauccgggaauggagcgacugaucucuuga

SEQ ID NO: 61173 - RNA, 1587 nt, Artificial Sequence
  derived and/or modified sequence opt3 from PRKCSH__Homo_sapiens__XP_011526433
augcugcucccccuucuguuguuacugccuaugugcugggccguggaggucaagagaccaaggggcguuagccuaaccaaccaccauuucuacgacgaauccaaaccguuuacaugucucgaugggucugcuacuauccccuucgaccaggugaaugaugacuauugcgauuguaaggacggaucagaugagccugguacggcagccugcccaaacggcaguuuucacuguaccaauacaggguacaaaccccuguauauuccuagcaaccggguaaaugacggagugugcgauuguugcgacggcacugaugaauacaacuccggugucauaugugagaauaccugcaaggaaaaagggcgcaaggagcgagagucucuucaacagauggcggaagugacacgugagggauucagacugaagaaaaucuugauugaagacuggaagaaagcuagggaggagaagcagaaaaagcucaucgaacugcaggccggcaagaaaucgcuggaggaucaaguugaaaugcuccggaccgugaaggaggaagcagagaaaccagagcgcgaagccaaggagcagcaucagaaauuaugggaggaacagcuggcugcagccaaggcucaacaggaacaggagcuugccgcggacgcauuuaaagaguuggacgaugacauggauggcacugucucagugacagaacugcagacccaccccgagcuagacacggauggggacggagcccucagcgaagcugaggcccaagcacugcuuaguggugauacucagaccgacgcuacauccuucuaugauagaguaugggccgcgauuagggacaaguaccggucugaagcccugccuacugauuugccagcaccgagcgcucccgaccucaccgagccuaaggaggaacagccacccguuccuuccucaccaacagaggaagaggaggaagaggaagaggaagaggaggaagaggccgaagaggaagaggaggaagaggacagugaagaggcucccccgccucugucucccccacaaccugccagccccgcagaagaggauaaaaugccacccuaugacgagcagacccaggccuuuaucgaugcugcgcaggaagcacgcaacaaguucgaggaagccgagcgauccuuaaaagacauggaggaaucaauaagaaaucuggagcaagaaaucagcuuugauuucggcccuaacggggaguuugcuuaccucuacagucaguguuaugaacuuacgacuaaugaguacguguauaggcugugcccauucaaguuggucucucagaaaccgaagcuaggaggcucccccacaagccuggguaccugggggucguggauuggaccugaccaugauaaguuuucugccaugaaauacgagcagggcacuggcugcuggcaagggccaaaccgguccacaaccgugcgucuccuguguggaaaggaaacgauggugaccucaacaacugagcccagucgcugcgaauaucuuauggagcugaugaccccugcagccuguccagaacccccgccugaggcuccaacagaggacgaucacgacgaauuguga

SEQ ID NO: 61174 - RNA, 1788 nt, Artificial Sequence
  derived and/or modified sequence opt3 from PRKCZ__Homo_sapiens__XP_011540075
augcccagcagaaccggcccuaagauggagggguccggagguagggugcggcugaaagcccacuacggcggggacaucuucauuacaucugucgaugcugcaacuacguuugaggaacucugcgaagagguucgcgacaugugucgacuucaucagcaacacccacugaccuugaaguggguggauucagaaggagacccgugcacaguaaguagccagauggaguuagaggaagccuuccgucuggcgagacaguguagggaugagggccuaauaauccauguguuucccuccacuccugaacagccaggucuccccugcccuggggaggacaaaucuauuuaucggcgcggagcuagaagguggcggaagcuguaccgcgccaacggccaccuuuuccaagcaaaacgauuuaauagaagggccuauuguggccagugcucggagcggaucugggggcuggcucgucagggauaccgcuguauuaacugcaaguugcucguccauaagagaugucacggucuggugccacugaccugcaggaaacacauggauucaguuaugcccagccaggaaccuccaguggacgauaagaaugaggacgcagaucucccgagugaagagacagacggcaucgccuauauauccucuagccggaaacaugauuccaucaaggacgacucagaagauuuaaaacccgucauugacgggauggauggaaucaagauuagucaaggccugggucuucaggacuucgauuugauccgagugauagggcgcggaagcuacgcuaagguacugcuaguuagacucaaaaagaacgaccagauuuaugccaugaaaguggucaagaaagagcuggugcacgaugacgaggauaucgacugggugcagaccgaaaagcaugucuuugagcaagcgucuuccaauccuuuccuuguuggccugcacucauguuuucagacuacaagcagguuguuccucgugauugaauacguaaacggcggggaucugauguuucacaugcagcggcaacgcaaauuaccagaggaacaugcaagauucuacgccgcugagaucugcaucgcccugaauuuucuccacgagaggggaauuauauaucgugaccuuaagcuggacaacguguugcuagaugcagacggucauaucaagcugaccgauuacggcaugugcaaagaagggcucggacccggcgacacgaccaguacuuucugugguacaccuaauuauauugcuccagagauccugagaggggaagaguacggcuucucugucgauuggugggcccuuggagugcugauguuugaaaugauggcgggccgaucccccuucgacauaauuacugauaacccggacaugaauaccgaggauuauuuguuucagguuauccucgagaagccuauccggauucccagguuccugagcgugaaagccucgcacgucuuaaagggguuucugaacaaagacccaaaggaacgccuaggaugccggccucagacagguuucucugauaucaagucccaugcauuuuucagaucaauugacugggaucucaugcacaggcagcugcgcuguaccgacgcucgaacgacuuggacaccccggcguugcggcagaaccgacgauauggacgcccaaacuauguggaugcacgggaggcgccggcauacagaugacaguagcaccgaugacuccgaugcuagaacgccaaggcgacgcggacggaccgacgaugccgacgcacagaugacauggacucacagauga

SEQ ID NO: 61175 - RNA, 2739 nt, Artificial Sequence
  derived and/or modified sequence opt3 from PRKD1__Homo_sapiens__NP_002733
augagcgcucccccugugcugagaccaccgaguccccuccuuccugucgccgcagccgcggcugccgcagccgcugcacugguuccaggcucugggcccggaccugccccauucuuggcucccguggccgcgccuguagguggcaucucauuucacuuacagauugggcugaguagggagccagugcuacuccugcaagacagcuccggagauuacucucuugcacauguccgggaaauggccugcucgauaguggaccagaaguucccggaguguggcuuuuaugguauguacgauaaaauccuguuguuccgccacgaccccaccucagaaaacauucuccagcugguuaaggcugccagcgauauccaggagggggaccugauugaagugguccucagugcauccgcuacauuugaggauuuccaaauccgaccucaugccuuauuugugcacucuuaucgugcgccagccuucugcgaccauuguggagagaugcuguggggccuuguaagacagggcuugaaaugcgaaggguguggacugaauuaccacaagaggugcgcauuuaaaauacccaacaauuguagcgguguucggcgcagaaggcuauccaacgugucacucacuggcgucaguacgauccggaccagcucugcugagcuguccacaucagccccugaugaaccacuucugcaaaagagccccagugagucuuucauugggcgcgagaagcgauccaauagccagucguauaucggaagaccgauucacuuggacaaaauccucaugucuaaggugaaagugccucauacuuuugucauacacuccuacaccaggcccacaguuugccaguauuguaagaaacuguuaaagggccuguuccggcagggucuccagugcaaggauugucguuuuaacugccauaaacgcugcgcuccaaaggugccuaauaacugucuuggggaaguaaccauuaauggagaccuguugucacccggcgccgagagugauguggucauggaagagggcagcgacgacaacgauuccgaaagaaauucugggcuaauggacgauauggaggaggcaauggugcaggacgccgaaauggcuauggcggagugccaaaacgauagcggagaaaugcaggacccagaucccgaccacgaggaugcaaauaggacuaucucaccuaguacauccaacaauauuccacugaugcggguugugcagagcgucaaacacaccaagcgaaaaucuucaacggugaugaaggaagguuggaugguacauuacacuuccaaagacacccuccgcaagagacacuacuggaggcuggauagcaaguguaucacacuuuuccaaaacgacacuggcucccgguauuacaaagagaucccgcugucugagauuuugucgcucgaacccguuaagaccagcgcccugauaccuaacggggcuaauccacauugcuucgagaucacaaccgccaacguggucuauuacgugggagaaaaugucgugaaccccuccucaccuaguccaaauaacucuguuuuaacgagcggcgugggugcagacguagcccgcaugugggagauugcuauccagcacgcccugaugcccgucauaccgaaaggguccucagugggcacuggaacaaaucuacauagagauauuagcguuucuaucuccgugaguaacugucagauccaggaaaaugucgacauuagcaccguguaucaaaucuuuccugaugagguacucggcucugggcaguucggaauuguguacgguggcaagcacaggaaaacugggcgugacguugcaauaaagaucauugauaagcugcgguuuccaacaaaacaggagucccagcuucgaaacgaagucgcgaucuugcaaaaucugcaccaucccggaguggugaaccucgagugcauguucgaaaccccugagagagucuuuguugugauggagaagcugcacggcgacaugcuugaaaugauccugucaagugagaaagguagguugcccgaacauauuacgaaguuccucauaacccagauccugguggcuuuacgccaccuucacuuuaaaaauauuguacauugugaucuaaagccagagaacguccuccuggccagcgcagacccuuucccccaggugaagcugugcgauuuuggguucgcccggaucauuggcgaaaaaucguuuagaagguccguugugggaacaccagcuuauuuggccccggagguccugcgcaauaagggcuacaaccgaucucucgacauguggagcguggggguuaucauauacgugucacugaguggaacuuucccuuuuaacgaggaugaagacauccacgaucagauucaaaaugcagcuuucauguaucccccaaaccccuggaaagagaucucccaugaagccauugacuuaaucaauaaccugcuucagguaaagaugcggaaacguuacucugucgacaagaccuugagccacccuuggcuccaggauuaucagacauggcuggaccuaagagagcuggaauguaagauaggugagagguacauuacucaugaguccgaugaccuccgcugggaaaaauaugcgggcgagcaagggcugcaguacccaacccaccuuaucaaucccucagccagccacagugauacaccugaaaccgaggaaacugagaugaaggcuuugggagagcgggugucuauucuguga

SEQ ID NO: 61176 - RNA, 2673 nt, Artificial Sequence
  derived and/or modified sequence opt3 from PRKD3__Homo_sapiens__XP_005264294
augagcgccaacaauuccccuccuucugcucagaagucagugcugccaaccgcaaucccggccguccuccccgcggcuaguccuugcagcuccccaaaaacaggccuuucugccagacugucgaacgggucauucagcgcacccaguuugacuaauuccaggggaucuguucacacggugagcuuuuuacugcaaauuggucuaacccgggaguccguaacaauagaagcccaggagcucucacugagugcugugaaggaccuugucuguagcaucguguaccagaaauucccugaaugcggcuuuuucgggauguaugauaagauucuguuguuucgccaugacaugaacucugagaauauccuccagcugauuacuuccgcagaugaaauccacgagggagaccugguugaggugguccucucagccuuagcuaccguggaagauuuccaaauacgaccacauacacuguacguacacagcuauaaagcccccaccuuuugugacuacugcggcgagaugcuuugggguuugguucgucaggggcugaagugugaaggaugcggccuaaacuaucauaagagaugugcguucaaaaucccuaauaacugcaguggcgugaggaagcggcgccucucuaaugucucccugccagggccgggacuuagcgugcccagaccucugcagccagaguacguggcauugcccucggaggaaucucacguccaccaggagccuuccaaaaggauuccaucauggaguggucggcccaucuggauggaaaagaugguuaugugucgcgugaaaguaccgcauacuuuugccgugcacagcuauacacgaccuaccauuugccaauacuguaagagacuccugaagggcuuauucaggcaggggaugcagugcaaagauugcaaguuuaacugucauaaacggugcgcuuccaaggucccccgugacugucugggagaggugacguucaauggcgaaccaucuagccucgguacugauaccgacaucccuauggauauagacaacaaugauauuaacucagacaguucccgcgggcuugacgauacagaggagcccagcccacccgaagacaaaauguuuuuccuggauccuucugacuuggauguugagagagacgaagaggccgugaagacuaucucaccaaguaccagcaauaacauuccgcuaaugagggucgugcaguccaucaaacacacaaagcggaagucuucgaccaugguaaaagaaggauggaugguucacuacacgagccgagauaaccugcgcaagagacauuauuggaggcucgacuccaaaugccugacucuuuuccaaaaugagucaggcaguaaguacuauaaagagaucccccugucugaaauuuugcggauaagcuccccucgcgauuuuacaaacaucucacagggcagcaauccacacuguuucgagauuaucaccgacacuaugguguacuuugucggggaaaacaauggagauucuucccauaaccccgugcucgcagcuacaggugucggccuggacguggcccagaguugggagaaggcgauaagacaagccuuaaugccuguuaccccacaggcaagcgugugcacgucucccgggcagggaaaggaccacaaagaucuguccaccucaauuaguguaagcaauugucagauccaagaaaacgucgacaucucgacaguguaucagauuuucgcugaugagguucuaggcuccggucaguuugggaucguguacggcggaaagcauaggaaaacuggccgugacgucgccauuaaggugauagauaaaaugcgguucccgaccaagcaggagucucaacuccgaaaugaaguagcuauccugcagaaccuucaccacccugggauugugaauuuggagugcauguuugaaacaccagagagaguuuucgucgugauggagaagcugcauggagacaugcucgaaaugauccugagcucagagaaaaguaggcuucccgaacgcaucacuaaguuuauggugacccagauucuggucgccuugcggaaccuccacuucaaaaauauaguucauugugaucugaagccugagaacguguuacuggcauccgccgaacccuuuccacaggugaaacuaugcgacuucgguuuugcuagaaucauuggcgagaagucuuucaggcgcagcguagucgggacacccgcguaucucgcacccgaggugcugcgauccaagggauacaaucggucacuugauauguggagcguuggcgugaucauuuacgucaguuugucugguaccuucccauuuaacgaagacgaggauaucaacgaccaaauacagaaugccgcuuucauguauccgccuaaccccuggcgugaaaucuccggggaggccauugaucugaucaauaaccucuuacaggugaaaaugagaaagagguacagcguugacaaaucgcugucacacccauggcugcaggacuaucaaacuuggcuugauuugcgcgaauuugagacgcggauuggcgagagauacaucacacacgaaucugacgaugcaaggugggagauacaugccuauacccacaaucucguguaccccaagcauuucauuauggcuccuaacccagacgauauggaagaggaccccuga

SEQ ID NO: 61177 - RNA, 12294 nt, Artificial Sequence
  derived and/or modified sequence opt3 from PRKDC__Homo_sapiens__NP_001075109
auggccggaucuggggcuggagugaggugcucccugcucaggcuucaggaaacccugucugcugccgaccgguguggugcggcuuuggccggacaccaauuaauccgcgggcugggacaggaaugcguccuaucaaguagccccgcaguucucgcccugcagacaucccuuguguucucucgagauuuuggccuguugguauucgugcguaagucgcucaacucaauugaauuuagagaauguagggaggaaauacugaaauuccugugcaucuuucucgagaagaugggucagaaaauugcuccuuacagcgucgagaucaagaauacuuguacgaguguguauaccaaagaccgggcagccaagugcaagauuccagcuuuagaucugcuuaucaaauugcugcaaacauuccgcuccucuagacuaauggacgaauuuaagauaggggaacucuucagcaaauuuuacggagaacuggcccuuaagaaaaagaucccggauacuguucuggagaagguguaugaguugcucggccuguuaggcgaaguccaucccuccgagaugauuaacaaugcggaaaaccuguucagggcauuucucggggagcuuaaaacccagaugacaucagccgugcgggaaccuaagcugccaguuuuggcuggaugucuaaaaggucugaguagccuccugugcaauuucaccaagucuauggaggaggacccccagacuucccgcgaaaucuuuaacuucguucuuaaagccauucgaccucagaucgaucugaagagauacgcagugccaucagcuggcuugagacucuucgcccugcacgcgagccaauuuaguacauguuuacuggacaauuaugucucucuauucgaggugcuccugaaauggugcgcccauaccaacguggaacuuaagaaggcagcuuuguccgcccuggagagcuuucucaaacaggucucgaauaugguugcuaagaacgccgaaaugcacaaaaauaagcugcaguacuucauggagcaguuuuaugggauaauucggaacguggauucuaauaacaaagagcuuuccaucgcaauucguggauacggccuguucgccggucccuguaagguaaucaaugcuaaggacguggauuuuauguacgucgaauugauccaacgcugcaaacagauguuccucacgcagacugacaccggggaugacagaguguaucaaaugccuucauuucugcagaguguugcgagcguguuacuguaccuagacacagucccagagguguauacuccgguacucgaacaucugguugugaugcagauugauuccuucccccaguacucuccuaagaugcaacuugucugcuguagggcaauagugaaagucuuuuuggcccuggcugccaagggaccagugcuccggaacugcaucagcaccguugugcaccagggccugauucgaaucuguucaaaacccguagucuuaccuaagggcccagagagugaauccgaggaccaccgcgcaagcggggaggugagaacaggaaaguggaaaguucccaccuauaaggauuacguggaccuguucaggcaucuuuugucuucagaucagaugauggacaguauacucgccgaugaggcuuucuucagcgucaacuccucuucggaaagccugaaucaccuacuguaugacgaguucgugaaauccguacucaagauuguggagaaacuggaucuuacguuggagauccagacuguuggugaacaagagaacggcgacgaagccccgggggucuggaugaucccuacaucagaucccgcagcgaaucugcauccagcuaagccuaaggacuuuagugccuucauuaacuuaguggaguuuugccgggaaauccuccccgagaaacaggcagaguucuuugaaccauggguguacucuuucagcuacgagcugauucuucaguccacccgccugcccuugauaucaggauuuuauaagcuccugagcaucacugucagaaaugccaaaaagauuaaauacuucgaaggcguuucuccuaagucccuaaaacacaguccagaggacccggaaaaguauagcuguuuugcucuguucgugaaguuugguaaagagguggccguaaagaugaaacaguacaaggaugagcuccuggcaucuugccuuacauucuugcuguccuuaccccacaacaucaucgaacucgacgucagggcuuaugugccugcccugcaaauggcguuuaaacuugggcugucauacaccccacuagccgagguuggccucaaugcucuggaagaguggaguauuuauauagaucgucaugugaugcagcccuacuacaaggacaucuugccuugucuggauggauauuuaaagacgagcgcacucucggacgaaaccaaaaacaauugggaggucuccgcccugucucgggcugcccagaagggcuucaacaaagugguucuuaagcaccugaaaaagacaaagaauuugagcucaaacgaggcaauuagucucgaagagauccgaauuagagugguacagaugcuggggucccuaggaggucaaaucaauaaaaaccugcuuacugucaccucuagcgaugaaaugaugaaguccuacguggcgugggacagggagaaacgccucucauucgccgugccauuucgggagaugaagcccgucauauuccuggauguauuuuugccgagagugacagaacuggcuuuaacugccagcgacaggcagaccaaaguagcagcuugcgagcuccugcauaguauggugauguucaugcuuggcaaggccacacagaugccugaagggggacaaggcgcaccacccauguaucagcuguacaagcgcaccuuuccugucuugcuccgacuggccugugauguggaccagguuacucggcagcuauaugagccccuggugaugcaacuuauccacugguucacgaauaacaaaaaguuugaaucucaggauacagucgcucuccuggaggcgauuuuggacgguaucguggacccaguugauuccaccuuacgugacuucugcgggagauguauuagggaguuucugaaauggagcaucaagcagauaacuccucagcaacaggaaaaaucgcccgugaacaccaagucacucuucaaacgccuguacucucuugcccugcauccaaaugcauuuaagcgguugggcgcuagucuagccuucaacaauauuuauagagaguucagggaagaggaaucccuggucgagcaguuuguauucgaggcccucgugaucuacauggaaagccuggcucuugcacacgccgaugagaagucuuuaggaacaauucagcaaugcugcgacgcgaucgaucaccugugucgaauaaucgagaaaaagcauguuagccucaacaaagcuaagaaacgccgguugccgagaggcuuuccucccuccgccucacugugccuccuggaccuugugaaguggcuguuggcacacugugggaggccacagaccgagugccgucauaagaguauugaacuauucuacaaauuugucccccugcucccuggaaaucgcagcccaaacuuauggcugaaggaugugcuuaaagaggaggguguaucuuuccugaucaauacuuuugaaggcgggggauguggccagcccuccgguauucucgcccaaccuacauugcuguaucuccgggggccguucucacugcaggcuacgcuuugcuggcuagaccuguuguuagcagcccuggaguguuacaacaccuuuaucggcgaaagaacugugggagcgcuccagguccugggcacagaggcucagaguagccuucugaaggccguugcauucuuucucgaguccauagccaugcacgauauuaucgcugccgaaaaaugcuucgggaccggagcagcuggcaauaggacaucuccacaagagggugaacgauauaacuacucgaaguguacuguggugguccggaucauggaguuuaccacgaccuugcugaauacaagccccgaaggguggaagcuacugaaaaaggaccucugcaacacucaccuuaugcgcgugcugguucagaccuuaugugagccugccucaauuggauucaauaucggcgauguacaggugauggcgcauuugccagacgucugcgugaaccugaugaaagcccucaagaugucccccuauaaagauauucuggagacacaccuuagagaaaagauaacugcacagaguaucgaggaacugugcgcuguuaaucucuacgguccugacgcccaaguggacaggucucgguuggcugcagucgugagcgccuguaagcagcugcaucgagccggcuuacuacacaacauucugccgucccagucaaccgaucuccaucacucuguagggacggagcuucugagcuuggucuauaaaggaaucgcucccggcgacgaaagacagugccugccaagucucgaucuguccuguaagcaacuugcgagcgggcuccuggaguuggcauucgccuuuggaggccugugcgagcgcuuagugucucuacugcucaacccugcuguucuuucaacagccucccuggguaguagccaggggucggugauucacuucucucauggagaauacuuuuacuccuuguucagcgagaccaucaauacugaacugcucaaaaaccuggaccuugcagucuuagagcugaugcagucaaguguggauaauacaaagaugguuucugccgugcucaacggcauguuggaccaguccuuuagggaacgugcuaaucaaaaacaccagggucugaagcuagcgaccacuauacugcagcauuggaagaaaugugauagcuggugggccaaggacucaccccucgagaccaaaauggcaguccuugcucuguuggccaagauccugcaaauugauaguagcguguccuucaacacaucucacggcagcuuuccagagguauucacgaccuauaucucccuccuggcagacacuaaauuagaucuucaucugaaggggcaggccgugacacuccuacccuuuuucaccucacugacaggaggcucuuuggaagaacugcggagaguucucgaacagcuuauugucgcucacuuuccuaugcagaguagggaguucccaccggggacuccucgcuuuaauaacuacguggacugcaugaaaaaguuccuggacgccuuggagcugucgcaaagccccaugcucuuagaacugaugaccgaggugcuuugucgagaacagcagcacgucauggaggaacuguuccaguccucuuuuagacggaucgcgaggcgcggaucaugcguaacgcaagugggccuacucgagagcguuuaugagauguuccguaaggaugacccaagacuguccuuuacacggcagaguuucguggauaggucuuugcugacccuccuuuggcauuguagccuggacgcauuacgcgaauuuuucucaacuauagucguggaugccauugacguucugaaaucccgauuuaccaaguugaaugagaguacauucgauacucagaucaccaaaaagauggguuacuauaaaauccucgacgugauguacagcagacugcccaaggaugacguccacgcuaaggaaucuaaaauuaaccagguguuucauggguccugcauaacagagggaaaugaacuaacgaagacccuuaucaaacuguguuaugaugccuucacugagaacauggcuggcgagaaucaacuccuggaacggaggcgcuuguaccacugcgcagccuacaacugcgcuauuucaguaaucuguugcguguuuaaugagcugaaguucuaucaggguuuucucuucagcgaaaaaccugagaagaaccuucugauuuucgaaaacuuaaucgaccugaagagaagguacaauuuuccaguugaggucgaggugcccauggaacggaaaaagaaauauauagagauccguaaggaagcccgcgaggcagcgaacggcgauucggacgggccuucuuacaugaguuccuugagcuaucucgccgacucaacacuguccgaggaaaugucucaguucgauuuuagcaccggagugcaaaguuacuccuauagcucucaggacccgcgaccagcuacuggcagauucaggcggcgcgagcagagagaucccacaguccacgacgauguucuagaacuugagauggacgaacugaauaggcaugaguguauggccccucucaccgcacuggugaaacacaugcaucggucauuggggcccccacagggagaggaagauaguguaccucgagacuuacccuccuggaugaaguuucugcacggcaagcucgguaacccaauugugccucuuaauaucagacuguuccuagcuaaacuggucauuaacacggaggaaguguuucgcccguacgccaagcauuggcucagccccuugcugcaacuugcagccucugagaauaacgggggagaaggcauccacuacaugguuguggagauagucgcuacuauucugucguggaccggccucgcgacaccaaccgggguaccuaaagaugagguguuagccaauaggcuguugaacuuccugaugaagcacguuuuucaucccaaacgggcaguguuccgucacaaucucgaaaucaucaagacucuugucgagugcuggaaagacugucugucaauuccauauagacuaaucuuugaaaaguucagcggaaaggauccuaacuccaaagacaauaguguggguauacagcugcucggcauugucauggcuaacgauuugcccccguacgacccacagugcgggauccagucuagcgaguauuuucaagcccuggugaauaacauguccuucguuagguacaaggaaguguaugccgcagcugccgagguacuuggacugauuuuacgcuacgugauggagcggaaaaauauccucgaagagucacugugugaauuggucgcgaagcagcugaaacagcaucagaacacaauggaggacaaguucauaguuugccucaacaaggugaccaaaaguuuuccuccccuugcugaucgauucaugaaugccgucuuuuuccugcuaccaaaguuucacggcgugcugaaaacacucuguuuggagguagugcugugcagaguugaagguaugacugaguuauauuuccaacuuaagucuaaagacuuugugcaggucaugaggcaccgcgaugacgaacggcagaaggugugucuggauauuaucuacaagaugaugcccaaacucaagccugucgagcugagagaauugcugaacccggugguugaguucguaagccaucccuccaccacgugccgugagcagauguacaauauccucauguggauucacgacaacuauagggauccagaaucagagacagacaaugauagccaagaaaucuuuaaacuugcaaaggacgugcugauucaggggcuaauagaugagaacccuggacugcaguuaaucauucggaauuucuggucucaugaaacccgccuccccuccaacacucuggaccgauugcuugcccugaauagucucuacagcccuaaaaucgagguccacuuucugucguuggcuaccaacuuccugcuagagaugacauccaugucuccagacuaucccaauccuauguuugaacauccacucucagagugcgaguuccaagaguacacuaucgauagcgacuggagauucaggaguaccgugcuuacgcccauguuuguugaaacacaggcaucccagggcacccugcagacucggacacaagagggcucuuuaagcgcccgcuggccgguggcggggcagauuagagcuacccagcagcaacacgauuucacucugacacagaccgccgacggaaggucauccuuugauuggcucacggguaguagcacugacccucuggucgaucacaccucuccaucauccgacagcuugcuuuucgcacauaagcgaucugagcggcugcagcgugcaccccucaagagugugggcccugauuuugggaaaaagagacugggacuaccaggcgacgaaguagauaacaaagugaagggugcugccgggcgcacagacuugcugaggcuccggagacgcuucaugagggaucaggagaaacuuucgcugauguaugcacgaaagggaguugcugaacaaaaacgggagaaggagauaaaguccgaauuaaaaaugaagcaggacgcccaggucgugcuguacagaagcuauaggcacggcgaccuccccgauauccaaauuaaacauucaucucugaucaccccguugcaggcgguggcccagcgcgacccuauuaucgcaaagcagcuuuuuagcucccuguucaguggcauacucaaagagauggauaaguuuaagacacugucagagaaaaacaacaucacucaaaagcuauuacaggacuucaaucguuuucugaacaccacguucagcuucuuucccccauuugucagcuguauucaggauaucuccugccagcacgcugccuugcucagucuggacccugcagcuguuagcgccgggugucuugccucccugcaacagcccgugggcauucggcuccuggaggaagcguugcuuagacugcuaccagcugagcuccccgcaaaaaggguacgcgguaaggcccgacugccuccagauguguuacggugggucgagcuggcuaaauuguacagaucuaucggcgaauacgacgugcucagggggauauuuacaucagagauuggaacuaagcagaucacccagagcgcccugcuugcagaagcccgcucggauuauuccgaggcugcgaagcaauacgacgaagcccugaacaaacaggauuggguugacggcgagccgacagaggcagaaaaggacuucugggagcucgcuaguuuggauugcuauaaucaccuggccgaauggaaaucucuugaguacuguagcaccgcaucaauugacuccgaaaaucccccugaucugaauaagaucuggucugagccauuuuaucaggagacuuacuuacccuauaugauaagaaguaaacuaaagcuccugcugcaaggugaagccgaccagagcuugcucaccuucaucgauaaggcuaugcauggggagcugcagaaagccauucuugaacugcacuacucccaggaguuaucacuccuguacuugcuucaagacgauguggaccgggcgaaguauuacauccagaacggcauucagagcuuuaugcagaauuauucuaguaucgauguccugcuacaucaauccaggcucacaaaacugcagagcgugcaggcacugacggagauacaggaguucauuucauuuaucucuaagcaaggcaacuuguccucgcagguaccucucaaacgucugcuuaauacuuggaccaaccgauacccagacgccaagauggaucccaugaauaucugggacgauauuaucacaaaccgcugcuucuuucugagcaagauagaggaaaaauuaaccccucucccggaggacaauaguaugaacguugaccaggauggcgacccaucugauagaauggaagugcaggagcaagaggaagacauuuccagccugauccggucauguaaguucaguaugaaaaugaagaugauugauuccgcuaggaaacagaauaacuuuagccuagccaugaaguugcugaaagagcuucacaaggaaucuaagacucgcgacgauuggcucgucucaugggugcagagcuauugcagacugucccauugucggucuaggagucaagggugcucggaacaggugcugacagucuugaaaaccguuagccuucucgacgaaaauaacguguccucauaccugucuaagaacaucuuagcauuccgagaucagaauauacugcuaggaacgacuuaucguaucauugcuaacgcccucagcagugagcccgcuugucuggccgagaucgaagaggacaaagcaagacgcauuuuggaacuguccgguucaucuagcgaggauuccgaaaagguaaucgcgggccuuuaccagcgggccuuccaacaccucagugaggcugugcaggccgcagaggaagaggcucagccucccagcuggucuugcgggccagccgcaggagucauugacgccuacaugacacuggcggauuuuugcgaccagcaauuaaggaaagaagaggagaaugcuucagugaucgacuccgccgaacugcaggcauauccugccuugguuguggagaagaugcucaaggcucugaaacuuaacagcaaugaagccagacugaaguucccccgccuacuccagauaauugagcgguacccagaagagacccugaguuugaugaccaaagagaucucuuccgucccguguuggcaguuuaucucguggauuagccacaugguggcacugcuugauaaggaccaagcuguagccguucagcauucaguggaagagauaacugauaacuauccucaggcgaucgucuaccccuucauuaucuccucugaaaguuauagcuuuaaagacacaucaaccggccacaagaauaaggaguucguggcuaggauuaaauccaagcucgaucaaggugggguuauccaggacuuuauaaacgcccuggaucaguuaagcaauccagaacuguuguucaaagacuggucuaacgaugugcgagcagagcucgccaagacacccgucaauaaaaagaacaucgagaagauguacgaaagaauguaugcugcacugggagacccuaaagccccaggccuuggcgcguuucggaggaaguucauucagacuuuugggaaagaguucgauaagcauuuuggaaaagguggcaguaagcugcuacgcaugaaacucuccgacuucaaugacaucacgaacaugcuguugcugaagaugaauaaggauagcaaacccccugggaaccuuaaggaaugcucaccguggaugucugacuucaaaguggaguuuuuacguaacgaacuggagauuccaggacaauacgauggcagagguaagccccucccugaguaccacguacgaaucgccggguucgacgaaagggugaccgucauggcuucgcugcggcgcccaaaaagaauaauuaucaggggccaugaugagcgggaacaccccuuucuaguuaagggaggcgaggacuugcgccaggaucagagaguggagcagcuguuccaagucaugaaugggauccucgcacaggacagcgccuguucccagcgagcacuucagcugaggacauauagugugguaccuaugacuucuucagauccccgggccccaccgugcgaauacaaggacuggcucaccaaaaugagcggaaagcacgaugugggugcauauaugcugauguacaaaggcgcuaaccguacagagaccguuacuuccuuucgcaagagagaaaguaaagugccugccgacuuauugaagagggcguucguccggaugucuacgagccccgaggccuuucuggcacuuagaucccauuucgcuucaagccacgcccugauuuguauaucucauuggauccucgggauuggagaucgccaccugaauaacuuuaugguggcaauggaaaccggcgguguuaucgggauugacuucggccacgccuuuggauccgcuacacaauuccuaccagucccugagcuuaugcccuuucgacugacuaggcaguucaucaaucucauguugccaaugaaggagaccggccugauguauaguauaauggugcaugccuuacgggcguucagaucagacccugggcugcucacaaacaccauggauguguuuguaaaagaacccagcuucgacuggaagaauuuugagcagaaaaugcuuaagaaaggagguucguggauccaggaaauuaacgucgcugagaagaauugguacccgcgucaaaagaucugcuaugcaaaacgcaagcuggccggcgcuaacccagccgugauuacuugugaugaauugcugcucgggcacgagaaagccccugccuucagggacuacguugcuguggcgcggggauccaaggaucauaauaucagagcccaggagcccgaaucuggccuaagugaggaaacacaggucaaaugccugauggaccaagcaacggauccaaacauucuuggucgaaccugggaggggugggaacccuggauguga

SEQ ID NO: 61178 - RNA, 2016 nt, Artificial Sequence
  derived and/or modified sequence opt3 from PRKG1__Homo_sapiens__NP_001091982
augagcgagcuggaagaggacuucgccaagauccucaugcuuaaagaagagagaauuaaggaacuggagaaaagguuguccgagaaggaagaggaaauacaggaguuaaaacggaagcugcacaagugccaaucugugcuacccgucccuucaacccauaucggcccacgcacaacucgagcucaggggauuagugcagagccgcagacguaccguagcuuucacgaucucagacaggccuucaggaaauuuaccaaguccgaacggucuaaagaccugaucaaggaggcgauucuugauaacgacuucaugaaaaaucuggaauugucgcaaauccaggagauaguugauuguauguaucccguggaauacggaaaggacucaugcaucauuaaggagggugauguaggcagccucguguaugucauggaggacgggaaaguggaaguuacaaaggagggagugaaacuguguacuaugggcccugguaaggucuuuggggaacuggcuauccucuacaacugcacccgcacagccaccgugaaaacuuuaguaaauguuaagcugugggcaauugauagacaguguuuccagacaaucaugaugaggaccggacuuauaaaacauacggaguauauggaauuuuugaagagugugccaacuuuccaaucccugcccgaggagauucuaucuaagcucgccgacguccuggaagagacccacuacgaaaacggcgaguauaucauucggcagggcgcucgcggggauacauuuuucaucaucagcaaaggaacugugaaugugacccgagaagacuccccuucagaggauccagucuuucuuagaacacuggguaagggcgacugguucggggagaaagcauugcagggagaagacguuaggaccgccaacgugauugcugccgaggcgguaacgugccucgugauagaucgggacaguuuuaagcaucugaucggcgguuuagaugacgucagcaauaaagcauacgaagaugccgaggcuaaggccaaguacgaggcagaagcugccuucuucgcgaaccugaaacucucugacuuuaauauuaucgauacucuuggggugggaggcuucggccguguugagcuggugcaguugaaguccgaagagucaaaaacauuugccaugaagauacugaaaaagcgccacauugucgacaccagacaacaggaacacaucaggagcgagaagcagaucaugcaaggggcacauagugauuucauugugcggcuauaucgaacuuuuaaagacucuaaguaccucuauaugcugauggaggcuugucuuggaggugaacuguggacaaucuugcgcgauagaggcuccuucgaggacagcaccacgagguuuuacaccgccugcguaguugaagcauucgccuaucuccacucgaaagggauuauauaccgggaccugaagcccgagaacuuaauccuggaucaucgcggauaugcaaagcuaguggacuuuggcuucgccaagaagauugguuuugggaaaaagacauggacuuucuguggcaccccugaauacgucgcuccagagaucauccucaauaaaggacacgauauuucugcggacuacuggucccugggcauacuuauguaugaguugcugacagggucaccgcccuuuaguggaccugauccaaugaagacuuacaacaucauucucagagguaucgacaugauugaguuccccaaaaagaucgcuaaaaaugccgcuaaccugauaaagaaacuuugcagggauaauccuagcgaacgucugggcaacuugaaaaacggggugaaggacauccagaaacacaagugguucgaaggauuuaauugggagggccuccggaaagguacccugacaccacccauuaucccguccgucgccucuccuaccgauacuagcaacuucgacucauuucccgaagauaaugacgagccaccucccgaugacaacagugggugggacauugauuucuga

SEQ ID NO: 61179 - RNA, 1029 nt, Artificial Sequence
  derived and/or modified sequence opt3 from PRKG2__Homo_sapiens__NP_001269410
augagcaacuggaagcuguccaaagcccucucucuugagaugauccagcugaaggaaaaaguggcuagauucucaaguagcucccccuuucaaaauuuggagauuauagcaaccuuaggcgucgggggauucgguaggguugaacuggugaaggugaaaaacgagaauguagccuuugcgaugaagugcauccggaagaaacacauugucgacacaaagcagcaggaacauguguacucugagaaacgcauccuagaggaacucuguucgccuuucauuguuaagcuguaccgaacuuuuaaagauaacaaguacguguauaugcuucuggaggcuugcuugggcggggaacucuggucaauccugcgugacagaggcagcuucgaugagccaacgaguaaguuuugugucgccugcgugaccgaggcauucgacuaccugcacaggcucggaauaaucuaucgggauuuaaaaccggaaaaucugauucuugacgccgaggguuacuugaagcugguagauuuuggguucgcuaaaaagaucggauccggccagaaaacauggacuuuuuguggcacccccgaauauguugcaccugaggugauucuaaacaaggggcaugacuucucugucgauuuuuggagccucggaauccugguguacgaacuucugacagguaauccacccuucuccggcguggaccaaaugaugaccuacaacuugauacucaaagggauugagaagauggauuucccucgcaagaucacuagaaggccagaggaccugauucggcgcuuaugccgacagaaucccacagaaagacugggaaaccucaaaaauggcaucaacgauaucaagaaacacagguggcuuaaugguuuuaacugggaggggcugaaggcccggucauugccuaguccacuacagcgugaacugaaaggaccgauugaccauagcuauuucgacaaguaucccccugagaagggcaugccacccgaugaacucucuggcugggacaaagauuuuuga

SEQ ID NO: 61180 - RNA, 909 nt, Artificial Sequence
  derived and/or modified sequence opt3 from PRKRA__Homo_sapiens__NP_001132989
augcagagcacccccuucugcggcuuuuguucccuggggaagaugaucacagccaaaccuggaaagacuccaauucaagugcuccacgaguacgguaugaaaacgaagaacauaccggucuaugaaugcgagagaucugacguucagauccaugugcccaccuucacauuuaggguaacugugggcgauauuaccuguacaggggaaggaaccucaaagaaacuugcuaagcaccgggcagccgaggcggcuaucaauauucugaaagccaacgcaaguaucugcuucgccgucccugacccauugaugcccgauccuagcaagcagcccaaaaaucaguuaaacccaauaggcucccugcaagaacuagcuauccaucacgguuggcgccucccugaguacacucugucucaggaagggggaccagcacauaagcgagaguauacaaccauuugucgucuugagucguuuauggaaacgggcaaaggcgccucaaagaagcaggcuaaaagaaaugccgcggagaaguuccuggcaaaauuuagcaacaucaguccggagaaucacauuuccuugacuaacgugguugggcacucucucggaugcaccuggcauagccugaggaacucccccggugaaaagaucaaucugcucaaacggucauuacugaguauaccuaauacagacuacauucagcuuuugagcgagaucgccaaggaacaaggcuucaacauuacuuaucuggauaucgacgagcuaucugcuaaugggcaguaccagugucucgccgaacuguccaccucaccaaucacagugugccacggaagcggcauuaguugugguaacgcacagucugaugcugcccauaaugcgcuucaauaucugaaaauaaucgccgagcgcaaguga

SEQ ID NO: 61181 - RNA, 2286 nt, Artificial Sequence
  derived and/or modified sequence opt3 from PRKRIR__Homo_sapiens__NP_004696
augcccaacuucugcgccgcuccuaauuguaccagaaagagcacacaguccgaccuggcauuuuucagguuuccacgggauccggcccgcugccaaaaauggguggagaacugucgacgugcggaccucgaagauaagacucccgaccagcuuaauaaacacuacagacugugcgcuaagcauuucgagacgucuaugaucuguaggaccucaccuuaucggacagucuugcgcgauaacgccauuccaacuauauuugacuuaaccagucaccugaauaacccccauagcagacacaggaaacggaucaaggaacuauccgaggaugaaauucgcacacucaagcagaaaaagaucgacgagaccucugagcaggaacaaaaacauaaggagacuaauaacucgaaugcacagaacccuucagaagaggagggcgaagggcaggaugaggacauucugccacuuacacuggaagagaaagaaaauaaggaguaccucaagagcuuguucgagauccugauacugaugggaaaacagaacaucccccucgauggucacgaagccgacgagauuccugaaggcuuauuuaccccagauaauuuccaagcucugcuugagugccgaaucaacaguggggaagagguuuugagaaagagguuugagacgacugcagugaauacccuguucuguuccaaaacacagcagcggcagaugcuagaaauuugcgagucuuguauccgugaagagacucuccgcgaaguaagagacagccacuuuuucuccauaauuaccgacgauguggucgacaucgccggagaggagcaucugccggugcuuguuagguuuguggaugaaucacacaaccugcgggaggaguucauuggcuucuugcccuaugaggcugacgccgagauccucgcggucaaguuucauacaaugaucaccgaaaaauggggucugaacauggaguacugccgagggcaagcauauauugugaguagcggauucucuuccaagaugaaaguaguugccucacgcuuacuggaaaaguacccucaggcuauauauacgcucuguagcaguugcgcccuuaauauguggcuggcaaagucugugccagucaugggcguguccguggcuuugggcacuaucgaggaagucugcagcuuuuuccacagaucgccccagcuacugcucgagcuggauaacguuauuucugugcuuuuucaaaauuccaaagagagggggaaggaacugaaagagaucugucacucacaguggacaggacggcaugacgccuucgaaauauugguagagcuccugcaggcguuagugcugugccuagaugguauuaacagugacaccaauauccgcuggaacaauuacaucgccggcagagcauuuguccucuguagcgcuguguccgauuucgacuuuauuguuacuaucgugguccugaagaacgugcuuucuuucacaagggccuuugggaaaaauuugcagggacaaaccagcgauguauucuuugcugccggcucacugacggcaguucuccacagucugaacgaagugauggagaauauugaggucuaccaugaguucugguucgaagaagccaccaaccuugcuacaaagcuggacauacagaugaaguugccugguaaauuucgucgggcgcaccaggggaaucucgagucccagcugacuagcgaaucuuauuacaaggagaccuuaucagugccaacagucgagcauaucauucaagaacugaaagacaucuucagugagcagcaccuaaaggcacucaaaugccugagccuugugcccuccguuaugggacaguugaaguuuaacacuucugaagaacaccaugccgauauguaucgaucggaccugccgaauccugauacccucagcgcugagcugcacuguuggagaaucaaguggaaacauaggggcaaggacauugaauuacccuccacaauauacgaggcccugcaccuuccagauaucaaauucuuuccuaacguguaugcauugcucaagguacugugcauucuacccgucaugaaaguggaaaacgagcgcuacgaaaauggccggaagagacugaaggccuaucucaggaacacccugacugaccagcgcucaaguaaucuugcuuugcugaacaucaauuucgauauuaaacacgacuuagaucucaugguugacacguacaucaagcuguacacaucuaaaagcgagcuuccaaccgauaacuccgagacuguggaaaauaccuga

SEQ ID NO: 61182 - RNA, 1077 nt, Artificial Sequence
  derived and/or modified sequence opt3 from PRKX__Homo_sapiens__NP_005035
auggaggcccccggccuggcucaggcagccgcggcugaaagcgacuccagaaagguggccgaggaaaccccugauggggcaccagcccucugcccgucucccgaggcucuuucaccugaaccacccgucuacagucugcaagacuucgauacauuggcaacuguuggaacggguaccuuuggcagggugcacuuaguaaaagagaagacagccaaacauuucuuugcucugaaggugaugagcaucccugacgucauucggcuaaaacaggagcagcacgugcauaacgaaaaguccguucucaaggaggugucucacccauuccugauacgccuguuuuggacuuggcaugaugaacgauuccuuuauauguugauggaguacguccccgggggagagcucuuuucguaucugcguaauagaggcagguucucaagcaccacaggucuguuuuacagugccgaaaucauuugugcgaucgaguaucuccacuccaaagaaauuguguaccgggacuuaaagccugagaacauccugcuugaucgcgacgggcacauaaaauugaccgauuucggauuugcaaagaaacugguagacagaacuuggacacuaugcggcaccccagaauaucucgccccggagguuauccagucuaagggccaugggagggcuguggauuggugggcccuggguauucuuaucuucgagaugcugagcggauuucccccuuucuucgacgauaauccauuuggcauuuaccaaaagaucuuggcagggaaaauagacuucccccggcaccucgacuuucaugucaaggaucugauuaaaaaguuacuggugguggaccgcacgcgaagacucggaaacaugaaaaauggcgcuaacgaugucaagcaccacaggugguuccgguccguugacugggaagccgugccucagcguaaacuuaagccacccaucguaccgaagauugcgggugauggggacacuucaaauuuugagaccuacccugaaaacgauugggacacagccgcacccgugccacagaaagaucuggagaucuucaagaauuuuuga

SEQ ID NO: 61183 - RNA, 264 nt, Artificial Sequence
  derived and/or modified sequence opt3 from PRLH__Homo_sapiens__NP_056977
augaaggugcugagagccuggcuccuuugccuguugauguuaggccuggcucuaaggggagcagccagccggacccaccgccauuccauggagauccgaacacccgacauuaacccugcgugguacgcuucucgugggauaagaccagucgguagguucggccggcgcagagccacucucggggauguuccgaaacccggacugaggccucggcuuacguguuuuccacuggaaggcggugcaaugucaagucaggacggguga

SEQ ID NO: 61184 - RNA, 684 nt, Artificial Sequence
  derived and/or modified sequence opt3 from PRL__Homo_sapiens__NP_000939
augaacaucaagggcagccccuggaaagggucccugcuccuucuguuggugucuaauuuacugcuaugccagucagucgccccucucccaauuuguccgggaggugcugcaagaugccaaguuacccugagggaccuuuucgaucgggccgugguacugagucacuacauacauaacuugagcuccgagauguuuucugaguucgacaagcgcuauacacacggccgaggguuuaucacuaaagcgauuaauucgugucauacgucaagccucgcuacccccgaagauaaggaacaggcccagcagaugaaccaaaaagacuuccugagucugaucguguccauucuccguucuuggaaugagccuuuauaccaccuggucacagaagugagaggaaugcaggaggcaccagaggccauccuuagcaaggcuguugaaauagaggaacagacuaagagguugcuggagggcauggagcuaaucgugucccagguccaucccgaaaccaaagagaacgaaauuuauccuguguggucaggucucccaagucugcaaauggcagaugaggaaagccggcuuucugccuacuauaaucuguugcacugccuccgcagagacucccacaagaucgauaacuaccugaaauuacugaaguguaggauuauccauaauaacaauugcuga

SEQ ID NO: 61185 - RNA, 1113 nt, Artificial Sequence
  derived and/or modified sequence opt3 from PRLHR__Homo_sapiens__NP_004239
auggccagcuccaccacaagaggccccagggugucugaccuguucucagggcucccuccagcugucacuacgccggcaaaccagagugccgaggcgagcgcuggaaaugguuccguugccggcgcagaugcccccgcugugaccccuuuucaaucucuucagcugguacaccaguugaagggguuaaucgugcugcuauacucggucgugguuguggucggacucgugggcaacugccugcuuguacugguuauugcacgggugcgccgauugcauaaugucacaaacuuccucauagguaaucuggcccugucagacgugcucauguguacugcuugcgugccauuaacccuggccuaugcguuugaaccccgugggugggucuucggaggcggccuuugucacuugguguuuuuccugcagccuguuacaguauacgugagcgucuuuacccuaacuacaaucgcaguggauagauauguugugcucguccauccacugaggcggcgcauuagucuuagacuguccgccuacgcuguguuggccaucugggcacucucugcuguacuggccuuacccgcggccguucacaccuaucauguggagcugaaaccucacgacgucaggcucugcgaagaguucugggggagccaagaacggcagcgccagcuuuacgcauggggacuguugcuagugacguaucugcucccacugcuugucauucuguuguccuacgugcgaguuucagugaagcucagaaacaggguagucccggguugugugacucagagucaagcugauugggaccgggcccgucgcagaaggaccuuuugccuguuaguuguggucgugguaguguucgcuguuuguuggcugccccuacacgucuuuaaucuccugcgggaucuugacccucaugccaucgauccauacgcauucggcuuggugcagcugcucugccacuggcuggccaugagcucugcuuguuauaaccccuuuauauacgcguggcuucaugacuccuuccgagaggagcugcgcaaauugcucguggcauggccuagaaagaucgccccacacgggcagaauaugacagucucaguugugauuuga

SEQ ID NO: 61186 - RNA, 1566 nt, Artificial Sequence
  derived and/or modified sequence opt3 from PRLR__Homo_sapiens__NP_001191243
augaaggagaacguggccagcgcuaccgucuucacacugcuccuuuuucugaauacuugcuuguuaaacguucagcccgacccuccacuggaacuagcaguggagguaaaacaaccggaagauagaaagcccuaccucuggaucaaaugguccccuccaacgcugauugaccuuaagaccggcugguucacacuguuguaugagauaaggcucaaacccgaaaaggccgcggagugggagauccacuuugcugggcagcagacugaguucaagauucugucucugcauccuggacagaaauaccucgugcaaguccgguguaagccagaucacgguuauuggucagccuggagucccgcaaccuuuauccagauuccuagcgacuucacaaugaaugauaccacuguguggaucuccguugccguguuaucugcugucauaugccugaucauugugugggcaguagcccuuaaaggcuacucgaugguuacauguaucuuuccaccggugcccgggccuaagauuaaaggauucgacgcucauuugcuggagaagggcaagucagaagaacuacucagcgcccuggguugccaggauuuuccacccaccagugacuaugaggaucuucuggucgaauacuuggagguggacgauuccgaagaccagcaccucaugucugugcauagcaaagagcacccuucccaagggaugaagccaacguaucuggaucccgacacugacucaggacgcggcaguugugauagcccgucuuuacuguccgaaaaaugcgaggagccucaggcgaaccccucaaccuucuacgacccagaagucaucgagaagccugaaaaucccgagacaacucacaccugggauccacaguguauaagcauggaaggcaaaauucccuacuuucaugcagggggaaguaagugcucuacauggccucucccacagccgucccaacacaacccccgaagcucguaucauaauaucaccgacguuugugagcuugccguggguccugcuggcgccccagcaacgcuguugaacgaggcugggaaagaugcccuaaagucuucccagacuauuaagucacgugaagagggaaaagcgacacagcaaagagaaguagagaguuuccacagcgaaaccgaccaggauacucccuggcugcucccucaggagaagacaccauuuggcuccgccaaaccccuggacuacguggagauccacaaggucaauaaagauggugcacuuucucuguugccgaagcagagggaaaacagcgggaagccuaaaaagccaggaacccccgagaauaacaaagaauaugcuaaggugucaggcguuauggacaauaacauccucgugcuggucccugauccccaugccaaaaauguggcuugcuucgaggagagugccaaggaagcaccaccuuccuuagagcaaaaccaggccgaaaaggcucuggcgaacuucacggcaaccagcucuaaaugucggcuacagcucggcgggcuggacuaccuugaccccgccugcuuuacacacucauuccauuga

SEQ ID NO: 61187 - RNA, 156 nt, Artificial Sequence
  derived and/or modified sequence opt3 from PRM1__Homo_sapiens__NP_002752
auggccagauacaggugcugucggagccagucccgcucucgauauuaccgucaaagacagaggucacggcgcagaaggcggcgcaguugccagacccgaagaagggcuaugcgguguugccguccccgcuauagaccuaggugucggcgacacuga

SEQ ID NO: 61188 - RNA, 423 nt, Artificial Sequence
  derived and/or modified sequence opt3 from PRM2__Homo_sapiens__NP_001273285
auggugagauacaggguccggagccuguccgagcgcucucacgaaguuuaucgacagcaacuccauggccaggagcaggggcaccauggacaggaggaacaaggucuuucacccgaacacguggagguauacgagcguacccauggccagagucacuauagaaggcggcacugcagccgcagaaggcugcaucggauccaccgccgacagcauagauccuguaggcggcguaagcgcagaucuugcaggcaccggcgacgccacagaagggaaucguugggggacccuuuaaaccagaauuuccugucacaaaaagccgcugagccaggacgggaacaugcagagggcacaaagcuaccggguccccucacuccuagcuggaaacugcgcaagaguagaccaaaacaccaggugaggcccuga

SEQ ID NO: 61189 - RNA, 312 nt, Artificial Sequence
  derived and/or modified sequence opt3 from PRM3__Homo_sapiens__NP_067070
augggcagcagaugcgccaagcugaacaccgggcagucccccggacacucuccuggucauucaacaggccacgggaggggacaugagaguagcaugaaaaagcucauggcuugugugucccaagacaauuucucucuuucgucagcaggcgaagaggaagaggaagaggaggaagagggugaagaggaggaaaaagaggaacugccaguccaggggaaguuguuacugcuagagccggaacggcaggaggagggacacaaagauaacgccgaagcgcagcaaagccccgagccuaagcgcacuccaaguuga

SEQ ID NO: 61190 - RNA, 1116 nt, Artificial Sequence
  derived and/or modified sequence opt3 from PRMT1__Homo_sapiens__NP_001527
auggccgcugcagaggccgcgaacugcaucauggaaaauuucguggcuacccuggccaacggcaugagccuccagcccccucuugaggaagucuccugugggcaagcagagucuucagaaaagccaaaugccgaggacaugacaaguaaagauuacuauuuugacagcuacgcucacuucgguauucaugaggaaaugcugaaggaugagguuagaacuuugacguauaggaacuccauguuucacaaucggcauuuauucaaagacaaggugguacuggaugugggaucuggcaccgggauacuaugcauguuugcagccaaagcuggagcccgcaaggucaucggcauugaauguucgucaaucagcgacuacgcggugaagauuguuaaagcaaacaagcucgaucacguggucacaaucauaaaagguaagguggaggagguagaacugccgguugagaaaguggacaucauuaucagugaauggaugggguauugccuuuucuacgaguccaugcugaauacugucuuguaugcccgagauaaguggcucgcucccgacggacugauuuuuccugaucgugccacccuguacgugacagcaaucgaagacagacaguacaaggauuauaaaauacauuggugggagaacguguacggcuucgacaugucuuguauuaaggacgucgcuaucaaagagccacucguugaugugguagaccccaagcaguuagugaccaaugccugccugauuaaagaagucgauaucuauacugugaagguugaggaccuuacauuuaccagcccuuucuguuugcaagugaaaaggaacgauuacguccacgcgcugguggccuauuuuaauaucgaguucacgcggugccacaagcgcacuggcuuuuccaccucaccagaaagucccuacacacauuggaagcagacuguauucuauauggaagacuaccuaaccguuaaaacaggggaggagauuuucggaaccauagguaugagaccuaacgcaaagaauaacagggaucucgacuuuacgaucgaucuggacuucaaaggccagcuuugugaacugagcugcucuacugauuaccggaugcgcuga

SEQ ID NO: 61191 - RNA, 996 nt, Artificial Sequence
  derived and/or modified sequence opt3 from PRMT2__Homo_sapiens__NP_001229793
auggccaccagcggcgacugccccagauccgagucucagggggaggaaccugcugaauguucagaggcaggacugcuccaagaaggugugcagccagaggaguucgucgccaucgcggauuacgcugccacagacgaaacucagcuuaguuuucugaggggcgagaagauuuugauauuacggcagacgaccgcagauuggugguggggagaacgcgccgggugcuguggcuauaucccggcuaaccacguugguaaacauguggacgaguacgaucccgaggacacauggcaagaugaagaguauuucgggagcuacggaacucugaagcuacaccucgaaaugcuggcagaccagccucgaaccacaaaauaucauuccguaauucuucagaauaaggagucucugaccgauaaagugaucuuggacgucggcugcggcacugggauuaucucgcucuuuugugcccacuacgcucguccaagagccguguaugcgguugaagcaucagagauggcccagcauacaggacaacuggugcugcagaacgguuucgcugauauaaucaccgucuaccagcagaagguggaggacguaguucuccccgaaaagguggaugucuuagugagcgaguggaugggcacgugccugcuuacuuugaggggagaacugcgguuugacauucgcaaagccgggacccuacacggcuucacagcaugguuuagugugcacuuccaaucccuccaggagggucagccuccacaaguccugucuacugggcccuuucauccuaccacacacuggaagcagacccuuuucaugauggacgauccaguuccggugcauacgggagacguagugacuggcagcgucgugcugcagagaaaucccguuuggaggcggcacauguccguggcuuugucaugggccgucacaagucgccaggauccuaccagccaaaaagugggcgaaaagguauuuccaaucuggcgauga

SEQ ID NO: 61192 - RNA, 1410 nt, Artificial Sequence
  derived and/or modified sequence opt3 from PRMT3__Homo_sapiens__NP_001138638
augugcagccuggccuccggcgcuaccggguacucucaccuccuuaagaaacauuuccacacagugucacugaguaucagcuugauuuuaacugcaugguuuauaaacaugaaucccacggucgaguauaugaacuccaucuacaauccuguuccaugggaaaaggaggaauaucugaaaccggugcuagaggacgaucuccugcuucaguucgacguagaagaucuguacgagcccgugucugucccuuuuucguauccaaacggauugucagagaauaccagcgugguugaaaagcucaaacauauggaggccagagcgcugagugcugaagccgcacuggccagggcucgggaggaccuccaaaagaugaagcaguucgcacaggauuuugugaugcacacagacguccgcacuuguuccucuagcaccuccgugauugccgauuuacaggaggacgaagaugguguauacuucucaaguuauggccauuacgggauccacgaggaaaugcugaaagacaagauucgaacagagagcuaccgugauuuuaucuaucaaaacccccacauauucaaagacaagguugugcuugaugucggaugcggcaccgguaucuugucuauguuugcugccaaagcgggggcaaagaaggugcugggaguggaccaguccgaaauucuauaccaggccauggacaucauuagacucaauaaacuggaggauacuaucacacuuauaaagggcaaaauugaggaaguccaucugccuguugagaagguggacguaaucauuucagaauggaugggcuauuucuugcucuuugagagcaugcuggauaguguguuauacgcuaaaaacaaguaucuggccaaagggggaucugucuacccagacaucuguaccaucucccucguggcaguuagcgaugugaauaagcacgcugacaggauugccuucugggaugacgucuaugguuuuaagaugucgugcaugaaaaaggcggugauacccgaagccguaguugaggugcuugauccuaaaacgcugaucucugagccauguggcauuaagcauaucgacugccacacuaccuccauaucagauuuggaguucaguagcgacuucacacuaaaaauuacucggaccuccauguguacagcaaucgcuggguacuuugacaucuacuucgaaaagaacugccacaaucgcgucguguuuucuaccggaccgcagagcacgaagacucauuggaaacaaacagucuuccugcucgaaaagcccuuuucagugaaagccggcgaggcucugaaggguaaaguuaccgugcacaagaacaagaaagauccuagaagucuuacuguaacacugaccuugaauaacuccacgcagaccuaugggcuccaguga

SEQ ID NO: 61193 - RNA, 1863 nt, Artificial Sequence
  derived and/or modified sequence opt3 from PRMT5__Homo_sapiens__NP_001034708
augagaggccccaacagcgggaccgagaagggaaggcuggugaucccugaaaaacaggguuucgacuuucucugcaugccagucuuccacccgcgguuuaagcgcgaguucauucaagaacccgccaaaaaucgaccuggcccacagacacguuccgaucuucuguugucugggagagacuggaacacuuuaauaguuggaaagcugucacccuggaucaggccugauaguaaaguggagaagauucggcgcaauagcgaagcugcaaugcuacaggagcucaacuuuggcgccuaccugggucuuccagcguuccuguugccccucaaucaggaggacaacacgaaucuggcuagaguacugaccaaccauauccacacagggcaucacuccucuauguuuuggaugagggugccucucgucgccccagaagauuuacgggacgauauuaucgagaaugcaccgacuacccauacagaagaguauucgggagaggaaaagaccuggaugugguggcacaacuuccgcacucugugugacuacucaaaacgaauagccguggcucuugagaucggcgcagauuugcccagcaaucacguuauugacagauggcugggcgaaccuaucaaggccgcuauucuaccaacaaguaucuuucucaccaacaaaaagggguuccccgugcuguccaaaaugcaucaaaggcuuauauuucggcuguugaagcucgagguccaguucauuaucacgggaacuaaucaccauucugaaaaggaguuuugcagcuaucugcaguacuuagaguaucugucccagaaccguccuccacccaaugccuacgaacucuucgcgaaagguuaugaggauuaccuucaaucaccgcugcagccuuugauggacaaccuagaaagucagaccuacgagguguucgaaaaggaucccauuaaauauagccaguaccaacaggcaaucuauaagugucugcucgaccgcguaccagaggaggaaaaagacacaaacguucaggugcugaugguccuuggcgccgggagaggaccucuggugaaugcuucuuugagggccgcaaagcaagcugaucggcgaaucaaacucuacgccguggagaagaaccccaaugcggucguuacucuggaaaacuggcaguuugaggaauggggcucccaggugaccguagugucaagcgacaugcgcgagugggucgccccagagaaggcagauauuauagugagugaauuacuggguucuuucgcugacaaugagcuaucccccgaaugccucgauggggcccagcacuuucugaaagacgauggaguuagcaucccuggcgaguauacaucguuccuugcuccaauuucuuccucaaaguuguacaacgaggugagagccuguagggaaaaagaccgggauccggaggcacaauuugaaaugcccuaugucgugcgccugcacaauuuccaucagcucagugccccucagccaugcuuuaccuucagccaccccaacagagacccuaugaucgauaauaacagguacuguacgcuggaguuuccaguagaaguuaauacugugcuucauggcuucgcuggguacuuugagacaguccuguaucaggacauaaccuuguccauucgucccgagacucacucuccgggaauguucagcugguuuccuauccucuucccaaucaagcaacccauuacagugcgggaaggucagaccaucugcguccgauucuggagauguucaaacaguaaaaaggugugguacgagugggcgguuacggcaccugugugcuccgccauucauaaucccaccggcaggagcuauacaauagggcuguga

SEQ ID NO: 61194 - RNA, 1158 nt, Artificial Sequence
  derived and/or modified sequence opt3 from PRMT8__Homo_sapiens__NP_001243465
auggagagccuggccuccgacggcuucaagcucaaagaagugucuucagucaacagucccccuagccagccaccgcaacccguugugccugcuaagccaguacagugcgugcaccaugucuccacccagcccucuuguccugggagaggaaaaaugucgaaacuucugaauccagaggaaaugacaucaagggauuacuauuuugacagcuacgcacacuucgguauccaugaggaaauguugaaagaugaggugcggacuuuaacguaucgcaacaguauguaccacaauaagcauguuuuuaaggacaaagugguccuggaugugggcuccgggaccggcauucuaucuauguucgccgcgaaggcuggagccaaaaagguauuugguauagagugcagcuccaucucagacuauagugaaaagauuaucaaggcaaaccaccucgauaauauuaucacaauauucaaggggaaaguugaggaaguggagcugcccgucgagaagguggacaucauuaucagcgaauggaugggauacugucuguuuuaugagucuaugcuuaacacugugauuuucgcccgagauaaaugguugaagccuggcggccucauguuuccagaccgugcugcacuguacgucguugccaucgaagauagacaguacaaagacuucaagauacacuggugggagaauguguauggguuugauaugaccugcauuagggacguagcuaugaaagaaccgcugguggacaucgucgaucccaagcaagugguuacaaacgccugucucauuaaggagguggacaucuacaccgucaaaacugaggaauuauccuucacaucagcguuuugccugcagauccagcggaaugauuaugugcaugcacuuguaaccuacuucaacauugaguucacgaagugucacaaaaagaugggauuuagcacugccccugacgcuccauauacccauuggaaacagacaguuuucuacuuggaagauuaucugacugugcgcagaggugaggaaauauacggcaccaucaguaugaagcccaaugccaagaacgucagggaccuagauuuuacaguggaccucgauuucaaagggcaacugugcgagaccucugucuccaaugacuacaagaugcgguga

SEQ ID NO: 61195 - RNA, 531 nt, Artificial Sequence
  derived and/or modified sequence opt3 from PRND__Homo_sapiens__NP_036541
augagaaagcaccugagcuggugguggcucgccaccgugugcaugcuucuguucucccauuugucugcuguccagacaaggggcaucaaacaccggauuaaguggaaccgcaaagcauuacccucaacugcccaaauaacggaggcgcagguugcugaaaaucgaccuggggccuuuaucaagcagggacguaaacuggacauugauuucggugcagagggcaacagauacuaugaagccaauuacuggcaguuuccagacgggauccauuauaacggauguagugaggcuaaugugaccaaggaagcauucguaacaggcugcauuaacgccacucaagcugccaaucagggugaguuucagaagccggauaacaaacuacaccagcaagugcucuggaggcugguccaggagcuuuguagccugaagcauugcgaguucugguuggaacgcggggcgggacuccgggugaccaugcaccagcccguucugcugugucucuuagcacugaucuggcuuacagugaaauga

SEQ ID NO: 61196 - RNA, 762 nt, Artificial Sequence
  derived and/or modified sequence opt3 from PRNP__Homo_sapiens__NP_001073592
auggccaaccugggcugcuggaugcucgugcuuuucgucgcuaccuggagcgaccugggguuguguaagaaaagacccaagccuggagguuggaauacaggcggguccagguacccaggacagggcucuccgggugggaaccgguaucccccucaaggaggcggcggguggggacagccacacgguggcggguggggacagccccauggcgguggguggggacagccucacggcggcggguggggacaaccacaugguggcggguggggacagggcggugggacucacucacaguggaauaaacccaguaagccuaaaacgaacaugaagcauauggcaggcgccgcggcugccggagcaguugugggcggguuaggagguuacaugcugggcagcgccaugucccgcccaaucauucacuuugggucugauuaugaggaccgauacuaucgugaaaauaugcacagauacccgaaccagguauauuacaggcccauggaugaguacucgaaucaaaacaauuucgugcaugacugcgucaacauaaccaucaagcagcacacagugacuaccacaaccaaaggagaaaauuuuacugagacagauguuaagaugauggaacggguggucgagcagauguguauuacccaguaugagcgcgaaucacaggcuuacuaucaaagaggcagcaguauggugcuauucuccucuccuccaguaauccuccugauuagcuuucuuaucuuccugauaguugguuga

SEQ ID NO: 61197 - RNA, 1386 nt, Artificial Sequence
  derived and/or modified sequence opt3 from PROC__Homo_sapiens__NP_000303
auguggcagcugaccagccuccuucuguucguggccacauggggcaucuccgggacucccgcuccuuuggacucugucuuuucaaguagcgagagagcacaccagguuuuaaggauucggaagcgcgccaacuccuuccuggaggaacuacgacauucuucgcucgaacgugagugcauagaagagaucugugauuuugaggaagcgaaagagauuuuccagaauguggacgauacgcuggcuuuuuggucaaagcacguagacggagaucagugccuugugcugccauuggaacauccgugugccagccucugcuguggucacgggaccugcaucgacggcauuggaaguuucuccugugauugcagaucuggcugggaggguagguuuugucagcgggaggucagcuuccugaacugcucccuggacaaugggggauguacacauuacugccucgaagaggugggcuggcgcagaugcucaugugcacccggcuauaaauuaggggaugaccugcuucaaugccacccugccguuaaguuuccauguggaaggcccuggaaacggauggaaaagaagcgcagucacuugaaacgagauacugaggaccaggaagaucagguggacccuagacugaucgacgguaagaugaccaggcggggcgauagcccauggcaggucgugcuacucgacucuaaaaagaaacuggcuugcggggcaguacuuauacaucccuccuggguucugacagccgcucacuguauggaugagucaaagaaguugcucgugcgucugggagaguacgacuuacgcagaugggaaaaaugggagcuggaucucgacaucaaggaagucuucgugcauccuaacuauagcaaaaguaccacugauaaugacauugcccuucugcacuuggcgcaaccagcaacacuaucucagaccaucgugccgauuugccugcccgauuccggccucgccgagagggaacugaaccaggcuggucaggagacgcuugucacuggguggggauaccacagcucgcgggagaaggaagccaaacgaaaucgcaccuuuguucugaacuucaucaagauaccugugguaccacauaaugaguguucugaagugauguccaacauggucucagagaauauguugugcgcaggcauucucggcgacagacaagaugcuugugaaggggacaguggaggucccaugguggccagcuuucacggcacaugguuccugguuggguuaguguccuggggagagggcugcggucugcuacauaacuauggggucuacacuaaagugucuagguaucucgacuggauccacggccauauucgggauaaggaggcgccucaaaagagcugggccccauga

SEQ ID NO: 61198 - RNA, 717 nt, Artificial Sequence
  derived and/or modified sequence opt3 from PROCR__Homo_sapiens__NP_006395
augcugaccacacuccuucccauccuguuguuaagcggcugggccuucugcucccaggacgcuucugaugggcugcaaagacuacacaugcuccagauuucauacuuuagggacccuuaucaugugugguaccagggaaacgcaagucuggguggccaccuuacucauguccuggaggggccagauacgaauaccacaauaauccaguugcaaccgcuccaggaacccgagagcugggcccggacucaguccggacugcagucuuaucugcuccaauuccacggcuuaguucgccuggugcaucaggaacgaacccuugcguuuccuuugacaauucguuguuuccuggguugcgagcuaccacccgaagggucgagagcucacguauuuuucgagguggccgucaacggaaguagcuuugugaguuucaggccugagcgggcacucuggcaggccgacacccagguuacuuccggcguggucacauuuacccugcaacagcuuaaugcuuacaaccgcacgagauaugaacugagggaguucuuggaagauacuugugugcaguacguacaaaagcacaucucugcagagaauaccaaaggcagccagacaucccggucauauacuucacucguucuggggguguuagucgguagcuuuauuaucgccggaguggcugugggcauauuccugugcaccgggggacgccgauguuga

SEQ ID NO: 61199 - RNA, 1230 nt, Artificial Sequence
  derived and/or modified sequence opt3 from PRODH__Homo_sapiens__XP_011528580
auggccguggcuagaaucagcggcaccuccaacacaaggcccacugggccuucuggaacggcagguauggucucaaguguuccagccccgaccagcacacccaugcggccuuccgcgacugcuaccuggcgccacucuugcgccgcaucgaagccacagcugcaauucucagaggugcucgccaaauggcgaugcuuuuuccaucagauggcuguagaacagggccaggcagggcuugccgcuauggacacaaagcuggagguggccgucuugcaagaaagcguggcgaaauuaggaauugcaagucgugccgagauagaagauugguuuaccgcugagacucugggcguuuccgguacaauggaccuacucgauuggucuagccugaucgacuccagaaccaaacuuucaaagcaccuggugguccccaaugcccagacggggcaguuggagccucuccugaguagguucacugaagaggaagaacugcagaugacccggaugcuccaacgcauggauguguuagcaaagaaggcuacagagaugggaguaagacugaugguugacgccgaacagacuuacuuucagccagcgauuagcaggcuuaccuuggagaugcagcggaaauucaacguggaaaagccccugaucuuuaauacauaucaauguuaccuaaaagaugccuaugacaacgucacccucgauguggagcuggcacgccgagaaggcugguguuucggcgcuaaacuugugagaggggccuaccuggcucaggagagggcccgggcagccgagauuggauaugaagacccuaucaauccaacguacgaggcuacuaacgcgauguaucaucguugcuuggauuacguccucgaggagcugaagcacaaugcaaaggccaagguuaugguggcuucucauaacgaagacacaguacgcuuugccuuaagaaggauggaggagcugggucuccacccggcagaucaccggguguacuucggccagcuucuggggaugugugaccaaauauccuuucccuugggacaggccggcuauccugucuacaaauaugugccauacggucccguuauggaagugcuaccuuaucugucacgacgcgcucucgagaauagcagucugaugaaggggacccauagagaaaggcagcuucugugguuggagcuccugcggcgcuuaagaacuggaaaccuguuccacaggccagccuga

SEQ ID NO: 61200 - RNA, 390 nt, Artificial Sequence
  derived and/or modified sequence opt3 from PROK2__Homo_sapiens__NP_001119600
augagaagccugugcugugcuccccuccuucuguuguuacugcuaccuccacuccugcuuaccccgagggccggcgacgcagccgugaucacaggggcgugcgauaaggacucccaguguggagguggcaugugcugugcugucucuauuuggguuaaaucaauacggaucugcacucccauggggaagcugggagauaguugucacccuuugacgcgcaaaaacaauuucggcaacggucgacaagagcguagaaagaggaaacggagcaagcgcaagaaagaagugccauuuuucgggagaaggaugcaccauaccugccccugucucccuggacuggccugccugcggacauccuuuaaucgcuucauuugucucgcacagaaguga

SEQ ID NO: 61201 - RNA, 1182 nt, Artificial Sequence
  derived and/or modified sequence opt3 from PROKR1__Homo_sapiens__NP_620414
auggagaccacaaugggcuucauggacgauaacgccacuaauacgagcaccuccuuucugucugugcucaacccccacggggcucaugcaacaucauucccuuuuaauuucaguuacagcgacuaugauaugccacuugacgaagaugaggacgucacuaacuccagaaccuuuuucgccgcgaagaucguuauuggaauggcucugguggguauaauguugguaugcggcaucgggaauuuuauuuucaucgccgcauuagugagguacaaaaagcugcggaaccuaacaaaucuccugauugccaaccuugcuaucucugauuuucuggucgcaauaguguguugcccguucgaaauggacuauuacguugugcgccaguugucgugggagcacggacauguccucuguaccucagugaauuaucugcgaacuguaagccuguacguuaguacaaacgcccucuuagcuaucgccauugaucguuaucuggcgaucgugcacccccuuagaccuaggaugaaaugccaaaccgcaacgggcuugauugcccuggucuggacuguguccauccuaauagcuauuccaucugccuacuuuaccacagaaacugugcucgucaucguuaagagccaggagaaaauuuucuguggucagaucuggcccguggaccagcaacuguacuauaaguccuacuuucuuuucaucuucgggauugaguuuguaggaccuguggucaccaugacacugugcuaugcacggauaucacgcgaauugugguucaaggcugugccaggcuuucagaccgagcagaucagaaaaaggcuccggugucgccgaaagacgguucugguguuaaugugcauucugacugccuacguccucuguugggcgcccuucuauggcuuuacaaucgugagagauuucuuuccuaccguauucguuaaagaaaagcauuaccuuacugccuuuuauauaguggagugcauugcaaugaguaauagcaugaucaacacacuguguuucgucaccgugaaaaaugacacggucaaguacuuuaagaaaaucauguugcuacacuggaaggcuucuuacaacgggggaaaauccucagccgaucuggaccucaagaccauugguaugccagcuacagaggaaguggacugcaucaggcugaaauga

SEQ ID NO: 61202 - RNA, 1155 nt, Artificial Sequence
  derived and/or modified sequence opt3 from PROKR2__Homo_sapiens__NP_658986
auggccgcucagaacggcaauaccagcuucacacccaacuuuaauccuccacaagaccacgcauccucucugucauucaacuuuaguuacggggauuaugaccucccgauggaugaggacgaagauaugacuaagacgagaaccuucuuugccgcgaaaaucgugauuggaauagcucuugccgguaucaugcuggucugcggcauugggaauuucguuuuuaucgcagccuugacaagguacaagaaauuacggaaccugacuaaucuacucauugcuaaccuggcaaucagcgacuuccuuguggccauaaucuguugccccuuugagauggauuauuacguagugcgccagcuguccugggaacauggacacgucuugugugcuucugugaauuaucuccgaaccguuucgcuguacgugucaacaaacgcccugcucgcgauugcaaucgaccguuauuuagccauuguccauccucugaagccaagaaugaauuaccagaccgcuagcuuccuuaucgccuugguguggaugguaaguauacugauugcaauccccuccgcuuacuuugccacugagacaguucuauucauugugaaaucucaggaaaagaucuuuugcggccaaaucuggccugucgaucagcagcucuauuacaagagcuauuuccuguucauuuuugguguggaguucguggggccagucguuaccaugacgcuuuguuacgcgaggauaucccgggagcugugguuuaaagccgugcccggauuccagacugaacaaauccgcaagagauugaggugccggcgcaaaaccguacucgugcugauguguauuuuaacagcauauguccugugcugggcuccuuuuuacggcuucacuaucgugcgagacuuuuucccaaccguuuuugugaaggagaaacacuaucucacagccuucuacgucguggaauguauagcuaugucaaacaguaugauuaauaccguaugcuuuguuacggugaagaacaauacuaugaaguacuucaaaaagaugaugcuucugcauuggagaccgagccagaggggcucuaaauccucagccgauuuggaccuacggacaaacgggguccccaccacugaggagguggauuguauccgucugaaguga

SEQ ID NO: 61203 - RNA, 747 nt, Artificial Sequence
  derived and/or modified sequence opt3 from PROL1__Homo_sapiens__NP_067048
augaagcugaccuucuuucucggccuucuggccuugaucagcugcuucacacccuccgagucucagagauuuucaaggcggccuuacuuaccagggcaacugccgcccccuccacuauaucgcccccgaugggugccuccaagucccccuccaccguacgacagccgucucaacucuccccugucccuuccuuucgucccaggaagaguucccccuucgucauuuagcagguucagucaggcugugauucugucccaguuguuuccacucgaaucuauacggcagccccgccuguucccggguuauccuaaucugcacuuuccccucagaccauacuauguaggcccuaucaggauuuuaaaacccccauuucccccuaucccauucuuccuggcaauuuaccuuccgaucagcaaccccgagccucaaauaaauaucacuacggccgauaccacaauuacuaccaacccacccacaaccgcgacugcuacaaccuccacgucaacuaagccuaccaugacaaucaguagcucuacugugccaauuuccucaacccccgaaccggccacaagcaucagugcagccaccccugcugcaucuacggagaauacuacacagauauuggccaaccggccacauaccguccugcuaaaugcuacugugcagguuacaaccuccaaccagacgauucucagcucgcccgccuuuaaaucuuucuggcaaaagcuguucgcgaucuuuggguga

SEQ ID NO: 61204 - RNA, 2571 nt, Artificial Sequence
  derived and/or modified sequence opt3 from PROM1__Homo_sapiens__NP_001139319
auggcccuggugcucggcagccuucuguuguuagggcugugcggaaacuccuucucugguggccagcccucaaguaccgacgcuccuaaggcauggaauuacgagcuaccagccacaaacuaugaaacucaagauagccacaaagcggggccgaucggcauucucuuugagcugguccauauauuccuuuacguugugcagcccagagacuuuccugaagauacgcugaggaaguucuugcagaaggcuuaugaguccaaaaucgacuacgauaaaauuguauauuacgaagccggaaucauucucuguugcgugcugggucugcucuuuaucauauuaaugccacuggucggguauuucuuuuguaugugccgguguugcaauaaguguggaggcgagaugcaccagcgccaaaaggagaacggccccuuccuucgaaaaugcuuugcaaucucuuugcuggugauuuguaucauuaucucgauagggauuuucuacggauuuguugccaaucaucaggugcguaccagaaucaagaggucacggaaacuagcugacagcaacuucaaggaucuccgcacacugcuuaaugaaacuccugagcagauuaaauacauccuggcacaguauaacaccacaaaggacaaggccuuuaccgauuugaauaguaucaacuccguccucgguggcgggauucuggacagauuaaggccaaauauaauccccgugcuggaugaaauuaaaucuauggcuacugccaucaaggagacaaaagaggcgcucgaaaacaugaauagcacccuuaagucccugcaccaacagucaacgcaguugaguagcucucuaacuuccguaaaaaccucacugcggagcagucucaacgacccucugugccuuguucauccaucuuccgagacauguaauagcauacgccugucguugucucagcucaacuccaacccggaacugcgacaauuacccccuguggaugcagagcuggacaaugucaacaaugugcuaagaacugaccucgauggacuggugcagcagggcuaccaaucacuuaacgacauuccagauaggguccagcggcagaccacaaccguuguggccgguaucaagcguguauugaauaguaucgggagcgacauugauaacgugacgcagcgccugcccauccaagacauucucuccgcuuucucugucuaugugaauaacacugaaagcuacauacacagaaaucugccuacacuugaggaguaugauucauacugguggcugggaggcuugguuaucugcagucuccugaccuuaauugugaucuucuauuaccugggccuacucugcggggucuguggauacgacaggcacgccacuccaacaacccgggguugcguguccaacacgggcgggguauuucugaugguuggagugggccuuagcuucuuguuuuguuggauccugaugauuauagucgugcucaccuucgucuuuggugcaaauguggaaaaacugaucugcgagcccuauacaucuaaggaauuauuccgaguucuggauacuccguaccuuuugaacgaggacugggaauauuaccucucagggaagcuguuuaauaaaaguaagaugaaacuaaccuucgaacagguguauagcgauuguaagaaaaaccgcggcacauacggaacucugcaucuccaaaauuccuuuaacauuucugagcaccugaacaucaaugagcauaccggcucgauuagcuccgagcuugaaucauugaagguaaaccugaauaucuucuuacucggggcugccggaagaaagaaccugcaggacuuugcggccugcgguauagacaggaugaauuaugauaguuaccuugcacagacaggcaaaucuccugcuggggucaaccuguugagcuucgccuacgaccucgaggcuaaggccaauucccugcccccaggaaaccuacgcaauucacugaaacgggaugcacagaccaucaagacuauucaccagcagagagugcucccuaucgaacaaagccugucuacgcuuuaucaguccguuaaaauuuugcagaggacaggcaacggucuguuagagcgugugacccggauccucgccagucuggacuuugcucagaauuucauaacuaacaauaccagcucugucauuaucgaggaaacaaagaaguacgggcgaaccauuaucggcuauuucgagcacuaccuucaauggauagaauuuuccaucucagagaaaguggcgaguuguaagcccguagcaacugcccuggauacagcuguggacguuuuccuaugcagcuauauuaucgauccacucaaccuguuuugguucggaauuggcaaagccacggucuuuuugcugcccgcauuaaucuucgccgugaagcucgcuaaauacuauagaaggauggacucggaggauguguacgacgaugucgaaaccauaccuaugaagaauauggagaacgggaacaauggauaccauaaggaccacguuuaugguauucauaacccagugaugacuuccccgucucagcacuga

SEQ ID NO: 61205 - RNA, 2505 nt, Artificial Sequence
  derived and/or modified sequence opt3 from PROM2__Homo_sapiens__NP_001159449
augaagcacacccuggcccuccuugcuccccuguugggcuuagggcugggacuagcacucagccagcuggccgcgggugcuacagacugcaaauuccuuggcccugccgagcaucugacuuuuacgccagcagccagagcuaggugguuggcaccgcgggugcgcgcccccgggcuccuggauucccuguacggaaccguccgacguuuccucucuguugugcaguuaaacccuuuuccaucagaacugguaaaggcucuuuugaaugagcuggccagugugaaagucaacgaagugguuagauaugaggcgggcuacguggucugugcagugaucgccggucuauaucuccugcuuguacccacagcugggcugugcuucuguugcuguaggugccaccggcgcuguggaggcagaguuaagacugaacauaaagccuuggcaugcgagagggcugcccucaugguguuucuguuacugaccacacuccuucuguugauuggcgucgugugugcguucgugaccaaucagcggacucacgagcagauggggccuagcauagaagccaugccagagacacuacugucccucuggggacuggucucugacguuccccaggaacuucaagcaguggcucagcaguuuucgcugccucaggagcaaguaucagaggaauuggauggugugggcgucagcaucgggagugccauucauacccagcuccgcuccucuguguacccacuguuagcugccguuggaagccugggccaggugcuacaggucuccgugcaccaccuccaaacgcugaacgcaacuguaguugagcuucaggccggucagcaagacuuggaaccggcuauccgagagcauagagauaggcugcucgaacugcuucaggaggcgcggugccagggggacugugcaggagcccugucaugggcucguaccuuggagcucggcgccgauuucagucaggugcccagcgucgaccacgugcugcaucaauuaaagggcgucccugaagcaaauuuuucuuccauggugcaggaggaaaacucaacauucaaugcccugccagcucuagccgcaaugcagacuagcaguguugugcaggagcucaagaaagcgguagcucaacagcccgaagggguccgcacccuggccgagggauuuccuggucuugaggcagccucuagaugggcucaggccuugcaggaaguggaggaauccagcaggccauaucugcaagagguucagcgguacgaaacauaucgauggauugugggcugcguccucugcucggugguacuguucgugguuuuauguaaccugcuuggguugaaucucggaaucuggggccugucugcacgcgaugaccccucccacccggaggcuaagggugaggccggggcgagauuucuaauggccggcgucggacugucauuccucuucgcugcaccucugauacuuuugguguuugccaccuuccuggugggcgggaacguccagacguuaguuugccagaguugggaaaauggagagcucuuugaguucgcugauacucccgguaaccugccaccuagcaugaaucuuucccaacuguugggccucaggaaaaacaucucuauucaccaggccuaccagcaauguaaggaaggggcagcgcuguggacagugcuacagcugaaugacagcuacgaucucgaggaacaucuggacaucaaccaguauaccaacaaacuucggcaggaguugcaaucacugaagguggacacucagaguuuagaucuccuguccagcgccgcucgcagagaccuugaagcccugcagucuucaggacuacagaggauucacuaccccgauuuucucguacaaauccagcguccagucgugaagacaaguauggagcagcuggcacaggaauugcaaggccuggcucaggcccaggacaauagcguuuuaggucaacggcuccaggaggaggcacaggggcugcgaaaccuucaucaggaaaaaguggucccccaacagucccugguggccaaguugaaucucucuguuagagcucuggagucgagcgcgccuaaccuacagcuggaaaccuccgaugugcuugccaauguaacguaucucaaaggcgagcugccagcaugggcugccaggauauugcgcaacgucucagaaugcuuccuggcccgggagaugggauacuuuagucaguauguggcuugggugagagaggaagucacccaaaggauugcaacaugucagccguuaucuggcgcccucgacaauagccgcguuauccugugcgauaugauggcggaccccuggaacgcuuucugguuuugucuugccuggugcacuuucuuucugauuccuuccaucaucuucgcagugaagaccucaaaauacuuucgaccaauucggaagcguuugagcucuacauccagugaggaaacucaacucuuccacauacccagaguaaccagccugaaacuauga

SEQ ID NO: 61206 - RNA, 681 nt, Artificial Sequence
  derived and/or modified sequence opt3 from PROP1__Homo_sapiens__NP_006252
auggaggccgaaagaaggcggcaggcugagaagcccaaaaagggccgcguggggagcucccugcucccugaacgacacccagcaaccggaacaccgacuacgaccgucgacucuucagcacccccuugccguagacuuccaggugcgggcgggggaaggagucgguucagcccccaaggcggucagcgcgggagaccucauuccaggcggcgccaccgaacaacuuuuucuccaguucagcuggagcaguuggaaucggcuuucggaagaaaccaauaccccgauaucugggccagggagucauuagcacgggacaccggccugagcgaggcccguauucaggugugguuucagaaucgcagagcuaaacagaggaagcaagaacggagucuacuccagccucuggcacaucuuuccccagccgcuuucucuagcuuucugccggaguccacagccugucccuauucauacgcggcaccuccacccccuguaaccugcuucccacaccccuauagucaugccuugccgagccagccuucuacuggcggggcuuuugcccucucccaccagucagaagauugguaccccacacugcacccagccccugcuggacaucugcccuguccacccccuccaccgaugcuccccuuaagccuggagccuaguaaaucuuggaacuga

SEQ ID NO: 61207 - RNA, 2031 nt, Artificial Sequence
  derived and/or modified sequence opt3 from PROS1__Homo_sapiens__NP_000304
augagagugcugggcgggaggugcggagcccuccuugcuugucuguuguuaguccugcccguuagcgaggcaaacuuccuauccaagcagcaagccucucaggugcucguacggaaacgccgagcaaauucacugcuugaagagaccaagcaggguaaccuggaacgugagugcaucgaagaguuguguaauaaagaggaagcuagagagguguuugaaaacgacccugagacagauuacuucuauccaaaguaccucgucugccugaggaguuuucagacuggccuguucacggccgcacggcaaagcaccaaugccuauccggaccuccgcuccugugugaacgcuauucccgaucagugcucuccuuuaccauguaaugaggacggguacaugucgugcaaagauggaaaggcaucauuuacauguacuugcaagcccggcuggcagggugaaaaaugugaguucgacauaaacgaaugcaaggauccuagcaauaucaacgggggaugcagucagauuugugacaauaccccaggcuccuaucacugcucuuguaaaaacggcuuuguuaugcugagcaauaagaaagauugcaaggacguggaugaguguucccuuaagcccucaaucugcgggacagccgucuguaaaaacauuccuggagacuucgaaugcgaguguccagaggguuacagauauaauuugaagaguaaaagcugcgaagauaucgacgaguguucugaaaacaugugcgcucaacugugcgugaacuacccgggcggguacaccuguuauugcgacggaaagaaaggcuuuaagcuagcccaggaucagaaauccugugagguaguuucagugugccucccccugaaucuugacacuaaguacgaacuguuguaucucgcggagcaguucgcgggugucgugcuguacuuaaaguuuaggcugccugagauaagccgguucagugccgaauuugauuuccgcacauaugacucugagggggugauccucuacgcugaauccauugaucauagcgccuggcuucugaucgcauugcgaggaggcaaaauugagguccaacuaaagaacgaacacaccucgaaaaucacgacuggcggggacguuauaaauaacggacuguggaauauggugucuguagaggagcucgaacauuccauuucaaucaagauugcuaaagaggccgugauggauaucaacaagccagguccccuguucaagccugaaaauggccuucuggagaccaaagucuauuuugcgggguucccaagaaagguggagagugaauugaucaaacccauuaacccgaggcucgacggauguauacggagcuggaaucugaugaagcagggcgccuccgguaucaaagagauuauccaggaaaagcaaaacaagcacugcuuaguuacaguggagaaagggucuuacuacccuggcagcggaauagcacaguuucauauugauuauaauaacgucucaagugcugaaggcuggcacgugaauguaacucugaacauccgucccuccaccgggacaggaguuaugcuagcccucgugagcgguaauaacaccgucccauucgcugugucucuggucgacucaacgagugaaaagagccaggauauccuuuuguccguggagaacacuguuauuuaccgcauccaggcccugucucucuguucggaccaacagagccaccuggaguuuagagugaauaggaacaaucuugagcuguccacaccuuugaaaauugaaaccauaucacaugaggaccuccagcggcagcuggcaguauuagauaaggccaugaaagcuaaggucgcgacuuaucugggcgggcuacccgacgugccauucagugcaacacccguuaacgccuuuuacaauggaugcauggaagugaacaucaauggcguccaacucgaucuggacgaggcuauuucuaagcacaacgauauccgagcccauagcuguccuuccguguggaaaaagaccaaaaauucauga

SEQ ID NO: 61208 - RNA, 2835 nt, Artificial Sequence
  derived and/or modified sequence opt3 from PROSER1__Homo_sapiens__NP_079414
auggacaagaaaaguuucgagauggugcuggaugaaaucagaaaggccguccucaccgaguacaaacuuaaggcuauugaauauguucacggcuacuuuuccucugaacaggugguagaccuguugagguauuucucaugggcagagccccaauuaaaagccaugaaggcgcugcagcauaagaugguggcuguccagccuacagaggugguuaacauacuaaauugcuuuacuuucaguaaagauaagcucguggcccuggagcuucuggcaagcaacaucauugacgcccaaaauucccggccaaucgaagauuuguuucgcgucaacaugucugagaaaaagcgauguaaacguauucucgaacaggcuuucaaagggggaugcaaggcaccgcacgccaugaucucgucaugugguacgauacccggcaauccuuacccaaaggggagacccagcaggaucaacggaauuuuuccuggcaccccacugaagaaagacggugaggagugcacaaaugaagggaagggaaucgcugcccggauucugggccccaguaaaccuccaccguccacuuauaacccccauaagccugugccauaccccaucccuccaugucgcccccacgcgaccauagcaccgucugccuauaauaacgcuggccucguaccuuuagccaauguuauugcacccccaccucccccauacacacccaacccuguggggaccgagaaugaagaucugagcaacccauccaaaccgauccagaaucagacuuucucaacacccgcuagucagcuuuuuagcccucauggaucuaacccauccacccccgccgcgacgccugucccaacugccucacccgugaaggcaauuaaccacccgagcgcuagugccgcugccaccgugucugguaugaauuugcugaacacaguccuaccuguuuucccaggccaaguguccagcgcaguacacacuccccagccuucgauccccaauccaaccgugaucagaacaccuucucuccccaccgccccagucacguccauucauucaacuacaaccacuccggugccuaguauauuuagcgggcugguuucccuucccggaccaucugcuacacccaccgcggcaacgccuaccccaggccccacaccuaggagcacucuggguucaagugaggccuucgcuuccaccagcgccccguuuacaucuuugccauucucaacuagcagcuccgcagccucuaccucgaaccccaauagcgcuucccucucaaguguguucgccgggcugccuuuaccacugcccccuacaucucagggacucagcaacccgacccccgucaucgcaggcggcuccacuccaucaguggcggggccucuuggaguaaauagcccccuguugucugcucuaaaggguuuucugacguccaacgacacaaaucucauuaacaguagcgcccugucuuccgcaguuaccucaggccuugccagucugagcucguugacucuccaaaauuccgauucuagcgcuucagccccaaacaaaugcuacgcaccuagugcuauccccaccccacagcggacauccaccccggggcuggccuuauucccuggacugcccucuccaguggcgaauagcacuuccacaccccuaacgcucccuguccagucaccacuggccaccgcugcaagcgccaguacuucugugcccgucuccuguggcagcucggcuucacuuuugcgcgguccucacccggggacaucugaccugcauauaaguuccaccccagccgcaacaacucuccccgugaugauuaagaccgaaccuacgagccccaccccaucugcguuuaaaggcccuagccacuccggaaaccccucacacggcacacuggggcuuaguggaacucugggucgagccuauaccagcacaucuguuccaaucuccuugucagcuugccucaauccugcccugaguggcuuaagcucccugucuacuccgcuaaacgggucgaacccccucagcucaaucucccugccaccucauggaaguucuacccccauugcaccaguguucacggcccuuccuagcuuuacauccuugaccaauaacuucccccugacuggcaauccgucacucaacccaucuguaagccugccugguaguuuaaucgcuacauccagcaccgcagccacuucuaccucacugccccacccauccaguacagcugcgguccuuagcggguugucggccucugcacccguguccgcugccccuuuuccgcucaaucugagcacggccguucccucacuauucagugugacccagggcccacugucuuccagcaacccuucauaccccggauuuagugucagcaauacuccuuccgugacaccagcucuccccucuuucccuggccugcaagcaccaagcaccguagccgcggugacaccccuuccgguugcugccacugcaccuuccccagcccccgucuugccuggguuugcuucagcauucucuaguaacuuuaauucggcccugguggcgcaggcuggauuaagcuccggucuccaggccgcaggaucuucaguguucccagggcugcuuagccugcccggcauuccgggcuucccucagaaccccucccaaaguucuuugcaggagcuccagcauaaugccgcugcccagagcgcacugcuacaacagguccacucagcuuccgcccuggagaguuauccagcgcagccugaugguuuucccagcuacccaucugcccccgggaccccuuucucccuccagccaucacugagccaaucgggcuggcaguga

SEQ ID NO: 61209 - RNA, 2217 nt, Artificial Sequence
  derived and/or modified sequence opt3 from PROX1__Homo_sapiens__XP_011508075
augcccgaccacgauagcaccgcccugcucuccagacagacaaagaggcggcgcguggacaucggcgucaaacgaacuguugggacggcuucugcauucuuugccaaggcgcgugcuaccuucuuuucagccaugaacccucaaggaagugagcaggauguggaauacagcguagugcagcaugcagacggugagaaauccaauguccuuagaaagcuguugaaaagggccaacucuuaugaagaugcuaugaugccauucccgggcgcaacaauuauaucgcaguuacugaagaauaacaugaauaagaacgggggaacugagcccucauuucaagccagcggccuaaguuccaccgguucugaagugcaccaggaggacaucugcagcaauuccucacgggauaguccuccagagugucucagccccuucgggcgcccuacaaugucucaguuugacauggauagacugugcgacgaacaucuuagggcuaaacgggcccgcguugagaacauuauccgaggaaugucccacucaccaagcguggcgcugagaggcaaugaaaacgagagggagauggcaccccagagugucucuccucgggaauccuaccgugagaauaagcgcaaacaaaaguugccacagcagcagcaacagagcuuccagcaacucgugucggccagaaaagaacagaagagggaggaacggcgacagcugaagcagcaacuggaggauaugcagaaacagcuccgccaguuacaagagaaguuuuaucagauuuacgacucuaccgauuccgaaaacgacgaggacggcaaucugucagaagauaguaugagaagcgagauccuugacgcuagggcccaggauuccguagggcggucugacaacgaaaugugugaguuggauccgggacaguucauagaccgcgcaagagcucugaucagggagcaagaaauggccgagaauaaacccaagcgugaagguaacaacaaagagcgggaucauggcccuaauagccuacagccagaagggaagcaccucgcggagacucugaaacaggagcuuaacacagccaugucacagguuguggacaccgucgugaagguguuuagugcaaagcccucccgacaagucccucagguuuucccaccccugcagauuccgcaagcuagauuugccgugaauggagaaaaccacaauuuccauacggcuaaccagagguugcagugcuucggcgauguaaucauuccuaauccccucgacacuuuugguaacgugcagauggccagcucuaccgaucaaacagaggcacugccauuagucgugcgcaaaaauucaagugaccagagcgccuccgggccugcugcgggaggccaccaucagccccugcaccagucuccacucucggcaacuaccggcuucacaaccagcacguuucggcaccccuucccucuuccacugauggccuauccguuucaaucccccuugggggcuccuucaggaaguuucucugguaaggacagagccagcccagaaucccuagaucugacuagggacacaaccucacuccgcacuaaaaugagcucucaucaccugucccaucaccccuguaguccugcacauccacccagcacagccgagggccuuucucuguccuugaucaagucagagugcggggaucuccaggacaugagugaaauaagcccguacucgggauccgcuaugcaggagggccugucuccuaaccaccugaaaaaggccaagcugauguuuuucuauacccgauacccaagcucaaauaugcuaaaaacguacuuuagugauguuaaguucaaccgguguauuaccucccagcucaucaaaugguuuucuaauuuccgugaauuuuauuacauucaaauggagaaguaugcaagacaggcgaucaacgacggugugacaagcacugaagaguuauccaucaccagggauugcgagcuuuaccgcgcuuugaauaugcacuauaacaaagccaacgacuucgaacagguccccgagcgguuccuggaaguggcacaaauuacacucagagaguuuuucaaugccauaaucgcugggaaggauguagacccuucauggaagaaagccauuuacaagguuaucuguaaacuggauagcgaagugcccgagauauuuaagaguccaaacugccuucaggagcuguugcaugaauga

SEQ ID NO: 61210 - RNA, 1269 nt, Artificial Sequence
  derived and/or modified sequence opt3 from PROZ__Homo_sapiens__NP_001243063
auggccggcugcgugccccugcuccaggggcuuguccugguuuuggcuuuacacagaguggagccuagcgcaaccucccugaaggaaaggcauggacuacacucugacucagccuguacagguguacaagagagucucuuccugccagcgagcaaagcuaacgaugugcuuguccgguggaagcgcgccggcuccuaccuguuggaggaacucuuugaagggaaucuggagaaagagugcuaugaagagaucuguguguacgaagaggcacgagagguuuucgaaaacgagguggucacugacgaauuuuggcguagauauaagggaggcucuccgugcauuucgcagcccugucugcauaaugguucaugccaggauagcauauggggguacacguguaccugcaguccuggauaugagggcuccaacugugaacucgccaaaaaugagugccacccagagaggacagacggcugucagcauuucugcuuacccgggcaagaaucuuacacuugcagcugugcucagggauaucggcugggugaggaucacaagcagugcgugccucacgaccagugugcaugcggcguacuuaccuccgaaaagcgcgccccagauuugcaagaccugcccuggcagguuaaacuaacaaacucagaggggaaggauuuuuguggaggcgugaucauuagagaaaauuucguccucaccacugcuaaaugcagucugcuucauaggaacaucacagugaagaccuacuuuaaucggacgagccaggacccucugaugauuaaaaucacucacgugcauguccacaugcgcuacgaugccgacgcgggugagaacgauuugucucuccuggaguuagaauggccaauacaguguccgggggcaggacugcccguuugcaccccugagaaggacuucgccgaacaccuccuuaucccacgaacaagaggccuguuguccggcugggcuaggaaugggacugaccuaggaaacucacugaccacacggcccgugacccucguagagggugaagaguguggccaagugcugaaugucacggugacuacacguaccuauugcgagcgcagcaguguugccgcaaugcauuggauggaugggucuguggucacuagagaacacaggggauccugguuucuuacaggcgugcuggguagccagccuguagggggccaggcucauaugguuuuggugaccaaggucucgcgguacucucucugguucaaacaaauuaugaacuga

SEQ ID NO: 61211 - RNA, 1515 nt, Artificial Sequence
  derived and/or modified sequence opt3 from PRPF19__Homo_sapiens__NP_055317
augagccugaucugcuccauuucuaacgaggugcccgaacacccuugugucucaccaguuaguaaucauguguacgagagaaggcucauagaaaaguauaucgccgagaacggcaccgacccgauuaauaaccagccccuuagcgaagaacaacugaucgauauuaaaguagcucacccuauccggccaaagcccccuuccgcaacaucuauaccagccaucuugaaagcguuacaggacgagugggaugcugugaugcugcauucguucacucuacgccagcagcuccaaacgacccgacaggaacugucacacgcccuuuaccagcaugacgcagccugccgugucauugcuagacugacaaaggaggugacugcagccagggaggcuuuggccacccucaaaccccaggcggggcugaucguuccucaagcagugccaagcagucagccguccgucgugggagccggugagcccauggaucugggcgagcucguagggaugacaccugaaauuauccagaaguuacaggacaaggcuaccguucugacuacagagcggaaaaagcgcggaaaaaccgugccagaggaacuugucaagcccgaagaguugucuaaauauagacaaguggccagccacgugggccugcacuccgcaucaauaccugguauucuagcucucgaucuguguccaagugacacgaauaagauccuuacugggggagccgauaagaacgucguuguguuugacaaaagcucugagcagauucuggcgaccuugaagggccauacaaagaagguaacuuccguggucuuccaccccucacaggaucucguguuuagcgccaguccggacgcaaccaucaggaucuggucuguuccuaaugcuuccugcgugcaagucgugcgggcccaugaaagcgcuguaacaggccugucguuacacgccaccggggauuaccugcucucuuccucagacgaccaguauugggcauucagugauauucagacgggacgcguucuuacuaaagugacagacgagaccagcgguuguucccugacuugcgcccaguuucaccccgauggcuugauauucgggacaggaaccauggacucucaaaucaagauuugggaucuaaaagaacgaacgaacgucgcuaauuuuccaggccauagcgguccuaucaccucaauagcguucagugagaacggguacuaucuggcaacagccgcugacgauuccagcgugaagcucugggaccugagaaaacuuaaaaauuuuaagacucugcaguuggauaacaauuucgaagucaaaucucucauuuuugaccagucaggaaccuaccuggccuuaggcggcacagaugugcagaucuacaucuguaagcaauggacugagauucugcacuucaccgagcauagugggcuaacaaccggaguugcauuuggucaccaugccaaauucaucgcuagcacuggcauggacaggucccucaaguucuauucucuguga

SEQ ID NO: 61212 - RNA, 1500 nt, Artificial Sequence
  derived and/or modified sequence opt3 from PRPF31__Homo_sapiens__XP_006726118
augagccuggccgacgagcuccuugcugaucuggaagaggcagccgaagaggaagagggcggguccuacggagaggaagaggaggaacccgcgaucgaggacgugcaggaagagacccaauuggauuuaucuggugacucagucaagacaauugcuaaacugugggauaguaagauguucgccgaaauaaugaugaaaaucgaggaauauauuagcaagcaggcaaaagccuccgagguuaugggcccuguggaggcugcaccagaauacagaguaaucguggacgccaacaaucuaacugucgagauugaaaacgagcucaauaucauacacaaguuuaucagggauaaguauucuaaacgguucccggaacuggagucgcuugugcccaacgcucuggacuacauucgcacgguuaaggaguugggaaauucacucgauaaaugcaagaacaaugaaaaccugcagcagauccugaccaaugccacaauuaugguggucagcgugacugcgaguaccacacaagggcagcagcucuccgaggaagaguuagaacgacuggaggaggcaugugacauggcccuugaauugaacgcuucuaaacaucguaucuaugaguacguagaaagcagaauguccuuuauagccccuaaucugucaauuaucauuggcgcaaguaccgcugccaagaucauggguguugccgggggacuaacuaaccucagcaagaugccagcgugcaauaucaugcugcuuggcgcacagaggaaaacacugucuggcuucuccucaaccagcguguugccccacacgggguauauuuaccauagugauauaguccaaucucucccuccagaccugcggcgcaaggcugccagauuaguggcugccaaauguacucuggcagccaggguggauuccuuucacgagagcaccgagggaaaggucgguuacgaacucaaagacgagaucgaacggaaguucgacaaauggcaggagcccccuccaguuaaacaggugaagccgcuucccgcuccucuggauggccagcgcaagaagcgagggggaagaagguaucggaaaaugaaggaacguuugggccuaacagagauucgcaaacaagcgaacagaaugucguuuggugagaucgaagaggacgcauaccaggaagaucugggguucucucucggacaucugggcaaguccggcucagggaggguacggcagacucaagugaaugaggccaccaaggcucgaauaaguaaaacacuucagcgcacccugcagaagcagagcgucguguauggagguaaauccacgauuagagacaggucuagcggcacugccucaaguguugcauuuacaccauugcaagggcucgaaaucgugaacccccaggccgcugagaagaaagucgccgaggcaaaccagaaguacuucuccagcauggcggaauuucugaaggugaaaggagagaagucuggcuuaaugucaaccuga

SEQ ID NO: 61213 - RNA, 1050 nt, Artificial Sequence
  derived and/or modified sequence opt3 from PRPF38B__Homo_sapiens__XP_011539987
augaccaucggcgagaugcugcggagcuuccucacaaaacuugaaugguuuuccacucuguuccccaggauuccugugccaguccagaaaaacauagaccaacagaucaagacgcggccgcgcaaaauuaagaaagaugggaaggagggagccgaagagaucgaccgacacguugaacguagaaggucucggucaccccgcagaaguuugagcccuaggcgguccccacgccgaucuagaucgaggucacaucaccgggagggucauggcagcaguuccuuugaucgugaguuagaacgcgagaaggaaagacagaggcuggagcgggaggcuaaagaacgagagaaggaacgcagaaggucucggagcauugaccgcgggcuagagagaaggcguucccggucacgagaaagacacaggagucgcagccggucuagagauaggaaaggagaccgccgagaucgggaccgugagagagagaaggaaaaugagaggggccgccggagagauagggacuacgauaaagaacgagguaacgagcgcgaaaaggagcgggagagauccagggaacguucaaaggagcagcgcagcagaggggaaguggaggaaaagaagcauaaagaggacaaggaugacagaaggcaccgagacgauaaacgggacaguaagaaagagaagaagcacucucgcuccagaagcagggaacggaaacaucgaucgagaucucgcuccaggaaugcaggaaagcguucacggaguagaagcaaagagaaguccucuaaacacaagaacgaaagcaaggagaaaucaaauaagaggagucgcuccggcagccaaggccgaaccgauucuguagagaaaucaaagaaaagagaacauagucccagcaaggagaagucccggaaaaggucucgcucgaaggaacguagccacaaaagagaccacuccgauucaaaggaccagagugauaaacaugaccggaggcgcucucagagcaucgagcaggaaucccaagagaagcagcacaagaacaaagaugagacaguguga

SEQ ID NO: 61214 - RNA, 1251 nt, Artificial Sequence
  derived and/or modified sequence opt3 from PRPF3__Homo_sapiens__XP_011508434
auggcccugagcaagagagagcucgacgaacuuaaacccuggaucgagaagaccgugaaaaggguccugggcuucuccgaaccuacaguugugacugcugcauugaacugcguagggaagggaauggauaaaaagaaggccgcggaccacuuaaaaccauuucuggaugacucuacgcuacgguucguggauaagcucuuugaggcugucgaagagggucgcucaagucgacauagcaaauccucuucggaccguucaagaaagagggagcugaaagaaguguucggcgaugacagcgagauuaguaaggaauccucugggguuaagaaacggcgcauaccgagauuugaggagguggaagaggaacccgaggucaucccuggaccacccagcgaauccccuggcaugcuuaccaagcugcagauuaaacaaaugauggaggccgcaacaaggcagaucgaggaacggaagaaacaguugucauucauuaguccacccacuccucagccaaagaccccgucuagcucccaacccgagcgccucccuaucgguaauacaauacagccaucacaggccgcuaccuuuaugaacgaugcaaucgaaaaagcccgaaaggcugccgagcugcaggcgaggauucaagcacagcuggcccucaagcccggguuaaucggaaaugcuaacauggugggccuggccaaucuucacgcaaugggcauugcuccuccaaaaguagaauugaaggaccagacuaaacccacaccgcugauccuagaugagcaggggagaaccguugacgccacgggaaaggagauagaacucacucaucggaugccuacccugaaagcgaacauucgugccgugaagcgcgagcaauucaagcagcagcuuaaagaaaagcccagcgaggauauggaaaguaauacauuuuucgacccaagagucucuaucgcaccuucccaaaggcagcggcgaacuuuuaaauuccacgacaaggguaaauuugagaagauugcucagcgccugagaaccaaggcccaguuggagaaacuccaagcugaaaucagccaggccgcaaggaagacaggcauccauaccucgacgcggcuggccuuaauugcucccaaaaaggagcugaaagaaggggauauaccagagaucgaguggugggacucuuacauuauccccaacggauucgaucucggcaagucccaggaacgcagacuuuucuggaaucacaagucauguuga

SEQ ID NO: 61215 - RNA, 2793 nt, Artificial Sequence
  derived and/or modified sequence opt3 from PRPF40A__Homo_sapiens__NP_060362
augugcagcggcuccgggagaaggcggucuucacugagucccaccaugcgcccuggaacaggugccgagcgaggcgggcucaugaugggacacccaggcaugcauuacgcuccgauggguaugcaccccauggggcagcgugcaaacaugccuccagugccccauggaaugaugccucaaaugaugccacccaugggcggcccuccaauggggcagaugccgggaaugaugagcuccgucaugcccgguaugaugaugucucacaugucgcaggccucaaugcagccugcgcuuccacccggcguuaauagcauggacguggcugccgggacugcaaguggagccaaguccauguggacggaacauaaaucuccugauggcagaaccuauuacuauaacacagagacuaagcaaagcaccugggaaaaaccagacgaucugaagacacccgcugagcaguuguuauccaaauguccguggaaggaauacaagucagacagugguaaaccuuauuacuauaauagccagaccaaggagucuaggugggcaaaacccaaggagcuggaagaucuagagggguaccagaacacuaucguagccggaucccucauuacaaaaucaaaucugcacgcuaugauaaaggccgaagagagcaguaagcaagaggaaugcaccacgacuucuaccgcgccagugccuacaacugagauccccaccacaauguccaccauggcagccgcugaagccgcagcugccgucguggcggccgcagcugccgcugccgcagccgcugcggcagccaacgcuaaugccagcacgucggcaucuaacacuguuuccggcacagugccagucgugcccgagccugaaguaaccucaauuguugccacuguggucgacaaugagaacacagugaccaucaguacggaggaacaggcucagcuuaccagcacaccagccauucaggaucaauccguggaggucucuagcaauacuggcgaagagaccucaaaacaggaaacaguugcagacuucacuccgaagaaagaggaggaagagagucagcccgcgaagaaaaccuacacauggaacaccaaggaagaggcuaaacaagccuuuaaggaacuguugaaggagaaacgggugccuuccaaugcaagcugggagcaggccaugaagaugaucauaaacgauccacgcuauucugcucucgccaaacugucagaaaagaaacaggcauucaaugcuuacaagguacagacugagaaggaagagaaagaggaagccagaaguaaguauaaagaggcgaaggagagcuuucaaagguuccuggagaaccacgagaaaaugacguccacaacccgguacaagaaggccgaacagauguuuggggagauggaaguguggaacgcuaucucugagcgcgaccgacucgaaauuuaugaggaugucuuauucuuucugucgaaaaaggaaaaagagcaggcaaagcagcuuagaaaaaggaauugggaggccuugaagaacauccuggacaauauggcuaacgugacuuacagcaccacaugguccgaagcccaacaguaucuaauggauaaucccaccuucgcagaggacgaagaacuccagaacauggacaaggaagaugcgcugauuuguuuugaggagcauauccgggcccuugaaaaagaggaagaggaggaaaagcagaaaucacuguugcgugagcgcagaaggcaacggaagaaucgagaaaguuuccagauauuucucgacgagcugcacgaacauggacaguuacacucuaugagcuccuggauggagcuguacccuacuauuucaagcgauauccgcuucacaaacaugcucggucagccaggcucuacggcucuugaccuguuuaaauucuacguugaggauuugaaggccagauaucacgacgagaaaaagauuaucaaggauauccuaaaagacaagggguucguggucgaagugaauaccacuuuugaagauuucguagcaauuauauccaguacaaaaaggagcaccacacuggacgcuggaaacaucaagcucgccuuuaauucucugcuugagaaagcagaagcccgggagcgcgagagagaaaaggaggaagcuaggaagaugaaacguaaggaguccgcguucaaaucaaugcugaagcaagccgcacccccgauugaauuggaugcuguuugggaggacauccgggagcgauuugugaaagaaccugccuucgaggacauaacucucgaaagugagagaaagaggauuuuuaaggauuucaugcauguccuggagcacgaaugccagcaucaccauagcaaaaacaagaaacacucgaagaaauccaagaagcaccaucgcaaacggucuagaagcaggucaggcagugacuccgaugacgaugacucucacagcaagaaaaagcgccagcgauccgagucacggagcgccagugaacauucuuccagcgcugagucggaacguucauacaaaaagucuaaaaagcacaagaaaaagaguaaaaagagaaggcacaaauccgauagcccagagucugacgcagagcgcgaaaaggauaagaaagagaaggaccgggaaagcgagaaagauagaaccaggcaacgauccgaaucaaagcauaaaagucccaagaagaaaacggguaaggacagcgggaauugggauaccucuggcuccgaguuaucagagggagaacuggagaaacgccggagaacacuacucgaacagcuggacgacgaucaguga

SEQ ID NO: 61216 - RNA, 3024 nt, Artificial Sequence
  derived and/or modified sequence opt3 from PRPF4B__Homo_sapiens__NP_003904
auggccgcugcagagacccagagccugagagaacaacccgagauggaagacgccaacuccgagaagucuaucaaugaagagaacggcgaggugucagaagaucagagucagaauaaacacagcaggcauaagaaaaagaaacacaagcaucgguccaagcacaaaaagcauaaacacucuucggaggaagacaaggauaaaaagcacaagcauaaacacaagcauaaaaagcacaaacgcaaggagauuauagacgcgucagauaaagaggggaugagcccugcuaagcgaacaaagcucgacgaucuugcccuguuggaagacuuagagaaacagcgugcacugaucaaggccgaacuagauaacgagcucauggaaggaaaaguccaaagugguaugggccugauucuucagggguacgaguccggaucugaggaagagggcgaaauccacgagaaggcuagaaaugguaacaggagcuccacucggucaaguagcacgaaagggaagcuggaauugguugacaauaagauuaccacaaagaagcgcucuaaauccagaucaaaggagaggacucggcaucgcagcgauaaaaagaagaguaaaggaggcaucgagauagugaaggagaaaaccacacgaucuaaguccaaagaaagaaagaaaagcaaaucgccaucuaagagguccaaaucacaggaccaggcacggaagaguaaaagcccgacccuccgucgcagaucccaagaaaagaucggcaaagccaggucucccacugaugacaagguaaagauugaggacaaaagcaagucaaaagaucggaagaaaaguccuaucauuaacgaaucccgaagccgcgacagagggaagaagucuaggucaccaguggaucugcggggaaaaaguaaggaccgcagaagcagguccaaagagcguaagucuaaacggucggagacagauaaggaaaagaaacccaucaagagcccuuccaaagacgcuucaagugguaaggagaaucgaucuccaagcagaaggcccggccgcuccccuaaacggagaucacugagcccaaagccgagggauaagucucgccgaucccggaguccccucuuaaacgaccguagaagcaaacagucuaaguccccuucaaggacccugaguccagggcgccgggccaaaagcagaucgcuugaaaggaagcgacgcgagcccgagcggagaagguuguccucuccucguacgcgcccacgggaugacauacugagcagaagggaacgaucaaaagaugcgagucccauuaaucggugguccccgacucgcagaaggucucggagcccuauccgaagacgcuccaggucaccccuacgucggagcagaaguccaaggcgccgaucuagauccccucggaggcgcgaccguggaagacggagcaggucgcgccuccgaagacggucaaggucucgcggcgguagaaggcggcguagucgcuccaaggucaaagaggacaaguucaaggggagccugucugaaggaaugaaaguggagcaggaaagcuccucagaugacaaccuugaggauuuugacguugaggaagaggaugaagaggcacugauugaacagcgaagaauccaaaggcaggccaucgugcagaaguauaaauacuuggcugaggacaguaauaugagcguccccucugagccauccucaccccaaaguagcacccggacacgcuccccuucuccagaugacauucucgaaagaguggccgcagauguaaaggaguaugaaagggagaacguugacacuuucgaggcuucggugaaagccaagcacaaucugaugaccgucgaacagaacaacggcagcucacagaagaaauuacuggcgccggauauguuuacagaguccgacgauauguucgccgcauacuuugacagugcucggcuccgagccgcuggcauagggaaggacuucaaagaaaaucccaaccuuagagauaauuggaccgacgccgagggauauuaccgcgugaacaucggugaagugcuggauaagagguauaaugucuacggcuacacggggcagggaguguuuucuaacguuguacgggcacgugacaaugccagagcuaaccaagagguggcggucaaaauuaucaggaauaacgaguugaugcagaagacuggccuaaaggaacuggaguuccucaaaaagcugaaugaugcagacccugaugacaaauuucauugccuucgccuguuccggcacuuuuaucauaagcagcacuugugucucguguucgaaccacugagcaugaacuuacgagagguucugaaaaaguacgguaaggauguggggcuacacauaaaagccgucagauccuauucacagcaacucuuucuggcucuuaaguugcugaaaaggugcaauauucuccaugccgacaucaagcccgauaacauccuggugaaugaaucuaaaacaauucuuaagcugugugacuucggcagcgcaagucacguagccgauaacgacaucaccccuuacuugguuucccgcuucuaucgggcuccagagauuauaaucggaaagagcuacgacuauggcauugauauguggucuguggggugcacucucuacgagcuguacacaggaaaaaucuuauuucccgguaagaccaacaaucauaugcugaaacuagccauggaccucaagggcaaaaugccgaacaagaugaucagaaaaggggucuucaaggaucagcacuuugaccagaaucugaacuucauguauauugaaguggauaaggucacggagcgugaaaaagugaccguuaugucaacaauaaauccuacuaaggaccuuuuggcagaucugaucggaugucagaggcucccagaggaccaacggaaaaaggugcaccagcugaaagauuuacuggaccagauucuuauguuggaucccgcgaagcgcaucuccauuaaccaggcucuccaacaugccuuuauccaggaaaagauauga

SEQ ID NO: 61217 - RNA, 1566 nt, Artificial Sequence
  derived and/or modified sequence opt3 from PRPF4__Homo_sapiens__NP_001231855
auggccagcuccagagcuucuucaaccgcaacaaagacuaaagcccccgacgaucugguggcgccugucguuaagaaaccacacaucuacuauggcagucucgaggaaaaggagagggaacggcuugcuaaaggggagagcgguauucugggaaaggacggcuugaaggccgggauagaagcaggaaacaucaauauuacguccggcgagguguucgagaucgaggaacauauuucugaacgccaggccgagguauuagcugaguuugaacgacguaaaagagcaaggcaaaucaacgugucgaccgaugacucagaggucaaggccugccugcgggcucuaggugaaccgauaacacucuucggggagggacccgccgaacgcagagagaggcugcggaauauccuuagcgugguuggcacugaugcgcugaaaaagaccaaaaaggacgaugagaagaguaaaaaguccaaagaagaguaccagcagacaugguaucacgaaggcccuaacucuuugaagguggcacgccucuggauugccaauuacagccugccacgagcuaugaaaagacuggaggaagccaggcuccauaaggagauccccgagaccacucggacaucccagaugcaagaauuacacaaaucacugcguagucuuaacaauuuuuguagccagauuggggacgaucgcccuaucucuuauugccauuucuccccaaacucaaagauguuggcaaccgcuuguuggagcggacugugcaagcuauggaguguccccgacuguaaucuccugcacacgcuuagaggucacaacacuaaugugggcgccauaguauuucauccuaaaucuaccguuucccuggauccaaaggacgugaacuuggcgagcugcgccgcagaugggucggucaaacucuggucucuggacuccgacgagccgguggcugauauugaaggacacacagugagggucgcccggguuauguggcaucccucaggccgauucuuagguacuaccuguuacgaccgcaguuggagacugugggaucucgaggcucaggaagagauccuucaccaggaggggcacagcaugggaguguaugacauugccuuucaucaagauggcucccuggcaggcacagggggauuggacgccuucgguaggguaugggaucuacggaccggccgcugcaucauguuucuggaagggcaccucaaggagaucuacggaauuaauuucucuccuaacggcuaccauauagcuacggguagcggggacaauacuuguaaagugugggaucugagacagaggcguugcgucuauacaaucccagcgcaccagaaccuugugaccggcguuaaguuugaacccauucauggaaacuuccuguugacuggcgcauacgacaauacagccaagaucuggacccacccuggguggucaccacucaaaacgcuggcuggacacgaggguaaggugaugggcuuagauauaaguuccgacgggcagcugauugccaccuguagcuaugaccggacauuuaaacuauggauggcagaguga

SEQ ID NO: 61218 - RNA, 2826 nt, Artificial Sequence
  derived and/or modified sequence opt3 from PRPF6__Homo_sapiens__NP_036601
augaacaagaaaaagaaacccuuccugggcaugccugccccacucggguacgugccgggacuugguagaggcgcuaccggguuuacaacuaggagcgacaucggacccgcacgggaugccaaugacccugucgaugaccgccacgcgccacccggcaagcgaacgguuggugaucagaugaaaaagaaccaagcugccgacgaugacgaugaggaccugaaugauaccaacuaugacgaguucaauggguacgcaggauccuuguuuucuucaggcccuuaugagaaggaugacgaagaggccgacgcuauuuacgcagccuuagauaaacguauggacgaaagaaggaaggagcggcgcgagcagagagaaaaagaggaaauagagaaguauaggauggagcggccaaaaauccagcagcaauucagugaucugaagcgcaagcuagcugaagugacagaggaagaguggcucagcauucccgaaguaggcgacgcccgaaacaaaagacagaggaauccucgguacgagaagcugacuccagugccggauuccuuuuucgcgaaacaucuucagaccggggagaaccacacaucugucgacccccgucagacccaauuuggaggucugaauacuccuuauccaggcggguugaacacacccuacccuggaggcaugaccccaggucucaugacgcccgggacuggagaacuggauaugcgcaagaucggccaggcaagaaauacccugauggacaugaggcucagccaggugucagauagcguuaguggccagacaguggucgacccgaaaggguacuuaacugaucugaacuccaugauuccuacccauggaggugacaucaaugacauaaagaaagcccggcuuuugcugaagucugugcgagagacaaacccccaccauccuccagcuuggaucgccagcgcacgccuagaagagguaaccggcaagcuccaaguugcuagaaaucugauuaugaaagggacggaaaugugccccaaguccgaggauguguggcuugaggccgcgaggcugcagccaggagacacugccaaagcagucguggcucaggccgugcggcacuugccccaaucaguccgcaucuauauuagagcugccgaacucgagacagauaucagggcaaagaaacguguucugcggaaggccuuagaacacgugccuaacaguguacgacuguggaaggcugcgguggagcucgaagaaccagaggacgcaagaauaaugcuuagcagggccgucgaauguugcccgaccucuguggagcugugguuggcucuagcccgccuggaaacuuacgagaacgcacggaaaguucucaauaaggccagagagaacauucccacagauaggcauaucuggauuaccgcugccaaacuggaagaggcaaauggcaacacgcagaugguggaaaagaucaucgaccgcgcgauuaccucccuucgagcuaauggugucgagauaaaccgggaacaguggauccaggaugccgaggagugugaccgugcagggucaguggccacaugccaagcuguaaugagagccguuauuggcaucggaauagaagaggaagauaggaaacacacuuggauggaggacgcagauagcuguguggcucauaaugcccuggaaugcgcgcgcgccauuuaugcuuacgcauugcaggucuucccuaguaagaagucuguguggcuccgggccgcuuauuuugagaaaaaccacggcaccagagagucccuggaagccuuacugcagagggcagucgcgcacuguccaaaggccgaggugcuauggcucaugggggcuaaaagcaaguggcuggccggagacguucccgcagcucgaucgauccuugccuuggcauuccaggccaauccuaacucugaagagaucuggcuggcugcggugaaacucgaauccgagaaugaugaguacgaacgcgcccggagacugcuugcaaaggcuaggucaagugccccaacagcccguguauuuaugaagucggucaaacuggagugggugcaagacaacauucgcgcugcacaggacuugugcgaagaggcccuccggcauuaugaggauuuccccaagcuguggaugaugaaaggucagaucgaagaacagaaggaaaugauggagaaagcgagagaggcuuacaaucaaggcuuaaagaaauguccgcacuccacuccucuguggcuacuccugucuaggcuugaggagaagauugggcaguugacccgagcccgggcaauacuggaaaagagccgccucaaaaacccaaagaaucccggacugugguuagagucaguuagacuggaauacagggccggccuuaaaaacaucgcuaacacauugauggcaaaggcccuccaggagugcccuaauagugguauucugugguccgaagcgaucuuucuagaggcucggccccagcgaagaaccaaaagcguggacgcccugaagaagugugagcaugauccacacguccuccuggcaguggccaaacuuuucuggucucaacgcaagaucacuaaagcuagggaaugguuccaucguacgguaaagauugacucagauuugggggacgccugggcauuuuucuauaaauuugagcugcagcacggcacagaggaacagcaagaagaggugcggaagagaugcgagagugcugaaccuaggcacggagaguuauggugcgccguuagcaaggauauagcgaacuggcagaaaaagaucggcgacauucuccgccuggucgccgggcgaaucaaaaauaccuucuga

SEQ ID NO: 61219 - RNA, 7008 nt, Artificial Sequence
  derived and/or modified sequence opt3 from PRPF8__Homo_sapiens__NP_006436
auggccggcguguuccccuacagagggccuggaaacccagucccggguccccuggcuccucucccagacuauaugagcgaggaaaagcuucaggagaaagcaaggaaguggcaacagcugcaggccaaacgguacgcggaaaagcgcaaauuuggcuucguugaugcucagaaggaggacaugcccccugaacacgugcgaaagaucauucgugaucauggggacaugaccaauagaaaauuuaggcacgauaagcggguauauuugggagccuuaaaauacaugccacaugcagugcugaagcuacucgagaacaugcccaugccuugggagcaaauacgcgacgucccagugcuguaucacaucacaggcgccauuuccuucguuaaugaaaucccgugggugauugagcccgucuacaucucucagugggguucaauguggauaaugaugagaagggaaaaacgggaucgccgacauuuuaagagaaugagguucccuccauuugacgaugaggagcccccucuugacuaugcugauaacauccuggacguggaaccauuggaggcaauucagcucgaacuggaucccgaggaagacgccccgguacuggacugguucuacgaucaccagccucuccgggacagucguaaguacguuaaugggagcacuuaucaacgcuggcaguuuacguuacccaugauguccacccuguacagacuugcuaaccaguugcugacagaucuaguggacgauaauuauuucuaccucuuugaccugaaagccuucuuuacuucuaaggcgcuuaacauggcaaucccaggaggcccuaaauucgagccccuggucagggauauuaauuugcaggacgaggauuggaacgaauucaaugacaucaacaagauaauuauccggcaaccaauucgaaccgaguauaaaaucgccuuucccuaccucuauaauaaccugccucaccaugugcacuuaacaugguaccauaccccaaauguggucuucaucaagacugaagauccggaccugcccgcuuuuuacuucgacccucucauuaacccaauaucgcaccgccacucaguuaaaagccaggagccccuuccugaugacgaugaagaguuugagcugccagaauucguggagcccuuuuugaaggacacaccgcuauauaccgauaacacggccaauggcaucgcacugcucugggcuccuagaccauucaaccugaggagugggcggacucgcagagcccuugacauuccccugguaaagaauugguacagggaacauugcccugcgggacagcccgugaaaguccguguguccuaucaaaaguugcucaaauacuauguucugaacgccuuaaagcaccggccaccuaaagcacagaagaagcgauaccuguuuagaucuuucaaagcuaccaaguuuuuccagagcacaaaacuagauuggguggaggucggucuccagguguguaggcaaggcuauaauaugcugaaccuuuugauccaucgcaagaaucugaacuaccuccaccuggacuacaauuuuaaccuuaaacccguaaagacucugaccacaaaggaacggaaaaaguccagauucgggaaugccuuccauuugugcagggagguucuccgccugaccaaauuaguggucgauucacacgugcaguaucgacugggaaacgucgacgcuuuucagcuagccgauggccuccaguacauauucgcacacgugggucaacugacggggauguaucgguacaaguauaaacuuaugcgucagauuagaauguguaaggacuugaagcaucugaucuacuauagguuuaauacuggaccaguuggcaaaggcccggggugcggauucugggccgcugguuggcgcguguggcucuuuuucaugcggggcaucacaccucuguuagagagauggcuggggaaccuuuuggcgaggcaguuugaaggacgacacaguaagggcguagcaaaaaccgucacuaagcagcgcguggagagccauuucgaucucgaacugcgggccgcuguuaugcacgacauucuagacaugaugcccgaggguaucaaacaaaauaaggccagaacaauucugcagcaccucucugaggcauggagguguuggaaagccaacauaccauggaaggugcccgggcugccuaccccaaucgaaaacaugauucuucguuacgucaaggcuaaagccgauugguggacgaauaccgcacauuacaaccgcgagcggaucagaaggggcgcgacaguggacaagacuguaugcaaaaagaauuugggacgacugacccgguuauaucucaaagcugaacaggagcgccagcacaacuaccugaaggauggccccuauaucacagccgaagaggcaguggccguuuacacuaccacaguccauuggcuugaguccagaagguuuucaccuauuccguucccaccccugagcuauaagcacgacaccaaauugcucauacuggcucuagaacggcugaaggaggccuacagugugaaaucucgacucaaucaaucccagagagaagagcuggggcuuaucgaacaggcauaugauaacccucaugaggcuuugagccgcauuaagaggcaccuguuaacucaacgugccuuuaaagaggugggaaucgaauucauggaccucuacucgcaccuggucccaguuuacgauguggagccccuugaaaagauuacggacgcguaucuggaucaguaccuaugguaugaggccgacaagcggagacucuuuccuccguggaucaaacccgcugauacagaaccaccuccccuguugguguacaaguggugucaggguauaaauaaccugcaggacguaugggagaccucugagggcgaaugcaaugucauguuagaguccagguucgaaaaaauguaugagaagaucgaucucacucugcuuaaccgccuguugcgacucauuguggaccauaauaucgcagacuacaugaccgccaaaaacaauguugugauuaacuauaaggauaugaaucacacaaacucauacgggaucauaagaggacugcaauucgcuaguuuuauuguccaguacuauggccuagugauggaccugcuuguucucggucugcaucgggccagcgagauggcagggccaccucagaugcccaacgauuucuuguccuuucaggacaucgcgaccgaagccgcucacccaauuaggcuguucugucgcuacaucgaucguauacauaucuuuuucagauuuacugccgacgaggcacgggauuuaauucaaagguaucucacagaacacccggacccuaauaacgagaauaucgugggcuacaacaauaagaaaugcuggccccgcgaugcucgaaugagacugaugaagcacgacguaaaccuuggacgggccgucuucugggauauuaaaaauaggcugccacgcucugugacgaccgugcagugggaaaacagcuuugucucaguuuauaguaaggacaaucccaacuugcucuucaauauguguggcuuugagugcagaauccugccuaaaugcaggacuuccuacgaggaauucacacauaaggacgggguguggaaccuacagaaugagguaaccaaagaacggacagcacaguguuuccugcguguggaugacgagagcaugcaacgcuuucacaaccgagucagacagauacuuauggccucuggaucaacuaccuucacgaagauugugaauaaguggaacaccgcucucaucggucugaugacauauuuuagggaagcgguugugaacacucaggaguuguuagaucugcucgucaaaugcgagaauaagauccaaacccggauuaaaaucggccugaacaguaagaugccaagccgcuuccccccugugguuuuuuacacaccgaaagaacuugggggacugggcauguuguccaugggucaugugcuaauuccacagucugaccugagauggucgaagcagacugaugucgggauaacccacuucaggagcggcaugucccacgaggaagaccagcucauccccaaucuguaccgguauauucaaccuugggagucagaauuuaucgauagucagcgaguaugggccgaguacgcacuuaagagacaggaggcuauugcccagaaccgcagguuaacgcuggaagaccucgaggauucuugggaccggggaaucccccguauaaauacauuguuccaaaaagauagacauacccuggccuaugacaagggcuggagggugcgcacugauuuuaaacaguaccagguucucaagcagaacccauucugguggacacaccaacggcaugacgggaaacuguggaaucuuaacaauuaucgaaccgacaugauccaggcucugggaggcguggaagguauuuuggagcacacucuauuuaaggggaccuacuucccuacaugggagggacuguuuugggaaaaggcaagcggcuucgaggaauccaugaaauggaagaaacucacgaacgcccagagaucagguuuaaaucagauccccaacaggcgcuucacccugugguggagcccaacuauuaaucgggcgaacgucuaugugggcuuucaaguacagcuugaucugacagggaucuucaugcauggaaagauaccuacccucaaaauuucuuugauccagaucuuuagagcucaccuguggcaaaagauucacgaguccauagugauggaccucugucaggucuucgaucaggaacuggacgcccuugagaucgagacaguucagaaggaaacuauucauccgcguaaaaguuacaagaugaauagcucuugcgcagauauccuacuguuugccuccuacaaauggaacgugucaaggcccaguuuguuagcugacagcaaggaugugauggacucgaccacgacacaaaaauauuggauugauauccagcugcgguggggcgacuacgauucccacgacauagagcgcuaugcacgagccaaguuccucgauuacaccacugacaauaugucuaucuauccaagcccuaccgggguccugauugcgaucgaccuugcuuacaaccugcauucagccuauggaaacugguuucccggcaguaagccacucauucagcaggcaauggccaaaaucaugaaggcuaauccugccuuguacgugcugagagaaaggauacggaaaggucuacaacuguacuccucugagcccacagaaccguaucucagcucccagaacuacggggagcuuuucucaaaucagauuaucugguuuguugaugacacuaacguauaucgcgugaccauccacaagacauucgagggaaaucugacgaccaaaccaauuaacggcgcaaucuuuauauucaauccuagaacuggucaguuauuuuugaagauuauccacacaagcgucugggcuggccaaaaaaggcuggggcagcucgccaaguggaagaccgcggaagagguggccgcacugauucgaagucuucccguugaagagcagccaaaacaaaucauagugacucggaagggaaugcuggauccccucgaaguccauuugcuggacuucccuaacauugugaucaaaggcucugaguuacagcuaccguuccaggcuugucugaagguagagaaauuuggggaucucauccuuaaggccacagaaccccagaugguccuguucaauuuguacgacgauuggcugaagaccauuuccagcuauacggcuuuuucgcgucucauccugauucuuagagcacuccacgugaacaaugaccgcgccaaaguuauacugaagccagauaaaacuaccaucacagagccucaucacauuuggcccaccuugacugacgaagaguggaucaagguggagguccaacugaaagauuuaauccuagccgacuacggaaagaagaacaaugugaacguugcuucacugacacagucugaaauuagggacauaauccucggcauggagauuagugcgccuucccagcagcggcaacagaucgcagaaauugagaaacagaccaaggaacagagccaacuuacagccacucagaccagaacggugaauaaacauggugaugagaucauaacaucuaccacuagcaacuaugagacccagacauucuccucaaagacugaauggcgcgucagggcuaucagugccgcaaaccugcacuugcgaaccaaucacauuuacgugagcucugacgauaucaaagagacgggguacacauauauucugccaaagaacguacucaagaaauuuaucugcauauccgaccugcgggcccagauugcuggauaccuuuauggcgugucacccccugauaauccacaaguuaaggaaaucagauguauugucauggugccccagugggguacccaucagacugugcacuuaccgggccaacugccucagcaugaguaccucaaagaaauggagccauugggguggauccacacacagcccaacgagaguccucagcugagcccacaagacgucaccacucacgcgaagauaauggccgauaaucccuccugggacggagaaaaaacaaucauuaucaccugcucuuucacgccgggcucguguacucuaaccgcauauaagcugacaccuagcggguacgaguggggaaggcagaacaccgauaaaggcaauaaccccaaggguuaucucccaucacauuacgaacgcguacagaugcuucuguccgaccguuuuuugggguucuuuauggugccugcucagaguucuuggaauuacaacuucaugggaguucggcacgaucccaauaugaaguaugagcugcaacucgccaacccaaaagaauuuuaccaugaggugcacagacccagccauuuccugaauuuugcauuacuucaggagggcgaagucuauuccgccgacagggaggaucuguacgcuuga

SEQ ID NO: 61220 - RNA, 1041 nt, Artificial Sequence
  derived and/or modified sequence opt3 from PRPH2__Homo_sapiens__NP_000313
auggcccugcucaaggugaaauucgaccagaagaaaagagucaaacuugcucaaggccugugguugaugaacugguuuagcguuuuagcagggaucauuauauucucccugggacuauuucucaaaaucgagcugaggaagcggucugaugugaugaauaacucagaaagucacuucguacccaauagccuuauugguaugggcgugcuguccugcgucuuuaacucuuuggccgggaagaucuguuacgacgcgcucgauccugcuaaauaugcccgcuggaagccauggcugaaaccguaccuggcaauuugcguucucuucaauaucauauuauuucugguggcccuuuguugcuucuugcugcgaggaucgcuagagaacacccucggccagggucugaagaaugggaugaaauauuaccgugacacagauacucccggaagauguuuuaugaagaagacgaucgacaugcuucagauugaguucaaaugcuguggcaacaauggcuuuagggauugguucgaaauccaguggauuucaaaccgguaucuggacuuuagcaguaaggaagugaaagaucgcaucaaguccaaugucgacgggagauacuugguggauggaguaccuuucucuugcuguaacccaagcucccccaggccuugcauacaauaucagauuaccaauaacucagcucauuacaguuacgaccaccagacagaggagcucaaucuguggguucgggguugucgcgcagccuuacugagcuauuacucuucccucaugaacucaaugggcguggucacucuucugaucugguuguucgaagugaccauuacaaucgggcuacgauaucugcagaccagccucgauggagugaguaacccagaggaaucugaguccgagagccaaggcuggcugcuugaaagaucgguccccgagacuuggaaggcuuuucuggaaucuguuaagaaauuggguaaggggaaucagguggaggccgaaggagcggacgcaggccaggccccugaggcuggcuga

SEQ ID NO: 61221 - RNA, 1413 nt, Artificial Sequence
  derived and/or modified sequence opt3 from PRPH__Homo_sapiens__NP_006253
augagccaccaucccuccggccugagagccggguucucuucaaccaguuacaggcggacauuuggaccuccaccgagccucucccccggugcuuucucuuauucgucaagcagucgcuuuuccucuagccgacuucugggcuccgcaucaccuaguagcucugugcguuugggguccuucagaucaccaagggccggagcgggcgcuuuacugcggcuacccagcgagcgccucgacuuuaguauggccgaagcacugaaccaggaguuccuugccacuagaucuaaugaaaagcaagagcugcaggaauugaacgauagguuugcuaauuucaucgagaaaguccgguuucucgagcagcagaacgcagcccugcgcggugaacugucccaagcucgagggcaggagccugccagagcggaccagcucugccagcaagaauuaagggagcugcggcgugagcuugaauugcugggacgcgagagagauaggguucagguggaacgggacggccuagcagaggaucucgccgcucugaagcagcgacuugaagaggagacgcgcaaaagagaagacgccgagcacaaucugguauuguucaggaaggauguggacgaugcaacccucagccggcuggaauuagagcgcaaaauugaaucgcugauggacgagauagaguuucucaagaaacuucaugaagaggaacugagagauuugcaggucucuguggagucccaacagguucagcaaguggaagucgaggcuacagugaagccagagcuaacugccgcgcugagggacauccgugcccaguacgaaucaauugcagcuaagaaccuccaggaggccgaagagugguauaaaaguaaguacgcugaucugagcgacgccgcaaaucggaaccacgaggcccuucgacaggcuaaacaagaaaugaaugaguccagaaggcagauccagucucugaccugugaaguagacggcuugcgcgggacaaacgaggcgcuccugcggcaguuaagagaacuggaggagcaauucgcacuagaagccggagguuaucaggcuggcgccgcaaggcucgaggaggaacugcgccagcuuaaggaagagauggcccgacauuugcgggaguaccaggaacugcucaauguuaagauggcucuggauauugagaucgccaccuaucguaaacuucuggaaggggaggaaagcagaauaucagugcccguccacaguuuugcauccuugaacaucaagacuacagugccugagguggagccaccgcaagacagccacucuaggaaaaccguccucauuaagacgaucgaaacucgcaauggagagguugugaccgaaucacagaaagagcagcggagugagcuggauaagagcuccgcgcauucuuacuga

SEQ ID NO: 61222 - RNA, 957 nt, Artificial Sequence
  derived and/or modified sequence opt3 from PRPS1__Homo_sapiens__NP_002755
augcccaacaucaagauuuucagcggcuccucucaccaggaccugucacagaaaauagccgauagacucgggcuugagcugggaaagguggucaccaaaaaguuuaguaaucaagaaacaugcguugagaucggugaaagcgugaggggcgaggacguauacauugugcaguccggguguggagaaaucaacgauaauuugauggaguuacugauuaugaucaacgcuugcaaaauagcaucugccucgcgggucacugcggugaucccuuguuucccauaugcucgccaggacaagaaggauaaaucacgagccccgauuagcgcaaagcuaguugccaauaugcucaguguggcuggcgcagaccauaucauuacgauggaucugcacgccucccaaauccagggguuuuucgacauacccgucgauaaccuuuacgcugagccugccgugcugaaauggauucgugaaaauaucucugaguggagaaacugcaccauuguaagcccagacgcggguggagcaaagaggguuacauccaucgccgaucgguugaauguggacuuugcucucauccauaaagaacgcaagaaggccaacgaggucgauagaauggugcuggugggcgacgucaaagacaggguugcaauucugguggaugacauggcugauacuuguggcaccauaugccacgccgcggacaagcucuuaucagccggggcaacacggguauaugcuauccugacccauggaauuuucaguggucccgccaucagccgcauaaauaacgcuuguuuugaggccguggucgugacuaauacaauuccucaggaagauaaaaugaagcacugcucuaaaauccagguuaucgacauuuccaugauccuugcagaggccauucgaagaacccacaacggcgaaucagugagcuacuuguucagucaugucccacuguga

SEQ ID NO: 61223 - RNA, 957 nt, Artificial Sequence
  derived and/or modified sequence opt3 from PRPS1L1__Homo_sapiens__NP_787082
augcccaacaucaagauuuucagcggcuccucucaccaggaccugucacagaaaauagccgauagacucgggcuugagcugggaaagguggucaccaaaaaguuuaguaaucaagaaacaugcguugagaucgacgaaagcgugaggggugaggauguauacauugugcaguccggcuguggggaaaucaacgacucuuugauggaguuacugauuaugaucaaugcuugcaaaauagcaucggccucacgggucacugcggugaucccuuguuucccauaugcucgccaggauaagaaggacaaaagccgaaguccgauuuccgccaagcuaguugcaaacaugcucucuaucgccggagcugaucauauuaucacgauggaccugcacgcaagccaaauacagggcuuuuucgauauucccguggacaaucuuuacgccgagccuaccguccugaaauggauccgugaaaacauuccagaguggaagaauugcaucaucgugucccccgaugcugguggggccaaaagaguaacaucaauugcggaccaguugaacguugauuuugcacucauacauaaggaaaggaagaaagccaaugagguggacuguaucguccuggugggagacgugaacgaucgggucgcuauucugguugacgauauggccgacacuugcgugaccaucugucucgcagcugauaaguuacugagugccggcgcgacacgcguauaugccauacuuacccacggcauuuucagcgggccugcaaucucuagaaucaauacugcuugcuuugaggccguggucgugacaaacaccauuccacaggacgagaaaaugaagcauuguuccaaaaucaggguuauugauauaucaaugaucuuggcugaagccauucggcgcacgcacaauggagaaagcgugaguuaccuguucucucacgucccccuauga

SEQ ID NO: 61224 - RNA, 966 nt, Artificial Sequence
  derived and/or modified sequence opt3 from PRPS2__Homo_sapiens__NP_001034180
augcccaacaucgugcuguucagcggcuccucucaccaggaccucucacaaagagucgccgauaggcuugggcuggaguugggaaagguugugaccaaaaaguuuaguaaucaggaaacaagcguagagauuggugaauccgugcggggcgaggacgucuacauaauccagucugggugcggagaaauuaacgauaauuuaauggagcugcuaaucaugauuaacgcuuguaaaaucgcaucgucaagccgcgugacugccguuauaccuugcuucccauaugcgcgacaggacaagaaagauaaggugggcgagagucgugcuccgaucuccgccaagcucgucgcaaauaugcugucuguggccggugcugaccauauuaucacgauggaucuucacgcaagccaaauucagggguuuuucgacauccccguagauaaccuguacgccgaaccugcuguuuugcaguggauaagagagaauauugccgaauggaaaaacuguaucauuguguccccagacgcgggaggcgcaaagagggucaccucaaucgccgaucggcucaauguggaguuugcucugauccauaaagagcgcaagaaagccaacgaaguggacagaaugguccugguuggcgaugugaaggacaggguagcaauucucguggacgauauggcugacacaugcgggacuauaugucacgccgcggauaaguuacugagugccggagcaaccaaagucuaugcuauccuuacacaugguauuuucagcggccccgccaucucucggauaaauaacgcugccuuugaggcagugguugugaccaauacuauuccucaggaagacaagaugaaacacugcacaaagauccaagucaucgauauuuccaugaucuuggccgaggcuauucgccgaacccacaacggggaaucagugagcuaccuguucagucauguaccacuauga

SEQ ID NO: 61225 - RNA, 1158 nt, Artificial Sequence
  derived and/or modified sequence opt3 from PRPSAP1__Homo_sapiens__NP_002757
augcccaagaaacugcuccuucugccuccaccgagcgccuccucugcuuucagagugcccagggcacggccugucccacccccugccaugaacgcggcucgcaccggcuaccgaguguuuucagccaauaguacagcagccugcacugaguuggcuaagcguaucacggaaagauuaggggcagagcugggaaaaagcguuguauaucaggaaaccaacggugagacaaggguggaaauuaaggaguccguccggggccaagacauauucaucauucagacuaucccacgcgaugugaauaccgccguuauggagcuacucauuauggcuuacgcccugaaaacagcgugugcaagaaacaucauaggggugauccccuauuuuccuuacucuaagcagucgaagaugaggaaacggggaucaauugucugcaaacuucuggccagcauguuggcuaaggccggccucacccacaucauuacuauggaccugcaucagaaggaaauccaagguuucuuuaguuucccaguggauaaucugcgcgcauccccguuucucuuacaguauauacaggaggaaauucccaacuaccgaaaugcuguaaucguugccaaaucuccugacgcggccaagagagcacagagcuaugcugagaggcugcggcuuggguuggccgugauucacggagaggcucaauguacagaacuggauauggacgauggccgucauuccccacccauggucaagaacgccaccgugcacccuggccuagagcucccacugaugauggcaaaagaaaagcccccgaucacgguggucggggacguuggaggucgcaucgccauuauaguggaugacaucauugaugacguagagucauucguggcugcggcagaaauccuuaaagagagaggcgccuacaagauauacgucauggcuacucaugggauucugagugccgaggcaccuagguugaucgaagagagcucuguggaugaaguuguggucaccaauacagugccccacgagguacagaaacuccagugcccaaagaucaaaacuguugacauuucccugaucuuaucagaagccauucggcgaauacacaacggagagagcauggcuuaucuguuucgcaauaucaccguggacgauuga

SEQ ID NO: 61226 - RNA, 990 nt, Artificial Sequence
  derived and/or modified sequence opt3 from PRPSAP2__Homo_sapiens__NP_001230865
auguucugcgugaccccuccugagcuggaaacaaagaugaacaucacuaaaggcgggcucguccuuuuuagcgccaauuccaacucuucauguauggagcugaguaagaaaauugcugaagacguuaauacgaccauaauggaguuguuaaucaugguguacgcaugcaagacaagcugugccaaauccauuaucggaguaauuccauauuucccguacucuaagcagugcaagaugagaaaaagggguucgaucgugucaaagcugcuagcgagcaugauguguaaagcuggccucacucaccugauaaccauggaucuucaucaaaaggaaauccagggguuuuucaacauucccgucgacaaucugcgggccagucccuuuuugcuccaguauauccaggaggagauuccagauuaccgcaacgcagugaucguugccaaaucccccgcuucugcaaagcgagcccagagcuucgcugaacgucugagacugggaauagccgugauucacggcgaggcgcaagacgcagaauccgaucucgucgacgguaggcauucaccuccaauggugcggaguguagccgcuauccaccccagcuuagagauuccuaugcugaucccaaaggagaaaccgcccaucacaguugugggggaugucggaggccgcauugccauaaucguggacgauauuaucgacgauguggacucuuuucuugcagcugccgaaaccuugaaggagagaggcgcguauaaaauauucgucauggccacucaugggcugcuauccucagaugcaccuaggcggauugaagagagcgcuaucgacgaaguugugguaacaaauaccaucccacacgaggugcagaagcuccagugccccaaaauuaagacggucgacaucaguaugauucugucugaggccauacgccgaauccacaacggagaauccaugagcuaccuuuuuagaaauauuggucuggaugacuga

SEQ ID NO: 61227 - RNA, 1083 nt, Artificial Sequence
  derived and/or modified sequence opt3 from PRR11__Homo_sapiens__NP_060774
augcccaaguucaaacagagaaggcggaagcugaaagccaaggcugagcgccucuuuaaaaagaaggaagcaagccacuuccaauccaaacuuaucaccccuccaccgcccccuccaucucccgagcgagugggcauuucaaguauagacaucagccagucccguucuuggcugacaucgucauggaacuuuaauuucccuaacauuagagaugccaucaaguuguggacuaauagggucuggagcauuuacaguuggugccagaacuguaucacgcaguccuuagaaguucugaaagacaccauauuuccaucucggaucugccaucgcgagcuauauagcgugaagcaacaguucuguauucucgaauccaaacugugcaaacuucaggaggcgcugaagacaaucucagagaguagcucuugucccuccugcgggcagacuugucacaugucaggaaaauugaccaauguaccugcuugcgugcucauuacaccaggugauagcaaggccguccugccgcccacccugccucaaccagcaagucauuuucccccuccacccccgccucccccacucccucccccacccccuccauuagccccggugcugcuuagaaaacccucuuuggcuaaggcacugcaggccggcccucuaaagaaggacgggccaaugcagaucacuguuaaagaucuccugacagugaaacuuaagaagacccagucccuggacgaaaagaggaaauugauacccagcccuaaggcucggaacccacucgucacggugucggaucugcaacacguaacuuuaaaacccaauucuaagguucuguccacccgcgugacaaacguccucauuacuccgggaaagucacagauggaccuucgaaaacuguugagaaagguggauguggagaggaguccuggcgguaccccacuaacaaauaaagaaaacauggagaccgggacgggacugacucccgucaugacacaggcccuccggcguaaguuccaacuggcgcauccucgcagccccaccccaacucuuccucuguccacaucuagcuuugacgagcagaauuga

SEQ ID NO: 61228 - RNA, 297 nt, Artificial Sequence
  derived and/or modified sequence opt3 from PRR13__Homo_sapiens__NP_001005354
auguggaaccccaaugccggcgggccuccacacccggugccccagccuggauacccagguugccaaccccugggcccuuauccacccccuuacccaccgcccgcuccugggaucccacccgucaacccucucgcaccaggaaugguuggccccgccgugauuguagacaagaaaaugcagaagaaaaugaagaaagcgcauaagaagaugcacaaacaucagaagcaccauaaauaucacaagcacgguaaacauagcuccucuucaaguagcuccucuucgucagauagcgacuga

SEQ ID NO: 61229 - RNA, 390 nt, Artificial Sequence
  derived and/or modified sequence opt3 from PRR15__Homo_sapiens__XP_011513501
auggccgacagcggcgaugcuggguccucuggacccugguggaagucacugaccaacaguaggaaaaagagcaaagaggcagccgugggugucccuccaccggcgcagcccgcuccuggcgaaccaacacccccugccccacccuccccugacuggacuucuucgucaagagagaaucaacacccaaaccuccuugggggagcaggcgaaccgcccaagccugauaaacuguacggugacaagagcgggaguucccggcgcaauuugaagaucucucgaagcggacguuucaaagagaagagaaaaguuagggccacguuacugccagaagcuggccggucccccgaggaggcaggcuuuccuggggauccacaugaagacaagcaguga

SEQ ID NO: 61230 - RNA, 915 nt, Artificial Sequence
  derived and/or modified sequence opt3 from PRR16__Homo_sapiens__NP_001287712
augagcgccaaguccaaaggcaaccccucuucaaguugcccugcugaggggccaccggcagccagcaagaccaaagugaaggaacagaucaaaauuauagucgaggaccuggaacucguucuuggagaucugaaggacguggcgaaggaguugaaagaaguaguggaucaaaucgacacauuaacuuccgaucugcagcuagaggacgagaugacggauucuucgaagaccgacacacucaauucaagcaguuccgguacuaccgcuucuagccuggagaaaauuaagguccaggccaacgcaccccuuaucaaaccuccagcccaccccuccgcuauucugacaguguugagaaagccuaauccacccccuccaccgcccaggcucaccccuguuaagugugaagauccaaaacgggugguccccacugcaaacccugugaagacaaauggcacccugcugcgcaacgggggacucccaggcggucccaauaaaaucccgaacggggacauaugcuguaucccuaauucaaacuuagauaaggcccccguacagcugcuuaugcaucgaccagaaaaagaccguugcccucaagcuggacccagagagaggguucgguucaaugagaaggugcaguaccacggcuauuguccagauugcgacacgcgcuacaacauuaaaaauagagaaguccauuugcacagugagcccgugcauccuccaggcaagaucccgcaccaggggcccccucugccacccacuccucaccuaccacccuuuccgcucgaaaacggagguaugggcauuagccauucuaauuccuucccuccaaucaggcccgccaccgugccucccccaacagcgccuaagccccagaaaacuauacugcggaagucaaccacaaccacggucuga

SEQ ID NO: 61231 - RNA, 417 nt, Artificial Sequence
  derived and/or modified sequence opt3 from PRR34__Homo_sapiens__NP_060750
augcccgccagcgcuaccgcagccuggcacugcccuccacugugucucccgccccuuccugcguccgcuccaacaucucccccuaacccagccacuagacccgcaccuggcccagggaggcgggcccgcugcccgcagucagcucaucccgcaccuacgcgaggagcccugaccuucugggcuccagguaguuggccccguguguuguuagucccuagaagcccaggccccguucugagggccccgcggcuaccucaccccgcggcacgcgccagaaggcgggcuuggcauggggcccgccucccaggauccccugcacgagcuggcagaacauuucagaggggucuggugucuaauucgugggcccacgcgaucuuccuuccccggccacccaacguacuggaguugcaaguguga

SEQ ID NO: 61232 - RNA, 504 nt, Artificial Sequence
  derived and/or modified sequence opt3 from PRR3__Homo_sapiens__NP_001070965
augcccaagaggaaaaagcagaaccaccaucaaccuccaacccagcagcagccgccccugccugagagagaagagacaggcgacgaagaggaugggagcccaaucgcccuccaccggggacccccugguucccgcggcccacuuauucccccucuguugucuuuaccaccgcccccuugggggcgaggaccaauacguagaggccugggucccaggucaaguccuuacgggcggggaugguggggcgugaaugcugaaccacccuucccgggcccugggcauggaggucccacucgcggcagcuuucacaaagagcaaagaaacccaaggcggcuaaaguccuggucucucaucaaaaauacgugcccucccaaggacgauccacaggucauggaggacaagucggaucgccccguuugucgacauuucgccaaaaaggggcacugcagauaugaagaccugugugcauuuuaccacccuggagugaacggcccaccgcuuuga

SEQ ID NO: 61233 - RNA, 1140 nt, Artificial Sequence
  derived and/or modified sequence opt3 from PRR5__Homo_sapiens__NP_001017528
augagcucccccucucugucagaccucggcaagagagagccugccgcugcagccgaugaaagggggacccagcaacggcgcgcgugcgcuaacgccacauggaauaguauccacaacggagugauugcagucuuccagcgaaaaggucuuccagaccaggagcuguuuagcuugaaugaaggcguucgucaguuacugaagacugagcuaggguccuucuuuacggaauaccuccaaaaccagcugcuuaccaaaggaauggugauacugagagauaagaucagguucuaugagggccagaaauugcucgacucucuggccgagacaugggacuuuuucuuuucggauguacugccgaugcuccaggcuauuuucuaccccgugcaagguaaggaaccuucaguccggcaguuagcacugcuucauuuucgcaaugccaucacuuugagcgugaagcuggaggaugcucuagccagagcgcacgcaaggguuccacccgccauugugcagaugcuccugguccuucagggggugcaugaaagucggggaguaaccgaggacuaucugcgcuuggagacacucguucaaaaaguggucuccccuuaccugggcaccuauggcuuacacucuagcgaagggccauucacucauuccuguauccuggagaagcgacuccuuagaaggucacggaguggagaugugcuggcuaaaaaccccgugguccguagcaagucuuacaauacaccuuugcuaaacccaguucaggaacacgaggccgaaggugcagcugccggcgggaccuccauacgcagacacucagugagcgagaugacgaguugcccggagccccagggauuuucugacccuccaggccaaggucccacugggaccuucagguccagcccugcgccacauucgggacccuguccgucucggcuguauccuacaacucagcccccagaacagggccucgauccuacccgauccucacugccccgcaguagcccagagaaucuuguagaccagauccuggaauccguggauucugacagcgagggcauuuuuaucgacuucgggagaggaagggguucaggcaugagugauuuggaaggguccggaggccggcaaagcgucguguga

SEQ ID NO: 61234 - RNA, 387 nt, Artificial Sequence
  derived and/or modified sequence opt3 from PRR9__Homo_sapiens__XP_011508108
augaccgccugcacauguagcgcuaaccaccccagaauguccuucucugagcagcaaugcaagcagccuugugugccaccgcccugccugccuaaaacucaggaacagugucaagcaaaggccgaggaagucugccucccaacgugucagcaucccugccaggacaaaugucuuguucaggcgcaagaggugugccugucacagugucaggaaaguagccaggagaagugcccucaacagggccaggagccauacuugcccccuugccaagaucaguguccaccgcagugcgcugaacccugucaggaguuauuucaaaccaaaugcguagaaguguguccucagaagguccaggagaagugcuccucuccagggaaaggaaaguga

SEQ ID NO: 61235 - RNA, 1389 nt, Artificial Sequence
  derived and/or modified sequence opt3 from PRRC1__Homo_sapiens__NP_001273737
augauggaggaaagcggcaucgagaccacacccccugggacuccaccgcccaacccugccggacuggcugcaacggccauguccucuaccccagugccccucgcggcuacaucaaguuucagcuccccuaaugucucuucgauggaaucauuuccaccccuugccuacagcacuccucagccaccgcugcccccuguuagaccaagugcacccuugccuuucgugccacccccggccguaccuuccgugcccccauuagucaccucuaugccucccccagugagccccuccacagcugcagccuuugguaacccuccaguuucacacuucccgcccaguaccagcgcuccuaauacucugcuaccagcgcccccuucuggcccacccauuuccggguuuucagugggaagcacauaugacauaaccaggggccaugccggucgggcaccgcaaacgccucucaugccaaguuucucugcccccuccgggacuggacugcuuccuacccccaucacacagcaggcuagccugacuucguuggcccagggcaccggcacaaccucugcaauuacguuuccagaggaacaagaggauccucgcaucacucgagggcaggacgaggcuuccgccggagguauuuggggcuucaucaagggggucgcgggaaaccccauggugaaaucaguacucgauaagacaaaacacaguguugaaagcaugauaaccacucuggacccaggcauggccccguacaucaaguccgguggggagcuggauauuguggucacaucuaauaaagaagugaagguggcagcuguccgugacgccuuucaggagguuuucggacucgcugugguagugggcgaggccggccagagcaacaucgcaccucaacccgucggguaugccgcuggauuaaagggugcgcaggaaagaauugauucacugaggcggaccggcgugauccaugagaaacagacggcaguuaguguggaaaauuuuauagccgagcuuuugccagacaagugguucgauauugggugccuggucguggaagaccccguacacggaauccaucuagagaccuuuacacaggcuacuccuguuccacucgaguucgugcaacaggcccagucccugacaccccaagauuacaaccuucgcuggagcggccuguuggucaccgugggugaaguccucgagaaaucucuguuaaaugugucaagaacugacuggcacauggcauucaccgggaugaguaggcggcagaugauuuauagcgccgcucgcgccaucgcagaugacuacuuuccucgaaucccgaaggaacaguggcaguccauggcguggcugaaacucgagauuuuccuuccacugguuacaugguga

SEQ ID NO: 61236 - RNA, 6474 nt, Artificial Sequence
  derived and/or modified sequence opt3 from PRRC2A__Homo_sapiens__NP_542417
augagcgacagguccggccccaccgccaaggggaaagauggaaagaaauacucuucacugaaccucuucgacacuuacaaggguaaaagucuugagauccagaagccugcuguggccccaaggcacggccugcagagcuuggggaaggucgccauugcgcggcgcaugccgcccccugcuaauuuaccaucccugaaagccgaaaacaagggaaaugaucccaacguuucucuggugccuaaagacggcacugguugggcuucgaagcaggagcagucagauccaaaaagcagugacgccuccacggcucagcccccugaaucucaaccacucccggcaagccagacccccgccuccaaucagccuaagcgaccacccgcugccccugagaacacaccacugguacccucaggggugaagaguugggcgcaggcaagcgucacucauggagcccacggcgauggcgggcgugcuucuucccuucugucaagauuuagcagggaagaguucccgaccuugcaagccgcaggagaccaggauaaagcugccaaggagcgggaaagugcggagcagucuuccgguccuggccccagccuccgcccacaaaauucgacaaccuggagagacgggggaggcagggguccugaugaacuggaggggcccgacucuaaacugcaucacggacaugauccacggggcggccuccaacccuccgggccuccacaguuuccgcccuaccgcggaaugaugccuccauucauguaucccccuuacuuaccauuucccccgccuuaugguccacagggccccuaccgauauccuacucccgacgggccaucaagauucccuaggguggccggaccccggggcagugguccaccgaugcgucugguugagccuguggggcgccccagcauacuuaaggaagacaacuugaaagaguuugaucaacuggaccaggaaaaugaugacggcugggcaggagcucacgaggaagucgauuacacagagaagcuaaaauucuccgacgaggaagauggcagagacucugaugaggaaggggccgagggacacagggacagccagucagcuaguggugaggaacggccacccgaggccgauggcaagaaggggaacuccccuaauagcgaaccacccaccccuaaaacggcaugggccgagacuucucgaccgccagaaaccgagcccggaccuccagcucccaagccuccgcucccaccgccucaucgcggccccgcggguaacugggggccaccuggcgacuaccccgacagaggaggcccaccgugcaaaccucccgcaccagaagaugaggacgaggccuggaggcagcggcgcaagcaaucaaguagcgaaaucucccuggcuguggagagagccaggcgucggcgagaagaggaggaaagaaggaugcaggaggaacgccgggcagccugugcugagaaacuuaagagacuggaugaaaaguuuggggcccccgacaaaagguugaaggcagagccugcggcuccacccgccgcaccuucuacaccggccccacccccugcuguacccaaagagcucccagccccucccgcaccaccuccggcuucggcccccacuccagaaaccgagccugaggaaccagcgcaggcucccccugcccagagcacacccaccccgggaguugcagccgcuccaacgcugguguccgguggcgggucaacaagcucuacaagcuccggaucauucgaagccagcccugucgagccccaauuaccaucuaaggagggccccgaaccuccggaggaagugcccccaccuaccacucccccugugccaaaagucgagcccaagggugaugggauuggcccuacacgccagccacccucccagggacugggcuauccgaaguaccagaaaagucucccuccacgauuucaacggcagcagcaggaacaacuucugaagcagcagcaacagcaccaguggcagcaacaucagcaggggagcgcacccccuaccccaguucccccgucuccuccccagccagugacguugggagcgguaccugcaccccaagcuccacccccuccaccgaaagcccuauaucccggcgcacugggucguccuccacccaugccuccaaugaauuucgaccccagauggaugaugaucccuccguacguggauccaaggcuccugcaggggagacccccucuugacuuuuaucccccaggaguccacccuuccggccuggugccccgggagagaucagauagugguggcagcucguccgagccauucgacaggcacgcuccggccauguugcgagaacgcgggaccccucccguugauccaaagcucgcaugggugggagacgucuucacagccacucccgcugagccucggccacugaccucucccuuaagacaggcggccgaugaagacgacaaaggcaugaggagcgagacaccuccggugccacccccuccacccuaccuggcaucauauccuggguuucccgagaacggagcuccaggcccgccuauuagucguuucccccuagaggaaccagguccucgcccccucccauggccucccggguccgaugaaguagccaagauccagacuccgccaccuaagaaagagcccccaaaggaagagaccgcccaacugacaggacccgaggcuggccggaaaccugcaagagguguuggcucugggggacagggcccgccacccccuaggcgagaaagccggaccgagacucgcugggggcccagaccaggauccucaaggcggggcauaccucccgaggaaccaggugccccuccgcgacgcgcggggcccaucaagaaaccaccucccccaacgaagguggaggaacuuccucccaaaccguuggagcagggagacgaaacaccaaagccucccaagccagauccccugaaaauuaccaagggcaaacucgguggcccuaaggagacucccccaaaugggaaccugagcccugcuccgcgccuuaggcgugacuacaguuacgaacgggucggacccaccucuugcagaggcagggggcgcggagaguauuuugcccgaggcagagguuuccgggggacauacggaggcaggggccgcggggcacguuccagagaauuucggagcuauagggaguuccgcggagaugacggucgaggcgggggaaccggcgguccaaaccauccucccgccccaagagggcggacugcuucggagacaaggucagaaggaucugaguacgaagagaucccuaaacgcagaaggcaacggggcagugagacgggcuccgaaacccacgagagcgaucuggcacccucugacaaggaagccccgacuccuaaggaggggacauugacccaggugccacucgcgcccccuccacccggagcuccuccaagccccgccccggcacguuuuacagcccgcgguggccgagucuucacuccuagaggggugcccuccaggcggggacgcggcggugggagaccacccccucagguuuguccaggauggucacccccugcuaaaagucuggccccaaagaaaccgcccaccggcccuuuaccacccagcaaggaaccucugaaagagaagcuaauuccaggcccccucucuccgguggcaagagggggauccaaugguggcucaaacguagggauggaggauggagaacggccucgaagacgcaggcauggccgggcucagcaacaggacaagccaccccguuuuagaaggcugaaacaggagcgcgaaaaugccgcgcgggguagugaggggaagccuagccuuacguugcccgccuccgcaccaggaccggaagaggcucugaccacagucacuguggccccugcuccccgaagggccgccgccaaaucuccagaucucucgaaccagaauagcgaccaagcuaacgaggaaugggagaccgcgucagaauccagugauuucacaucugagaggcgcggcgacaaggaagcacccccuccaguucuguuaacucccaaagccgugggcaccccugggggagguggcgggggagcugucccaggcaucagcgccaugucccggggugaccugucacagagagcaaaggaucuuucuaagcguagcuuuaguucccagaggccggggauggagcggcagaaucgccgacccggaccuggcggcaaagccgggagcucuggaucauccagugguggcgggggaggcgguccagggggcagaacgggacccggcagaggggacaagcggagcuggccuucgcccaaaaaccgcucuagacccccugaggaaaggccgcccggauugccacucccucccccaccucccuccagcucagcuguguuccgacuggaucaaguaauacacaguaauccagcggguauucagcaggcccuagcacagcugucuucccggcaaggcagcgugacagcuccagggggacauccucgucacaagcccggccucccacaggcaccccaggguccuucaccaagacccccuacccgcuaugagccgcaaaggguuaacagugggcugagcuccgacccccacuuugaggaaccaggcccuaugguccggggagugggcgggacucccagagauucugcaggagugagcccauucccucccaaacgcagggagcgaccaccgcggaagccugaacuuuugcaggaggaaucccugcccccaccucauucaucugguuucuuaggcaguaaacccgaggggccaggaccucaggccgaaucgagagacacaggcaccgaggcucucacuccccacaucuggaauaggcugcauaccgccacaagccgcaaguccuaccguccgucuucaauggagccauggauggaaccccuuagcccuuuugaggaugucgcggguacggaaaugucccagagugacucugggguugaucugagcggcgacucacaaguguccaguggaccaugcagccagcggucuucccccgauggcggguugaagggagcagccgagggcccuccgaaaagacccggugggucaagcccacucaacgcugugccuugugaaggacccccaggcucggagccucccaggcgcccaccucccgccccgcacgacggugaccgaaaggagcugccucgggaacagccacuacccccuggcccaauugggaccgagagaucucagaggacugaucgcggaacagaacccggcccgaucagaccuagucaccggcccgggccacccguacaauucggaaccuccgacaaagauagcgaccugaggcucgucgugggcgauucacugaaggcugagaaagaacuuacagcauccguuacugaggccaucccugugucucgugacugggaguugcugccaagcgcugccgcaagugcggaaccccaguccaagaauuuagauagcggucauugcgucccugagccaucuucaagugggcagcgacucuauccggaaguguuuuacggauccgccggccccaguucuucgcagauuucagguggcgcuauggacagccaacugcacccuaacuccgggggauuccgcccaggcacccccagucuucauccuuacagaucucagccacuguaucuacccccggggccugccccacccagcgcacuccuguccggauuggcucugaagggccaguuuuuagauuucucaacgaugcaagccacagagcucgguaaacugccugcagggggaguucuuuaucccccaccuaguuuucuguauucucccgccuucuguccaagcccguugcccgacaccucccuccuacaggugcggcaggaucuaccuucaccaagcgacuuuuacucuacuccccugcagccuggcggccaauccggguuccuuccaaguggagcucccgcgcagcagaugcuccugccuaugguagauagccaguugccggucgugaauuuugguucgcugccacccgccccuccacccgcaccucccccauuaucccuccugccggugggcccugcacuucaacccccaucucuggccgucaggccucccccagccccggcaacccgcguuuugccuucacccgcuagaccauuccccgccagccucgggcgggcggagcugcacccuguggaacuaaagccauuucaggacuaucagaaacugaguuccaaccuuggaggccccgguucuagcaggacaccuccgacugggcgaucauucuccggacucaacagucgucugaaggcuaccccaagcacauacucuggcguauucagaacgcagcgcguggacuuguaucaacaggccucacccccugaugcauuacgguggauacccaaaccaugggagaggaccggcccucccccaagagaagggccuucccgccgggccgaggaaccgggaagcaggggugacaaggagcccggccugccaccuccccgauga

SEQ ID NO: 61237 - RNA, 8454 nt, Artificial Sequence
  derived and/or modified sequence opt3 from PRRC2C__Homo_sapiens__NP_055987
augagcgaaaaguccggacagucuaccaaagccaaggacgggaaaaaguacgcuacacugucacucuucaacacuuauaaaggaaagagccuugaaacgcagaagaccacagcaagacacggucugcagagcuugggaaaaguggggaucuccaggcggaugcccccuccagccaauuuaccgucucugaaggcggagaacaaaggaaaugaucccaacgucaauauuguuccuaaggacggcacugguugggcuucgaaacaggaacagcaugaggaagagaagaccccagaggugcccccugcccaaccaaagcccgggguagcagccccuccagaaguggcuccggcacccaaaucaugggccagcaacaagcagggaggccagggcgaugggauacaggucaauagccaauuucagcaggaguucccuucccuacaggcugccggagaccaagagaagaaggagaaagagacaaacgaugacaauuacgguccaggccccucucuccgcccuccaaacguggcgugcuggcgagaugggggaaaggcagccggcagccccuccucaagugaccaggaugaaaaacugccgggucaggacgagagcaccgcugggacuucugaacaaaaugauauccuuaagguuguggagaagcguauugccuguggaccuccccaggcaaaacugaacggccagcaggcugccuuggcgucccaauauagagccaugaugccaccuuacauguuucagcaguaucccaggaugacauacccaccccuccacggcccuaugcgguucccaccgucacugagcgaaaccaauaaggggcugcgcggaagaggucccccuccaaguugggcaucugagcccgagaggccuuccauccucagcgcuucggaauuaaaagagcuggacaaguuugauaaccuugacgccgaagcugacgagggcugggccggggcacagauggaagucgauuauacggagcaauugaauuucucugacgaugacgagcagggauccaacucaccaaaagaaaacaauagugaggaucagggcagcaaggccuccgaaaacaaugagaacaagaaagaaacugacgaggugucuaauaccaagagcucaagucagauucccgcucaaccguccguagcgaaaguuccuuacgguaaggggcccagcuuuaaccaggagcggggcacaucuucacaucugcccccucccccaaaacuacucgcacagcagcacccucccccagaucgccaagccgugccgggacgaccuggccccuucccaaguaagcagcaggucgcugacgaagaugagaucuggaagcaaagaaggcggcagcagagcgaaauauccgccgcaguggagcgugcccgcaaaagaagggaggaagaggaacggcgaauggaggaacagcgcaaggcugccugcgcagagaaacugaagagacuugacgagaaacuggggaucuuggaaaagcaacccucuccugaggaaauuagggagcgggaacgcgagaaggagagagaaagggagaaagaacucgagaaggaacaggagcaggagcgugaaaaagagcgggaaaaggaucgagagagacagcaagagaaagaaaaggagcuggaaaaagagcaggaaaagcagagggagauggagaaggaacgcaaacaggagaaggaaaaagaguuagaacggcaaaaggagaaagagaaggaacugcagaagaugaaagagcaggaaaaggagugugaacucgagaaagagagagaaaaacuugaggagaaaaucgagccaagggagcccaaucuggaaccuaugguggagaagcaagaaucggagaacagcugcaauaaggaagaggagccggucuuuacucgccaggacuccaaccgaucagaaaaagaggcgaccccaguugugcaugaaacagagcccgaaaguggaucucagccucggccagcuguauugagcgguuacuucaagcaguuucaaaaaucccuacccccucguuuccagagacagcaggagcaaaugaagcagcagcaguggcaacagcagcagcaacagggcgugcugccgcagaccguccccucacaaccaaguucuuccacggugccucccccaccucacaggccccucuaucagccaaugcagccgcacccucagcaucuggccaguaugggguuugacccccgcuggcuuaugaugcaaagcuacauggauccacggaugaugucuggaagacccgcaauggacauuccuccaauccaccccggcaugauaccuccgaaaccacugaugaggcgagaucagauggaggguucccccaauucaagugagagcuucgagcauauugcccgcucggcucgggaccacgccaucuccuugucugaaccuagaaugcucugggggagcgaucccuauccacacgcagagccucagcaggcuacuacacccaaggccaccgaagaaccagaggacguuaggucagaagcggcccuggaucaagagcagauuacugcugcauacaguguggaacauaaccaguuagaggcccacccuaaggcugacuucauccgugaguccucugaagcccagguccaaaaauuucugagccgcuccguggaggauguacggccgcaucacacagacgcaaauaaccagucagcguguuucgaagcccccgaucagaagacccuaagcgcuccacaagaggaaagaaucagugccguugagucucagccuuccaggaaacgaagcgugucgcauggcucaaaucacacgcagaagcccgacgagcagcggucugaaccaagugcaggcauuccuaaagucaccucccgcugcauagauagcaaggagcccaucgaaagaccggaggaaaaaccaaagaaggagggcuuuauuaggucuagcgaggggccuaaacccgaaaagguguauaaauccaagucagagacacgguggggaccacgacccaguagcaacagacgcgaagaggucaacgacaggccugugcgucggucugguccgaucaaaaagcccguucucagagacaugaaggaagagagggagcaacgcaaagaaaaggagggcgaaaaagcugagaaggugacugagaaaguagucgugaagccagaaaagaccgagaaaaaggaucugccucccccuccacccccuccacagcccccggccccuauacagccacaguccguucccccuccaauucaacccgaagcagagaaauucccgucaacagaaacugccacccuugcucagaagccuagucaggacacagagaaacccuuggagccagugagcaccguccagguggaaccugcgguaaagacugugaaucaacagacgauggccgcacccguugucaaggaggaaaaacagccagagaaggugaucuccaaagaucuggugaucgaacgacccagaccugacucucggccagcugucaagaaagagucgacacucccgcccaggaccuacuggaaggaggcccgcgaacgugauugguuuccugaccagggguauagaggacggggcaggggugaguacuacagccgcgggcgaucauauagaggcuccuacggaggccgggggaggggaggccgcggucacacuagagauuauccacaauacagggacaacaagccccgggccgaacauauuccuagugggccacugcgucagcgcgaggaaucugagacccgaagcgaguccucagauuucgaaguugugcccaaaagaaggcggcagcgcggaucugagacagacaccgauagcgaaauccacgagagugcuuccgacaaggauagccuuucuaaaggcaagcugccuaaaagagaggaaaggccggagaauaagaaaccagugaagccccauucauccuuuaagccugacaaccacguacggauugacaaucgauugcucgaaaaacccuaugucagagaugacgauaaggcaaaaccagguuuccugccuaagggcgagcccacucgcagggggcggggaggcacauuucguagagggggaagggacccaggcggucgcccgagucggccuagcacguuacgaagacccgccuacagggauaaccaauggaauccacgccagucggaagugcccaaaccugaggacggggagccaccccggagacacgaacaguucauaccuaucgcggcugauaagcguccgccaaaguuugagaggaaauucgaccccgcccgggaacgcccucgaagacagaggccaacccggcccccucgccaagauaagcccccaagauuuaggcgacugcgggagcgugaagcagccucuaaauccaacgagguuguggcugucccgacuaauggaacagugaacaauguugcacaggagccugugaacacccuaggcgacauuagcgguaauaagacacccgaucucucaaaccagaauaguucugaccaggccaacgaagagugggaaacugcguccgagagcucagacuucaacgaaagacgcgagagggaugagaaaaagaaugcugaccugaacgcccaaaccguagucaaggugggcgaaaaugugcuuccaccuaaacgggagaucgcaaagagaaguuucagcucccagcgccccgucgauaggcagaaccgacgggggaauaacggaccaccuaaaucuggcagaaauuuuagcgggcccaggaacgaacgccguuccggaccgccaucaaagucuggcaaacgggguccuuucgacgaucagcccgccgggacgaccggaguugacuugaucaauggcaguucggcucaucaccaagagggugugccaaacggcacagggcagaagaauagcaaggauuccacuggcaaaaagagagaggaccccaaaccuggcccgaagaaaccaaaggaaaaaguagaugcccugucucaguuugaccucaacaauuaugcaucaguggucauuauagaugaccaucccgaggugaccguuaucgaagauccucaaagcaaccugaaugacgacggguucacagagguggucuccaagaagcagcagaaaagguuacaggaugaagaacgccgaaagaaagaggaacaagugauucagguuuggaacaagaaaaacgcuaaugagaagggacggagucagacuucuaagcugcccccaagauuugccaaaaagcaggcgaccggcauccaacaggcccagagcucagcauccgugccuccccuugcuagugccccauugccuccgagcacgucugcuuccguccccgcaucaacaagcgccccacucccugccacccugacucccguaccagcuucgacaucugcgccugugcccgcaaguacccuagccccgguucuggcuuccacuagcgccccagugccugcaucaccccucgccccagucuccgcuucugcgagcgugagugccuccguacccgcaagcaccucugcugccgcaauuacaucaaguuccgccccugcuagcgcccccgcgccaacgccuauccuggcaucugugucgaccccggccucagucacuauacuugcuagcgccuccauccccauuuuggcuagugcacuggccucuacaagcgcuccaaccccugcccccgcagcguccucaccagccgcuccuguuaucacagcccccacuauuccggcaagugcuccuaccgccucugugccauuagcacccgccagcgcuuccgcgccugccccagcacccacgccugugucagcuccaaaccccgccccgccugcccccgcacagacacaagcucagacccacaaaccaguccagaauccccuccaaacuaccagccagucuuccaagcagccuccacccaguaucaggcugccuagcgcccagacaccaaacgguacugacuacguggcgucggggaaauccauacaaaccccgcagucucauggaacacuuacggcugaacugugggauaauaagguugcaccuccagcaguauugaacgacauuucaaagaaacucggcccaaucagucccccucagccacccaguguguccgccuggaauaagccgcugaccucuuucggcagcgcuccuucauccgagggggccaaaaacggacaggaaaguggucuagagauuggcacugauacaauccaauuuggggccccagcgagcaauggaaacgagaaugaagucgugcccguucugucugagaagucagcugacaaaauaccugaacccaaggagcagcgccagaagcagccaagagccggcccgaucaaagcacaaaagcucccugaucugucccccguggaaaacaaagagcacaagccaggucccauugggaaagagcggagccuuaagaauaggaaagucaaggacgcccaacagguggaaccugagggacaggaaaagccaucucccgcuaccguacguaguacugauccugucacaaccaaagagacgaaggccgugucggagauguccacugaaaucggcaccaugauuagcguuucaucugcagaguacggcacaaacgcuaaagaaagcgugaccgacuauacuacaccauccaguucauugccgaauaccgucgccacaaacaauacuaagauggaggauacccuggugaacaacguucccuuaccuaauacgcucccacugcccaaacgagaaacaauccaacagucuagcucccuuaccagugugccuccaacuaccuucagccugacauuuaagauggaguccgcgcgcaaggccugggagaacucucccaaugucagagaaaaagggucaccugugacuagcaccgcaccgcccauagcuacgggaguaucguccagugccucugguccaagcacagcaaacuacaauucauucuccucugcuaguaugccucagauucccguggccagcguuaccccaacugccucccuaucaggcgcggggacauauaccacuagcucucucaguacaaaguccaccacgacuagcgacccucccaacaucuguaaagucaagccacaacagcugcagaccucaucuuugccguccgcuucgcacuuuagccagcugaguugcaugccuucuuuaaucgcacaacagcagcagaauccccaaguguacgugucccagagcgccgcugcccagauuccagcauucuauauggauacaucacaucucuuuaacacccagcacgcccggcuggcucccccuagucuugcgcaacagcagggauuccaaccaggccugucccagcccacaagcguccagcagaucccuauuccgauauacgcccccuugcaaggucagcaucaggcacagcucucucugggggcuggaccagccguaucacaagcacaggagcuauucagcuccucucugcagccuuauaggagucagcccgccuuuaugcaaucgagccuuucccagccaucagugguucucucuggcacugcuauccacaauuucccuaccgugcagcaucaggaacuggccaaagcgcaaagcggcuuggcauuucagcagacgaguaacacacaacccauuccaauccuguacgagcaccaguuagggcaggccuccggacucgguggcucacagcugauugacacucaccuucugcaagcucgcgccaauuugacccaggcaucuaaccucuacagcgggcagguccagcaaccgggacagacaaauuucuauaacaccgcucaguccccuagugcccugcagcaagugacuguuccccuaccagcuagccagcugucucuuccuaauuuuggcucaaccggucagccccucaucgcccugccacaaacauugcagccucccuuacagcauacgacuccgcaggcacaagcgcagucccugagcagaccagcccaggugagucagcccuuccgggggcucauaccugcuggaacccaacacucuaugaucgccacaaccggcaagauguccgaaauggagcugaaggcauuuggcucggggauugacaucaaaccaggaacucccccuauugcugguaggagcacaaccccgacgucaucccccuuccgagccacuucuacaaguccaaacagccagucauccaagaugaacagcaucgucuaccagaaacaguuucaaucugccccugccaccgugcguaugacccagcccuucccaacucaguuugcgccucaagcuaagcagagagccgagguacuucagaguacacagcgcuucuucuccgaacaacagcagagcaaacagauaggcgggggaaaggcacaaaagguggauucagacucuucgaaacccccagagacccugacagauccucccggcguuugucaggaaaaggucgaggaaaaaccgccuccagcccccagcauugcuacuaagccugugcggacggguccaaucaaaccccaggccaucaagaccgaggagacaaaguccuga

SEQ ID NO: 61238 - RNA, 681 nt, Artificial Sequence
  derived and/or modified sequence opt3 from PRRG4__Homo_sapiens__NP_076986
auguucacccugcucgugcuucugagccaguugcccacagucacuuuaggcuuuccucacugcgccagagggccaaaggcuuccaaacaugcaggagaggaaguuuucacgucuaaggaggaagccaacuuuuucauccacaggcggcugcuauacaaucgcuuugaccucgagcuguucaccccggguaaccuugaacgagaguguaaugaggaacugugcaacuaugaggaagcgcgugagauuuuuguggaugaggacaaaacaauagcuuucuggcaagaauacucagccaagggccccacuaccaaaagugaugggaauagagagaagaucgacguaaugggauugcucacaggccugauugcagccgguguguuucuggucaucuucgggcucuuaggauauuaccuguguauuaccaagugcaacaggcuucagcauccuuguagcuccgcuguguaugaacggggccgccacacuccaucuaucauauuuagaaggcccgaggaagcagccuugucgccucugccacccucaguugaggaugcuggccuaccuagcuacgagcaggccguggcgcucacacggaaacauagugucuccccaccgcccccuuauccagggcacaccaagggauuccgcguguuuaaaaagucuaugagccugcccucccacuga

SEQ ID NO: 61239 - RNA, 921 nt, Artificial Sequence
  derived and/or modified sequence opt3 from PRRT1__Homo_sapiens__NP_085154
augagcuccgagaagucuggccugcccgacucagugccucacaccaguccaccgcccuacaacgccccucagccacccgcugaaccuccagcacccccuccacaagccgcgccgagcucccaucaccaucaccaucaccacuaucaucagucugggacagcuacucuccccagacuuggagccgguggccuggcaucgucagccgcuacggcacagagggggccuagcaguuccgccaccuugccacggcccccucaccaugcuccacccggaccggccgcgggcgcaccucccccagguugcgccacauuaccucgcaugcccccagaucccuaccugcaggagacucgauucgaagggccucuaccaccgcccccuccagcugccgcagcucccccuccacccgccccggcgcaaaccgcccaggcaccuggauuugucguuccaacacacgcuggcaccgugggcacucucccccuugggggauauguagccccugguuacccccugcagcugcagccauguacagcuuaugugccugucuaccccgugggcaccccauaugccgggggaacgccgggcgguacugggguuaccucuacauugccucccccaccccaaggaccuggccucgcacugcuggagccacguagacccccucacgacuacaugccgaucgccgugcucacuaccauuugcuguuucuggccaacaggcauaaucgcuauuuuuaaagcgguccaggugaggaccgcauuagcccgcggggauaugguaagcgcugaaaucgccucccgggaggcaagaaauuucucauuuauuagucuggccguuggaaucgcugccauggugcuuugcacgauauugacugucgugaucauuaucgcagcgcagcaucacgagaacuacugggaccccuga

SEQ ID NO: 61240 - RNA, 900 nt, Artificial Sequence
  derived and/or modified sequence opt3 from PRRT2__Homo_sapiens__NP_001243372
auggccgcuagcuccucugagaucucagaaaugaagggcguggaggaaagucccaaagucccuggggagggaccaggucacagcgaagcagagaccggcccgccccagguucuggccggggugccugaccaaccagaggcgccccagccuggaccaaacacaacugcugcccccguagauuccggcccuaaggcaggucucgccccagaaacgaccgagacaccggcuggggcaucugaaacugcccaggcuaccgaccuuucgcugucacccggaggcgagagcaaagccaauugcaguccugaggauccaugucaggaaacaguguccaagcccgaggucucuaaagaagcgaccgcagaccaaggcagcagauuggaguccgccgcuccuccagaacccgccccggagccugcaccccagccagauccuaggcccgacucacagccaacucccaagccugcuuuacagccagagcugccgacacaagaagaucccaccccugagauucuaagugaaagcgugggggagaagcaggaaaacggagccguugugccacuccaggcgggugacggcgaggaggggcccgccccugaaccacauucucccccguccaaaaagucaccuccagcaaauggagcucccccucggguccugcagcaacuuguggaggaagaucgcaugcgacgugcccacagcggccaucccgguaguccaagagggucucuguccaggcacccuagcucgcaguuggcuggacccggcguagagggcggggaaggaacgcagaaaccacgggacuacauaauccucgccauucugucuugcuucuguccgauguggccuguuaacaucguggcauuugccuaugcugucauggugucccccauggguccauga

SEQ ID NO: 61241 - RNA, 654 nt, Artificial Sequence
  derived and/or modified sequence opt3 from PRRX1__Homo_sapiens__NP_008833
augaccagcuccuacggccacgugcuggagagacagcccgcccucgggggaaggcuugacucuccugguaaccuggauacauugcaagcuaagaaaaauuucucagucagucauuuacuggaccuagaagaggcaggcgauaugguugccgcgcaggcugacgaaaacgugggggaggccggacggagccuccuggaauccccaggccuuacuucugguucggauacgccgcagcaggacaaugaucaacugaacucagaggagaagaaaaagcgcaaacagcgacguaauagaaccacauuuaacagcagucaguugcaggcacucgaaaggguauucgagcggacucacuaucccgacgccuuugugcgcgaagaucuggcuagaagggucaaucugaccgaggcacgggugcaaguuugguuccagaaccgccgagccaaguuuagaaggaaugagcgggcuaugcucgccaacaagaaugcguccuuacugaaaucuuacagcggggacgugacagcagucgaacagccuaucgugccacgucccgccccucgcccaaccgauuaucuuuccuggggaacugcuucacccuacagaaguagcucuuugccuaggugcugucugcaugagggccuacacaacggcuucuga

SEQ ID NO: 61242 - RNA, 762 nt, Artificial Sequence
  derived and/or modified sequence opt3 from PRRX2__Homo_sapiens__NP_057391
auggacagcgccgcugcagccuucgcgcuggauaagcccgcucucggcccugggccaccgcccccuccacccgcccuuggaccuggugacugcgcacaggccaggaaaaacuuuuccgugucucaccuguuggauuuagaggaagucgcugcagccggcagacuggcugcccggccaggggcgcgcgcagaggcccgagaaggagcugcccgugagcccucaggcgguaguagcggguccgaagcagcuccucaagacggagaguguccaucuccgggcagaggcucggccgcgaagaggaaaaagaaacagcggcgcaauagaaccacauucaacucaagccagcuacaggcccucgagaggguuuuugaacggacucauuaccccgaugcauucgugcgcgaggaacuggcucgaagaguaaaucuuagugaggccagggugcaagucugguuucagaaccggcgugcuaaguuccgcagaaaugagagggccaugcuggcaucccggucugccagcuugcucaaguccuauucacaggaagcugcgaucgagcagccuguggcaccacgacccacggcccugaguccugacuaccugagcuggaccgcuucuuccccauauucaacaguucccccguacagcccugggaguucuggacccgccacuccaggugugaacauggcaaauuccauugccagccuccgcuuaaaagcuaaggaauuuucgcugcaccauucucaagucccuaccgugaacuga

SEQ ID NO: 61243 - RNA, 2628 nt, Artificial Sequence
  derived and/or modified sequence opt3 from PRSS12__Homo_sapiens__NP_003610
augacccuggccagauucgugcucgcucuuaugcugggcgcauugcccgaggucguuggguuugacagcguguuaaacgauucccugcaccauucucacaggcauucaccuccagccggaccgcacuaccccuauuaccuaccuacacagcaacggccaccccgcacucgaccuccacccccucucccacguuucccgagacccccuagggcgcugccagcucagcggccccaugcccuucaggcaggucacacgccucgcccacaccccuggggcugcccggccggggaaccuuggguaagugugaccgacuuuggagcucccugucugagaugggcagaggucccaccuuucuuggaaaggagcccacccgccuccugggcucagcuccggggccaacgccauaauuuuugccgaucucccgauggugccgggagaccuugguguuucuauggagacgcgaggggcaagguggauuggggcuacugcgacugucggcacgggucgguucgucugcgcggagguaaaaacgaguuugaaggcacaguggaggucuaugcaucagggguguggggaacuguaugcagcagucauugggaugacuccgaugccucuguuaucugucaccagcugcagcucggcgguaaggggauugcuaaacagaccccauucagcggauuaggccugauaccgaucuacugguccaaugugagaugcaggggcgacgaggaaaacauucuuuugugugagaaggauaucuggcaagggggagucugcccccagaaaauggccgcagcugugacauguucauuuagucacgguccuaccuucccaauuauccggcuggccggcgggagcucugugcaugaaggacgagucgagcuauaucacgcgggccagugggguacuguuugcgacgaucagugggacgacgccgaugcagaggugauaugccgccaacucgggcuguccggcaucgcuaaggccuggcaucaggcuuacuuuggagaaggcucagggcccguaaugcuugacgaggugagauguacaggaaaugaacugagcauugagcagugcccuaagaguucuuggggugaacacaacuguggccauaaagaggaugccggggucuccugcaccccauugacggacggagugaucaggcucgcaggcgguaaggggagccacgagggccggcuggaaguuuacuaucgcggacaauggggcacugugugugaugacggguggaccgaguuaaauacauacgucgugugcagacagcugggauucaaauaugguaagcaggccucggcuaaccacuuugaagagucuacuggccccauuuggcucgaugacguauccuguucagggaaagaaaccagguuccuucagugcagucgucggcaauggggacgacaugauuguagccacagagaggacguuuccaucgcgugcuacccgggcggugaggggcauaggcugucuuugggcuucccugugcgccuaauggauggagaaaauaagaaggagggccgggucgaaguguuuauaaacgggcaguggggaacaauuugugacgacggcuggaccgauaaagacgcagccgucaucugcagacagcuggguuauaaggggccagcuagggcccgcacgauggcauacuucggagagggcaaaggucccauucacguggauaauguuaagugcacuggcaacgaacgaagccucgccgacuguaucaaacaggauaucgggcggcacaauugccgucauucagaggacgcuggagugauuugugauuauuuuggcaagaaagccagugggaacuccaauaaggagagccugucuucaguaugcggacuuagacuguugcacaggcgccaaaagcggauaaucggcgguaaaaacagucucagagggggauggccuuggcaggucagccugagguuaaaguccucucauggcgacggucgacugcuauguggcgcaacacuccugucgagcugcugggugcuuaccgcggcucacuguuucaaacgcuacgggaacuccacucggucauacgccguuagagugggagauuaucauacauugguccccgaagaguuugaagaggagauuggcgugcagcagaucguaauacacagggaauaccguccagaccgcagugauuaugacauugcacuggugcggcuccaagggccugaggaacagugcgccagauucucuagccacguucugcccgcuugucuuccacuguggagggagcgaccgcagaagaccgccuccaauugcuacaucacgggauggggcgauaccggucgggcauauucacgcacauugcagcaagcugccaucccucuccugcccaaaagauuuugugaagagagguacaaggggcgguucacuggacgaauguuaugcgcgggcaaccugcaugagcacaagagagucgacagcugccagggugacucuggcgggccacuaaugugugaacgccccggagaguccugggugguguauggcgucaccaguuggggguacggaugcggcguuaaagauagcccugguguguacacaaaggugucugccuuuguaccauggauuaaauccgucacuaagcucuga

SEQ ID NO: 61244 - RNA, 1545 nt, Artificial Sequence
  derived and/or modified sequence opt3 from PRSS16__Homo_sapiens__NP_005856
auggccguguggcuggcucaguggcucggcccccuucuguuggucagcuuaugggggcugcuagccccugcaucccuccugagaaggcuuggagagcacauccaacaguuccaggaaucuucagcgcagggucugggcuugagucucgggccaggagcugccgcacugccgaagguuggcuggcuggagcaacucuuagaccccuuuaacgugagcgaucggcgcuccuuccugcagcgauacuggguaaaugaccagcauugggugggucaggaugggccuauuuuucuucacuugggaggcgaaggcucucuggggccaggaucggucaugcguggucaucccgccgcucuagccccugcauggggcgcucucgugauaucacuggagcacagauucuaugggcuuagcaucccagccggaggccuggaaauggcgcaauugagguuucucaguucccggcuggcauuagccgacguugugucugcucgccuggcccucagcagacuuuucaacauuuccucaaguagccccuggaucugcuuuggugggucuuacgcaggaucccuggcugccugggcgagguugaaauucccucaucuaauuuuugccucagucgcaagcagugcuccagugcgggccguacuggauuucucugaguauaaugacguugugucccgcagccucaugucgaccgcuaucggcggcucucuggagugucgagccgcagucuccguggccuuugcugaaguggagagaaggcuucggucagggggagcggcacaggccgcucugcguacagaauugagugccugcgguccgcucggccgcgcagagaaccaggccgagcuguuaggggcucugcaggcccuagucggaggcguugugcaauacgauggucagacuggggcaccccucagcguaagacagcuguguggccuuuugcugggaggcgggggaaauaggucccacucuacgccuuauugcggucuccggcgagcggugcaaauaguccugcacagccuuggccagaagugucugucauucagucgcgcugaaaccguggcccaguugagauccacagagccacagcucagcgggguuggagacaggcaauggcuguaccagacuugcaccgaauuuggcuucuaugugacaugugagaacccccggugcccuuucucucaguuaccagcacugcccucacagcuagaucucugugaacaagucuuuggucugagugcccuuagcguggcucaggccguagcacagaccaauuccuacuacgggggccagacuccgggagcuaacaaaguuuuguucgugaauggcgacacagauccuuggcauguccugucugugacccaagcccucgggucgagcgaguccacgcuguuaauccgcacuggaucacacugccuggacauggcgcccgagagaccaagugauucuccuagccuuagguugggucgucagaacauuuuucagcagcuccaaaccuggcugaagcuagccaaagaaucccagaucaagggcgaggucuga

SEQ ID NO: 61245 - RNA, 744 nt, Artificial Sequence
  derived and/or modified sequence opt3 from PRSS1__Homo_sapiens__NP_002760
augaacccccugcucauccuuaccuucguggccgcugcacuggccgcgccuuuugacgaugacgauaagauugucggcggguacaauugcgaggaaaacagcguuccauaucaggugucccuuaauucuggauaccacuucugugguggcucauuaauaaacgagcaauggguagugagugcugggcauugcuauaaaagcagaauccaggucaggcugggagaacacaauauugaggugcuagaaggcaacgagcaguuuaucaaugccgcaaagauuauccggcauccgcaguacgaccgcaaaacacucaacaaugauauaaugcugaucaaguuguccucucgagccguuauuaacgcucgugugucgacuaucucacugcccacggcaccuccagccaccgguacaaaauguuugauuagcggguggggaaauacugcuaguuccggcgccgacuaucccgaugagcuccaaugccuggacgcgccuguccugucucaggcaaagugugaagccagcuacccaggcaagaucaccuccaacauguucugcgugggguuucucgagggagguaaagauucaugucagggcgacagugggggacccguaguuugcaauggccaguuacaagguguggucagcuggggagaugggugugcucagaagaacaaaccuggcguguauacaaagguguacaauuacgucaaauggauaaagaacaccauugccgcaaacucuuga

SEQ ID NO: 61246 - RNA, 678 nt, Artificial Sequence
  derived and/or modified sequence opt3 from PRSS21__Homo_sapiens__NP_001257381
augggcgccagaggggcucugcuccuugcacuguuguuagccagggcgggacugcggaagcccgagagccaggaagcugccccucuauccgguccaugcggccgccgagugaucaccucucguauugucgggggagaggacgcagaacucggcagauggccguggcaagguucacugaggcuuugggauagucacguuuguggggugagccuguugucccaucggugggcccucacagcugcacacugcuucgagacugaccugucugaucccucgggauggaugguacaguuuggccagcugacgucaaugccuagcuucuggagucuccaggccuacuauacccgcuacuuuguguccaacauauauuuaucuccaagauaccugggcaauagccccuaugacaucgcucuugucaaauuguccgccccugugacauacacuaagcauauucaaccaaucugucugcaggcgucaaccuucgaauuugagaacaggacagauugcuggguuaccggguggggauauauuaaagaggacgaagguaguagcggccggcaccauaagcagcuauacgugcagcccccucucccacaaguccaguucccgcaggggcaccuguggcgccacggacuuuguuggcagugcccccgaagagagggcugucuguugagguga

SEQ ID NO: 61247 - RNA, 954 nt, Artificial Sequence
  derived and/or modified sequence opt3 from PRSS22__Homo_sapiens__NP_071402
augguggucagcggcgcucccccugcccucgggggagguugccugggcaccuucacaucccuucuguuguuagcaucuacugccauccugaacgcggcuaggauuccaguuccgcccgccugugggaagccucagcaacuaaauagagugguaggaggcgaggacucaacggauagugaauggccauggauagugagcauccagaaaaacgguacccaccauugcgcagggucccuccugacaucucggugggucauuacugccgcucacuguuuuaaggacaaucuuaacaaacccuaccuguucucgguguugcucggagcauggcagcugggcaauccuggcucacgcagccagaagguugggguggccugggucgagccacaucccguguauaguuggaaagaaggagcuugcgccgauaucgcgcugguacgacucgagcguuccauucaauuuucugaaagaguuuuaccuaucugucugccagacgcaagcauacaccuuccgcccaacacccauugcuggaucuccgguuggggcucaauucaggauggggugccuuugccacacccccagacacugcagaagcuaaaggucccuaucauugacagugagguguguagccaccucuacuggaggggagccggccaagguccaaucaccgaggauaugcugugcgcuggguaucuugaaggagagcgggacgccugucugggcgauucuggcgggcccuugaugugccagguggacggagcauggcuccuggcugguauaauuuccuggggcgaagggugugccgagcgcaauagaccgggagucuacaucucauuaagcgcgcauaggaguuggguugagaaaauugugcagggcguacagcugcggggucgcgcccaagggggcggagcacuccgagcuccuucucagggcuccggggccgcugccagaagcuga

SEQ ID NO: 61248 - RNA, 1299 nt, Artificial Sequence
  derived and/or modified sequence opt3 from PRSS23__Homo_sapiens__NP_001280107
augugcagcggcgccgggggagugagagcugcaucccccaggccugaggccggucgggcgggccugggguggcgcggaggccgaacccgucagcucccagcccuucuggcuucuuuguuagcacuggguugugccgcugggcaagcaugggaaccgagagcccuaucaaggcggccccaccucagugagcgcagaagcgaaccuaggccaggacgggcugcccgccgaggcacaguccugggcauggcggggauccccggacuucuguucuugcucuuuuuccugcugugcgcaguuggucagguguccccuuacucugccccauggaagcccacuuggccugcuuauagacucccaguaguguuaccgcagucgacgcugaaccuugccaaacaguacuugucauaugagacccuguacgcaaauggcagcaggacagaaacucaagucgggauuuauauacuaaguuccucuggagacggcgcucagcaucgggauagcgguuccucagggaagagucgucgcaaaagacagaucuacggauaugacagcagguuuucuauuuucggcaaggauuuucuccugaacuaccccuucuccaccucagugaaacuuagcacaggcuguaccgggacucugguugccgagaagcacguguugacagcggcccauugcauccacgacggaaagaccuacgucaaagguacgcagaagcuccgggugggcuuucugaaaccuaaguucaaagaugggggacgaggcgcaaaugacaguacuucugcuaugccagagcaaaugaaguuucaguggauucgcguaaagagaacccauguucccaaagguuggaucaaggggaacgccaaugauauaggcauggacuaugauuacgcuuuacuggaacucaaaaagccucacaaaaggaaguucaugaaaaucggaguguccccacccgccaagcagcuuccgggcgggcggauucacuuuagcggauaugacaacgaucgcccugguaaucuggucuacagauucugugacgugaaggaugagacauaugacuugcuauaccagcaaugcgacgcacagcccggcgccucggggucuggaguguaugucaggauguggaaacgucagcaacagaagugggaacggaaaaucauuggcaucuuuuccggucaucaguggguugauaugaacgggucaccacaggacuucaauguggcuguacgaauaacuccucugaaguacgcgcaaauuuguuacuggaucaaaggcaacuaucucgauugcagagagggauga

SEQ ID NO: 61249 - RNA, 873 nt, Artificial Sequence
  derived and/or modified sequence opt3 from PRSS27__Homo_sapiens__NP_114154
augagaaggcccgccgcugugccucugcuccuucuguugugcuucggcagccagcgggcaaaggccgcgaccgcuugugggcgcccacgaauguuaaaccguauggucggaggucaagacacacaggagggcgaauggccguggcagguuuccauccagagaaaugggucucacuuuugcggaggcucacugauugccgagcaaugggugcuaacugcagcccauuguuucaggaacacgagugaaaccagccucuaccagguacugcuuggugcucggcagcuggugcagcccgggccucacgcaauguaugcccgcgucagacaaguggaguccaauccauuguaccagggaacagcuucuucggccgauguugcgcucguggaacuggaggcacccgucccuuuuacuaacuauauacugccagugugccuccccgacccuucaguaaucuucgagaccggcaugaauuguuggguuacaggcugggggagcccaagugaagaggauuuacugccggaacccaggauucuucagaaauuggccgugccuaucauugacaccccaaagugcaaccugcuauacuccaaagauacugaguuuggauaucagcccaagacaaucaaaaaugacaugcucugugcugguuucgaggaaggcaagaaggaugccugcaaaggggacucuggaggcccucuggucugucuugugggucaaagcuggcugcaggcaggggugauauccuggggagagggcugcgcucggcagaaccgcccaggcgucuacauccgaguuaccgcccaucacaauuggauucauagaaucauucccaaguugcaauuucagccggcgaggcucgggggacagaaauga

SEQ ID NO: 61250 - RNA, 744 nt, Artificial Sequence
  derived and/or modified sequence opt3 from PRSS2__Homo_sapiens__NP_002761
augaaccugcuccuuauccugaccuucguggccgcugcagucgccgcgcccuuugacgaugacgauaagauuguuggcggguacauaugcgaggaaaauagcgugccuuaucagguauccuugaacucuggauaccacuucugugguggcucauuaaucagugagcaauggguggucagcgcugggcauugcuauaaauccaggauucaggugagacugggagaacacaauaucgagguucuagaaggcaacgagcaguuuauuaaugccgcaaagaucauacggcauccaaaauacaacucucgcacacucgacaaugauauccugcuuauuaagcugucgucaccggccgugaucaacagccgagucagugcuauuuccuugcccacugcaccuccagccgcugguacggagucucucaucagcggguggggaaauacccuguccucaggcgccgacuaucccgaugaacugcagugucucgacgcgccuguguuaagucaagcagagugcgaagccagcuacccaggcaaaauaacaaacaauauguucuguguaggguuucuggagggagguaaggauucuugccagggcgacuccgggggacccguugugucaaacggcgagcuucaggguauugucagcuggggguauggaugugcucagaagaaucguccuggcguguacacuaaaguguacaacuaugucgauuggaucaaggacaccauugccgcaaauaguuga

SEQ ID NO: 61251 - RNA, 843 nt, Artificial Sequence
  derived and/or modified sequence opt3 from PRSS33__Homo_sapiens__NP_690851
augagaggcgugagcugccugcagguccuccuucuguugguuuuaggggccgcuggaacccaagguaggaaguccgcagccuguggccagccccggaugucuucacgcaucguagggggacgagacggccgugauggugaguggccuuggcaggcgaguauucagcacagaggggcucaugugugcggaggcagccugauagccccacaaugggugcuaacagcagcccacuguuucccgaggcgggcucuccccgcagaauaccgcgucagacugggcgcccuuaggcugggguccacuucuccucggacguugucggugccaguucgccgagugcuccugcccccugacuauucagaggauggagcuagaggugaccuggcccucuuacagcugaggcggccagucccccuuagcgcgcgugugcagccuguaugcuugccaguuccgggcgcaagacccccuccagggacccccugucgcgugacaggauggggcagucugaggccuggugucccacuacccgaauggcggccgcuccagggggugcgagugccucugcuugauucccgcacuugcgacggacuguaccaugucggcgccgauguuccccaagcugagagaaucguguugccaggcucucucugugccggguauccucagggacacaaagacgcaugccagggugauagcggcgggccccugaccuguuuacaguccggaucauggguacuggugggcgucgugaguugggguaaggggugcgcucucccaaacaggcccggcguuuacacaagcguggccaccuauucuccuuggauucaagcgcgggucuccuuuuga

SEQ ID NO: 61252 - RNA, 1242 nt, Artificial Sequence
  derived and/or modified sequence opt3 from PRSS35__Homo_sapiens__NP_001163894
auggagaacaugcugcucuggcuuaucuucuuuacccccggcuggacacugauugacgggagcgaaauggagugggauuucauguggcacuugagaaaggugccuaggauagucuccgaacggacuuuucauuuaacgucuccagccuucgaggcugacgcaaaaaugaugguuaauaccgugugcggaaucgaaugucagaaggagcugccgacacccucacuaagugagcucgaagauuaccugagcuaugagacuguauuugaaaacgguacccgcacacuuacccgagugaaaguccaagaccugguguuggagccuacucagaauauuacaaccaagggcguuuccgugcguagaaaaaggcaggucuacgggacggauucucgguucucgauccucgacaagcgcuuucugacuaacuucccauuuucaaccgccgugaagcugagcacaggaugcaguggcauucucaucucuccccagcacguauuaacugcggcucauuguguucacgaugguaaagacuaugugaagggguccaaaaagcugagagucggacuuuugaaaaugaggaauaagagcggcggcaagaaacggcgcggguccaagcgaucaagaagggaggccaguggaggugaucaacgggaaggcacccgugagcaucugcgcgaaagagcaaaagggggaaggcggcgaaagaaaagcggccgcggucagagaauagccgaggggaggccuucuuuccaguggacacgggugaagaacacccacaucccaaaaggaugggcucgcggcggcaugggggacgcaacgcuagauuacgacuaugcccuccuggaacuuaagagagcucacaagaaaaaguacauggagcugggaauuucccccacuaucaaaaagaugccugguggcaugauucauuuuucaggguucgauaaugacagggccgaccaguugguguaucguuuuugcagcgucagugaugagucuaacgaccuccuguaccaauacugugaugcggaauccggaagcacaggcucggguguuuauuuacggcugaaagacccagauaagaagaauuggaaacgaaagaucauagcaguguacucugggcaccaguggguagacgugcauggcguccagaaagauuauaacguggccguuagaauuaccccgcucaaguacgcucagaucugccuuuggauucacggaaaugacgccaacugugcauauggcuga

SEQ ID NO: 61253 - RNA, 786 nt, Artificial Sequence
  derived and/or modified sequence opt3 from PRSS3__Homo_sapiens__NP_001184026
augcacaugagagagaccagcggcuucacacugaagaaagggagguccgcuccccucguguuucauccuccagacgcccuuaucgcagucccguucgaugacgaugacaagauuguuggagguuacacuugcgaagagaacucucugcccuaucaggugucauugaauaguggcagccacuuuugugggggauccuuaauaucugaacaauggguagugucggccgcgcauugcuacaaaacgcggauccagguccgccugggcgagcacaacauuaaggugcuagaagguaaugagcaguucaucaacgcugccaaaauuauccgacauccuaaguauaaucgugauacccucgacaacgauauaaugcugaucaaacuuucaagcccagcaguuauuaaugccagagugaguacaaucucccugcccacugcuccuccagcagccgggaccgaguguuugauuucuggauggggcaacacacucagcuuuggcgcugacuaccccgaugaacugaagugccuggacgccccuguccucacccaggcggaguguaaggcauccuauccagggaaaaucacuaauucaauguucugcgugggauuuuuagaagguggcaaggauaguugucaaagggacagcgggggaccgguaguuugcaacggccagcugcaggguguggucucuugggggcacggaugugccuggaaaaaucggcccggcguguacacaaagguguauaacuacgucgauuggauaaaggacaccauugcugccaauuccuga

SEQ ID NO: 61254 - RNA, 1158 nt, Artificial Sequence
  derived and/or modified sequence opt3 from PRSS50__Homo_sapiens__NP_037402
augggcagauggugccagaccguggccagggggcaacggccccgcacaagcgcuccuucccgagcaggagcccugcuccuucuguuguuacugcuacguucugcggguuguuggggcgcuggggaggccccaggagcacucucaacugccgacccggcugaucagaguguccagugcguucccaaggcaacguguccuagcuccagaccaaggcugcuuuggcagacccccacaacucaaacccugccuucuacaaccauggaaacucaguucccagugucggagggcaaaguagaccccuaccggucaugcgguuuuagcuaugaacaggauccuacauugcgcgacccagaggccguggcuagaagguggccguggauggucagugugcgggccaacgggacccacaucugugcgggaacgauuauagcaucccaguggguucucacuguggcccauugccugaucuggcgcgaugucauuuacucugugcgaguaggcagccccuggaucgaccaaaugacccagacagcuuccgauguuccugugcugcaggucauuaugcacucaagauauagggcccagcgguucuggaguugggugggccaagcaaaugacaucgggcucuuaaagcugaaacaggaacuuaaguacagcaacuaugugcguccaauauguuugcccggaacugauuacguccugaaagaccauucucgcugcaccguuacagguuggggccuauccaaggcugaugggauguggccucaguuuagaaccauccaagagaaggaggugauuauccucaauaacaaagaaugugacaauuucuaucacaacuuuacgaagauuccaacucugguacagaucauaaaaucacagaugaugugcgccgaggauacacauagggaaaaguucuguuacgagcuuaccggagagccccuggugugcagcauggaaggcacuugguacuuggucggucucgugaguuggggagcggggugccagaaaucugaggccccgccuauuuaucugcaaguuuccagcuaccagcacuggaucugggacuguuuaaauggccaggcacuggcucuccccgccccaucgcggacacuucuguuggcucuaccucugccccucucucugcuugccgcacuguga

SEQ ID NO: 61255 - RNA, 1662 nt, Artificial Sequence
  derived and/or modified sequence opt3 from PRSS53__Homo_sapiens__NP_001034592
augaaguggugcuggggccccgugcugcucaucgccggggcuaccguccuuauggagggacugcaggcagcccaaagagcguguggucagaggggcccugggccaccgaaaccccaggaaggaaacacaguuccuggcgaguggccauggcaggcuagcgugcggcgccaaggugcccacauuugcuccgggucuuugguagcagacacuuggguguuaacggccgcucauuguuucgaaaaggcagccgcuaccgagcuaaauucauggagugucgugcugggaagccuccagcgagaaggccugucccccggcgccgaggagguugggguggcggcacuucagcugccucgugccuacaaccacuauucucagggaucggauuuggcucuccugcaacuggcccauccaacaacucacacuccccucugcuuaccucagccagcacauagauuuccguucggugcuucauguugggccacaggcugggaccaggauaccagcgacgcgcccgggacucugaggaaucuucgguugcgccugauaaguagaccuacaugcaacuguaucuacaaucagcuacaccaaaggcaccucuccaacccagcccggcccggaaugcugugcggcgguccucagccagggguccagggacccugucaaggcgauucuggcgggccggugcuuugccuggaaccugacggacauuggguacaggcagguauuaucagcuuugcuuccucaugugcccaggaggaugcucccguuuugcucaccaauacggccgcacacaguagcuggcugcaggcccgcgugcaaggcgcugcguucuuagcacagucuccagaaacuccugagauguccgacgaggauucaugcgucgccugcgggagccugcgaaccgcuggaccccaggccggcgcaccaagucccuggccuugggaagccagacucaugcaucagggucaacuugcuugugggggcgcccuggugucugaggaagcaguguugacagcggcucacugcuuuauuggaaggcaggccccagaggaaugguccgucggccuagggacucggccggaggaguggggacugaaacagcucauccugcacggugcauauacccaucccgaaggcggguacgacauggcccuucuguugcucgcucagccuguuacacugggagccagcuuacguccacugugucuacccuauccugaucaccaucucccagacggcgagcgcgguugggugcuggggagagcaaggcccggcgcuggaauaucgucucuucaaaccguaccggugacguugcugggcccucgggccugcucccgacuccacgcggccccagggggagaugguucacccauccugccuggcauggucuguaccagugcugugggggaacuucccagcugcgagggacuguccggcgcaccauugguucaugaagugcgcgguacaugguuccucgccgggcugcacucuuuuggcgacgcuugucagggaccugccagacccgcagucuucaccgcguuaccagccuacgaggacugggugagcucacuggauuggcagguauauuuugcugaggaaccggagccugaagccgagcccggcaguugccuagcaaacauuucccagccaacuagcuguuga

SEQ ID NO: 61256 - RNA, 831 nt, Artificial Sequence
  derived and/or modified sequence opt3 from PRSS55__Homo_sapiens__NP_001183949
augcuccuguucagcgugcuucuguuguuaucccuggucaccggcacacagcuagggcccagaacuccucucccagaggccggaguugcuauccuggguagggcacggggcgcccaccgcccgcaacccccucauccacccucuccugugucagaaugcggggaccgaaguauuuuugagggacguacgagauacagcaggauaaccggcgguauggaagcggagguaggggaguucccauggcaaguguccauccaggcucggucugaacccuuuuguggaggcucgauucuuaacaagugguggauccugacagccgcacacugcuuguauucagaggaacucuucccugaggaacugagcgucgugcugggcacuaaugaucucaccaguccauccauggagauuaaagagguugccucuaucauauuacauaaggacuuuaaacgcgcuaacauggauaaugacaucgcacugcuuuugcuggccagcccgauuaagcuagaugaccucaaagugcccaucugucugccuacacagccagggcccgcuaccuggagagaaugcugggucgccggauggggucagacuaacgcggcagauaaaaauuccgugaagacagaccuuaugaaggccccuaugguaauuauggauugggaggaauguucaaagauguucccaaaacugaccaagaacauguugugcgcuggcuacaaaaaugagaguuaugacgccuguaagcagagcuacuuucccacgcuccagaggaugaacacugggucuucccagaccaagccgccuggaucacacacauuccaucugcaaaauuga

SEQ ID NO: 61257 - RNA, 852 nt, Artificial Sequence
  derived and/or modified sequence opt3 from PRSS57__Homo_sapiens__NP_999875
augggccuggggcucagaggaugggguaggccccuucugaccguggccacagcuuugauguuaccugucaagccaccggcaggcagcuggggagcccagaucauugggggccacgagguuacuccccauucccggccuuacauggcgucugugcgcuucggugggcaacaccauugcggaggcuuucugcuacgagcucguuggguagugucagccgcacacuguuucagucauagagaccucaggacgggccuggucgugcuuggggcccacguucugagcaccgcugaaccaacacaacagguguuuggaauagaugcauugacuacccaccccgacuaucauccuaugacacacgccaacgauaucugccuccugcggcugaaugguuccgcuguccucggcccagccgugggguuacugcgccuucccggaagaagggcgcggccuccaaccgcaggcacucgcugucgaguagccgguuggggguucguuucugacuuugaggaauugccgcccggacugauggaggcuaaagugagaguccuagauccugacgugugcaacucgucauggaagggccaucucacacugaccaugcuuuguacgaggagcggcgauagucaccggcguggguucugcuccgccgacucuggagguccacuggugugucgcaauagagcacacggcuuggucagcuuuuccgggcucuggugcggagaucccaaaacuccugacguuuacacccaggugucagcuuucguagccuggauuugggauguggucaggcggaguagcccacagcccggcccgcugccugguacaacucgacccccaggggaagcggccuga

SEQ ID NO: 61258 - RNA, 726 nt, Artificial Sequence
  derived and/or modified sequence opt3 from PRSS58__Homo_sapiens__NP_001001317
augaaguucauccugcucugggcccuucugaacuugaccguggcuuuagcauuuaaucccgacuacacagucagcuccacuccuccauaucugguuuaccuaaaaucugauuaucucccgugcgccggcgugcugauucacccccuuuggguaauaacggcggcucauuguaaccugccuaaguugagagugauccucggggucaccauuccagccgacucaaaugagaaacaccuccaggugaucggauacgaaaagaugauucaucacccccauuucaguguuacaagcaucgaucacgacauaaugcugaucaaacugaagacugaggcagaauuaaacgauuaugugaagcuggccaaucuuccuuaccaaaccauuuccgagaacacaaugugcucugucucgaccuggucauauaaugugugugacaucuacaaagaaccagauagcuugcagacuguaaacauuaguguuaucuccaagccccagugcagggacgcuuacaaaacauauaauauaaccgagaacaugcuguguguggguauugucccuggccggcgccagccaugcaaggaggugucugcagccccggcuaucuguaaugggaugcuacaaggcauucucagcuuugccgauggaugcgugcugcgagcggacgucgguaucuacgcaaaaaucuucuauuacauucccuggauagaaaacguuauccagaauaacuga

SEQ ID NO: 61259 - RNA, 1032 nt, Artificial Sequence
  derived and/or modified sequence opt3 from PRSS8__Homo_sapiens__NP_002764
auggcccagaagggcgugcuggggcccggacaacucggugcugucgcaauccuucuguacuugggcuuacugagaagcgggaccggagccgagggcgcggaagcuccuugcgguguugccccacaggcaaggauuacagggggauccucugccguggcuggccaguggccguggcagguaucaauaacuuaugagggcgugcacgucugugggggaagucuagugagcgaacaauggguucucuccgcagcccauugcuuccccucugagcaccauaaagaggcuuacgaagugaagcugggugcccaccagcuugacucguauucagaggaugcgaaagucagcacgcugaaggacaucauuccucauccaaguuacuugcaggaaggcucccagggggauaucgcacuccugcaacugucucggcccauuaccuuuagccgcuauauccgaccuauaugucucccagccgcuaacgccuccuuccccaauggauuacacugcacagugacuggcuggggucacguagcaccuucaguuagucugcuuaccccaaaaccguugcagcagcuggaggugccccuaaucagccgugaaacauguaacugccucuacaauauugacgcuaagccugaggagccacauuuuguccaggaagauauggugugugccggguauguggagggaggcaaggacgcgugccaaggcgauucugggggaccccuguccuguccugucgaaggucuuugguaccugaccggcaucguuucauggggagacgccugcggggcaagaaacaggccaggcguguacacuuuggcuagcaguuaugccucuuggauucaguccaaaguaacagagcuccagccccggguggucccgcaaacccaggaaagccagccugauucgaaucugugugguucucacuuagcuuucuccucagcccccgcacaggggcugcuccgcccaauccuuuuucugccuuugggccuagcccugggacuccugagucccuggcuuagcgagcauuga

SEQ ID NO: 61260 - RNA, 573 nt, Artificial Sequence
  derived and/or modified sequence opt3 from PRTFDC1__Homo_sapiens__NP_001269715
auggccggcagcuccgaggaagcucccgacuacgggagaggaguggucaucauggaugacuggccugguuaugaucugaaccucuucaccuacccacagcacuauuacggcgaccuugaguauguucugauuccgcaugggauaaucguggauaggauugaacgguuggcaaaggacaucaugaaagauauuggauacucugacaucaugguauuaugcgugcugaagggcgguuauaaauuuugugccgaucuagucgagcaccucaagaauauaucacgcaacagugaccgauucgugagcaugaaaguugauuuuauccgucugaaguccuacagaaaugaccaaucuaugggggaaaugcagauuaucggaggcgaugaccuuucgacacuggcgggcaagaacguguugauugucgaggacgugguagggacuggaaggacgaugaaagcucuccugucaaauaucgagaaguacaaacccaacaugauaaagguugccagccugcucgugaaacggaccagucgcuccgaugguuucagaccugacucucauaugaggcaccaguga

SEQ ID NO: 61261 - RNA, 3453 nt, Artificial Sequence
  derived and/or modified sequence opt3 from PRTG__Homo_sapiens__NP_776175
auggcacccccucugagaccacucgcuaggcuucggccgcccggcaugcuguugcgcgcauuacugcuacuccugcuucugagcccuuugccagggguguggugcuucuccgagcucucuuuugucaaggaaccccaggacguuaccgugacacgaaaagauccuguagugcuggacugucaagcccacggagaggucccaaucaaggugacuuggcugaaaaacggugcgaagaugucagaaaauaaacguauugagguucucaguaacggcagcuuauacauauccgaaguggaggggagaaggggagagcagucugaugaaggcuucuaucagugccuggcuaugaauaaguacggugccauccuuucgcagaaggcacauuuggcccugucaacgauuagcgcuuuugagguccaacccaucaguaccgaagugcacgaagggggaguagcacgguucgccuguaaaauuuccucucauccuccagcuguuaucacaugggaguuuaaccgcacuacccuaccgaugacaauggacagaauaaccgcccuccccacuggcgugcugcagaucuaugaugucagccagagggacuccggcaauuaccggugcauugcggcaacaguggcccaccgccgaaagucaauggaggcuagucuuaccgugaucccugccaaagagagcaagucuuuccauacgccaacuauuaucgcagggccccagaacauaaccacaucccugcaccaaacugucguuuuggaauguauggcuaccggaaauccuaaaccaauuaucucauggagcagacucgaucacaagaguauugacguguuuaacacaaggguacuggguaauggcaacuuaaugaucucugaugugcggcugcagcaugccggggucuaugugugccgugcgaccacgcccggaacucgcaauuucacaguugccauggcaacccucacugugcuugcuccgccuuccuuugucgaguggcccgaaagccugacaagaccaagggccggcaccgcucgguucgugugucaggccgaggguaucccuucgcccaagaugucuugguugaaaaacgggcgaaagauucacuccaauggacgcauaaaaauguacaacucaaagcuaguaaucaaucagauuaucccagaggacgaugcaauauaucaaugcauggccgaaaacagucagggcagcauucuguccagagcuaggcucacgguugugaugucugaggaccggcccagcgcgccuuacaacguccaugcagaaaccaugucaaguuccgccauccugcuugcuugggagcgcccacuguacaauagcgauaaagugaucgccuauucuguccacuacaugaaggcagaaggcuugaacaaugaggaguaucaggugguuauugggaacgacacaacucacuacaucauugacgaucucgaaccggccucaaauuauaccuuuuacauaguggcuuauaugcccaugggagccagucaaaugagcgaccauguaacacagaacacucuggaggaugucccuuuaagaccacccgaaaucucccugaccucuaggucgccuacagacauucuaaucagcuggcucccaauccccgcaaaauaccgucggggucaggugguucuguaccgacuuuccuucagauugucaaccgagaauaguauucaggugcuggaacucccgggcacuacgcacgaguaucugcuugaggggcugaagccugauucugucuacuuggugaggauaacagcggcuacccgcguaggacucggcgaaagcuccguguggacuucacaucggaccccaaaggccacaagcguuaaagcacccaagucuccugagcugcacuuagaaccccugaacuguaccacuaucuccgucagauggcaacaggacguggaggauacagccgcuauucaggguuauaaacuauacuauaaggaggaagggcagcaagagaauggcccaaucuuucucgacacgaaagaucugcuuuacaccuugaguggacuggacccuaggcgcaaguaucaugugcgacuccuggccuacaacaauauugaugacggcuaccaggcagaccagacugucagcacacccgggugcguuucugugcgggaucguauggugccaccgccucccccaccccaccacuuauaugcuaaggccaacaccuccucaaguaucuuccugcauuggagaaggccugcguucacagccgcucagauaaucaauuacacuauucgcuguaacccaguaggacuucaaaaugccagcuugguccucuaucugcagaccucggaaacgcacaugcuagugcagggucuggagcccaacaccaaauacgaauuugccguucggcuccauguggaccagcuguccucuccuuggagcccggucguguaucacucaacacuuccagaggcucccgccggcccuccaguuggggugaagguaacuuugaucgaggaugacaccgcacuggucaguuggaaacccccugauggaccggaaacaguggugacuagauacaccauuuuauaugcguccaggaaggccuggaucgcuggcgaguggcaaguccuccaccgagaaggugccauaacgauggcacugcuugagaaccugguugcugggaauguguacauuguaaaaaucucugccagcaacgaagugggcgagggacccuucuccaauucagucgaguuggcagugcucccaaaggaaacaagcgagaguaaccagcgcccuaagcggcuggacucugccgaugcuaaaguuuacuccggcuauuaccaucuagaccaaaagagcaugaccgggauugcggugggagucgguaucgcccugacuugcauacucaucugcgugcugauucuuaucuauagaucgaaagcaaggaagucaucugcuaguaaaacagcccagaauggcacccagcaguugccccguacuuccgccagccuggcuucugggaacgaaguuggaaagaauuuagagggcgcaguggguaacgaagagagccucaugccaaugauuaugccuaauuccuuuaucgaugccaaagggggcaccgaccugauaauuaacucauacggacccaucaucaagaauaacaguaagaaaaagugguucuuuuuccaggauagcaaaaagauucaagucgagcagccacagcgccgguuuacaccggcgguauguuucuaucagccuggcacgaccgugcuuaucucugacgaagauucccccucaaguccagggcaaacuaccagcuuuuccagacccuucggaguugcugccgacacagagcacucugcaaauucggaaggcagccaugagacaggugacucagggagguuuucccacgagaguaacgaugaaauucaucugucuagcgugauauccacuaccccuccaaaucuauga

SEQ ID NO: 61262 - RNA, 771 nt, Artificial Sequence
  derived and/or modified sequence opt3 from PRTN3__Homo_sapiens__NP_002768
auggcccacagacccccuagcccagcucuggcauccgugcuccuugcccuguuguuaucuggcgcggcuagggccgcagagaucgucgggggacaugaagcccagccgcacucacggcccuacauggcuagucugcaaaugcgcgguaacccuggcagccauuucugcgggggaacccuaauucacccauccuuuguucucacagcagcccauugucugcgagacauaccccagcgucuugugaauguagugcugggcgcucacaacgucagaacucaggagccuacgcagcaacacuucucuguggcccagguguuuuugaauaacuaugaugcggaaaauaagcucaacgacguucugcugauccagcucucgucaccagcaaauuuaagcgccagugucgcuaccgugcagcugccccaacaggaucagccuguaccacaugguacacagugccuugccaugggguggggaaggguuggcgcacacgacccgcccgcucaaguguugcaggagcugaacgucacuguggugaccuucuuuugucggccucauaauauuugcacauucgucccacgcagaaaagccggcaucuguuuuggggauuccggagguccccuaauuugcgacggcaucauacaggggaucgauucuuucguuauuuggggaugugcgaccaggcucuuuccugacuucuuuacucggguggcccuguacguagauuggauccgcagcacacuucgaagaguggaagcaaagggcaggccauga

SEQ ID NO: 61263 - RNA, 9267 nt, Artificial Sequence
  derived and/or modified sequence opt3 from PRUNE2__Homo_sapiens__NP_056040
auggaggaguuccugcagagagccaagagcaaacucaacagauccaagcggcuugaaaaagugcacgucguuaucggccccaagucuugcgaccuggacucauugauuaguaccuuuacauacgcuuauuucuuagacaaaguguccccuccagggguacugugucuaccggugcucaauauaccccgcacugaauuuaacuacuucacggaaacccgauuuauccuggaagaacuuaauauuuccgaaucuuuccauaucuuucgugaugaaauuaaccugcaccaauugaaugacgaggggaagcucucgaucacacuggucgguucaagcgugcuggcaagugaagauaagacucucgaguccgcaguugugaaagucauaaacccuguggagcagucugacgcgaauguagaguucagagagagcuccucaaguuuaguucugaaggaaauccuucaggaggcuccagaauugauuaccgagcagcuggcacauaggcuacggggcagcauccucuuuaaauggaugacaauggagucugaaaagauuuccgagaaacaagaagagauccugucaauacuugaagagaaguuccccaaccugccuccacgcgaggauauuaucaauguguugcaggaaacccaguuuagcgcacaggggcucaguauugagcaaacuaugcugaaggacuuaaaagaacugucugauggagagaucaaggucgccaucuccacagugagcaugaaccucgaaaauugccuuuuccacucgaacauuaccucugaccugaaggcuuuuacggauaaguucggcuucgacguguugauacuauuuuccucauaucugagugaggagcagcagcccagaaggcagaucgcagucuacagcgaaaauauggagcucuguucccaaauuugcugugaacuggaggagugccagaacccuugucuugaacuggagccauucgauugcgguugugacgaaaucuugguuuaucagcaagaggacccgucugugacuugcgaucagguagugcucgucgugaaagaaguuauaaaucggcgcugucccgagauggugagcaacucacgaaccaguuccacagaggccgucgcugggagcgccccucugucucagggaucaaguggcauuauggaauuauacggcagcgacaucgagccacagcccuccucugugaacuuuaucgaaaauccuccagaucugaacgacucgaaucaagcgcagguagaugcaaacguugaccuagugagccccgauuccgggcucgccacuauuagaucaaguaggucuagcaaggaguccucagucuuccugagcgacgauucuccggugggagaaggugcuggcccucaucacacccuuuugcccgggcuggacuccuauaguccaaucccugagggagccgucgcagaggaacacgcuuggagcggcgagcauggugaacacuuugaucucuucaauuuugaccccgccccaauggcgucugggcagucccagcaaucaagucauagcgccgacuacucgcccgcagaugacuucuuuccuaacuccgaucugucugagggacagcuuccagcuggcccggaaggccuggacgggaugggaacaaauaugagcaacuacucaaguuccucuuugcucagcggugccggcaaagauucccugguggagcacgacgaggaguucguucagcggcaggauucaccccgugacaauagcgagcgcaacuuaagucugaccgauuuugugggggacgaaucuccuuccccagagagacuaaagaauacgggaaagaggauucccccuacuccaaugaacagccucguagagucgucacccucuacagaagaaccggcuagucuguauaccgaagauaugacucaaaaagccacagacaccggccacauggguccuccacagacgcaugcacggugcuccagcugguggggaggccuugagauagauucuaagaauaucgccgacgcuuggagcuccucagaacaggagagugucuuccagagccccgagucuuggaaagaacacaagccuuccucaauugaccgacgcgcgagugauagcguguuucaacccaaauccuuggaguucaccaagucuggaccaugggaaucggaguucggccagccugaacuggggagcaacgacauccaggauaagaaugaggagucacuccccuuucaaaaccugccaauggaaaaauccccguuaccuaacacaaguccccagggaacuaaucaucugaucgaggacuucgcaucucuuuggcacagcgguagauccccaaccgccaugcccgaaccuuggggcaacccaacagaugacggggagcccgcugccguugcaccuuuuccggccuggucagcuuucggaaaggaagaucaugacgaggccuugaaaaauacuuggaaccuccacccaaccucuagcaagacacccagugugagggauccuaaugagugggcaauggcgaaauccggcuuugcuuucaguucuucagaacugcuagacaacuccccaagugagauuaauaacgaagccgcacccgagauaugggguaagaagaauaacgauagccgggaccacaucuuugccccugggaauccgucgucugaucuggaccauaccuggacuaacuccaaacccccaaaggaggaccagaauggccucgucgauccuaaaacgcgcggaaagguguacgaaaaaguagacagcuggaaccuguucgaggaaaauaugaagaagggcgggucagaugugcuuguucccugggaggacagcuuuuugucuuauaaaugcuccgauuacagcgcuucaaaccugggagaagacagugucccaagcccuuuagauacaaacuauuccaccucugacagcuacacuucccccaccuucgccggugaugagaaggagacagaacacaaaccauuugcaaaggaggaaggcuucgagucaaaagacggaaauucuaccgcugaagagacugauauuccgccucagagucuccaacagucgagcagaaacaggaucuccucuggacccggcaaucuggacaugugggccucaccacauacagacaacagcuccgagauuaauacgacccacaaccuugaugaaaaugagcugaagacugaacacacagacgguaaaaacaucaguauggaggaugacgugggggaaucuagccagucauccuaugaugaccccaguaugaugcaguuguacaaugagaccaaccgucaacucacacugcuacauagcucuacuaauucccggcagaccgcgccugauucacuggaccucuggaaccgagugauacuggaggauacgcagagcaccgccacaaucucggacauggauaaugaccuugauugggacgacuguucuggcggagcugcaauuccaagugauggccagacugaaggguacauggccgagggauccgaacccgagaccagauuuacagucaggcaauuggagccuuggggccuggaauaucaggaggcuaaccagguugacugggaauuaccggccagcgaugagcacacuaaggacucagcaccauccgaacaucacacccucaaugagaagucuggucaacugaucgcgaacagcauuugggauagugugaugcgcgacaaagauauguccagcuucaugcuucccgggucuucacauaucacggacagugagcagcgggaacugccucccgagauaccaucccacagcgccaacgugaaggauacacacucuccugacgcucccgccgcaucgggaaccucagaaagcgaggcucuaauuucccaucucgauaaacaggacacugaaagagagacacugcagagugaugccgcaucuuuggccaccaggcuggagaauccaggcuacuucccucacccggaccccuggaagggucauggcgacgggcaaagcgaauccgagaaagaagcucagggagcgacugaucgcggccacuuagacgaggaagagguaaucgccucaggggucgagaacgcaaguggaauuucugaaaagggccagagcgaucaggagcucuccucacugguggcuagcgaacaucaagagaucugcauaaagucugguaaaaucuccagucuugccguuaccuuuagcccacagacagaggaaccugaggaagugcuggaguaugaagaggggucguacaauuuggacucccgagauguccagacgggaaugucugccgacaaccuccagcccaaggauacccacgagaaacaccugaugucacaacggaauagcggcgaaacuacagagaccagugacgguaugaacuucacaaaguauguguccguuccagaaaaagaucuagagaagacugaagaguguaauuuucuggagccugaaaacgugggcgggggacccccgcaucguguaccaagaucucuugacuucggcgaugucccuauugacagcgacgugcacgugucaaguaccugcagcgagaucacgaagaaucucgaugucaaagggagcgaaaacucucugcccggagcuggcucauccgguaauuuugacagggauacaauuagcucugaguacacccauaguucggcauccagcccagaauugaacgacucaucuguugcccugagcuccugggggcagcagcccaguucaggauaucaggaggagaaucaaggcaacuggucugaacagaaucaccaggagagcgaauuaaucacuaccgauggucaaguggagauaguaacaaaggugaaagaccucgagaagaaccgcauuaaugaguucgagaaauccuuugaucggaagacuccuaccuuccuggaaaucuggaacgacagugucgauggcgacagcuuuuccucucuuucaagcccggagacagggaaguacucggaacacuccggaacgcaucaggagaguaaccugaucgcgucuuaccaggagaaaaaugaacacgauauuagcgcuaccgugcagcccgaggacgccagaguuaucucaacuuccucuggcagugaugacgacagcgugggcggggaagaguccauugaagaggagauacaagucgcaaacugucauguggccgaagaugagucaagggcuugggacagcuugaaugaaucuaacaaguuccucguuacagcagauccaaaaagugagaauaucuaugacuaccuggauuccagcgaaccugccgagaacgagaauaagucaaaccccuuuugcgacaaucagcagucuuccccugauccauggaccuucucgccccuaacugaaacagagaugcagauuaccgcgguggaaaaagagaagcgaagcaguccugagacggggacuaccggugacgucgcuuggcaaaucucuccaaaagccuccuuccccaagaacgaagauaauagccagcuggagaugcuuggguuuucagcagacaguacagaaugguggaaggccuccccgcaggagggacgccucauugaaagcccuuucgagcgggagcugucugauucaagcggcguauuggaaaucaacuccucugugcaccagaaugcuaguccauggggcguucccgugcaaggggacauagagccugucgaaacccauuauacuaacccauuuucggacaaucaccagagccccuucuuagagggaaacgguaaaaacucccacgaacagcuguggaauauccaaccgagacagccugaucccgacgccgauaaguuuucacagcucgugaaacuggaccagauuaaggagaaagauucuagggagcaaacauucguaagcgcagcuggcgacgaacuuaccccagagacaccuacucaggaacagugucaggauaccaugcugcccgugugcgaccauccagauacggccuuuacacacgcggaggaaaacaguugugucaccuccaauguuucaacuaacgaggggcaagagaccaaucagugggaacaggagaagucuuacuugggagaaaugacaaacagcuccaucgccacugagaauuuccccgcagugaguagcccuacccagcuaauuaugaagccaggcucugagugggacgguucaacgccguccgaagauagccgugggacauuugugcccgacauccugcauggaaacuuccaagagggcggccagcucgcuagugccgcuccugaucuguggauagacgccaagaaaccauuuucucuuaaagccgacggggaaaaucccgauauuuuaacccacugcgagcacgacuccaacucgcaggccagcgauucaccugacaucugucaugauuccgaagcuaagcaggagacugagaaacaccugucugcgugcaugggaccagaagucgagaguagcgaacucugcuugacagagcccgaaaucgacgaggagccuauuuaugaaccgggucgcgaguucgugccaucaaaugcagaacuggauuccgagaacgccaccguucuacccccuauaggcuaccaagcugacaucaaggggagcucucagcccgccagucauaagggauccccagaaccuagcgagauuaauggcgauaacucaacuggucugcagguaucugagaaaggggcaucgcccgacauggccccaauccuugaaccgguggaucggaggauuccuaggaucgagaaugucgcuacaagcauauuugugacccaccaagaacccacgccagagggagacggcuccuggaucagugauucuuucucacccgagagccagccuggcgcgcgagcccuguucgacggggacccacauuuguccacugaaaaccccgcccucguuccugaugcucugcucgccagugacaccuguuuagauauuucugaggcagccuuugaccacagcuucuccgaugcuucaggacugaacacaagcaccgguacaaucgacgauaugucuaaacuuacucuguccgaaggccacccggagaccccaguggacggggaucucggaaaacaggacauuugcaguucagaagccagcuggggcgauuuugaguaugacgucaugggucagaauaucgacgaggauuugcugcgggaacccgagcauuuccucuacgggggagacccuccacuggaagaggauucgcuuaagcaaucccuagcgcccuacacgccucccuuugaccugucuuauuugacagaaccagcacagagugccgagacuauagaggaagcuggcagcccggaggaugaaucauuaggcugucgcgccgcugagauugugcuguccgcacucccugacagaaggucugaagggaaccaggccgagaccaaaaaucggcugcccggaagccagcuugcuguacugcacauccgagaggauccagaaagugucuaccucccugugggugccggcuccaacaucuugagccccucuaauguugacugggagguggaaacagauaacucagaccugccagcagggggagauauuggcccucccaauggugcguccaaggagaucagcgagcuagaagaggaaaagaccauaccgacuaaagagccagaacaaauuaagagugaguauaaagaggaaagaugcaccgagaagaacgaagaccgccaugcccugcacauggauuacauccucgucaauagggaggaaaacucucacucaaaaccugagacaugugaggaacgugaguccauugcugaacuugagcuguauguggggagcaaggaaacgggauuacagggcacucaguuggccucguuccccgauaccugccagccagcaucucugaaugagcggaagggccucagugcugagaaaauguccagcaagucagacacaagaucuagcuuugaaucccccgcccaagaucagaguuggauguuccuggggcauucagagguuggagacccuagccuugaugcaagggacuccgguccgggcuggucugggaaaaccguggaaccauuuagugagcugggacucggcgaggguccccaguugcaaauccuggaagagaugaagccuuuagaaagccuagcccuggaggaggcuuccgggcccgucucacagucucagaaaagcaagucgcgcggccgagcgggaccagaugccgugacucuccaggcaguaacacacgacaacgagugggagaugcuuuccccucaacccgugcagaaaaauaugauaccagauaccgaaauggaggaagagacggaguuccuggaguugggcacuagaauuagucggccuaacgggcugcucucugaggacguuggaauggauaucccguuugaagaggguguccugagccccucagcugccgacaugaggccagaaccucccaauucccuugaucucaacgacacacauccacgccguaucaagcugaccgccccuaacauuaauuugagccuggaucagucugagggcaguaucuuauccgacgacaaccuagauucacccgacgaaauugauauaaauguggacgagcuggauaccccggacgaggcagauagcuucgaauacacugggcacgacccaacagcuaacaaggauucuggacaggagucggaauccaucccugaguauaccgccgaggaagagagagaagacaaucggcucuggaggacaguggucauuggcgagcaagaacagcgcaucgauaugaaaguaaucgagcccuaccgaagagugauuagucaugguggguacuauggcgacggacuuaacgcgauaaucguuuuugcugccuguuuccugccagacagcucacgggcagauuaccacuaugugauggagaauuuguuccuguacgucauuucuacucucgaacugaugguggccgaggacuauaugaucguuuaccuuaacggcgcuacgcccaggcgcagaaugccuggguuaggauggaugaagaaaugcuaucagaugauugauaggcggcugcguaagaaucucaaauccuuuaucauagugcaccccagcugguucauccgcaccauuuuggcagucacacgaccauuuaucaguucaaaguucuccagcaagauuaaauacgugaacucucugagugaacuaagcggucugaucccuauggacuguauacauauuccggaguccaucauuaagcucgaugaagaacuuagagaggccucugaagcggcuaaaacuucaugccuguacaaugaccccgagaugagcuccauggaaaaggauaucgacuugaaacugaaggagaagccauga

SEQ ID NO: 61264 - RNA, 816 nt, Artificial Sequence
  derived and/or modified sequence opt3 from PRUNE__Homo_sapiens__NP_001290158
auggaccugaagaucggcaaagccacccccaaggauagcaaauacguggagaagcucgaagcucuuuucccugaccugccaaaaagaaaugauauuuuugacuccuugcagaaggcaaaguucgaugucucuggguuaacaacugagcaaaugcugaggaaagaccagaagacgauauaucggcagggaguuaaaguggccaucucagcgauuuacauggaucuagaggcuuuucuccagcgcaguaaucugcuugccgaccugcacgcauucugccaagcccauagcuaugauguauugguggcuaugaccaucuuuuucaacacacacaaugagccgguccgacagcucgcaaucuuuuguccccauguggcccugcagacuaccauuugcgaaguucuggagcguucccacucuccuccacucaaguuaacacccgcuucgucaacccauccuaaccugcacgccuaccuucaggguaauacucaagugagcaggaaaaaguugcugccacuacuccaggaggcgcugagugcauauuucgacuccaugaagauacccucuggccagccugaaacagccgaugucagcagagaacagguggacaaagaacuugaucgggcuuccaacucacugaucaguggguugagccaagacgaggaggacccaccgcugcccccuaccccaaugaacucucucguagaugaaugucccuuagaccagggacugccuaagcucuccgccgaggcaguuuuugaaaaaugcucacagauuagccuuagucaaucuacgacugcuucccugagcaagaaauga

SEQ ID NO: 61265 - RNA, 444 nt, Artificial Sequence
  derived and/or modified sequence opt3 from PRX__Homo_sapiens__NP_066007
auggaggccagaagcagguccgcugaggaacugcggcgcgcagaacucguggagaucauugucgaaaccgaggcccagacaggcguuucugggauaaacguggcgggagguggcaaggaggggaucuucguacgagaacuucgugaggacucacccgcugccagaagucugagcuugcaagaaggagaucaguuacuguccgcaaggguguuuuucgagaauuuuaaauacgaggacgcccuacggcuccugcagugcgcugaaccuuauaaggucucuuucugucuuaaacgcacugugccaacgggcgaucuggcauugagaccggguaccguuucgggguacgagauuaagggacccagggccaaaguggcuaagcucguccgggugcugagcccugccccagcgcuggacugccccucagauccuguaagugcaccauga

SEQ ID NO: 61266 - RNA, 444 nt, Artificial Sequence
  derived and/or modified sequence opt3 from PRY__Homo_sapiens__XP_011529813
augggcgccaccgggcugggauuccuccuuagcuggagacaggacaaccugaaugguacagauugccaaggcuguaacaucuuguacuuuuccgagacuacggggucuaugugcucagaauuaagucugaauaggggacuagaggcucggcgcaagaaagaccucaaggauagcuuccuguggcgauauggcaaaguggguuguauuucccuuccccugcgugaaaugaccgcauggauaaacccuccacagaucucugagauuuuucagggguaccaccagagaguccauggagccgacgcguugucgcuccaaacaaauucacugaggagccggcugaguucccagugccucggccagucuuucuuacugcgcacucuugaaagaggcaggggguuucgggcuuugggagauaucuguggucacguucaugaggaggacuga

SEQ ID NO: 61267 - RNA, 1584 nt, Artificial Sequence
  derived and/or modified sequence opt3 from PSAP__Homo_sapiens__NP_001035930
auguacgcccuguuccuccuugcuagccuguugggcgcagccuuagcggggcccgugcugggacuaaaggagugcaccagagguuccgcugucuggugucagaacguuaaaacagccucugacugcggcgcagugaagcacugucuccaaacuguauggaauaaaccuacggugaagucacugccaugcgauaucuguaaagacgucgugaccgccgcuggggauaugcuuaaggacaacgcaacagaagaggaaauucugguuuauuuggagaagacuugcgauuggcucccgaaacccaauaugagugccagcuguaaggaaauaguggacuccuaccugccugucauccuggauauuaucaaaggagagaugucuaggccaggcgaggugugcucggcucucaacuuaugugaaucacugcagaagcaucuugccgaguugaaucaccagaaacagcuggaaagcaacaagauucccgagcuagacaugaccgagguaguugcgccuuuuauggcaaauaucccacuccugcuuuauccccaagaugguccucggaguaagccacagccgaaagacaacggggaugugugccaggacuguauacagauggucacagauauccaaaccgccgugcgcacuaauuccacauucgugcaggcucuggucgaacauguuaaggaggaaugcgaccgauugggacccggcauggccgacauuugcaaaaacuacaucucucaguauagcgagauugcaauccagaugaugaugcacaugcaagaucagcagccuaaggaaauaugugcucucgugggcuuuugcgacgagguaaaagagaugccaaugcaaacccuggugcccgccaaggucgcguccaaaaaugugauuccugccuuagaacugguugagccaaucaagaagcaugaagugcccgcaaaaucagaugucuacugugaggugugcgaguuccucguaaaggaaguuacgaaacuuauugacaacaauaagacugagaaagaaauccuggaugcuuuugacaagauguguaguaaguugccgaaaagccuaucugaggaaugccaggagguggucgauaccuauggguccucaauccugagcauucuccuggaagaggugaguccugagcuugucuguucuaugcugcacuugugcuccggaacacgucuccccgcccugacugugcacguuacccagccaaaggacgguggcuucugugaagugugcaaaaaguuaguaggguaccuggauagaaaccuagagaaaaauagcacaaagcaggaaauacucgcugcccuggagaagggauguucguuucuuccugaccccuaccaaaaacagugcgaucaguucgucgcagaguaugaaccaguguugaucgagauucugguugaagugauggaccccucuuuugucugccucaagaucggcgccuguccuuccgcucauaaaccacugcuugguaccgagaagugcauaugggggccgucauacuggugucagaacacggaaacugcggcacaaugcaacgccguggagcacuguaaaaggcauguauggaauuga

SEQ ID NO: 61268 - RNA, 975 nt, Artificial Sequence
  derived and/or modified sequence opt3 from PSAT1__Homo_sapiens__NP_066977
auggacgcccccagacagguggucaacuucggcccugggccagcuaagcugccgcacagcguucuccuugagauccaaaaagaacuguuggauuacaagggaguggguauuuccguauuagagaugucucauaggucaagugacuuugcaaaaauaaucaauaacaccgaaaaucuggugcgggagcuacucgccguccccgauaacuauaaggugauuuuccugcagggcgggggaugcggccaguuuagcgcgguuccucuuaaucugaucgguuugaaagcugggcgcugugccgacuacguggucacaggagcaugguccgccaaggcugcagaagaggccaagaaauucggcacuauuaacaucgugcacccaaagcucggcucuuauacgaaaauacccgauccuucgaccuggaaucugaacccagacgcuucauacguauauuacugcgccaaugagacaguucaugggguggaauuugauuucauccccgacgucaagggagcggugcuggugugugauaugagcaguaacuuucucuccaaaccugucgacguuucuaaguucggugugauuuuugcaggcgcccagaagaauguagggagcgcuggagugacugucgugaucguucgagaugacuuacugggcuucgcccuucgugagugcccauccguguuggaauauaaaguccaagcagguaacucaagucuguacaauaccccgcccuguuuuagcauuuacgugauggggcuaguacucgaguggaucaagaacaauggaggcgcugccgcgauggagaaacugucuuccauaaagucacagacaauuuaugaaaucauugauaacagccagggcuucuacguuagugucgggggaaucagagccucucuuuauaacgcagugaccaucgaggacgugcagaaacuggcugccuuuaugaagaaauucuuggaaaugcaccaacucuga

SEQ ID NO: 61269 - RNA, 345 nt, Artificial Sequence
  derived and/or modified sequence opt3 from PSCA__Homo_sapiens__NP_005663
auggccggccuggcucuccagcccgggaccgcacuucugugcuacagcuguaaggcccaaguguccaacgaggacugcuugcaggucgaaaauuguacacaguuaggagagcagugcuggacugcgagaaucagggcuguuggucugcuaacggugauuucuaaaggcuguucacucaacugcguagaugacagucaagauuauuacguggggaagaaaaauauaaccuguugcgacacagaucuguguaacgccagcggagcacacgcccuucagccugcugcagccauccuggcuuugcucccagcccugggccugcucuuaugggguccggggcagcuguga

SEQ ID NO: 61270 - RNA, 3144 nt, Artificial Sequence
  derived and/or modified sequence opt3 from PSD3__Homo_sapiens__NP_056125
auggagggcagaagcgccgcugcagaaaccuucgugugggucaacaaugccuccgcgcacucucagucaguugcuaaggccaaauacgaguuucuguucgggaggagugaaggaaaggcacccgacacaagcgaucaugguggcuccacucuccuuccuccaaacgugacgaaugaguuuccggaauaugggaccauggaggagggaggcgaaggucugcgggccucuuuggaguucgacggggaggcuuuacccugccacccucaagagcagcagggaguacagccacugacaggcugucauucgggccuagauucagugacugaggggcccaaagacguccgcgaagcaccuagccaaagucaccucaaggagcagucccugcagccaaucgauucucuuauuagcgcccugaaagcuaccgaagcccgaauaaucuccggaacauugcaggcgaccaaggugcucgaccaagaugcaguuucaaguuuuagcgugcagcaggucgagaaggaacuggacacugccucucguaaaacacagagagugaacaagacccugcccgcuggucaaaagaaucucccugagauuccauuauccgccgagguaacgacugaagagucauucuaccugagcauccagaaggaucuuaccgcauugcugacaggcgacacucaggcugaaauuagucaaaucaugaacaaugggaggaaaggagccguuugcgugcaggagccgucuuguccccuagcgucccucggcagcucggccgugaccugccauucugcagguuccgucggguuucugaaggaacagcggucagcucuuggacgcgagcacccuggcggcugugauagaaguagcuccauggggaggccaggacgggugaagcacgucgaguuccaggguguugaaauacuguggacaggcggggacaaacgcgagacccaacaucccaucgauuuugaaacgucuuugcagcgaacugccagcccugacucaaaggagaguuccaaagugccaagacaccucauuagcucugcuggacugugcaacucaaguagcuuaacagaaaauguaugggacgaguccuggaaggcccccucugagaggccgggcaccucgagcgguacuuucuccccugugcggcuggaugaaucaggggaggacgaagucuuucuccaggagaacaaacagcaucuugagaagacacccaaaccagaacgugaucgcgagagaaucagugaacaagaggaacacgugaagggcgaggacgaggauauucugggaccuggcuauaccgaagacucuacggauguuuacagcucccaguucgagaccaucuuggacaauacaucacuauauuacagcgcagaaucucuggagacucucuauuccgaacccgauaguuacuuuagcuucgagaugccacugacccccaugauacagcagaggauuaaggaagggggacaauuccuugaacggacaucugguggcgggcaccaggacauccuguccgugucagccgauggaggcauugucauggguuacaguagcggggugacuaacggcuugaaugacgcuucggacuccaucuauaccaaaggaacaccugagaucgcguuuuggggcucuaacgcagggguaaagaccacucgacucgaagcccauagcgagaugggaucaacggaaauucuggagaaagagacaccagaaaauuuaaguaacgguaccuccucuaacguugaggcugccaagcgccuggcaaaaagacuauaccagcucgauagguucaagcggagcgacguggccaagcaccugggcaaaaauaacgaauuuuccaaacuugucgcugaggaguauuugaaauucuuugauuucacugggaugacccuggaccagucacuccgcuacuuuuucaaggccuuuagccuggugggagaaacacaagagagagaaaggguccuuauacauuucaguaaucguuauuuuuacuguaacccggauaccaucgcaucucaggacggcgugcacugccugacuugugcgauuauguugcucaauacagaucugcauggucacaacaucgggaaaaagaugacgugccaggaguucauagcuaauuuacaaggcguuaacgaaggaguggacuuuuccaaggaucugcuaaaagcccucuauaauagcauuaagaacgagaaacuggagugggcaguagacgaugaagagaagaaaaagucgcccucagaaucuaccgaggaaaaggccaauggcacucacccuaaaacaaucagucggaucggguccaccacaaacccauuccuugacauuccccaugauccuaaugcugccgucuacaagagcggauucuuggcacgaaaaauccacgcugacauggacggcaagaaaacuccaagagguaagaggggguggaaaaccuuuuacgccgugcugaagggaacgguucucuaucugcagaaggaugaguacaaacccgagaaggcguuaucugaagaggaccugaaaaacgccgugagcguccaucacgcucuugcauccaaggccaccgauuaugaaaagaagccgaauguguucaaguugaaaacagcugacuggcgcguacuccuguuucagacucagucaccugaggaaaugcaaggcuggauuaacaagauaaacuguguggccgcaguuuucagugcgccacccuuuccugccgcuaucgguagccagaaaaaguucucucggccccuacugccagccaccacaacuaaacucucccaggaggagcagcugaagucacacgaaaguaaacuuaaacaaauuaccacggaguuggcagaacauagaagcuacccucccgauaagaaagucaaggcuaaagacguggaugaguauaagcugaaggaccacuacuuagaguuugagaaaacaagguaugaaauguacguguccauccucaaggaaggcgggaaagagcugcuuucuaaugaugaaucggaggccgcaggacugaagaaaagccauucauccccaaguuugaacccggacaccucuccuaucacugccaaggucaaacgcaauguuagcgagcgaaaggaucaccggcccgaaacaccauccauuaagcagaaagugaccuga

SEQ ID NO: 61271 - RNA, 3171 nt, Artificial Sequence
  derived and/or modified sequence opt3 from PSD4__Homo_sapiens__NP_036587
augaugggcgacuacagacugcccgaucacccucagccaauggagauccucaaccuuuaucugggggacagcuuggaaccgcaucccggagagugcccuagggaaaccuguucccacgaggauccacccgaaccuuucgaggagcaaacaugggccacugacccacccgaaccuacgcggcagaaugugccaccgugggguucuggcgucgaguuaacccaucuggggucauggguucaccaggauggacuagaacccugccaggagcaaacacgcgcuacugacccuccagagaguacccgacaggaugcacccccuuggggcagcgguguggaacucacacaucugggguccccaucugcccagcgugagcacagacagaacaccgcgucgcccggaucaccgguaaauagccaccuuccuggcagucccaagcaaaacagguccacuucuacacagguggucuuuugggcuggcauucugcaggcccagauguguguguuggaccucgaagaggaacuggagaaaaccgaggggcugaaggcaggacucaaaugcuguuuaccaacgccucccguugaucugccaggugacacuggccuucauagcucacccccugaaaaugaggauucaggggaagacaguagcgagccagaaggagagggccaagccugguugcgggaggguaccccggauucuucaccccaguggggagcugaagaggaauccauguucuuuagcaacccucuguuccuagcaaguccaugcucugaaaauuccgccagcggggaauguuuuucguggggcgcuucugacucccacgccggcgugcgcacagggcccgaguccccugcgacucucgagccaccccugccggaagacaccguccuuugggagcuggaaagugagccugauuugggagacggugcagccauaagcggccauugcacaccacccuucccugugcccaucuacaagccacacuccauuuguugggcuucuguagccgcagcugagggggccccugcggcacccccaggacacggcgaaagcgagggugauagacucgggccggccccuucagcugcccccugcguugacgaagcucugaccugggagaguggcugugugggauccgauuuaggcccagccgcacaucccguccagccuugggccagccugucuccagaaggguggcaaaggggaggucccuuuuggccucaggugacgcucaacucacaggaccgggaugagcgcgagggcgggcacccgcaggaaagucuuccaugcacucuggcucccugcccuuggcgaagcccagcguccucucccgagccuucgagcccggaauccgagucaagaggacccggcccaaggccuagucccgcaucuagccaagaagguuccccacaguugcagcaucacucaagcgggauccuaccuaaauggacacuggacgccucucaguccagucuccuggagaccgauggcgagcaacccagcucucuuaagaagaaagaagcuggagaggccccaaagccgggcgaagaggugaaauccgaagggacugcacggccugccgagacaggagacguccagcccgauauucaucugaccucagcugagcacgaaaauuugcguacgccaaugaacaguagcuggcuccccgguucgccuaugccacaggcccagucccccgaggaaggccaacgcccuccggcaggggacaagcuggcgaauggaguuagaaacaauaaaguggcuuggaacuuagccucuaggcuguaucggcuagagggcuuccgaaagagcgagguagcagccuaccuccagaagaauaacgacuuuucacgcgcuguggccgaagaguaucugaguuucuuucaguucggugggcagucccuugauagagcauugaggucuuuucugcaagcucucguccugagcggcgaaacccaggagcgggaacgcauccuuuaccaguucuccagaagguuccaccauuguaacccaggaauauuucccucaguggacagcguucacacacugacuugcgccaucauguugcucaauaccgaucugcauggccaaaacauugggaaaaguaugucuugucaggaguucaucacaaauuuaaacggacugcgugacggcgguaauuuuccuaaggagcuacucaaagcgcuguauugguccauucggagcgaaaaacuugagugggccguggaugaagaggacacugcucgacccgaaaaagcacagccaucguugccugccgggaagaugucaaaacccuuccugcagcucgcucaagauccaaccgucccuacauacaagcagggaauccuggccagaaagaugcaccaggacgcagauggcaaaaagaccccgugggguaaaaggggcuggaagauguuucacacuuuacugcgcgggauggugcuuuacuucuugaaacagggagaggaccauugccucgagggcgaaucucugguagggcaaaugguugaugagcccgugggaguccaccauagucuagcgacgccagccacacacuauaccaagaagccucauguguuucagcugcggacugcugacuggagacucuaccuguuccaggcccccaccgcaaaagaaauguccagcuggauagcuaggauuaaccuugccgcagccacacacucugcuccaccuuuucccgcggccgucggcagccagcgccgauucgugcggccgaucuugccaguugguccugcacaauccucacuggaggaacagcaccguagucaugagaauuguuuagaugcugccgccgacgaccuccuggaucuucagagaaaccugcccgagaggcgcgggcggggaagagaauuggaggaacacaggcuccgaaaggaguaucuggaguacgaaaagacccgcuaugagacuuacgugcaacuacugguagcucggcuccauugcccaagcgacgcacuggaucuuugggaggagcaguugggcagagaagccgguggcacaagggagcccaagcugucucucaaaaagucccacucaaguccuagcuuacaucaggacgaggcgccgacgaccgcuaaggucaaacguaauauuuccgaacgccggacuuauagaaagaucauccccaaaaggaaccgaaaucagcuguga

SEQ ID NO: 61272 - RNA, 3075 nt, Artificial Sequence
  derived and/or modified sequence opt3 from PSD__Homo_sapiens__NP_002770
auggcccagggcgcuaugagauucugcagcgagggggacugugcaaucagcccuccuaggugcccacggcgcuggcugccggaaggacccgugccucaaucuccacccgccucaauguacgguaguaccggcagccuccuucgacgugucgcggggccuggaccaagaggcagggagcugggucggguuacagcucccuguacuccuuugcgcgggccaccgucccccagaguggccccuucuccaugggcacccucgucaccuacgggacagccacccccgggcgcccagagcaguguagugauuuuuagguucgucgaaaaggcuuccgugcggccuuuaaacggccugcccgcaccagggggacuaucucgcagcugggaucucgguggcguuuccccuccccgaccaacccccgcccuggggccuggaucaaauagaaaacuuaggcuggaggcuaguacaagcgacccauugccggcccggggcgguucugcgcuccccgggucccguaaccuggugcacggaccuccagcacccccucaggucggcgccgauggccuguauucaagccucccaaauggguuaggaggucccccggaacgccuggcuacucuuuuuggcgggccugccgacaccggauucuugaaccaaggcgauacauggaguucuccaagagagguguccagccaugcacagaggauagcucgggccaagugggaguuuuucuacgguucgcuggaucccccuucuuccggggcgaaacccccagaacaggccccucccucaccaccgggcguaggaagucgacagggcagcgggguugcagugggacgcgcugccaaguauuccgagaccgaccuagacacugucccucucagaugcuacagggaaacagauaucgacgaggugcuggcugagcgggaagaggccgauucugcaauugaaagccaacccucaagugaggguccacccggcaccgccuauccuccagcuccccgcccugggccgcuuccaggaccccacccuucccugggcagcgguaaugaagacgaggaugacgacgaggcgggaggcgaagaggauguggacgaugaagucuuugaggcaucugaaggagccagaccaggcucaaggaugcccuugaaaaguccuguuccguuccuccccgggacgagcccauccgcugacggaccugauucuuuuucguguguguucgaggccauccuggagagccaucgugcaaaggguacuuccuacaccucauuagccagucuggaagcucucgccucucccggcccaacacagagccccuuuuucacuuuugagcuucccccacagccgccugcaccccggccagaucccccugcgccagcuccccuggccccuuuggaaccggacuccgggaccucaagcgcagccgacggaccauggacacagcgaggcgaggaagaggaggcugaagccagagcaaagcuagcucccgguagggagccucccucuccaugccacuccgaagauagucuggggcucggcgccgcgccucugggaagcgagcccccacuuucucaacugguauccgacucagauagugaguuggacagcaccgaacgccucgcccugggcucgacggacacuuuauccaacgggcagaaagcugaucuggaggcagcccagcggcuagcuaagagacucuauaggcuggacggauuccgcaaagccgauguggcacgacaucuuggcaagaauaacgacuucucuaaauuggucgcgggugaauaccugaaguuuuucguguuuacagggaugacccucgaucaagcccugcggguuuuccuuaaggagcuggcuuugaugggagaaacucaggagcgugagagagugcucgcccacuuuagccagagguacuuccaguguaauccugaagcacugucaagugaggacggcgcucacacauuaaccugcgcccugaugcuacucaacacggaucugcauggucacaauauuggcaaacgcaugaccuguggggacuuuaucggaaaccuugaaggcuugaaugaugggggagacuucccgcgggagcugcucaaggcacuguauuccucuauaaagaacgaaaaguuacaaugggccaucgaugaggaggaacugagaaggagccuuuccgaguuggcugaccccaauccaaaagucauuaagcgaaucucaggcgguagcgggaguggaucuuccccuuuucucgaucugacacccgaaccaggcgcggccguguacaaacauggugcccuaguacgcaagguucacgcugacccugacugccggaagacucccagaggcaaaaggggguggaaguccuuccacgggauucugaaaggcaugauccucuaucugcagaaggaggaauacaaaccggggaaggcccuuucggagaccgaguugaagaacgccauaucaauucaucacgcucuggcaacacgugccucugauuauaguaaacgcccacauguguuuuacuuacggacugcggacuggagagucuuccucuuucaggcuccuucccuggaacagaugcaaagcuggaucaccaggauuaacguggucgccgcaauguucucugcacccccauuccccgcugcagugagcucccagaagaaauuuucacgaccucuucugccgagugccgcgacacgguugagccaggaggaacagguucgcacccacgaggcuaagcucaaagccauggcaucugagcugagagaacauagggccgcucaacuaggaaagaagggccgggguaaagaggccgaggaacagcgacagaaggaagcauaucuggaguucgagaaauccagauacucaacuuacgcugcccuccugcgcgugaaacuuaaagcggggagugaagaguuggaugccguagaagcagcucuggcccaggcuggaagcacggaggacggcuuacccccaucccacucuucgccuagccuccaacccaagccuucaucccagccaagggcacagcgucacaguucugaaccccggccuggugccggcagcgggagaaggaagccauga

SEQ ID NO: 61273 - RNA, 1404 nt, Artificial Sequence
  derived and/or modified sequence opt3 from PSEN1__Homo_sapiens__XP_011535274
augaccgagcugcccgccccucucagcuacuuccagaacgcucaaauguccgaagacaaucaccuuucuaacacagugagaucacagaaugauaacagggagcggcaggaacauaaugaccgccgaagucugggccacccagagccguugagcaacgggcguccccagggaaauuccagacaagucguugaacaggaugaggaggaagacgaggaauuaacucugaaguauggugcaaaacaugugaucaugcuauuuguaccugugacgcucugcauggucgugguuguggccaccauuaagucugucucguucuacacaaggaaagauggccagcugauauauacuccauuuaccgaggacacagagaccguggggcagcgggcgcuucacucaauccugaacgcugccauuaugaucagcguaauuguugugaugacuaucuugcucgucgugcuguacaaguaucgcuguuacaaagugauacaugcauggcugaucauuaguucccucuuacugcuuuucuuuuucucuuuuaucuauuugggagaagucuucaagacauacaauguugccguggauuacauuaccguagcucugcuaaucuggaacuuuggcguggucgguaugauaagcauucacuggaaggggccccucagacugcaacaggcauaucuuaucaugauuuccgcccugauggcuuugguguucaucaaauaccucccugaguggacggccuggcugaucuuagcgguuauuucaguguaugaccuggucgcagugcucugcccaaagggaccccuuaggaugcugguagaaacugcccaggagcggaaugaaaccuuguuuccugcucuaauauacaguagcacaaugguuuggcuggugaacauggccgagggcgauccagaggcacagcgccgagucucuaaaaauuccaaguauaacgcugaaucaacugagagagaaagccaagacaccguggccgagaaugaugacggcggguucagugaagagugggaggcgcagagggauucucaccucggaccgcaucgguccacacccgaaagccgugccgcaguccaggagcugucgucuuccauccuugcuggugaagacccugaggaacgcggcgugaaacugggguugggagacuuuauuuucuacucaguucucgugggcaaggccagugcuaccgccagcggugauuggaacacgacuaucgcauguuucguagccauacugauuggguuaugccugacacuacuccugcuugcuaucuuuaagaaagcguugccagcacugcccaucuccauuaccuucggacucgucuuuuauuucgccacugacuaccuggugcaaccuuuuauggaucagcuugcuuuccaccaguuuuacaucuga

SEQ ID NO: 61274 - RNA, 1344 nt, Artificial Sequence
  derived and/or modified sequence opt3 from PSEN2__Homo_sapiens__NP_036618
augcugaccuucauggccagcgacuccgaggaagaggugugcgaugaaagaacaucucucaugucagcugagagucccacuccuaggagcugucaggaaggccggcaagggccagaggacggagagaacacggcacaguggcgcucccaggaaaaugaggaagauggugaggaggacccggaucgauacgucugcucuggcguucccgggcguccuccaggacuugaagaggaacugaccuugaaguauggcgccaaacacgugaucauguuauuuguacccgugacacuguguaugauugucgugguugcgacuauaaagucggugagauucuacaccgagaaaaacggucagcuaaucuauacaccuuuuaccgaagacacuccaucagucgggcaaaggcuccugaauagcgugcuuaacacacugauuaugaucaguguaauuguugugaugaccaucuucuuggucgugcucuacaaguaucggugcuacaaauuuauacauggauggcugaucauguccucucugaugcucuuauuccuguuuacguauauuuaccuuggcgagguguugaagacuuacaaugucgcuauggauuaucccacccugcuacucacaguuuggaacuucggcgccguggggaugguauguauccacuggaagggaccucuggugcuucagcaggcauaccugauuaugaucagcgccuugauggcucucgucuuuauaaaauaucugccagagugguccgcaugggugauuuuaggugccaucucaguuuacgaccugguggcuguccucugcccgaagggcccccuucgcaugcugguggaaacugcccaggagagaaaugaaccuauuuucccagcguugaucuauaguagcgcaaugguauggaccguugggauggccaaacuagaucccucuucccaaggagcucugcagcucccuuacgacccagagauggaagauucauaugacagcuuuggcgagcccaguuacccggagguguucgaaccuccccugacagguuacccaggggaggaacuugaggaagaggaggaaaggggagucaagcugggcuugggcgauuuuaucuucuauucugugcucgucgggaaagccgcagcuaccggauccggugacuggaacacgacucuggccuguuucguggcgauuuuaauaggccugugccuaacacuccugcuuuuggccguuuuuaagaaggcacugccugcucuccccaucagcauuaccuucgggcugaucuuuuacuucucgacugacaaucuugugcggccauuuauggauacacuggccucucaucaguuguauauauga

SEQ ID NO: 61275 - RNA, 306 nt, Artificial Sequence
  derived and/or modified sequence opt3 from PSENEN__Homo_sapiens__NP_001268461
augaaccuggagagagugagcaaugaagagaagcucaaccuuugcaggaaauacuaucugggcggguucgccuuuuugcccuucuuauggcuggucaauaucuuuugguucuuucgggaggcuuuccuaguuccugcauacaccgaacagucccaaauuaagggauauguguggcgcucugccguagguuuucucuucugggugauaguccugacaucauggaucacuauuuuucagaucuaccgaccacguuggggcgcgcuuggggacuaucugaguuucacgauuccguugggaacccccuga

SEQ ID NO: 61276 - RNA, 1260 nt, Artificial Sequence
  derived and/or modified sequence opt3 from PSG1__Homo_sapiens__NP_001171754
augggcacccugagcgcucccccuugcacacagaggaucaaguggaaagggcuccuucugacugccuccuuguuaaacuucuggaaucugccaacgaccgcacaagugacaauugaggccgaaccgacuaaggucucugagggaaaagacguucuacuccuggugcacaaccuuccccagaaucugaccgguuacauaugguauaagggccagaugagggauuuguaccauuauaucacaucauacguaguggacggggaaauuaucauuuauggaccugcguacaguggccgggagaccgcuuauagcaacgccucccuccugauccagaaugucacucgcgaagaugcagguucuuacacacugcacauaaucaaaggggacgauggaacccgaggcgugacgggccguuuuacuuucacccuccauuuagagacaccaaagcccucgauuucaagcaguaaccugaauccuagagagacuauggaagccguuucccuuaccugugacccagagacacccgaugcuucuuacuugugguggaugaacgggcaaagccugccuaugacccacucccuaaagcucucagaaacgaauaggacucuguuucuucugggagugacaaaauauaccgcagguccauacgagugcgagauccggaacccggucagugccagccgcucugaccccgugacuuugaaucuccugccuaaguuaccaaaacccuauauuacaaucaacaaucugaacccuagagaaaauaaggauguacucaacuucaccugugagccaaaauccgaaaacuacacguauauaugguggcuuaauggccagucacugcccguuagcccgagggugaagcggccuauugagaaccgcaucuugauucuacccagugucacccgaaaugaaacagggccauaccagugcgagaucagagacagguauggaggcauccggucugauccugugacucugaacgugcucuacggucccgaccugccacguauuuaccccuccuuuaccuauuaccgcagcggggagguccuuuaucugucguguucugcugauuccaauccuccagcccaguacucauggacaauaaacgaaaaguuccaauugccgggacagaaacucuuuaucagacauauuacuaccaagcacaguggccuguauguuugcagcgugagaaauuccgcgacaggcaaagagucuagcaagucaaugaccguagaagugagugacuggacuguccccuga

SEQ ID NO: 61277 - RNA, 1008 nt, Artificial Sequence
  derived and/or modified sequence opt3 from PSG2__Homo_sapiens__NP_112536
augggcccccugagcgccccuccaugcaccgagcacaucaaguggaaagggcuccuugugacagcuucccuguugaacuucuggaauuuaccgacuacggcacaggucaccauugaagcccaacccccuaagguuucugagggaaaagacgugcugcuacucguacauaaccugccacagaaucuuacagguuacauaugguauaagggccagaucagagaucuguaccacuauauuacuucauacguggucgacgggcagaucauuaucuauggacccgcguacaguggcagggaaaccgcuuauagcaacgccuccuugcucauacaaaaugugacacgggaggaugcagguucuuacacccugcauaucauuaaacgcggggacggaacucgaggcguuacaggcuacuuuaccuucacgcuguaucucgaaacuccuaagccaucgaucucaagcaguaacuuaaauccccgugaggccauggagaccgugauucugacaugugauccugaaacuccagacaccuccuaccagugguggaugaacgggcagucucuuccgaugacacacagauuucaguugagcgagaccaauaggacgcuguuccuauuuggagucacuaaguauacagcuggucccuacgaaugcgagauccggaacuccggcucagcaagucgcagcgauccugugacccucaaucugcuucaugggccagaccugcccagaauacacccuucuuauacuaacuacagguccggagauaauuuguaucucucauguuucgccaacagcaauccacccgcucaauacaguuggacaauuaacggcaaauuucagcagucuggucagaaccuguucaucccgcaaauuaccacgaagcacuccggguuauacguaugcagcguucgcaauucggccaccggagaggaaucuuccacaucacugacugugaaagucagugcgagcacccggaucggccuccuuccucuguugaaccccacauga

SEQ ID NO: 61278 - RNA, 1008 nt, Artificial Sequence
  derived and/or modified sequence opt3 from PSG5__Homo_sapiens__NP_001123486
augggcccccugagcgccccuccaugcacccagcacaucacauggaaggggcuccuucugacugcuuccuuguuaaacuucuggaaucugccgauuacggcacaagugaccauagaggcccuacccccuaaagucucugaaggaaaggacguucuccugcuugugcauaaccugccacagaauuuggcggguuacaucugguauaaaggccagcucauggaucuguaccacuauauuacaucauacguaguggacgggcagaucaacauuuauggacccgcuuacacuggcagagagaccgucuauaguaaugccagccugcucauccaaaacgugacaagggaagaugcagguuccuacaccuuacauauaaucaagcgcggggaccggacucgaggaguuacaggcuacuuuaccuucaaucuguaucuuaaauugccuaagccauacauuacgaucaacaauucuaagccccgugagaacaaagaugugcuggccuuuacuugugaaccuaagucggagaauuauaccuacauuugguggcuaaacggccagucacucccagucagcccgagagugaaaaggcccaucgagaaucggauacugauucuuccuaguguaacacgcaacgaaacugggccauaugagugcgaaaucagagacagggauggagguaugcgguccgaccccguuacccugaauguguuguacggcccugaucucccaucuauuuaucccagcuucacauacuaccgcuccggggagaaccuguauuuaucauguuuugcugagaguaacccgccugcagaauacuucuggaccaucaauggaaaguuucagcagagcggccaaaaacugucuaucccccagauuacgacuaagcaccgaggucucuauacaugcuccgucagaaacucagccaccgggaaggagagcaguaaaucuaugacuguggaaguguccgcuccaagcggaauaggcaggcuuccucuguugaaucccaucuga

SEQ ID NO: 61279 - RNA, 1275 nt, Artificial Sequence
  derived and/or modified sequence opt3 from PSG6__Homo_sapiens__NP_001027020
augggcccccugagcgccccuccaugcacccagcacaucacauggaaggggcuccuucugacugcuuccuuguuaaacuucuggaaucugccgacgaccgcacaagugauuauagaggccaaacccccuaaggucucugaaggaaaagacguucuacuccuggugcauaaccuuccacagaaucugacagguuacaucugguauaagggccagaugacugauuuguaccacuauauuaccucauacguagugcaugggcagaucauuuauggacccgcguacaguggcagagagacagucuauagcaacgcuucccuccugauccaaaaugugacccaggaagacgccgguucuuacacucugcacauaaucaaaaggggagaugggacaggcggcguuaccggguacuuuacggugacucucuauucggagaccccuaagccaucaauuagcaguuccaacuuaaauccccgggaagucauggaggcagugcgccugaucugugacccugagacaccagaugccucuuaccuuugguugcugaacggacagaaucuaccgaugacucaucgacuccagcugagcaagaccaaccguacacuuuaucuguucgguguaaccaaauacauugcuggccccuaugaaugcgagaucagaaauccuguuuccgcaucaaggagugacccagugacguugaaccuccugcccaaguuaccuaugccauacauaacuauuaauaaccugaauccccgggagaaaaaggauguccucgccuuuacaugugaaccgaaaagccgcaacuauaccuacaucugguggcuuaacgggcaaucucugccugugucccccagagugaagaggccaauugagaaucggaucuugauccuaccuucagucacucgcaacgaaacaggacccuaccagugcgagauucgagacagauauggcgguauaaggagcaauccaguuacccugaacgugcucuacgggcccgaucugccucggaucuauccaaguuucacguacuaucguucuggagaaaaucuugaccuguccuguuuugcugauagcaacccgcccgccgaguacucguggaccauuaauggcaaguuccaguugucuggccagaaacucuuuaucccucaaauaacaacuaaccacuccgggcuguaugcgugcucaguacgcaauagugcaaccggaaaggaaauuagcaaauccaugaucgugaaggucucugguccaugucacggcaaccagacagagagccauuga

SEQ ID NO: 61280 - RNA, 1260 nt, Artificial Sequence
  derived and/or modified sequence opt3 from PSG8__Homo_sapiens__NP_001123639
augggccugcucagcgcucccccuugcacccagagaaucacauggaaggggcuucuguugacugccuccuuacugaacuucuggaauccaccgacgaccgcacaagugacaauugaggcccagcccacuaaagucucugaaggaaaggacguucuacuccuggugcacaaccuuccucagaaucugaccgguuacauaugguauaaaggccagaucagggauuuguaccauuauauuacaucauacguaguggacgggcaaaucauuaucuauggaccagcguacaguggccgggagaccauauauagcaacgcuucccuccugauccagaaugucacucaggaagaugccgguucuuacacacugcacauuaucaugggaggggacgagaaccgcggcgugaccggccauuuuacguucacucucuacuuagaaacccccaagccuucgauuucaagcaguaaacugaauccacgagaggcaauggaggccguuucccuuacaugugaucccgaaacuccugacgcuucuuauuugugguggaugaacgggcagagccugccaaugucccaccgucuacaacucucagagaccaauagaacacuguuucuucugggagugaccaaguacacggcagguccguaugaaugcgagaucaggaaccccgucagugccagccggucugauccuuucacuuugaaucuccugccaaaguuacccaaaccuuacauaacaauuaacaaucugaagccacgcgagaacaaagacgugcucaauuuuaccugugaacccaaguccgagaacuauacuuacaucugguggcuuaacggccagucacugccgguaagcccuagaguuaaaaggcccauugaaaaucggaucuugauccuaccaagugugacacgcaacgagaccgggccuuaucagugcgaaauucgagaucaguacggaggcauaagaucuuaccccgucacgcugaaugugcucuaugguccagaccugcccaggaucuacccuuccuucaccuauuaccggagcggggaggugcuuuaucugucguguucugcugauuccaacccaccggcccaauacucauggacaauuaauggaaaguuucaguugaguggccagaaacucuucaucccccaaauaacuaccaagcauagcggccuguaugcgugcuccguccguaacucugcaacagggaaggagagcucaaaaaguaugacuguuaagguguccgacuggaccuuaccuuga

SEQ ID NO: 61281 - RNA, 1002 nt, Artificial Sequence
  derived and/or modified sequence opt3 from PSG9__Homo_sapiens__NP_001288636
augggcccccugccugccccaagcugcacccagagaaucacauggaaggggcuccuucugacugcuuccuuguuaaacuucuggaauccgcccacgaccgcagaggugacaauugaagcccaaccuccaaaagucucugagggaaaggacguucugcuacucgugcacaaccugccccagaaucuuccugguuacuuuugguauaaaggcgaaaugacugaucuguaccauuauauaaucucauacauuguagacgggaagaucauuaucuauggaccagcguacaguggcagggagaccguguauagcaacgcuuccuugcucauacagaaugucacacggaaagaugccgguaccuacacucugcacaucauuaagcgcggggacgaaacacgagaggagauccgucauuucaccuuuacgcuguacucuaagcuccccauuccuuauaucacuauaaacaauuuaaacccaagagaaaauaaagaugugcuggcauucaccugugagccgaagucggaaaacuacacauauauuugguggcuuaauggacagucauugcccguuagcccuggcgugaaaaggccaaucgagaaccggauucugauccuacccagugucacucgcaaugagaccggcccuuaccaaugcgaaaucagagacagguaugggggacuccgguccaacccagugauucugaauguacuuuacggucccgaucugccgcgcauauauccuucuuuuacauacuaccgaagcggcgagaacuuggaccucuccuguuucaccgaaucaaaucccccagccgaguauuuuuggacgaucaacgggaaguuccagcagaguggacagaaacuguuuauuccucaaaucacuagaaaccacagcggcuuauacgcuugcucuguucauaauuccgcaacagguaaggaaauaucaaagagcaugaccgugaaagucagugggcccugucacggagaucugacugagucucaguccuga

SEQ ID NO: 61282 - RNA, 1593 nt, Artificial Sequence
  derived and/or modified sequence opt3 from PSIP1__Homo_sapiens__NP_001121689
augaccagagacuucaagcccggcgaucugaucuuugccaaaaugaagggguacccucacuggccagcuaggguggacgaggucccggauggagcaguuaaacccccuacaaacaagcucccaauuuucuuuuucgguacucaugaaacggccuuucuuggccccaaagacauauucccuuauagcgagaauaaggaaaaguacgggaaaccaaacaagcggaaaggauuuaaugagggccugugggaaaucgauaacaaucccaaggugaaauucuccucucagcaagcggcuaccaagcagucaaacgccaguagcgacguagagguggaggaaaaggagacauccgucucuaaagaagauacugaccacgaggagaaggcaucgaaugaagaugugaccaaagccguugacauuacaaccccuaaggcugcacgccgaggucguaaaagaaaggccgagaaacagguggaaacugaggaagcuggggucgugacaaccgccacggcgucaguaaacuugaagguuagcccaaagaggggacggccggcagccacugaggugaaaauccccaagccucgcggcagaccaaaaauggucaagcagcccugcccuagugaguccgauauuaucaccgaagaggacaaaucuaagaagaaaggccaagaagagaagcagccaaagaaacagcccaaaaaggaugaagaggggcagaaggaggaagacaaaccgaggaaggagccugacaaaaaggaagguaaaaaggagguggaaagcaagcggaaaaauuuagcuaagacaggagugacuuccaccucagauagugaggaggaaggcgacgaucaagagggggagaaaaagcgcaaaggaggccgaaacuuucagacagcccauagaaggaauaugcugaagggucagcacgagaaagaggcagcugaccggaagcguaagcaggaagaacaaauggaaaccgagcagcagaacaaagaugaagggaagaaacccgaggucaagaaaguugagaagaagcgcgaaacgagcauggacucuagacuacaaaggauacaugccgagaucaaaaauucccucaagauugauaaccuggacgugaaucgguguaucgaagcgcuugaugagcuggccucauugcagguaacuaugcagcaggcacaaaaacacacagaaaugauuaccacucucaagaaaauccgacgcuucaaggugagccaggucauaauggagaagaguacaaugcuguauaacaaauuuaagaacauguuccuggugggagagggcgacucuguuauuacccaggugcucaauaaauccuuagcugaacagagacaacacgaggaagccaacaagacgaaagaucagggcaagaaggggccaaauaaaaagcuggagaaagaacagaccggaagcaagacacuuaacgguggcucggacgcucaggacgggaaucaaccucagcauaacggagagucuaaugaggauuccaaagacaaccacgaagccucaacuaagaaaaagcccaguagcgaggaaagggagaccgagaucuccuugaaggauucuacacuggacaauuga

SEQ ID NO: 61283 - RNA, 1275 nt, Artificial Sequence
  derived and/or modified sequence opt3 from PSKH1__Homo_sapiens__NP_006733
augggcugcgggaccagcaaggugcugcccgagccuccaaaagacguccagcucgaucuuguuaagaaaguggaaccguucuccggaacaaagucugacguauacaaacacuuuaucacugagguggauucagucggucccgugaaggccggcuucccugcugcaagucaauaugcccauccaugucccgggccuccaacggcgggacacaccgaacccccuagcgagccaccgagaagggcucggguugccaaguaccgcgcaaaauuugacccccgagugacagccaaguaugauauuaaagcucugauaggccgugguuccuucucuagagucgugaggguagaacaucgggcaacucgccagccuuacgccaucaagaugauugagaccaaauauagagaggggagggaaguuugcgagucggaauugcggguguuacgccgagucagacacgcuaacaucauucagcugguggagguguuugagacacaggaaagggucuacaugguuauggagcuagccaccggaggcgaacucuucgaccggaucauagcgaagggcucauuuacugagcgugaugcaacacgcgugcugcaaaugguacuugacggggugagauaucugcaugccuugggaaucacccacagggaucucaagccagaaaaucugcuguacuaccaccccgguacggacagcaaaauuaucauuacugauuucggccucgcuagugcccggaagaaaggggacgauuguuuaaugaagaccacaugcggaacuccugaguauaucgcaccagagguccuggugcgaaaacccuacaccaacuccguugacaugugggcucuuggcgugauagccuauauuuugcugucugguacaaugccguuugaagacgauaaucgcaccagacuauacaggcagauccuccgggggaaguauagcuacuccggagagccuuggcccucagucaguaaccuggcgaaagacuucauugaucgccuucugacgguggacccaggcgccagaaugacugcauugcaggcucucaggcauccuuggguaguuagcauggccgcuucuuccucaaugaagaaucugcaccguagcaucagucagaacuuacugaagcgggccucuucccgaugucaaagcacaaaaucggcacagucuaccagauccucaaggaguacucgcagcaauaagucccggagagugagggaacgcgagcuccgagaacuuaaccugcgguaucagcagcaauacaauggcuga

SEQ ID NO: 61284 - RNA, 393 nt, Artificial Sequence
  derived and/or modified sequence opt3 from PSMA1__Homo_sapiens__NP_001137409
auguucagaaaccaguacgacaaugaugugaccgucuggagcccccaaggcaggauccaccagauugaguaugccauggaagcuguuaagcagggguccgcaacagugggacugaaaucuaagacucaugccguacucguggcgcuuaaacgggcucagucagagcuggccgcacaccaaaagaaaauauugcaugucgacaaccacaucgguauuaguaucgccggcuuaacggcugaugcacgccugcuaugcaauuuuaugcgacaggaaugucucgacagccguuucguguuugauagaccucugccaguuuccaggcuugugucucugauugggucgucaaucuuguucaugcucgccuuuauggacaugaacuucgagggauuuuga

SEQ ID NO: 61285 - RNA, 705 nt, Artificial Sequence
  derived and/or modified sequence opt3 from PSMA2__Homo_sapiens__NP_002778
auggccgagagaggcuacagcuucucccugaccacauuuucucccucagggaagcucgugcagaucgaauaugcucuugcagccgucgcgggaggugcuccuaguguuggcauuaaagccgcaaacggggugguacuggccacugagaagaaacaaaagagcauauuguacgacgaaagguccgugcacaaagucgagccaaucacgaagcauauuggauuaguguauucuggcauggguccggauuaccggguucuggugcaccgcgcucgaaagcuagcacagcaguauuaccucgucuaucaggaacccaucccuaccgcccaacuggugcagcguguagcuucgguuaugcaggaguacacacagucagggggagugagaccauucggcgucagccuucugauuugcggcuggaaugaggggaggcccuacuuguuucaaagugacccuuccggagccuauuucgcguggaaagcaacugccauggguaagaacuacgugaauggcaaaaccuuucucgaaaagcgguauaacgaggaucuggaacuggaggacgcuauccauacagccauacucaccuuaaaagagucuuucgaagggcagaugacugaggauaauaucgaagugggaauuuguaacgaggcaggcuuucgcagacugacaccaaccgaagucaaggacuaccuugcugccaucgcguga

SEQ ID NO: 61286 - RNA, 768 nt, Artificial Sequence
  derived and/or modified sequence opt3 from PSMA3__Homo_sapiens__NP_002779
augagcuccaucggcaccggguacgaccugucugccucaacauucagucccgauggaagaguguuucaggucgaguaugcuaugaaggcaguugaaaacagcuccacugccauugguauaaggugcaaagacggcgugguauucgggguggagaagcucguccuuucuaaacuguacgaagagggaucgaauaagcgguuguuuaacguggaucgccacguuggcauggcgguggcugguuuacuggccgacgcacgaucacuagccgauaucgcucgugaagaggcaagcaauuucagaaguaacuuuggguauaauauuccucucaaacaucuggccgacagggucgcuauguacgugcacgccuauacgcuuuacuccgcgguacggccauucggauguucuuuuaugcugggcagcuauuccguuaacgauggcgcacaauuguacaugaucgacccgucaggggugaguuacggauauugggguugcgccauuggcaaggcucgccaggccgcaaagaccgagaucgaaaaacuccagaugaaggagaugacauguagagauauagucaaagaaguggcuaagaucauuuacaucgugcaugacgaggucaaagauaaggccuucgagcuggaacugagcuggguuggggagcucacuaauggaaggcacgaaauugugcccaaggacauccgggaggaagcggagaaauaugccaaggagucuuuaaaagaagaggaugaauccgacgacgauaacauguga

SEQ ID NO: 61287 - RNA, 786 nt, Artificial Sequence
  derived and/or modified sequence opt3 from PSMA4__Homo_sapiens__NP_001096137
augagcagaagguacgacucccggaccacaauauucucucccgagggccgccuguaucagguggaauacgccauggaggcuauugggcacgcaggaacuugccucgguauacuugccaacgauggcguccuguuggcggcugaacgacguaauauccauaaguuacuggacgagguguuuuucucagagaaaauuuauaagcuaaacgaagauauggccuguaguguugcagggaucacgagcgacgccaauguacucaccaacgagcugagacuuauugcucaaagguaccuguugcaguaucaggaaccuaucccaugcgagcagcucgugacagcacugugugauauaaaacaagccuacacucaguuuggaggcaagcggccguucggugucucccugcucuauaucgggugggacaaacacuacggauuucaguuauaccagucugaucccucgggcaauuauggcggguggaaggcuaccugcauuggaaacaauucagccgcggcagugagcaugcugaagcaagacuacaaagaaggugagaugacacuuaagagugccuuggcucuggccaucaaaguucuaaacaagaccauggauguguccaaacucucugcagagaaggucgaaauugcuacucugacacgcgagaauggcaagaccgugaucagaguacuuaaacagaaggaaguugagcagcugaucaaaaagcaugaagaggaggaagccaaagcggagagggaaaagaaagagaaggaacagaaggagaaagacaaguga

SEQ ID NO: 61288 - RNA, 504 nt, Artificial Sequence
  derived and/or modified sequence opt3 from PSMA6__Homo_sapiens__NP_001269161
augaccggcaugacagccgacagcagaucccaggugcaaagggcucgguacgaggcagccaacuggaaguauaaauacggguaugaaauccccgucgauaugcugugcaagcgcauugcggacauaucucagguuuacacucagaaugcugagaugcgaccucucggauguugcaugauccuuauugguaucgaugaggaacagggcccacaaguguauaaaugugacccggccggguacuauugcggauucaaggcaacggccgcuggcguaaaacagaccgaaucaacaaguuuucuggagaagaaggugaaaaagaaauucgauuggacuuuugagcagaccgucgaaacagcaauuaccuguuugagcacuguguuauccaucgacuucaagcccucugagauagaaguugguguggucacaguggagaacccuaaauuucguauccugaccgaggccgaaauugaugcucaccuaguagcccucgcggagagagacuga

SEQ ID NO: 61289 - RNA, 747 nt, Artificial Sequence
  derived and/or modified sequence opt3 from PSMA7__Homo_sapiens__NP_002783
augagcuacgacagagccaucaccguguucucccccgauggccaccuguuucaggucgaguaugcucaagaagcaguuaagaaagggucuacagccgugggaguaaggggucgggacauugugguccucggcguggagaagaaaucaguugcgaaacuucaggaugaacgcacugugcgaaaaauaugcgcucuggacgauaacgucuguauggccuucgcaggguugacggccgacgcucguaucgugauuaauagagcaaggguagagugccagagucaucgguuaaccguugaagauccugugacagucgaguacaucacucgcuauauugccagccugaagcagagauacacccaauccaacggaaggcggccauuuggcaucucugcucuaauaguggguuucgacuuugaugggacaccgcgccucuaucagaccgaccccucgggaacuuaccacgccuggaaggcgaaugcaaucggccgaggcgccaaaucagugagagaguuccuggaaaagaacuauacagaugaggcuauugaaaccgacgaucuuacgaucaaacuggucauuaaggccuugcucgagguugugcagagcgggggaaagaauaucgagcuggcaguaaugaggcgggaccagagucugaagauacucaacccugaagagauugaaaaguacguggcugagaucgaaaaagagaaggaggaaaaugagaaaaagaaacaaaagaaagccuccuga

SEQ ID NO: 61290 - RNA, 822 nt, Artificial Sequence
  derived and/or modified sequence opt3 from PSMB10__Homo_sapiens__NP_002792
augcugaagcccgcccucgagccuagaggcggguucagcuuugaaaacugccagaggaaugcuucccuugagcgggugcugccaggauugaaagucccgcacgcacgcaagaccgguacaacuaucgccggcuuaguuuuccaagacggggugauucugggagcggauacgcgagcuaccaacgacucuguaguggccgauaaaucaugugaaaagauacauuuuaucgcacccaaaauuuacugcuguggcgccggugucgcugcagacgccgagaugacaacucguaugguggcuaguaagauggaacuacacgcccucagcaccgggagagagccuaggguugcgacagugacccggauccugcgccagacucuuuucagauaucagggacaugucggcgcaucccugauugugggcgggguagauuugacaggaccacagcucuacgguguucacccccauggcucuuauucgaggcugccuuuuaccgcccuggggucaggacaagacgcugcccucgcaguguuagaggaucgguuccagccaaauaugacgcuggaagcugcccagggccuuuuggucgaggcggugacugccgguauccugggggaccuaggaagcggcggcaacguggaugcaugcgucauaaccaagacaggggcuaaacuccugcgcacucuuaguucccccaccgaaccuguuaagcgaucuggaagauaccacuuugugccagguacaaccgccguacugacgcagacugugaaaccguugacacucgagcuggucgaggaaaccgugcaagcuauggagguugaauga

SEQ ID NO: 61291 - RNA, 726 nt, Artificial Sequence
  derived and/or modified sequence opt3 from PSMB1__Homo_sapiens__NP_002784
augcugagcuccaccgcuauguacucugcucccggcagagaccucgggauggagccucacagggcagccggaccacuucagcugcgguucucaccguauguguuuaacgguggcacaaucuuggcgauugcuggggaagauuucgccauagucgcaagugacacucgcuuaagcgagggauuuuccauccauacgcgagauucucccaagugcuacaaacugaccgacaagacaguuauuggcuguucggguuuccacggggauugccuaacucucaccaaaaucauugaagcccgucugaagauguauaaacauucaaauaacaaggcuaugacaaccggagcaaucgccgcuaugcuuagcacuauacuguacaguagaagguuuuucccuuauuacguguauaauaucauuggcggcuuggacgaggaagggaagggagccguauacuccuuugauccaguggguucuuaccaacgggacagcuucaaagcgggcggguccgcaucagccaugcuccagccccugcuggauaaccaggucggauuuaagaauaugcagaacguggagcacguuccucucaguuuagaccgcgcuaugagacuggugaaagaugucuucaucagcgccgcagagagggacguguauacaggcgaugcccuucggauuuguaucguaaccaaggaagguauacgcgaggaaacgguuucuuugcgaaaagacuga

SEQ ID NO: 61292 - RNA, 795 nt, Artificial Sequence
  derived and/or modified sequence opt3 from PSMB4__Homo_sapiens__NP_002787
auggaggccuuccugggcagcagauccgggcucugggcuggaggucccgcaccuggccaguuuuacaggaucccaucuaccccggacucauucauggaucccgccagugcgcuuuaucgggggccuauuacacgcacucaaaacccaauggugacgggaaccagcguccugggcguuaaguuugaagguggggugguaauagcugccgacauguugggauccuacggcucuuuagcacgauuccguaauaucucgagaauuaugagggugaacaauucaacaaugcugggcgccagcggggauuaugcugacuuucaguaccuaaaacagguccucggacagauggugaucgaugaggaacugcuuggugacggccacaguuauucuccccgggcaauucauuccuggcugacucgcgccauguacagcagaagguccaagaugaacccuuuguggaauaccaugguuaucgggggauaugcugauggcgagucauuccucgguuacguggacaugcugggggucgccuacgaagcgccaagucuggcaacaggauauggcgccuaccucgcucaacccuuacugcgggaggugcuugagaaacagccuguauugagccagaccgaagcccgcgaucugguugagcgaugcaugagagugcuauauuacagggacgcacggucuuauaaccguuuucagauagcuacugucacagaaaagggcguggagaucgaggggccacucuccaccgaaacgaauugggauauugcccacaugaucucaggauucgaguga

SEQ ID NO: 61293 - RNA, 483 nt, Artificial Sequence
  derived and/or modified sequence opt3 from PSMB5__Homo_sapiens__NP_001124197
auggccggcggggcugcagacugcagcuucugggagagacugcucgccaggcagugucggaucuacgaacuucgcaacaaggagcgaauuuccguggcggcugccucuaaacuguuggcaaauauggucuaucaauacaagggaauggguuuaucaaugggcaccaugauaugcgggugggauaaacguggacccggccuguauuacguugacagugaagguaacagaaucagcggggccacauuuuccgugggaucuggcucgguauaugcuuacggcgugauggauaggggguauucauacgaccuagaggucgaacaggcauacgaucucgcccggcgcgcuauuuaucaggccacuuacagagacgcguauagcggaggugcagugaaucuguaccacguuagggaggauggcuggauccgggugaguuccgacaacgucgccgaucuucaugagaaguauucugggagcacgccuuga

SEQ ID NO: 61294 - RNA, 720 nt, Artificial Sequence
  derived and/or modified sequence opt3 from PSMB6__Homo_sapiens__NP_002789
auggccgcuacccugcucgcagcccggggcgcggggcccgcuccugccuggggaccagaggcauucacaccggacugggaaagcagggagguguccacugguacgaccaucauggccguccaguuugauggcgggguugugcuuggagcugacucucggacaacuaccggcucauacauugcaaaccgcguaacagauaagcugacccccauacacgaccgaaucuucugcugucguagugguagcgccgcugauacucaagccguggcggacgcagucacauaucaguugggguuucauuccauugaauuaaaugagccuccacuggugcacaccgccgcuucucuauucaaagaaaugugcuacagauauagggaggaucucauggccggaaucauuaucgcaggcugggacccccaggagggcgggcagguuuacucggugccuaugggagguaugaugguccggcaaucauuugcuauaggcgggagcggaaguuccuauaucuacggcuauguggaugccacguaccgcgaagguaugacuaaggaggaaugucugcaguucaccgcgaacgcccuugcacuggcuauggagagagacgggucuagcggaggcguaauuagguuggccgcuaucgccgaguccggcguugaaagacaggugcuccugggggaucagauuccaaaauuugcagucgccacacugcccccugcuuga

SEQ ID NO: 61295 - RNA, 834 nt, Artificial Sequence
  derived and/or modified sequence opt3 from PSMB7__Homo_sapiens__NP_002790
auggccgcugugagcgucuacgcacccccuguuggcggguucuccuuugacaacugcagaaggaaugccgugcuggaggcggauuucgcuaagcggggauauaaacucccaaagguacgcaaaaccgguacaacuaucgccggcguggucuacaaggacgggauugugcuuggagcagauacgcgagccaccgaaggcaugguuguggcugacaaaaacuguucuaagauacacuuuaucucaccgaauauuuauugcuguggugcagggacagccgcugauacugacaugaccacacagcugaucaguagcaacuuggaguuacauucccugucuaccggacgucuacccagagucgugacugccaauaggaugcucaagcaaaugcuguuccgguaccagggcuauauuggcgcggcacuuguacugggagggguugaugugacagguccucacuuguacucgaucuauccacauggcucaaccgacaaacuccccuacgucacgauggggagcggaagucuggccgcuauggccguguuugaagauaaguuccgcccugacauggaggaagaggaggcuaaaaaccugguguccgaagcaauagccgcgggcaucuuuaaugaucucgguucugggagcaacauugacuuaugcgucaucuccaagaauaaacuggauuuccuuagaccauacacuguucccaacaagaagggaaccagguugggccgguaucgcugugagaaaggcacaacugccgugcugaccgaaaagauuacaccucuagagaucgagguacucgaagagaccgugcagacgauggacacuucauga

SEQ ID NO: 61296 - RNA, 819 nt, Artificial Sequence
  derived and/or modified sequence opt3 from PSMB8__Homo_sapiens__NP_004150
augcugaucggcacccccacaccuagagacacuacgccaagcuccuggcucaccucuucacuucugguggaggccgcuccguuggaugacacaacuuuacccaccccugucaguagcgggugcccaggacuggaacccacagaguucuuucagucccuagguggcgauggggaaaggaacguucaaauugagauggcacacggaaccacuacacucgccuucaaguuucagcauggcgugauagcggcuguagacucucgggccucggcagguucauacaucagcgcccugcgcgugaauaaagucauugaaaucaacccuuaucuucuggggaccaugaguggaugugcugcagauugccaguacugggagcgauugcucgccaaggagugucgucuguauuaccugagaaauggcgaaaggauuuccgugucugcugccagcaaacucuuauccaacaugaugugccaguaucggggcauggggcugucaaugggaaguaugaucugugguugggacaagaaaggcccagggcuuuacuauguugaugagcacggaacgcgcuugagcggcaauauguucucuacugguuccgggaacaccuacgcguacggagugauggacucaggcuauagacccaaucugagcccugaagaggcauacgaucuaggcaggcgggccauagcuuaugccacacaucgcgacaguuacucugggggagucgugaacauguaucacaugaaggaggaugguuggguaaagguugaauccacugacgugagcgaucuccugcaucaauaccgagaggcaaaucaguga

SEQ ID NO: 61297 - RNA, 660 nt, Artificial Sequence
  derived and/or modified sequence opt3 from PSMB9__Homo_sapiens__NP_002791
augcugagagccggcgcucccaccggggaccucccuagggcaggagaggugcacacagguacuacgaucauggccgucgaguucgauggcgggguugugaugggaagcgacucccggguaucugcgggcgaagcuguggucaaccgcguguuugauaaacuuucaccacugcaugaacgaauuuacugcgccuugagugguagcgcagccgacgcucaggcaguugccgauauggcugccuaucaauuagagcugcacgggauagaacuagaggagccgccccucgugcuggcggcagccaaugucgugcguaacaucuccuacaaguauagagaagaccuuucugcucaucugaugguagccggaugggaucagagggagggcggccagguuuacgggaccuugggagguaugcucacacggcagccuuucgcaauuggcgggucgggaucaacuuuuaucuauggcuacguggacgcugccuauaagccagguaugagccccgaagagugucgcagauucaccacagaugcgauugcccuggcaaugaguagggacggguccucuggaggcgucaucuaccuggugaccauaacugcugccggcguggaucaccgggucauccucgggaaugaguuaccuaaauuuuacgacgaauga

SEQ ID NO: 61298 - RNA, 1323 nt, Artificial Sequence
  derived and/or modified sequence opt3 from PSMC1__Homo_sapiens__NP_002793
augggccagagccaauccgggggacacggucccggcgggggaaagaaagacgauaaggacaaaaagaaaaaguacgagccuccagugccgaccagagucggcaagaaaaagaaaaagacaaaaggucccgaugccgcuucuaagcugccucucguuacuccacauacgcagugcaggcuuaagcuguugaaauuagaacggaucaaggacuaucugcuaauggaggaagaguucauucgcaaccaggaacagaugaaaccccucgaggagaagcaagaagaggaacgaucaaaaguggaugaccugcgugggaccccuaugaguguaggaacacuugaggagauaaucgaugacaaucacgcaauugugagcacuuccgucggcucugaacauuacgugucgauccugucauuuguugauaaggacuugcucgagccaggcuguagcgugcugcugaaccacaaaguccaugccgugauugggguacucauggaugacaccgaucccuuaguuacagugaugaaggucgaaaaggcgccucaggagaccuaugcugacaucggaggucuggacaaucagauacaggaaaucaaagagaguguggagcuuccauugacucacccggaauacuaugaggaaaugggcauuaagcccccuaaaggggugauccuguacggaccacccggcacagguaagacccuacucgccaaagcagucgccaaccaaacguccgcuacuuuccugagaguuguggggucugagcuuauucagaaguaucugggagauggcccuaaguugguaagggaacucuuucggguggcagaggagcacgccccaagcaucgucuucauagacgaaauugaugcuaucggcaccaaacgcuacgacuccaauucagggggagagagagaaauucagaggacaaugcuggaguuacugaaccagcucgaugguuuugacagucggggcgaugugaagguuaucauggccacuaaucgcaucgaaacccuugaccccgcgcugauucgaccggggagaauagauaggaaaaucgaguucccuuugcccgacgagaagaccaaaaagcggauuuuucaaauccauacaagccguaugacgcuagcagaugacgugacucuggacgaucucauaauggccaaggacgaucugucuggagcugacauuaaagccaucugcacagaagcaggccuuauggcucugcgcgagagaaggaugaaggucaccaacgaagauuucaaaaaguccaaagagaauguguuguacaagaagcaggaggguacuccagaagggcucuaucuguga

SEQ ID NO: 61299 - RNA, 426 nt, Artificial Sequence
  derived and/or modified sequence opt3 from PSMC2__Homo_sapiens__NP_001191382
augcccgacuaccugggcgccgaucagagaaagaccaaagaggacgaaaaggaugacaaaccuaucagggcucucgaugagggggacauugcacuucugaagacauauggacaaagcacuuacucccggcagauaaaacagguggaagaugacauccagcaauuguuaaagaagauuaacgagcugacggguaucaaagaaucugauaccggccuagccccaccggcgcucugggaccuggcugccgauaagcagacacuucagucagagcagccccugcaagucgcacgcugcacuaaaauuaucaaugccgacagugaggauccuaaguauauaaucaacguuaaacaguucgcuaaguuugugguagacuugagcgaccagguggcaccaaccgauauugaagaggggaugcgagucggauga

SEQ ID NO: 61300 - RNA, 1320 nt, Artificial Sequence
  derived and/or modified sequence opt3 from PSMC3__Homo_sapiens__NP_002795
augaaccugcuccccaauaucgagagcccugugaccagacaggaaaagauggccacagucugggacgaggcugaacaagauggcauuggggaggaaguucuuaaaauguccacugaggagauaauccagaggacgcggcuguuggacucugaaauuaagaucaugaaaucagagguguuacgcguaacccacgaacugcaggcaaugaaggauaaaauuaaggagaacagugagaagaucaaagugaauaagacacuaccauaccucgucagcaacgugauagaacugcuugacguugauccgaaugaccaggaggaagauggagccaacaucgaccuggauucccaacgaaaagguaagugcgcggugauuaaaacuucuacccgucagacauauuucuugcccgucaucggccucguggacgcugagaagcugaagccuggggaucugguaggaguuaauaaagacucguaccucauuuuagaaacccugccaacugaguaugauucaagagugaaggccauggaggucgacgaaaggcccacagagcaguacagcgacaucggcggucuugauaaacagauacaagaauugguggaggcaauugugcugccuaugaaccauaaggaaaaauuugagaaucuagggauccagccacccaagggaguccucauguauggcccuccaggcaccgggaaaacgcugcuugcccgggcuugugcagcccagacuaaggcuaccuuccugaaguuggccggaccgcagcucguucaaauguuuauuggugacggcgcgaaacuggugcgcgaugcauucgccuuagcuaaggagaaagcccccaguaucaucuuuauugacgaacuggaugcaauagggacaaagagauucgacuccgagaaagcuggagauagggaaguacagcggacuaugcucgagcuucugaaccaguuggacggcuuucaaccuaauacccaggugaaggucaucgccgcgacaaaccgcguggauauucuagacccagcccugcuccgaucugguagacuggauaggaagaucgaguuccccaugccuaaugaggaggcacgggcucguauaaugcagauucacagccgcaaaaugaacguuuccccagacgugaauuacgaagaacuugccagaugcaccgacgauuuuaacggggcucaguguaaggccgucugcguggaagcaggaaugaucgcccugaggcggggcgcuacggaguugacucaugaggacuauauggaaggcauccucgagguacaagcgaaaaagaaagcaaaccugcaguacuacgccuga

SEQ ID NO: 61301 - RNA, 465 nt, Artificial Sequence
  derived and/or modified sequence opt3 from PSMC3IP__Homo_sapiens__NP_001242943
auguacggcaagcagaaaaucuauuucgccgaccaagaucaguuugacauggugagcgaugcugaccugcagguccucgaugggaagauuguugcacuuaccgccaaagugcagucccugcaacagucuugcagauacauggaggcggaauugaaggaguuaucaagugcucugacaacucccgaaaugcagaaagagauacaggaacuaaagaaggagugugccggauauagggagcggcucaaaaacaucaaggcagccacgaaucacguaaccccugaagagaaagaacaaguguaccgcgagcgacagaaguauugcaaagaguggcguaagagaaagaggauggcuacagaacugagcgacgcaauucuugaggguuacccaaaauccaagaaacaguucuuugaagaggucggcaucgaaacugaugaggacuauaacgugacccugccggaucccuga

SEQ ID NO: 61302 - RNA, 1257 nt, Artificial Sequence
  derived and/or modified sequence opt3 from PSMC4__Homo_sapiens__NP_006494
auggaggaaaucggcauucugguggagaaggcccaggacgaaauacccgcucucagcgucuccagaccucaaaccgggcuuucuuuccugggaccagagccggaagauuuggaggacuuauacucaagguauaaaaagcugcagcaggagcuagaauuucucgagguucaggaagaguacaucaaagaugagcaaaagaaccugaaaaaggaguuccuucacgcacaggaagaagugaagcggauucagaguaucccccugguaauuggucaguuuuuggaggccguggaccaaaauacagcgaucgucggcagcacuacgggguccaacuauuacgugcgcauacucucuaccaucgaucgagaacugcugaaaccuaaugcuucgguugcccuccauaagcacucaaacgcauuaguggacguccugccacccgaggccgauagcaguauuaugaugcuuacauccgaccagaaaccugaugugauguaugcugacaucggaggcauggauauucagaagcaggagguacgugaagcaguugaguugccacugacucauuucgaacuauacaaacaaaucgguauagaucccccuagaggggugcucauguauggaccaccgggcugcggcaagaccaugcuggccaaggcugucgcccaccauacaaccgcggcauuuauuagggugguggggucugaguucguccagaaauaccuuggagaagguccccggaugguucgcgacguguuuagacuggccaaggagaaugcuccugccaucauuuucaucgacgagaucgacgcaauugcuacuaaaagguuugaugcccagacaggcgcggaccgggaaguacaacgcauauugcucgagcuguuaaaccagauggauggguucgaccagaaugugaacgucaaggugaucauggccaccaaucgagcagauacgcuggacccagcucuccuuagacccggaaggcuggaucggaaaauugaauuuccuuugccagaccgucgccagaagagacuaaucuucagcacuauaaccuccaaaaugaaccugucagaggaaguugaucucgaggacuacguggccaggcccgauaagauuaguggcgcugacaucaauagcaucugucaagagucugguaugcuggccguccgggaaaaccgauauauugugcuugcaaaggacuuugagaaagccuacaagacaguaaucaaaaaggaugaacaggagcacgaguucuauaaauga

SEQ ID NO: 61303 - RNA, 1197 nt, Artificial Sequence
  derived and/or modified sequence opt3 from PSMC5__Homo_sapiens__NP_001186092
auggagcuggaagagggcaaggccgggagcggacucagacaguacuaucuuuccaaaaucgaggagcugcaauugauugugaacgacaagucucagaauuuaaggcggcugcaggcucagcgcaacgaacuaaaugcaaaaguccgacuccugcgugaggagcuucaacuguugcaggaacaggguucauacguuggcgaggugguaagagccauggauaagaaaaaggugcucgucaaggugcaccccgaagggaaauucguuguggacgucgauaagaacauagacaucaaugaugugaccccuaacugcaggguagcgcugcggaaugacaguuauacacugcauaaaauucucccaaacaagguugauccguuagugagccugaugauggucgagaaagugcccgacuccacuuacgagaugaucggaggccuugauaagcagauuaaggaaaucaaagaggugauagaauugccugucaagcacccagagcuguuugaagcucuagguaucgcccaacccaaagggguucuccuguauggaccuccaggcacgggcaagacccuucuggcacgcgccguggcucaucacacagacuguacuuucauuagaguaucugggucggaguuggugcagaaauuuaucggagagggugcaaggaugguccgggaacucuucgugauggcccgcgagcaugcucccucaauuaucuuuauggaugaaauagacagcauuggcaguucccgacuggaagggggaucuggcggugauagcgaaguucagagaaccauguuagagcugcucaaucagcuugacggguucgaggccacaaagaacaucaaagugauuauggcgaccaauaggaucgacauccuggauuccgcauugcuacggccuggacguauugaccgcaagauagaauuuccaccgcccaacgaggaagccagacuggauauccucaagauucacucaaggaaaaugaaucugacucggggcaucaaccuucgaaagauagcugagcugaugccuggcgccaguggggcagaagucaaaggagugugcacagaggcugguauguacgccuugcgcgagagaaggguacacguuacccaagaagacuucgagauggcgguggccaaggucaugcagaaagauagcgaaaagaauaugucuauuaagaaacucuggaaguga

SEQ ID NO: 61304 - RNA, 1212 nt, Artificial Sequence
  derived and/or modified sequence opt3 from PSMC6__Homo_sapiens__NP_002797
auggccauccccggcauuccuuacgagagaaggcugcucauaauggcugacccacgggauaaggcacuucaggacuaucgcaaaaagcuguuggaacacaaagagaucgaugggcgauuaaaggaacugcgugagcaacuaaaagaacucaccaagcaguacgaaaagagcgagaacgaccugaaagcccuucaguccgugggacagauugucggugagguucugaagcaauugacagaggaaaaauucaucgugaaggcgacuaauggcccgagauauguaguggggugcaggcggcagcucgauaaaucuaagcugaagcccggaacgcgcgucgcucuggacaugaccacacucacuauuaugagauacuuaccuagggagguggauccacugguuuauaacaugucacaugaggaccccggcaaugugaguuacagcgaaaucggugggcuuuccgagcagauacgggaauugcgcgaggucaucgaacugccucuaaccaacccagagcucuuucagcgagugggaauuauucccccuaaaggcugucugcuuuauggcccaccggggacaggaaagacccuguuggccagagcaguagccucucaacucgauugcaauuuccugaaaguugugucgucaagcaucgucgacaaguacaucggugagagugcuagguuaauacgggaaauguuuaacuacgcacgugaucaccagcccuguauuaucuucauggacgagauugaugccaucggcgggcgcagauuuuccgaaggaacuucugcugacagggagauccagcggacacugauggaacuccuuaaucagauggacggcuucgauacccugcaucgagugaaaaugauuauggccacgaaccgcccugacacuuuggauccagcgcuacugagacccgguaggcucgaccggaagauacacaucgaucugccuaaugagcaagcacgccuugacauucugaaaauccaugccgggccaauaaccaagcacggagagauugauuaugaagcuaucgugaaguugagcgacggcuuuaacggcgccgaucucagaaaugucugcacagaggcagggauguucgcuaucagggccgaccacgauuuuguugugcaggaagacuucaugaaagcgguacguaagguggccgacuccaaaaagcuggagucaaaauuagauuacaagcccgucuga

SEQ ID NO: 61305 - RNA, 681 nt, Artificial Sequence
  derived and/or modified sequence opt3 from PSMD10__Homo_sapiens__NP_002805
auggagggcugcgugagcaaccugauggucuguaaucucgccuacuccgggaaacuugaagaacugaaggaaucuaucuuggcugacaagucauuagcaaccagaacagaucaggacaguaggacugcccugcacugggcgugcagcgcuggacauacggagauuguugaguuccuacuccaacugggugugcccguaaacgauaaagacgaugccggcugguccccucuucacauagcagccucugcugggcgggacgagaucgugaaggcacuguugggaaaaggcgcccaggucaaugcugugaaccagaaugguuguaccccacuccauuaugccgcgucgaagaaccgccacgagauugcaguuaugcugcuggaagggggagccaauccggaugcuaaggaccauuacgaggccacagcaaugcaccgagcugccgcgaaaggcaaccucaagaugauccacauuuuacuguauuacaaagccucaacuaauauccaggauaccgaaggcaacacaccccuucauuuggcaugcgacgaggagcguguggaagaggcuaagcugcuagucagccaaggggccaguauauauaucgaaaauaaagaggaaaagaccccucuccagguggcuaagggaggucugggccuuauucugaaaagaaugguagagggguga

SEQ ID NO: 61306 - RNA, 1371 nt, Artificial Sequence
  derived and/or modified sequence opt3 from PSMD12__Homo_sapiens__NP_002807
auggccgacggcgggagcgagagagcugauggaaggaucgugaagauggaagucgacuacuccgcaaccguugaucagcggcugcccgagugcgccaaacucgcgaaggaaggucgccuucaagaggugauugaaacacuguugucuuuagagaaacagacucgaacggcuucagacaugguaaguaccagccguauacugguggccgucgugaagauguguuaugaggcaaaagaaugggaucuacucaacgagaauaucaugcugcuuuccaagagaaggucucagcugaagcaggccguugcuaaaauggugcaacagugcuguacauacgucgaagagauuacugacuugccuaucaagcuccggcugauugauacccugcgcauggugacagagggcaaaaucuauguagaaauagagagagcaaggcucaccaagacuuuagccacaaucaaagaacagaacggggacguuaaggaggcugccucgauucugcaggaacuucaaguggagaccuacggaucaauggagaagaaagaacgggucgaguucaucuuggaacagaugcgccugugccuagcggugaaggauuauauucgaacgcagaucauaagcaaaaagauuaauacuaaauuuuuccaggaggaaaacaccgagaagcucaaacugaaguacuauaaucuuaugauccaacuggaccagcacgagggcaguuacuuguccauuuguaagcauuacagagcaaucuaugauacaccaugcauccaggccgaaucugagaaauggcaacaggcucucaagagcgugguccuguacguuauuuuagccccguuugacaacgaacaguccgaucuggugcacaggauaucaggugacaaaaagcucgaggaaauccccaaauauaaggaccuucugaaguuguucacuaccauggagcuaaugcgguggaguacacugguagaggauuacgggauggaacuccguaaaggaagccuggagucuccugcaaccgacguguuuggcuccacggaagagggcgagaagcgcuggaaagaucuuaagaauagagucguggaacauaacauuaggaucauggcuaaauauuacacucggauaacaaugaagcgaauggcccagcuguuggaccucucaguugaugagagcgaagcguuccugaguaauuuaguggucaacaagaccauuuuugccaaaguggaccgccuggcagggaucaucaauuuccaaagaccaaaggaucccaacaaucuacucaacgacuggucucagaaacuuaauucccugaugagcuugguaaacaagacuacacaccugauugcuaaagaggaaaugauccauaaccuccaguga

SEQ ID NO: 61307 - RNA, 1131 nt, Artificial Sequence
  derived and/or modified sequence opt3 from PSMD13__Homo_sapiens__NP_002808
augaaggacgugcccggcuuccugcagcaaagccagaacuccgggccuggacagccagccgucuggcacagacucgaggaacuuuacaccaaaaagcuguggcaucaguugacauuacaaguucuggauuuugugcaggacccgugcuucgcucagggugauggccuaaucaaacucuaugagaauuuuauuucugaguucgaacacaggguaaacccccugucacuuguggaaauaauccugcaugucgugcggcagaugacugacccuaauguugcauugacguuucucgagaagacccgcgagaaagugaagaguagcgaugaagccgucauucuguguaagacagcgaucggggcucugaaacucaacauuggagacuuacaagugacuaaggagaccaucgaagauguagaggagaugcugaauaaccuuccaggcguuacauccgugcacucucgauucuacgacuugucgucaaaauauuaccagaccauagguaaucaugccagcuauuacaaggaugcacugcguuuucuagggugcgucgacaucaaagaucuccccgugagugaacagcaggagagagccuucacucugggacuugcuggccuguugggcgaagggguguuuaacuucggagagcuccugaugcacccugucuuagaaucccugaggaauacagaccggcaauggcucauugauacccuuuaugcauuuaacucugguaauguugagcgcuuccagacgcugaagacugccuggggccagcaaccagacuuggcugccaacgaggcgcagcuacugagaaagauccagcuccugugucuuauggaaaugaccuuuacaaggcccgcaaaucaccggcagcugacuuucgaggaaauugccaaaagcgcuaagaucaccgugaacgagguagaauugcucgugaugaaagcccuguccgucggguuagugaagggaucaauagacgagguugauaaacgcgugcauaugacauggguccaaccucgagugcuggaccuacagcagauuaagggcaugaaagauagacucgaguucuggugcaccgacguaaagaguauggaaaugcugguugagcaccaggcacaugauauccuuacguga

SEQ ID NO: 61308 - RNA, 933 nt, Artificial Sequence
  derived and/or modified sequence opt3 from PSMD14__Homo_sapiens__NP_005796
auggacagacugcucaggcuuggcgggggaaugcccggucugggccaggggccuccaaccgaugccccggcuguggacacagcagagcaagucuacaucagcuccuuggccuuacugaagaugcuaaaacacggacgggcgggcguucccauggaagugaugggucucaugcugggggaguucguagaugacuauacugugcgcgucauugauguguuugcuaugccucagucuggaacgggcguuucaguggaagccgucgacccaguguuccaggcaaagaugcuugauaugcugaaacagaccggccgacccgagaugguaguugggugguaccauagucacccuggauuugguugcugguugagcggcguggacauaaacacacaacaguccuucgaagcccucucugagcgugcugucgcagugguggucgauccaauccagucgguuaaggggaaagugguaauugacgccuuuagacugaucaaugcuaacaugauggugcugggacaugagcccaggcagacuaccucaaaucucggccacuuaaacaagccuagcauucaagcccugauccauggucuuaaucggcacuauuacaguauaacaaucaacuaucgcaagaaugaauuggagcagaaaaugcugcuaaaccuccacaagaaauccuggauggaagggcugacccuucaggauuacucugagcauuguaagcacaaugagagcgucgugaaagaaaugcuggaguuggcgaagaacuauaauaaggcaguugaagaggaagacaaaaugacuccagagcagcucgccauuaagaacgugggaaaacaagauccgaagagacaucuggaggaacacgucgacguguuaaugacauccaauaucguacagugccuggcugccaugcucgacaccguuguguucaaauga

SEQ ID NO: 61309 - RNA, 2769 nt, Artificial Sequence
  derived and/or modified sequence opt3 from PSMD1__Homo_sapiens__NP_001177966
augaucaccagcgccgcuggcauuauaucccugcucgacgaggaugaaccccagcuuaaggaguucgcacugcacaaauugaacgccguggucaaugacuuuugggcggaaaucucugagucaguugauaagauugaaguguuauacgaggacgagggguucagaaguaggcaauuugcugcccugguagcaagcaaaguguucuaucaucuaggagccuuugaagagucccucaacuacgcucugggugcaggcgaucuuuucaaugucaacgacaauucugaauauguggagacaaucauugccaagugcaucgaucacuacacuaaacaguguguugagaacgcugaccugccugaaggggagaagaagccaauagaucagcgguuggaaggaaucgugaauaaaauguuucagcgcugccucgacgaucauaaguauaaacaagccauuggcaucgcgcuggagacgcgacgucuggacgucuucgaaaagaccauucucgagucgaacgaugugccggguauguuagcauacucacugaaacuuuguaugagcuugaugcagaauaagcaguuuagaaacaagguacugaggguucuagugaaaaucuauaugaaucucgagaagcccgacuucauaaacgucugccagugucugauuuuucuugacgauccucaagccgugagugacauccuggaaaaauuggugaaggaggauaaucuccugauggcuuaccagauuugcuucgacuuauacgaauccgccucucagcaguuucugagcuccgucauccaaaaccuccggacaguugggacuccaaucgcaucagugcccggaaguaccaauacaggcaccguaccuggcagcgagaaagauucugacuccauggaaacugaggagaagacaucaagcgcuuucguggggaaaaccccagaagccagucccgagccuaaggaucagacgcuuaagaugauuaaaauacugucuggagaaauggcgaucgaguugcaccuacaguuccugauucgcaacaacaauacugaccucaugauccugaagaacaccaaagaugccgucagaaauuccgugugucauacagcaacuguuauagcuaacagcuuuaugcacugcgguaccacaucggaccaauuccuuagggauaaucuggaaugguuggcccgggcuaccaacugggccaaguuuacggcaacugccucucucggcgugauucacaaagggcaugagaaggaggcucugcaguuaauggcgacauaucugccaaaggacaccuccccgggaucagcauaccaggaaggcggugggcuauaugcccucggacugauccacgcuaaucauggcggcgacaucauugauuaccuuuugaaccagcugaaaaaugccaguaacgacaucguccgccacgggggaagccucggucugggccuugcagccauggggacugcucgacaagauguguaugaccuguugaagacaaaucucuaccaggaugacgccguaaccggagaggcagcgggccuggcuuuaggucugguuaugcuaggguccaaaaacgcccaggcaauugaagauauggugggcuaugcccaggagacgcaacacgagaagauacucagaggacuggcugucggcaucgcccuugugauguacgggaggauggaagaggcagacgcuuugauugaaucucugugucgggauaaagaccccauccuccgucgcagcggaauguacaccgucgccauggcguauugcgguucaggcaauaacaaggccaucagaaggcuguuacauguggcuguuagugaugugaaugacgauguacggcgagcagccgucgagucccugggguucauucuuuuucgcacaccugaacaguguccaagcgugguuucuuugcucucagagaguuacaacccccacgugagauauggagcugccauggcacugggcauaugcugcgcggguacugggaacaaggaggccaucaaucuacuggaaccuaugaccaacgacccagucaauuacgugaggcagggcgcucucauugccagcgcacugaucaugauucagcaaacagagaucacuugucccaaaguaaaccaguuccggcagcuuuauuccaaggugauaaaugacaaacaugaugacguuauggcuaaguuuggagccaucuuggcacagggcauucuggaugccgggggacacaacgucaccaucucuuuacaaucgcgcacaggucauacccacaugccgagcguggugggcguccucguuuucacucaguuuugguucugguuuccucugucccacuuccuuucacuggcuuacacgcccacaugcgugauuggguugaauaaagaccucaaggugaguaccgcgguacugucuaucacugccaaggcuaaaaagaaagaaaaggagaaagaaaagaaagaggaggaaaagauggaggucgaugaagcagagaagaaagaagagaaggagaaaaagaaagaaccagagccuaacuuucagcuacuggacaaucccgccagagugaugccagcccaacucaagguucugaccaugcccgaaacauguagguaucagccuuucaagccacuuagcauaggaggcauuaucauuuugaaagauaccuccgaggacaucgaggaacugguggagccggucgcugcacauggucccaagauagaagaggaggaacaggagccugaaccacccgagccuuucgaauacaucgaugacuga

SEQ ID NO: 61310 - RNA, 2250 nt, Artificial Sequence
  derived and/or modified sequence opt3 from PSMD2__Homo_sapiens__NP_001265638
augagcauguccggcgagguggccaaggaauggcaggagcuggacgaugcugaaaaaguccaaagagagccccuccuuacccugguuaaggaaaucgugccuuacaacauggcacacaaugccgagcaugaggcgugcgacuuguuaauggaaauugagcagguagauaugcuggaaaaagacauagaugagaacgcuuaugccaaggugugucuauaccucacaucuugcgucaauuaugugccagagccggaaaacucagcacugcuuaggugugcccuggggguuuuccggaaauuuagucgcuuccccgaggcuuugcgacucgcacugaugcugaaugacauggaacucguggaggauaucuuuacuagcugcaaggacgucgugguacagaagcagauggccuucauguuaggacgucacgguguuuuucuggaacuuuccgaggauguggaggaauacgaggacuugacggaaauuaugucuaacguccaacuaaauucgaacuuccuagcucucgccagagagcuggauaucauggaaccuaaagugccagacgauauuuauaagacccaucuugagaauaacagguuuggcgggucaggaagccagguggacagugcgcggaugaaucuggcauccucuuucgucaacggcuuuguuaaugccgcuuucggucaggacaaauugcucacagaugacgggaacaaguggcuguacaaaaauaaggaucacggaauguuaagcgccgcagcuucccugggcaugauccuccuuugggacguggauggcgggcugacucagauagacaaguauuuguacucaagugaggauuacaucaaaagcggagcccuacuggcgugugguauuguaaacucuggcgugcgcaacgaaugcgaccccgcccucgcacugcuuuccgauuauguccugcauaauucaaacaccaugagauuggggagcaucuuuggacucggccuggcuuacgccgguaguaauagggaggacguguuaacacugcuacucccuguuaugggggauucuaaguccagcauggaaguggcuggagucaccgcccuggcauguggcaugauugccgugggcucgugcaacggggacguaacuucuacaauccuucaaaccauaauggagaaauccgaaacggaguugaaggacacuuaugcucgguggcugccacucggacugggucuuaaucaccugggcaaaggggaggcgauugaagcaaucuuggccgcucucgagguugugucagaacccuuccgcaguuuugccaacacccuggucgaugugugugcauacgccggaagcggcaaugucuuaaaggugcagcagcugcuacacauuugcuccgagcauuucgacucuaaagagaaggaagaggauaaggacaaaaaggagaaaaaggauaaagacaagaaggaggcuccugccgauaugggugcacaccaggggguugcggugcucggcaucgcucugaucgccaugggagaagagauuggcgcagagauggcccuucgaacauucgggcauuugcugagauauggagaaccaacucucaggcgggcuguaccgcuggccuuagcacugauaagcgucucaaacccccgucuuaauaucuuggacacccucaguaaauuuucccacgaugcugacccugaggugagcuacaacucuauuuucgccauggguaugguuggcucagggacaaauaacgcgcgccuggccgcuaugcuaagacaacuggcacaguaucacgccaaggauccaaauaaccucuuuauggugaggcuggcucagggacuuacccauuugggcaaagguacgcugacuuuaugucccuaccacagugaccggcaacucaugagccaggucgccguggcagggcugcuuacaguacugguguccuucuuggauguucgaaauaucauacucggcaagucucauuacguccuguauggacugguggcggccaugcagccucgcaugcuggugaccuuugacgaagaacucagaccacugcccgucucgguuagggugggccaggcuguggacguagucgggcaagccggaaaaccgaagacuauuacagguuuccagacccacacgaccccugugcuuuuggcacauggcgaacgggcugagcuggccacagaggaauuuuuacccguuacuccaauccucgagggguucgugauccugcgcaagaacccuaacuacgaucuuuga

SEQ ID NO: 61311 - RNA, 1605 nt, Artificial Sequence
  derived and/or modified sequence opt3 from PSMD3__Homo_sapiens__NP_002800
augaagcaggagggcagcgccagaaggcgcggggcugacaaagcaaagcccccuccaggagguggcgaacaagagccgcccccuccacccgccccucaggauguggaaaugaaagaggaagcggcuaccgggggaggcuccacaggugaggccgacgggaagacugcagccgcugcagccgagcacucucagcgggaacuggauacggucacccucgaggacaucaaagaacauguuaagcagcuugagaaggcugugucaggaaaagagccacgauucguacugcgugccuugagaauguuacccaguacaagcaggcggcugaaccacuacgugcuauauaaggcgguccaaggcuuuuucacuuccaauaacgcaacccgcgauuuucuccugccuuuccuugaggaaccaauggacacagaagccgaucugcaguuuagaccgaggaccggcaaagcugccucuacucccuugcucccugagguggaagcauaccugcagcugcucguugugauuuucaugaugaacucgaagcgguauaaagaggcucagaagauaucagacgauuuaaugcaaaagaucagcacacagaaucgccgagcccuggaccuugucgcggccaaaugcuacuauuaccaugcaagaguguaugaguuuuuggauaagcuggacguaguuaggaguuuccuacacgcucggcuccguaccgccacgcugcgccaugaugcugacgggcaggccacucuucugaauuugcuccugagaaacuacuuacacuacucccuguaugaccaggcagaaaaacucgugucuaagagcgucuuuccagagcaagccaauaacaaugaaugggcuagguaccuuuauuacaccggacggauuaaagcgauccagcuggaguauuccgaagcacgacgcacaaugacuaacgccuugagaaaggcuccccagcacaccgccguggguuucaaacaaacagugcauaagcuacugauugucguugagcuccugcuuggcgagaucccugauaggcugcaguuucggcagccaucauugaagcgcagucucaugcccuacuuccuguuaacccaggcagugagaacggggaaucuggccaaauuuaaccaaguacuagaccaguucggagaaaaguuccaggcugauggcacuuauacacucauaaucaggcugcgucacaaugugauuaaaaccgguguccggaugaucagccuuucuuacucccgaauuucauuggccgacaucgcacagaagcugcaacucgauagcccggaggacgcggaauuuauaguggcuaaagccauuagagaugggguuaucgaggcaaguauuaaccaugaaaagggauacgugcagucuaaggagaugaucgacaucuauuccacuagggagccucagcuggccuuccaccagcgcauuagcuuuugucuugauauacacaauaugucggucaaagcuaugcgguucccacccaagucuuacaacaaagaccuggaauccgccgaggaaagaagggagcgcgagcaacaggauuuggaauuugcaaaggagauggcugaagacgacgaugacucauucccuuga

SEQ ID NO: 61312 - RNA, 1134 nt, Artificial Sequence
  derived and/or modified sequence opt3 from PSMD4__Homo_sapiens__NP_002801
auggugcuggagagcaccauggucugcguugacaacuccgaauacaugagaaauggcgauuuccuccccacaaggcuucaggcccaacaggacgcugugaacaucguaugucacucuaagacucggucaaauccugagaacaauguggggcugauuacguuggcaaacgauugcgaagucuuaaccacacugacuccagacaccggacgcauacuaaguaaacuccauacagugcagccgaaggguaaaaucaccuuuuguacuggcauucgaguugcccaccuggcgcuuaagcaucgucaggggaaaaaucacaagaugagaaucauugcuuucgugggaagccccgucgaggauaacgaaaaggaccuggugaaauuggccaagaggcucaaaaaggagaaaguaaauguugauaucauaaacuuuggcgaggaagaggugaauacagaaaagcugaccgcauucgucaacacgcugaaugguaaggacgggacuggaucccaucucgugaccgugccuccaggccccucuuuagccgaugcucugaucucgucaccuauucuugcaggcgaagggggagccauguugggucugggcgcuagcgacuuugaguucggggucgauccaagugccgaccccgagcuagcgcucgcacugcggguuuccauggaggaacaacgccagagacaggaggaagaggccaggcgggcugccgcagcuucugccgcggaggccggaaucgcaacaacuggcaccgaagauagcgacgacgcccuucugaaaaugacaauuucccagcaagaguuuggucgcaccggguugccugaucucucaaguaugacggaagaggaacagaucgcuuaugcuaugcagaugagccugcagggagccgaguucggccaagcagagucugccgacauagaugcuuccucagcgauggacacuagcgaaccagcaaaggaggaagaugacuacgaugugaugcaggacccggaguuuuuacagaguguacuggaaaaccuccccggcguggauccuaauaacgaggccauucgaaacgcuauggggucucuugccucccaagcaacaaaagacggaaagaaagauaagaaagaggaagacaagaaguga

SEQ ID NO: 61313 - RNA, 1329 nt, Artificial Sequence
  derived and/or modified sequence opt3 from PSMD6__Homo_sapiens__NP_001258708
augccccuggagaaccucgaagaggaaggccuuccuaagaauccagaccugagaaucgcccaguugagguucuuacugagccuaccggagcaccgcggggaugcugcagugcgggacgaacucauggccgcgguccgagauaacaauuuuuggaaccguauuagacaagagcagaccgaggacugucccccuuccucuccaucaaggggauggcauugccaggauuggcccagucggaaaccuccaacaagcauacgccugugcuucgcuaagcccaucauuaaaagacacaggaugccuuccuacauggccccauauuacgaagcacuuuguaagucucuggacuggcagaucgauguugacuugcucaauaaaaugaagaaggccaacgaggaugaacugaaacggcuggacgaggagcucgaagaugcugagaagaauuuaggugaaucggagauucgcgacgcaaugauggccaaagcugaauaucugugccgaaucggcgauaaggagggggcccuuacugcguuuagaaaaacguacgacaagaccguggcauugggacauaggcuggacauaguauucuaucuacuccggaucggccuguuuuacauggauaacgaccuuauuacacguaauacugagaaggccaaaucacugaucgaagaggguggggauugggaccgcagaaacagguugaagguguaucaaggacucuacugugucgcuauucgggauuucaaacaggccgcagaacuguuuuuagacaccgugagcacauucaccaguuacgagcugauggauuauaagacuuuuguuacauacaccguguaugucuccaugaucgcucucgaacgaccggaccuucgcgagaaagugauaaagggcgccgagauucuggaaguauugcacucucuacccgcgguuagacaguaccuguucagccucuaugagugcagguacuccguguuuuuccagucacuggccgucguggaacaagagaugaaaaaggauuggcuuuuugcaccucauuaucgguacuacgugcgcgaaaugagaauccacgcuuauagucagcuguuggagagcuacaggucucucacgcugggcuauauggccgaggcuuucggggucggaguugaguucauugaccaggaauuaucccguuuuaucgccgcaggucggcugcacuguaagaucgauaaagugaaugaaauuguagagacuaaccgaccagacucaaagaauuggcaguaccaagagaccaucaaaaagggcgaccuacuccugaacagagugcagaaacuuagcagggucauaaauauguga

SEQ ID NO: 61314 - RNA, 975 nt, Artificial Sequence
  derived and/or modified sequence opt3 from PSMD7__Homo_sapiens__NP_002802
augcccgagcuggccgugcagaaggucguugugcacccucucguacuucugagcguggucgaccauuucaacagaaucggcaaaguggggaaucaaaagaggguugugggagucuuguuagguuccuggcagaaaaaggugcuggauguaucuaacucauuugcuguuccauucgacgaagaugacaaagaugacagugugugguuucuagaucacgacuaccucgagaauauguauggcauguucaagaaggucaacgcacgggaacgcauuguggggugguaccauaccggaccgaaacugcacaagaaugauauagccaucaacgagcuuaugaaacgauauugccccaauagcgugcuggucauuaucgacguuaagccuaaagauuugggccucccaacagaagcguacauuuccguggaggagguacaugacgaugguacucccacgucuaagaccuuugaacacgugacaucggagaucggggcugaagaggccgaggaagucggaguggagcaccuucugcgugacauaaaggacacuaccguuggcacacucucacagagaaucaccaaccaggugcauggcuuaaaagggcugaauagcaagcuguuggauauuaggaguuaucuggaaaaagucgcaacuggaaagcuaccuaucaaccaccaaauuaucuaccagcuccaggacguguucaaucugcuuccagauguaucccugcaggaguuuguuaaagccuucuauuugaagacaaacgaccaaaugguggucguguaccucgcuucucugauacggagcgucguggcauuacauaaucugauuaacaauaaaaucgccaaccgcgaugcugaaaagaaggagggucaggagaaagaagaguccaagaaagacagaaaggaagauaaagagaaggacaaggauaaagaaaagucagacguuaaaaaggaggagaaaaaggaaaagaaauga

SEQ ID NO: 61315 - RNA, 1053 nt, Artificial Sequence
  derived and/or modified sequence opt3 from PSMD8__Homo_sapiens__NP_002803
auguucaucaagggcagagcccccagggcuccuccacgggagcgccgacgugcaaccagagggggacugagacagguggucgccccgccccgggcgcucgguagcacaucccgcccucacuuuagaagggcuucuguuugccggcgccgauguagaaagucaggcgggcuucuggccgcaaguaggaagauggccgcugcagccgugaacggagcugccggcuucagcuccucugguccagcggcaacuucgggggccguauugcaagcugccacgggaauguacgaacaguuaaaaggcgaguggaaucggaagucacccaaccugagcaaaugcggcgaggaacuagggcgucucaagcuggugcuucuggaauugaauuuucucccuaccacaggaacuaagcugaccaaacagcagcugauucucgcacgcgacauauuagagaucggugcucaauggaguauucugagaaaggauaucccauccuucgagagguauauggcccagcuuaaauguuacuauuuugacuacaaggaacaguugcccgagucugcguauaugcaucagcugcuaggccucaaccugcuuuuccuguugagccaaaaucgggucgccgaauuucacacagagcucgagcgacugccugcaaaagauauucagaccaacguguacaucaagcauccaguuuccuuagaacaguaucugauggaggggucauacaauaagguguuccucgcuaaaggaaacauaccggccgaaaguuacacauuuuucaucgacauucuucuggauacuauccgcgacgagauugcuggcugcaucgaaaaggccuaugagaaaauauuguuuaccgaggcaacgaggauucuauucuuuaauacucccaagaaaaugaccgauuacgccaagaaaagggguuggguccuggggccuaacaauuauuacagcuucgcuucucagcaacagaagccagaagacacaacuauccccuccaccgagcucgcgaaacaggugauugaauaugcacggcaacuggagaugaucguauga

SEQ ID NO: 61316 - RNA, 672 nt, Artificial Sequence
  derived and/or modified sequence opt3 from PSMD9__Homo_sapiens__NP_002804
augagcgacgaggaagccagacaguccggcgggucuucacaagcuggaguggucaccguuagugaugugcaggagcugaugaggcggaaggaagagaucgaagcacagauuaaagccaacuacgacguacucgagagccagaaggguauaggcaugaaugagccccuuguggauugcgaaggguauccucgcuccgacgucgaucuguaccaagugcgaacagcgcgucacaacaucauuuguuugcagaaugaccauaaagcuguuaugaaacagguggaggaagccuuacaccagcugcaugcaagagauaaggagaagcaagccagggacauggcugaggcacacaaggaagccaugucucggaaacuaggacagucggagucacagggcccaccgcgcgcuuucgccaaggucaacagcaucagucccgguuccccugcgucuauugcagggcuccagguggaugacgaaaucguagaguuuggaagcguuaauacucaaaacuuccagucccugcauaauauaggcucagugguccagcacagugaaggcaaaccacuuaacgugacggugaucagaaggggagagaagcaccaacugcgguugguccccacccgcugggccgggaaaggucuccugggcugcaauauuaucccucugcagcgauga

SEQ ID NO: 61317 - RNA, 750 nt, Artificial Sequence
  derived and/or modified sequence opt3 from PSME1__Homo_sapiens__NP_006254
auggccaugcugagagugcagcccgaggcucaagcaaaggucgacguuuucagggaagaucucugcaccaaaacagagaaccuucugggcagcuacuuuccuaagaaaaucuccgaauuggacgccuucuuaaaggagccagcgcugaaugaagcuaaccuaucuaaucucaaagccccgcuggauauucccgugccugacccaguaaaggagaaggagaaagaagaacggaagaaacagcaggaaaaggaggauaaagacgagaagaagaaaggggaagaugaggacaagggacccccuugugguccagugaacugcaaugagaaaauagucgugcuucugcagcgcuugaagcccgagaucaaagauguuauugaacaacucaaccuggugacuacguggcugcagcuccagaucccucgaauugaggacggcaauaacuuuggggucgcagugcaggagaagguauucgaauuaaugaccucacugcacacaaaacuugagggauuucauacucaaaucaguaaguauuucagcgaacguggcgaugccguuaccaaggcugcaaaacagccacacgugggugacuacagacaguugguccaugagcuggaugaagccgaguauagggacauacggcuaauggugauggagauccgcaaugcuuacgccgugcucuaugacauuauccugaagaacuuugaaaaacuuaagaaaccgagaggggagacaaagggaaugauuuacuga

SEQ ID NO: 61318 - RNA, 720 nt, Artificial Sequence
  derived and/or modified sequence opt3 from PSME2__Homo_sapiens__NP_002809
auggccaagcccugcggcgugagacugagcggggaggcuaggaaacaggucgaaguuuuccggcaaaaccucuuucaggaggcagaagaguuccuuuaccgcuuucugccucagaagaucauuuauuugaaucaguuacugcaagaagacucccuaaacguggccgaucucaccucucugcgagcgccacuugacauaccgauccccgauccuccacccaaagacgaugagauggagacagacaagcaggagaaaaaggaaguacacaaguguggauuccugccugguaaugaaaaaguguugucacuccuggcucuggucaagccagagguguggacucucaaagagaagugcauuuuaguuaucacguggauucagcaucugauccccaaaauagaagauggcaacgacuuugggguggccauccaggagaagguccuugaacgugugaaugcaguaaagaccaaaguugaggccuuccaaacaacuauuaguaaguacuuuagcgaaagaggagaugcuguggcaaaagccuccaaggagacccacgucauggacuauagggcuuuggugcaugagcgggaugaagccgcguacggcgagcugcgcgcaauggugcuagaccucagagccuucuaugcugaacuguaccacaucauuucuucgaaccuugagaaaaucgucaauccuaagggugaagagaaaccaucaauguauuga

SEQ ID NO: 61319 - RNA, 798 nt, Artificial Sequence
  derived and/or modified sequence opt3 from PSME3__Homo_sapiens__NP_001253974
auggagaaguggauccugaaaaagauuaaauaccuccagagcggcgggcuuuccgccucuuauuacucauauaagguggacaguuucagagaaaggauaaccagcgaggcugaagaucuggucgcaaacuuuuuccccaaaaaguuguuagagcuggacuccuuucuaaaggaaccuauccucaauauucacgaucugacacaaauccauucugacaugaaccuuccaguuccggaucccauucuguugacuaauucgcacgacggacucgaugguccuacguacaaaaagcggcgccuggacgagugcgaggaagccuuccagggcaccaaaguguuuguaaugccaaacgggaugcugaagucaaaucagcagcucguggauaucauagagaaagucaagcccgaaauccgauuacugauugagaaguguaacacagugaaaauguggguucaacuuuugaucccucguauugaggacggaaauaacuucggcgugagcauccaggaagagacugucgcggaacugagaaccguggagagugaagcugccuccuaucuagaucagauaucuagguacuauauuacacgggcaaagcucguaagcaaaaucgccaaguacccacauguugaggacuaccgcagaaccgugacugagauugaugaaaaagaguauaucucccugaggcuuaucauuucagaacugcggaaucaguacgucacauugcacgacaugauacucaagaacaucgagaaaauuaagcgcccccgaaguagcaaugcugaaacccuguauuga

SEQ ID NO: 61320 - RNA, 5532 nt, Artificial Sequence
  derived and/or modified sequence opt3 from PSME4__Homo_sapiens__NP_055429
auggagcccgccgaacgagcuggagugggggagccuccagaaccgggagguaggcccgagccuggcccacggggguucgucccccagaaggaaaucguuuacaacaagcugcucccuuaugcagagcgccuugacgccgagagcgaucugcaguuggcgcagauuaagugcaauuuaggacgagcugugcagcugcaggaacuauggccaggcggucucuuuuggacccguaaacuguccacauacauaagacuuuaugggaggaaguucucuaaagaggaccacguacuguuuaucaaguugcucuacgaacuggugucaauucccaagcuggagaucaguaugaugcaaggauucgcccggcucuuaauuaaccugcuuaaaaagaaagaguugcugagccgcgcagaucuagaacucccuuggagaccacuguaugacauggucgagaggauccuuuacuccaagacugaacaucugggcuugaauugguuuccgaacucuguggagaauauucucaaaacgcugguuaagucgugccggcccuauuucccugccgaugcuaccgcagaaauguuagaggaguggcgcccacugaugugccccuuugacgugacaaugcagaaggccaucacuuacuucgaaauuuuucucccuaccucacuuccacccgagcugcaccauaaaggcuucaaguugugguuugaugaacuaaucgggcugugggucagcgugcagaaccucccgcagugggagggacaacugguaaaucuuuucgcucgacuggccacagacaacauugguuacaucgauugggacccuuauguucccaaaauauuuaccagaauuuugaggagucucaaucugccagugggcuccucucaggucuuagugccucgguuccugacuaacgcguacgauaucgggcacgcagugauuuggaucacagccaugaugggaggccccagcaagcuaguccagaaacaucucgcuggucuguucaauuccaucaccucauuuuaucacccaaguaacaaugggcguuggcuuaacaaguugaugaaacugcuccagcgccugcccaauagcguugugagaaggcuucaccgggaacgauacaagaagccuucuuggcugacgccaguaccggacucccauaaauugacugaucaagacgugaccgacuucguccaguguauuauacagcccgugcuccuggccauguuuucaaagacaggcagcuuagaggcagcucaagcccugcagaaccuagcgcucaugcgcccugagcugguuaucccacccgugcuugaaagaacuuauccugccuuggagacccugacagaaccacaccagcucaccgcaacgcugaguugcgucauuggcguggcuaggucuuuaguauccggcgggcggugguuccccgagggaccgacucauaugcugccucuuuugaugcgcgcccucccagguguugaucccaacgacuuuagcaaauguaugaucacauuccaguuuauagcuaccuucucgacucuggugccucuagucgauuguucuuccgugcugcaagaaagaaaugaccucacagaggucgagagggaacuguguucagccaccgcagaguuugaagauuucgugcuucaguuuauggaccguugcuucggcuugauugagaguagcacgcuggagcagacccgggaagagacagaaacugagaagaugacccacuuagaaucccucguugagcuggggcuuucuagcacauuuucaacuauccugacccaguguaguaaagagaucuucaugguggccuugcaaaagguauucaacuuuuccacaagccacauuuucgaaacccgagucgcuggaagaaugguggcggauaugugcagggcagccguuaaguguugccccgaggaaucucucaaacuguuugugccacauugcuguucagucaucacucagcuaacgaugaaugacgaugugcugaacgacgaggaacucgauaaggagcugcuuuggaauuugcagcuguuaagugagauuacacgcguagacggccggaaacuccugcuuuacagagaacagcuggugaagauacuacaaaggacccuccaccugacuugcaaacaggguuauaccuugagcuguaaccuguuacaucaccuccugcgcuccacaacccuuaucuacccuacugaguacugcucuguucccgggggcuucgacaagccaccgucggaauauuuuccuauuaaggauuggggaaaacccggcgaccuguggaauuuggggauccaguggcaugucccaagcuccgaggaagugucauucgcuuuuuaccuccuggauaguuuccuacagcccgagcuggugaaacuucaacacuguggagacgguaaacucgagaugucucgagaugacauccugcagagcuugacaauuguccacaacugccugauaggcuccgggaauuuacucccuccacugaagggagaacccguuacgaaccuugugccuucaauggugagccuggaggaaaccaaauuguauacuggccucgaguacgaucugucucgggagaaucaucgugaaguaaucgccacagucauuagaaagcuacugaaccacauccuugacaauuccgaggaugacaccaagagucucuuucugauuaucaaaauaaucggugauuuguuacaguuccaagggagccauaagcacgaauuugacucuagguggaaauccuucaaccuggugaagaaaucaauggagaaucgccuccacggcaagaaacagcauauucgggcacugcuuaucgauagaguuaugcugcagcacgaauugaggacacuaacuguggagggaugugaguauaagaagauucaucaggacaugauccgagaccugcuccgccugaguaccagcucguacucccaaguccggaacaaagcccagcagacguuuuucgcugcccuuggcgcauauaacuucugcuguagagauauaauuccguuagugcuggaauuucucaggccagaccgucaggggguuacccaacagcaguucaagggagcguuguacugccugcucgguaaucacucuggcgugugucuggcuaaccuucaugauugggacugcaucguacagacauggcccgccauugucagcucagggcugagucaagcaauguccuuggagaaaccuucuaucgugcgccuauuugaugaccuggccgaaaagauacaccggcaguacgagacuaucggacucgauuucaccauuccaaaaagcugcguggaaaucgcugaguuacugcagcaauccaagaaucccucaauuaaccagauccuucugagcccugagaagauaaaagaaggcauuaagagacagcaggagaaaaaugccgacgcacucaggaacuaugaaaauuuggucgauacacugcucgacgguguugagcaacgaaaccugccguggaaguuugaacacaucgggaucggccuucuaagucuguuguuacgggaugaccgcgugcugccccucagagcuauuagguucuuuguagagaaucugaaccaugaugccaucgugguccggaaaauggcgauuucugccguggcuggaauacuuaagcagcugaagcgaacucacaaaaagcucaccaucaauccaugugagauuuccggcugcccuaaacccacgcagaucauugcaggggacagaccagacaaccauugguugcacuacgauagcaagacaaucccucgcaccaaaaaggaaugggagucgucauguuucguugaaaagacucauuggggauauuacacauggcccaaaaauaugguggucuaugccggcguggaggagcagccaaagcuggguaggucucgugaagacaugaccgaggcugaacaaauaaucuuugaucacuucagugacccgaaauuuguugagcagcuaauuacuuuccugucccucgaagaucggaaggggaaagacaaguucaacccuagaagguuuugccuuuucaaaggaaucuuucgcaauuucgaugacgccuuucugcccguguuaaagccacacuuggagcaucuggucgcagauagccacgagucuacccagcgauguguagcggaaauuaucgccggccucauaagagguagcaagcauuggacauucgagaaaguggaaaagcugugggagcuucugugcccccucuugcggacggcucuguccaacauuaccguugaaacuuacaacgacuggggcgccuguaucgcaacaucaugcgagaguagggauccucgcaaauuacacuggcuauuugagcugcuccuugaaagcccacugucuggggagggaggcuccuucguggacgcuugucguuuguauguccugcaagggggacucgcccaacaggaauggagagugcccgagcugcuucaccggcuccugaaguacuuggaaccuaaacugacccagguauacaagaaugugagggagcgcaucggcucagucuuaacauauauuuuuaugauagacguuagucuaccgaacacuaccccaacgaucagcccccaugugccugaguucacagcacggauucuggaaaagcucaaaccccuuauggauguggacgaggaaauccagaaucacgucauggaggagaacgguauuggggaagaggaugaaagaacccaaggaaucaagcuguugaaaacuauacugaaguggcucauggccuccgcuggcagaucuuuuucgaccgcggugacagagcagcugcagcuuuuaccacuguucuuuaaaaucgccccuguugaaaaugacaacagcuacgaugagcucaagagggacgcaaaguugugccugucacuaaugucccaaggucugcucuauccccaucagguaccacuugugcugcaggucuugaaacagacugcucgcaguucuagcuggcacgccagauacaccgugcugacauaucuccaaacgaugguuuucuacaaucuguucauauuuuuaaacaaugaggaugccgugaaggacaucagguggcuugucauuucccugcucgaagaugagcagcuagaagugcgggagauggcugcaaccacucugucaggcuugcugcaguguaacuuccucacaauggacucuccuaugcagauccauuuugaacaacuuugcaaaaccaagcugccgaaaaagcguaagcgcgaucccgggagcguaggagacacuauaccaagugccgaguuggucaaacgacacgcgggcgugcuggggcucggagcuugcguuuuauccagcccuuaugaugugcccacauggaugccacagcugcuuaugaaucugucugcccaccuaaacgacccucagcccauugagaugaccgucaagaaaacgcucucaaauuucagaaggacucaucacgacaacuggcaggaacauaagcaacaguuuaccgaugaccagcuguuggugcugacagaucuccuuguuuccccguguuacuacgcauga

SEQ ID NO: 61321 - RNA, 816 nt, Artificial Sequence
  derived and/or modified sequence opt3 from PSMF1__Homo_sapiens__NP_848693
auggccggccuggagguccucuucgcuagcgcagcccccgcgauuaccugcagacaggacgcucuuguguguuuucugcacugggaaguugugacacauggguacuucggauuggguguaggcgaucaaccugggccaaacgacaagaaauccgaguuacugccggccggauggaauaacaauaaggaucuauaugugcucagguacgaauauaaagacggcucucggaagcugcuugucaaagcaaucacuguggagucaaguaugauacugaacguuuuggaauacgguagccaacagguggccgaucucacgcugaaucuggacgauuauaucgacgcugagcaccucggggauuuucaucgcaccuacaagaacuccgaggaauuacgaucucguauugucucgggaaucauuacacccauccacgagcagugggaaaaggcaaaugugucaagcccucauagagaguucccacccgccacugcuagggagguagacccucugcggauaccaccccaccacccucauaccagucgccagccaccguggugcgauccccuuggcccuuuuguugugggcggggaagacuuggauccauucggacccagaagggguggcaugaucgucgacccucugcgguccggguuuccacgcgcccuaauugaccccucuagcggacucccgaaccgacugccucccggcgcggugccaccuggugcaagauucgaucccuuugggccaaucggaacauccccucccggcccaaauccggaccaccuucccccuccaggcuaugaugacauguaccuguga

SEQ ID NO: 61322 - RNA, 867 nt, Artificial Sequence
  derived and/or modified sequence opt3 from PSMG1__Homo_sapiens__NP_003711
auggccgcuaccuucuuuggcgagguggucaaggcacccugcagagccgggacagaagacgaggaagaggaagaggagggaaggcgggaaacuccugaggaucgcgaaguucgacugcagcucgcgcguaaaagagaggugaggcuucugcggcgccaaacgaagaccagcuuggagguauccuuacuggaaaaauacccauguucuaaguucaucauugcuauagguaacaaugccguggcauuucuaucaaguuucgucaugaacagcggcgugugggaggaaguugggugcgccaaacucuggaaugagugguguagaacaacugacaccacacaccuguccucuaccgaggcuuuuugcguguucuaucaucuuaagucgaacccgucagucuuucugugucagugcagcuguuacguggcagaagaucagcaguaucaaugguuggagaagguauucggaaguugccccaggaaaaauaugcagaucacuauucucacaugucggcacguuaccgacuacaagacguccgaaucuacuggcagccugccuuccccauuucugcgcgcccucaaaacccagaacuucaaggauucagcuugcugucccuuacuggagcagccuaauaucgugcaugaccuuccagccgcggucuugaguuauugccaaguguggaaaauucccgcaauccuguaccuaugcuauacagaugugaugaagcucgaccugauaacugucgaagccuuuaagccuauccuuagcacccgaucucugaaagguuugguuaagaacauuccacaguccacagagauccucaaaaagcugaugaccacgaaugaaauucagucaaacaucuacacuuga

SEQ ID NO: 61323 - RNA, 795 nt, Artificial Sequence
  derived and/or modified sequence opt3 from PSMG2__Homo_sapiens__NP_064617
auguucgugcccugcggcgagagcgccccugaccuggcuggguuuacccuccuuaugccagcagucuccguuggaaacgugggucagcuggccauggauuugaucauuucuacauuaaauaugucaaagauaggcuacuucuauacugacugucugguaccgaugguggggaacaaucccuacgcgacgaccgaaggaaacaguacagagcuaagcaucaaugcugaagucuauucccucccuucuagaaaacugguggcccuucaacugaggucgauuuuuaucaaguacaaaucaaagccauucugcgagaaauugcucagcuggguuaagaguuccggcugugcacgggugauuguccugucuagcucccacucauaucagcgcaacgaucugcagcuccgaaguacucccuuucguuacuuacugaccccuagcaugcagaagucugugcaaaauaaaaucaagucccuuaacugggaagagauggagaaaucaagaugcauaccagaaaucgacgauagcgaguucuguauuaggauccccggugggggaauuacaaagaccuuguaugacgaaaguugcucuaaagagauccagauggccguacugcuaaaguuuguuuccgagggcgauaauauaccugacgcucucggccugguggaauaccuuaacgaguggcugcagauuuugaagccacucagcgaugacccgacugucucggcaucucgguggaaaauccccuccucauggcgccuguuauucgggaguggacugccuccagcccucuuuuga

SEQ ID NO: 61324 - RNA, 369 nt, Artificial Sequence
  derived and/or modified sequence opt3 from PSMG3__Homo_sapiens__XP_011513881
auggaggacacaccccuggugaucagcaagcagaaaaccgaagucguuugcggcgugccuacucaaguaguguguacggccuucuccucucacauucucgucgugguuacccaguuugggaagaugggaacacuugugucacuggagccaaguagcgucgcuuccgaugugucuaaaccgguauugacuaccaagguuuuacugggucaggacgaaccccuaauacauguguucgccaaaaaccucgucgcauuugugucgcaggaggcgggcaauagagcugugcugcuugccgucgcaguuaaggauaagucaauggaagggcugaaagccuugagggaggugauccggguaugccaagugugguga

SEQ ID NO: 61325 - RNA, 459 nt, Artificial Sequence
  derived and/or modified sequence opt3 from PSORS1C1__Homo_sapiens__NP_054787
augaccugcacagaccaaaagagccacucccagagagcccugggcacucagacgcccgcucuccaggggccucagcuucugaacaccgauccaucuucagaggaaacaaggccgccccaugugaauccugaccgguugugucacauggagccagcaaaccauuucuggcacgccggagauuuacaagcgaugaucaguaaagaauuucaucuggcugccacucaggacgauugccgcaagggucgaacccaggaggacauucuaguccccagcucccacccugaacucuucgcaucuguucugccaauggcccccgaggaggcugcacgucuucagcaaccucagccacugccgcccccuucgggcauacacuugucagccagcagaacacucgcuccaacccugcuguacaguucucccccuucccauagcccauuugggcucuccucauuaaucuga

SEQ ID NO: 61326 - RNA, 411 nt, Artificial Sequence
  derived and/or modified sequence opt3 from PSORS1C2__Homo_sapiens__NP_054788
augauccugaacuggaagcuccuuggcauucugguguugugcuuacacaccagagggauaagcggauccgagggucaucccucucacccuccagccgaagacagggaggaagcuggcucaccgacacugccccaggggccuccaguccccggagauccuuggccaggcgcacccccucuauucgaggacccaccgcccacucggccuagucgcccauggcgagaucuccccgaaacggguguuuggcugccugagccaccccguaccgacccgccucaacccccaagaccugaugaccccuggccagccgggccccagccuccagagaauccguggcccccugcgccagaaguggauaacaggccccaggaggaaccugaccuugauccaccccgggaggaguaccgcuga

SEQ ID NO: 61327 - RNA, 1572 nt, Artificial Sequence
  derived and/or modified sequence opt3 from PSPC1__Homo_sapiens__XP_006719907
augaugcugagaggcaaccucaaacaggugaggaucgagaaaaaucccgcccggcuucgcgcucuggaaagcgcagucggggaguccgaaccugccgcggcugccgcaauggccuuggcuuuagcaggagagccagccccgcccgcuccugccccacccgaagaccacccugaugaggagauggguuucaccauugacauaaagucuuuucugaaaccaggcgaaaagacauacacucaacgaugccgucuauucguugggaaccuccccacggauaucaccgaggaagacuuuaaaagacuguucgagagguauggagagccuucagaaguguuuauuaaucgggaucgcggcuucgguuuuaucagacuugagaguaggacacuggcggaaauugcaaaggccgaguuggacgggacuauccucaagagccggccacugcgcauacgauucgcuacccauggagccgcacugacaguaaagaaccucuccccgguggucucuaaugaauuacuggagcaggcuuuuucgcaguucggccccguggagaaggccguuguggucguggaugacagaggcagggcgaccgggaaaggauuuguagaauuugccgcaaagccuccagcucggaaagcccuugagcguuguggugauggcgcuuucuugcugacuacaacgccccgcccuguuaucguggaaccaauggagcaguucgacgaugaagacgggcuacccgagaagcucaugcaaaagacccagcaguaccacaaagagagagaacagccgccuagguucgcccaacccggaacuuuugaguucgaauaugcaucacgguggaaggcccuggaugagauggaaaaacagcagcgagagcaggucgaccgcaacauuagagaggcuaaggaaaaacuugaggcggaaauggaggcagccaggcaugagcaccaacugauguugaugcggcaggaccucaugcgcagacaggaagaacugaggcguuuagaggagcugcggaaucaagaacuccagaagcgaaaacagauccagcuuagacaugaggaggaacacaggcgccgggaggaagagaugauuagacacagggaacaagaggagcugcgccgacagcaggaaggcuuuaagccaaacuacauggagaaucgggaacaggagaugcguaugggugauauggggccuagaggagcuaucaacaugggcgacgccuucagccccgcaccagccggcaaucaagggcccccuccaaugaugggaaugaacaugaauaacagggcuaccauaccgggucccccuaugggcccagggcccgccaugggaccugaaggcgcagcgaauauggguacaccaaugaugcccgauaacggggcugugcauaacgaccgcuuuccgcagggcccuccaagucagaugggaucccccaugggcucucggacugggagcgagaccccucaggcccccauguccggaguggguccagucucaggcgggccuggaggcuucgguagagggagucaaggcggaaauuuugagggccccaacaagaggcgacgcuauuga

SEQ ID NO: 61328 - RNA, 678 nt, Artificial Sequence
  derived and/or modified sequence opt3 from PSPH__Homo_sapiens__XP_011513763
auggugagccacuccgagcugagaaaacucuucuacucugccgacgcugugugcuuugauguugacucaaccgugaucagggaagagggcauugaugaacuugcaaagauaugcgggguagaggacgccgugagugaaaugacacggcgcgcgaugggaggugcuguccccuucaaggccgcacugacugagcgauuggccuuaauccagccuagccgugagcaagugcagagacugauugcugaacagccaccgcaucuaacgcccggcaucagggagcucguuucccggcugcaggaacgcaacgugcaagucuuucuuauuucugggggauucagaucgaucguggagcacguagcaucaaaacugaauauaccugccaccaacguuuuugcuaauagguugaaguucuauuuuaacggcgaguacgccgguuucgaugaaacacagccaacugcggagagcgggggaaaaggcaaggugaucaagcuccugaaagaaaaguuucauuucaaaaagauuaucaugauuggcgacggggcaaccgauauggaggccugucccccugcugacgccuuuaucggauucgguggcaaugucauacggcagcaggucaaagauaacgcaaagugguauauuacagacuuuguggaacugcucggggaguuagaggaauga

SEQ ID NO: 61329 - RNA, 471 nt, Artificial Sequence
  derived and/or modified sequence opt3 from PSPN__Homo_sapiens__NP_004149
auggccgugggcaaguuccugcucgggagccuucuguuguuaucccugcagcuaggacaagguuggggccccgacgcuagaggggucccuguugcagauggagaguuuucuucagaacagguggccaaagcgggcgguaccuggcucgggacacacaggccacuggcucggcuucgccgagcccugaguggaccgugccaguuguggagccucacucuguccguagcagagcugggccucggcuacgccucugaagagaaggugaucuuccguuauugugcugggucgugccccagaggagcaaggacgcagcaugguuuagcccuggcucggcuucaaggccaggggcgcgcccacggaggcccuuguugcagaccaaccagguacacagacgucgcguuuuuggaugaccggcaucgcuggcagcgacugccccagcuaucagcagccgcuugugguugcgggggauga

SEQ ID NO: 61330 - RNA, 1251 nt, Artificial Sequence
  derived and/or modified sequence opt3 from PSTPIP1__Homo_sapiens__NP_003969
augaugccccagcugcaauucaaggacgccuuuuggugcagagauuucaccgcucacacaggcuacgaggugcuccuucagaggcuguuggacgggcggaaaauguguaaggauauggaagaguuacugcgccagcgagcacaggccgaagaacguuauggaaaagagcuaguccaaaucgcgagaaaggcugguggccagacugagauuaacagccucagggccuccuuugacucucugaaacagcagauggagaauguugggucaagucauauacaacuugcacugacguugcgggaggaacuccgcagccuggaagaguucagagagaggcagaaggaacagcggaagaaauacgaggccgugauggaucgcguacagaaguccaaacugucucucuauaagaaagcuauggaaucgaagaagaccuacgagcaaaaaugccgagacgcagaugacgccgaacaggcuuuugagagaaucucagccaacggacaccagaagcaaguggagaaaagccagaauaaggcgaggcaguguaaagauagugcaacagaagccgagcgggucuaucgucaguccauugcucaauuagaaaaggugcgcgccgagugggaacaggagcauagaacuaccugcgaggcauuccagcugcaggaauuugacaggcuuacaaucuugcggaacgcucuguggguucacucuaaucaacuaagcaugcagugugugaaagaugacgagcucuacgaagagguccgacugacccuugaaggcugcuccauugaugccgacaucgacucauucauacaggcgaagaguacugguacagagccuccagccccggugcccuaucagaacuacuacgaucgcgagguaaccccucugacgagcucuccagggauccaacccuccuguggaaugauuaagagauuuucaggcuugcuccauggcagcccuaaaacuaccagucuggcagcuucugccgcuuccacagaaacuuuaaccccaacacccgagaggaaugaagggguuuauaccgccaucgcagugcaggagauucagggaaacccugccagcccagcucaggaguaccgggcgcuguaugacuacacggcacaaaauccggaugaacucgaccuuucggccggugauauccuggaggucauauuggaaggcgaggacgggugguggacuguggaacgcaacggacagagaggcuucgugcccgguucuuaucuagagaagcuguga

SEQ ID NO: 61331 - RNA, 1005 nt, Artificial Sequence
  derived and/or modified sequence opt3 from PSTPIP2__Homo_sapiens__NP_077748
augaccagaagccuguucaagggcaacuuuugguccgccgacauccucucuacaauuggguacgauaauauaauccagcaccuuaacaauggaaggaaaaacugcaaggaguucgaagacuuucugaaagagcgggcugcaauugaggaacgcuaugguaaggauuuguuaaaucugucacguaaaaagcccuguggccaaagugaaaucaacacucuaaagcgagcccucgagguguucaaacagcaggucgacaauguugcgcagugccauauucaacuggcucagagccuuagagaggaagccaggaagauggaggaauuucgggagaaacagaagcugcagcgcaaaaagacggaguugaucauggaugcaauacacaagcaaaaaucccuccaguucaagaaaaccauggacgccaagaaaaacuacgaacagaaguguagagauaaagacgaggcugaacaggcagugucuaggucggccaaucugguaaacccuaagcaacaggagaagcuguuugugaaacucgcuacaucaaagacugccgucgaagauagcgacaaagcguauauguuacauaucgggacccuggauaaggugcgggaggaguggcagagugaacacauuaaagcaugcgaggccuucgaagcucaagagugugaacgcaucaacuuuuuccgaaaugcccuuugguugcauguuaaucagcugucccagcagugcgugacaucugacgagauguacgagcaagucagaaagagccuagaaauguguuccauucagagggauaucgaguauuuugugaaccagcggaagaccggacagauaccaccggcacccauuauguacgaaaauuucuauucaagucagaaaaacgcuguaccugccggcaaggcgacugguccaaaccucgcccgucgcgggccccugccuaucccaaaaagcucucccgacgacccuaauuacucccuuguugaugacuacucacuguuguaucaauga

SEQ ID NO: 61332 - RNA, 1674 nt, Artificial Sequence
  derived and/or modified sequence opt3 from PTBP1__Homo_sapiens__NP_002810
auggacggcaucgugcccgauauugccgucgggaccaagagaggaagcgacgagcuguucuccacaugcguuacuaacgguccuuuuauaaugucuucaaauagugcuagcgcagccaacggcaaugauuccaaaaaguucaaaggggacucuaggucggcgggagugccaucacggguaauccacauucgcaagcucccgaucgaugugacggaaggcgaggucauuagccuuggucugcccuuugggaaagugaccaacuuguuaaugcugaagggaaagaaucaggcuuucaucgaaaugaacacagaggaagccgcaaauacuaugguuaacuacuauaccagugugacaccuguccuacgaggccaaccaauauacauccaguuuuccaaucauaaagagcucaagaccgacucuagccccaaccaggcccgugcucaggcagcccugcaagcuguaaauuccgugcagucaggcaaccuugcccuggcggcaagugccgcugccguugaugcagggauggcuauggccggacagagcccuguguugagaauuaucgucgagaaucucuucuauccagugacucuggacgugcugcaccagaucuuuucuaaauucgguacaguccucaagauuauaaccuuuacgaaaaacaaucaauuccaggcguuacugcaguacgccgaucccguuuccgcacagcaugcuaagcugucauuggacggccaaaacauuuauaacgccuguugcacucugaggaucgauuuuagcaagcuaaccagucucaaugugaaauacaacaaugacaagucucgggauuauacacgcccugaccugccauccggggacagccagccgucgcuugaucagacuauggcugccgcauucggagcccccggcauuaucucugcuuccccuuacgcgggugcaggguuuccacccaccuucgccaucccucaagcugccggacugucaguaccaaacgugcacggcgcauuggcuccccucgccauuccgagugccgcagcggcugccgcagccgcuggcagaauagccaucccugggcuggcaggagcugguaauagcgucuuacugguguccaaccucaaucccgaaaggguuacaccacagucucuuuucauucuguuuggcguguacggggacguccagcgggugaaaaucuuguucaacaagaaagagaaugcccuaguacagauggcggauggaaaccaagcccagcuggcuaugagccaucucaauggccacaagcugcacgguaaaccuauacgcauuacccuuucaaagcaucagaacguucagcugccccgagaagggcaagaggaccagggcuugacgaaggauuauggaaauaguccacuccacagauuuaaaaagcccggcuccaaaaacuuccagaauaucuuuccuccaagcgcaacucugcauuuaucuaacaucccgcccucagugagugaggaagaccugaagguccuauucagcuccaacgggggaguggucaaagguuuuaaguucuuucagaaggauaggaaaauggcccucauucaaaugggcucuguggaggaagcuguucaggcccugaucgaccuucacaaucacgauuugggggagaaccaucaccuucgggugucguucagcaaguccacaauuuga

SEQ ID NO: 61333 - RNA, 1614 nt, Artificial Sequence
  derived and/or modified sequence opt3 from PTBP2__Homo_sapiens__NP_001287914
auggacggcaucgugaccgaggucgccguuggggugaagagaggaagcgaugaacugcucuccgguucuguacuuucaagucccaacagcaauauguccucuaugguggucacagcuaacggcaaugacucgaaaaaguucaaaggggaggauaagauggacggagcaccuucaagggugcugcacauucggaaauugccaggcgaaguuacugagacggaagugauagccuuaggucugccguuugggaaggucaccaacauccuaaugcucaagggcaaaaaucaggcguuccuggagcuugcuacagaggaagccgcaauuacuauggugaacuacuauagcgccguaacaccccaucugcgcaaucaaccuaucuacauucaguauaguaaccacaaggaguugaaaaccgauaauacccucaaccagcgagcucaggcaguucugcaagccgugacugcuguccagacagccaauaccccacuguccggaacgacugugucugaaagcgcggugacccccgcacaguccccuguccuccguaucauaaucgacaacauguacuauccaguuacauuagaugugcugcaucagaucuuuucaaaguucggcgccguacuuaaaaucauuacuuuuaccaagaauaaccaauuccaggcuuugcugcaguacggggaccccgugaaugcccagcaagcaaagcuagcucucgauggacagaacaucuauaacgccugcuguacacugagaauagacuuuaguaaacuugucaaucugaacgugaaguacaauaacgauaaaagcagggacuacacccggccugauuugccaucuggugacggccagccggcgcucgaccccgccauugcagcugccuucgcuaaggagacgucccuguuagggcugccuguugccgcagugccaggagcccucucaccccuugcuaucccuaaugcggcagccgcugccgcagccgcugccgcaggccgcgucgguaugccaggggugagcgcgggaggcaacacuguacuguugguuaguaaucuaaacgaggaaauggugacaccccaaucucuguuuacccucuucggcgucuauggggaugugcagagagucaaaauucuguacaauaagaaagacuccgcucuuauccagauggccgauggaaaccagagccaacuggcaaugaaucacuugaacggucagaagauguauggcaagaucauuagggugacucucucgaaacaucagacaguucagcugccgcgggagggguuagacgaucaaggacugaccaaggacuuuggcaauucuccucuacaccgcuucaaaaagcccgguuccaaaaacuuucagaauauauucccaccuucagccacgcuccaccugaguaacauucccccaagcguggcugaagaggaucuucgaaccuuguucgccaacacagggggcacuguaaaggcauuuaaguucuuucagagagaccauaaaauggcucugcuccagauggccaccgucgaagaggcgauucaagcccugaucgaucuucacaauuacaaccugggagagaaucaucacuugaggguguccuucucuaagagcacaauauga

SEQ ID NO: 61334 - RNA, 2103 nt, Artificial Sequence
  derived and/or modified sequence opt3 from PTCD1__Homo_sapiens__NP_056360
auggacuucgugagacuggccaggcucuuugcucgggcacgccccaugggccuuuucauccugcagcacuuggauccuugccgagcccguugggcgggaggaagagaggguuuaaugaggccaaugugggcuccguuuagcuccucuucaagucaacugccccuaggccaggaacggcaggagaacaccgggagccucggauccgacccuucucauucaaauucgacagccacucaggaagaggaugaagaggaggaagagagcuucggcacgcugagugacaaguacuccucucgcagacuuuuuaggaaaagcgcagcccaauuccacaaccugcgguuuggugaacgccgagaugagcagauggagccagaacccaaguuguggagagggaggcggaauaccccuuauugguacuuccuccaguguaaacaucugauuaaggagggaaaacuggucgaagcucucgacuuauuugagcgucagaugcugaaggaggaacgccuucaaccaauggaguccaacuauacaguuuugauaggcggcugcgggagagugggauaccugaagaaagcauucaaucuauauaaccagaugaagaaaagggaucucgaacccucagacgccacuuacaccgcucuguuuaauguaugugccgagaguccuuggaaggauagcgcgcuucagucugcacugaaauugcggcagcaacuccaggccaagaacuucgaacugaauuuaaagacauaucacgcucugcucaaaauggccgcaaagugcgcugaccuucgaaugugucuggauguguuuaaagagaucauucauaagggucacgucgugaccgaagagacuuucuccuucuugcuaaugggcugcauccaggacaaaaagacaggguuucgcuacgcccugcaaguuuggagacucaugcugucacuuggacugcagccaagcagggauaguuacaacuugcuccugguggcggcccgggacuguggcuuaggugacccgcaggucgcaucugagcugcuacucaaaccccgcgaagaggcuaccgugcugcagccuccaguauccagacaaaggccccgucggacggcccaggcuaaggccgggaaucuuaugagcgcaauguugcacguugaagcccuggagcgacaacucuuccuggaaccuucgcaggcucuuggaccacccgagccgccugaggcgagagugcccggcaaggcacagccagaagucgauacuaaagccgagccuucucauaccgcugcccugacagcaguggccuugaagcccccacccguggaacucgaggucaaccuguuaacuccuggcgcuguuccaccgaccgugguauccuuugggacagugaccacgcccgccgacaggcuggcacuaauuggaggucucgagggcuuccugucaaaaauggcggaacaccgccagcagccugauauccggacucuuacauugcuggcugaggucguggaaagugggagcccagccgagucccuccuguuagcacugcuugacgaacaucagguugaggccgauuugaccuuuuucaauacucucgugagaaagaaaucuaagcugggagaccuagagggcgcuaaggcccugcuccccguccuggcaaaaaggggucuugugccuaacuugcaaacauuuugcaaucuggcuauagggugucaccgcccaaaggauggcuuacagcuccugaccgacaugaaaaagagccagguaacgcccaacacccacaucuauucagcccuuauuaacgcggccauccgaaaacugaauuacacauauuugauuaguauccucaaggauaugaagcagaaccggguuccggugaaugaagucgugauacgucaacuggaguucgcugcacaguacccuccaacuuuugacagauaucaggggaaaaacaccuaccuagaaaagauugauggcuucagggccuauuacaaacaauggcugacagucaugcccgcugaggaaacuccucaucccuggcagaaguuucgcaccaaaccacagggggaccaggacacaggaaaggaggccgaugacgguugcgcacucggcgggcgguga

SEQ ID NO: 61335 - RNA, 4344 nt, Artificial Sequence
  derived and/or modified sequence opt3 from PTCH1__Homo_sapiens__NP_000255
auggccagcgcuggcaacgcagccgagccccaggacagagggggagguggcuccgggugcaucggagcgccuggcaggccagcuggugggggacggcgccgacguaccggcggccugagaagggccgcagccccggaucgggacuaccuccaccgccccucuuauugugaugcugcauucgcccuugaacaaauuucaaaggggaaagcuacaggaagaaaggccccucugugguugagggcgaaauuucagcgguuacuguucaagcuagguugcuacauacagaaaaauuguggcaaguuucucguggucgggcugcuuaucuucggagcauuugccguuggccugaaggcugccaacuuggagacuaauguggaagaacucuggguagaagugggugggcgcgucagucgagagcugaacuauacgagacagaaaauuggagaggaagcaauguucaauccacaacugaugauccagacccccaaggaggaaggcgcuaacgugcucacaacugaggccuuacugcagcaucuugacagcgcguugcaggccuccaggguucacguguacauguauaaucggcaauggaaacuggagcaucuaugcuacaagucuggcgaacucauuaccgagacaggguauauggaucagaucauagaauaccuguacccuugucuuaucauuaccccacuggacugcuuuugggagggagcaaaauugcagucggguacugcuuaucuccugggcaagcccccuuuacguuggacaaacuucgauccacuggaauuucucgaggagcuuaagaaaaucaauuaccaggucgacucaugggaagagaugcugaacaaggccgaaguggggcacggauauauggaucgcccguguuugaaucccgcugacccugauugcccagccaccgcacccaacaaaaauagcacgaagccucuagacauggcccugguacucaacggcgguugucaugggcugaguagaaaauacaugcacuggcaagaggaacuuauuguuggcggaacugugaaaaauuccaccggcaaacuggucucugcucacgcguugcagacaauguuccagcucaugacuccaaagcaaauguaugagcauuuuaagggguacgaguaugugagccacaucaacuggaacgaagauaaagcagccgcuauacuggaggccuggcagaggaccuacguggaagucguucaucaguccguggcacagaauagcacacaaaagguauuaaguuucaccacgacuacacuggacgacauucuaaagagcuuuucugauguguccgucauccggguggccucaggauaccuccugaugcuugcuuaugccugcuugaccaugcugcgaugggacuguagcaagagucagggugcaguuggccucgcgggggugcugcuugucgcucugucuguggccgcaggauugggccucugcucccugauugguaucagcuucaacgccgcuacuacacagguauuacccuuccuggcccuagggguuggcguggaugacgucuuucuccuggcacacgcuuucucggagaccggacagaauaaacgcaucccguuugaagauagaacgggcgagugccuuaagaggaccggggccucuguggcguugacauccauuucaaacgucacugccuucuuuauggcugcacugauaccuauccccgcccuccgggcuuucagucugcaagccgcagugguugugguauuuaauuucgcgauggucuuacugauuuuuccagccauccuuagcauggacuuguaccgcagagaggauaggcgucucgacauauucuguugcuuuaccuccccuugugugucucggguuauucagguggaaccccaggcuuauacagauacucacgacaacacccgauacagcccacccccuccauauucaagucauuccuucgcccacgagacacagaucaccaugcaaagcacuguccagcugagaacggaauacgauccgcauacacacguguauuacaccacugcagagcccaggucugagaucucaguacagccugugaccguuacacaggacacccuaaguugccaaagcccagaauccacuucuucgacacgcgaccugcucagccaguuuuccgauucaagucugcauugucuugagcccccuugcacgaaguggaccuugucuagcuucgcugaaaaacacuacgccccauuccuguuaaagcccaaagcaaaggucguggugauuuuucucuuccugggacuucugggugucuccuuguauggcacuacacggguuagagacgggcucgaucugaccgacaucgugccgagggagacacgcgaauacgauuuuauugccgcucaguucaaauauuuuucauucuacaauauguauauagugacucaaaaggcggacuacccuaacauccagcaccuacuguaugaucuccaucgaucauuuucuaauguaaaguacgucaugcuggaggagaacaaacagcuuccaaagaugugguugcacuacuuccgggacuggcugcagggauuacaagaugccuuugacuccgauugggaaaccggcaaaauuaugcccaauaacuauaagaaugguagugacgauggggugcucgcauacaaacugcuuguucagacgggcagccgugacaagccuaucgacaucucucagcugaccaagcagaggcuaguggaugcugacggaauuauaaaccccuccgccuucuauaucuaccucacagccugggucucaaaugauccaguggcuuaugcagccagucaagcgaacauuagaccucaucgccccgaguggguucacgacaaagcugauuacaugccagaaacucggcugagaaucccggccgcagagccuauugaauaugcccaguuucccuucuacuugaacggccugagggacaccagcgauuuuguggaggcuaucgagaagguacgaacaauauguucgaauuacacuuccuuagggcucucuagcuauccaaacggauaccccuuccuguucugggaacaguauaucggccuucgccacuggcuguugcucuuuauuucagucgugcuggcaugcaccuuccuagugugugccgucuuucugcuuaauccuuggacggcggguaucauuguuauggugcucgcucugaugacaguagaguuguucgggaugaugggacugaucggcauaaaauuaagugccgugccagucgugauucucaucgcauccguugguauuggcguggaauuuaccguccauguggcccuggcuuuccuuacugccaucggggacaagaaccggagagcaguucuggcuuuggagcacauguuugcccccgugcucgauggagcggucucuacacugcuaggcguacugaugcuugccgggagcgaguucgacuuuauagugagguacuucuuugcaguucucgcuauccugaccauuuugggaguguuaaauggccugguccuccugccugugcuucuguccuucuucgguccguauccagagguaucacccgccaacggguugaaucgucuaccuacuccaagccccgagccuccgcccagugugguccgcuuugcuaugccaccuggacauacccacucuggcuccgauagcucggacucagaauacucuagucagacaacgguuuccggucugagcgaggaacuccggcauuaugaggcacaacagggcgccgggggacccgcccaccaggugaucguggaggcuaccgaaaacccagucuucgcgcacucuacugugguucauccugagagcagacaccaucccccauccaauccgaggcaacagccucaccuggauucaggcagucuucccccagggcgacagggacagcaaccccggcgcgacccuccaagagaaggcuuauggcccccuccguacaggccacggcgagacgcauuugagauuagcacagaaggucauucugggcccuccaacagagcccgcuggggaccuaggggcgcucguucacacaauccccggaacccagccaguaccgcaauggguagcuccguaccuggcuacugccagcccaucacaacugugaccgccucugcuucggucacgguggcgguucacccaccuccggugcccgggccaggaagaaauccuaggggcgggcugugucccggauauccagagacagaucauggccucuucgaggacccucacguccccuuucaugugcgcugcgaacgaagagauagcaaaguagaggucauagaauugcaggacguggagugcgaggaacggccgagggguucauccaguaacuga

SEQ ID NO: 61336 - RNA, 2667 nt, Artificial Sequence
  derived and/or modified sequence opt3 from PTCHD1__Homo_sapiens__NP_775766
augcugagacaggugcuccacaggggccuucggaccugcuucagccgccuggggcauuuuaucgccucccaccccgucuucuuugcuucugcaccuguuuugauuucaauauuacugggagccaguuucagccgauaccaaguggaggaauccguagagcaucuacucgcgccacagcacucucuggcuaagaucgaacguaaccuugucaauucgcuguuuccggugaacagaucaaaacauagguuguauagcgaccuccagacacccggucgguacggccgcgugauuguuacgaguuuccagaaggccaauaugcuggaucaacaccacacggaccugauccucaaauuacaugcagccgugaccaagauucaggucccuagaccaggguuuaacuauacauucgcucacaucuguauacugaauaacgauaaaacuugcaucguggacgauauuguacauguucuugaggaauugaagaaugcaagggccaccaaccggacaaauuuugcuaucaccuaccccauuacucaccugaaggacggacgcgccguguauaacggccaccagcuagguggggucacagugcauuccaaagaucgagugaagucugcggaggcaauccagcucaccuacuaucugcaaagcauaaauucccuuaacgacauggucgccgagagaugggaaucaaguuucugugauacgguuaggcuguuucagaaaagcaauucuaaggugaaaauguacccuuacacuuccucaucuuugcgggaggacuuccagaagaccagucguguaucugaacgcuaucucgugacaucccugauuuuagucgugacuauggcuauccugugcuguagcaugcaggauugcguuagaucgaagccauggcucggacuucugggcuuggugaccauuucucuagccacacugaccgcagcuggcaucaucaaccucacugggggaaaauacaauuccacuuuucuggguguccccuucgugaugcuuggccacgggcuguauggaacauucgagauguugucaaguuggaggaagacccgggaggaccaacauguaaaagaacgaacugccgcgguuuacgccgauagcaugcucuccuuuucucugacaaccgcaauguauuuagugacguucggcauuggugcuagcccuuuuaccaacauagaggccgcucgcaucuucuguugcaacucauguauugccaucuuuuucaauuaccuguauguccuaaguuuuuacggguccagccucguguucacaggauacauagaaaacaauuaucagcacucuaucuuuugcagaaaggucccaaaaccggaggcacugcaggaaaagcccgccugguacagguuccuuuugacugcucgguuuucagaggacaccgcggagggcgaagaggcaaacacauaugaaagucaucugcucguguguuuccugaaacgcuacuauugcgacuggauuacuaauaccuacguuaagccuuuugugguacuuuucuaucugaucuacauuagcuucgccuugaugggcuaccuccaagucuccgaggggucugaucugucgaacaucguggcuacagccacccagacuauugaauauacgacagcacagcagaaguacuuuagcaauuauuccccaguuauaggauucuacaucuaugagucaauugaguacuggaacaccagugugcaagaagacgucuuagaguauacuaaagguuuugugagaaucucuugguucgaaagcuaccugaauuaccuaaggaagcucaacguauccaccggccugcccaaaaagaauuuuacagauaugcuucguaacucauucuugaaagccccucaguuuagccacuuccaggaggacaucauuuuuagcaagaaguauaaugaugaaguggacguugucgcuucccggauguuccugguggccaaaaccauggagacuaaccgagaggaacucuacgaucuguuagagacacugagaaggcuuagugugacgagcaaggucaaauuuauaguuuucaauccaucuuuuguguauauggaccgcuacgcauccucauugggggcgccccuccacaacaguugcaucagcgcucuguuccuacuguucuuuucggccuuccucguggcagauucccugauuaacguauggaucacccuuacugucgugucuguugaauuuggagugauuggcuucaugacauuguggaaggucgagcuggacuguaucagcguguuaugccucauauaugguaucaauuacaccauugauaacugugccccgaugcugucaacauuuguucuugggaaagacuucacucggaccaagugggugaagaaugcucuggagguacauggcgucgccaucuugcagaguuaucucugcuacauugugggacugaucccucuagcagcugugcccuccaaccugacguguacccucuuuagaugccuguuccuuauagccuuugucacauucuuucacuguuucgcgauuuugccaguuauccugacuuucuuaccucccucuaaaaagaaaaggaaggagaaaaagaauccagaaaaccgcgaagagauugaaugcguggagaugguagacaucgauagcacccgaguggucgaccaaauaacaacuguguga

SEQ ID NO: 61337 - RNA, 2541 nt, Artificial Sequence
  derived and/or modified sequence opt3 from PTCHD4__Homo_sapiens__NP_001013754
augugcuuccugagaaggcccggcgccccugcuagcuggaucugguggcggaugcuccgccaggugcuucgacgugggcugcaauccuuuugucacagauugggauuaugcgucucuaggcauccaguuuucuuucugaccgugccggcaguacuaacaauuacuuucggucucucagcccugaaccgguuucagcccgagggcgaccuugaacgccugguggcgccuagucacagcuuggcuaagauagagagaucccucgccucuucgcuguucccacuggaucagucaaaaagccagcucuacagugacuuacauacgcccgggagguauggacgggucauccugcuuuccccuaccggcgauaauauuuugcugcaagcagaagguauccuacagacacaccgcgccgugcucgagaugaaggacgggcgaaacucuuuuauuggacaucagcugggcggcguuguggaagucccaaauagcaaagaucagagagugaaguccgcuagggcaauccaaauaacuuacuaucuucagaccuacgggucagccacacaggaccugaucggagagaaaugggagaacgaguucuguaaguugauucggaagcuccaggaagaacaccaagagcugcaguuauauagucuggcuagcuuuucucucuggcgugauuuccacaaaaccuccauccuugcccgcucaaagguacugguuagcuuggugcuaauucugacuacagcgacccucaguucuuccaugaaagacugccugagaagcaagcccuuucuuggucuguugggcguccucacgguguguaucucgauaauuacugcagccgggaucuucuuuauuaccgauggaaaauacaauucuacacuguuaggcaucccuuucuucgcuaugggucaugggacuaagggaguguuugagcugcuauccggcuggaggcggaccaaggaaaaccucccauucaaagaccgaaucgccgaugcauauucagacgucaugguuacauacaccaugacgaguagccuguacuuuauuacuuucggcaugggggcuuccccguuuacaaauauagaggccgugaagguauucugccagaacaugugugugucuauccuuuugaauuauuuuuacauuuucagcuuuuucggaucaugccuggucuuugcgggucaacucgaacagaaccgcuaucacaguaucuucuguugcaaaauacccuccgccgaguaccuggauagaaagccugugugguuucagaccguuaugagcgacggccaucagcaaacuucucaccacgaaacaaauccauaucagcaucacuucauucagcauuuccuuagggagcacuacaacgaguggaucaccaauaucuaugugaaacccuuugucgugauucuguacuugaucuacgcaucauucaguuuuauggggugucuccagauuagcgacggagcuaacauaaucaaucuguuagccuccgauucuccuucgguaagcuaugcuaugguucaacagaaguacuucuccaacuauucaccagugauuggcuuuuacgucuaugaaccccuggaguacuggaacaguucugugcaggacgaucuacggcgccucugcagcgguuucacggccgucuccuggguggaacaguauuaccaauuucugaaaguuucaaaugugagcgcaaacaauaagucugacuucaucuccguacuucagaguagcuuuuugaagaaaccggaguuccagcauuuuagaaacgauaucauuuucucuaaggccggggacgaauccaauauaaucgcuucaaggcuguaccucgucgcgcguaccagucgggauaaacagaaggagauuacagaggugcuggaaaaauuacgaccucugagccuuucgaaguccaucagauuuauuguuuucaaccccucuuucguguuuauggaccacuauagcuugucagucacugugccaguacucaucgcaggcuucggagugcugcuaguucugauacucaccuuuuuccuggucauccacccucuuggcaauuuuugguugauucugagugugacauccaucgaguuaggggugcucggacugaugacucuuuggaacgucgauauggacugcauuucuauccuguguuugauauacacccucaauuucgccauugaucauugcgcuccccugcuauuuacauucguucuggccaccgaacacacuaggacgcaauguaucaagagcucccuccaggaccaugguacagcaauucugcagaacgugaccucauuucuuaucggcuuggugccacuguuauucguacccagcaaucucacuuuuacccuguucaaaugccuucugcuaacagggggauguacccuccugcacugcuucgucauauugccuguguuucugacuuucuuuccaccgaguaagaaacaccauaagaaaaagaagcgcgccaaacggaaggagagagaagagaucgaguguauugaaauccaagagaaccccgaccacguuacaacgguguga

SEQ ID NO: 61338 - RNA, 771 nt, Artificial Sequence
  derived and/or modified sequence opt3 from PTCRA__Homo_sapiens__NP_001230098
auggccggcaccuggcugcuccuucuguuggcuuuagggugccccgcacugccuacaggaccagugagcuucccguccucucccgaggccgcgacuacggguccuaucugguuuucagcuggcaacgggagugcccuagacgcauucaccuacggaccaagccccgccacagauggcacuuggaccaaucucgcucaccugucccuuccuucugaagaacuggcaucgugggaaccauuggucugucauacaggucccggggccgagggacacucaagaagcacccagccuaugcaucucaguggcgaggcuuccacugccaggacaugcccacaagagccgcugcggggcacccccgggggagcgcuguggcucgguguuuuacgccugcuuuuguuuaagcugcuacucuucgaccugcuucugacguguucuugcuugugugauccugcaggcccacuccccagcccugccacuaccacacgacugcgugcuuuagggucccacagacugcauccagccacugagaccggaggcagggaagcaacaucaaguccccggccgcagccucgcgacagaagguggggugauacgcccccagggcggaaaccuggaagccccguguggggcgagggcucuuaucucuccucauacccaaccugccccgcucaggccugguguagccgcagugcgcuucgagccccuucuuccagccugggggcauuuuucgcuggagacuugccaccgccccuacaggccggugcugccuga

SEQ ID NO: 61339 - RNA, 984 nt, Artificial Sequence
  derived and/or modified sequence opt3 from PTDSS1__Homo_sapiens__NP_001277154
auggaguacgccgugaacugccacgucaucaccugggaaagaauuauaagccauuucgacaucuuugcuuucggccacuuuugggggugggcaaugaaggcccugcucauuagguccuauggacuuuguuggacaaucucuauuacuugggagcugacggaauuguucuuuaugcauuuacugcccaauuucgcggagugcuggugggaucagguuauccuagacauacuccuguguaacgguggcgggaucuggcuuggaauggugguaugccgguuucuggaaaugcgcaccuaccacugggcuucauucaaagauauucauacaacuaccggcaagaucaaacgagccguguugcaauuuaccccugcaaguuggacauauguccguugguucgacccaaagagcuccuuucagagaguggccgguguuuaccucuucaugauuaucuggcagcugacugagcugaauacauuuuuccucaaacacauauucguguuucaggcuucucacccguuaucgugggggaggauucuguucaucggaggcauuaccgcacccacgguccggcaauauuacgccuaucuuacugauacccaguguaagcgcgugggcacacagugcuggguauuugggguuaucggauucuuggaggcuaucguguguauuaaguuuggucaggaccuguucucaaaaacucaaauacuauacgucgugcucuggcugcuuugcguggccuuuaccacauuccuguguuuguacggcaugaucugguaugcggaacauuacgggcacagagagaagaccuauagcgaaugcgaggauggaacguacaguccugagauuuccuggcaucacaggaaaggcacuaaggguucugaagacagcccacccaaacacgcagggaacaaugagucccauucaagucggcgccgaaacagacacagcaagucuaaggucacaaauggaguuggcaaaaaguga

SEQ ID NO: 61340 - RNA, 1212 nt, Artificial Sequence
  derived and/or modified sequence opt3 from PTEN__Homo_sapiens__NP_000305
augaccgccaucauuaaggagauagugagcagaaacaaaaggcgguaccaggaagacggcuucgaucuggaccucacauauaucuaccccaauauuaucgcuaugggguuuccugcagagcgccuugaaggagucuaucgaaacaauauugaugacguugugcguuuccuggauuccaagcacaaaaaccauuacaagaucuauaauuugugcgccgagagacacuacgacacugcgaaauuuaacuguaggguagcucaauauccauucgaagaucauaauccgccccaguuagagcugauaaagccuuuuugcgaggaccuagaucaguggcucucugaagacgauaaccacguggccgcaauccauuguaaggccgguaaaggccggacgggggucaugauuugcgcuuaccugcuucaccgcggaaaguuccugaaagcacaggaggccuuggacuuuuacggcgaagugagaaccagggauaagaaagguguuacaaucccaucacaacggcgcuauguguacuauuacaguuaucuccugaagaaucaccuggacuaccgacccgucgcucucuuauuccauaagaugauguuugagacuauuccuauguucagcgggggaaccuguaacccacaguuugugguaugccagcugaaaguuaagaucuauuccucuaauucgggccccacaagaagggaggacaaauucauguacuuugaguucccucagccacuuccgguguguggcgauauaaaggucgaguucuuucacaaacaaaacaagauguugaaaaaggacaagauguuccauuuuugggugaauaccuucuuuauucccgggccugaagagacuucagaaaaaguggagaacggaagccugugcgaucaggagaucgacaguauuuguuccaucgaacgggccgauaaugacaaggaguaccuaguccucacacugaccaaaaacgaucuugacaaggcgaacaaagauaaggcaaaucguuauuucucuccaaacuuuaagguuaaacuguacuucacgaagacuguggaagaacccagcaauccugaagccuccucaaguaccagcguaacaccagacgugucugauaacgagcccgaccacuaucgcuacuccgacacuaccgauucagacccggagaaugaaccuuuugaugaggaccagcacacacagaucaccaaagucuga

SEQ ID NO: 61341 - RNA, 909 nt, Artificial Sequence
  derived and/or modified sequence opt3 from PTER__Homo_sapiens__NP_001248766
augagcucccugucuggcaaggugcagaccguccucgggcuuguugagcccucaaaacugggaagaacauugacucacgaacauuuagccaugacguucgacugcuguuacugcccuccaccgcccugucaagaggcuaucaguaaggaaccuauugugaugaaaaaccuguauuggauacagaagaaugcauacagccacaaagagaaccuacagcucaaucaggaaaccgaggccaucaaggaggaacugcuuuauuuuaaggcgaacgguggcggggcucugguagagaauacaacuaccggaauuuccagggauacacaaaccuugaaacggcucgccgaagagacuggcgugcauaucauuucuggugcaggguucuacgucgacgccacacacucgucagagacccgcgcuaugagcguggaacagcugacggauguucugaugaacgagauccuccauggagcagacggcaccaguauaaagugcggcaucauuggggaaaucggauguuccuggccauuaacugagucugaacgaaaagugcugcaggccacagcucacgcccaggcgcaacuugguugccccgucauuauccacccuggccguagcuccagagcaccauuucagauaauuaggaucuugcaggaggccggggcugauauuucaaagacugugaugagucaucuggaccggguacgccuacucguugaggaaggaugugaggauagaauccugguggcccacgacauccauaccaaaacaaggcuuaugaaguauggcggucacggguacagccacauucugaccaaugucgugcccaagauguugcuccggggaauaacggaaaacgugcuggauaaaaucuuaauugagaauccuaagcaguggcugacuuucaaauga

SEQ ID NO: 61342 - RNA, 987 nt, Artificial Sequence
  derived and/or modified sequence opt3 from PTF1A__Homo_sapiens__NP_835455
auggacgccgugcugcucgagcacuuccccggcgggcuugaugcuuuuccuagcuccuacuucgacgaagaugacuuuuucaccgaucagucuucaagagacccacuggaggauggagacgaauuguuagcagaugagcaagccgaagucgaguuucugagucaucagcuacacgaguauugcuacagggacggugcgugucuccugcuucagccggcucccccugccgcaccacuggccuuggcucccccuagcuccggcgggcucggagaaccagaugacggcggugggggaggcuauugcugugagacaggcgcacccccugggggauucccauacucuccggguucgcccccuucaugccuggccuauccaugugcuggcgccgcgguucugagccccggggcacggcuccgcggauuaaguggcgccgcugccgcagcugcccgacguagaaggcgggugcgcuccgaagcggagcugcagcaacuuagacaggccgcaaacguaagggagcggcgccgaaugcagucuaucaaugaugcuuuugaagguuugagaagccauauuccuacucugccauacgagaagaggcuauccaaaguggacacgcuccggcuggccauaggguauaucaacuuccuuucagaacugguccaggcugacuugccccuccguggaggcggcgccgggggaugcgguggcccugggggaggcggucgcuuagggggcgauaguccgggaagccaagcacagaaggugauuaucugucacagaggcaccaggucucccuccccaucagacccugauuacgggcugcccccacuggccggacauagccucaguuggacagacgagaaacagcuuaaggaacagaauauuauccggacugcuaaaguuuggacccccgaggauccucgaaagcugaacucuaaguccagcuuuaauaacauagagaaugaaccaccguucgaguuugugucguga

SEQ ID NO: 61343 - RNA, 1188 nt, Artificial Sequence
  derived and/or modified sequence opt3 from PTGDR2__Homo_sapiens__NP_004769
augagcgccaacgcuacccugaagccccucugcccuauccuugagcagauguccagacugcaaucucacucaaauacaaguauuagguacauagaccaugcagccguguuguuacacggccuggcgagccuacucgggcuggucgaaaacggaguuauccuuuucgugguagguugucggaugcgccagacuguggucacgaccugggugcugcauuuggcucucuccgaucugcuggccucugcaucgcucccauuuuucacauauuuucuggccguuggccacucaugggagcuggggacuaccuucugcaaacuucauagcaguaucuuuuucuugaauauguuugcuuccggauuccugcuaucugcaauuagccucgaccgauguuuacaggugguccguccggugugggcccagaaccacagaacaguagcugccgcgcacaagguuugccuugugcugugggcauuggccguccucaauaccgugcccuacuuuguguucagggauacuauuucccggcuggacggccgcaucauguguuauuacaacgucuuacugcucaauccugguccagauagagacgcuacaugcaacucaaggcaaguugcccuugcagugaguaaauuucuguuggcuuuccuaguaccccuggccauaaucgcgagcucucaugccgcagugucccuccggcugcagcaccgcgggcgaagaaggccuggacgguuuguccgucuuguggcugccguuguggcugccuucgcacuguguuggggcccauaucaugucuucucauugcucgaagcccgcgcucacgcgaaucccggccugagaccuuuaguguggagggggcugccauuuguaaccagccuagcauucuuuaacaguguugccaauccggugcucuacguccugacgugccccgauaugcuucggaaguugcgacgcucucugagaacugugcucgaguccguccugguggacgauagcgaacuuggaggugcuggcucgucuaggcggcgcagaaccuccucaacagccaggagugcaagcccucuggccuuguguucccguccagaggagccccgggggccugcucgacuccugggaugguuacugggcucuugcgccgcaagcccacagacugguccccuaaacagagcgcucucaaguaccuccagcuga

SEQ ID NO: 61344 - RNA, 1080 nt, Artificial Sequence
  derived and/or modified sequence opt3 from PTGDR__Homo_sapiens__XP_005267948
augaaaagccccuucuacagaugccagaacaccacauccguggagaagggcaauucugccgucaugggagggguucuguuuucaacuggucuccuuggcaaccuguuggcuuuagggcugcuagcaaggaguggacucggcugguguagccggcgcccucugcgaccacuuccguccguguucuauaugcugguaugcgguuugacggugaccgaccuccuggggaagugucugcucucucccgucguguuagccgcguacgcucaaaaucguucgcugagaguucuugccccugcauuggauaacucacugugccaggccuuugcuuucuuuaugagcuucuuuggacuaaguuccacacuccagcugcuugcaauggcccuggaauguugguugucucucggccacccauucuuuuauaggcggcauaucacucugcgcuuaggcgcucugguggcccccgucgugagcgcguucucccucgcauuuugcgcccuuccuuucaugggguuuggaaaauucguacaguacuguccagguaccuggugcuucauucaaaugguucacgaggaaggcucacugaguguguugggguauagcguccuauacucuucccugauggcucuccuggugcuugccacagugcuguguaauuugggagcaaugagaaaccucuaugcuaugcauaggcggcugcagcgccacccccgaucaugcaccagagacugugccgagccuagggcggauggccgggaagccagcccacagccguuagaggagcuggaccaucuacuccugcuugcauugaugacuguccuguuuacaaugugcagucuccccguuauauaccgugcuuacuauggugccuucaaggaugugaaagaaaagaaucgcaccucugaggaagcugaggaccugagagcccuuagguuucuguccguaaucagcauuguggauccuuggaucuucauuaucuuucggucgccagucuuccgaauauuuuuccacaagaucuuuauucgccccuugagauacaggucucggugcuccaacucaacgaauauggagaguagccucuga

SEQ ID NO: 61345 - RNA, 573 nt, Artificial Sequence
  derived and/or modified sequence opt3 from PTGDS__Homo_sapiens__NP_000945
auggccacccaccauacacuguggaugggccucgcacuucuggggguguugggagacuuacaggcugcccccgaggcgcaagucagcguucagccuaacuuccagcaggauaaguuucuggguagaugguucuccgcuggccuagccucuaauucaaguuggcucagggagaaaaaggcagcccugagcaugugcaaauccgugguagcuccagcaacugacgggggacuuaaccugacgucuaccuuuuugcggaagaaucaaugugaaacacgcacuaugcuccugcagccggccggcucgcuggguucauacagcuaucgaaguccccacuggggguccaccuacucugugagcgucguggaaacagauuaugaccaguacgcucucuuauauucccagggaucaaaaggcccuggcgaggauuuccguauggccacccuguacaguagaacucaaacaccaagggcggaacuuaaggagaaguuuaccgcauucugcaaagcccagggguuuacggaggacacuaucguuuucuugccccagaccgauaaguguaugacagaacaguga

SEQ ID NO: 61346 - RNA, 1209 nt, Artificial Sequence
  derived and/or modified sequence opt3 from PTGER1__Homo_sapiens__NP_000946
augagccccugcggcccucugaaccucucccuugccggggaggcuaccacaugugcagccccaugggugccgaauacuucugcgguucccccuucaggagcuaguccagcccugcccaucuucagcaugacguugggugcagucuccaacuuacuggcccuagcucuccuggcacaggccgcuggcagacuuaggcggcgccgaucugccgcgaccuuucuguuguucguggcaucgcuccuggccacagaccuggcugggcacguaauuccuggagcccucguguuacgucuguacacugcaggcagagcuccagccgguggggcgugccauuuucuuggaggcuguauggucuucuuuggcuugugcccccugcuacucggguguggaauggccguggaaaggugcguuggugugacccggccucugcuucacgcagcucgcgucucaguggccagagcuaggcuggccuuggcagccguagcugcgguugcacucgccguggcucuguuaccacuggcccgggucggccgcuaugagcuccaauacccggggacaugguguuucauaggacuuggucccccuggcggguggcgacaggcacuguuggccggacuauuugcuagccugggccucguggcccugcuugcagcgcuggugugcaauaccuugaguggccucgcucuguuaagagccagguggcggcgucgcuccagaaggccacccccugcaucugggccagauagccggcgacgcuggggagcccauggucccagauccgcuucagccaguagcgcaucuuccaucgcuucagccagcacuuucuuuggcgggaguaggucuuccggaagcgcgcggcgcgccagagcucacgacgucgaaaugguuggccagcugguggguauuaugguagugucguguaucugcuggucuccgaugcuaguccucguggcacuggccguugggggcugguccucaacaagucuucagaggccuuuguuccuggcugugcgucucgccagcuggaaccaaauucuggaucccugggucuauauccuucugcggcaggcaguguugcgacagcuccugagauuacugccaccuagggcgggagccaagggcgggcccgcuggacuaggucucaccccauccgccugggaggcaucuagccugcgcucaagucggcauuccggccuuagccacuuuuga

SEQ ID NO: 61347 - RNA, 1077 nt, Artificial Sequence
  derived and/or modified sequence opt3 from PTGER2__Homo_sapiens__NP_000947
augggcaacgccagcaaugacucccagucugaggauugcgaaaccagacaauggcugcccccuggggagucaccagcuaucaguagcgugauguucuccgcaggaguccucgguaaccuuauugcccuggcguuguuagcuaggcgguggcgcggcgacguuggguguucugccggacgacguucgucacugagccuauuucacgugcucguaacagaacugguguucacugaucuucugggcacgugcuugauaaguccggucgugcucgcauccuacgccagaaaucagacccugguugcucuggcacccgagucuagggccuguacauauuuugcuuucgccaugaccuuuuucagccucgcgacuauguuaaugcuguuugcaauggcccuugaacgguacuuguccaucggucauccuuauuucuaccagcgcagagugucaaggagugggggacuggcuguccuaccagugauuuaugccguaagccuccuguuuugcucucuuccccuguuggacuacggccaguauguucaauacuguccuggcacauggugcuucauccggcacgggcgcaccgcauaccuccagcuguaugcuacuuuacugcuccuucugauuguguccgucuuggccuguaacuuuucagugauccuaaaucugauacgaaugcauagaaggagccggcguagucgcugcggaccaucucucgguuccggcagagggggacccggcgcgaggcggcgaggugagcgcgugagcauggccgaggaaacagaucaccugauccuucuggcaauuaugaccaucacguucgcugucuguucguugccuuuuacuauuuucgccuacaugaacgagaccucuuccagaaaggaaaaaugggaccuccaggcucugagguucuuaucaaucaauaguauaauugauccauggguuuuugccauccugcggccgcccgugcuacgccucaugagaagcguacugugcuguaggauuucccuucguacacaggacgcaacucaaaccucuugcagcacacagucagaugccaguaagcaggcugacuuguga

SEQ ID NO: 61348 - RNA, 1257 nt, Artificial Sequence
  derived and/or modified sequence opt3 from PTGER3__Homo_sapiens__XP_011540111
augaaggagaccagaggcuacgggggagacgcccccuucugcacaaggcugaaccacagcuauacugguaugugggcuccugaacgguccgcagaggcccgcggcaaucucacgcgaccaccggggucuggagaagauuguggcucagugagugucgcguuucccaucaccaugcuucugacagguuucguugggaacgcuuuggccauguuacuggugagccguuccuacagaaggcgggagucuaaacgcaagaaaucguuucuacucugcauuggauggcuggcacuuacugaccugguaggccaguugcucaccacaccuguggucauagugguuuaucugucaaagcaaagaugggaacauaucgauccaagcggcaggcuguguaccuucuuugggcucacuaugacaguguucggauuaaguucccuguuuauugccucugcuauggcagucgagcgggcccuugcuauccgcgcgccccacugguacgccagccauaugaaaacccgagcaacgagagccguguugcuggguguauggcuagcuguucucgccuucgcacugcuuccugugcugggcgucgggcaguauacugugcaguggccaggaaccuggugcuuuauuuccacaggcaggggugggaauggaacuucaaguagccacaacuggggcaauuuguucuuugcuucugccuucgcguuucucggccuguuagcccugaccgugacauucuccuguaaccucgcaaccaucaaggcucuugucucacggugccgugccaaggcuacggccagccagaguucugcacaaugggggcgcauaacuacagagaccgccauccagcugaugggaauuauguguguuuuguccgugugcuggagcccccuacugaucaugaugcucaaaaugauuuucaaucagacuucgguagaacauuguaagacacacaccgagaaacagaaggaaugcaacuuuuuccugaucgcugugagacuugcgucucugaaucaaauauuggacccuugggucuaccuccuguuaaggaaaauucugcuacggaaguuuugucagaugcgaaagcgcagacucagggagcaggcaccacugcuuccgacguccaccgugaucgaucccucacgguucugcgcccagccuuuucgcugguucuuggaccugaguuuuccagcuaugagcuccucucacccccaacucccucugacacuugccagcuucaaacuguugucaaaguga

SEQ ID NO: 61349 - RNA, 1467 nt, Artificial Sequence
  derived and/or modified sequence opt3 from PTGER4__Homo_sapiens__NP_000949
augagcacccccggcgugaacuccucugccucacugaguccugacagacucaauagcccagucacaaucccggcuguuauguucauuuuuggggugguaggaaaccuuguggcaauagucgugcugugcaaguccaggaaagagcagaaggaaacuacguucuacaccuugguuugugguuuagccgugacagaucugcuaggcacucuccuggucucucccgugaccaucgcgacauauaugaaagggcaauggccuggaggccagccacuuugcgaguacucgaccuuuauucuguuguucuuuucacucagcggucugaguaucauuugugcuauguccguagaacgguaucuggccaucaaucacgcauacuucuauucucauuacguugacaagcgccucgccggguuaacucuguuugcuguguaugcaagcaacguccuuuucugcgccuugcccaauaugggacugggcuccucacgacuacaguacccugauacaugguguuuuauagacuggaccacgaacgugacugcucacgccgcguacaguuauauguacgcaggcuucagcucuuuucucauccuggccaccgugcuuugcaauguccugguuuguggggcuuugcuccguaugcauagacaguucaugaggcggacaucccugggaacugagcaacaccaugccgcagcugccgcgucaguggccagccgcggucacccagcagcuagucccgccuuaccuagacugucugauuuuaggcggcgccgauccuucagaaggauugcuggcgccgaaauccagaugguaauucuccuuaucgcaaccagccugguggucuugauaugcucgauuccgcuagugguucggguguucgucaaccagcuguaucagccaucucucgagcgugagguguccaaaaaucccgaccugcaagccauccgcauugcuucaguaaacccuauccuugauccauggaucuacauucuguugagaaagacaguucucaguaaggcgauagagaaaaucaagugucuguuuugcaggauugggggaagccggcgagaacgcuccggccagcacuguucugacagccagagaaccucaagugcaauguccggucauagcaggucuuucaucucacgggaauuaaaagagauaaguagcacgucccagacucugcuacccgaucucucucugccugaccuuucggagaauggguugggaggccgcaaccugcucccaggcgugcccgggaugggacuggcccaagaagauacaaccagccuuagaacucugaggauuuccgagacaucagacaguucucagggucaggauagcgaauccgucuugcucguggacgaggcuggcgggucaggacgugccggcccggcaccuaaggguagcucucugcaagucaccuuucccuccgaaacguuaaaucugagugagaaaugcaucuga

SEQ ID NO: 61350 - RNA, 1134 nt, Artificial Sequence
  derived and/or modified sequence opt3 from PTGES2__Homo_sapiens__NP_079348
auggaccccgccgcuagaguggucagggcacuguggccuggcgggugcgcccucgcguggcggcuuggaggucgcccacagccgcuguugcccacccaaagccgagcuggcuucgccggggcagccggaggcccuuccccaguugcugcagcccguaaggguucucccagauuacugggggcugccgcgcuagcacucggaggcgcccugggccuuuaccacacagcuagguggcaucugcgggcccaggauuugcacgcagagcgcucagcugcccagcucagucugagcuccagacugcagcucacuuuauaucaauacaaaacguguccuuuuugcucuaaggugagggcguuccuggacuuucaugcccuuccauaucagguaguggaagucaaccccgugcggcgcgcagagaucaaauucucgucauaccgaaagguuccuauuuugguggcucaggaaggggagagcagucagcaacugaaugauuccucugucauaaucagcgcccuaaaaaccuaucucguguccggacagccacuggaagagauuaucacauacuauccggcuaugaaggccguaaacgagcaggguaaggaaguuacugaguuuggcaauaaauacuggcuuaugcugaacgaaaaggaggcacagcaaguguacgggggaaaagaggccagaaccgaagagaugaaguggaggcagugggcugacgauugguugguccaccucauuucacccaauguguaucggacaccuaccgaagcgcuggcaaguuucgacuacaucgugcgugagggcaaauuuggugccgucgaaggggcuguugccaaguauaugggagcagccgcuauguacuuaauaagcaagcgccugaaaucuagacauaggcuccaggauaacgugcgggaggaccuuuaugaggccgcagauaaguggguagcggcugugggcaaagaccgaccauucaugggcgggcaaaagcccaaucuggccgauuuggcagucuacggagugcuacgcguuauggaaggucuggacgccuuugaugaccucaugcagcacacucacauccagccuugguaucugagaguggagagggcuauuacagaagccuccccagcacauuga

SEQ ID NO: 61351 - RNA, 483 nt, Artificial Sequence
  derived and/or modified sequence opt3 from PTGES3__Homo_sapiens__NP_006592
augcagcccgccagcgcuaagugguacgacagaagggauuauguguucaucgaguuuugcgucgaagacuccaaagauguuaacgugaauuucgagaagucuaaacugaccuuuucaugucucggcgggagugacaacuucaagcaccuuaaugaaauugaucuguuucauugcauagacccuaacgauagcaaacacaagcggacagaccgcuccaucuuguguugcuuacgaaagggagagucuggucaaucguggccacgucugacuaaagaaagagcaaagcuaaauuggcucucaguagauuucaacaauuggaaagacugggaggaugacagcgaugaggacaugaguaacuuugacagguucuccgaaaugaugaauaacaugggcggggaugaggacguggaucugccggaagucgacggagccgaugacgauucucaggacagcgaugacgagaagaugcccgaucuugaguga

SEQ ID NO: 61352 - RNA, 459 nt, Artificial Sequence
  derived and/or modified sequence opt3 from PTGES__Homo_sapiens__NP_004869
augcccgcccacagccuggugauguccucuccugcucucccagcauuccuucugugcucaaccuuguuagucaucaagauguacguuguggccauuauaacaggccagguaagacugaggaaaaaggcguuugcuaacccggaggacgcccuacggcaugggggaccccaauauugucgcagugauccugacguggaacgaugccuccgugcacacagaaaugauauggagacuaucuacccauuccuguuucuugguuucgucuauagcuuucugggccccaacccuuucguggccuggaugcacuuuuugguuuuccucguggggagggucgcucauacgguggcauaccugggaaaacugcgggccccaauucgcuccguaaccuauacacucgcucaguuacccugugccucuauggcgcugcagauccuuugggaagcagccagacauuuguga

SEQ ID NO: 61353 - RNA, 1161 nt, Artificial Sequence
  derived and/or modified sequence opt3 from PTGIR__Homo_sapiens__NP_000951
auggccgacagcugcagaaaccugaccuacgugaggggcuccgucgggcccgcuacaucuacucucauguucguugcaggagugguagguaauggccuugcccuggggaucuugucagcgcggcgcccugcucgaccaagugccuuugcaguguuagucacgggacuggccgcuaccgaucuacucggcacuagcuuccuguccccggcaguguuuguugccuaugcucguaacucuucgcuucuggguuuggccagagggggacccgcgcucugugacgcauucgccuuugcuaugacauucuuuggccuggccucaaugcugauucucuucgcaauggcuguggagaggugcuuagcccugagccacccuuaccuuuaugcgcaguuggauggcccacggugugcccgccuggcacuacccgcuauauacgccuuuugcguccucuucugugcucugccucuucugggguugggacaacaucagcaguauugcccagguaguugguguuuucucagaaugaggugggcccagcccggcggggcagccuucucccuggcuuacgcgggauuaguggcacugcucguagccgcuaucuuucuuugcaauggcucuguuacccugagcuugugucggauguaucgccaacagaagcgacaccaggguucccuagggccuagaccaaggacaggagaagacgagguggaucaucugauucuccuggcccuuaugaccgucgugauggcagugugcucacugccguugacuauccgguguuucacacaggccgucgcucccgacaguagcucugaaaugggcgaucuccuggccuuccguuuuuacgcauucaacccuauuuuagacccauggguuuuuauccuguuccgcaaagcgguguuucaaagacuaaagcucuggguaugcugccugugucuuggccccgcucacggggauucccagaccccuuugucacagcuggccagcggaaggcgggacccacgagcacccagugccccgguggguaaagagggcucuugcgucccucucuccgcuuggggagaaggccagguggagccccugccaccuacgcaacagagcucggggucugccguugguacuuccucaaaggcagaggcuaguguggccuguagccuuugcuga

SEQ ID NO: 61354 - RNA, 1503 nt, Artificial Sequence
  derived and/or modified sequence opt3 from PTGIS__Homo_sapiens__NP_000952
auggccugggcugcacugcucggccuucuggccgcguuguuacugcuacuccugcuuagcagaaggcggacccgccgacccggggagccuccacuggacuugggauccaucccguggcucgguuacgcucuggauuucggcaaggacgccgcaucuuuucugacacguaugaaagaaaagcacggggauauuuucacuauacucgugggaggcagauaugucacgguuuuacuggacccccauucauacgaugccgugguaugggagccuaggacccggcuugacuuucacgcuuaugcaaucuucuugauggaacgcauuuuugaugugcagcugccacauuacagucccagcgacgagaaagccagaaugaagcuaacacuccugcacagggaacuucaagcucugacugaggccauguauaccaacuugcaugcgguccuccugggugaugcaacagaggccggguccggauggcacgaaaugggcuuacuggacuucucuuacucguuucuccuucgggcuggcuaucugaccuuguacgggaucgaggcccuaccucgcacucacgaaucacaggcacaggaucgagugcauagcgcugacguuuuccacacauuuagacagcuggauaggcuccugccaaaacuugcccggggaagucuguccgugggugacaaggaccauaugugcucugucaagagccguuuguggaaacuccugucccccgcgcgcuuagccagaagggcacaccggucaaaguggcuggagaguuaccuacuccaccuggaggaaaugggcgugagcgaggaaaugcaagcucgagcccuuguauugcagcugugggcuacccaggggaauaugggaccugccgcauucuggcuccugcuuuuucuguugaaaaacccagaggcccucgcugcgguucgcggcgaacuggagucuauuuuauggcaggcagagcaaccggugucccagacgacuacccugccccagaagguccuagauucaacaccugugcucgacagcgugcugagugaaucucuuagauugacugccgcuccauucaucaccagggaggucguuguggaucuggccaugcccauggcagacggucgggaauuuaaucuccgcagaggggauaggcuguuacuguucccuuuccuuuccccacagcgugaccccgagauauauacagauccggaaguauuuaaauacaaccgguucuugaauccugacggaagcgagaagaaggauuuuuauaaagacggcaagcgacucaaaaacuacaauaugcccuggggcgccgggcauaaccacugucugggaagaucguaugcugucaauucuaucaagcaauucguguuucuagugcugguucaucucgaucuggagcuuauuaacgccgacguggaaaucccagaguucgacuuguccagguacgguuuuggccugaugcagccugaacacgauguccccgugcgcuaucggauuagaccauga

SEQ ID NO: 61355 - RNA, 906 nt, Artificial Sequence
  derived and/or modified sequence opt3 from PTGR1__Homo_sapiens__NP_001139581
auggugagaaccaagacauggacucugaaaaagcacuucgucggcuaccccacgaacagcgacuuugagcucaaaaccgccgaacuuccuccacugaagaauggggagguuuuguuagaagcucuguuccuaacaguggauccguauaugaggguagcagccaaacggcucaaggagggagacacuaugaugggucagcaaguggcgaaggucguggaauccaaaaacguugcucugcccaagggcaccaucgugcuugccucuccuggguggacaacccauucaauuagugauggaaaagaccuggagaaguugcucacugaguggccagauacaauaccccugagccuggcacucggcaccgucgguaugccuggguuaacggccuacuuuggacugcuugaaaucugcggcgugaaaggcggggagacuguaaugguuaaugcugcagccggagcuguggguuccgucgugggccagauugccaaguugaagggguguaaaguggucggagcgguuggcucugacgaaaagguggcauaucugcagaaacuagguuucgauguaguguuuaacuacaagaccgucgagucgcucgaggaaacacugaaaaaggccucaccagacggguaugauugcuacuucgacaaugugggaggcgaguuuagcaacacuguuaucggccagaugaaaaaguucgggcgcauugcuaucuguggagccauaaguaccuauaaucgaacagguccccuuccuccaggcccgcccccugaaaucgugauuuaccaagagcugcguauggaagcauuugucguguacagauggcagggggaugcuaggcagaaggccuugaaagaccuccugaaguggguauuagagaucaaacgggagaacgaagaggauuga

SEQ ID NO: 61356 - RNA, 1800 nt, Artificial Sequence
  derived and/or modified sequence opt3 from PTGS1__Homo_sapiens__NP_000953
augagcagaucccugcuccuuugguuccuguuguuuuuacugcuacugcccccucucccagugcuucuggccgacccgggcgcucccaccccugucaacccaugcuguuacuaucccugccagcaccaagggaucuguguuagguucggauuggaucgguaccagugcgacuguacacgcacugguuauucuggcccuaauugcacgauuccagggcucuggaccuggcugcgaaacucacugcgucccaguccuagcuuuacacauuuccucuuaacucacggaagaugguuuugggaguucgugaaugcaaccuuuauaagggaaaugcugaugcggcuuguauugacagugcgcuccaaccugaucccaucuccgcccaccuacaauucggcccaugauuauauuucaugggagagcuucaguaacgucuccuacuauacuagaauccuaccuucugugccaaaggacugucccacaccuaugggcaccaaagguaagaaacagcucccagaugcgcagcugcuugcuaggcgguuucuguugcgccgaaaguucauucccgacccgcaagggacgaaucucauguuugccuucuuugcacagcacuucacucaucaguucuuuaaaaccagcggaaagaugggcccuggcuucacaaaggcccuggggcacggaguugauuuaggucacaucuacggcgacaaccuggaaagacaguaccaacucaggcuuuuuaaagaugggaagcugaaauaucagguguuggacggagagauguaucccccauccgucgaagaggcuccugugcuaaugcauuacccccggggcauaccaccccagucacagauggcaguaggucaagagguuuucgggcugcucccuggacugaugcuuuacgccacucugugguugcgugaacacaaucgcgugugcgaucuccugaaggcugagcauccaaccuggggcgacgaacaguuauuucagacaaccagacugauccuaauuggcgagacgaucaaaauugucaucgaggaauaugugcaacagcucaguggguacuuccugcagcuuaaguuugauccggaguugcuguucggagugcaguuucaauauaggaaccggauagccauggaguucaaucaccucuaccacuggcauccccugaugccugacagcuuuaaggucgguucucaggaauacuccuaugaacaguuccuuuuuaacacuucaaugcugguugacuacggcguggaggcguugguagaugcauucagccgacagauugccgggcgcaucggaggcgguagaaauauggaccaccauauucuccacguggcugucgaugugaucagggagagucgggaaaugcgccugcaaccauucaacgaguauagaaaaagguuugggaugaagcccuacacaucuuuccaggaauuaguuggcgagaaagaaauggccgcagagcuggaggaacuauauggagacaucgaugcucucgaguuuuacccuggccugcuuuuggaaaagugucauccaaauuccauuuucggggagagcaugauagaaaucggagcccccuuuucgcugaaaggucuccugggcaacccgauuugcucuccugaguauuggaagccauccaccuucgggggagaggugggcuuuaacaucgucaaaacugcgacauuaaagaagcuggugugucuuaauaccaaaacgugccccuacguaucauuccguguuccugacgccagucaggaugacggucccgcaguggaacggccaagcaccgaguuguga

SEQ ID NO: 61357 - RNA, 1815 nt, Artificial Sequence
  derived and/or modified sequence opt3 from PTGS2__Homo_sapiens__NP_000954
augcuggccagagcucuccuucugugcgcaguguuggccuuaagccacaccgcgaaccccuguugcucccauccuugucagaauaggggcgucugcaugucuguuggguucgaccaauacaagugugauugcacacggacuggauuuuauggugagaacuguucaacgccagaguuccugacccgcaucaaacuauuucucaagccgacacccaauacugugcacuacauucugacccauuucaaaggcuuuuggaacguagugaauaacauaccuuuccuucgaaaugcuaucaugaguuauguccugacaagccguucccacuugauugacucuccacccaccuacaacgccgauuauggguacaagucgugggaggcauuuucaaaucucagcuauuacacuagagcccugccuccagugcccgacgauugcccuacaccacugggaguuaaaggcaagaagcagcucccggacaguaacgaaaucguggagaaauuacugcuuaggcggaaguucauucccgauccucaggguuccaauaugauguuugcuuucuuugcacagcauuucacccaccaauuuuucaaaacggaccacaagcgcgggccagccuucacuaacggauugggccauggcgucgaucugaaucacaucuacggggaaacccuagcuagacagaggaaacuccggcuguuuaaggacggaaagaugaaauaucagauaaucgauggugagauguaucccccuacagugaaggacacucaggccgagaugauuuacccaccccaaguaccggaacaucuucgcuucgcgguuggccaggagguguuugggcuggucccuggauugaugauguacgcaaccaucuggcuccgagaacacaacagagugugugaugugcugaaacaggagcaccccgaguggggcgacgaacaguuauuccaaacaucuaggcugauucucaucggugagaccauaaagauugucaucgaagacuauguucagcaucuuagcggguaccacuuuaaacugaaguucgauccagaguugcuauuuaauaaacaguuccaauaucagaaccggauugccgcugaauuuaacacgcuguaccauuggcacccucuccugcccgacacuuuccagauccaugaucagaaguacaauuaucaacaguuuaucuacaacaauuccauucuucuggagcacggaauaacacaguucguggagucauuuacccgucagaucgccggccgcguagcaggcgggagaaacgugccacccgcuguccaaaaggugagucaggccagcauugaccagucuaggcagaugaaauaucaauccuucaaugaauaccggaagcgauucauguugaaaccuuaugagucauuugaagaacucacuggagaaaaggagaugagcgcggagcuggaagccuuauacggugauaucgacgcaguugagcuguauccagcucuacucguggaaaaaccgcgccccgaugccauauucggcgagacaauggucgaagugggggcuccuuuuagucugaagggacuuaugggcaacguaauuugcucuccagccuacuggaagcccuccaccuucgguggggagguuggcuuucagaucaucaauacggcaagcauucagucguugaucuguaacaaugugaaaggaugcccuuucaccucuuuuuccgucccagaccccgagcugauuaagacagugacuauaaacgccucaaguagcagauccggccucgaugacaucaauccgaccguccugcuuaaagaaaggucuacagagcuguga

SEQ ID NO: 61358 - RNA, 1782 nt, Artificial Sequence
  derived and/or modified sequence opt3 from PTH1R__Homo_sapiens__NP_000307
augggcaccgccagaaucgcucccgggcuggcacuccuucugugcuguccuguguugagcuccgccuacgcguuagucgacgcugaugacguuaugacaaaggaggaacagauuuuccugcuacacagggcccaagcacagugcgagaaacggcucaaggaagugcugcagcgcccagccucuauaauggagucagauaaaggauggacgagugcuagcacuuccgguaagccgcgaaaagacaaggcaucuggcaaacuuuaucccgaaucggaggaggauaaagaagccccuaccgggucacguuacagaggaaggccaugucugcccgagugggaccauaucuugugcuggccucucggcgcuccaggugaaguaguggccguccccuguccugauuauauuuacgacuuuaaccacaaggggcaugcguaucggcgcugcgauagaaauggaagcugggagcuggugccaggccacaacaggacaugggcaaauuacagugaguguguuaaauuccugacuaacgaaacccgggagcgcgaaguguuugaccgacucggcaugaucuauacagucggguacuccgugucuuuagccagccugaccguagcuguucuuauuuuggccuacuucagaaggcugcauugcacucggaauuauauccacaugcaccuauuucucuccuucaugcugcgugcagugucaauauuugucaaggaugcugugcuuuacaguggagccacacuggacgaggcggaacgcuugaccgaggaggaacucagagccaucgcacaggcuccgcccccuccagccacggcugccgcagguuaugccggcuguaggguggcugucacuuucuuucuguacuucuuagcgaccaacuauuacuggauucugguugaggggcucuaucuucauagccugaucuuuauggcauucuuuucugaaaagaaguacuuguggggauucacaguguucggcuggggucuacccgccguauuuguggcugucuggguguccguucgggccacucuggcaaauaccgggugcugggaucucucaagcggaaacaagaaauggauuauccaagugccuauacuggccaguauuguccuuaauuucauccuguuuauuaacaucgugcgaguauuggcuacaaagcuccgcgagaccaaugccggcagaugugacacgaggcagcaguaccggaaacuguuaaagucuacucugguucuaaugccacucuucggcgugcacuauaucgucuuuauggcaacacccuacaccgaaguguccgggacucuguggcagguccaaaugcauuaugagaugcuuuucaacagcuuucagggauucuuuguggcgauuauauacugcuucugcaauggugagguucaggcugaaaucaaaaagucguggucucgcuggacauuggcccuggacuuuaaaagaaaggcaagguccggcucaaguagcuauuccuacgggccgauggugucucacaccagcguaacgaacgucggaccucgugugggccucggucugccccuuucaccacggcuguugccuaccgccacaacuaaugggcacccccagcucccaggccaugcuaagcccggaaccccugcccuggagacauuagaaacuaccccaccggcaauggcugcccccaaagaugacggcuuccugaacgggaguuguuccggacuagaugaggaagcgagcgguccugagcgaccacccgcccuccugcaagaggaaugggagacaguuauguga

SEQ ID NO: 61359 - RNA, 303 nt, Artificial Sequence
  derived and/or modified sequence opt3 from PTH2__Homo_sapiens__NP_848544
auggagaccagacaggugagcaggucuccccggguccgccugcuccuucuguuguuacugcuacucguugugccuuggggcguacgaacagccuccgggguggcucugccaccggucggagugcuuucacugcgucccccugguagagcaugggccgacccagcgacucccaggccucggcgcaguuuggcucucgccgaugacgcagccuucagagaaagggcucggcugcuggcagcccucgagcgccgacacugguuaaacagcuacaugcauaagcugcuuguuuuggaugcuccauga

SEQ ID NO: 61360 - RNA, 1653 nt, Artificial Sequence
  derived and/or modified sequence opt3 from PTH2R__Homo_sapiens__NP_005039
auggccggccugggggcuagccuccacguguggggauggcuuaugcuggguuccugcuuguuagcaagagcccagcuggacucugauggcaccaucacaauugaggaacaaauaguccuaguucucaaggcgaaagugcagugugagcugaacaucacugcucagcuucaggaaggggagggaaauugcuuccccgaaugggacggccugauuuguuggccuagggguacgguagggaagaucucagccgugccaugcccgcccuacauuuaugauuuuaaccauaaaggagucgcauuccggcacuguaauccuaacggcaccugggacuuuaugcauaguuugaauaagacaugggccaacuacagcgauugccuccgcuuccugcaaccagacaucuccauaggcaaacaggaguuuuucgagcgacuguaugugauguacacuguuggguauucuaucucguuuggaucacucgcuguggcaauuuuaaucauugguuacuuccguagacugcacuguaccaggaauuauauccauaugcaccuuuuugucagcuucauguugcgggccacaaguauauuugugaaggaucgcguaguucacgcucauauuggcgugaaggaacuggagucccuaaucaugcaggacgauccccagaacucuauugaagccaccagcgucgacaaaucccaauacaucgggugcaagaucgcgguggugauguucauuuacuuucucgcaacuaauuauuacuggauacuggucgagggacuuuaucugcacaacuugaucuucguugccuucuuuucagauacaaaauaccucuggggcuucauucugaucgguuggggguuuccugcugccuucguggcagcuugggccguagcgagagccaccuuagcagacgcuagguguugggagcugagugccggagauauaaaguggauuuaucaggcuccaauccucgccgcaaucggccuuaauuuuauucuguucuugaacacggugcggguccuagccacuaaaaucugggaaaccaaugcugugggccaugacacacgcaagcaguaccgaaagcuggcgaaaagcacucucguucuggugcuugucuuuggggugcacuauauuguauucguuugccugccccacucuuuuaccggauuggguugggagauaagaaugcauugugaacucuucuuuaacuccuuccagggcuuuuucgugucaaucauuuacugcuacugcaauggggagguccaagcagaagugaagaaaauguggaguagguggaaccugagcgucgacuggaagcggacaccuccauguggaucucgucgcugcggcuccguguuaaccacgguuacucacagcacaucgucucagucccagguggccgcuucaaccagaaugguacugaucagugguaaagccgcaaagaucgccagcaggcaaccggauucccauauuacucuacccggguaugucuggucuaacagcgagcaggacugucucccucacucauuccaugaggaaacaaaagaggauaguggccggcagggagacgauauacugauggaaaagccaucccgacccauggagagcaauccugacaccgaaggcugccagggggagacggaggaugugcuuuga

SEQ ID NO: 61361 - RNA, 348 nt, Artificial Sequence
  derived and/or modified sequence opt3 from PTH__Homo_sapiens__NP_000306
augauccccgccaaggacauggcuaaagugaugauugucaugcuggcaauaugcuuccucaccaagagcgauggcaaauccguuaagaaaagaucugugucagagauccagcuuaugcacaaccuggggaagcauuugaauaguauggaaaggguagagugguuacggaagaaacugcaagacgugcacaacuuugucgcccuaggagcgccucucgcuccacgcgaugccgguagccagcgaccgcguaagaaagaagacaaugugcugguugagucccaugaaaagucucuuggcgaggcagauaaagccgacgugaacguccugacaaaggcuaagucgcaguga

SEQ ID NO: 61362 - RNA, 528 nt, Artificial Sequence
  derived and/or modified sequence opt3 from PTHLH__Homo_sapiens__NP_945315
augcagagaaggcuggugcaacaguggagcgucgccguuuuccuccuuagcuacgcugugcccucuugcggccggucaguagaggggcugagucgccgauugaagcgugcagugagcgaacaccaguuacugcaugacaaaggaaaguccauccaggaucuaagaaggcgguuuuuccuccaccaucugauugccgagauacacaccgcggaaauccgcgcuacaucugaggucucgccuaacucaaaaccaagcccgaauacuaagaaccaucccgugagauuugguagugacgaugaaggcagguaucuuacgcaagagaccaauaaaguugagacauacaaggaacagccucugaagacuccagggaaaaagaaaaagggaaaacccggcaagcggaaggagcaggagaaaaagaaacgccgaaccagauccgccugguuggacucuggugugacagggagcggacucgaaggcgaucaccuguccgacaccucaacuacaagucuggagcucgauuccagguga

SEQ ID NO: 61363 - RNA, 2904 nt, Artificial Sequence
  derived and/or modified sequence opt3 from PTK2B__Homo_sapiens__NP_775267
augagcggcguguccgagccccugucuagagucaagcucgggacccuuaggcggccugaaggaccagccgagccgaugguugugguacccguggacgucgaaaaagaggaugugcgcauccugaagguuugcuucuacucaaacaguuuuaauccugguaaaaacuucaaguuggugaaauguacaguccagacugaaauucgagagauaaucacgagcauuuuacuguccggccguaucgggccaaauauuagacuagcugagugcuauggacucaggcugaagcacaugaagucugacgaaauccauuggcuucacccccaaaugaccgugggcgagguacaggauaaauacgaaugucugcauguugaggcagaguggcgguaugacuugcagauacgcuaccucccugaagauuuuauggagucgcugaaggaagacagaacaacucugcucuauuucuaccagcaauuaaggaacgauuauaugcagcgguacgccucaaaagugagcgaggguauggcgcugcagcuugggugcuuggaacugcgccgauuuuucaaggacaugccacacaaugcucuagauaaaaagaguaacuuugagcuccuggagaaggaagucggacuugaccuguucuuucccaaacagaugcaagagaauuugaagccuaaacaguucagaaagaugauccagcagaccuuucaacaguacgccucccucagggaagaggaaugugugaugaaauucuuuaacacacuggcaggcuucgccaauauugaucaggagaccuaucggugcgaguuaauccaaggcuggaacauuacuguggaccuggucaucgggccaaagggaauacgucagcucacaucucaggaugcuaaaccgaccugucuugcagaguucaagcagauucgcagcaucagaugccugcccuuggaggaaggucaagccguucuacagcugggcauugagggggcuccucaggcccucuccaucaagacgucaagucuggcggaagcagagaauauggccgaccuuaucgacggauacuguaggcugcagggcgagcaucaagguagcuugauuauacacccacggaaagauggggaaaagcgaaacucucucccccagaucccuaugcugaauuuagaggcucgcagaucccaccugucagaaagcugcaguauugagucugacaucuaugccgagauaccagaugaaacucuaaggcggcccggaggcccgcaguacggcauugcacgcgaggacgugguacucaacagaauccugggggaaggauuuuucggugagguguaugaaggcgucuacaccaaucauaaaggggagaagaucaacguggcuguuaaaacauguaagaaggauugcacucuugacaacaaagagaaguuuauguccgaagccgugauuaugaaaaauuuggaucacccucauaucgucaagcugauuggaauaaucgaggaagaacccaccuggauuaucauggaacucuauccauacggcgagcugggucacuaccuugagaggaacaaaaauagccugaagguguugacacucguacuguauucguuacagaucugcaaggcgauggccuaccuggaaucuauuaacuguguucaccgugacauagcagugcggaauauccuagucgcuuccccugagugcgugaaacucggggauuucggccugucacgauauauugaagacgaggauuacuauaaggccagugucaccagacuucccaucaaauggaugagcccagaauccauuaacuuuaggcgcuucacgacugcuucugacguguggauguuugccguuuguaugugggagaucuugagcuucggaaagcaacccuuuuucuggcuggagaauaaagacgugauaggcguacucgaaaagggggaucggcugccuaagccagacuuaugcccgcccguccuguacacacuuaugaccagauguugggauuaugacccuucagauaggccacgcuuuacugaguuggugugcagucucuccgacguuuaccagauggaaaaagauaucgcaauggagcaggagcgaaacgcccgguaccguacacccaagauucuggaaccuaccgcuuuccaggagccacccccgaaaccuagcagaccaaaguauaggcccccuccccaaacgaaucuacuggcgccaaaacuccaguuucaggaagaggacuucauccaaccuucuucacgcgaagaggcacagcagcugugggaggccgaaaaggugaaaaugcggcagauucuugauaagcaacagaagcagauggucgaggacuaccagugguugagacaagaagagaaaagucuggaucccaugguguauaugaacgacaagagcccauuaaccccggaaaaagagguaggauaccucgaguucacagguccuccccagaagccacccaggcugggcgcucaguccauccagccuacugccaaucuugaucgaaccgacgaccugguguauuugaacguuauggaacucguccgcgcagugcuggagcugaaaaaugaacuaugucaacucccacccgagggguacguggucguugugaagaacgugggacugacacuucggaaguugauaggcucuguagaugaccuguuaccuucgcucccgagcuccucaagaacugaaauugaggguacccagaaacugcuuaauaaggaucuggccgagcuaaucaacaaaaugaggcucgcucagcaaaacgccgucacaagucugucugaagagugcaagcgucagauguugaccgcaagccauacucuggcgguggacgcuaaaaauuuacucgaugccguugaccaggcaaaggugcuggccaaccuugcucacccacccgccgaauga

SEQ ID NO: 61364 - RNA, 3198 nt, Artificial Sequence
  derived and/or modified sequence opt3 from PTK2__Homo_sapiens__NP_001186578
auggccgcugcauaccuggaccccaaccucaaucacaccccuaacagcuccacaaagacucaucuuggcacggggauggagagaucuccaggagccauggaaagggugcugaaagucuuccacuauuuugagucaaauagugaaccgaccacaugggcgagcaucauucggcauggugaugcuacugacguucgcggcauaauccagaagauuguggauucccacaaaguaaagcauguggccugcuacggguuccgauugucucacuuacguucggaggaaguccacuggcugcauguggacaugggaguuucaagcgugagagagaaauaugagcuagcacaucccccugaagaguggaaguacgaacucaggauccgguaucugccaaagggcuuucuuaaccaauucaccgaggauaaacccacacugaacuuuuucuaccagcaggucaagagugacuauauguuggagauugccgaucagguggaccaagaaaucgcucucaaacuggguugucuggagauacgcagauccuacugggaaaugagggggaaugcacucgagaagaaaucuaauuacgaaguauuagagaaggauguuggacugaagcgguuuuucccuaaaagccuuuuggacuccgugaaggccaaaacccugcgcaagcuaauccagcagacuuuucgacaguucgcuaaccucaauagagaggaaucaauucugaaauuuuucgagauccuuaguccagucuauagguuugauaaggaaugcuucaaaugugcccugggcagcucuuggauuaucuccguggaguuggcgauaggccccgaagaggggauuucauaccucacagacaagggaugcaacccuacccaccuggcagauuucacgcaagugcagacuauccaguauagcaauagugaggacaaggaccggaaagguauguuacagcugaagauugccggcgcuccagaaccgcucaccgucacagcccccucucuuacuaucgcagagaacauggcugaucugaucgacggguacugucguuugguuaauggaaccucccagagcuuuauuauacgcccucagaaagaaggcgagagagcccuaccaucgauccccaagcuggcgaacucugaaaaacaggguaugaggacacacgccguguccguaucagagaccgaugacuaugcagagauuaucgaugaagaggacacguacacuaugccuaguacacgggauuaugaaauacaacgagagcgcauugagcucgggagaugcaucggagaaggccaguucggcgacgugcaccaggggaucuacaugagcccagagaaucccgcucuggccgucgcuauuaagaccuguaagaacugcacuuccgauucugugagggaaaaauuucuucaggaggcccugacaaugcggcaauucgaccauccgcacaucguuaaguugauuggagugauaaccgaaaacccugucuggaucauuauggagcucuguacgcugggugaguuacgcagcuuucugcaagugagaaaauacucacuagaucucgcaagucugauccuuuaugccuaccaguuguccaccgcucuggcguaucucgaaagcaagagguucguacaucgugacaucgcagcccggaauguucuggugucuucaaacgacugcgucaaacuuggcgauuuugggcugagucgauacauggaggacagcacauauuacaaggcuuccaagggaaaauugcccauuaaguggauggccccagaaucuauaaauuucagaagguuuacuucggcaagcgauguguggauguucggcgucuguaugugggagauccucaugcacggugugaaaccuuuucaggggguuaagaacaaugacgugauuggccgcaucgaaaacggagagcggcugcccaugccacccaauugcccuccaaccuuauauucccugaugacaaaaugcugggccuacgauccgucaagaaggccccgcuucacugagcuaaaggcucaacucaguaccauucuggaagaggaaaaggcccagcaggaggaacgaaugcggauggagucucguagacaggcaacaguaagcugggacuccggcgggucagaugaggcgccuccaaaacccagcaggccuggauacccaucuccccgcuccagugaagguuuuuauccgagcccucaacauaugguccagaccaaccacuaccaggugucuggcuauccagggucccacggaaucacugcuauggccggcucaauauaccccggucaggcaagucuuuuggaccaaacggauagcuggaaucaucggccucaggagaucgccauguggcagcccaacguugaagacucgacagugcuggaucucagagggauuggccaaguccugccaacccacuuaauggaggagaggcugauccgacagcagcaggaaauggaggaagaccaacgcuggcuugagaaggaggaacgguucuugaaaccugaugugagacucuccaggggaucuauugaccgugaggacggcagccugcaggggcccaucggaaaucagcauauauaucagccaguagguaagccgggcaaagaagagaagaacugggcugaacgcaauccugccgcacccccaaagaaacccccucggccaggggcucccggacaccuaggcucacuggccagucucuccucuccugcggauagcuacaacgagggugugaagccguggagacugcaaccacaggaaauuucacccccuccaacugccaaucuugacagguccaacgauaaaguuuaugagaacgucaccggguuggugaaggcugugaucgagaugagcaguaaaauucagcccgcaccuccggaagaguacguccccaugguuaaggaagugggccuggccuuacgaacacuccuggcuaccguggacgagacuaucccacuucugccugccucuacacaccgggaaauagagauggcacagaaauugcucaauuccgaucugggagagcuaaucaacaagaugaagcuggcgcaacaguacguaaugacgagccuccagcaagaauauaaaaagcagaugcugaccgccgcucaugcccuugcagucgacgcuaaaaauuugcuggaugugauugaccaggcccgcuuaaagaugcucggccagacuagaccccacuga

SEQ ID NO: 61365 - RNA, 405 nt, Artificial Sequence
  derived and/or modified sequence opt3 from PTK6__Homo_sapiens__NP_001243287
auggugagcagagaccaggcccaccugggccccaaguacgucgggcucugggauuucaaauccaggaccgacgaggaacuuucuuuucgggcuggagauguuuuccauguggcacgcaaggaggaacaaugguggugggccacacuguuggacgaggcggguggcgcuguagcccagggguaugugccucacaacuacuuagcagaacgagagacugucgagucagaaccagccggacaugcuggcugcgcagcccugcaggaucuagcugccugucgugguccggcggcacccgagagagggggagugcucccucagccagccagggcuugcgaacugccccaaggcccugagccaguuccccggccugccgcaggccgcgcccuuccagaggcuagagcguga

SEQ ID NO: 61366 - RNA, 3237 nt, Artificial Sequence
  derived and/or modified sequence opt3 from PTK7__Homo_sapiens__NP_001257327
augggcagcuuccuguccggggagaagagacccucugccccuaccgugggaucagcuauggagaaaaaggaauuuccaacaccgcccgguagggucggcccugggacucagacggcaaucguuuucauuaaacaaccaaguagccaggacgcccuccagggacggcgcgcgcuucugcgaugcgaaguggaggcucccggcccuguacacguguacugguuguuagauggugccccaguccaggacaccgaacguagauuugcacaaggguccucucugucguucgccgcuguggauaggcuacaggacucaggaacauuucaguguguugcacgggaugacgugacuggcgaggaggcccgcagcgcuaacgccaguuucaauauaaaguggaucgaagcgggccccgucgugcucaaacauccugcauccgaggccgaaauucagccacaaacccagguaacacugagaugccacaucgaugggcauccgaggcccaccuaucagugguuucgggacggaacuccucuuucugauggucagagcaaccacacaguuuccucaaaggagcgcaaucugaccuugcgaccagcuggccccgagcauagugggcucuacagcuguugcgcccacucugcauucggacaggcuuguuccucacaaaacuuuacgcugagcauugccgacgaaaguuucgcgagagugguccuggccccucaggaugugguggucgcaagguaugaggaagcuauguuucacugccaauucucugcccagccacccccgucccuccagugguuauuugaggacgaaacuccuaucaccaaucggagccgucccccacaucugcgcagagcuacaguuuucgccaacggcucgcuuuugcugacucaggugaggccucggaaugcagguauauaccgauguaucgggcaaggacagcgcggcccuccaauuauccuagaggccacccuccaccuggcugagauugaagauaugccccuuuucgagccuagaguauuuacagcgggcucugaagagagggugaccugccugccaccgaagggguugcccgaaccuuccgucuggugggagcaugcaggagugcggcucccaacgcacggucgcguuuaucagaaaggccacgagcugguguuagccaacaucgcugaaucagacgccggggucuacacuugucaugcagccaaucuggcuggacagagaaggcaagacgugaacauaacaguagccaccguucccaguuggcucaagaaaccucaggauagccagcuugaggaaggcaagccagguuaucuggacugcuugacucaggcaacacccaaaccgaccguggucugguaccguaaucaaaugcuaauuuccgaggauucucgguucgaaguguuuaagaacgggacgcugcgaaucaauagcgucgagguguacgacggcaccugguauagauguaugucaaguacacccgcgggauccauugaggcucaggccaggguucaggugcucgaaaagcugaaauucacuccacccccucagccccaacagugcauggaguuugauaaggaagcaaccguaccaugcagcgccacaggccgcgagaaaccuacuaucaagugggagcgggcugacgggucuucacuucccgaaugggucaccgauaacgccggaacacugcacuucgcaagagugaccagggacgaugcugguaauuacacuuguaucgccaguaacggcccacaggggcaaauucgcgcgcauguucaguugacgguggccgucuuuauaacauucaaaguggagccggaacgaaccacuguauaucagggacacaccgcucuccugcagugcgaggcacaaggcgacccuaagcccuuaauccaguggaaagguaaggaucggauucuggacccaacaaagcuagggccccguaugcauaucuuucagaacggcagccucgugauacacgacguugccccugaagauuccggaagauacaccuguauugcuggcaauucuugcaacaucaaacacacugaggccccacuguaugucguggacaagcccgugccugaggaaucggaggggccgggaagcccacccccuuacaaaaugauccagacaauuggucuuuccgucggcgcagcgguugccuauaucauugcuguguuggggcugauguucuacuguaagaaaaggugcaaggccaagcgccuccaaaaacagccagaaggagaggaacccgagauggagugucugaauggcgguccucuucagaacgggcagccgucagcagaaauacaagaggaaguggcucugacgaguuugggcucuggacccgccgcaaccaauaagcggcauagcacuuccgauaaaaugcacuuuccaagaucaagccuccagccuaucacaacccugggcaagucugaguucggggaaguauuuuuagccaaagcucagggacuggaggagggcgucgcggaaacucuagugcucguuaagucccugcaaaguaaggacgagcagcagcagcuugauuucaggcgagaauuggagauguucgguaaacugaaccaugccaaugugguccgccuccugggguuaugccgggaggcagaaccccacuacauggugcuggaguauguugaccuuggagauuugaagcaauuucucagaauuagcaaaucuaaggacgaaaaacugaagucccagccacuaucaacaaagcagaaaguggcucuguguacccagguagcccucggcauggagcaccugaguaacaauagguucguccauaaggaucuugccgcucguaacugcuuggugagcgcacaacgccaggugaaagucucggcccuggguuuauccaaggacguuuacaauucugaauauuaccacuuucggcaggcgugggugccucucagauggaugagccccgaggcuauccuggagggcgauuucucaacgaaaagugacguaugggccuuuggggugcuuaugugggaagucuucacccauggagagaugccacacggcgggcaggcagaugacgaagugcuggccgacuugcaagcuggaaaggcaaggcucccgcagccugagggcugucccuccaaacuguaucgacuaaugcagcggugcugggcccugucuccaaaggaucgccccagcuuuuccgaaaucgcgucagcucucggugacagcacaguugauaguaagccuuga

SEQ ID NO: 61367 - RNA, 336 nt, Artificial Sequence
  derived and/or modified sequence opt3 from PTMA__Homo_sapiens__NP_001092755
augagcgacgccgcuguggauaccuccucugagaucacaacuaaggaccugaaagaaaagaaagaggucguugaagaggcagaaaacggcagagaugcccccgcgaaugggaacgcugagaaugaggaaaacggagagcaggaagccgacaaugagguggaugaggaagaggaagaggguggcgaagaggaggaagaggaagaggaaggggacggagaggaggaagauggcgacgaggaugaagaggcagaaucagccacggguaagagggcugcagaggacgaugaggacgaugacguagacaccaaaaagcaaaagacagaugaagacgauuga

SEQ ID NO: 61368 - RNA, 309 nt, Artificial Sequence
  derived and/or modified sequence opt3 from PTMS__Homo_sapiens__NP_002815
augagcgagaaguccguggaagccgcugcagagcugucugccaaagaccucaaggagaaaaaggaaaaagucgaagagaaggcgucaagaaaggagaggaaaaaggaaguuguggaggaagaggagaacggcgcugaagaggaagaggaagagaccgccgaggauggggaagaggaagacgagggagaagaggaggaugaagaggaagaggaagaggacgaugagggucccgcacuuaaacgggccgcugaagaggaagacgaggcagauccuaagcgccagaaaacagagaauggcgccagugcuuga

SEQ ID NO: 61369 - RNA, 507 nt, Artificial Sequence
  derived and/or modified sequence opt3 from PTN__Homo_sapiens__XP_005250572
augcaggcccaacaguaccagcagcaaagaaggaaguucgcugcagccuuucuggcguucaucuuuauucucgcugccguggacaccgcagaggccggcaaaaaggaaaaacccgagaagaaagucaaaaagagcgauugcggggaauggcagugguccguuugugugccuacaucuggagacugcggucuuggcacucgggaggggacgcgcaccggagcugaauguaagcagacaaugaagacucagcgaugcaaaauaccauguaacuggaagaaacaauucggcgcagagugcaaguaucaguuucaggccuggggugagugugaucugaauaccgcuuugaagacacguaccgggucauuaaaaagagcccugcacaacgcggaaugccagaagacuguaacaaucaguaaaccguguggaaagcuaaccaaacccaagccucaagcagagagcaaaaagaagaaaaaggaaggcaaaaagcaggagaaaaugcucgacuga

SEQ ID NO: 61370 - RNA, 1251 nt, Artificial Sequence
  derived and/or modified sequence opt3 from PTOV1__Homo_sapiens__NP_059128
auggugagacccaggcgggccccuuaccgcagcggcgcugggggaccacuggguggccgagggcguccgcccagaccucucgucguuagggcagugcggucccgcucuuggccagccucacccagaggaccucagccacccaggauccgggcgcgcagugcuccuccaauggagggcgcccgaguauucggugcacuugggccgauuggacccagcuccccuggccugaccuugggcggguuagccgugucugaacacagacugucgaacaagcuacucgcuuggucaggaguccuggaguggcaagaaaagaggcggccauauagcgacaguacagcaaaacuuaaacguacucugcccugccaggccuacgugaaucagggugagaacuuggaaacggaucaguggccucaaaagcucauaaugcagcugaucccacagcagcugcucaccacauuaggcccccuguuucgcaauucccaacuugcucaguuccauuuuacuaacagagacugugauucuuugaaagggcugugcaggauuaugggaaauggcuucgccgguuguaugcuauuuccgcacaucagcccuugcgagguucgggugcucaugcugcuuuauuccucaaagaagaaaauuuucauggggcugauccccuacgaccagaguggauuugucagcgcgauacgacaggugaucaccacacgcaagcaagcaguaggcccaggcgggguuaacucuggaccugugcagauugucaauaacaaauucuuggccugguccggugugauggaguggcaggaacccagaccagagcccaauucaaggagcaagcgguggcucccuagucauguguaugucaaccaaggcgaaauccugcgcaccgagcaguggccaagaaaauuauacaugcagcugauuccgcagcaacuccuuacuacacugguucccuuguuucguaauucuaggcuagugcaguuccacuuuaccaaggaucuggagacgcucaagucccugugucggaucauggacaacggguucgcuggaugcguacauuuuagcuauaaagccucgugugaaauacgagugcuuaugcuguuguacucuuccgagaagaaaauuuucaucggccucauuccucacgaucaggguaauuucgucaacgggaucagaagggugaucgcaaaucagcaacagguucugcagcgcaacuuagaacaggagcaacagcagcggggcaugggaggcuga

SEQ ID NO: 61371 - RNA, 522 nt, Artificial Sequence
  derived and/or modified sequence opt3 from PTP4A1__Homo_sapiens__XP_011534414
auggccagaaugaacaggcccgcuccuguggaggucaccuacaagaauaugcgguuccugaucacacacaacccaacuaaugcaacgcucaacaaauuuauugaggaacuuaagaaauauggcguuaccacaauagugcgcguaugcgaagccacuuacgacaccacacugguggagaaggaagggauccaugucuuggauuggccguucgacgauggagcgcccccuagcaaucagauuguggacgauugguuaucccugguuaaaaucaaguuucgagaggagccagguuguugcauugcugugcacugugucgccggccuagggcgugcacccgugcucguagcccuggcucuuaucgaaggaggcaugaaguaugaggacgcaguucaauucauaagacagaaaaggcggggugccuuuaacucuaagcagcuguuguaccucgaaaaauaucgcccuaagaugagacugagguucaaagauucaaaugggcaucggaacaauugcuguauccaguga

SEQ ID NO: 61372 - RNA, 447 nt, Artificial Sequence
  derived and/or modified sequence opt3 from PTP4A3__Homo_sapiens__XP_005250824
auggccagaaugaacaggcccgcuccuguggaggucagcuacaagcacaugcgguuccugaucacccauaauccaacaaacgcaacucucuccacguuuauugaagaccuuaaaaaguauggcgccaccacaguugugcgcguaugcgaggugacuuacgauaaaaccccgcuggaaaaggacgggauaacagucguggauuggcccuucgacgauggagcgccuccacccgguaaaguuguggaggacugguugucuuuagucaaggcuaaguuuugugaagccccuggcucaugcguggcaguacacuguguugccgggcugggacgaaaacguagaggcgcuaucaauaguaagcagcuaaccuaucucgagaaauacaggccaaagcaacggcugcgcuucaaagauccccauacucacaagacaagaugcugugugauguga

SEQ ID NO: 61373 - RNA, 456 nt, Artificial Sequence
  derived and/or modified sequence opt3 from PTPMT1__Homo_sapiens__NP_001137456
auggccgcuaccgcacugcucgaggccggccuugcgagagugcuguucuaccccacauuguuauauacucuguuuagggggaaggucccuggacgggcucaccgcgacugguaccaucgaaucgauccaacgguucuacucggugcccugccgcuucguagccugaccagacagguguccagggcaggcgaacccgggccuuugccacggccccgcagaucuguaccugugggaccacucggcucacccccuagucugcugagccaccucuucgccuccgcugcagguacagggagggagcgggcccgcggagaccaucacgaacgaggcgucagagaugaggugccaguucaauuauuuacuggcgcucagauggaaucuaggggagggugcaaaucgcaucggcaggacccggugauucacccccaccaggccuggccugcggguuguucauga

SEQ ID NO: 61374 - RNA, 1782 nt, Artificial Sequence
  derived and/or modified sequence opt3 from PTPN11__Homo_sapiens__NP_002825
augaccagcagaaggugguuccaccccaacaucaccggcguggaggccgaaaaucugcuccuuacucgcggggucgacggauccuuucuggcucggccuucuaagucaaacccaggugauuucacguugaguguucgacguaauggcgcagugacccauauuaaaauacagaacacaggggacuacuaugauuuauacggaggcgagaaguuugccacucuggcggagcuaguacaauauuacauggagcaccauggucagcucaaagaaaagaauggggacgugaucgagcugaaauauccgcuuaacugcgcugaucccaccagcgagagaugguuccacggacaucuguccggcaaggaagccgagaaguugcucacagaaaaaggcaagcacgggucuuuucuggucagggagucgcagucacacccuggagacuucgugcugagcguucggaccggugaugacaaaggcgagaguaaugaugggaaguccaaagugacucaugucaugauucgcugucaggaacucaaguacgacgugggaggcggugagagauuugauucuuuaacagaccugguagaacacuauaagaaaaacccaaugguugagacccuugggacgguguugcaacugaagcagccccuaaauacuaccaggaucaacgcagccgaaauugagagccggguccgcgagcucuccaaacuggcugaaacaacugauaaggugaaacagggauucugggaggaauuugagacccuucagcaacaggaaugcaagcuguuguacucacgaaaagagggccagagacaggagaauaagaacaagaauagguacaaaaacauccucccuuucgaccauacacgggugguccugcacgacggcgauccaaaugaacccguuagugacuauauaaacgcaaacaucauuaugccugaguuugaaaccaaguguaauaacagcaaaccaaagaaaucuuacaucgccacgcaagggugcuuacagaauacugugaacgauuucuggcguaugguauuucaggaaaauucccgcgugauugucaugacaaccaaggaaguggagagaggaaagucaaaauguguuaaguauuggccggacgaguacgcucugaaagaauauggugugaugaggguccggaacgugaaggagagcgccgcgcacgauuacacucuccgagaacuuaaacugaguaagguaggccaagggaauacagagcgcaccguuuggcaguaucauuucagaacguggcccgaccacggagugccuucugauccaggcggugucuuggacuuccuagaggaagugcaucacaagcaggaguccaucauggaugcagggcccgucgugguucauugcagcgccggcauaggaaggaccggcacauuuauugugaucgacauucugaucgauaucauucgggaaaaagggguagacugugacauagaugucccuaagacuauccagauggugcgcucgcaaagaucuggaaugguucagaccgaggcucaguacagguucauuuacauggccgugcagcacuauaucgaaacacuccaacgucggauagaggaggaacagaaauccaagcgaaaaggucacgaguacacuaacauuaaguauucacuggcagaccagaccaguggcgaucagagcccacuucccccgugcacaccuacacccccaugugcugaaaugagagaggacuccgccagggucuacgaaaauguggggcugaugcaacagcagaagucuuuucgcuga

SEQ ID NO: 61375 - RNA, 1986 nt, Artificial Sequence
  derived and/or modified sequence opt3 from PTPN12__Homo_sapiens__NP_001124480
augaucugggaguacaacguggucauuauaguuauggccugcagagaguucgaaaugggcaggaagaaaugugaacgguauuggccccuguacggggaggacccuaucaccuuugcuccauucaagauuagcugcgaagaugagcaggcacgcacagacuauuuuauccgaacucuccuucuggaguuccaaaaugaaucccguagauuguaccaguuucacuaugugaacuggccggaucaugacguacccucuucauucgauaguauuuuagacaugaucagccugaugaggaaauaccaggagcacgaagaugugccuauauguauccauugcuccgccggauguggucggacgggcgcgauuugcgcuaucgacuauaccuggaaucuacucaaggccgggaaaauuccagaggaguuuaacgucuucaaucugauccaggaaaugcgcacacaaagacacucugcagugcagacuaaggagcaguacgaacuuguucauagggccauagcucagcuguuugagaagcaauugcagcucuacgaaauucacggagcacagaaaaucgccgauggcgugaacgagauuaauaccgagaacauggucucgucaaucgaacccgagaagcaggacagcccuccacccaaaccuccacggacacgcaguugucugguggaaggugaugcuaaggaggaaauccugcaaccgcccgagccucacccaguacccccuauucucaccccaucucccccguccgccuucccuacuguuacaaccguguggcaggacaaugaucgauaucaucccaaaccagucuuacacauggugagcuccgagcagcauucagcggaccugaacagaaauuacaguaagagcacggaacuuccugggaagaacgagucuacuauagaacaaaucgacaaaaaguuggagaggaaucuguccuuugaaauuaaaaaggugccccuacaggagggaccaaaaucauucgauggcaacacccuccugaaucggggccacgcaaucaagauaaaaagcgccagucccugcauugcugacaagaucucuaagccucaggagcuuuccagcgaucugaacgucggggacacaucgcagaacucuuguguugauugcuccgugacucaaucaaauaaaguaagugugaccccaccggaagagagccagaacuccgacacacccccucguccagaucgcuugccccucgacgaaaagggacacgucaccuggucuuuucaugguccugagaaugccaucccaauucccgaucugagcgagggcaacucaagugacaucaauuaucagacgagaaaaacuguguccuuaacaccgagcccuaccacucagguugaaacaccagaucugguggaccacgacaacaccucuccccucuucaggacgccucuuucauucaccaauccccugcauagugaugacagcgauuccgacgagcggaacucugauggggcagucacacaaaauaagacuaacauuucgaccgcuagcgccacaguguccgcggccacuucaaccgaaaguauaucuacacgaaaaguauugccaaugagcaucgcacgccacaauauugcuggaaccacucauuccggcgccgagaaggacguugaugugucagaagacagcccucccccacuaccggagagaacgccugagucuuuuguccuggcuuccgaacacaacacacccgugaggagugaguggagcgaacuccagucucaggagcgguccgaacagaagaaaucagagggucugaucaccagugagaaugaaaagugugaucacccagccgggggaauccauuacgagaugugcauugaaugucccccuacuuucagcgacaaacgcgagcaaauaucggaaaacccaaccgaggcaacagauaucggcuuuggcaauagaugcgggaagcccaaaggaccuagggacccgccauccgaguggaccuga

SEQ ID NO: 61376 - RNA, 7401 nt, Artificial Sequence
  derived and/or modified sequence opt3 from PTPN13__Homo_sapiens__NP_006255
augcacgugagccuggccgaggcucucgaagucagaggcgggccccuucaggaggaagagaucugggcaguucugaaccaauccgccgaaucuuugcaggaguuauucaggaaggugucacuggcggacccugcugcccuaggauuuauuauaaguccauggagccuccugcuucugccguccgguucuguaucguucaccgaugagaauaucucaaaccaggacuugcgggcauuuacagcccccgaagugcuccagaaucaaagccugacuagucuguccgaugucgagaaaauucauaucuacucucucggcaugacguuauauuggggggcugacuacgaagugccucagagccagccaauuaagcugggagaucaccuuaacuccaucuugcugggcaugugcgaggacguuauauaugcacgcgugucaguccgaaccgugcuagaugccuguagugcucauauccguaauagcaacugcgcccccucuuucuccuacguaaaacaccucguuaagcuggugcuugguaaucugucagggacagaccaguugagcuguaacagugagcaaaaaccugauagaucucaggcgauuagggaccggcuccgcggaaagggccugccaacuggcagauccagcaccucggaugucuuagacauccagaagcccccucugucucaucagacauuucucaauaaagggcuuuccaagucaaugggauuccugaguauuaaagauacccaagacgaaaacuauuuuaaggacaucuugagcgauaauuccgguagggaggacucugaaaacacuuucagcccauaccaguuuaaaacaucaggcccggagaagaagcccauaccugggauugaugugcuaaguaaaaagaaaaucugggcauccagcauggaccugcucugcaccgccgaucgggacuucucuucaggagaaacggcuacuuaucgccgaugucacccagaggccgugaccgucagaacaaguacuacccccaggaagaaagaggcacgguacagcgauggcuccauugcucuggacaucuuugguccucagaagauggauccaaucuaccacacacgugaacuucccaccucuucggccauuagcuccgcgcuggaccgcauaagagagaggcaaaaaaaguugcagguucuccgggaagccaugaauguggaggaaccgguacgacgcuauaagacguaccauggggauguguucucaacuaguucugagagcccuuccaucauuucaagcgagucugacuuuagacaggucaggcgguccgaagcaaguaaacgcuucgagagcucuuccggacugcccggcguggacgaaacauuaucacagggccaaagucagagaccaagcaggcaguaugagaccccuuucgaagggaaccugaucaaucaggagauaaugcuaaagcgucaagaggaagagcucaugcagcugcaggcuaaaauggcccuucggcagucgcgauugucccuguaccccggagauacuauuaaggcuucuaugcucgacaucacaagagauccacugagggaaaucgcccuugagaccgcaaugacgcaacgcaaacugcggaacuuuuucggucccgaguuuguuaagaugaccauugaaccuuucaucagcuuggaccucccaagaucaauucugacaaagaaaggcaagaacgaggauaauaggcgcaaagugaacauaauguuacugaaugggcagcgacuagaacucacuugcgacaccaagacaaucuguaaagaugucuuugacauggugguagcccacauuggacugguugagcaucaccuuuucgcuuuggcgacucugaaggauaacgaauauuuuuucguggacccggaucucaagcugaccaaagucgcacccgagggcuggaaggaggaaccuaaaaagaaaacaaaggccaccgugaauuuuacuuuauucuuucggaucaaguucuuuauggacgaugucagucugauccagcacacgcuuacaugccaucaguacuauuugcaacuccguaaagacauucuggaggaaagaaugcacugugacgaugagaccucccuacugcucgcuucucuggcccuucaggcagaauacggugacuaccagccagaggugcaugggguuagcuauuucaggauggagcacuacuugcccgcccgcgugauggaaaagcuggauuuauccuauauaaaagaggaacucccuaagcugcauaacacuuacguaggcgcuucagagaaagaaaccgagcuugaguuccugaaggucugccaacgguugacagaauauggagugcacuuucacagaguucauccagagaaaaagagccagaccggcauccuccuggggguguguaguaagggaguccuaguguucgaaguacacaauggugugaggacucugguucuccgauuucccuggcgcgagacaaaaaagauuucuuucuccaaaaagaaaaucacgcugcagaacaccagcgacggcauuaagcauggguuucagacugauaauucgaagaucugccaauaccuuuugcaccugugcucauaucagcacaaauuccaguuacagaugcgggccagacaaucuaaccaggacgcacaggauauagagagggcgaguuuucguucccucaaucugcaggcugaaagcguccgcggauucaacaugggccgggccaucucuacagguagccuugcauccucaacccugaauaagcuagccgugagaccgcucagugugcaagcugagauucugaaaagguugagcuguucugaacuguccuuauaccagccucuccagaacucaaguaaggagaaaaaugacaaggccagcugggaagagaagccacgagagauguccaaaucuuaccaugaucugucgcaagcaagccuuuauccccaccggaagaacgucaucguuaacauggaaccucccccacagacaguggcugagcugguggggaaaccuucacaucagaugucccgcagugacgccgaaucuuuggcgggcguaacuaagcucaauaacagcaaauccgucgccucacugaauagaucucccgagaggcggaagcacgaaagcgauaguuccagcauugaggacccaggacaggcuuacgugcuagauguucugcauaagcgauggucuaucgugucauccccggagagagaaauaacccuugucaaccucaaaaaggacgcaaaauauggccugggguuucaaauuaucggaggugagaagaugggccgcuuggaccuggggauuuucaucaguagcguggccccuggaggccccgcugauuuagacgguugccucaaaccaggggauaggcugauaucgguuaauucugugucccuugaaggcguaagccaccacgccgcaaucgagauucugcagaacgcgcccgaagacgucacguuggugaucucacagccuaaggagaaaauuaguaaggugccaucuacccccguccaucucacaaaugagaugaagaacuacaugaaaaaguccagcuauaugcaggauucagccaucgacaguagcuccaaagaucaccauuggucucguggaacucugcggcacauaagcgaaaauuccuuuggcccuucagggggacuaagagagggcucucugaguucgcaagacagcaggaccgaauccgcuucucuuucacagagccagguuaacgguuucuuugccucccaucucggggaucagacauggcaagagagucagcacggaucuccgagcccaucagugauuuccaaggcaacugagaaagaaaccuucacggacaguaaucagagcaagacaaagaaacccggcaucucugauguaaccgacuacuccgaccgcggugauucagacauggaugaggcuacuuauagcucgucucaggaccaccaaacaccuaagcaggaaaguuccagcucagugaacaccuccaauaaaaugaacuucaagacuuuuucuagcaguccacccaaaccuggcgauaucuucgaggucgaacuggccaagaaugacaacuccuuggggauuagcgugaccggaggcguuaacacaucugugcgacaugggggaaucuacgucaaggcagugauuccgcagggcgccgcugagucagaugguagaauacacaaaggggaccggguuuuagcggugaauggagucagucuggagggcgccacgcauaagcaagcaguagaaacccucaggaacacuggucaggugguucaccugcuucuggagaaaggccagucccccacaagcaaggaacacgugccagucaccccucaguguacauugucugaucaaaaugcucaggggcagggacccgagaaagugaagaagacuacccagguaaaagacuacucguuugugacggaagagaacacauucgaggucaagcuauuuaaaaauucaagcggccugggguucuccuuuagucgcgaagauaaccucaucccagagcaaauuaaugccucuaucguucgugugaagaaacuguucccuggacagcccgccgcugaaagcggcaagauugacgugggugaugucauccuuaaggugaacggggcauccuuaaaaggacugucacagcaggagguuauaagugcccucagaggcaccgcgccagaaguauuuuugcugcucugccggccgccucccggugugcugccagagaucgacacugcucuucugacccccuugcaaucuccugcccagguccuaccaaauagcuccaaggacucaagccagcccucuuguguggagcaauccacaaguagcgaugaaaacgagaugucggacaaauccaagaaacagugcaagucuccuucaaggcgcgauagcuauagugacuccucuggcagcggggaagaugaccugguuacugcaccggccaauauuucaaacuccaccuggaguagcgcucuccaucagacauuaucuaauauggugucacaggcacaaucccaccaugaggccccaaaaagccaggaggauacgaucuguaccauguucuacuauccccagaagauuccuaacaagcccgaauuugaggacucuaauccaaguccucugcccccagauauggcgccuggacagucguaccaaccgcaguccgaaagcgcuucaucuagcuccauggacaaauaucacauccaucacauaagugagcccacucgacaggaaaacuggacaccacuuaagaacgaucuggagaaucaccucgaggacuucgaauuggaggucgaacugcucauuacccugaucaaaucagagaagggcucucuuggguucacugugacaaaaggaaaccagagaaucggcugcuacguacaugaugucauucaagacccugccaagagcgacggucggcuaaagcccggggauaggcugauaaaagugaaugacaccgauguuacgaacaugacucacaccgacgcagugaauuuguuacgcgccgcuuccaagacagucagacuggugaucggaaggguucucgaacugccacggauuccuaugcuuccccaucugcucccggauaucaccuugacuuguaacaaagaggagcugggcuuuagucuaugcggcgggcacgacagccuguaucagguggucuacauuuccgauaucaauccacguucuguggccgcaauagaaggaaaccuccagcuucuggacguaauccacuacgugaaugguguuucaacacagggcaugaccuuagaggaagucaaccgcgcuuuggauaugagccugccuucgcucgugcugaaggccacacgaaaugaccuucccguggucccauccaguaaaagaucugcgguaagcgcccccaagucaacuaaggggaacggauccuauucugugggcaguuguagccaaccugcacugaccccgaaugauuccuucucaacgguugcuggugaggaaauuaacgagaucagcuaccccaaagggaagugcucuacauaucagauuaaaggaaguccaaaucucaccuugccuaaggaguccuacauccaggaagacgacauauaugaugacagccaagaggccgaagugauucagucacuguuagaugucguggacgaggaggcucagaaccuacugaaugaaaacaacgcagccggcuacucuugcggccccgggacucucaaaaugaauggaaagcuuuccgaggaaaggaccgaggauacagacugugaugguucgccucugccagaauauuuuacugaggccaccaagaugaacggcugcgaggaauacugugaggaaaaaguuaagagcgagaguuugauccagaaaccccaagaaaagaaaacggacgaugacgagaucacaugggggaaugaugagcugccuauugaacggaccaaccaugaggacucugauaaggaccacuccuuccucacuaaugacgaacuggcugugcuuccagucgugaaaguacuccccagcggaaaguacacaggcgcgaaccugaagucagugauccgcguuuugagaggucuguuagaucaggggauaccgaguaaagagcuagaaaaucugcaggagcucaagccucuugaccagugccugauuggacaaaccaaagagaacaggcggaagaaucgauauaaaaacaucuugccauacgaugcaacuagagucccccugggcgacgaaggcggguauauuaaugccuccuuuaucaagauaccugugggaaaggaggaauucguguacauugcuugucaggguccacuccccacaaccgucggcgauuuuuggcagaugaucugggagcagaaaagcacgguuaucgccaugaugacucaagagguggaaggggagaagauuaaaugccagcgcuauuggccgaacauccugggaaagaccacaaugguaucuaauaggcuucgguuagcacuggugcguaugcagcaacucaaaggcuucgucgugagagccaugaccuuggaagacauucagacaagggagguucgccauauaucacaccugaacuuuacugcuuggccugaucaugacacccccagccagccagaugaccuacugacguucaucuccuacaugcggcacauucaccgaucugguccuaucaucacacauuguagugcggggauuggaagaucgggcacucucauaugcaucgaugugguccuuggccugauuagccaggacuuggacuuugauaucuccgaccugguaagguguaugcgccuccaacggcacgggauggugcagaccgaagaucaguauauuuucugcuaccagguuauccuguacguguuaacaagacuucaagccgaggaggaacagaagcagcagccccaacugcucaaguga

SEQ ID NO: 61377 - RNA, 3564 nt, Artificial Sequence
  derived and/or modified sequence opt3 from PTPN14__Homo_sapiens__NP_005392
augcccuucggccugaagcucagaaggacccggcgcuacaacgugcuuagcaaaaauugcuuugucacacgaauccgucuguuggacuccaacguuauugaguguacuuuaucuguggaaucaacggggcaggagugccuggaagccguagcucaaagacuagagcucagggaaacccacuauuucggacugugguuucuuaguaagagccagcaggcacgguggguggagcuggagaaaccuuugaagaaacaucucgauaaguucgccaaugaaccacugcuguuuuucggugucauguuuuacgugccgaacguuuccuggcuccagcaagaggcgacacgcuaucaguacuauuuacaggugaagaaagacguccuggaaggcagacuuagguguacuuuggaucaggugauacggcuggcugggcuagccguacaagcagacuucggagauuacaaucaguuugacucucaggauuuccuccgcgaguauguucuguuucccauggaccuugcccuggaggaagcuguguuggaggaacucacccagaaggucgcacaagagcacaaagcccauucgggcauccugccugcugaagccgaguuaauguacauuaacgagguggaacgacuggaugguuucgggcaggagaucuuuccagugaaggacaaucacggaaacugcguccaucucggcauuuucuucaugggcaucuuuguuagaaauaggauagggcggcaggcggugaucuaccguuggaacgauaugggaaauauuacacacaacaaaucaaccauccuuguagaacugauuaauaaggaggaaacugcauuguuccacacagacgauaucgagaacgccaaguauauaagccgccuauuugcuaccagacauaaauucuacaagcaaaauaaaauuuguacggagcagaguaacuccccaccuccaaucaggcggcagcccacuuggucucgaagcucccugccucgccagcaaccauauauucucccgcccgugcacguccagugcggugaacauuacucagagacccacacaagucaggacagcaucuuucacggcaacgaagaggcccuguauuguaauucucauaacucccuugaccugaauuacuugaacgggacugugaccaauggaucaguuugcagcgugcacagugucaacucucucaauuguucccagagcuucauccaagcaucgccugugucuuccaaccugucaauuccaggcagugauauaaugagagcugacuauauccccagccauaggcacuccgccauuaucguaccuucuuaccggccaacacccgauuacgaaaccguuaugcgccagaugaagagagguauauuacauacggacagccagucacagagucugaggaaucuaaacauuaucaauacucacgcguauaaccaaccggaggaucucguguacucccagccugagaugcgugaacggcaccccuauacagucccauacgggccucagggaguguauagcaauaaacuggucucucccucagaccagcgaaacccaaagaauaacgugguucccaguaaaccuggcgccagcgcaaucucccauaccgugucuacuccagagcuugcuaacaugcaauugcagggcucgcacaauuacagcacagcccauaugcugaagaacuaucucuuuagaccgcccccuccauaccccaggccucgcccagcuaccuccacgcccgaucuggccucacaccggcacaaguacguaagugggucuagcccggaccuugucaccagaaaagugcagcuguccguuaagacauuccaagaagauucaagcccugugguccaucagucuuugcaggagguguccgagccacucacugcaaccaaacaccauggaacaguaaauaagaggcacagucuggaagugaugaacagcaugguucgcgguauggaggccaugacuuuaaaaucucugcaucuacccauggcucgacggaauacccuccgugaacagggcccucccgaggaaggguccggaucacacgaggucccacaacugccucaguaucaccauaagaagacauuuagugacgcgaccaugcuuauucacagcucggaguccgaagaggaagaggaagaggcacccgagucugugccacagaucccgauguugagagagaaaauggaauacagcgcccagcugcaagcugcccucgcaaggauuccuaacaagcccccacccgaauauccuggcccacgcaaaucagugaguaauggugcccugcggcaggaucaggcuuccuuacccccugccauggcaagagcgaggguccugcgacaugggccggcuaaggccauaucuaugagccgcacugacccacccgcaguuaacggcgccucccuuggaccuucaaucagcgagccagacuugacgagugugaaagaacgggugaagaaggagcccguaaaagagagaccugucucugaaauguucucccucgaggauagcauuaucgaaagggagaugaugauccguaaucuggagaagcagaaaauggcuggccuagaagcccaaaagcgcccgcugaugcucgcagcucugaacgggcuuucgguggcccggguuucaggaagagaggaaaauaggguggacgcgacacgaguccccauggaugagcgguuucgcaccuugaaaaagaagcuggaagaggguaugguguucacugaguacgaacagauucccaaaaagaaagccaacggcauauuuucuaccgcugcauuaccugagaaugccgaaagaaguaggauccgggagguugugcccuaugaagagaaccgaguagagcucauuccaacaaaggaaaauaacaccggguacaucaacgcuucccacauuaaagucguggugggaggcgccgaguggcauuauaucgcaacucaggguccucugccccacacaugccacgacuucuggcaaauggucugggaacaggggguuaaugugauagcgaugguaacggccgaggaagagggcggaagaaccaagagccaucgcuacuggccaaaacuuggcucuaagcacagcuccgcuacuuacgggaaguucaaagugacaaccaaguuuaggacagauucagucuguuaugccacuaccggacugaaagugaagcauuugcucaguggucaggagcguacgguuuggcaucugcaguacaccgacuggccggaucacggcugcccugaagacgugcaaggguuccuaagcuaucuggaggaaauccagucuguccggagacacacaaacuccaugcucgagggaacuaaaaauaggcaucccccaauugugguucacugcucagcaggcgugggucgcaccgggguccugauccuuagugaguugaugauuuacugucuggaacacaacgagaagguagaagugcccaugauguuacgacuccugagagagcagcggauguuuaugauccagacaauagcucaauauaaguucguuuaccaggugcuuauucaguuucugcagaauagcaggcuaaucuga

SEQ ID NO: 61378 - RNA, 1062 nt, Artificial Sequence
  derived and/or modified sequence opt3 from PTPN18__Homo_sapiens__NP_001135842
augagcagaucccuggacucugccaggucauuccucgagcggcuugaagcucgcggcgggcgagagggagcagugcuggccggugaauuuaguaagcguugcgagagauacugggcgcaggaacaagagcccuugcagaccggcuuauucuguaucacacugauuaaagagaaguggcuaaacgaagauauaaugcucaggacucugaaagucacguuucagaaggagagccgguccguuuaucagcuucaauacaugucuuggccugaccgcggggugccaucgucaccggaucacaugcuggcuaugguagaagaggccagaagguugcagggaagcggccccgagccucucugcgugcauuguagugcagguugcgggcggaccggaguccuguguacaguggacuauguucgccagcugcucuuaacucagaugaucccacccgauuucucccuguuugacgugguccuuaaaaugcgaaagcaaagaccugccgcugugcagaccgaggaacaguacagguucuuguaucacacaguagcacagauguuuugcucuacccugcaaaaugccagcccacauuaccagaacauuaaggaaaauugugcuccccuauaugaugacgcccucuuccugcggacuccucaggcgcuucuggcaaucccacguccgcccggcggcguuuugcgcuccauuucagugccugggaguccaggacacgccauggcugauacauacgccgucgugcagaaaagaggugcacccgcuggcgccgggagcggaacccaaacgggcacugguaccgggacaggagcgaggucugccgaggaagcaccucucuacuccaaggugacuccacgggcucagcgacccggcgcccaugcugaggacgcccgcggcacccugccggggagagucccugcagaucagucacccgccggaagcggugcuuaugaggacguugcgggcggggcacaaacaggaggcuuagguuuuaaccugaggaucgggcggccaaaaggcccucgcgaucccccagccgaauggaccagaguguga

SEQ ID NO: 61379 - RNA, 1089 nt, Artificial Sequence
  derived and/or modified sequence opt3 from PTPN1__Homo_sapiens__NP_001265547
auggaggaagcccagagaagcuacauccugacccaaggcccccucccuaacacaugcgggcacuucugggagauggugugggaacagaaguccaggggagucguuaugcuuaaucgggugauggagaaagguucucugaagugugcucaguauuggccacagaaagaagagaaggagaugauuuuugaagacacuaacuugaaauuaacgcugauaucagaggauaucaagaguuacuauaccguacgccaacuagaacucgagaaucugacaacucaggagacccgagaaauucuucauuuccacuacacaaccuggccggacuuuggcgugcccgagagcccugcauccuuccugaacuuuuuguucaagguccgugaaucugggucgcucucaccagagcauggacccgugguugugcacugcagcgccggcaucgguagaagugggacuuuuugucuggcggauacaugccugcucuuaauggacaaaaggaaggauccuuccucugucgacauuaaaaaggugcugcuugaaaugcggaaauuccgcaugggauugauccagaccgcugaucagcugagauuuagcuaucuagccguaauagagggcgcaaaguucaucaugggcgacuccucaguucaagaucaguggaaggagcucagucaugaagaccuggagccacccccugaacacauuccaccgcccccuaggccacccaaacggauccuugagccucacaaugggaagugucgcgaauuuuucccaaaccaucagugggugaaagaggagacgcaggaagauaaggacugccccauuaaagaggaaaagggaagcccgcugaaugccgcuccuuacgguaucgagucuaugucccaagauacugaaguccgaucaagaguggugggcgggagcuugaggggagcacaggccgcuagucccgccaaaggcgagccaucucucccugagaaggacgaagaccacgcgcuguccuauuggaagcccuuuuuagucaacauguguguugcaaccgugcugacagccggugcuuaccucugcuaccgguuccuuuucaauagcaacacuuga

SEQ ID NO: 61380 - RNA, 3525 nt, Artificial Sequence
  derived and/or modified sequence opt3 from PTPN21__Homo_sapiens__XP_011534669
augccccugccuuucggccucaaacuuaaaagaaccaggcgguacacagugagcuccaagucuugccuggucgcccgcauccaguuguuaaacaaugaguuuguugaguucacucugucaguggaaaguacggggcaagaaagccuagaggcuguagcacagcgacucgaacugcgugaggugaccuauuuuucccuuugguacuauaacaaacagaaucagagaaggugggucgaccuggagaagccauugaaaaagcaacucgauaaguacgcccuggaaccgacaguguauuucggaguuguguuuuacguccccucugugucgcagcugcagcaggagauuacucgguaucaauacuaccuccaguuaaagaaggacauacuggaagguucaaucccuuguacccuugagcaggcgauucaguuggcuggccuggccguacaagcagauuucggggacuuugaucaguaugagagccaggacuuccuacaaaaauuugcccucuucccaguuggauggcugcaggaugaaaaggugcuugaggaagcuacacagaaagucgcacuguugcaccagaaguaccgcggccucaccgcccccgacgcugagaugcuguauaugcaagaaguggagagaauggaugguuacggggaggaaaguuauccugccaaggacucccagggaucugauaucagcauuggcgcgugcuuagagggcaucuuugugaaacauaagaacgggaggcacccagucguuuuccgguggcaugacauagcaaauaugucccacaacaaaucauuuuucgcccuggaacucgcuaauaaggaggaaacuauccaguuccagacagaggauauggagaccgccaaauacauuuggcgccuuuguguggcacgacauaaguuuuauagacugaaccaaugcaauuugcagacgcagacuguaaccgugaaccccaucaggcggcguaguagcucucgcaugucccuaccuaaaccacagccguacgucaugcccccuccaccccaacugcacuacaauggacacuauacagaaccuuacgcuucaagccaggacaaccucuucgugccaaaucagaacgguuauuacugucauagucagacuucucuggacagagcccaaauugaucuuaauggcaggauccggaacggguccguuuauagcgcgcacucgaccaacucucugaauaacccccagccguacuugcagccuucccccaugucaaguaauccaagcauaacaggauccgacgugaugcgaccugauuaucuccccucucaucgccacagcgccgucauuccacccucauacagaccuaccccagacuacgagacggugaugaagcaacugaacaggggcuuaguacacgcagaacggcagagucauucccugcgcaaucuaaacaucgguagcucuuaugcuuacucaagaccggccgcucucguuuauagucagcccgagauuagggaacacgcccagcugccuagcccagcagccgcucauugccccuuuucccuuucuuacucguuccacagcccuuccccauaucccuacccggcggagcgucggccuguggucggggcagugucagucccagaguugacuaaugcccaacugcaggcucaggauuaucccaguccuaacaucaugcgaacacagguguacagacccccaccucccuacccaccgccuaggcccgccaauucuaccccagaccucagccgccaucuguauaucuccucaagcaaccccgaucuuauuacucggagaguucaccacucugugcaaacauuucaggaagacucccugccuguagcacauaguuugcaggaggucagcgaaccacucaccgccgcuaggcacgcccagcugcauaagcgcaauucuauagagguggcaggauuaucccacggccuggagggccuacgacucaaagaacggacgcugucagcgagugcugccgagguugcaccccgugccgugagcgucgggucgcaaccuuccguguucaccgaaagaacacagagggagggaccggaagaggcugagggucuucgcuacggccacaagaaaucuuugagcgaugccacuaugcugauccauucaagugaagaggaagaggacgaagauuuugaggaggaauccggggcacgggcuccacccgccagagcgagggagccucgaccaggacucgcccaggaucccccuggcuguccgcgcguacuguuagcugguccccugcacauucuugaaccaaaggcacaugugccugacgccgagaaacggaugauggacucuagccccguuagaaccacagcugaagcccaaaggccauggcgugacggguugcucaugccuuccaugucagagagcgaucugacuaccaguggccgcuaucgggcaagaagggacucucuaaagaagcgacccgucuccgaucugcucagcggcaaaaagaacaucguggagggacugccaccgcuugggggaaugaaaaagacacggguggacgcgaaaaagauagguccuuugaagcuggccgcuuuaaauggccucucgcugucacgcgucccccuuccagaugaagggaaagagguugccaccagagcaacuaacgacgaaaggugcaagauucuggagcagcgguuggagcagggaaugguguucacggaauacgagcgaauccucaaaaagagacugguggauggcgaauguucuacagcucgccuacccgagaaugccgaaaggaaccguuuucaggacguacugccuuaugaugacguccggguggagcucguuccaaccaaagagaacaauacugguuacaucaacgcaagucacauuaagguguccgucagcgggaucgaaugggauuauauugccacccaaggcccccugcagaauacaugccaggacuucuggcagauggugugggagcaaggaauagcuaucauugcgaugguuaccgccgaagaggaaggcgggagagagaagucuuuuagguacuggccucgccuuggaagccgacauaacacugugacauacgguagauucaaaaucacgacccgguuuaggacugacuccggcuguuaugcaacaaccggguugaagaugaaacaccuguuaacaggacaggagcgcacuguauggcaccuccaguacaccgauuggccggaacauggcugcccagaggaccugaaggguuuccuuucauaucuggaagagauccagaguguccguagacacacgaauagcaccucugauccccaauccccuaaucccccacuacucgugcauugcucagcuggggugggccggacaggagucguuauucugagugaaauaaugaucgccuguuuggagcacaacgaggugcuggacauuccuaggguauuagauaugcuccgccagcagcgaaugaugcuggugcagacucuuugccaauacaccuucgucuauagagugcugauccaguuuuugaaaagcucccggcucauuuga

SEQ ID NO: 61381 - RNA, 1980 nt, Artificial Sequence
  derived and/or modified sequence opt3 from PTPN22__Homo_sapiens__XP_011539526
augcagcuggaguucggccccuuuagcguguccugcgaagccgagaagagaaaaucugacuacaucauuaggacccucaaggucaaauucaacucagaaacacggacuauauaucaauuucacuacaagaauuggccugaucaugacguuccaaguagcaucgauccgauucuugagcugaucugggacgugcgcuguuaucaggaagaugacuccguacccauuugcauccacuguucugcugggugcggacgaacgggugugauaugugcaaucgauuacaccuggauguuguuaaaagacggcauuaucccugagaacuucucggucuuuucacugauucgugagaugagaacacagaggccaagccuagugcagacucaagaacaguaugagcucguuuacaaugccgugcuggaacuuuucaagcggcagauggaugucauccgcgacaagcauagugggaccgagucccaggcgaaacacugcauacccgagaagaaccauacacugcaagcugauucuuauagcccuaauuugccaaaauccaccacuaaggccgcaaaaaugaugaaccagcagagaacaaagauggaaauuaaggagucaaguagcuuugacuucaggaccucugaaaucuccgccaaagaggaacucgugcugcaccccgcuaagucaagcacgaguuuugauuuccuggagcucaauuacucuuuugacaaaaacgcagacacuaccaugaaguggcagacaaaagccuucccuauuguaggagagccauuacaaaagcaccagucccuggaucuuggcagcuugcuguuugaagguuguucuaauucgaaaccgguuaacgcugccgggcgguacuucaauuccaaggugcccaucacucgcaccaagucaacaccuuucgagcuaauccagcaacgagaaaccaaagaggucgacaguaaggaaaacuuuagcuaucucgagucccagccacaugauucuugcuucguggagaugcaggcgcagaaagugaugcacgucagcucagcagaacugaauuacagucuucccuaugacuccaagcaucaaauuagaaacgccagcaauguuaaacaccacgauucuucagcucugggaguguacaguuauauaccuuugguagagaacccauacuuuagcuccuggcccccgucuggcacgucgagcaagaugucccucgaccugccugaaaagcaggauggcacuguguuccccucaaguuuacugccaacaucuagcaccucccucuuuucauauuacaacagccaugacucucuuucccugaauaguccuacuaacaucagcucuuugcuaaaucaggaguccgccguccuggcaacagcucccaggauugaugacgaaaucccacccccucucccaguguggaccccggagucauucauaguuguggaggaagccggggaguuuagucccaacgucccuaaaagccugucguccgcggugaagguaaaaauuggaacgucucuugaaugggguggcaccagcgagccaaagaaauucgaugacucaguuauccugcggcccaguaaguccgugaaguugcguucuccuaaaagcgagcuccaccaggaccgcuccucaccacccccgccucugccagaaagaacauuagagagcuuuuuccuggccgaugaagacuguaugcaagcacagaguaucgagacuuacucuaccuccuaucccgauacaauggaaaauagcacuucgucaaagcagacccuaaaaacaccugggaagucuuuuaccaggaguaaaucccucaagauucugcggaacaugaagaaaagcaucugcaauucuugucccccaaacaagccugcugagagcguccaguccaauaacucaaguagcuuccuuaauuuuggauucgccaaccgauucucuaaacccaagggcccacgcaauccgccucccacuuggaacauuuga

SEQ ID NO: 61382 - RNA, 4533 nt, Artificial Sequence
  derived and/or modified sequence opt3 from PTPN23__Homo_sapiens__NP_001291411
augcugggcgccauggacaagagagugagcgaggaagggaugaaagucuccugcacccacuuccagugugcugcaggagccuuugcguaccucagggagcauuucccccaggcuuauucuguugauaugucacggcaaauccuuacacugaacgugaauuugauguuaggucaggcccaggaaugccugcuagagaagaguaugcucgacaaccgcaagagcuuucugguagcacgaauuuccgcccaaguggucgauuacuauaaggaggcuugucgugcacuugaaaauccugacacugccucucuguugggcagaauacagaaagauuggaagaagcucgugcagaugaaaaucuacuauuucgcugccguugcgcaucugcacauggggaagcaggcagaggaacaacagaaauuuggagagaggguggccuacuuccagucggcucuggacaagcucaacgaagccauuaaauuagcaaagggccagccagauacgguccaagacgcucugcgguuuaccauggaugugaucggugggaaguauaauucagccaaaaaggacaacgauuucauuuaccacgaggcgguaccggcccuugacacauugcagcccguuaaaggagcaccucuggugaagccacuacccgucaauccuacugauccagcugugaccggccccgacaucuuugccaaacucgugccuauggcugcccaugaggcaagcagucuguacuccgaagagaaggccaaacuucugcgcgaaaugauggcuaagauagaggacaagaacgaagucuuggaucaguucauggacucuaugcaacucgauccagagacaguugacaaucuggaugcguauagccacaucccgccccaguuaauggagaaaugcgcagcccuguccgugagaccugacaccguaaggaaccucgugcagucaaugcagguccuuaguggcguguuuacugauguugaagcuagccugaaggacauucgggauuugcuagaggaagacgagcugcucgaacaaaaauuccaggaggccguggggcaggcaggagccaucucuauuacauccaaggcugagcuggccgaaguccgccgagagugggcaaaauacauggaagugcacgagaaggcgucauuuaccaauagcgaacuucauagagcuaugaaccugcacguagguaauuugaggcuccugaguggcccauuagaucagguucgggccgcacugcccacgccugcccuaucuccagaggacaaggcugugcuccaaaaccugaaacguauccuugccaagguccaggagaugcgcgaccagagaguguccuuggaacagcaacugagggagcucauacagaaagaugacauuacugcaagccuggucaccacagaucauucggaaaugaagaaacuuuucgaggagcagcugaagaaguaugaccaguugaaaguguaccucgaacaaaaucuggcugcccaggaucggguuuuaugugcgcugacugaggccaacgugcaguaugcugcaguacgacgcguccuaucugaccucgaucaaaaguggaacuccacccugcagacacuuguggccucauacgaggcuuaugaagacuugaugaaaaagagucaggaagggagagauuucuacgccgaccuggagagcaaaguugcagcgcuccuggagaggacccaguccacgugccaagcccgggaagcugcccgccagcaguuacuggauagagagcuuaagaagaaacccccgccuaggcccacugcaccaaagccuuugcucccccgucgggaagagucugaagcuguggaggccggagacccacccgaggaacugcgaagccuaccuccagauauggucgcaggcccgagacugcccgacacauuucucgguucagccaccccucugcacuucccacccaguccuuuuccauccagcacugggcccggaccgcacuaccuuucuggcccuuugccacccggcacauauucagggccuacccagcugauccaacccagggcuccaggaccucaugcgaugcccguggccccagguccggcauuauacccugcucccgccuauacgccagagcucggccugguaccccgcaguagcccucagcacggggugguuuccucuccauacgucggagugggccccgccccuccgguggcuggucuuccaucggcacccccuccacaguucagcgggcccgaacuggccauggcgguccggccugcuaccacaacuguugacuccauucaggccccgauccccucacauaccgcaccaagaccuaaucccacaccagccccucccccaccguguuuuccugugcccccaccccaaccuuugccaacucccuauaccuacccugcuggcgcaaaacagccgaucccagcccagcaccauuucaguucuggcauucccgcgggauuuccugcucccaggauagggccacaaccucagccccacccacagccucacccgagccaggccuucggaccccaaccaccucagcagccccucccacugcagcauccucaccuauuucccccgcaagcaccaggucugcucccuccccaguccccauaucccuacgccccucagccgggcgugcuggggcagcccccaccuccccuucauacacaauuguacccuggaccagcucaggauccccugccugcccacucaggcgcauuaccauuccccagcccggguccuccacagcccccucacccaccccucgcuuaugggccggccccuucuacccgccccaugggcccacaggcggccccucugacuauccgaggacccuccagugcaggccaaagcacgccaucuccccaucuuguaccuuccccagcuccgucacccgggccuggaccagugcccccucggccacccgccgcugagccuccgccaugccugcguagaggugcagccgccgcugaccuacucaguagcucgcccgaaucccagcacggcgggacacagucuccuggaggcggucaaccccuguugcagccaaccaaggucgaugcggcagaggggaggcgcccucaggcccugcgguuaauugagagagaccccuacgaacauccagagaggcuccgacagcugcaacaggaacuugaggcuuuucgcggccagcugggagauguuggcgccuuggacacuguguggcgggagcuccaggaugcacaagaacacgacgccagagggaggagcaucgcuauagcgcguuguuauucacugaaaaaccgccaucaggaugucaugccguacgacaguaaucgggugguucuaagauccggaaaggaugacuauauuaacgccucuugcguggagggccugagcccuuacugucccccacuuguagcaacccaggcuccccucccugguacagccgcagauuucuggcugaugguccacgaacagaaaguguccgugaucgucauguugguuucagaggccgaaauggagaagcaaaagguggcuagguauuuuccaaccgagcgagggcagcccaugguacacggagcccugagcuuagcgcucaguucugugcgguccacugaaacacaugucgagcgcgugcugagccuucaguucagagaccaaucgcugaaaaggucauugguucaccuccauuucccuacguggccggaacugggccuaccagacucucccaguaaucugcuucgguuuauccaggaggugcacgcacauuaccuccaccagcgaccucugcacaccccaauuaucguccauugcuccagcggugugggcagaacuggggccuucgcuuuguuauacgccgcuguucaggaaguggaggcaggaaacggcauucccgagcugccucaacucguccgcaggaugcgucagcagcggaagcacaugcugcaggaaaaacuucaucugagauuuugcuaugaggccguagugaggcacguugaacaaguguugcagcgccacggggugcccccaccguguaagccucuagcuucugccagcauaucccagaaaaaucaucugccccaggauucacaagaccucguccugggaggcgauguaccaaucaguagcauucaggcaacaaucgcgaaacuuucuauccgaccucccgguggguuagaguccccaguggccucacugccuggacccgcugaaccgccaggccucccucccgccaguuugccagagagcacccccauuccuuccucuucgccgccaccccugagcucaccucuccccgaggcaccacagccuaaggaggaacccccagucccugaagcuccguccaguggucccccaucuagcucccuggagcuucuggccucauugacaccugaggcauucucucuagacagcagucugagaggcaaacagcggauguccaagcacaacuuucuccaagcccauaaugggcagggauuaagggcuacucgccccagcgaugacccacugucucuucuggauccucucuggaccuugaacaaaacguga

SEQ ID NO: 61383 - RNA, 1233 nt, Artificial Sequence
  derived and/or modified sequence opt3 from PTPN2__Homo_sapiens__NP_001193942
augcccaccacaaucgagagagaguucgaagaacuggacacucagaggcgguggcaaccucucuaccuugagauucgcaacgaaagccacgauuauccacaucgaguggccaaguuuccggagaaucguaacagaaauagguaccgggacgucucccccuaugaucacucucgcguuaaacugcagaacgcugagaaugacuacauaaacgcaucauugguggauaucgaagaggcccagagaaguuauauuuuaacgcagggcccucugccaaauaccugcugucauuucuggcuaaugguauggcaacagaagacaaaagcgguggucaugcucaacaggaucguggaaaaggagagcguuaaaugcgcucaguacuggcccacugacgaucaggagaugcuguuuaaggaaaccggguucuccgugaagcugcugucugaggacgucaaaucguauuacacagugcacuugcuccaacuggaaaauauuaacuacaucgagaaucuguggauaacccucuauuuaaagcugcuuauguuggauguaaaacggucacuuaagagcggagaaacucgcacaaucagucauuuucacuacaccacguggccugacuucgguguuccagagucccccgccucuuuucuaaacuuccucuuuaaagugcgagagagcggcucccugaauccugaucacgggccagcagucauucauuguucagccggaaucggcagaagugguacuuucagccuuguggauaccugccugguguugauggaaaagggggacgacauuaacaucaagcagguccuccugaauaugaggaaauaucggaugggauuaauacagacaccggaccagcugcguuuuucuuacauggcuauuaucgagggcgcaaaguguauuaaaggcgauuccucaauccaaaagcgcuggaaagaacucagcaaggaggaccuuagucccgccuucgaucacucuccuaacaaaaucaugacugaaaaguauaacgggaauagaauuggacuggaggaggaaaaguugaccggugacaggugcacaggccuauccagcaaaaugcaggauaccauggaggaaaacucggagucugcucugcggaagcgaauacgcgaagacagaaaagccacgacugcgcagaagguucaacagaugaaacagaggcucaaugagaacgagcggaagcgcaagagaccaaggcugacagauaccuga

SEQ ID NO: 61384 - RNA, 2607 nt, Artificial Sequence
  derived and/or modified sequence opt3 from PTPN3__Homo_sapiens__NP_001138840
augaccagcagacugagggcccucggcgggcggaucaacaauauucgcacauccgagcuucccaaggaaaagacucgaucugaggugauaugcucaauccacuuccuggacggagucguucagacguuuaaggugaccaaacaagauacaggucagguauuguuagacauggugcauaaccaccugggcgucacugaaaaggaguacuucgggcuacagcaugaugacgauaguguggacagcccucguuggcucgaagcuagcaaagcaauuagaaagcagcugaagggaggcuuuccauguacccuucacuucaggguucgguuuuucaucccggaucccaauacacugcaacaggagcagacccgccauuuguauuuucuccagcugaaaauggacauuugcgaggguagacugacuuguccucucaacucugccguggucuuagcgucguacgcugugcaaucacacuucggggauuauaauagcaguauccaccauccaggauaccuguccgacucucacuuuauacccgaucagaacgaagacuuccuuacaaagguagagagcuugcaugaacagcacuccggccugaaacagucagaggccgagaguugcuauaucaauauugcaaggacccuagauuuuuacggcguugaacuccacagcgggcgggaccugcauaaccuugaccugaugaucggaauugccucugcugguguggcagucuaucgcaaguacaucuguacguccuucuacccuugggugaauauauugaaaauuucauuuaagcgaaagaaauucuucauccaccaaagacagaagcaggccgagagcagggaacauauuguggcuuuuaacaugcucaauuaucggaguugcaaaaaccuguggaagucuugugucgagcaccauacuuucuuucaagccaaaaaguuacugccacaggagaaaaauguucucucccaguacuggaccaugggcagccguaacacaaagaagcgcucgcccagacuuaggcacgagauccggaaaccucgacacucuuccgcggauaaucuggcaaacgagaugacuuauaucaccgaaacagaggacguguucuacaccuauaaggggucauuggccccacaggauagugacagcgaaguaucccaaaaccgcucuccgcaucaggagagccuaucagaaaauaaccccgcucagaguuaccugacgcagaaauccuccucuucagugaguccuagcuccaaugccccaggaucuugcucgcccgauggcgucgaccaacagcuccuggaugacuuucacagagugacuaagggugggagcacagaggaugcaucccaguauuacugugacaaaaacgauaauggagacucauaccuuguucugauuaggauaaccccugacgaggauggcaaguucggcuuuaacuugaaagggggaguggaccagaaaaugccacucgucgugagucggaucaaucccgaaucuccggcugauacuugcauuccuaagcugaacgagggugaccaaaucguauuaauaaauggccgcgauauuagcgaacauacacacgaccagguugugauguucaucaaagccuccagagagucacacagcagggaacuggcgcuagucauccgucggcgagccgugagaucuuuugcagauuucaaguccgaggacgagcucaaccagcuguuucccgaagcuauuuucccaauguguccugaagggggagauacccuugaaggcaguauggcccaguugaaaaagggucuggagagcgggacgguccucauccaauuugagcagcuguauaggaagaaacccggccuugcuauuaccuucgccaagcugccacagaauuuggacaaaaaccgcuacaaggaugugcuccccuaugacacaacucggguucuguuacaaggaaaugaagauuacauaaacgcaucuuaugugaauauggagaucccugccgcuaaccugguaaacaaauacauugcgacccagggcccacuaccgcauacaugcgcacaguucuggcaggucgugugggaccaaaagcucucccugaucguuaugcuuacuaccuugacagaaagagggaggaccaagugccaccaguauuggcccgacccuccagaugugaugaaucauggagguuuucacauccagugucagucagaggacugcacuauugccuacgucagucgcgaaaugcuggugacgaacacacaaaccggcgaggagcauacuguaacccaccuccaguacguggcuuggcccgaucacgggguuccugacgauagcucggacuuccuggaauuugucaauuaugugcgauccuuacggguggauucugagccaguccugguucauuguagcgccggaauaggccguacaggugugcuugugaccauggaaacugcaaugugcuugacagagagaaaccuccccaucuacccgcuggacauuguaaggaaaaugcgcgaucagcgggccaugaugguccagacgucaagucaauauaaguucgugugugaagcuauccuaagaguuuacgaggaggggcuggugcagaugcucgacccuuccuga

SEQ ID NO: 61385 - RNA, 2781 nt, Artificial Sequence
  derived and/or modified sequence opt3 from PTPN4__Homo_sapiens__NP_002821
augaccagcagauucaggcugcccgccggccggacauacaacgugcgcgcuuccgagcucgcacgagaccgucagcacacugaagucguuugcaauauccuucuguuggauaacacggugcaagccuuuaagguaaauaaacaugaccaggggcaaguguuacuggaugucguguucaagcaccuagaccucaccgagcaggauuauuuuggacugcaacuugcggacgauucuacagacaacccuagauggcuggauccaaauaaaccgauuaggaagcaguugaaacgggguucacccuacagucucaacuuccgcguuaaguuuuucgugagcgacccuaauaagcugcaggaagaguauacuagauaccaguauuuucugcaaauaaaacaggauauccucaccggcagguuaccaugucccuccaacacagcugcccugcuugcaucuuucgccguccagucggaauugggggacuacgaucagucagagaaucugagcggauaucuaagugacuacuccuuuauuccuaaccaaccacaggacuucgagaaggaaaucgcuaaacuccaucagcaacacauuggccugucucccgcagaggccgaauuuaauuaccuuaacaccgcucggacucuggaguuguaugguguggaguuccauuacgcccgcgaucagagcaauaacgaaaucaugauagggguaauguccggaggcauccucauuuauaagaaucgaguuagaaugaacacauuuccuuggcugaaaaucgugaagauuucauucaagugcaaacaguucuuuauccaguuaaggaaggagcugcacgaaagucgggagacccuccuuggcuucaacauggucaauuaccgugcguguaaaaaccuguggaaggcaugcguggaacaccauacguuuuuccgcuuggacagaccacuaccgccccaaaagaacuuuuucgcccacuauuuuacucuggggagcaaguucagguacuguggacggaccgaggugcagucuguccaguaugguaaagagaaggcuaauaaggaucgaguuuuugcccgcuccccuucaaaaccacucgcaagaaagcugauggacugggaagugguaagcaggaauaguauaucugaugaccggcuugagacacagucccugcccagccgcucgccuccaggcacucccaaccauagaaauucuaccuucacacaagaagggaccagguugcguccguccucagugggacaccucgucgaucacauggugcauacgaguccuagcgagguuuuugugaaccagcggucccccucuagcacucaggcuaauucaauuguccuggaaaguuccccaagccaggagacaccuggcgacgguaaacccccagccuuacccccuaagcaaucuaaaaagaacucauggaaucagauccacuacagucauagccagcaggaucuggagucccacauuaacgaaaccuucgacaucccaucuucgccggagaagcccacuccuaaugggggaaucccacaugauaaccuagugcucauucgaaugaaacccgacgaaaauggcagauuuggcuucaacguaaaagggggauacgaccagaaaaugccuguuauagugagcagggucgcgccagguacacccgccgaucugugcgugccgcgccuuaacgagggcgaccaggucguguugaucaaugggcgggauauugcagaacacacccacgaccagguugugcuguucaucaaggcuuccugugagagacauucaggagagcucaugcugcuuguaaggccuaacgccgucuaugaugugguugaagagaaacuggaaaaugagccagacuuucaauacauacccgagaaggcuccuuuggauagugugcaccaggacgaucauucucuccgcgaaagcaugauucagcuggccgagggcuuaaucacggguaccguccugacacaguucgaccaacuauaucgaaagaaacccgggaugacuauguccugcgcaaagcucccacagaacaucagcaaaaaucgguaccgugauauuucaccuuaugacgccaccagagugauccugaagggcaacgaagauuacauuaaugcuaacuauauaaauauggagauccccucuuccaguauuaucaaccaguacaucgcgugucagggaccacuuccgcacacaugcacugacuuuuggcaaaugaccugggaacagggcagcucuaugguagugauguugacaacccagguugagagggggcgcgucaaaugucaccaguacuggccugagcccacuggauccucaaguuaugguugcuaccaagugacgugccauagcgaagagggcaauacagcauauauuuuccggaagaugacccuguuuaaccaggaaaagaaugagucgagaccacucacucagauacaauacaucgccuggcccgaccacggggugccugaugacuccucugauuuccuggacuuugucugucauguuaggaacaaacgagcuggaaaggaggaaccaguggugguacacugcagcgccggcauuggucgcaccggggucuuaaucacaauggagaccgcaaugugucugauugaaugcaaucagcccguguauccucuugauaucguucggacuaugagagaccagagggccaugaugauacagacaccgucacaauaccguuucgugugugaggcuaucuugaaagucuaugaagagggcuuugugaagccacucacgaccaguacuaacaaauga

SEQ ID NO: 61386 - RNA, 1602 nt, Artificial Sequence
  derived and/or modified sequence opt3 from PTPN5__Homo_sapiens__NP_001265165
augaacuacgagggcgccagaagcgaaagggagaaucacgcugcagacgauuccgaagggggagcccuggacaugugcuguucugagcggcuccccggucuuccucagccaaucgugauggaagcgcuggaugaggcugagggcuugcaagacucacagcgcgaaaugccgcccccuccacccccuaguccacccagcgauccugcccagaagccaccgccccgaggggcaggaucccauucuuuaaccguccguucgucacugugccuauucgccgcuagccaguuucuccuggagccuacagcauggcuugacaguggcacuugggguguuccaucccuguugcucguguuccugucuguagggcuggugcucgucacgaccuuaguguggcaucugcuuagaacacccccugaaccacccacuccguugccucccgaggauaggcggcaaagcguuucccgccagccaucauuuaccuauagugaguggauggaagagaaaauugaagacgauuuccuggaccuagauccugugcccgagacaccagucuuugacugugugauggauauaaagcccgaagccgacccuaccagccucacuguaaaaucuaugggacugcaggagagaaggggcuccaacguuucacuuacacuggacaugugcaccccaggcuguaaugaggaaggguucggauacuugaugagcccgcgggaggaaagugcucgcgaguaucuccugucugccucccgaguguuacaggcggaagaacugcacgagaaggcacucgaucccuuucuucugcaagccgaguucuuugagaucccuaugaacuucgucgacccaaaagaauacgauauucccgguuuggugagaaagaauagguauaagacgauccuaccuaacccacacagccgggugugccugacuucgcccgacccggaugacccucucucuuccuacauuaaugcuaacuauauccguggcuacgggggagaggaaaaagucuacauagccacccagggcccaaucguuucaacaguggcagauuuuuggcgcaugguauggcaggagcauacucccauuaucgugaugauuaccaauaucgaggaaaugaacgagaaguguacagaauauuggccugaggagcaggucgcuuacgacgguguggaaauaaccguucaaaaagugauucacacggaggauuauagacugaggcuuaucagucugaaaagcgggacugaggaacggggauugaagcacuacugguucacauccuggcccgaccagaagaccccagaucgagccccuccccuccugcauuuaguccgcgaaguggaggaggcggcccagcaagaaggcccacacugcgcaccgauuaucguacauuguucugcuggcaucgggagaacuggaugcuuuauugccacaagcauauguugccagcagcugaggcaggaggguguuguggacauccuaaagaccacgugccaacuccggcaggaccgcggcgggaugauucagaccugugaacaguaucaauucguccaccacgugaugucacuguacgagaaacagcuuagucaucaguccccugaauga

SEQ ID NO: 61387 - RNA, 1788 nt, Artificial Sequence
  derived and/or modified sequence opt3 from PTPN6__Homo_sapiens__NP_002822
auggugagaugguuccacagggaccugagcggccucgaugccgagacacuucugaaggggcggggaguccaugguuccuuuuuggcucgccccucucgaaagaaccagggcgacuucucauuaaguguucgugugggggaucaaguaacacacaucaggauucagaauagcggagacuuuuacgaucuguauggcggugaaaaauucgcaacucuaacggagcucguggaauacuauacccagcagcaagggguccugcaggacagagauggaacaauaauccaucuuaaauacccucugaacugcuccgacccaacuucugagcggugguaucacggccauaugucgggcgggcaggccgaaaccuugcuccaggcgaagggagagccguggacauuucuggugcgcgagucacugagccaacccggugauuucguucucaguguguuauccgaccagccuaaagcuggcccagggucuccccugagagucacccacauuaaggugaugugugaaggaggcagguacacuguaggugggcuugagacauuugauagcuugaccgaccugguugaacacuucaagaaaacgggaaucgaggaggccuccggcgcauuuguguaucuacggcagccuuacuacgccacucgcgucaaugcugcagauauugaaaaccgagugcucgagcugaauaagaaacaggaaucagaggacaccgccaaggcuggcuucugggaagaguuugagagucuucaaaaacaggaagugaagaaccugcaucagagauuggaggggcaaaggccagaaaauaaggguaaaaaccgguauaagaauauccuccccuucgaccacagccgugucauacugcagggacgcgauucuaacaucccuggcuccgacuacauuaaugccaacuauaucaaaaaucaguuacuggggccagaugagaacgcgaagacauacauugcaucacagggaugccucgaagccacuguuaaugacuuuuggcaaauggcuuggcaggagaacagcagagugaucguaaugaccacaagggagguggaaaaaggccggaacaagugugucccguauuggcccgagguggguaugcagcgagccuacgggccuuauaguguuaccaauugcggcgaacaugauacgacugaguacaaacuucgcacacugcaagugucuccauuggacaacggagaucuaauaagagaaauuuggcacuaccaguaucuguccuggcccgaccacggcgucccuagcgagccagggggagugcucucguuccuggaucagaucaaucagaggcaggagucucuuccccaugcagguccgauuaucguacacuguuccgcuggcaucgggcggaccggaacuauuauaguuaucgacaugcugauggaaaacauuucaacaaagggcuuggauugcgacaucgacauacaaaagaccauucagauggugcgcgcccagagaagugguaugguccagacggaggcgcaauacaaauucaucuauguggccaucgcacaguuuauugaaaccacaaagaaaaagcucgagguccugcagagccaaaaagggcaggaguccgaauacggcaauaucacuuauccucccgcuaugaagaacgcccaugcuaaggccucuaggaccagcucaaaacacaaggaggauguguacgaaaauuuacauaccaaaaacaagcgugaggaaaaaguuaagaagcagcggagugcagacaaagagaaguccaaaggaagccugaagcgaaaauga

SEQ ID NO: 61388 - RNA, 1305 nt, Artificial Sequence
  derived and/or modified sequence opt3 from PTPN7__Homo_sapiens__NP_001186726
augaacagacugggcugcuggcccgccaggagccucccucgguccgggcgcggaucuggucagcgaucacuuggccugggagggcacccaaguggcccgcgucaucccgguaccccugcugcaaagagaacaugggagagcccaggggugagggcccgggacugucccuuguccacuucuugguuaucggaaccuccacugggacccgcgccucaccuaucaaugguccaagcucauggcggccgcagcagagcccagccacucacgcugagucuuggggcagccaugacccagccgcccccugagaaaacaccagcuaagaaacacguuaggcugcaggaacggcgcggauccaauguggcauugaugcucgauguacgaucucugggugccguggagcccaucugcagcgucaacacuccuagagaagugacccugcauuuccucaggacagcuggccacccauuaacccggugggcccugcaacgucagcccccguccccuaagcagcuugaggaggaauuuuugaaaauucccucaaauuucguuaguccagaggaccuggauauaccugggcacgcgagcaaggaccgcuacaagacuauccuacccaacccacagucuagagugugucucggaagggcacaaucccaggaagauggcgacuauauuaaugccaacuacauccgggguuaugaugggaaagagaaggucuacauugcuacacagggacccaugccuaauaccgugucagacuuuugggagaugguauggcaggaagagguuagccugaucgugaugcuuacgcaacugcgagaaggcaaagagaagugcguccauuauuggccaacugaagaggagaccuacggcccguuccagauacgcauccaggauaugaaagaaugucccgaguauacagugagacaauugacuauucaguaccaggaagagaggcggagugugaagcacauccucuuuucugccuggccugaccaucagaccccagaauccgcagggccccuguuacgccuggucgcugagguugaggaaagcccugagacagccgcgcacccaggacccauugugguacacugcucggccgguaucggcagaaccggguguuucauagcaacgaggauuggaugccaacagcucaaggcucguggcgaaguggauauccuugguauugucugucagcugcgguuggaccgagggggcaugauccagacugccgagcaauaccaguuucuacaucacacacuggcucucuaugccggacagcugccggaggaaccuucuccauga

SEQ ID NO: 61389 - RNA, 1782 nt, Artificial Sequence
  derived and/or modified sequence opt3 from PTPN9__Homo_sapiens__NP_002824
auggagcccgccaccgcuccuagaccagacauggcaccggaacugacacccgaggaagaacaggccacuaagcaauuccucgaagagaucaacaaauggacggugcaguacaaugucagcccucuuuccuggaacguugcggugaaguuucugauggcuaggaaauucgauguauugcgggccauugaguuauuucacucuuaucgcgaaacccgacguaaggagggcauagugaaacugaagccacaugaagaaccccuaagaucagagauccucagugggaaguucacaauucugaaugucagggacccuacuggagcaagcaucgcccuuuuuaccgcucggcugcaccauccacacaaauccgugcagcauguuguguugcaggcacucuucuaccugcuggaucgcgccgucgacucuuuugaaacacaaagaaacggucucguguucauuuaugauaugugcggcucgaauuacgcuaacuuugaguuagaccuggggaagaaaguacuuaauuugcugaagggagccuuccccgcgaggcucaaaaagguucuaaucgugggcgcaccuauaugguuucgggucccauauucaaucauuagccugcuucugaaggauaaagugcgcgaacgaauccagauuuugaagaccagugaggugacucagcaccucccgagagaaugucugcccgagaacuuagguggguacgucaaaaucgaccuggccacauggaauuuccaguuucucccucaaguuaacggacacccagaucccuucgacgagauaauucuuuucucccugccuccagcuuuggauugggacucugugcauguacccggcccgcacgccaugaccauccaggagcuaguggauuaugucaaugcaaggcagaagcagggcauuuacgaggaauacgaggacauccggcgugaaaacccuguggggacguuucauugcagcaugucccccggaaaucuggagaaaaaccgcuauggugacguuccaugucucgaucaaacuagagugaagcugaccaaaaggucaggccacacacagacugacuacaucaaugcuaguuucauggauggguauaagcagaagaacgccuacauuggaacccaaggcccucuugagaacacauaucgggacuuuuggcugauggucugggaacagaaaguguugguaauaguuaugaccacgcgauucgaggaaggugggcgcagaaagugcggacaguacuggccccucgagaaagauagcaggauccgguuuggcuuccugacugugacaaauuuaggcgucgaaaacaugaaucacuauaagaaaaccacucuggagauucauaacacagaggaacgccagaagagacaagugacccacuuucaguuccuaucuuggccagacuacgggguccccuccucagcggccagccucaucgauuuucugagggugguucguaaucagcagagucuugcagugucuaacaugggagcucgguccaagggucaauguccugagccaccgauaguaguccauugcagcgccggcauugggcgaacgggaaccuucuguucguuggacaucugccuggcucagcucgaggagcugggcacacuuaauguguuucagacuguuucuagaaugaggacccagcgcgccuucuccauccaaacacccgagcaguacuauuuuuguuacaaagcaauucuggaguucgccgaaaaggaagguauggugucaagugggcagaacuugcucgcugucgagagccaguga

SEQ ID NO: 61390 - RNA, 2409 nt, Artificial Sequence
  derived and/or modified sequence opt3 from PTPRA__Homo_sapiens__NP_002827
auggacagcugguucauccuggugcuccuuggcuccgggcugauuugcgucucugccaacaaugcuaccacaguugcacccucagugggaauaacuagauugaucaacaguagcacggccgagccuguaaaggaagaggcgaaaaccuccaauccaacaucuucguuaacuucacugagcguggcuccgaccuuuagucccaacauuacacuagguccuaccuaccucacuacagucaauuccucugauagcgacaacggcaccacgaggacugccuccaccaauucaaucgggauuacaaucaguccaaacggaacuuggcugcccgauaaucaguucaccgacgcacggacagaaccuugggagggcaacagcucuaccgccgcuacgacuccagaaacauuucccccuuccgguaauucagauagcaaggaccgccgagaugagaccccaauaaucgcagugaugguugcccuuaguucucuguuggugauugucuucaucauuaucgugcucuauaugcugcguuuuaaaaaguacaaacaagcugggucccacagcaacucguucagacugucuaauggaaggacugaggacguagaaccgcaguccguuccccucuuagcccggucaccuaguacaaaccgcaaguauccaccccugccuguggauaaacuugaggaagagauaaauagaaggauggcggacgauaacaaguuguuucgggaggaguucaacgcacugccagccugucccauucaggcuaccugcgaagccgcaagcaaggaagagaauaaagaaaagaaccgcuacgucaauauccuaccguaugaccauucccgagugcaccucacgccuguggagggcguccccgauucugacuacauuaacgcuagcuuuaucaauggcuaucaggagaaaaacaaguucaucgccgcgcaagggccaaaggaagagaccguuaaugacuuuuggagaaugauuugggaacagaacacagccacuauagugaugguaaccaaucugaaagagaggaaggaauguaaaugcgcacaguacuggccugaucagggauguuggacauacgguaacauccgggugucagucgaggacgugacuguucuuguggauuauaccguccguaaguucugcauucaacaggugggcgacaugacaaaucgcaaaccccagagacugaucacccaguuucauuucacuagcuggccagauuucgggguacccuuuacgccuauaggaauguugaaguuccucaaaaagguuaaggcuuguaacccacaauacgccggcgcuauugugguccacugcuccgccgguguggggaggacaggaaccuuugucgugaucgacgcaaugcuggauaugaugcauacugagcggaaaguugacguguauggcuucguaagccgaauccgcgcccagagaugucagaugguccaaaccgauaugcaguacguguuuauuuaucaggcuuuacuggaacacuaccucuauggcgacacagagcuugaaguuaccucucuggagacucacuugcagaagaucuacaauaaaauuccggggacaucaaacaauggacuagaagaggaguucaagaaacugacgaguauaaagauccaaaacgauaagaugaggaccgguaaccuccccgcgaauaugaaaaagaaccgggugcugcagauuaucccuuacgaauuuaaucgcgucaucauuccagugaaaagaggcgaggaaaacacugacuauguaaaugcaaguuucauagacggguacaggcagaaggauuccuauaucgccucucagggaccccuucugcauacaauugaggacuuuuggcguaugaucugggaguggaaaucgugcagcauugugauguugaccgaacucgaggaacggggccaagagaagugugcucaguacuggccuuccgauggucugguuucauauggggacaucacagucgaauuaaagaaagaggaggaaugcgagaguuacacugugcgagaucugcuagugaccaacacgagagaaaauaagucuaggcagauacgccaguuccacuuucauggcuggccagaggucggaauccccagcgacggcaaagggaugauuuccaucauugccgcaguucaaaagcagcagcagcaaucaggaaaccacccgaucaccgugcacugcagcgccggugcuggccggacagggacuuucugugcccucucuaccgugcuggaaagaguaaaagcagagggaauacuugaugucuuucagacagugaaguccuugaggcugcagcgcccucauaugguucaaacucucgagcaguaugaguucugcuacaaggugguccaggaauacauugacgcguucagugauuaugcuaauuuuaaauga

SEQ ID NO: 61391 - RNA, 6648 nt, Artificial Sequence
  derived and/or modified sequence opt3 from PTPRB__Homo_sapiens__NP_001103224
auggaggccgaguucuacauggugauccugaccugccucauuuuuagaaacagcgaaggauuccagauaguccacguucaaaagcagcagugucuuuucaaaaaugaaaaggugguagugggguccugcaacaggacaauccagaaucaacaguggauguggacugaagacgaaaaacuguugcaugucaagucugcuuuaugucuggcaauuucaaacaguagccggggacccucccgcucugccauccuagaucgaugcucgcaggcgccucguuggacguguuaugaccaggaagguuuccucgagguggaaaaugcuucacuguuucuucaaaaacagggcagccgaguuguggucaagaaggccaggaaauaccugcacaguuggaugaagauugaugugaacaaagaggggaaguugguaaaugaaucccucugccugcagaaagcaggacugggcgccgagguuucugugcggagcacccgcaacacagcuccaccgcagauccucacuaccuucaaugcaguccccgacgguuuaguguuucugauaagaaacacaaccgaggccuucaucaggaaugcugccgaaaacuauucccaaaauucaagugagcggcagcauccuaaccuucacaugacugggauuacagauaccagcuggguguugucuacgacucagccauuuuccucaaccacagaagagacuggacuggcggaacccgagcgcuguaauuucacccuagcagagagcaaggccaguucucauuccgucagcauccaauggagaauuuuaggcucgccuugcaacuuuucucugaucuacuccucagacacacuuggcgcugcccuguguccaaccuucagaauagauaacacgacuuaugggugcaauuugcaggaccuccaggcaggaacaauuuacaacuuuaggaucauuagucuggaugaagaacggaccguuguguuacagacugacccccugccuccagcucguuucgguguaagcaaggagaagacaaccuccacgucucuccacgugugguggaccccgagcucaggcaaggucacaaguuaugaggugcaacuuuucgaugaaaauaaccagaaaauccaggggguucagauccaagaguccacuagcuggaaugaguacaccuuuuucaaccugacagccggaucuaaguacaauauugcgauaacugccgugucaggcgguaaacgcaguuuuagcgucuauaccaacggguccacagugcccucuccuguaaaggacaucggaauuucgaccaaagcaaauagcuugcuaaucuccuggucacacggcaguggcaacguugaaagauacaggcugaugcucauggauaaggggauacuggugcauggaggugucguggacaagcacgcuacuucuuaugccuuccauggccuuacgccaggguaccuguauaauuugacagucaugaccgaggcugccggacuccagaacuaccgguggaaacuggugcgaacugcacccauggaaguuagcaauuuaaaggugaccaacgacggcucccugacaucacuaaaaguaaaguggcagcgcccuccagguaaugucgauagcuauaacauuacccucucucacaaagggacuaucaaggaguccagagugcuggcccccuggaucacagaaacgcacuuuaaggagcuuguuccgggcagguuguaccaggugaccgucaguugugugagcggagagcugucugcucagaagauggcgguaggccggacuuucccugacaagguggcaaaccucgaagccaauaacaaugggcgcaugagaucccugguugucucauggagucccccagcuggagauugggagcaguacaggauucuucuguuuaacgacagcgugguguugcucaauaucacagucgguaaagaagagacccaguauguuauggaugacacaggccuggugccugggcgucaguacgagguggaaguaauugucgagucgggaaaccucaaaaauuccgaacggugccaaggccgaacugugccccuggccguucuacagcucagagugaaacaugcaaacgagaccucucugagcauaauguggcagacgccagucgccgaaugggagaaguauaucauuucacuugcugauagggacuugcugcucauccacaagagucuguccaaagaugccaaggaguucaccuuuacagacuuagugcccggucgcaaauacauggcaacuguuaccucuaucagcggggaucugaaaaauuccucaagcgugaaaggccggacaguaccugcgcaagucacugaccuucauguggcuaaccagggaaugaccaguucuuuguucacgaauuggacacaggcccagggcgacguggaauuuuaucaaguccuccugauucacgagaacguugugauaaagaaugaauccaucagcucggagaccucaagauacucuuuccauagucuaaaguccgggagccuguauucuguaguggucacuacagugagcggagguauuuccucaaggcagguuguggucgaaggccgcaccgugccaaguagcguuucuggggugacugucaacaauuccggacgaaacgauuaccucucaguaaguuggcugcuugcaccgggcgacguggauaacuacgagguuaccuugagccacgacgguaaagugguccagucccuggugaucgccaagucuguacgggagugcucguuuagcucauuaacacccgggcgucucuauacggugaccauuacuacaagauccggcaaauacgaaaaucacaguuucucucaggagaggaccgucccugauaagguucaaggagugagcguguccaacucagcucgcucugacuaucugcgggucagcugggugcaugccacaggcgauuucgaccacuacgaaguuacuaucaaaaauaagaacaauuuuauacagaccaaaaguaucccaaaguccgagaacgaauguguauucgugcagcuuguccccgggagacuguauagcgugacgguuacaaccaagucuggacaguacgaggcaaaugagcaaggcaacgguaggacuauuccugaaccagugaaagauuugacccuccgaaaucgcucaacagaggaccugcaugucacuugguccggggcuaacggagauguggaccaguaugaaauccagcuacuguuuaaugauaugaagguauuucccccguuucaccucgucaacaccgccacagaguaccgguucacgagucugaccccuggcagacaauacaaaauucuuguguugacuaucagcggugacguucagcagucggcguuuauagagggcuucacagugccaucugccgucaagaauauucacaucucccccaacggggcuaccgacagccugacugugaauuggacaccuggaggcggggauguugacucauauaccgugagugcauuuaggcauucucagaaagucgauucccaaacgauucccaagcacguguucgaacauacuuuucaccguuuagaggccggagaacaguaccagaucaugauagcuagcguaucaggcagucucaagaaccagaucaacgugguuggucgcaccgucccagccagcgugcaaggggugauugcagacaaugcguauuccucuuacagccugaucgucuccuggcagaaagccgcuggaguagccgagcgguaugauauucuucugcuaacagaaaacggcauccuccugagaaauaccucagagccugcaacuacaaagcagcauaaauucgaggacuugacccccgguaagaaauacaagauacagauucugacagugucuggcggguuauuuaguaaggaagcucaaacugagggaaggaccguuccagccgcagugacggaucuccgaaucacagaaaacucgacccggcaccugagcuuccgcuggacugccuccgagggcgaacuuucuugguauaauaucuuccuguacaacccggacgggaauuugcaggagagagcucaggucgauccucucgugcagucauuuagcuuccaaaaccugcuacagggaaggauguacaaaaugguuauugugacccacuccggcgagcugaguaaugaaucuuuuaucuucggucggacaguccccgcgagcgugucacaucuucgaggguccaacagaaauacuaccgacagucucugguuuaacuggagcccagccucuggagauuucgacuuuuaugagcugauuuuguacaaucccaacggcacgaagaaagaaaauuggaaggauaaagaccugacagaguggcgcuuccaggguuuaguaccuggcaggaaguaugugcucuggguugucacccacuccggggaccugucaaacaaggugacugcagaaagccguacagcuccaucgcccccuucucuuaugaguuuugccgauauagccaauaccucccuggcuaucacuuggaaaggaccgccagacuggacagauuacaacgacuucgaguugcaauggcucccccgggaugcacugaccguguuuaacccuuauaauaacagaaagagcgagggcaggauugucuacgggcuacgcccaggacgaucauaucaguucaauguuaaaacgguguccggcgacucuuggaagacuuacagcaaacccaucuucgguaguguaagaaccaagccugauaaaauucagaaccugcauugccggccgcaaaauuccacagccaucgcguguagcuggauacccccagacucugauuuugacggguacucaaucgaaugcaggaagauggauacccaagagguggaguucagucgcaaacuugagaaagagaagucccuccugaacauuaugauguuggucccucacaaacguuauuuagugagcaucaagguucagucugcuggaaugacaucggaaguggucgaggacucaacuauuaccaugaucgacagacccccaccucccccaccgcauauacggguaaaugaaaaagaugugcugauuagcaaguccaguaucaacuuuacgguuaauuguucuugguucagcgacacaaacggcgccgugaaguacuuuacugucguggucagggaggcagauggcuccgacgaacucaaaccugagcagcagcacccccugccaucauaucuugaguaccgccacaaugccaguauccgaguguaucaaaccaacuacuucgcuucuaagugcgcagaaaaucccaacagcaauuccaaaucauuuaacauuaagcugggggccgagauggagagcuugggagguaaaugugauccuacacagcagaaguucugcgacggcccacuaaagccccauaccgcguauagaauaucuauccgggcuuuuacucagcuguucgaugaggaccucaaagaauuuaccaagccucuguacuccgauacauucuuuagucuuccgauuacgacugagagcgagccauuauucggggccaucgaaggaguuucggcaggccuguuccucauugguauguugguggccguaguggcucugcucaucuguaggcaaaaagucucccacgggcgcgagagacccucugccaggcugucaauacggcgugaccgcccucuuagcguucaucugaacuugggacagaagggcaaucgaaaaaccaguugccccaucaagauuaaccaguuugaaggccacuucaugaagcuacaagcagauuccaauuaccugcucucuaaagaguaugaagaguuaaaggacguggggagaaaccagagcugugauaucgcucugcuuccagagaauaggggcaagaaccgguacaauaacauucugccuuaugacgccacacgcgucaagcucucaaauguggacgaugaccccugcuccgauuacaucaacgcgaguuauauaccagguaauaacuuuagaagggaauacauuguaacccagggcccuuugccggggacuaaagacgauuucuggaagauggugugggagcagaauguucacaacaucgugauggucacacaaugcguggaaaagggacgggucaaaugugaccauuauuggcccgccgaucaggacagccuguacuacggcgaucucauccugcagaugcuuucugagucagugcuaccagaguggaccauucgagaauuuaagaucugcggugaggaacagcuggacgcacacagauugauacgccauuuccacuauacgguuuggccugaucaugggguacccgagacuacacaauccuuaauucaguuugugaggaccguccgggacuacaucaaucguagcccaggagcuggcccuaccgugguucacuguucugccggcguggggagaacuggaacauucauugcucuggauaggauccuccagcagcuggacaguaaagacucggucgauauauauggugcagugcacgaccuucgccugcaucggguacacauggugcaaaccgaaugccaguacguuuaucuccaucaguguguccgagauguguugagagccaggaagcugcgcuccgagcaggagaacccccuauuuccgauuuacgaaaacgugaauccagaguaucaccgggacccugucuacagcagacacuga

SEQ ID NO: 61392 - RNA, 621 nt, Artificial Sequence
  derived and/or modified sequence opt3 from PTPRCAP__Homo_sapiens__NP_005599
auggcccugcccugcacccucggccuugggaugcuguuggcuuuaccuggagcacuggguagcggcggguccgccgaggacucugugggaucaaguagcgucacaguugugcuacuccugcuucuguugcuccugcuggcgacuggccucgcuuuagccuggagaaggcugucccgggauucugguggguacuaucacccagcacgccuuggagccgcuuuguggggccgaacgcguagacugcuaugggcaucgccgcccgggagguggcuccaggcccgggcugaacugggcucaaccgacaacgaucuugagcgccaagaagacgagcaggauacagacuacgaucauguagccgacggaggucugcaggcggauccuggcgaaggggagcagcaauguggagaggcaagcaguccagaacaggugcccgucagagccgaggaagcuagggacuccgauacugagggcgacuuggugcucgguucuccugggccagccagcgcaggaggcuccgcugaggcccuguuaucagaucugcacgcguucgccggcagugcagcuugggacgacagcgcccgggcugccgggggacagggucuccauguuaccgcacuuuga

SEQ ID NO: 61393 - RNA, 4509 nt, Artificial Sequence
  derived and/or modified sequence opt3 from PTPRD__Homo_sapiens__NP_001035802
auggugcacgucgccagacugcuccuucuguuguuaaccuucuuucugaggacagacgcugagacucccccucgguucacgcgcaccccaguugaucagacaggcgugagcgggggaguagcauccuuuaucugccaagccacuggugacccgcgacccaagauuguguggaacaaaaagggcaaaaaggucucuaaucagcguuucgaagugauagaguuugaugacgggucaggaaguguucuaagaauccagccucucaggaccccacgggaugaagcgauuuacgaguguguggcuagcaacaaugucggcgaaaucuccgugucuacacgccugaccguacuuagagaggaccagauucccagggguuucccuacuaucgauauggggccacaacugaaaguuguggagcggacacgcaccgccacgauguugugcgcagccucgggaaaccccgacccugaaauaacuugguuuaaggauuuccucccagucgacaccucaaauaacaauggccgaaucaagcagcugagaagcggcgggacaccgauuaggggagcucugcagaucgagcagagugaagaguccgaucaagguaaauaugaguguguggcaacuaacucugccggcacccgguacagcgcucccgccaaucucuaugugcgugaauuacgcgaggucagaaggguuccuccacgguuuuccauucccccuacaaaccaugaaaucaugccagggggaucagugaauauaaccugcguagcggugggcagucccaugccguacgucaaguggaugcugggugcagaggaccuuacgccugaagaugacaugcccauugggcgaaacguguuggagcugaaugacguucgccagagcgccaacuauacuuguguggcuaugucuacacuaggagucaucgaggccauugcacagaucaccgugaaagcucucccaaagccucccggcacuccaguaguuacagaauccaccgccacgucaaucacccugacaugggauagcggcaaucccgagccugugaguuacuauauuauacagcacaaaccaaagaacucugaagaacuuuacaaggaaaucgacggggucgcgacuaccagauacuccguggccggacugagcccguauucggauuacgaguucagggucguggcaguuaacaauauuggucgggggcccccuucugagccaguguugacacaaacuuccgaacaggcucccucaagugccccucgcgacguacaggcuagaaugcucagcuccaccacaauccugguccaauggaaagagccagaagaacccaacggccagauacagggauauaggguguacuauaccauggauccgacucagcauguuaauaacuggaugaagcacaauguggccgacucucaaauuacgacaaucggcaacuuagucccucagaaaaccuacagcgugaagguacuggcauuuacuucaaucggugaugggccacucaguuccgacauucaggugaucacccagacaggcguucccggacaaccucuuaauuucaaagccgaacccgagagcgagaccucuauucuguugucauggacuccaccucguagugauacaauagcuaacuaugagcuagucuacaaggacggcgagcauggggaggagcagcggaucacgauugagcccggaaccagcuaccgacugcagggucucaaaccaaauucccuguauuacuuuagacuugcggcaaggucuccgcagggccugggggccucgacugcugaaaucagcgcccgcacaaugcaauccauguucgcaaagaacuuccacgugaaggccgugaugaaaaccucagucuugcucaguugggagaucccugaaaauuauaacucugcuaugcccuuuaagauucuguacgaugacggaaaaaugguugaggaaguggacggccgggccacacagaaguuaauagugaaucugaaaccagaaaagagcuauuccuucguacuaacuaacagagguaauucagcagggggccuccagcacagggucaccgcgaagacggcucccgaugugcugcgcaccaaaccugccuuuaucggaaagacaaaccuugacggcaugauuacuguucaguugccagaggugcccgcaaacgaaaauaucaaaggguacuauauuaucauagucccucugaagaaaagccgaggaaaguucaucaagccgugggagucuccagaugaaauggagcucgacgaacugcuuaaagagauuucccggaagcguagaaguaucagguacggucgcgagguggaacugaaacccuacauugccgcucauuuugauguuuugccuaccgaguucacacucggcgacgauaagcacuaugggggauuuacuaacaaacaacugcagagcggccaggaauacguguucuuuguauuagccgucauggagcaugcagaaucuaagauguaugcuaccuccccauacucagaccccguggugaguauggaucuggacccucaaccgaucacggaugaggaggaaggucuaauaugggucguugggcccgugcucgccguaguguucauuaucugcauugucaucgcgauacugcuuuauaagagcaaaccagaccggaagagagccgagucggauuccaggaaaucuagcaucccuaauaacaaggaaauucccucacaccacccaacagacccuguggaguugcgacgccugaauuuucagacccccggcauggcuagucauccaccgaucccuauucucgagcuggcagaccacaucgaacgguuaaaagccaacgauaaucugaaguucucccaggaguacgaaucuauagaccccggacagcaauuuacuugggagcauagcaaccuugaaguuaauaaaccaaagaacagauaugcuaaugugauugccuacgaucacuccagggucuugcucucagcaaucgagggcauccccgggagcgacuacgugaacgcgaauuauauugauggauaccguaagcagaacgccuauaucgcuacacagggcagucugccugagaccuucggugacuucuggcgcaugauuugggaacagcggucugccacuguugugaugaugaccaaacuagaggaaagauccagggucaagugugaucaauacuggccaagccgagggacagagacgcauggacugguacaggugacccuccuggacacuguugaacuugcaacauauugcgugcggaccuuugcuuuguacaaaaauggcucgucagagaagcgcgaggucagacaguuccaguuuacagccuggcccgaucacggugugccugaacacccgacuccauuccuggcauuuuuaaggcggguaaaaaccuguaaucccccugacgccggccccauggugguccauugcucugcugggguuggacgaacgggcuguuucauagugaucgaugcgaugcucgagagaauuaagcacgaaaagacaguggacaucuaugggcaugucacccugaugcgcgcccaaaggaacuacauggugcagacugaggaucaguacauuuuuauccacgacgcacuucuggaagcuguuaccugcggaaacacagagguaccagcccguaacuuguaugccuacauacaaaaacucacucagaucgagaccggcgaaaaugugacagguauggagcuggaguucaagcggcuagcuaguuccaaagcacacacgagcagauuuauuucugccaaccugccuugcaauaaguucaaaaacaggcucgucaauaucaugcccuaugagagcacccgcgugugucugcagccaauucgagggguugagggauccgacuacaucaacgcgucauuuauagauggcuauagacagcaaaaggcuuacauugccacucaggguccucuugcagaaacaaccgaggacuucuggcggauguugugggaacauaauaguacuaucguggucaugcugacaaaguuaagggagaugggccgcgaaaaaugccaccaguauuggccggccgagcguagcgcuagauaccaguacuuugugguagaucccauggcagaguauaacaugccacaauacauccuccgggaguucaaggucaccgacgccagggaugggcagucucgcacggugcgacaguuccaguuuacugacuggccugaacaaggaguucccaaauccggcgaaggguucauugauuuuauaggacaggugcauaagaccaaagagcaguucggccaggacgguccaaucucaguccacuguagugcgggggugggaagaacaggcguuuuuauuacccugagcaucgugcuugaacggaugagguaugagggugucguggauauuuuccaaacuguaaagaugcugcgcacacagagaccugcuauggugcagaccgaggaccaauaccaguuuuccuauagggccgcacuagaauaccucggcucuuucgaucauuaugccacauga

SEQ ID NO: 61394 - RNA, 2103 nt, Artificial Sequence
  derived and/or modified sequence opt3 from PTPRE__Homo_sapiens__NP_006495
auggagccccugugcccucuccuucuggugggcuucagcuugccauuagccagagcucugagggggaacgaaaccacagcagacuccaaugagacuacgaccacaucuggaccgcccgauccuggugccucacagccacuacucgcguggcugcuucugcccuugcuccugcugcucuuaguccugcuuuuggcugccuacuuuuuccgguuucgcaagcaacgaaaagcaguugugaguacuagcgacaagaaaaugccuaacggcauccuggaagaacaggaacagcagcguguaaugcuacucuccagaucuccaucggggcccaagaaauauuucccuauuccaguggagcaccuggaggaagagauaaggauccggucagccgaugacuguaagcaauuucgcgaagaguucaauagccuuccgaguggacauauucagggcaccuuugagcuggcuaacaaggaagagaauagagagaaaaacagguaccccaauaucuugccuaacgaucacucccgggucauucucucucagcuggacgguaucccaugcagcgauuauauaaaugcauccuacaucgacggguauaaggagaaaaacaaguucauugccgcucagggacccaaacaagaaacagugaaugauuuuuggcgcaugguuugggagcagaagucagccaccaucgugauguuaacuaaccugaaggagcgaaaagaagagaagugucaucaguacuggccugaccagggcugcuggacauauggcaauauuagagucuguguggaagauugcguaguucucguggacuacaccaucaggaaauucuguauacaaccacagcuucccgaugggugcaaggcgccgcggcuggucagucaguugcacuuuacgagcuggccugacuucggagugcccuuuacuccaauugguaugcuaaaauuccugaagaaagugaagacccucaacccuguccaugcaggccccaucguugugcacuguucugccgggguaggacguacaggcacuuucauugugaucgacgcuaugauggccaugaugcacgcagagcaaaaggucgauguguuugaguucguuucccgcaucagaaaucagaggccacagauggugcagaccgacaugcaauacacauuuauuuaucaggcucugcuugaauacuaucuguacggugauaccgaguuggacgucucaagccucgaaaaacaucugcagacgaugcacgggacuacaacccauuucgauaagauaggauuagaggaagaguuucggaaacugacuaacgugcgaaucaugaaggaaaacaugcgcacaggcaaucuacccgccaacaugaaaaaggcgagaguaauucagaucauaccuuaugacuucaauaggguuauucucaguaugaagcggggccaagaguacaccgauuauaucaacgccucuuuuaucgacggguaccgccagaaagauuacuucauugcaacgcagggaccacuggcucacaccguggaggacuuuuggagaaugaucugggaauggaagucccacacaauugucaugcuuacugaggugcaggaaagggagcaagauaaaugcuaucaguacuggccgaccgaggguagcgucacacauggcgaaauaacuaucgagauuaagaaugacaccuugucggaagccaucucuauccgugacuuccuggugacacucaaccagccccaggcucggcaagaggaacagguucgagugguaagacaguuucacuuccauggguggccugagauuggaauaccagccgagggcaaagguaugaucgaucugauugcagccguccaaaagcagcagcagcaaaccgggaaucaccccaucacugugcauuguuccgcuggcgcgggaaggacgggcacauuuauugcacuuucaaacauccuggaacgcguuaaggccgagggguugcucgacguguuccaggcugucaaaagucugcgguuacagagaccucacauggugcagacccuggaacaauaugaguucugcuacaagguagugcaggauuuuauagacaucuucagcgauuaugccaauuuuaaauga

SEQ ID NO: 61395 - RNA, 4338 nt, Artificial Sequence
  derived and/or modified sequence opt3 from PTPRG__Homo_sapiens__NP_002832
augagaaggcugcucgagcccugcugguggauccuuuuccugaagauuaccagcuccguguugcacuacgucguuuguuuuccugccuuaacagaaggcuaugugggggcucugcaugagaaccggcacggaucugcaguacagauacgccgacguaaagccucaggugacccauacugggcguauaguggcgcuuacgggccggaacauugggugacuagcuccgucucuugcggaggcagacaccaaucgcccaucgauauucuagaccaguaugccagggugggugaggaauaccaggagcuccagcuggauggguucgacaaugagucaagcaacaagacguggaugaaaaauaccggaaagacaguugcaauccuucugaaagaugacuauuuugugaguggcgccggcuugccugggcgguucaaggcugaaaaggucgaguuucauuggggacacuccaacgguucugcaggcagcgaacacuccauuaaugggcgcagauucccaguggagaugcaaaucuuuuucuacaaccccgaugacuuugauucauuccagacugccauaagugagaauaggaucauuggagcuauggccaucuuuuuccagguaagcccucgggacaacucugcgcucgauccaauuauccauggccugaaagguguugugcaccaugaaaaggagaccuuucuggaccccuucguccuccgcgauuuacugccugcaucccuugggucauacuaucgauacacagggagcuugaccacuccaccguguagugaaauaguggaguggauuguguucagaaggcccgucccuaucucuuaucaccagcuggaagccuuuuacuccauuuucacaaccgagcaacaggaccacguuaaaagcguggaguaucuacggaauaacuuucguccacagcagcgccuccaugacagaguagugucgaagucugcugucagggauuccuggaaucacgacaugacggauuuccuggaaaacccccuuggcacugaggccucaaaagugugcaguagcccuccaauccauaugaagguucaaccccugaaucagaccgcacuccagguguccuggucucaaccggaaacaaucuaccacccucccauuaugaacuauaugauaagcuacucauggacuaagaaugaggacgaaaaagagaagaccuuuacaaaagauagugacaaggauuugaaagcuaccaucucccaugucagcccagacucucuguacuuauuccgggugcaggccguaugucgaaacgauaugcgcucagacuuuagucagacgaugcuguuccaggcgaacacuacaagaauuuuucaaggcaccaggaucguuaagacuggggugccuacagccagccccgcauccucugcugauauggccccaauaucgagcggauccucaaccuggacgaguucugguauucccuucagcuuugucuccauggcuaccggcauggggccuucaagcucuggaucccaggccacaguggcaagugucgugacuagcacccuccuugccggccuggguuucgggggcggaggcaucucuuccuuuccaucaacaguuuggccgacucgguugcccaccgcugcgagugcaagcaaacaggccgcucgcccugugcuagccacaaccgaggcacuggccucgccagggcccgacggagacuccucuccuacuaaggauggugaaggcacggaggaaggggagaaggacgagaaaagcgagucagaggauggagaaagagagcacgaagaggacggcgagaaggauagugagaaaaaggaaaaauccgguguaacacacgcugccgaagagaggaaucagaccgaaccaucucccacuccgagcuccccuaaccguaccgcagaagggggccaucaaacaaucccaggacacgagcaggaccauaccgcgguccccacugaucagacaggcgggcggcgagacgcuggaccuggucucgaucccgacauggugacgucaacccagguuccaccuacugccacagaggaacaauaugcaggcagcgaucccaagagaccagaaaugccgaguaagaaaccuaugucuaggggagaccgcuucuccgaggauagccgguucauuaccgugaaucccgccgaaaagaacacaucgggaaugaucucaagaccagcucccggcaggauggaguggauuauaccucugaucgucgugucugcccuuacuuuuguaugccugauuuugcucaucgcagugcugguuuacuggcgcgguuguaauaaaaucaagaguaaaggguucccacgacgguuucgugagguccccuccagcggcgaaagaggagagaagggcucuaggaagugcuuccagaccgcucacuuuuauguggaagacagcuccucaccucgcguggucccgaacgagaguauuccaauaauccccauuccugacgauauggaagccaucccaguuaaacaguucgugaagcacauuggggaguuauacagcaauaaccagcauggauuuucugaggacuucgaagaggugcaacgguguacggcggauaugaauaucaccgccgaacacuccaaccaucccgagaauaaacacaagaacagauauauaaauauccuggcuuacgaccauucaaggguaaaacuacgaccucucccgggcaaggauaguaagcacagcgacuauauuaacgcaaauuacgucgaugguuacaacaaagccaaggcuuauaucgccacacaggggccccugaaauccacuuuugaggacuucuggcgcaugauuugggaacagaacaccggaaucauagugaugauuacaaaucuuguugagaagggccggagaaaaugcgaucaauacuggccaacugaaaacucugaggaauaugguaauaucauugugaccuugaagucgacgaaaauccacgcauguuacacagucaggcguuuuagcauacgcaacaccaaggugaagaaaggccagaaggggaauccuaaaggacggcagaacgagagaguugugauccaguaucauuacacucaauggcccgacaugggcguaccagaguaugcgcugccuguccucacauucgugaggcgaucauccgccgcucggaugcccgaaaccgggccagugcugguccacugcagugccggaguuggccgcacugguaccuacauugugaucgauucuaugcuucagcagauuaaggacaaaagcacaguaaaugugcugggguuuuugaagcauaucagaacgcagaggaacuaccucguccaaaccgaggaacaguauauauucauucacgaugcacuguuagaggcuauccugggaaaggaaacugagguguccucaaaucagcuacauucuuacguuaacagcauccucauuccgggcguggguggcaaaacacggcuggagaagcaguucaaacuugucacccaaugcaaugccaaguauguggaauguuuuagugcacagaaagagugcaacaaggaaaagaaucgaaacuccagcguugugccuucugagagagcccgcgucggguuggcuccccugccaggaaugaaaggcacagacuacaucaaugcgucauauauuaugggguacuauagguccaacgaguucauaaucacucagcacccccucccucacaccacgaaggacuuuuggcguaugauuugggaucauaacgcccaaaucauuguaaugcugccagacaaucagaguuuagcagaagaugaguucguguacuggcccagccgggaagagucgaugaacugugaagccuuuacaguuacccugaucucuaaagacagacuuugcuuguccaaugaggagcagauaaucauucacgauuucauccucgaagcuacucaggacgauuacgugcuggaggucaggcauuuucaauguccuaaguggccgaacccagacgcccccauuagcucaaccuucgaacuaaucaaugugauaaaagaggaagcucugacacgcgauggaccuacuauuguacacgacgaguauggcgcagugagugccgguaugcucugcgcgcugaccacacuuucucagcaguuggagaacgaaaaugcugucgauguuuuucagguggccaagaugaucaaccugaugcgacccgggguguucacggacaucgagcaauaccaguuuauuuauaaggcaauguuaucccucgucagcaccaaagaaaauggaaacggcccaaugacuguggacaagaauggugccguucugauagcugaugagucagacccugcagaaaguauggagagccuuguauga

SEQ ID NO: 61396 - RNA, 2814 nt, Artificial Sequence
  derived and/or modified sequence opt3 from PTPRH__Homo_sapiens__NP_001154912
auggccggcgcugggggaggucugggcgugugggggaaccucguccuucugggauugugcagcuggaccggcgcaagagcccccgcgccuaauccagguaggaacuuaacaguugagacucagacgaccuccucuaucucacugaguugggaagugccggacgggcuagauagccaaaauuccaacuacuggguacaguguacaggagacggcggcacuaccgagacacggaauaccacugcuacaaacgugaccgucgaugggcucggacccgguucucuguauacgugcucgguguggguugaaaaggacggcguuaauucaagcgucgggacugugaccacagccacugcaccuaacccaguacgcaaucuuaccguugaggcccagacaaacaguuccauugcucugaccugggaagugcccgauggaccugacccacaaaauucuacguacggcgucgaguauacuggugaugggggacgagcaggcacacguagcaccgcccacacuaacauaacaguggacagauuggagcccggcugucucuacguguucuccgucuggguugggaaaaauggaaucaacucaaguagggaaacccggaaugcuacgaccgccccuaacccagugcgcaaccugcauauggagacacagacuaauagcucuauugcgcugugcugggaaguaccggauggucccuauccucaggacuacaccuauuggguggaguacacaggcgaugggggaggcacugagaccagaaacacaaccaauacuuccgucacggcagaaaggcucgagccagguacauuauacaccuuuucagugugggccgaaaagaacggggcucggggcagccgccagaauguuaguaucucuacugugcccaacgccgucaccucccugagcaaacaggacuggacaaauucgaccauugcacuucgauggacugcuccucaaggaccaggccagucuuccuauucauacugggugaguuggguaagagaggggaugacagaucccaggacgcagagcaccuccggaacugacaucacauugaaggaacuggaggccgguucucuauaucaccucaccguuugggcggagcggaacgaagugcguggcuacaauagcacacugacugccgcaaccgcuccgaacgaggucacggaccuucagaaugaaacccaaacuaaaaacucagugaugcugugguggaaggccccuggggauccccauagucaguuguaugucuacugggugcagugggcuuccaagggacacccacgcagaggccaagacccucaggccaauuggguuaaccagacaagcaggaccaaugagacaugguauaaaguggaagcacucgagcccgguacucuguacaacuucaccguaugggccgagcggaacgaugucgcuucuucaacgcagaguuuaugugcgagcacauacccagacaccgugacuauaacauccugcguuucuaccucggcaggguauggcgugaaucugaucuggagcuguccccaaggaggcuacgaagccuuugagcucgaagucgggggacagcgagguucccaggaucgcucaaguugcggcgaggcugugucuguacuugggcugggaccugccagaagcuauccagcaacuauuaccacaaucugggacggcaugaaggugguuucccauucagucgugugucacacggaaagcgccggugugauugcuggggccuucgucggcaucuugcuauuucugauacucguuggacugcuuauuuucuuucugaaaaggcggaacaagaaaaagcagcaaaagccggaguugcgcgaucucguguucucuucccccggcgacaucccugcagaggauuuugcggaccacgugaggaaaaaugaaagagauaguaacugcggguucgcugacgaguaccagcagcugagcuuaguaggacauucucagucccaaauggucgccucagcaagugaaaauaacgccaagaaucguuaucggaacgugcugccauacgacuggagccgaguuccccuaaaaccuauucacgaggagccaggcucggauuauaucaaugcuuccuuuaugcccggucucuggucuccgcaggaguucaucgccacccaggggccucugccacagacugugggagacuuuuggagacuugucugggaacaacagagccauacauuggugaugcugaccaacuguauggaagcaggcaggguuaagugcgagcacuacuggccccucgauucacagccuugcacacacggucaucugcgcgugacucuuguaggcgaagaggucauggagaauuggaccgugcgggaacuguugcuccugcaaguggaggaacagaaaacguuaagugucagacaguuccacuaccaggcuuggcccgaccaugggguuccauccucuccugauacacugcuagccuucuggaggaugcuccgccaauggcuggaccagaccauggagggagggcccccaauugugcacuguagcgcgggcguaggacgaacuggcacccuuauagccuuggaugugcugcuccggcagcugcaguccgaagguuuacuggggccguuuucauucguccguaagaugagagagagcaggccucuuauggugcaaacagaggcucaguauguguuuuugcaucagugcauccuccgcuuccugcagcaaagugcacaggcccccgcugaaaaagaggugccauacgaagacgucgagaaccuaauuuaugaaaauguggccgcaauccaggcgcacaagcuggagguuuga

SEQ ID NO: 61397 - RNA, 1620 nt, Artificial Sequence
  derived and/or modified sequence opt3 from PTPRJ__Homo_sapiens__NP_001091973
augaagcccgccgcuagagaggcaaggcugccuccacggagcccgggccuccgcugggcccuuccccuguuguuacugcuacuccgacuggggcagauccuuugcgcgggagguaccccuuccccaauucccgacccuucuguggcuacagucgccacuggcgaaaacgggauaacgcaaaucucaaguaccgcagagagcuuccacaaacagaauggaacaggcacuccacagguugaaaccaacacauccgaggauggugaaucuucgggggccaaugacucacugcguacccccgagcagggaagcaacggcacugauggcgcuagucaaaagacaccuuccucuaccgggccaagcccgguguuugacauuaaagcaguauccaucucacccacgaaugugauuuugacuuggaagaguaacgauaccgccgcuagcgaguacaaauaugucgugaagcauaagauggaaaaugagaaaacaaucacuguugugcaccagccuugguguaacauaaccggacucagaccagccacaucuuacgucuucuccaucacccccgguauuggcaaugaaacguggggagacccuagggugaucaagguaauuacugagccaauccccguuucagaucugcggguggcgcugacagggguccgcaaagcagcccucagcuggaguaacggcaaugguaccgcuucuugcagaguguuacuggaguccauagggagccaugaagaguugacucaggacucgaggcuucaggugaacauuucuggacugaagccgggcguccaauauaauaucaacccuuaccuacuccaguccaauaaaacaaagggcgauccccuggggaccgaaggaggucuugacgccucaaacacggagcggagucgcgcaggcagcccaaccgcuccuguucacgaugaaucccugguggggcccguagacccaucuagcggacagcagucacgagauacagagguguugcucgucggccuggagcccgguacuagauauaacgccaccguguacagucaagcggccaaugggacagaaggccagccucaggcaauugaguuuaggacuaacgcuauccaaguuuucgacgugaccgccgucaauaucuccgcuaccagcuuaacacugauuuggaaggugucugacaacgaaucaaguagcaauuauacuuacaaaauacauguagccggagagacggauuccucuaaccucaauguuucggaaccacgggcagugaucccgggccuucguagcuccacauuuuacaacauuaccgucugucccgugcugggggacaucgagggaacuccugguuucuugcagguccacaccccacccgugccuguuucagauuuucgcgugacaguagucaguaccacugagauaggccuagccuggucuagccacgacgcugaauccuuccagaugcauauuacacaggagggggcgggaaauucaagaguggaaaucacgaccaaccaaagcaucauuaucggcggucuguuuccagggacuaaguauugcuucgagauuguucccaaaggcccgaauggaacagaaggcgcaucuaggaccguguguaaccggacaggguga

SEQ ID NO: 61398 - RNA, 4341 nt, Artificial Sequence
  derived and/or modified sequence opt3 from PTPRK__Homo_sapiens__NP_001129120
auggacaccacagccgcugcagcccugcccgcguucguggcucuccuucuguugagcccuuggccauuacugggcuccgcccaggggcaauuuucugcaggagguugcacuuucgaugacggcccgggggccugugauuaccaccaggaccuauaugaugacuuugaguggguccauguuucagcucaggaaccccacuaccucccuccagagaugccccagggaaguuauaugaucguggauagcuccgaccaugauccuggcgaaaaggcaagacugcaacuuccaacgaugaaagagaacgacacccacugcauugauuucucuuaccuguuguauucgcagaagggucucaaucccgggacacugaacauacugguaagggugaauaaaggaccucucgccaacccaaucuggaaugucacuggcuuuaccggccgggacugguuacgcgcugaacuggccgugucaacauucuggccgaacgaguaccagguuauuuuugaggcggaagugagcgggggacgaagugguuauaucgcaauugaugacauccagguccuuuccuaccccugugacaagucuccucauuucuugcgucugggcgauguggagguaaaugccgggcaaaacgcuaccuuucagugcauagccacuggaagagacgcaguucacaauaaacuauggcuccagaggcggaacggcgaagauaucccaguggcucagacaaagaauauuaaccaccgcagauucgccgcgagcuuuaggcugcaagaggucaccaagacggaccaggaucuuuaccggugugugacucaguccgagcgcgguucaggggugaguaauuucgcccaacugaucguccgagaacccccuagaccaauugcacccccgcaguugcucggaguuggcccuaccuaucuguuaauccagcugaacgcuaauagcauaauuggcgacgggcccaucauucucaaagagguggaauacaggaugacaucuggauccuggacugagacccaugccguaaacgcuccaacauauaaacuuuggcaccuggauccugacaccgaauacgagauccggguguugcuaacgcgucccggugagggcgggacuggacugccaggucccccucucaucacacgcaccaaaugcgccgaaccaaugagaacuccgaagacacugaaaauugcagagauacaggccaggcggaucgcugucgauugggaaucacuuggcuauaacauuacccgaugucauacguuuaaugugaccaucugcuaccacuauuuccgcgggcacaacgagagcaaggcggacugucuggauauggaccccaaggcaccucaacauguugugaaucacuugccacccuacacaaacgucagucucaaaaugauacugacuaauccugaaggcagaaaggagucugaggaaaccauuauccagacagacgaggaugugccaggacccguaccgguuaaauccuuacagggcacuagcuucgaaaacaagaucuuucugaauuggaaagagccucuagacccaaacgggauuaucacccaguacgaaauuucguauucuuccauaaggucauucgaucccgccgugccugucgcuggacccccacaaacagugaguaaucucuggaacagcacccaucacgucuuuaugcaucugcacccugguacuacguaccaguucuuuauccgggccuccacagugaagggcuucgggcccgcaaccgccauuaauguuacuaccaacaucucugcuccaacacuuccggacuaugagggaguggaugccagcuugaaugagaccgcaacuacaaucacgguacugcuccgcccugcgcaggcuaaaggcgcccccauuucagcauaccagauagucguggaagaacugcacccacauagaaccaagagggaagccggugcuauggagugcuaucaaguucccgugacuuaccagaacgccaugagugggggcgcaccuuauuacuuugcugccgagcuuccacccggaaaucugccugaaccggcgccauucacagucggcgacaaccguaccuaccagggguuuuggaaucccccuuuggccccacggaagggauauaacaucuacuuccaggcuauguccagcguggagaaagaaacaaagacucaauguguacgaauugcaaccaaagccgcugccacggaggaacccgaggugaucccugauccggcaaagcagaccgacagaguugucaaaauugcggguaucucugccggcauacucguguuuauccuguuacugcuaguggucauucucaucguuaagaagucaaaacuggcuaagaaaaggaaggaugccauggggaacacacgccaggagaugacucacauggugaaugcaauggaccggaguuaugcugaucaaagcacccuucaugccgaagaccccuuguccauuacauucauggaucagcacaacuuuucuccaagauacgagaaucacucggcaacugccgaaagcuccaggcugcucgacgugccucgcuaucugugcgagggaaccgaaucacccuaccagacgggccaguuacauccagcuauccgaguagcggaccugcuucaacacauaaacuugaugaaaacaagugauucuuaugguuucaaggaggaguacgagagcuucuuugaggggcaguccgccucaugggacgucgcaaagaaagaucagaaucgggcuaagaaccguuacggcaauauuaucgccuaugaccauagcagagugauucuccagccuguugaagaugaccccucuuccgauuacaucaacgccaauuauauagacaucuggcuguacagggauggauaucaacgcccaagucacuacauugcuacccagggcccggugcaugagacugucuaugacuucuggcggaugaucuggcaggaacagagcgcaugcauugugaugguuacaaaccuaguggagguagggagagucaaauguuacaaguacuggccugaugacaccgagguguauggagauuuuaaagugacuugcgucgaaauggagccccuggccgaauacguugugaggaccuucacacucgagcgacgcggcuauaaugagauccgggaaguaaagcaauuucacuucacggguuggccagaccacggggugcccuaccaugcgaccggacugcuuucuuuuauaagaagggucaaguuguccaacccuccaucagcuggccccauugugguucacuguagugccggugcaggccguacugggugcuauaucgugaucgacauuaugcuggauauggccgagcgcgaaggagucguggacaucuacaauuguguuaaggcuuuacggagcagaaggauuaacauggugcagacagaggaacaguauauauucauccaugaugcaauucucgaggccugccuguguggcgagaccgcgaucccugucugcgaauuuaaggcugccuacuucgacaugauucgaaucgauucgcaaacaaacuccucucaccuuaaagacgaguuucagacucugaauagcguaaccccgcgguugcaggcagaagauuguucaauagccugccucccacgcaaccaugacaagaauagauucauggauaugcugcccccugacaggugucuacccuuucugaucacgauugauggggagaguuccaacuacaucaaugcugcccucauggacucuuaucggcagccagcagcuuucauugugacacaauacccucugcccaacaccguuaaagacuucuggcgacuuguguaugauuacggaugcacuagcaucgucauguugaaugaaguggaccugucccagggcugcccacaguauuggccugaggaggguauguuaagauacgggccgauacagguagaauguaugucaugcagcauggauugugacgugauuaaccgcaucuuuaggaucugcaaucucacccguccccaagagggauaucugaugguccagcaguuccaguaccuuggcugggccagucaccgggaaguuccagguucuaagagauccuuucugaaacuaauucuccaaguggagaaguggcaggaagagugugaggaaggcgaggggaggacaauaauccacugccugaacggaggcgggcgcagcggaauguucugugcgauuggcaucguggucgaaauggugaagcgacagaauguuguagauguguuucaugccgucaaaacuuugagaaacucgaagccuaauaugguggaggcacccgagcaguaccgguucugcuaugacguugcucuggaauacuuagagucaucuuga

SEQ ID NO: 61399 - RNA, 4398 nt, Artificial Sequence
  derived and/or modified sequence opt3 from PTPRM__Homo_sapiens__NP_001098714
augagaggccuggggaccugccucgccacacuugcuggacuguuguuaacugcagccggugagacguucagcggcgggugucuguuugacgaacccuacucuaccugcggauauucccagucagagggcgaugacuucaacugggaacaagugaauacacuaacuaagccuaccagugauccauggaugccgagcgguuccuuuaugcucgucaacgcgucugggaggcccgagggacagcgggcucaucugcuucugccucaguugaaagaaaaugacacacacuguaucgauuuccacuacuuuguuucgucaaagagcaacaguccacccggccuccugaauguguauguaaaagugaacaauggcccucuggggaacccaauuuggaauauauccggagaccccacccgcacuuggaaccgagccgagcucgcaaucucuacauucuggccuaauuuuuaccaggucauuuucgaggugaucaccagcggucaucaaggcuauuuagccauugaugaaguuaaggugcuggggcacccaugcacgcguacuccgcauuuucuuagaauccagaacgucgaggugaaugcuggacaguucgcaaccuuucaguguuccgccauaggcaggacaguagcuggugaccgguuguggcugcaagggaucgauguucgcgacgcuccccuaaaagaaauuaaggugacuucaaguagaagguucaucgcgagcuuuaacgucgugaauaccacaaagcgggaugcaggaaaauaccgcugcaugauucgaaccgagggcggcguggggaucucuaacuaugccgagcucgucguuaaggaaccuccagugcccauagcuccuccacagcuggccuccguaggagcaacguaccuuuggauucagcugaacgcuaauucaaucaacggugacggccccauuguggccagagaggucgaauacuguacugcgagcgggaguuggaaugauaggcagccgguggacucuacauccuauaaaaucggacacuuggacccugauaccgaguacgaaaucagcguucuccugacucggcccggcgagggugggacaggcucgccaggaccugccuuacguacccgcacgaagugcgcagaccccaugagaggcccaaggaaacuggagguggucgaagugaagucucggcaaauuaccauacgaugggagcccuucggguauaacguaacacgcugucacuccuacaaucucacuguucauuauugcuaccaggugggaggucaggaacaagucagagaggaagugucaugggauaccgagaacagucacccucagcauacaaucacuaaucuuagcccauauaccaacgucuccgugaagcugauuuugaugaauccggagggcaggaaagaaucucaggagcuaaucguucagacagacgaagaucugcccggggcugugccuaccgagagcauacaaggaucaacuuucgaagagaagauuuuucuccaguggcgggagccaacgcagacauacggcguaaucacccuguacgaaaucacuuauaaagccgucaguuccuucgaccccgagauugaucuuagcaaccagucuggucgcgugucaaagcuggggaaugaaacccacuuuuuguucuuuggccucuacccuggaacaaccuauaguuucacuaucagagcuagcacagccaaaggcuuugggccacccgcaacgaaccaauucaccacuaagauuuccgccccgucuaugccugcuuacgagcuggagacaccauuaaaucagaccgacaacacaguuacugugaugcugaaacccgcgcacucgaggggagcaccugucagcguguaucagauaguaguggaagaggaacguccccggcgaaccaagaagacgaccgagauccuaaaauguuacccaguuccuauucauuuucagaaugccucccuccugaacucacaauauuacuucgcugccgaauuucccgcagauagucuucaggccgcucagccauucacaaucggugacaacaagacuuacaauggcuauuggaacaccccguugcugccuuacaaaucuuauagaaucuacuuucaggccgcaagcagggcgaauggggagacaaagauugauugcguccaaguggcuacuaaaggagccgcaacccccaagccagugcccgagccugaaaagcagacggaccacacagucaaaauagccggcguuaucgcugguauucuccuguucgugaucauuuuccuuggggugguacuggucaugaagaaacgcaaguuggccaaaaagcggaaggagaccauguccucaacuagacaggaaaugacagugaugguuaacagcauggacaaaucuuaugcagagcaaggcaccaauugcgaugaagccuuuuccuucauggacacucauaaccucaauggaaggagugugagcucuccauccucauuuaccaugaagacaaacacgcugaguaccagcguccccaauucguacuauccugauccguucgugccaacugccaucuuaguucccauaaacgacgagacacacaccauggcguccgauacaucuagccuggugcagucacauacuuacaaaaagcgcgagccugccgacguaccauaccagaccggccagcuacaccccgcuauccgagucgcagaucuccugcaacacauuacgcagaugaaaugugccgaaggguauggauuuaaggaggaauacgagaguuucuuugaaggccaguccgcuccuugggacucugccaagaaagaugagaaucggaugaagaaccguuaugguaauaucauugcauacgaccauagcagagugaggcuucagacaaucgagggggauaccaacuccgacuauauaaauggaaacuacauugauggcuaucaccgcccgaaccauuacaucgcgacucaaggucccaugcaggaaaccauuuacgacuucuggcggaugguguggcacgagaauacagccucaaucauaauggucacuaacuugguugaagugggcagaguaaaaugcuguaaguauuggccagacgauaccgagaucuacaaagacauuaaggugacacugaucgagacggaacuccuggcugaguaugucauuaggaccuuugccguggaaaaacgagggguucacgagauccgcgaaauacggcaguuccauuuuacuggauggccugaucacggcgugcccuaccaugcaacaggguuacugggauucgucagacagguuaagagcaagaguccaccuucugcuggcccccuuguggugcacugcuccgccggugcagggaggaccggauguuuuauugucaucgacaucauguuggauauggccgagcgugagggcguaguggacauuuauaauugcguucgcgaacuccggagcagaagggugaacaugguccaaacugaggaacaguacguguucauccaugaugcuauucuggaggcgugucuaugcggugacacaucgguaccagccucacaggugcgaucucuguauuacgauaugaauaaacucgacccgcaaaccaacaguucccagauaaaggaagaguuccggacgcugaauauggucacuccuacccuucgcguugaggauuguagcaucgcauugcugcccagaaaccacgaaaagaauaggugcauggacauuuuaccacccgaucggugucucccuuuucugaucacaauugacggcgagucuagcaacuacaucaaugcugcccuuauggacuccuauaagcagccaucagccuucauagugacccagcacccccugccuaacacugugaaagauuuuuggcgauugguccucgacuaccauugcacaagugugguuaugcugaaugauguagacccggcucaacuaugcccacaguauuggcccgaaaacggggugcacagacauggaccuauccaggucgaguucgugagcgcagaucuggaagaggacauuaucucucgcauuuuuaggaucuacaaugccgcgcguccccaggauggcuaucggaugguucaacaguuccaguuucucggguggccaauguacagagacaccccuguguccaagaggucauuccugaaacuuauacgccaggucgauaaauggcaagaggaauauaacggaggcgagggucgaacagugguacacuguuugaacgggggaggcagaagugguacuuuuugcgcuauuagcaucgucugugaaaugcugcggcaucagaggaccguggacguuuuccacgccgugaagacguuacgcaauaacaaacccaauauggucgaucuccuggaccaguacaaguuuugcuacgagguggcacuugaguaucugaacuccggcuga

SEQ ID NO: 61400 - RNA, 3048 nt, Artificial Sequence
  derived and/or modified sequence opt3 from PTPRN2__Homo_sapiens__NP_002838
augggcccaccucugccacuccuucuguuguuacugcuacuccugccgcccagagugcuuccugccgcuccaagcuccguccccagggggcggcagcugccuggacgcuuggguugccuccuggaggaaggccuguguggggcaucugaggccugcguuaacgacggaguguucggccgaugucaaaagguaccagcgauggauuuuuaccguuaugaagugucacccgucgcucuccagagauuaaggguggcccugcagaaacuuagugguaccggguucacauggcaggacgauuacacucaauauguuauggaccaggaguuggcagaucugccuaagacguaccuacggcgcccagaagccagcuccccggcuagacccucuaaacacucggugggaucagagaggcgguauagccgcgagggcggcgcagcccucgcuaaugcccugcgaagacaucuuccuuuucuggaagcguugagucaggcaccagccuccgacguccucgcuaggacccacacagcccaggaucggcccccugcagagggggacgaucguuucucugaaagcauccugacuuacguggcucauaccuccgccuuaacauauccacccggaucacgcacccaacugagagaggaccuccuuccgaggacucugggucaguugcagccugaugagcuaagucccaagguagacagcggcguugaucggcaccaucugauggcggcccucucugcauacgcugcccagcgacccccugcucccccaggggaaggaucccuggagccccaauaccuucugcgcgccccuucaagaaugccaaggccguugcucgcacccgccgcuccucagaaauggccaagcccccugggcgacagugaagacccuucuuccacaggugauggggcgcggauucacaccuuacugaaggaccuacagcgccaaccagcagaggugagaggacucagcggccuggaacuugauggcauggccgaguugauggcugggcugaugcagggagucgaccacgguguggccaggggcucgcccgggcgugcagcccucggagagucuggcgaacaggcugaugguccgaaggccacgcugcgaggggacuccuuuccugaugacggcgugcaggaugacgaugaccggcuuuaucaagagguccauagacugucagcaacuuugggaggccuccugcaggaccacgggaguagguuacugccaggagcgcuacccuucgcucgcccucucgauauggaacggaaaaagagcgagcaucccgaauccucucugagcucagaggaggaaaccgccgguguugagaacgugaaaagucagacauacuccaaggaccuuuugggccagcaaccacacagcgaaccuggggcagccgcuuuuggagagcugcagaaucagaugcccggcccaucuaaagaggaacagucacucccggccggugcacaagaggcucugagugauggguuacagcuggaaguacagccuagcgaggaagaggccagaggcuauauagugacugacagggauccccuucgcccagaggaaggacgacgguuggucgaggacguggcgcgucuccugcagguucccuccucugccuucgcugauguggaaguccuaggcccugcagugaccuuuaagguaucggccaacguucaaaaugugacaaccgaggacgucgaaaaggcuacgguggauaacaaagacaagcuggaggagacuagcgggcucaaaauccugcagacaggagucgguuccaagucaaaacuuaaguucuugccaccccaggccgaacaagaggauaguaccaaauuuauugcacugacuuuagugucucucgcgugcauccugggcguucuucuggccagcggguugauuuacugucucagacacuccucacagcauaggcugaaggaaaagcuaagcggacugggcggugacccuggggcugaugccacagcagcuuaucaggagcucugccgccagcggauggccaccagaccgccagacaggcccgaaggcccucacacgucucgaaucuccagugugagcucucaauucuccgacggaccaauacccucaccuagugcacgcagcucggccuccucuuggagcgaggagccgguacagucaaauauggauaucaguaccggccauaugauucuguccuacauggaagaccaccuuaaaaacaagaaucgguuggagaaagaaugggaggcucugugugcguaucaggccgaacccaacucuagcuuugucgcacagagagaggagaaugugccaaagaacagguccuuagcuguucucacauacgaucauucacgugugcugcuuaaagccgaaaauagccacagucacucugacuacaucaacgccuccccuauuauggaucaugacccccgcaauccagcuuauaucgcaacucaagggccucugcccgccaccgucgcggauuucuggcagauggugugggagagcggaugcguagugauaguuaugcuaacaccacucgcugaaaacggcguccggcaguguuaccacuauuggccggacgaggguucgaaccuguaccauauuuaugaggugaauuuggugucagaacacaucuggugcgaggauuuccuggucagaucuuuuuacuuaaagaaccuccagacuaaugaaaccaggacaguuacccaauuccacuuucugaguugguaugaccgaggggugccuuccagcucucggagccuucuggauuuccgcagaaaggugaacaaauguuacaggggacgguccugccccauuaucguacauugcucagacggcgccggucgaaguggcacuuacgucuugaucgauauggugcucaauaagauggcaaaaggggccaaggagauugacauagcugcaacgcuggaacaccuaagagaccagcgcccaggaaugguucagacaaaagagcaauuugaguucgcccugaccgcgguggcugaagaggucaacgccauccuuaaggcacucccccaguga

SEQ ID NO: 61401 - RNA, 2853 nt, Artificial Sequence
  derived and/or modified sequence opt3 from PTPRN__Homo_sapiens__NP_001186692
augagaaggccccggcgcccuggcgggcugggagguagcggcgggcuccgacuucuguugugcuuacugcuacucuccucucguccaggaggcuguucagccgugagugcucacgguugccuguucgacagaaggcuuuguagccaucuggaggucugcauccaggauggguuguuuggacaaugucagguuggcgugggccaggcacggccgcuccugcagguaaccucccccgugcugcaacgccuccagggggucuuaagacagcugaugucucagggacuuucguggcacgacgauuugacacaauacgugauuucacaggaaauggagaggauaccucggcugcgcccacccgaaccucgaccaagagacaggagcggucuagcccccaagcggccuggcccagcgggggagcuccugcuucaggauaucccgacuggaagugcucccgccgcacagcaucgucugccucaaccacccguuggcaaagguggggccggagcuuccucuagcuuguccccucuccaggcagaacuguuaccaccccugcucgagcaccuucuguugccgccucagcccccacauccuucacuaaguuaugagcccgcccugcuccaaccauaccuguuccaccaguuuggcagccgcgacggcucuagaguguccgaagggucacccggaauggucagcguggguccucuuccaaaggcugaggccccggcgcuguucaguaggacggcaucuaaaggcauuuuuggggaucaccccggacauuccuauggcgacuugccugguccaagccccgcccaguuauuccaggauucggggcuguuauaccuggcucaagaacuaccugccccaucucgggcacgaguaccccgccucccggagcagggcuccucaaguagagcugaggacagcccugaaggauaugagaaggaaggccugggggauaggggagagaaaccagccucccccgcgguucagccugacgccgcacuucagcgguuggcugccgugcuggcugguuacggcgucgaacuccgccaacugacccccgagcagcuuucuacacuguugacucuccugcaguuacugccaaagggggccggaagaaacccuggcgguguggugaaugucggggcagauaucaagaaaaccauggagggccccguugaaggaagggacacagccgagcuaccagcucguaccagcccgaugccuggccaccccacugcgucaccaacaaguuccgaagugcagcaaguacccagcccugugucuucagagccacccaaggcagcccggccuccggucaccccagugcuccuggagaaaaagaguccccuugggcagagccagccuacgguugcuggacagccauccgcccgacccgcagccgaagaguaugguuacauugugacugaccaaaacgucgugggcccugcuuugaccuuuagaaucaggcauaaugaacagaaccugucucucgccgauguaacacagcaagcagggcugguuaaaucggaguuagaagcgcagacuggacugcagauacuucagaccggcgugggucaacgcgaggaagcugccgcagucuugccgcagacagcccacagcaccucccccaugcggucagugcuccugacgcuagucgcucuggccgggguggcaggccuccugguugcucuugccguggcguugugcguaagacagcacgccaggcagcaagacaaggagcgccuggcugcauuaggaccagagggcgcccauggggauacuacauucgaauaccaggaccucugucgacagcacauggcuaccaagagucuguuuaaucgggccgagggaccucccgaaccaucucgugucagcuccgugucaagccaguucucugaugcagcgcaagccuccccuaguagccauucuuccacucccucauggugcgaggagccagcucaggccaacauggacaucaguacaggccacaugauucuugcauauauggaagaucaucugagaaauagggaccgcuuggcuaaagaguggcaggcccucugugcauaccaagccgaaccgaauaccugcgcuacggcgcagggugaggggaacaucaagaaaaaccggcacccugauuuucugcccuaugaccacgccagaauuaagcuaaaaguugaaagcucgccauccaggucugauuacaucaaugcaagccccauaauugagcaugacccucgaaugccagcuuauaucgccacccagggaccccugucacacacaauugccgacuucuggcagauggugugggagaguggcuguacugucaucgugaugcucaccccucugguagaagauggugugaagcaaugcgaccgcuacuggccggaugagggcgcuucccuuuaucauguuuacgaagucaacuuggugucugagcacaucuggugcgaagacuuucuggugcggagcuucuaccucaaaaauguccagacacaggagacuagaacccucacacaguuccacuuucuguccuggccagcagaggggacccccgccucaacuaggccucuucuggauuuccgucgcaagguuaacaaguguuaucggggaagaagcugccccauuauagugcauuguagugacggcgcggggaggacgggaacauacauccuaauugauauggugcucaaucgaauggcuaaaggcguaaaggaaaucgacauagccgcaacccuggagcacguccgggaucaacgcccagguuuggugagaucuaaagaccaguuugaguucgcccugacugcuguugcagaagaagugaacgccauuuuaaaggcgcucccucaguga

SEQ ID NO: 61402 - RNA, 3567 nt, Artificial Sequence
  derived and/or modified sequence opt3 from PTPRO__Homo_sapiens__NP_002839
augggccaucugcccaccgggauccacggagccagaaggcuccuuccucuguugugguuauucgugcuguuuaagaacgcuacagcauuccacgucacuguucaggacgauaauaacauugugguaagccuagaggccuccgacgugauaucuccagcgucagucuacgugguuaaaaucacgggugaaaguaagaauuacuuuuucgaguuugaagaguucaacagcacccucccgcccccugugauuuuuaaagcuagcuaucauggccuguauuacaucauuacacuugucgugguaaaugggaacguugugacuaagccaucucggucgaucaccguccugacaaaacccuugccugugaccucagugagcauauaugauuacaagccaagucccgaaacuggaguccucuucgagauccacuauccugagaaguacaauguuuuuacacgcgugaacauuuccuacugggaaggcaaagacuuccgaaccaugcuguauaaggacuuuuucaaagguaagacgguauuuaaucauuggcugccagggaugugcuacucuaacaucacuuuccaacucgugagcgaggccaccuucaauaaauccacauuagucgaauauucaggagugagucacgagccgaagcagcaccguacugcacccuacccuccacagaacauuagcguuagaaucgugaaucugaacaagaauaacugggaggaacagucuggcaacuuucccgaggaauccuucaugaggucacaagauaccauaggcaaagagaaacuuuuucauuucacagaagagaccccugagauuccaagcgggaauaucaguucuggauggcccgauuuuaacuccagcgacuaugaaacgacuucgcagccguacuggugggauucugccuccgcugcaccugagucagaagacgaguucgucaguguguugcccauggaauaugagaauaacagcacacuguccgagaccgaaaaaucuacuagcgguucauuuaguuucuuuccaguacagaugauucuaacauggcucccucccaagccacccaccgccuucgauggcuuucacauccauaucgagcgggaagagaauuucacggaauaccugaugguugacgaggaggcucacgaauuuguggccgagcuuaaagaaccugggaaguacaaacuguccgucaccacauucuccucuucaggaaguugugagacucgcaagagccaguccgcgaagucuuugucguucuauauuagcccauccggcgaguggauagaggaacucaccgaaaaaccgcaacacgugucaguccaugugcugaguucuacaacugcauuaaugagcuggaccuccucacaggagaacuacaauagcacaaucguuucugugguaucccugaccugccagaagcagaaagaaagucaaagacucgagaagcaguauuguacucaggucaacagcucuaaacccauuaucgagaaucuugugccuggugcccaauaccagguugugauauaucugaggaaggggccauugauuggacccccuuccgauccagucacguuugcuaucgugcccacaggcaucaaggaccuaaugcuguacccgcucggcccuaccgccguagugcugucauggacucggccauaucuugggguuuuccgcaaauacgucguggaaauguuuuacuucaaccccgcaaccaugacaagugaguggaccacuuauuacgaaauugcugccacagugagccugacggcgucgguccgaaucgccaauuugcucccugcaugguauuacaacuuuagaguuaccauggugacuuggggagaccccgagcuguccugcugugauucuagcacaauuucauucauaaccgcuccaguggccccugaaaucacaaguguagaguauuuuaauuccuuacuguacauuucuuggacuuauggugacgauaccacggaccuaagccacuccaggaugcuccauuggauggucguggcugagggcaagaaaaagaucaaaaagucaguuacccggaacgugaugacagccauccugagccuucccccaggggauauuuacaauuugagugucacugcaugcaccgaacguggaucuaacacauccaugcugcgccucgugaagcuggagccggccccucccaaaagccuuuucgcuguuaacaagacucagaccucggugacgcuguuguggguagaagagggcgucgcggacuuuuucgaaguguuuugucagcaaguggguucaucucagaaaacaaagcuccaggagccagucgcaguuaguucccacgugguaaccauaagcucucuguuacccgccacugcuuacaauugcagcgugacauccuucucacaugauaguccuagcgucccaaccuuuaucgccgugucuacuaugguuaccgagaugaaccccaauguggucgugauuuccguucuggcaauccuaucaacacuccugauugggcuuuugcuggugacgcucaucauacugagaaagaagcacuuacagauggccagggaauguggcgcuggaaccuucgucaacuucgccagucuggagcgggacggcaaacuuccuuauaauuggagcaaaaacggguugaagaaacgaaagcucacuaauccgguacaacuggaugacuuugaugcauacaucaaagacauggcgaaggacuccgauuauaaauucucucuacaguuugaggaacugaagcucauuggacuggacaucccacacuucgcugccgaucuucccuugaaccgcugcaagaauagauacacaaacauucugccuuaugacuuuucgagggugcgguuaguuagcaugaaugaggaagagggugcagauuacaucaacgccaauuauauaccaggcuacaacucaccccaggaauacauugcuacccaggggccucucccggagacacgcaaugacuucuggaaaauggugcugcaacagaagucccagaucauugucaugcuuacucaguguaacgaaaagagaagggugaagugcgaucauuauuggcccuuuaccgaggagccaaucgccuacggagacauaacgguagaaaugaucagugaggaggaacaagaugacugggcaugccgucacuuccggauuaacuaugcugaugaaaugcaggacgugaugcauuuuaauuacacagccuggccugaucacggcguccccaccgcgaacgccgcugagucuauccugcaguucguucacauggugcgacaacaggcaacuaaaagcaaggguccaaugauuauccauuguuccgccggggugggcagaaccggaacauuuauagcuuuggacaggcuccugcagcacauucgcgaccaugaguucgucgauauccuaggccuggugucagaaaugcggucuuauagaaugagcaugguucagacugaggaacaauacaucuucauucaccagugcguacagcucauguggaugaagaaaaagcagcaauuuuguaucagugacgugauuuaugagaaugucuccaaaagcuga

SEQ ID NO: 61403 - RNA, 6900 nt, Artificial Sequence
  derived and/or modified sequence opt3 from PTPRQ__Homo_sapiens__NP_001138498
auggacuuccugaucauuuuucuccuucuguucauaggcaccagcgagacacagguggaugucuccaacguugugcccgggacuagauacgacaucacgauuucuucaaucaguaccacauauacuagcccuguaaccaggauugugacaaccaaugucacuaagccaggaccgcccguguuuuuggccggugaacggguuggcuccgcugggaucuuacugucuuggaacacaccuccaaaucccaacggacgcauaaucucguacauugugaaauauaaggaggucugcccuuggaugcaaaccguguacacgcagguacgaucaaaaccagauagccuagaaguucuccugacuaaucuuaaccccggcaccacauaugagaucaagguggcagccgaaaauagugcggguauuggggucuucuccgacccuuuucuguuccagacugcugagucugccccaggaaaaguggugaacuugaccgucgaggcauacaaugccagcgcuguuaagcucaucugguaucugccgcgucagcccaacggcaagauaacauccuuuaaaauuucagugaagcacgcaagaaguggcaucguagugaaagaugucagcauuaggguggaagacauccugaccgggaagcucccugaguguaaugaaaacucugaguccuucuuauggucaacggccagcccaagucccacucugggacggguuacaccuccaucucgcaccacucauuccagcucgacacuuacccaaaaugagaucucuuccguguggaaagaacccauuucauuugucgugacgcacuugagaccguacaccacauaccuguucgagguaagugcugccacuaccgaagcggguuauauagauagcacaaucguuaggacuccugaguccgugcccgaaggcccaccucagaacugcgucaccgggaauauuacaggaaagucuuuuagcauccuaugggaccccccaaccauagugacuggcaaguucucauaccgggucgagcucuauggucccagugggcgcauucuggauaacuccacgaaagaccuuaaguuugcauucacaaaccugaccccuuucacuauguacgauguguauaucgccgcugagaccagcgccggaacaggcccaaaaucuaauaucucaguuuuuaccccgcccgacgugccuggcgcaguauucgauuugcagcucgcugaagucgagaguacucaggugcgaauuacauggaagaaaccaagacaacccaacgggaucauuaaucaguacaggguuaaggugcuggucccugaaacgggaauaaucuuagagaacacccugcucacugguaauaacgaauauauuaaugacccaauggcccccgagaucgugaacaucguagagccgauggugggccuuuacgaagggagcgcggagauguccucugaccugcauucguuggccacauuuauuuacaauagccacccugauaaaaacuucccagcacggaaucgugcugaagaccagaccucccccguugucacaacucgcaaccaguauauaaccgauaucgccgcugagcaacuaucauacgugauuagaaggcuggugccuuuuacggaacauaugaucagugucucugccuucaccauuaugggagagggccccccaacaguucucagcgugcggacucgacagcaggugccuuccucaaucaagauaaucaauuauaagaacauuagcucuuccaguauccugcuuuacugggaccccccagaguauccgaaugguaaaauuacccacuacacaaucuaugcaauggaacuggauacuaaccgcgccuuucaaauaaccacgauugacaacagcuucuugaucacagggcucaagaaauacaccaaguacaaaaugagaguagcugcgucuacucacgucggcgaguccucacugagugaagagaaugauauuuuugugaggacaagcgaggacgaaccugagucguccccccaggauguugaagugaucgacgucaccgcagaugagauacgguuaaaguggucuccacccgaaaagccuaacggaaucauuaucgccuaugaggugcuguacaaaaauauugacacucuauauaugaagaacaccagcacaacggacaucauacuccgcaaucugagaccacauacccuuuacaacauuucaguuaggaguuauacucguuucggccacgggaaucagguguccucuuugcugagcguacggacauccgagaccguccccgauucagcuccugaaaacaucacauacaaaaauaucagcaguggagagauugaacucucuuuucugccgccauccagccccaacgguaucauucagaaguauacuauauaccuuaaacgaucgaauggcaacgaggaaagaaccaucaauacgacaucacugacccaaaacauuaagguguugaagaaauacacucaguauaucauugaggugucugccaguacccucaagggggagggagucagguccgcaccuaucagcauacugacagaagaggacgccccagauucucccccucaggacuucagcguuaaacaguuauccggcgugacuguaaagcugucauggcaaccgccccuagaaccaaaugguaucauucucuacuauaccguguacgucuggaaccgcaguagccugaaaacaaucaacgugacggagaccucucuugaauuguccgaucuggacuauaauguugaguacucagcuuaugugacugccaguacacgguuuggggauggcaagaccagaagcaacauuaucuccuuccagacuccugagggagcacccucugacccaccuaaggaugucuacuacgcgaaucucucgagcucauccauaauucuguucuggacacccccaaguaaaccgaacggcaucauccaguauuacucuguguauuacaggaauaccagcgggacguuuaugcagaacuucacuuuacaugaaguuaccaaugacuuugauaacaugacaguguccaccauuauagacaagcugacuaucuucucauauuacacauuuuggcuuaccgcuucuacaagcgucggaaaugguaacaaaaguuccgauauuaucgagguauauacugaccaagacauuccugaaggcuucguggggaauuugaccuacgagagcaucucuucaacggccauaaacguuuccugggugcccccagcacagcccaauggacucgucuuuuacuaugugagucugauccuacagcagacaccucgccacguacgaccaccccuggugaccuacgagcggagcauuuauuucgauaaccucgaaaaguacacugacuauauccugaaaauuaccccuucgacagagaagggcuuuucugauacuuacaccgcccaacuuuauaucaaaacggaagaggacgucccggaaacauccccaauaauuaauaccuucaagaacuugagcucaacuaguguucuguuaucuugggaucccccugugaagcccaacggugcuaucaucuccuacgaccucacacugcaggggccaaaugagaacuacagcuuuauuaccucagauaauuauaucauacuugaggaacugaguccuuucacuuuguacagcuuuuucgccgcagcucguacaagaaaaggccucggacccuccucuauucuguucuuuuauaccgacgagagcgugccacuagccccuccgcagaaccugacgcucaucaauuguacuuccgauuucgucuggcugaaguggucacccucuccacuuccuggcgggauugugaaaguuuacaguuuuaagauccacgaacaugagaccgacacaauauauuacaaaaacauuucgggauucaagaccgaagcgaaguugguaggccuggagcccgugagcacauauuccaucagggucucugccuuuacuaaaguggguaaugggaaccaauucucaaauguugugaaguuuaccacgcaggagagcgucccagaugugguacagaacaugcagugcauggcuacauccuggcaaagugucuuagugaaaugggacccucccaagaaagcaaauggaaucauuacucaguacaugguuaccguggaacgcaacucuacaaaggucagcccgcaggaucacauguacaccuucaucaagcuccuggccaauacuucauauguguuuaaaguucgggcuuccaccagugccggcgagggugacgaaagcacaugucaugugucuacgcuuccagagacugucccuuccgugcccaccaacauugcauucucagacguacagagcacaucggcgacccugacuuggauaagaccagauacaauccuaggcuacuuucaaaauuauaagauuaccacgcagcucagggcccagaaaugcaaggaaugggagucugaggaauguguggaguaccagaaaauccaauaucuguacgaagcucacuugacugaggagacaguuuaugggcugaagaaguuccgaugguaccgcuuccaggucgccgcaaguaccaacgcuggauacggcaaugccuccaacuggaucagcaccaaaacuuuacccgggccuccggacggacccccagaaaacgugcauguggucgcaacaucaccuuuuuccauuucuauaagcuggagugagcccgccguaaucaccggcccuacaugcuaucucauugaugugaaguccguugacaaugaugaauucaacaucagcuuuauuaaaucuaaugaggaaaacaagacuaucgagauaaaagaccuggagaucuucacgcgguacucaguggucauuaccgcuuuuacagguaauaucagugcggccuauguggaagggaaguccagcgcagagaugauuguuacuacccuugaaucugcuccaaaagaucccccuaacaauaugacauuccagaagaucccagacgaggugaccaaguuucaacugacuuucuugcccccgucgcagccuaacggaaauauacaggucuaccaggcccucguguauagagaagaugacccaacggccguacaaauucacaaccugucaaucauucagaaaaccaauacauuugugaucgcuaugcuagagggccugaaggguggccacacuuacaacauaagcguuuaugcagucaauuccgccggggcgggacccaaagugccuaugaggaucaccauggauauuaaggcuccagcccgucccaaaacaaagccgaccccuaucuacgacgcaacuggcaagcuucucgugacaaguacgaccauuacuauccgcaugcccauauguuacuauucugacgaucaugggccaauuaaaaacguccagguucuggugacagagaccggagcccagcacgacggcaauguaaccaagugguacgaugcuuauuucaacaaagcacggccuuacuuuacaaacgaagguuuccccaauccacccugcacugaggggaagacgaaauuuagcggaaacgaagagaucuauaucauuggcgccgacaaugcguguaugaucccugguaacgaagauaagauaugcaauggcccauugaagccgaaaaagcaauaccuguucaaauucagagcuaccaacauuauggggcaguuuacagacuccgauuauucagaccccgugaagacuuuaggagagggccucagugagaggaccgucgaaaucauucugucugugacacuuugcauccugagcauaaucuugcucgggaccgccauuuucgcauuugcccgaauccggcagaaacagaaggagggaggcacuuacuccccucaagaugcugaaauuaucgacacgaagcugaaacuagaucagcugauuacaguugccgaccuugagcucaaggaugagcgccugaccagauuguuaucauacaggaaaagcaucaagccaauaucuaaaaaguccuuccugcagcauguggaagagcucuguacuaauaacaaucugaaguuucaggaagaguucagugaacuucccaaauuucugcaagacuugagcucgaccgacgcagaucuaccuuggaaccgggcuaagaaucgauucccaaacauuaaacccuauaauaacaauagagucaagcugaucgccgacgcguccguaccugguucugauuacaucaacgccucauauauuagcggguaccucugcccgaacgaguuuauagcaacacagggaccacugcccggcacugugggcgacuucuggcgcaugguuugggagaccagggcuaaaacacuugugauguuaacgcaguguuuugaaaaggggcguauccggugccaccaauauuggccugaggauaauaaacccgucaccguguucggagacauugucaucacuaagcugauggaagaugugcagauugacuggacaaucagagaucucaagauagagaggcacggugacuguaugaccguucgccagugcaacuuuacugccuggccagaacauggcgugccugagaauagugcucccuugauccacuucguaaaacuggugcgagcauccagagcccaugauacaaccccaaugauuguccacuguucugccgggguuggacggacgggcguguucaucgcucucgaccaucugacccagcacauuaacgaucacgacuuugucgacaucuacggucuuguggcggagcugaggagcgaacgcaugugcaugguacaaaauuuggcacaguauauauuccuacaucaguguauucuggaucucuuaucaaacaagggguccaaucagccgaucugcuuugugaacuacagugcccugcaaaaaauggacagccuugaugcuauggagggagacguugaacuggagugggaagagacaacuauguga

SEQ ID NO: 61404 - RNA, 1638 nt, Artificial Sequence
  derived and/or modified sequence opt3 from PTPRR__Homo_sapiens__NP_001193944
augcagagcaucuccaagcaaacccugcagauggacgugaacaaacucaauauuacacuucugagaauauucaggcagggcgucgccgcugcauugggguuacugccccagcaaguucacaucaaccggcuaauuggaaagaaaaauucuaucgagcucuuugugucaccuauuaaccgcaagacugguaucagugaugcccugccaagcgaagagguacuucgaucccugaauauaaacguguugcaucagucucucucgcaguucggcaucacggaagucucaccggagaaaaaugugcugcaggggcaacacgaagcggacaagauuuggagcaaggagggauuuuacgcuguugugaucuuccugaguauuuuugucaucauagugaccugccucaugauuuuauaucgucugaaagagagauuccagcuuuccuugaggcaggauaaggagaaaaaccaggaaauccaucugucucccauuacacuacaaccugcccucagcgaagcaaagacuguacacuccaugguucagccagagcaggcccccaaagugcugaaugucgugguggacccucaaggccggggugcuccagagaucaaggcaaccacagccaccucagucugucccaguccuuuuaagaugaaaccaaucgggcuucaggaacgcagaggaagcaacguuucucugacuuuggauauguccucacucggcaauauugagccguucgugagcauacccacaccuagggaaaagguagcuauggaguaccugcagagugccucucggaucuuaacccgcucccagcugcgagacguggucgcgagcucgcaucuccuucaaucugaauuuauggagauuccaaugaacuucguggaucccaaagagaucgacauaccuagacacggcacgaagaauagguauaaaacuauucugccaaaccccuugucccggguuugccuacguccgaagaaugugaccgauucacugaguacauacaucaacgcaaacuauauccgcggguacagcggaaaagaaaaggccuuuauugcuacucaggguccuaugaucaauaccgucgacgauuucuggcagaugguguggcaggaggacucccccguaauuguuaugauaacaaagcucaaagaaaagaacgagaaaugugugcuguauuggccagaaaagagaggcaucuacgggaaagucgaggugcuugucauuucugugaaugagugcgauaacuacaccaucaggaaucugguuuugaagcaaggaagccacacgcagcaugugaagcacuauugguacacuucauggccugaccauaaaacacccgacagugcccagccacuccugcaguuaaugcuggauguagaagaggaccggcuagcaucccaaggccgaggucccgucgugguucacuguagcgcugggaucggacgcaccggcugcuuuauugccacuucuauaggcugucagcagcucaaggaagaggggguggucgaugcgcugucaaucgugugccagcuuagaauggacaggggagguaugguacaaacaagugaacaguaugaguucgugcaccaugccuugugucuguacgagagccggcucuccgcagaaaccguucaguga

SEQ ID NO: 61405 - RNA, 5847 nt, Artificial Sequence
  derived and/or modified sequence opt3 from PTPRS__Homo_sapiens__NP_002841
auggcccccaccuggggcccugggauggugagcgucguuggaccaaugggucugcucgugguacuucuggugggcgggugcgcugcagaggaaccgcccagauucaucaaggagccuaaagaccagauuggagucuccggcgguguggccucuuuuguuugucaagcgacaggggauccaaagcccagggugacuuggaacaaaaagggaaaaaaggucaauucacagcgguucgaaacgauagaguuugacgaaagugcuggcgccguguugcgcauccagccuuuacgaaccccacgugaugagaacguauacgagugcguugcacagaauagcgugggcgaaauuacaguccacgccaagcugacugugcuaagagaggaccaacuccccuccggguucccuaacaucgauaugggaccacagcugaaaguggucgaaaggacccggacagcuaccaugcuuugugcagccucugguaauccggaccccgagauuacuugguuuaaggauuuccugccuguugacccaucggcuucaaacggccgcaucaaacaguugagaagcgagacauuugaaaguacccccauaaggggggcccuccagaucgaguccucugaagagacggaucaaggaaaguaugaaugcguggcgacuaauagcgcaggcguacgguacuccucaccugccaaccuguaugugcgcgagcugcgagaggucagaaggguggcuccacgguucaguauucuccccaugagccaugaaaucaugccgggugggaauguuaacauuaccuguguggccgucggaucuccuaugcccuacgugaaauggaugcagggcgcagaggacuuaacaccagaagaugacaugccuguaggccguaauguucuggagcuuacugaugugaaggacuccgcuaacuauaccugcgucgccaugucaagcuugggggugaucgaagcggucgcccagauaacagugaagagucugcccaaagcaccaggaacccccaugguuacggagaauacugcuacaucuauuaccaucacuugggacuccgguaacccugauccagugagcuacuauguaauugaguacaagucgaaaucucaggacggcccguaccaaaucaaggaagauaucacaaccacgcgcuauuccauugggggacuaucacccaauagugaguacgaaauaugggucagcgccgugaacuccaucggccaggguccuccaucugagagcguugugaccagaacaggggaacaggcucccgccucagcaccuaggaacguccaagcccggaugcucagugcuacuaccaugauugugcagugggaggagccaguagaacccaauggccugauccgaggauaucgcguguacuauacaauggagccggaacacccuguuggcaacuggcagaaacauaaugucgacgauucccuucugacuaccguggggagcuugcucgaggacgagacauacaccgugagaguccuggcguuuacuucuguuggagaugguccauuaucagaccccauacaggugaagacgcaacagggcgugccugggcagcccaugaaccugagggcagaagcccggagugagacaagcauuacccucuccuggucuccaccucgccaggaaucgaucaucaaauaugagcuucuguucagagaaggagaucacggcagggagguaggucguacuuuugaccccaccacaagcuacgucguggaggauuugaagccaaauaccgaauacgcuuuccggcuagccgcacgauccccgcaagggcugggcgccuuuacuccuguugugagacagaggacacuccagucaaagcccagugcuccaccccaggacgucaaaugugugucuguucgcagcacggccauucugguguccuggcggccuccacccccugagacccauaacggagcacuuguaggcuauucagucagauacaggccgcuggggagcgaagacccagagcccaaggaagugaauggaaucccuccaacuacaacccaaauuuugcucgaggcgcuggagaaauggacacaguaucgcauaacuaccguggcucacacggaagucggucccggcccugagucuuccccgguugugguacgaaccgaugaagacgugcccagugccccaccucggaaggucgaggcagaagccuuaaacgcuacagccauccgugugcuguggagaagccccgcaccagggaggcagcacggacagauucgcggcuaccaaguucauuaugugcggauggagggugcugaggccagagggccucccaggaucaaagaugucaugcuagcggacgcccagugggaaacugaugacaccgcugaguacgaaauggugaucacaaaucuccagccagagacugcauauucuauuaccguugccgcuuacacgaugaagggcgauggagcccgauccaagccgaaaguggucguaacaaagggcgcagugcuggggcgcccuacccuuucaguucaacagacucccgagggaaguuugcuggcgcggugggaaccacccgccggcacagcugaggaccaggugcucgguuacagacugcaguucgggagggaagauagcaccccucuugccacucuggaguucccacccucggaagaccguuauaccgcauccggaguccacaaaggcgcuacauacguguuucgcuuggccgcacggucuagagguggccucggggaggaggccgcugaaguacugagcauaccugaggauacgccgaggggacauccacaaaucuuagaagcggccggcaacgcaucagcugggaccgugcugcuacgauggcuccccccuguccccgccgagcggaauggagccauuguuaaguauacuguggcugugcgcgaagcaggcgcccuggguccagcgagagagacagagcuuccugcugccgcagaacccggggccgagaacgcuuugacccugcagggacucaaaccagacacagcauacgaucugcaggucagggcccacacucggcgaggcccugguccguucagucccccagugagauaucgcaccuuuuuaagggaccagguuuccccuaagaauuucaagguaaaaaugaucaugaagacgucugugcugcuuagcugggaauuucccgacaacuacaauuccccaacaccuuauaaaauucaauacaacggcuugacccucgaugucgacgggcguacuaccaagaaacugaucacacaccuaaagccccauacuuucuacaacuuugugcugaccaaucggggaucaagccucggcgggcugcagcagacaguuacggcguggaccgcuuucaaccuuuugaauggaaagccgaguguggccccaaaaccugaugcagacggcuuuauaauggucuaucugcccgauggucagucuccagugcccguacaauccuacuucaucgucauggugccuuuaagaaagagcagggggggacaguuucucacuccgcugggcucgcccgaggacauggaucuugaagagcugauucaggacaucucacgcuugcaacgaagaucucuccggcacaguaggcagcuggagguuccacgcccuuauauugccgcucguuucuccgugcuacccccuacauuucauccaggugaucagaaacaguacggcggguucgacaacagaggacuggaacccggccaccgguauguccucuucgugcuggccguucuucaaaagagcgagccuaccuuugcagcuucuccauucagcgaucccuuucaguuggacaauccggauccucagccaaucguggacggggaagagggacugauaugggucauuggccccguguuagccguaguguucaucauuugcaucguuauagcgauccuccuguacaaaaacaagccugacuccaaaaggaaggauucagagccacgcacuaagugucuucugaauaacgccgaccuagcaccccaucacccgaaagauccugucgaaaugcgaagaauuaauuuucagacacccgacaguggucuccggagcccacugagggagccuggguuccacuuugaaucuauguugucccaucccccaauccccauugcugauauggccgagcacaccgaacgccugaaggcuaacgacucauuaaaacucagucaagaguaugagagcaucgauccuggacagcaguucacgugggaacauuccaaucuggaggugaacaagccaaaaaauagauacgcaaacgugauagccuacgaccacucuagggucauucuucagccgaucgaaggcaucaugggcucggauuauauuaaugccaacuacguagacggguaucggugccaaaacgcuuacaucgcgacucagggaccccugccugagaccuuuggugauuucuggcguauggugugggaacagcgcagcgcaacaauuguuaugaugacccgauuggaggagaagucaagaauaaagugugaccaguauuggccaaauaggggcacugaaacauacggguuuauccaagugacccuccuggacacaauugagcuagccacuuucugcguccggaccuuuucccugcacaaaaacggaaguucugaaaagcgcgaggugagacaguuccaguucacggcuuggcccgaucauggcguuccugaauauccaacacccuuucuugccuuccucaggcgggugaaaaccugcaauccuccggacgcagguccaaucgucgugcacuguagcgccgggguaggacgaacuggcugcuuuauugugaucgaugcuaugcuggagagaauaaagcccgagaaaaccguugacgucuacggccaugugacauugaugcgcucccaaaggaacuacauggugcagacugaagaucaguauucauucauccacgaggcgcuguuagaagccgucggguguggaaauaccgagguuccugcacggucucucuacgcuuauauucagaagcuggcccaaguggagcccggugaacauguaacgggcauggagcuugaauuuaagcgucuggcaaacagcaaagcccacacaaguagauucaucuccgcuaauuugccaugcaacaaguuuaaaaauaggcucgugaacauuaugccuuacgagagcacccgcgucugucugcagcccauccgggggguggaaggaucugacuauauaaaugccucauucauugauggcuaccgacagcagaaggcguauaucgcaacucaagguccacuagccgagacaaccgaggacuuuuggagaaugcugugggaaaacaauuccacuaucguugugaugcuuacaaaacucagggagauggggcgcgaaaagugccaccaguacuggccggcugagcggagugccagauaccaguauuucgucguagauccuauggcugaauacaacaugccccaguauauucugcgugaguuuaaggugaccgacgcaagggauggacaaagccggacgguucgccaguuccaguucacugacuggccagagcaaggcgugcccaaaucgggcgaaggguuuauagauuucaucggacagguccauaagaccaaagagcaguuuggucaggacggcccuauuucugugcacuguuccgccggggucggacgaacaggcguguucaucaccuugagcauuguuuuagaaagaaugagguacgagggugugguagacaucuuucaaacagugaagaugcugcggacucagcgcccagcuaugguccagaccgaagaugaguaucaguucugcuaccaagccgcacucgaguaucuggggucauuugaccauuacgcgacguga

SEQ ID NO: 61406 - RNA, 4326 nt, Artificial Sequence
  derived and/or modified sequence opt3 from PTPRT__Homo_sapiens__NP_008981
auggccagccuggcugcacucgcccuuucccuguuguuaagacugcagcuacccccucucccaggcgcgagggcucaaucugccgcagggggaugcucauucgacgagcacuacaguaacugugguuauagcguggcccugggcaccaauggguuuacaugggaacagaucaacacuugggagaagccgaugcuugaucaggcuguccccacgggauccuucaugaugguuaauucuucgggccgggcaucaggucagaaagcccaucuguugcucccuacccugaaggaaaacgacacacacugcauugauuuucauuacuauuucagcagucgcgaccgauccucuccaggggcucugaauguguacguaaaagugaacggaggcccccaaggcaauccugucuggaacgugagcgggguugugacugagggaugggucaaggccgaacucgcgauauccaccuuuuggccacacuucuaucaggugaucuuugagucaguaaguuuaaaaggucaucccggcuacauugcaguugaugaggugcguguccuggcccacccuuguagaaaggcuccacacuuccuuagguugcagaauguggaagugaacgucgggcagaaugccacauuucaaugcaucgcaggaggcaaguggagccagcaugacaaacuguggcuacagcaguggaacggucgggauaccgcucucaugguuacucgcgugguaaaucacagaagguucucugccacaguguccgucgcggacaccgcccaacggucagugagcaaguaucgcuguguuauucgaagugaugggggaucuggcguguccaacuacgcagagcugaucgucaaagaaccgcccacgccuauagcuccacccgagcuucuggccgugggcgcuacuuacuuguggaucaagccuaaugccaacagcauuaucggggacggaccaauuauccucaaagagguagaauauagaaccacaacugguaccugggcagagacacauauaguugauucgcccaacuacaagcuguggcacuuagacccggauguggaauaugagauuaggguccugcucacccggccuggcgaagggggaacgggucccccagguccuccccuuacuacacguaccaagugcgccgacccagugcacgggccccagaaugucgagaucguggacauucgcgcuagacagcugacuuugcaaugggagccuuuuggcuacgcgguuacaaggugucauucuuauaaccuaaccgugcaguaccaguauguauucaaucagcaacaguacgaagcagaggaagucauccagacguccucacacuacacccugcggggacuccgaccauuuaugacaauccgccugagacuucuguugaguaacccggagggcaggauggaaagcgaggagcucgugguucagacugaagaggaugugcccggggccgucccucuggaauccauucaaggagguccauucgaggagaaaauauauauccaguggaagcccccuaaugaaaccaacggcgugauuacauuauacgagaucaauuauaaagcuguagggucucuggacccaagcgccgaucuaucaagucagcggggaaagguguucaaacuccgcaacgaaacucaucaccuguuuguuggccuuuaccccgguaccacauauuccuucaccauaaaggcaagcacugccaaaggguuuggcccgccugucacgacaagaauugcuaccaagaucucugccccaucaaugcccgaguacgacacugauaccccuuugaaugaaacagacaccacuaucacagugaugcugaagcccgcacagaguaggggagcgccagugagcgucuaucaacucguugugaaagaggagcgucugcagaagucccggcgagcugccgauauuaucgaaugcuucucugugccuguaucguacagaaacgcaagcucccuugacucacugcauuacuuugccgcugaguugaaacccgccaaucucccagucacgcagccguucaccgugggcgauaacaagacuuauaauggguacuggaacccuccccugaguccauuaaaaucuuauagcauuuacuuucaggcacuguccaaggcuaauggagaaacaaagauaaacuguguuaggcuagccaccaaaggugcgucaacacaaaacagcaauacuguggagcccgaaaagcaggucgacaacaccgugaaaauggccggcguuaucgcugggcuccugauguucauuaucauccuuuugggagugaugcugacgauuaagcgccggagaaaugcauauucuuacuccuauuaccucaaacuggccaagaagcagaaagagacccaaaguggcgcucagagggagauggguccuguagccagcgcagauaagccaacaacuaaauuaucugcgucccgcaacgacgaaggguuuucaaguagcucgcaggacgucaauggcuucaccgauggaucccgaggcgagcugucucagcccacacuuacuauacaaacccacccuuaccggacgugcgacccgguggaaaugagcuauccacgugaucaguuucagcccgccaucagaguggcugacuugcuccagcacauuacacaaaugaagagggggcagggauacggcuucaaagaggaauaugaggcccugccugagggucagaccgcaucaugggauacugcuaaggaagacgagaaccgcaauaagaaccgguacgggaauaucauuaguuaugaucauuccagagucaggcuacugguucucgacggagauccacacucugacuacaucaacgccaauuauauagauggcuaccaucgaccccgccacuacaucgcaacacaggguccuaugcaagaaaccgugaaagacuuuuggcggaugauuuggcaggagaacagcgccuccaucguaauggugacuaaucuggucgaagugggcagaguuaagugugugagguauuggccggaugacaccgaggucuacggggacauuaaagugacacuuaucgagacggaacccuuggcugaguauguuauacguaccuucacugugcagaagaaaggauaccacgaaauucgcgagcugcgguuauuccauuuuacaucauggccagaucacggcgucccuugcuaugcgaccgggcuccugggauucguaagacaagugaaguuucuuaaucccccagaggccggcccuaucguugugcauugcagcgcaggcgcugggaggacaggauguuucauugccaucgacacuaugcuggauauggccgaaaacgagggcgucguggacauauuuaacugcguacgagaauugcgggcucagcgcgugaaccucguccagaccgaggaacaguacguuuucgugcacgaugcaauccuggaggccugucuaugcgguaauacggcgauucccgugugugaguuuagaagucuguauuacaacaucucuaggcucgacccacaaacaaauuccagccagauuaaagaugaguuccagacccugaacaucgucacuccgcgggugcgaccugaagacugcucgauaggccuuuugcccagaaaucaugauaagaaccgcucaauggacguucugccauuagauaggugucuccccuuucugauuucuguagacggggaaaguuccaauuacaucaacgcugcccuuauggauagccacaagcagccugcagccuucguggucacccaacacccacugcccaauacaguggcugacuuuuggcgucuaguuuucgacuauaacugcucuagcguggucaugcucaaugagauggauacugcacaguuuuguaugcaguacuggccugaaaagaccuccggaugcuauggcccgauccagguggaguucguaucagccgacauugaugaggacaucauucaucggauauucagaaucuguaacauggcgaggccacaagauggguaccgcauuguccagcacuugcaguauaucggauggcccgcuuaccgagacacaccucccaguaaaagaagccugcugaaagugguucggagguuagaaaaguggcaggagcaauaugauggccgcgaaggucguacggugguccauugccucaaugggggaggcagaucugguaccuuuugcgccauuuguuccgugugcgagaugauccagcagcaaaacauaaucgacguuuuccacauugugaaaacucugcggaauaacaagucaaacauggucgaaacacuugagcaguacaaguuuguguacgagguagcacuggaauauuugaguagcuucuga

SEQ ID NO: 61407 - RNA, 4347 nt, Artificial Sequence
  derived and/or modified sequence opt3 from PTPRZ1__Homo_sapiens__NP_001193768
augagaauccugaagagguuccucgccugcauucagcuucugugugugugccgguuggacugggcuaacggcuacuaucgccaacagcgaaaauuagucgaggaaauaggguggagcuacaccggagcacugaaucagaagaacugggguaaaaaguaucccacauguaauuccccuaaacagucuccaaucaacauugaugaggaccuaacucaaguuaaugugaaccucaagaagcugaaauuucagggcugggauaagacgucacuugaaaauaccuucauccacaacacagggaaaacuguagagauuaaucugaccaacgacuaccgugugaguggaggcgucagcgaaaugguguuuaaggccuccaaaaucacauuccauugggguaagugcaauaugucuucggaugggucagagcacagcuuggagggacagaaguuuccgcucgaaaugcagauauauuguuucgacgcggauagauuuaguuccuucgaggaagcuguuaaaggcaagggcaaacugagggcccugucuauccucuuugagguggggaccgaggaaaacuuagacuucaaggcaauuaucgauggagucgagagcgugucccgguuugguaaacaagccgcucuggaccccuucauucuuuugaaucugcuaccuaacucaacugauaaguacuauaucuacaauggcagucucacaagcccacccugcaccgacacgguagauuggauaguuuuuaaagacacugugucuauuuccgaaucacagcuggcagucuucugugaggugcuuaccaugcagcagagcggguacgugaugcugauggacuauuugcaaaacaacuuccgcgaacagcaguacaaguuuaguagacaagucuucucuuccuauacaggaaaggaggagauccaugaagccguuugcagcucggagccugaaaaugugcaggcugauccagagaacuacacuucucuccugguaaccugggaaaggccccggguggucuaugacacaaugauugagaaauuugccguguuauaccagcagcuggauggcgaggaccaaaccaagcacgaguuccucacggaugguuaucaggaccuuggggcgauccugaauaacuugcuaccuaauauguccuacguucugcagaucguggcaauuuguacuaacggacucuacggcaaauauucagaucagcugauagucgacaugccaacagauaauccggagcuugaccuguuucccgaauugaucggcaccgaggaaauuaucaaggaggaggaagaggggaaagauauagaagagggagccauugugaacccuggucgcgacagugcuacuaaucaaauccgaaagaaggagccacagaucagcacaaccacgcauuacaacagaauuggcaccaaauauaaugaagccaagacaaacaggucccccacucgggggucugaguucagcggaaaaggcgacguaccuaauaccucacucaacaguacaucccagccaguuacuaagcuggcaaccgaaaaagauaucagcuuaacaucucagaccgugacugagcugcccccgcacacggucgaagguacaucagcuagucuaaaugacgggagcaagaccgugcuccguuccccucacaugaaccugucuggcacugccgagucgcuuaacaccgucagcauuacagaguacgaagaggaauccuugcugaccucauuuaagcucgauacuggagcggaggacaguucuggcagcucccccgccacaucagcaauaccauucaucagcgaaaauauuucucaaggguauaucuuuuccagugagaacccugagacgaucaccuacgaugugcugauucccgaaagcgcucgcaaugccucugaggacuccacuucaaguggaagcgaagagucgcuuaaagauccauccauggaagguaacguuugguuccccucuagcacagacauaaccgcucagccugaugugggcucagggagagagaguuuucugcagacaaauuauacugagaucaggguagacgaauccgagaagaccacgaaaucuuucagcgccggaccagucaugucccagggcccgucagugaccgauuuggaaaugccccauuacagcacauuugcauacuucccuacugagguuaccccacacgccuucacacccaguucucggcaacaggaccucguguccacugucaacgugguauauagccagaccacgcaaccuguguacaaugaggcuucgaacucaucucaugaaagucgaauuggucuggcggagggguuagaauccgagaagaaagcaguuaucccacuggucauugugagcgcccuaacauuuaucugccucgugguccugguuggcauacuuaucuauuggcgcaaguguuuccagaccgcucacuuuuacuuggaagauucuacuagccccagagugauuuccacaccgccuaccccaaucuuccccauuucagacgacgugggagccaucccuauaaagcacuuucccaaacauguagcagaucugcacgccaguagcggcuucacugaggaguuugaagagguccagucuugcaccguggaccucgggauuacagcugauuccucaaaucauccagacaacaagcacaaaaauagguauaucaacauuguugccuacgaucauagucgggugaagcuggcacaguuagcggaaaaagacggaaagcugacggauuauaucaaugcuaacuacgucgacgguuacaaucgcccuaaagccuauauagcagcccaaggcccccuuaagagcaccgcugaggauuucuggagaaugaucugggaacacaacguggagguuauugugaugaucacuaacuugguagagaaggggaggcguaaaugcgaccaguacuggccagccgauggauccgaagaguauggcaauuuucucgucacacagaagucuguccaggugcuggcauacuauaccgugcggaacuucacacuacgaaauacuaaaauuaagaaagguucgcaaaaggggagaccgagcggcaggguugugacccaguaccacuauacgcaguggccugacaugggaguacccgaauacucacugccagugcucacauuuguccgcaaggcugccuacgcgaaacggcaugccgugggccccguugugguccacuguuccgcuggggugggaagaaccggcacuuauaucguucuggauaguaugcuucagcaaauacagcaugaggguaccgugaacauuuucggguuuuugaagcacaucaggucucagcgcaauuaccugguccaaacagaagaacaguauguauucauccacgacacuuuaguggaggcaauucucagcaaagaaaccgagguucuggacucccauauccacgccuacgugaacgcccuucugauuccuggaccagcuggcaagacaaaauuggaaaagcaguuccagcuccugucacaaucuaauauacagcagagcgauuauagugcagcgcuaaagcagugcaaccgagagaaaaaucggacguccagcaucauucccgucgagcguucuagaguggguaucucaucccugaguggcgaagggaccgacuacauuaacgccagcuauaucaugggauacuaccaaucgaaugaguuuauaaucacucagcauccucuccugcacacaauuaaggauuucuggaggaugaucugggaccauaacgcucagcuuguagugaugauuccggauggccagaauauggccgaagacgaguuugucuauuggccaaacaaagaugaacccaucaauugugagucuuucaagguuaccuugauggcagaggaacacaaaugccuguccaacgaggaaaaguuaauaauucaagacuuuauccucgaggcuacucaggaugacuacgugcuggaagugcgccacuuccaguguccuaaguggccaaaccccgauagcccuaucucaaaaacauuugagcuuauuagugucauaaaggaggaagccgcaaaucgggacgggccgaugaucgugcaugacgagcacggaggcguuaccgccgguacguucugcgcucugacuacccuaaugcaucagcucgaaaaagagaacucuguagauguguaucaagucgcgaagaugauuaaucugaugagacccgggguguuugccgacaucgaacaguaccaguucuuguauaaaguuauucuguccuuagugagcacaaggcaagaggagaacccaucaaccagucucgauagcaauggagcagcucugccugacggcaacaucgccgaaucccuugagucucuggucuga

SEQ ID NO: 61408 - RNA, 1173 nt, Artificial Sequence
  derived and/or modified sequence opt3 from PTRF__Homo_sapiens__NP_036364
auggaggaccccacccuguacaucguggaaagaccucucccaggcuauccggaugccgaggcucccgaaccuagcuccgcaggggcccaggcggcugaggaaccaucuggagccgguucagaggagcuuauuaagagugaccaagucaacggcguucugguguugagcuuacuggauaaaauaaucggggcaguagaccagauucagcuaacacaggcccaacucgaagagaggcaggcugaaauggagggagcagugcaguccauccagggcgagcugucuaaacuugguaaggcccacgcuacuacgucgaauaccgucucaaagcuguuggaaaaagugcggaagguuagcgugaacgucaagacagugcgcgggagucucgagcgacaagccggacagauuaaaaagcuggaaguaaaugaggcggaacugcuccguagaaggaacuucaaaguuaugaucuaccaggaugaggugaaguuacccgcaaaacuguccauaucuaagagccuuaaggaguccgaagccuugccugagaaagaaggcgaggaacugggcgagggggagcggccagaagaggacgcugccgcacuagaacucucaagugaugaggcugucgaaguggaggaggugaucgaagagagccgcgccgaaagaauuaagaggucuggacugcggcgcgucgacgauuuuaaaaaggcguucuccaaagagaagauggagaaaacuaagguucgaaccagagaaaaucuugagaagacaaggcugaaaaccaaggaaaacuuggagaaaacucggcauacacucgaaaagcguaugaauaaacuggguacccgcuuagugcccgccgagagaagggagaagcugaagacgucacgggacaaacuccgaaagagcuuuacuccugaucacguaguguaugcacgcaguaaaaccgcugucuacaaggugccaccguucacauuucauguuaaaaagaucagagaaggccagguggagguccuuaaggccacugaaaugguggagguaggggcugacgaugacgaaggaggcgccgagaggggugaggcaggggaccugcggcgcggaucuucccccgauguucacgccuugcuagaaauuaccgaggaaagcgacgcugugcuggucgauaaaucggacucugauuga

SEQ ID NO: 61409 - RNA, 645 nt, Artificial Sequence
  derived and/or modified sequence opt3 from PTRH1__Homo_sapiens__NP_001002913
augagacccggcggguuccugggagccggucagaggcucagccgggcuaugucccgcugcgugcuugagccucgaccaccgggcaagcguuggauggucgcagggcugggaaaccccggcuugccugguaccagacacucuguugggauggccguguuaggacaacuggcgaggcggcuaggcguagcugaaucauggacacgcgacagacauugugccgcagaucucgcccuggcuccacuuggcgacgcacagcugguguugcucaggccccggcgccugaugaaugccaacgggcgaagugucgcuagagccgcggagcuguuuggacucacugcagaagagguguacuuaguucacgaugaacuggacaaaccucuugguagguuggcccugaagcuaggcgggagcgcucggggacauaauggcgugcguuccugcaucucuugucucaacucgaaugccaugccacgccugagagucgguauugggaggcccgcacacccugaggcugugcaggcccauguacuuggaugcuucucaccagcggagcaggaacuguugccgcuccuguuagaucgggccacggaccugauacucgaucacauccgagagcgcagccaaggccccagucuuggcccuuga

SEQ ID NO: 61410 - RNA, 540 nt, Artificial Sequence
  derived and/or modified sequence opt3 from PTRH2__Homo_sapiens__NP_057161
augcccagcaagucccuggugauggaguaccucgcccacccuucuacccuuggccuggcugucgggguugcaugcggaauguguuuggguuggucauuaagagugugcuucggcaugcugccaaaaaguaagacaagcaaaacucauacggacaccgaauccgaggccucuauccuaggggauucgggagaauauaagaugauucucguagugaggaacgaccugaaaaugggcaaggguaaggucgcggcucaguguucacacgccgcagugagcgccuacaaacaaauacagcggcgcaauccggagaugcuuaagcagugggaauauugcgggcagcccaaaguuguggucaaggcuccugaugaggagacacugaucgcauugcucgcccaugcuaaaaugcugggacugacugugagucucauucaagacgccggccgaacccagaucgcgccaggcucccagacaguauuagggauuggacccgguccugcagaucugaucgacaagguuaccggccaccuuaaguuguacuga

SEQ ID NO: 61411 - RNA, 423 nt, Artificial Sequence
  derived and/or modified sequence opt3 from PTRHD1__Homo_sapiens__NP_001013685
augcacagaggcguggggcccgccuucagggucguucggaagauggcugcaagcggagccgagccucaggugcugguacaauaccucgugcuucgcaaagaccugucccaggcgccauuuucuuggccggcuggugccuuggucgcacaggccugccaugcugcaaccgccgcuuuacacacacaucgagaucacccccauacugccgcguaucugcaggaacuaggccguaugagaaaggugguucucgaggcaccugacgaaacgacccugaaagagcuugccgaaacacugcaacagaagaacaucgaucacauguuguggcucgagcagccagagaauauugcuacuuguauagcccugaggcccuacccuaaagaagagguggggcaguaucugaagaaguuccggcucuuuaaauga

SEQ ID NO: 61412 - RNA, 438 nt, Artificial Sequence
  derived and/or modified sequence opt3 from PTS__Homo_sapiens__NP_000308
augagcaccgagggcgggggaagaaggugccaggcccaagugucccggcgcaucucuuucucagcuagucaccgacuguacagcaaguuucucuccgacgaagagaaccuuaaacuguucgguaaguguaauaaccccaauggccaugggcacaacuauaaagucguugugacaguacauggagaaauugauccugcaacuggcauggugaugaauuuggccgacuuaaagaaauacauggaggaagcgauaaugcagccacuggaucacaagaaccuagacauggaugucccguauuuugcugacgugguuucuacgaccgagaauguggccgucuacaucugggauaaccuccagaaggugcugcccguagguguucuuuauaaagugaaggucuacgagacagacaauaacauugugguguauaaaggggaauga

SEQ ID NO: 61413 - RNA, 609 nt, Artificial Sequence
  derived and/or modified sequence opt3 from PTTG1__Homo_sapiens__NP_001269312
auggccacccugaucuacguggacaaggagaacggcgaacccgggacaagagucguugcuaaagauggacucaaacuugguagcggcccuuccauuaaggcacuggacgggaggucucaggugucaacuccacgguucggaaagacguuugaugccccgcccgcguugccuaaagcuacccgcaaggccuuaggcacaguaaaucgagcaacugagaagagugugaaaaccaaggguccacugaaacaaaagcagcccagcuucuccgccaaaaagaugacagaaaagaccgucaaagcuaagucuucggugccugcaucagacgaugccuauccagagauagaaaaauuuuuccccuuuaacccucuagacuucgagagcuuugaucucccagaggaacaccagaucgcucaucugccgcuuagugggguuccccugaugauuuuggacgaggaacgugagcucgagaagcuguuccagcugggaccuccaucccccgugaaaaugccuucuccacccugggaaagcaaucucuuacaauccccgucaaguauccugagcacucuugaugucgaguugccucccgugugcugugacauugauaucuga

SEQ ID NO: 61414 - RNA, 429 nt, Artificial Sequence
  derived and/or modified sequence opt3 from PTTG1IP__Homo_sapiens__NP_001273751
auggcccccggcguggcuagagggccuaccccauacuggaggcugcggcucggaggugcagcccuucuguuguuacugaucccggucgcggcugcccaggagcccccuggcgcagccugcagccaaaacacaaauaagacuugugaagagugccucaaaaacguuuccgcuugucuaaagaaaaagacgcgcaugcuggaccuuaaaaccacaaaggcacugcagcacauuucuccagaugccucaugcgaagugcaugcuccccagccuaguccagccgggcgaccccguggacacuguggcuugcucacucuggcgagcgagccugcaucccugccaggucaggccgcuggggaacucccguuaaaggacucuccccugguacuucaaaccggagauuugcuguucccugugcaucuaugcuuuuga

SEQ ID NO: 61415 - RNA, 576 nt, Artificial Sequence
  derived and/or modified sequence opt3 from PTTG2__Homo_sapiens__NP_006598
auggccacccugaucuacguggacaaggagauuggcgaacccgggacaagagucgcugcaaaagauguucucaaacuugagagcaggccuuccauaaaggcccuggacggaaucucucagguguugacucggcgcuucgguaagacguaugaugcgccaucagcuuuaccgaaagccacccgaaaggcacugggcacaguaaaccgugccacugaaaagagugugaaaaccaaugggcccagaaagcaaaaacagccuagcuuuuccgcuaagaaaaugacagagaagaccgucaagacuaaaucuucggugccagcaucagacgaugccuaccccgaaauugagaaguucuuuccuuucaaccuacucgacuuugagagcuucgaucugccagaagagaggcagaucgcucaccuuccccugaguggaguuccuuugaugauucucgacgaagagggcgagcuggaaaaacuguuucagcucgguccaccgucccccgugaagaugccuucuccacccugggagugcaauuuauucgccgucagcuuuaaacauuccguggauccuggguguuga

SEQ ID NO: 61416 - RNA, 1146 nt, Artificial Sequence
  derived and/or modified sequence opt3 from PTX3__Homo_sapiens__NP_002843
augcaucugcucgccauccuuuucugcgcucuguggagcgcaguguuggccgagaacuccgacgauuacgacuuaauguaugucaaucuggauaacgaaauugacaauggccuacaccccaccgaggauccuacaccaugugcgugcgggcaggaacacucugagugggacaagcucuuuauaaugcuggaaaacucacaaaugagagagaggaugcuucugcaggcuacugaugacguuuugcggggagagcuccagcgccugcgagaagaacugggucgucucgccgaaaguuuagcaagaccgugugcccccggcgcuccugcagaggccaggcugacgagcgcucuugaugaguugcugcaggccacccgggacgcggggcgcagacuagcaaggauggaaggagccgaggcucaacggccagaagaggccggccgcgcacucgcugccgugcuggaggagcuucgacagacaagagcggaucugcaugccguacaggguugggcagcuagguccugguugcccgccgggugcgagacugcuauccucuucccuaugcggucuaaaaagauuuuuggaucggugcacccaguccgucccaugcgccuggaaucauucagcgccuguaucugggugaaagcaaccgacguuuuaaauaagacaauucuguuuaguuacggcaccaaaagaaacccuuaugagauccagcucuaccuuuccuaucaaucuauaguguucgucgugggcggggaagagaauaagcugguagccgaagcuaugguuagcuugggaagguggacucaucuaugcgguacauggaacuccgaggagggccugaccucacucugggugaauggggaacuggcggcaacgacugucgagauggccaccggacacaucgugccagaaggcgguauucuucagaucgggcaggagaagaacggauguugcgugggcggcggguuugaugaaacacuggcuuucaguggacgguugacugguuuuaauauuugggacagcguccucucuaacgaggagauccgagaaaccggcggggccgaguccugucacauacgcggaaauauuguuggcuggggugugacagaaauccagccgcaugggggcgcacaauacguaucauga

SEQ ID NO: 61417 - RNA, 1551 nt, Artificial Sequence
  derived and/or modified sequence opt3 from PUF60__Homo_sapiens__NP_001129505
auggagaacggccagagcaccgccgcuaagcuggggcuucccccucucacaccagaacaacaggaggcacugcagaaagccaagaaauacgcgauggaacaguccaucaagucuguguuggucaaacaaacuauugcucaccagcagcagcaauuaacgaaucugcagauggccgcaguuaccaugggauucggugacccgcuaucaccccuccagaguauggccgcucagagacaaagggcacuggccauaaugugccggguguauguaggcagcaucuacuaugagcuuggggaagauacaauucgccaggcuuuugccccuuucggaccaaucaaguccauugacaugucuugggauucggugacuaugaagcauaaaggcuuugcguucgucgaguacgaggugcccgaagcagcccagcuggcuuuggagcaaaugaacucaguuaugcucggugggcgaaauaucaaggugggacguccuagcaacauaggccaggcccagccaaucauugaccagcuggcagaagaggcuagagccuuuaauaggaucuaugucgcgagugugcaccaagaucuguccgacgaugacauuaaaucuguauucgaggccuuuggcaagaucaaaagcuguacccucgcacgggaucccacaaccgggaagcauaagggauacgguuucauagaauaugagaaagcucaguccucacaggacgccguuaguagcaugaacuuauuugaucugggcgggcaguaccuucgcgugggaaaggcugucacuccuccaaugccguugcugacacccgccaccccuggcggucuaccacccgcagccgcuguggcggcagccgcugccacggcaaaaauuacugcccaagaagcuguggccggggcagcgguccucggaacccugggcacaccuggccuuguuucuccagcucugacuuuggcccagccccucgggacccugccgcaggcagugauggccgcucaggccccuggaguaaucacaggugugacccccgcaagaccaccuauucccgucacgaucccauccgugggcguugugaaucccaucuuagcuucaccuccaacucuggggcuccuugagccgaagaaagaaaaggaggaggaggaacuguuccccgaaagcgagaggccugaaauguugagugagcaagagcacaugucuauuuccggaagcucggcccggcauauggucaugcagaaacuacugcgcaagcaggaaucuacagugaugguacuccgaaacaugguugacccaaaggauauagacgacgaucuggagggcgaagugaccgaggaaugcgguaaauuuggggcggucaauagagugaucauuuaccaggagaagcaaggcgaggaagaggacgccgaaaucauagucaaaauuuucguggaguuuuccaucgcuucagagacucacaaggcaauccaggcccuuaacggaaggugguucgcuggccggaaaguuguggccgaaguauaugaucaggagcguuucgacaauagugaucugagcgcauga

SEQ ID NO: 61418 - RNA, 3027 nt, Artificial Sequence
  derived and/or modified sequence opt3 from PUM2__Homo_sapiens__NP_001269681
augagccagcccaucauggugcaaagaagguccggccagggguuccacggaaacucugaggucaaugccauucugucaccucggagugaaagcgguggccucgggguuuccaugguggaguacguacuuucuucgucaccagcugacaagcuggauagccgcuuucgaaaaggaaacuucggcacccgugacgcagaaacagaugguccggagaagggggaccagaaaggaaaggccagucccuuugaagaggaucagaauagagacuugaaacaaggcgaugacgaugacuccaagauaaacggcaggggguuaccuaauggaauggaugcggacugcaaggauuucaaccggacuccagguucucgccaggcuagccccacggagguggucgaaagacugggcccuaauaccaacccauccgaggggcuaggaccccucccuaauccaacagccaacaaaccgcugguggaagaguuuucaaaucccgagacucagaaccuugacgcaauggaacagguuggccuggagaguuugcaauucgacuauccugguaaucaggugccaauggauagcucuggggccaccgucggacucuuugacuacaacucccagcagcaacuguuccagaggacaaaugcucugaccgugcagcaacucacugcagcccagcagcagcaauaugcuuuagccgcggcacagcagccccauaucgccggcguauuuucagcuggccuggccccugcagcuuucguuccaaaccccuacauuaucagcgccgcgccgccugggacagaucccuauaccgccgcaggacuugcugccgcugccacguuggcagguccagccguggucccuccccaguacuauggcgugccauggggaguguaccccgcuaaccuguuucaacagcaggcggcagccgcugccaauaacacugcaagucagcaagccgcuucucaggcccagccugggcagcaacagguccuacgggcaggcgcgggucagcgcccacucaccccgaaucaagggcagcagggccagcaagcugaaucccuggccgcagccgcugccgcaaaccccacacuugcuuucggacagggccuggccacugggaugccuggauaccagguuuuggcgccaaccgccuauuacgaccagacaggugcucucgugguaggccccggggcacgaaccggacugggcgccccugugagauuaauggcuccaacgcccguccugauuagcucggccgcagcgcaagccgcugccgcagcugccgccggugggacugcaucuucccucacaggcucaaccaauggacuuuuuaggccgaucggcacucagccuccacagcagcaacagcagcaacccaguacaaaccugcagagcaauuccuucuaugggucuagcucauugaccaacaguucccagucuucuucacuauucagucacggaccuggucagcccggcagcacgucccugggguuuggaucuggcaauucgcucggugcugcgauagggagcgcccuguccggcuucggaucaagugugggcucuagcgcauccucaagcgcuacccggcgugagucucuuuccacaaguagcgaucuguacaagcgcagcuccucaaguuuggccccaaucgggcaaccuuuuuauaacagccucggauucucguccucucccagcccaauuggcaugccgcugccuucacagacucccggucauaguuuaaccccacccccuucccugucuagccacggguccucaagcagucuacaucucggaggccugacaaaugguucuggcagauacaucuccgccgcuccaggggcagaagccaaauauaggagcgcgucgucaacuucuagucuuuucuccagcucuagccaguuguuucccccuucccggcugcgauacaaccgcucagacauuaugccgaguggaagaagcaggcuccuggaggauuuucggaauaaccgcuucccaaaucuucagcugagagacuugaucggccacauaguugaguuuucucaagaucagcacggguccagguucauucagcagaagcucgaacgugcuacccccgccgagcggcaaaugguguuuaacgaaauccugcaggcagccuaccaguuaaugacagacgucuucggaaacuaugugauucagaaauuuuucgaguucggcucacuggaucaaaagcuagcucucgcaacccgaaucagaggucauguacugccucuugccuugcagauguacggguguaggguuauccagaaggcgcuggaaaguauuagcuccgaccaacagucugagauggugaaagagcucgacggacacguccugaagugcgugaaagaucagaauggcaaccaugucgugcagaaguguauagaaugcguucaaccacagucguuacaguuuaucauugacgcuuucaaaggucagguguuuguacugagcacucaccccuauggcugucgcgucauccaacggauacuugagcacugcacggccgaacagacauugccuauucucgaggaacugcaucagcacaccgagcagcuagugcaagaucaguacgggaauuauguuauccagcaugugcuggagcacggaagaccggaagacaagucaaaaaucgucuccgagauuaggggcaaggugcucgcacugagucaacauaaguucgccucuaacguaguggaaaaauguguuacucacgcuagccgcgccgagcgagcacuuuugaucgaugaggucugcugucagaaugacgggccccacuccgcucuguacaccaugaugaaggaucaguaugccaacuacguggugcagaaaaugauugacauggcggaaccagcccaacggaagauaaucaugcauaaaauucguccucacaucacaaccuuaagaaaguacacuuauggaaagcauauccucgcaaaacuggagaaguacuaucuuaaaaauucacccgaucugggcccaauuggugggccucccaacggaauguuguga

SEQ ID NO: 61419 - RNA, 969 nt, Artificial Sequence
  derived and/or modified sequence opt3 from PURA__Homo_sapiens__NP_005850
auggccgacagagauagcggcuccgagcaagggggagcugcacuggguucuggcgggucacucggacaccccggcagugguagcggguccggaggcggcgggggagguggcgggggaggcggugggucuggaggcggcgggggaggugccccuggcgggcuucagcaugaaacccaggagcuggcgucgaagaggguggacauccagaacaaacgguucuacuuggaugucaagcagaaugcuaaaggacgcuuuuuaaagauugccgaaguuggcgccggugggaacaaaucacgacugacacuaagcaugaguguggcaguagaguuccgugacuaucucggcgauuuuauagaacacuacgcucaacugggaccaucccagccgcccgaccuugcacaggcccaggaugagccuagaagggcucugaagucugaguucuuggugcgggaaaaucgcaaguauuacauggaccucaaagagaaccaaagaggcagguuucugcggauccgccagacugucaaucgagggccaggacuggguagcacgcagggccagaccauugcccuccccgcgcaaggguuaaucgaguucagagaugcacuggccaaacuuauugacgauuauggaguggaagaggaaccugcugaguugccagaaggcacaucccugacuguugacaacaaaagguuuuucuuugauguggguucaaauaaguacggggucuucaugcgggugagugagguaaaacccaccuaucguaacagcaucacaguuccuuacaaggugugggccaaguuuggccauaccuucugcaaauacucugaagagaugaagaaaauacaggagaagcagcgcgaaaagagagcagcuugugagcaacuacaccagcagcagcaacagcagcaggaagagacugccgcggccacacuccugcuucaaggagaagaggagggcgaagaggacuga

SEQ ID NO: 61420 - RNA, 939 nt, Artificial Sequence
  derived and/or modified sequence opt3 from PURB__Homo_sapiens__NP_150093
auggccgacggcgauagcggguccgagagaggagguggcgggggacccugcggcuuccagccugcuucuaggggugggggagaacaagagacccaggaacuggcaucaaagcggcucgacauccagaacaaacgcuuuuaccuugaugugaagcagaaugccaaaggccgauuccugaagauugcggaggucggcgcugggggaaguaaaagccguuugacauuauccauggccguugcagccgaauuuagagacucucugggugauuucauagagcacuaugcucaacuaggcccaucgucaccggagcagcucgcagccggggcugaagagggaggcggucccaggcgggcccuuaagagcgaauuucuggugcgcgagaacagaaaguacuaucuggacuugaaagagaaucagagggggcgguuccuccgcauccgacagacuguaaacagaggaggcggcggguuuggagcggguccuggcccagggggacugcaaaguggccagacgauugcacugcccgcccagggucucaucgaguucagggaugcuuuagccaagcugauugacgauuacgggggcgaagacgaugaacuugcaggaggcccugggggaggugcuggcgggccaggaggcgguuuguauggggagcugcccgaaggcaccuccaucacaguggacucuaaacgguuuuucuuugaugucggauguaauaaguacggcguguuccuacguguuagcgaggugaaaccuuccuaucgcaacgccauaacugucccauuuaaggcgugggggaaguucggaggugccuucugcagauacgcagacgagaugaaagaaauccaggagaggcaacgggacaagcucuacgaacgacgcggcgggggaucaggcgguggggaggaaagugagggcgaggaaguggaugaggacuga

SEQ ID NO: 61421 - RNA, 1590 nt, Artificial Sequence
  derived and/or modified sequence opt3 from PUS10__Homo_sapiens__XP_011530879
auguucccccugaccgaggaaaacaagcacguggcccagcuccuucugaauacaggcacuugcccuagauguaucuuuagguucugcggggucgacuuucaugcuccauacaaauugccguauaaggaguuacugaacgaacuacaaaaauuccucgagacggaaaaggaugagcugauucuugagguuaugaaucccccucccaaaaagauacggcugcaggaauuggaggacagcaucgauaaccucucccagaauggagaaggucgcauuucugugucacacguaggcaguaccgcaagcaagaacuccaaucugaacguguguaaugucugccuggggauccuccaggaguuuugugagaaagacuucauuaagaaagugugccaaaagguugaagccucuggauuugaguucacaucguuaguguuuucagucagcuucccaccucagcugagugugcgagaacaugcggcuuggcuuuugguaaaacaggagaugggcaagcagucccugucucuaggucgugaugacaucguucaacucaaggaagccuacaaauggauaacucacccacuguuuagcgaggagcuuggggugcccaucgauggaaagucccuguucgaagucucagugguguuugcacauccugagaccgucgaagacugucacuucuuggccgcuauuugcccagauuguuucaaaccggcaaagaacaaacagaguguuuuuacaagaauggccgugaugaaggcucucaauaaaaucaaggaggaagacuuccugaagcaguuucccugcccuccaaacagccccaaagccguaugugcgguguuagagauugagugcgcacacggcgccgucuucguggcuggcagguauaauaaguacucucggaaccugccucagaccccauggaucauagauggggaacgcaaacucgaguccucaguugaagaacuuauuagcgaccaucuguuggccguguuuaaggcagaaaguuucaauuuuucuuccagcggaagagaggaugucgacgugaggacucuagguaacggccggcccuucgcuaucgagcugguaaacccgcaccgcguucauuuuacaucgcaagaaauuaaagagcuccagcagaagaucaauaacucuuccaauaagauccaagugcgagaccugcagcuugucaccagagaagccauugggcacaugaaagagggagaggaagagaagacgaaaacuuauucagcgcugauauggaccaacaaggccauccagaaaaaggauauugaguucuugaaugacaucaaggaucucaaaauagaccagaagacaccucugaggguguuacaccggcguccccuggcaguccgcgcuagagugauucauuuuauggagacucaauacguugaugaacaccauuucaggcuacaccucaaaacccaggccggcacauauaucaaggaguuugugcauggugacuucgggcggaccaaaccaaacaucggaagucugaugaauguaacggcugauauucuugaguuggacgucgaaagcguggauguugacuggccucccgcccuggaugacuga

SEQ ID NO: 61422 - RNA, 1200 nt, Artificial Sequence
  derived and/or modified sequence opt3 from PUS1__Homo_sapiens__NP_001002019
auggccggcaacgcugagcccccuccagcaggggccgcgugcccgcaggacagaaggagcuguuccggacgggcugguggcgaucgcgugugggaagacggggagcaccccgccaagaaacugaagucuggaggcgaugaagaacgacgugaaaaaccuccaaagagaaaaaucguccuccuuauggcauacucagguaagggguaucauggaaugcaaaggaauguuggcaguagccaguucaagaccauugaggacgaucugguguccgccuugguacggucuggcugcauacccgagaaccacggggaagacaugcgcaaaaugucguuucagagaugugcuaggacagauaagggagugucagcagccggucaggucgugagcuuaaaaguuuggcugaucgacgauauucuagagaagaucaauagucaucucccuucccacauucggauccugggccuuaaacgcgugacugggggauucaacucuaagaaucgaugcgacgcuagaacguacuguuaucuguugccaaccuuugccuucgcgcauaaggauagggacguccaagaugaaacauaccggcucagcgcagagacucugcaacaggugaaccgucugcucgccugcuauaaaggcacccacaauuuucacaacuucacaucccagaaggguccccaggacccuucagcuugucgcuacauauuagagauguauugcgaggagccauuuguaagagaagggcuggaguucgccguuaucagggugaaaggacagaguuuuaugaugcaucagauucggaagauggucggccuugugguggcaaucgucaaaggcuacgcuccggaaagcguuuuggagcgaucuugggggaccgagaagguggacguacccaaagccccuggacugggucuagugcucgaacgcguccacuucgagaaguacaaucagagauuuggcaacgaugggcugcaugaaccacuugacugggcgcaagaggaaggaaagguggccgcauucaaagaggagcacauuuaucccacuaucauaggcacagaaagggaugagcgguccauggcucaguggcugucaaccuugccuauucacaauuuuagcgccacggcucucacugccggugggaccggcgcaaagguuccaaguccccuggaaggaucugagggcgacggggauacagacuga

SEQ ID NO: 61423 - RNA, 324 nt, Artificial Sequence
  derived and/or modified sequence opt3 from PVALB__Homo_sapiens__XP_011545203
augagcaugaccgaccugcucaacgccgaggauaucaagaaagcugugggcgcauucuccgccacagacucuuuugaucacaagaaauucuuucagauggucgggcuuaagaaaaagucagcggacgauguuaagaaaguguuccauaugcuggacaaggauaaaaguggauuuauugaagaggacgaauuggguuucauauuaaagggcuuuagccccgaugcuagagaccuguccgccaaagagacuaagaugcuaauggcagccggggauaaggacggagauggcaaaaucgguguagacgacccugcugauguggacuga

SEQ ID NO: 61424 - RNA, 1119 nt, Artificial Sequence
  derived and/or modified sequence opt3 from PVR__Homo_sapiens__NP_001129240
auggccagagcuauggcagccgcguggccccugcuccuuguggcucuguuggucuuaagcuggccuccaccgggcaccggggacguugugguacaggcccccacacaagugccuggauuccugggugauuccgucacucuaccaugcuaccuccaggugcccaacauggagguuacgcacgugucucagcugaccugggcaaggcauggcgaaucagggaguauggccgucuuucaccagacacaaggaccuagcuauuccgagucuaagcggcuugaguucguggcugcacgccugggcgccgaauugcgaaaugcuucgcuccguauguuuggucugagaguagaagacgaggggaacuacacuugucuguucguuaccuuuccacagggaucaaggagcguggauaucuggcuccgggucuuagccaaaccccagaauacagcggaggugcagaaggugcaacugaccggcgaaccugucccaauggcacgcugcguuaguacuggcgggagaccgcccgcccagauuacauggcauuccgaccuuggagguaugccuaacaccucucaggugccaggcuucuugagcgggacgguaacugugaccucccuguggauccuaguccccucaagucagguggauggcaaaaauguuacauguaagguggagcacgagagcuuugaaaaaccucaacuccugacugucaaccuuaccguguauuacccacccgagguaucuauauccggauaugacaauaacugguaccugggucagaaugaagcuacauugaccugcgaugccaggucaaacccggagccuacgggguauaauuggagcacuacaaugggaccccucccaccuuucgcaguugcucagggcgcccaacuguuaauucggcccguggacaagccaaucaacaccacucugauuuguaaugucacaaacgcgcucggcgcccgccaggcagaacuuaccgugcaggucaaggaggggcccccuagugaacauucuggaacggagcacgcuuccgccagcgcuaauggucacgugucguacucugccguuucccgagagaacucaaguagccaggauccacaaaccgaaggcacaagauga

SEQ ID NO: 61425 - RNA, 1554 nt, Artificial Sequence
  derived and/or modified sequence opt3 from PVRL1__Homo_sapiens__NP_002846
auggccagaaugggccuggcuggggcagccggaaggugguggggucucgcgcuuggccugaccgcuuucuuuuugcccggggugcacagccaggucguucaagugaacgacuccauguacggauucaucggcacagauguaguguuacauugcucuuuugccaauccucugccaucagucaagauuacucaggugacguggcagaaaaguaccaacgguagcaagcagaauguugcaauauauaacccguccaugggggugucuguccuagcccccuaccgggagcgcguggaguuccuccgaccuucguuuacagacggaacuauccgucugucaagacuugaacuggaagaugagggcguauauauuugugaguucgcuaccuuuccaacaggcaauagggaaagccaauugaaccucaccguuauggcaaaacccacuaauuggaucgaggggacacaggccgugcugcgggcuaagaaaggacaggacgauaagguccugguggcgaccugcacgagugccaacgguaagccuccauccguggucucuugggaaacucgccucaaaggcgaggcagaauaccaggagauuagaaaucccaacgggaccguuacagugaucagcagguaucgguuaguaccuucccgcgaggcccaccaacagucacuggcuuguauagugaauuaccauauggaccgauucaaggaaagucuuacuuugaacguccaguaugagccagaagugaccaucgagggauuugauggcaauugguaccugcagagaauggacguuaaacuaacaugcaaggccgaugcaaacccgcccgcuaccgaauaccacuggacgacucucaaugguagccugccuaaagggguggaggcccaaaacaggacacuuuucuuuaagggaccaauuaacuauucucuggcgggcaccuacaucugugaggccacuaaucccauuggcacacgguccgggcaggucgaagugaacaucaccgaguucccuuauacgccaucacccccggaacauggacgucgcgcagguccuguacccaccgcuauaauuggcgggguugccggaagcaucuugcucgugcugauugucgugggcgguaucgucguggcuuuaagaaggcggcgacacacauuuaagggggacuacaguacuaaaaagcacguuuauggcaauggauacucuaaagccggcaucccacagcaucacccucccauggcacaaaaccugcaguauccagaugacuccgaugacgagaagaaagccgggccccucggagguagcucguacgaagaggaggaagaggaagaggaaggcgggggaggcggugagcgcaagguagggggcccucauccaaaauacgacgaggaugcuaagagaccguauuucaccguggacgaagcggaggcaaggcaggauggauacggcgaccggacacuuggguaucaguacgaucccgaacaacuggacuuggccgagaauauggucucucagaacgauggauccuucauuucaaagaaagagugguauguguga

SEQ ID NO: 61426 - RNA, 1617 nt, Artificial Sequence
  derived and/or modified sequence opt3 from PVRL2__Homo_sapiens__NP_001036189
auggccagagcugcagcccugcuccccagcagguccccuccaaccccgcuucuguggcccuuguuacugcuacuccugcuugagacaggcgcgcaggacgugcggguccaaguucugccugaagugcgcgggcaguugggagguacuguagagcucccaugccaucugcugcccccugugccaggccucuacaucucuuuagucacguggcagcgacccgaugcuccugccaaccaccagaauguggcagccuuccacccaaagauggggccgucauuucccaguccuaaaccaggaagcgaacgucuguccuucguuucugcuaagcaaucgaccggccaggacacagaggcagaacuucaggaugccacuuuggcucugcauggucuaaccguggaggacgaggggaacuauacaugugaauuugccaccuuccccaaaggaucagucagaggcaugacuuggcucagggugauugcgaagccuaaaaaucaggcagaggcccaaaagguaacauuuagccaggauccaaccacgguugcucugugcauaaguaaggaaggccggcccccggcccgcaucuccuggcuuucuagccuggacugggaggcaaaagagacucagguguccgggaccuuggcuggaacagucacugugaccucaagauucacacucgugccuagugguagggccgauggcgucaccguuacguguaagguggaacacgagagcuuugaggagcccgcgcugauuccaguaacuuuaucugugcgguacccucccgaagucuccaucucaggguaugacgauaacugguaccugggacgcacagacgccacccucagcugcgaugugcgaaguaauccagagcccacuggcuaugacuggucuacaaccuccgguacguucccuaccagcgcaguugcucaggggucgcaacuugugauucaugccgucgauucucuguuuaacacaacuuucguguguaccguaacaaaugcuguuggaaugggcagagccgaacaggugaucuuugucagggaaacuccaaacaccgcaggcgccggggcuacaggagguauaaucggcgggauuaucgcggcaauuaucgccaccgcuguggccgcaacuggaauauugauuugccggcagcaacguaaagagcagacgcuacagggcgccgaagaggacgaagaccuggaggguccgcccuccuacaagccuccaacacccaaagcuaagcucgaggcccaggaaaugccuucacaacuguucacccuuggggcaagugagcacagcccacugaagacucccuauuuugaugcgggcgcuuccuguaccgaacaggagaugccgcgcuaccacgaauugccuacacucgaggagagaucuggaccacugcaucccggcgccaccagcuuagggucaccuauccccgucccaccuggacccccagcaguggaagacguuagucuggaucuagaggacgaagagggugaggaagaggaagaguaccucgauaaaauuaauccgaucuaugacgcccuguccuacagcucuccuucagauaguuaucagggcaagggguucgugaugagcagggcuauguacguauga

SEQ ID NO: 61427 - RNA, 1101 nt, Artificial Sequence
  derived and/or modified sequence opt3 from PVRL3__Homo_sapiens__NP_001230215
auggccagaacccugaggcccagcccucucugcccaggcgggggaaaggcucagcuuuccucugcaucacuguugggugccggcuuacugcuacaaccgcccacaccuccaccccuccugcuucuguuguucccucuccugcuguuuagucggcucuguggggcguuagcuggaccaaucauuguggagccccacgucacugccguuuggggcaaaaacgugagccugaagugccuuauagaaguaaaugagacgaucacccagauuuccugggagaaaauccaugguaagucuucgcagacaguggcaguccaccauccucaguacggguucucagugcaaggagaauaucagggccgcguuuuguuuaaaaacuacagccugaaugacgccacuauuacccuacacaacaucggcuucagugauuccgggaaguauauauguaaggcugugacauuuccacucggaaaugcacagucuagcaccacugucacagugcugguagaaccgaccguuucccuuaucaaaggucccgacucacugauugauggcgggaacgagacgguggccgcuaucugcauugccgcgacuggaaagccugucgcacauaucgacugggagggcgauuugggugaaauggagaguaccacaacuagcuucccaaaugaaaccgccacaauaauuucucaguacaaacucuuucccacccgauucgcucgugggagaaggaucacguguguggugaagcacccugcccuggagaaagacauucgguauuccuuuaucuuagauauccaauacgcaccagaggucucaguuacuggauaugacggcaacugguucgugggccgcaaggggguaaaucugaagugcaacgcugaugccaaucccccgccuuuuaaaagcguguggaguagacucgacggacaguggcccgauggucuucuggcgucugacaacacauugcacuucguccauccacuaaccuuuaauuacuccggcguguacauuuguaagguuacuaacagccuggggcagaggucggaucagaaagugauauauaucucugccuacaauuccgucgcaucacucaacugcuga

SEQ ID NO: 61428 - RNA, 1533 nt, Artificial Sequence
  derived and/or modified sequence opt3 from PVRL4__Homo_sapiens__NP_112178
augccccugagccucggcgccgagaugugggggccugaagcauggcuucuguuguuacugcuacucgcauccuucaccggaagaugcccagccggugagcuggaaacaucugacguggucacuguugugcuuggccaggaugcgaagcugccguguuuuuacaggggagacucaggggagcaaguaggccagguggcuugggcccgggucgaugcuggugaaggggcccaggaguuggcucuccugcacaguaaauauggacugcaugugagccccgcauacgagggccgcguugaacagccuccacccccucgaaacccacucgacggcuccguguuacugcguaaugccguccaagcugaugagggggaauaugagugcagagugucuacguuccccgccggaucguuucaggcgaggcuucgguugcgcguacugguuccuccacuaccgucacucaaccccgguccugcacuggaggaaggccaggggcuuacccuggccgcuagcuguacagccgagggaaguccagcacccuccgugacuugggacaccgaagucaagggcacaaccucuagcagauccuucaaacacucaaggagugcugccgugacuagcgaguuucauuuggugccuucucgguccaugaauggucagccacucacaugcgucguuucacaccccgggcuguuacaagaucagcgcaucacccauauucugcacgugagcuuccucgcggaagccaguguacgaggacuugaggaccagaaccuguggcacauaggcagagagggcgcaauguugaagugucuaucugaagggcagccgccucccuccuacaauuggacgaggcuggauggaccacucccuagcggugugcgggucgacggcgauacucugggguuucccccacuuaccacagagcauucgggaaucuaugugugccacguuucuaacgaguucuccucacgugacagucaagugacugucgaugugcuggacccccaggaggacagcggcaaacagguagauuugguuuccgcuucuguggucguggucggugugauugccgcucuccuguuuuguuuacugguugugguagucgugcuaaugagccgcuaccauagaaggaaggcccaacagaugacccagaaguaugaagaggagcucacacugacccgggaaaauucaauccgacgccuucacagucaccauacggacccuagaucccagccagaggaaagcguuggguugagggcagagggccacccggauucucugaaagacaacucaaguugcagcgugauguccgaagaacccgagggacggucuuacucgacucucacaaccguccgcgaaauugagacucaaacagaacugcuuagcccuggcuccgggagagccgaggaggaagaggaucaggacgaaggaaucaagcaggcuaugaaucauuucgugcaggagaacgguacccugagggcgaaaccaacgggcaaugggauauacaucaacggacguggccacuugguauga

SEQ ID NO: 61429 - RNA, 2760 nt, Artificial Sequence
  derived and/or modified sequence opt3 from PWP2__Homo_sapiens__NP_005040
augaaguucgccuacagauuuagcaaccugcucggcaccguguauaggcgggggaaucuuaacuucacaugcgacggaaauuccgucaucucucccguugguaaccgcgugacuguauuugaucugaaaaauaacaagucagacacguugccuuuagcuacccgauacaaugugaaaugugucggccugaguccagaugggcgucuagcaauuauaguggacgagggaggcgaugcccuccugguuagccuugugugcagauccguccugcaccauuuccacuuuaaggguucugugcauucgguaucauucagcccggacgggaggaaauuuguugugacaaagggaaacaucgcgcagauguaucacgcucccggcaagaaacgggaauuuaaugccuuugucuuggauaagacuuacuucggcccuuaugacgagaccacauguauugauuggaccgacgauagucgcugcuuuguggugggguccaaagacaugucuacuugggucuucggagcagaaagaugggauaaccucaucuacuaugcccuggguggccauaaggacgcuauuguugcauguuucuucgagagcaauucccuggaccucuacucauuaagucaagauggggugcugugcauguggcagugugacacaccacccgaaggacuuagguugaaaccuccagccggcuggaaggcugaucugcuacagcgggaggaggaagaggaagaggaggaagaccaggagggugaucgcgaaaccacgauccgagggaaggccacucccgcggaggaagagaaaaccggaaagguaaaauacagcagacucgcaaaguauuucuuuaacaaagagggcgacuucaauaaccugacagccgcugccuuucacaagaaaucucaccuucuggugacuggcuucgcauccgggauauuucauuugcacgaacucccugaguucaaucugauccauucauuaagcauuagugaucaaucuaucgcuuccgucgccauuaacagcucgggagacuggaucgcguuugguugcucuggccuggggcagcuccuugugugggaauggcaguccgagucauacguucugaagcagcaaggacacuucaacaguaugguggccuuggcauauagcccagauggccaguacauagucaccgguggggacgauggcaaggugaaaguauggaauacacuauccggauuuuguuucguuaccuuuacggaacacucuagcggcgugacuggggucacauucaccgcuacuggauauguggucgugacaucaaguauggacgguaccguuagggccuuugaccugcaucgguaccguaacuuccgcacguucaccuccccgagacccacacaguuuagcugcguggcuguagaugccucuggcgagauugucucagcaggggcccaggacaguuucgagaucuuuguguggagcaugcaaacuggaaggcuccuggauguucuuuccggccacgaagguccuauuucugggcuguguuucaauccaaugaagucgguguuggcuagcgcguccugggacaaaaccguccggcucugggauauguuugacucauggcgaacaaaggagacucuggcauuaaccagugaugcccuggcugugacauuccgccccgacggcgccgaacuagcaguagccacccucaacucucagaucacuuuuugggauccugagaaugcugugcagacgggaagcaucgaaggcagacaugaccugaaaacagggaggaaggagcuugauaagauuaccgccaaacacgcagcgaagggaaaggcuuucacugccuugugcuauuccgcagacggucauucaauacuggccggcgggaugagcaaauuuguuugcaucuaccacguccgggagcaaauucucaugaaacgcuucgaaaucucuuguaaccugucccuugaugcuauggaggaauuucugaauagaaggaagaugaccgaguucggaaacuuggcccucauagaccaggacgcaggccaggaggaugguguggcuauuccacugcccggggugcguaagggcgacaugaguagccggcacuuuaaaccggaaauccgagucacaucuuuaagauucuccccuaccggaaggugcugggccgcgacuacaacggagggccugcuaaucuacucacucgauacccgcguucuguucgaccccuuugaacuugauacaagugugacuccagggcgggugagagaggccuugaggcagcaagacuucacccgcgcuauucugauggcacuccgacugaaugaaagcaaguuaguacaggaggcccuggaggcugucccucggggagaaaucgaggugguuacaucgucccuucccgaauuguauguggagaaaguccucgaauuucuggccucuagcuucgaggugucacgucaucuagaguuuuaccugcucuggacucacaagcugcuuauguugcauggccagaaacugaagaguagagcagguaccuuacucccaguuauucaguuccugcaaaaguccauacagaggcaccuugaugaccugucuaaauuguguagcuggaaccacuauaauaugcaguacgcgcucgccguguccaagcagcgcgggacgaaacggucacuggauccccuaggaagcgaagaggaagcugaggccagugaagacgauucucugcaucuccugggcgguggcgggagagacuccgaggaggaaaugcuugcauga

SEQ ID NO: 61430 - RNA, 1500 nt, Artificial Sequence
  derived and/or modified sequence opt3 from PWWP2B__Homo_sapiens__NP_001092107
auggagcccagagccggcugcaggcugccugugcgggucgaacagguugugaacggggcucucguagugaccgucagcuguggagagcgcuccuucgcagguauccuucuggacugcacaaagaaaucuggcuuguuuggguuaccaccgcuggcgccccuaccucaaguggaugaaucaccaguuaaugacagucacggacgagcccccgaggaaggcgaugcugaggugaugcagcucgguagcuccucuccuccacccgcccgugggguccagccuccagagacuacgagaccggaacccccuccaccccuggugccuccacuucccgcaggaucgcugccgccuuaucccccauacuucgagggcgccccuuuuccccauccauuguggcucagggacaccuacaagcuguggguaccccagccuccaccgcggacaauuaaacgcacuagaaggcggcugucacgcaaccgagaucccggcagacucauauuaagcaccaucaggcugcggccucgucaaguucuuugugaaaagugcaaaaguacauuguccccacccgaggcuucuccugggccacccgcagccccgcgcgcuagaaggcggcugggaagcgguccugaccgagagcuacgcaagccagaggaacccgaaaauggcgagccuaccgccgcggcaacugccagaagguccaagcgggaacgcagagaggaggauagggcucccgccgaacaggugccacguucaccugucauuaaaaucaguuauagcacaccccaggggaagggagagguggugaaaauuccaucucggguccacggcucccucgaaccguuccgaccucagcaagcaccccaggacgaugguucacaggacccagagguucuggauagagaaagcagggaccgccccaguugugcuccuucugccuccaucccaaaacuuaagcugacccggcccgugccugcgggggccgauuugccgccacccaagauaagacucaagccucauaggcugggagacagcgagcacgagccaguauaccgcgcagaauuagugggcgagcugaacggcuaucuccgagacucgucucccgcuccuugcgccgaugggccggcuggaggucuugccgaccuguccucaggcaguagcggggaagaugacgauuuuaaauccuguccccagggaccacaaggccgggaggguuuggcauuccuagucucuugcccugaagggcgugccgacugugcuagcgagucagcgugcaguuccgauagccuggacgaggcaagaucuucaggcagugaaggaacgcccgccgauacuggcgaccucagcccagggcauggagcuuccgccccuucugugucgagggaggcacgccagaccguucccccacugacagugcggcuucacacucagagcgucuccgaauguaucaccgaggaugguagaacaguggccguaggcgacauuguuugggggcacaggcgauga

SEQ ID NO: 61431 - RNA, 4440 nt, Artificial Sequence
  derived and/or modified sequence opt3 from PXDN__Homo_sapiens__NP_036425
auggccaagagaagcaggggccccgggcggcgcugccugcucgcucuugugcuguucugugcauggggaaccuuggccgucguugcgcagaaaccuggugcuggcugcccaucccgauguuuaugcuuucguacaacugugagauguaugcaccuccuacucgaggccguaccggcaguggcuccccaaacgucuauccuggaccuuagguucaaccggauucgcgaaauacagccuggggcuuuuagaaggcugcggaauuugaacacccuccugcugaauaacaaucagaucaagcgcauuccaucaggagcauucgaggaucucgaaaacuuaaaauaccuguaucuuuacaagaaugagauccagaguauugaccgacaagccuuuaaaggcuuggcuagccuggaacagcuauaucuccauuucaaccagaucgagacacuggaucccgacuccuuucagcaccuuccuaagcuggagagauuguuccuccauaauaacaggauaacucaccuggucccagguaccuuuaaucauuuagaaucuaugaagcggcugcgucucgauucgaacacacuucacugcgacugugagauccugugguuggccgaucuacugaaaaccuacgcggaaucagggaaugcacaagccgcugccauuugcgaguauccccgcagaauccagggaaggagcguggcaacuauuacaccugaggaacucaacugugagcggccacgaaucaccagugaaccgcaggacgcugauguuacguccggcaauacuguguacuuuaccugccgcgccgagggcaaccccaagccugaaauaauuuggcugagaaacaauaacgagcuuucuaugaaaacagacagcaggcugaauuugcucgaugacgggacucugaugauccagaacacccaagagacagaucagggaauuuaucaguguauggcgaagaaugucgccggugaagugaaaacccaagagguaacguuacgguacuucggcuccccagcacgccccacuuucguuauccagccucagaacacagaagugcuggucggggagucagugacccuagaaugcagugcuacuggacacccacccccgagaaucagcuggacaaggggcgaccguaccccucuccccguggacccacgggucaauauuacgccuucuggugggcuguacauacagaacguugugcaaggagauuccggcgaguaugccugcucagcuaccaauaacaucgacagcguacaugccacagcauuuauuaucgugcaggcccuuccccaguucacugucaccccacaggaucgagugguuauagagggccaaacaguggacuuccagugugaagcuaaggggaaucccccuccagucauugcguggacuaagggagguagucaguugucuguggauagaaggcaccugguacucuccagcggcacccugcgcaucucggggguugcacuucaugaccagggacaauacgagugccaggccgugaacaucauuggcucucagaaagucguggcucaccugacaguccagccgcgggugacccccguuuuugccuccaucccuucagauacuacgguggaaguaggugcaaauguccaauugccauguaguagccagggggagcccgaaccugccauuacauggaacaaggacggcgugcagguuaccgaguccggaaaauuccacauaucuccagagggcuuucucacuaucaaugauguggggcccgcugacgccggaagauaugaaugcgucgcaaggaacaccauugguagcgcgucagugaguaugguacuguccgugaacguuccggaugucagccgcaauggcgacccuuucguggcuacaucuaucguggaggccaucgcaaccgucgaccgagccauuaacucaacucggacacauuuauuugauagucguccaagaagccccaaugaccugcuagcucucuucagguacccucgcgaucccuauacgguugaacaagcccgggcaggggagauauuugagagaacccugcagcuuauccaggaacacgugcagcauggauugaugguggaccugaacggcacuuccuaccacuauaaugaucucguaucuccacaauaccugaacuuaauugcuaaucugucggguuguacagcccauaggcgagucaacaauugcagcgacauguguuuccaccagaaguaccgcacccacgaugggacaugcaacaaucuucagcauccuauguggggcgcguccuugacugccuuugagcggcuccugaaaucaguguaugaaaacggauucaauacccccagaggcaucaacccacacaggcuauacaaugggcaugcucugccgaugccucgucucguuaguacgacccugauuggaacagagacugugacccccgacgaacaguuuacacacaugcuuaugcaauggggucaguucuuggaucacgaccuggauucuacugucguggcauuaagccaggcccgcuuuuccgacggccagcauuguucaaacguuugcagcaacgauccacccuguuucucugugaugaucccuccaaaugacucccgggcuagaaguggggccaggugcauguucuuuguacgaagcucucccgucugcggauccggcaugaccucacuccugaugaacaguguguauccucgggagcaaauaaaucagcuuacgagcuacaucgacgcaucgaacguguaugguuccacagagcacgaagcgcgcucuauuagagaucuggccagccauaggggguugcuccggcagggcaucguccaacgaucaggaaagccgcugcuaccauucgcuaccggacccccuacugaguguaugagagacgaaaaugagaguccaauucccugcuuucuggccggggaucaccgcgcaaacgaacagcucggacugacauccaugcauacccuuugguucagggagcacaaucguaucgcuacugaguugcugaaauuaaacccucacugggacggcgauaccauauacuaugaaacacggaagauuguuggugccgagauccagcauauuacguaccagcacuggcucccgaagauccugggggaagugggaaugagaacccuuggcgaguaccaugguuaugaccccggcauaaaugcagggaucuuuaacgccuucgcuacugcggccuuuagguucggacacacacugguaaauccacuacucuaccgccuggaugaaaacuuucaaccuauugcacaggaccauuugccccugcacaaagccuucuuuucuccauuccgaaucgugaaugagggcgggauugauccuuuacucagaggacuguuuggcgucgccgguaagaugcgggugcccagccagcuucugaacaccgaguugacagaaaggcuguucuccauggcccacacuguugcucuggaccuagcagccaucaauauacagcgcgggcgugaucauggcauuccaccguaucacgacuacagaguguauuguaaccugucagcggcucauaccuucgaggaucuuaaaaacgaaaucaagaauccugagauccgggagaaacucaagaggcuguacggcagcacguugaacauugaccuguuucccgccuuagucguggaagaccucguuccagguagucgccugggccccacacuuaugugccuguugucuacccaauucaagcgacucagagauggggaccggcugugguaugagaauccuggaguguuuuccccagcacagcuaacucagaucaaacagaccagccuggccaggauucuuugugauaacgcugacaauauaacacgcguccaaucggauguauucagaguggcagaauuuccccacggcuacgggucaugcgacgagaucccuaggguugaucuccggguguggcaggacuguugcgaagauugucguacucgcggacaguucaacgccuuuucuuaccacuuccgaggcagaaggagucuggaguuuuccuaucaggaggacaagccgaccaaaaagacacggccacgcaaaauucccagcgucgguagacaaggggaacauuugucuaauagcacguccgcguucucaaccaggagugaugcuagcggaacuaacgacuuucgggaguucguguuagaaaugcagaagacaaucaccgaccugcgaacucagauuaagaaacucgagucuagacuguccacaaccgaaugcguagaugccggcggugagucacacgcaaauaacacgaaguggaaaaaggacgccuguacuaucugcgagugcaaagauggccaagugaccuguuucgucgaggcuugcccucccgccacaugugcaguuccagugaauauaccuggggcuugcugucccgugugccuucagaagcgcgccgaagaaaagccauga

SEQ ID NO: 61432 - RNA, 4392 nt, Artificial Sequence
  derived and/or modified sequence opt3 from PXDNL__Homo_sapiens__NP_653252
auggagcccagacuguucugcuggaccacacucuuucuucuggccggcugguguuugccuggguuaccaugcccgagccgaugucugugcuucaaguccacugugcgguguaugcaccuaaugcucgaccauaucccccaggucccucaacagacgaccguucuggaucuucgcuuuaacaggauucgugaaauaccaggaucugcuuucaaaaagcugaaaaauuugaacacacuccugcugaauaacaaucacaucagaaagauuucaaggaacgcauuugagggucucgaaaauuuacuguaccuuuauuuguacaaaaacgagauccaugcccuggacaagcagacuuucaagggccuaauuagucucgaacaccuguauauccauuuuaaucagcuugagaugcugcaacccgagaccuucggggauuugcuccggcuggaacgcuuauuucugcacaacaauaaacucagcaagauaccugcgggauccuucucuaaccuugacucgcugaaaagauugaggcuagauucaaaugcucuggugugcgacugugaucucauguggcugggcgagcuucugcaggguuuugcccagcacgggcauacacaggcagccgcuaccugcgaauacccacggcgcuugcacggacgagcaguagccagcgugacugucgaggaguucaacugucaaagucccagaaucacauuugaaccucaggacguggagguuccauccggcaauaccguguauuucacgugcagggcugaaggcaacccgaagcccgagauuaucuggauucauaacaaucacucucucgaucuggaagacgauacucgguuaaacgucuucgacgaugggacccugaugauccguaauacacgcgagagcgaccagggaguguaccaguguauggccagaaacuccgcgggugaggcaaaaacucaaucagccaugcuaagguauaguagccucccugcuaagccaucuuuuguaauacagccccaggacaccgaaguucugauuggcacauccaccacgcuugagugcauggccacugggcacccucauccauugaucacauggacccgggauaauggacuggaacucgacggcucacgacacguggcaacuagcaguggucuguaccuucaaaacauuacacagcgcgaucaugggagauuuaccugccacgcuaauaacucucauggaacgguccaggccgcggccaauaucaucgugcaggcacccccgcaauucaccgugacaccuaaggaccaggucguucuggaggaacacgcuguggagugguugugugaggccgauggcaacccuccaccuguaauuguguggacuaaaaccggcgggcagcuccccgucgaaggacagcacacagugcuguccagcgguacuuuaaggauagaccgggcugcccaacaugaucagggccaguacgagugccaggcaguuucgucucugggggugaagaaagucuccgugcaacuaaccguaaagccaaaagcccucgcuguuuucacacagcugccccaggacaccucaguggaagucggaaagaauaucaacauuaguugucacgcgcagggcgagccucaaccaaucauaacuuggaauaaagaaggugugcagauuacggagagcgggaaguuucaugucgaugacgagggcacacuuaccaucuaugaugcaggauucccggaccagggccgcuacgaaugcguggccagaaacuccuuuggguuggcuguuacuaauauguuccugaccgugacagccauccaaggaaggcaggcuggugacgauuuuguagagucuagcauucucgacgccguccagcguguggauucagcuaucaacaguacccggcgacaccuguucucccagaagccccacacuagcucugacuuacuggcccaauuucauuauccuagagauccacuuauuguugaaauggcaagggcgggcgagauauucgagcacacauugcagcucauccgcgaacgggugaaacaggggcugacggucgaccuagagggaaaggaauuuagauacaacgaucuggugucacccaggagucucagccugauugcuaaucuuuccggcuguaccgcccgccgaccuuugccaaacugcucuaaucgguguuuccaugcaaaauaucgugcccacgacgguacuugcaacaaucugcagcaacccacauggggcgcugccuuaaccgcauucgcuagacuccugcagccggccuacagggaugggauccgcgcgccucggggacuuggccugccaguagggucgagacagcccuugccucccccaaggcucguggccacaguuugggcucgagcagccgcugucacuccugaccauagcuauacccgcaugcugaugcacuggggaugguuucuagagcacgaucuggaccauacggugcccgcccucuccaccgcacgguucucagaugguagaccauguaguucugugugcacaaacgacccgccuuguuuucccaugaauacuaggcacgcggacccacguggcacccaugcccccugcaugcuguucgcucgcagcuccccugccugcgcaucagggcggccaagcgcuacagucgauucuguuuacgccagagaacagaucaaccaacagacugcauacauugacggauccaauguguauggcaguagcgagagggagucucaggcccuucgagaucccuccgugccucgggguuugcugaagaccggguuuccguggccacccucaggcaaaccuuuacucccauucaguacgggacccccuacagaaugugcucgccaagagcaggaaagcccgugcuuucuggcgggcgaccacagagccaacgagcaucuugcacuggcugccaugcacacccuaugguucagggaacacaaucggguagccacugagcucucggcucugaacccccauugggaggggaauacagucuaccaggaagcacgaaagauagugggagccgaguugcagcacaucaccuauucccauuggcugccaaagguuuuaggcgauccugguacuagaaugcuccgcggguacaggggauauaaccccaaugugaacgcgggcauuaucaacucuuuugcuaccgccgcauuccguuuuggucacacacugauuaauccaauccuuuaccggcugaacgccacguugggcgaaauaagcgaggggcaccucccuuuccauaaagcucuguuuucacccaguagaaucauuaaggaaggaggcaucgacccaguccuaagggggcuguucggaguggcagccaaauggcgcgcgccguccuaucuucucucuccugagcugacccaacgauuguucagcgcugccuacuccgcagccguugauucagcugccacuauuauccagagaggccgggaccacgguauacccccauacguggauuuuaggguauucuguaaucugacaagcgucaagaacuuugaggacuuacagaaugaaauuaaagauagugagauccgccagaagcuccguaagcuguaugggucucccggagacauugaucuuuggccugcacugaugguggaagacuugaucccaggcaccagagugggucccacacucaugugccuguucgucacucaauuucagcggcuaagggacggcgaucgcuucugguacgagaacccugggguuuuuaccccggcucagcugacgcagcuuaaacaagccucccucagccgagugcugugugacaauggagauucgauacagcagguacaggcggacguguucgucaaggccgaguauccacaagauuacuugaacugcucagaaauccccaaaguggacuuaagaguuuggcaggauuguugcgcagacugucggucuaggggccaguuucgcgcugugacacaagagagucagaagaaaagauccgcccaguauagcuacccugucgauaaggacauggaacugucucaucucaggagccggcagcaagauaagauuuaugugggggaggacgcucguaauguuaccgugcuggcaaaaacuaaguucucccaggacuuuucaaccuucgccgccgaaauccaggagacaauuacugcacuucgcgagcagaucaacaaacuggaagcgcgauugagacaagcaggaugcaccgaugucaggggcguaccccggaaggccgaggaacgcuggaugaaagaggacuguacacacugcauaugcgaaaguggucaggugacguguguuguggagauuugcccacccgcucccuguccaagcccugagcuagucaaggggaccugcuguccggugugcagagauaggggaaugcccucugacuccccagaaaaacgguga

SEQ ID NO: 61433 - RNA, 1638 nt, Artificial Sequence
  derived and/or modified sequence opt3 from PXK__Homo_sapiens__NP_001276025
auggccuucauggagaagcccccugcuggcaaagugcugcucgacgauaccgucccacuuacagcagccaucgaagcgagccagucccugcaaucucacacuauugcuggguugucauuaccgcugcccccuaagaaacuaauaggaaacauggacagagaguuuaucgccgaaaggcagaagggucuccagaauuaccugaacguuauuacgaccaaucauauccuuaguaacugcgagcuggugaaaaaguucuuggauccaaauaacuauagcgcaaauuacacagaaauugcccuccagcaaguauccauguuuuuccggucugagcccaagugggagguggucgaaccucugaaagacaucggcuggcgcauacgaaagaaauauuuucugaugaagaucaaaaaccagccaaaggagcgucucguguuaucgugggcugaucuggggcccgacaaguaccuuucagauaaagacuuccaguguuugauuaagcugcuaccuagcugccuccacccauauaucuacagaguuacuuuugcaaccgccaaugaaaguuccgcucugcuuauuaggauguucaacgagaaaggaacacugaaggauuugaucuauaaagccaagccgaaagaccccuuucucaagaaguacuguaauccuaaaaagauacagggccuggaguuacaacagauuaaaaccuacggucggcagauccuggaagugcucaaguuccuucaugauaaaggguuuccauauggacaucugcacgcgucuaacgucauguuggacggcgauacuugccgccuacuggaccucgagaauagccugcuuggccugcccuccuucuacagaucauauuuuagucaguucaggaagauuaacacauuggaaagcguggacguacacuguuucgggcaccuccuguacgagaugaccuauggacggccuccagauucuguucccguggacuccuuuccgccugcacccucaauggccgucguggcuguguuagaaagcacgcugaguugcgaggccuguaagaaugguaugccaacuaucucucgccuacuccaaaugccucuguucuccgauguccuuuugaccacaagcgagaaaccccaguuuaagaucccaacuaaacugaaggaagcacuccgaauugcuaaagagugcauagaaaagagacugaucgaggaacagaagcaaauucaucagcacaggcggcuuacccgugcccagucgcaucacggcucugaggaggaacgcaaaaagagaaaaauccuggcgaggaagaaauccaagcggucagccuuggagaacagugaggaacacagcgcaaaguacuccaacucuaauaacagcgcugggucaggagccaguagcccccucacauccccuucuucaccaaccccgcccaguacgagcggcauauccgcucugccuccacccccuccacccccgccuccacccgccgcaccuuuacccccagccucuacugaagcuccugcgcagcugucgagccaagcaguuaaugguaugucccgaggggcccuacucucaaguauucagaacuuccagaaaggaacacugcgcaaggcuaaaaccugugaccauucugcccccaagaucggcuga

SEQ ID NO: 61434 - RNA, 588 nt, Artificial Sequence
  derived and/or modified sequence opt3 from PXMP2__Homo_sapiens__NP_061133
auggcccccgcugcaagcagacugagggccgaggcgggccucggggcccuuccucggcgcgcucuggcacaguacuuguuauuccugcgacuauauccagugcucaccaaggccgcuacauccggaauccugucugcacuugguaacuuucuggcccaaaugauugagaaaaagcguaaaaaggaaaauucaagaaguuuggacgucggcgggccgcucagguacgcuguuuauggauucuuuuucacuggcccccugagccacuuuuucuacuuuuucauggaacauuggauaccuccagaggugccccuggccggucuccggcgcuuacugcuugauagauugguauuugcgccugcauuccugaugcuauuuuuccucaucaugaacuuucuggaagggaaagacgccuccgcuuucgccgcaaagaugaggggaggcuucuggccagcccuucggaugaauuggcgcguguggacgccccugcaguuuauuaacaucaauuaugucccuuugaaguuccgagugcucuuugcuaaccuggcggccuuauucugguacgcauaucuggcuucucucggcaaauga

SEQ ID NO: 61435 - RNA, 1776 nt, Artificial Sequence
  derived and/or modified sequence opt3 from PXN__Homo_sapiens__NP_001074324
auggacgaucuggacgcccuccuugcugaucuggagagcaccacaucccacaucucuaagagacccguguucuugucagaagagacuccuuacaguuauccaacgggcaaccauaccuaccaggaaauugcagucccgcccccuguuccacccccuccaagcuccgaggccuuaaaugggacaauacuggacccccuagaucaauggcagccuucuucgucaagguuuauccaccagcagccacaaagcaguuccccgguguauggaucuagcgcgaaaacuuccucaguaaguaacccccaggacagcguggguucuccuugcucccgggucggcgaagaggagcauguguacucauucccaaauaagcagaaaagcgcugaacccaguccuaccguuaugucuacaucccucgggagcaaccugucggagcuugaucgccuguugcucgaacugaaugccgugcagcacaacccacccggauuuccggcagacgaggccaauucuuccccuccccugccaggcgcucucucaccuuuauaugguguccccgagaccaacaguccacugggaggaaaggcaggcccccuuacuaaagaaaagccuaagcgaaauggcgggcguggauuggaggaugugagaccaagcguagaaucccugcuagacgagcucgaaucuagcguuccgucacccgugccugccauuacagucaaccaaggugagaugaguuccccacagagggugaccagcacgcagcagcaaacucggaucucugcuucaagugccacccgcgagcuggaugaacuuauggcgagccuguccgacuucaaaauucagggcuuggagcagagagcagauggggaaagguguugggccgcuggauggccccgggacggcggucgaucuucgccugggggacaagacgagggcggcuuuauggcccaggggaagacaggaagcuccucaccacccgguggcccgccuaaaccagggagucagcucgauucuaugcuggggagcuuacaguccgaccugaauaagcucggcguggcaacugucgcuaaagguguuugcggggccuguaagaagcccaucgcgggccaagugguaaccgccaugggaaaaacauggcauccugaacacuucgugugcacccacugucaggaggagauaggcucacgcaacuuuuucgaaagagaugggcagcccuacugcgagaaggacuaucauaaucuuuuuagcccaagguguuacuacugcaacggaccuauccuggauaaagucgugacggcauuggaccggacuuggcaccccgaacauuucuuuugugcucagugcggugccuucuuuggcccagagggguuccacgaaaaggauggaaaggcuuauugucguaaggacuacuucgauauguuugccccgaaaugcggcgguugcgcacgcgccauucuagagaauuauaucucugcucugaacacacucuggcacccugaguguuucguuugcagagaauguuuuacccccuucgugaacggguccuuuuucgagcaugacggccaaccauacugcgaaguccacuaucaugagaggcggggaagucuguguagcggcugccagaagcccauuacugggcgauguaucacagcgauggcaaagaaauuucacccugagcauuucgugugcgccuuuugucuuaagcagcugaauaaaggaaccuucaaggaacagaacgauaaaccauacugccaaaauugcuuuuugaaacucuucuguuga

SEQ ID NO: 61436 - RNA, 420 nt, Artificial Sequence
  derived and/or modified sequence opt3 from PXT1__Homo_sapiens__XP_011512702
augaagggcaaaaacaugaagaaaaagcacgacgggaucguguacgagaccaaagaaguccugaaucccagcccuaagguuacacauugcuguaagucccucuggcuuaaauauucuuuccagaaggccuacaugacucaacuggugucaagucagccaguaccggcuaugagcagaaaccccgaucacaauuuguuaucccagccuaaagagcauucuauugugcagaagcaccaucaagaagagauaauccacaaacuggcaaugcagcuaaggcacauuggagacaacaucgaucaucggaugguccgcgaagaccuccagcaggauggucgagacgcccuggaucacuuuguguucuuuuucuuucguagaguucaagugcuucugcauuucuuuuggaauaaccacuugcucuga

SEQ ID NO: 61437 - RNA, 588 nt, Artificial Sequence
  derived and/or modified sequence opt3 from PYCARD__Homo_sapiens__NP_037390
augggcagagccagggacgcuauccuggaugcacucgagaaccuuaccgccgaggaacugaagaaauucaaguugaaauuacugagcgugccccuacgggaaggguacggacgcauuccucgaggugcgcuccuguccauggacgcucuugaucugacagacaaguuggucucuuuuuaucucgagacuuacggcgccgaacugacggcaaauguucugcgugauauggggcuccaggagauggccggacaauuacaggcugcaacccaccagggcucaggugccgcuccagccgggauacaggcgccgccccaaagugcagccaaaccuggacugcauuucaucgaccagcacagagcugcccuuauugcaagggugacaaacguagagugguugcuggaugcucuauauggcaaggugcucacugacgaacaguaccaggccguccgggcggagccaaccaaucccagcaagaugcgcaaacuguuuuccuucaccccugccuggaacuggacaugcaaggaucuucuguugcaagcacucagagaaucucagucguaucugguggaggacuuagagaggucauga

SEQ ID NO: 61438 - RNA, 867 nt, Artificial Sequence
  derived and/or modified sequence opt3 from PYCR1__Homo_sapiens__NP_001269208
augagcgugggcuucaucggggccggacagcuggcuuuugcacucgccaaggguuucaccgcggcuggcguccuugccgcacacaaaauuauggccuccucucccgacauggaucuggcuacaguuucagcauugagaaagaugggggugaaauuaacuccucauaacaaggagacgguacaacacagugacgugcuguuucuagccgucaaaccacauauaaucccguucauucucgaugagaucggagcugacauugaggauaggcacaucgugguuagcugcgccgcgggcgugaccauauccucuaucgaaaagaagcugucggcauuucggcccgccccucgcgucauucgauguaugacaaauacuccagugguaguucgugagggugcuaccguguacgccacagggacccaugcacaggucgaagacggaagacuuauggagcagcuguugucaagcgugggcuucugcacugagguggaagaggaucucaucgacgcugucacaggccugaguggguccggacccgccuauggugcggccaaaaugcugcuccacucugaacagcacccuggccaauuaaaggauaacguuagcuccccagggggagcaaccauucaugcucugcacgugcuugagucaggcgguuuuaggaguuugcugaucaaugccguagaggcuagcuguauacggacgcgcgaacuacagucuauggccgaccaggaacaggugucccccgcagccauuaaaaagacuauccucgauaaagucaagcuggacagcccugcugggaccgcgcuuucaccaaguggacauacaaagcuguugccgagaucucucgcacccgccggcaaagauuga

SEQ ID NO: 61439 - RNA, 270 nt, Artificial Sequence
  derived and/or modified sequence opt3 from PYDC1__Homo_sapiens__NP_690865
augggcaccaagagagaggccauccugaaagugcucgaaaaccuuacacccgaggaacugaagaaauucaagaugaaauuggggacugucccuuuaagggagggauuugaacggauuccacgcggugcucugggccagcuagacauaguugaucucacggacaagcugguggcaagcuacuaugaggauuacgccgcggagcuuguaguggcuguccugcgagacaugcguauguuggaagaggccgcaagacuccaaagggccgcuuga

SEQ ID NO: 61440 - RNA, 294 nt, Artificial Sequence
  derived and/or modified sequence opt3 from PYDC2__Homo_sapiens__NP_001076777
auggccagcuccgcugagcuggacuucaaccuccaggcacuucuggaacaauugucucaggaugaguuaucaaaguuuaaaagucugaucagaaccauuagccuaggcaaggaacuccagacagugccccagacugaggucgacaaagccaaugggaagcaacugguugaaauauucacgucccacucuugcucguacugggcgggaauggcugccauccagguguuugagaaaaugaaccagacccaucuuucagguagggcagaugagcacuguguaaugccuccaccguga

SEQ ID NO: 61441 - RNA, 2532 nt, Artificial Sequence
  derived and/or modified sequence opt3 from PYGB__Homo_sapiens__NP_002853
auggccaagccccugaccgacagcgagaaaagaaagcagaucuccgugaggggccucgcugggcuuggagaugucgcagaaguucggaaaucuuucaaccgccaccuucauuuuacauuggugaaggaccgaaauguagccacuccucgugauuacuucuuugcguuagcucacacggugagagaccaucuggucgguagguggauucggacccaacagcacuauuacgagcgcgauccaaaaagaauauauuaccuaucacucgaguucuauaugggcaggacacugcagaacacuauggugaaucuugggcugcagaacgccugcgacgaggcaaucuaccaauugggacucgaucuggaagaacuggaggaaauugaggaagacgccggccucgguaaugggggauuaggccggcuggcugcauguuuucuugauaguauggccaccuugggccuggcugccuauggguacggaauccgcuacgaguucgguauuuuuaaccagaagaucguuaauggcuggcaaguggaggaagcggacgauuggcuacgauaugggaacccgugggagaaggcaagacccgaauacaugcucccuguccauuucuauggaaggguggagcacacaccagacggcguaaaauggcuggauacccagguugugcuugccaugcccuacgacacuccugucccagguuauaagaauaacacagugaauaccaugcggcuguggagcgcuaaagcccccaacgacuuuaaguugcaggauuucaaugugggggacuacauagaagcaguccucgaucguaaccuggcugagaauaucucccgcguuuuauauccuaacgacaacuuuuucgagggaaaagaacugagacucaagcaggaguacuuugugguagccgcgacgcuucaggauauuaucaggcgguucaagucuucgaaauucggcugccgagacccagugcgcacuuguuuugaaaccuucccggauaaggucgccauucagcugaaugacacacaccccgcauugucaaucccugagcuaaugagaauacugguggauguugaaaaaguggacugggauaaggcuugggagauuacuaaaaagaccugcgccuacacaaaccauaccguccucccagaggcucuggaaagguggcccgugagcauguuugagaaacuucugccucggcacuuggaaaucauuuaugccaucaaucaacgccaucucgaccacguagcagcccuguucccaggcgacguugauagauuaaggcguaugagugugaucgaggaaggggacuguaagcggauuaacauggcucaccugugcgucauaggaucccaugcggugaauggugucgcacgaauccacucugagauugugaagcagagcguuuuuaaagauuucuacgagcuagaacccgagaaguuucagaacaaaacgaauggcaucacuccgagaagguggcuccugcuuuguaacccuggguuggccgacacaauaguggaaaagauuggagaggaguuccugaccgaucucucccaacugaaaaagcugcugcccuugguaucagacgaagucuuuauccgcgauguggcuaagguuaaacaggagaauaagcucaaauucagugccuuucuggaaaaggaguauaaagugaagaucaacccaagcucuauguucgacguccaugugaagcggauucacgaauacaaaagacaguuacugaauugccuacauguagugacucucuauaacaggaucaagcgcgauccugcaaaagccuuuguuccccgaacagucaugauuggcgguaaggcugccccaggguaccacauggcaaaacugauaaucaaacuugugaccuccauuggcgacguggucaaucacgaucccguugugggagaccgguugaaggugaucuuccuggagaacuaucguguaucacucgcggagaaggucaucccugcugccgaucugagccagcaaauuaguacggcaggcaccgaagccucugggacaggaaauaugaaguucauguuaaacggugcucugacuauaggcaccauggacggggccaacguggagauggcagaagaggcuggagccgaaaaucuuuuuaucuucggcuugagaguugaggacguggaggcgcucgauaggaaagguuacaacgcccgcgaauacuaugaccaucugccagagcuaaagcaggcugucgaucagauuuccagcggguuuuucucgccgaaagaacccgacuguuuuaaggauaucgugaauaugcugaugcaccaugaccgguucaaaguuuuugcagauuacgaggccuauaugcagugccaagcucagguggaccagcucuacagaaacccuaaggaauggacaaagaaaguaauuaggaauaucgccuguucuggcaaguucuccucagaucgaacuauaaccgaguaugcacgcgagaucuggggagucgaaccaagugaccugcagauucccccuccaaacaucccccgggauuga

SEQ ID NO: 61442 - RNA, 2442 nt, Artificial Sequence
  derived and/or modified sequence opt3 from PYGL__Homo_sapiens__NP_001157412
auggccaagccccugaccgaccaggagaaaagaaggcaaaucagcauucggggcauagugggggucgaaaacguugcugagcucaagaaauccuucaaucgccaccuucauuuuacacuggugaaggaucgaaacguagcaacuacgcgugacuacuauuucgccuuggcgcacaccgugagagaucauuuagucggaagguggauccggacacagcagcacuacuaugacaaaugcccuaagcugggucuagauauugaggaacucgaagagaucgaggaagacgcuggccuggggaauggaggccuuggucgccuggccgcauguuuucuugauucuauggccacucucgggcuggcugcauacggauauggcauuagauacgaguauggcaucuucaaccagaagauaagggacggguggcaaguggaagaggccgaugacuggcugcgguacggaaauccaugggagaaaucacgcccggaauuuaugcuccccguucauuucuacgguaagguggagcacaccaacacaggcaccaaauggaucgauacucaggucguguuagcucugccuuaugacacaccaguacccggguacaugaauaacaccguuaauacgaugcgacuuuggagugccagagcgccuaacgauuuuaauuugagggacuucaacgugggagacuauauucaggcaguccuggaucggaaucuagccgaaaacaucagccgugugcucuacccaaaugacaacuuuuucgagggcaaggaacugcgccuuaaacaggaguauuuuguggucgcugccacucugcaagauauuaucagaagguucaaggcauccaaguuugguucuaccagaggggcuggaacaguuuucgacgccuuccccgaucagguggcgauacaguugaacgacacucacccugcccucgcaauuccagagcugaugcgaaucuuuguagauauugaaaaauuaccguggucgaaggcuugggagcugacccagaaaacauucgccuacaccaaucauacggugcuccccgaagcucuugagcgcuggccugucgaccugguggaaaaguugcuaccaagacaccuggagaucaucuaugagauuaaccaaaaacaucucgauaggauaguugcccuguuucccaaggacguggaucggcuucgcagaaugucacugaucgaagaggaaggcagcaaaaggauuaauauggcacacuugugcaucgucggcagucacgccgugaacgggguagcuaagauacauuccgacauuguuaagacuaaaguguucaaggacuuuucugagcucgaaccugauaaauuccagaauaagacaaacggaaucaccccacgucgguggcuguuacuguguaaucccggucuagcggagcucaucgcagagaaaauuggcgaagacuacgucaaggaucugagccagcuuacuaaguugcacuccuuucugggggacgauguguuccuccgagagcuggccaaagucaagcaagaaaacaaacuuaaguuuucacaguuccuggagacagaguacaaagugaagaucaauccgaguagcauguuugacguucaggugaagcggauucaugaauauaaaaggcaguugcucaacugccugcacguaauaaccauguacaaucgcaucaagaaagauccuaagaaauuauucgucccccggacggugauuaucggaggcaaggcugccccagguuaucauauggcaaagaugaucauuaaacugauaaccucuguugccgacguggucaacaaugauccuauggugggguccaagcuaaaaguaaucuuucucgagaacuacagagugucacuggcugaaaagguuauucccgccacagaccuuagcgagcaaaucaguacugcaggcaccgaagcgucuggaacaggcaauaugaaauucauguugaacggggcucugacuauuggaaccauggauggugccaacgucgagauggcagaggaagccggcgaggaaaaucucuucaucuuugggaugaggauagacgauguggcugcccuggacaagaaaggauaugaggcaaaggaauacuaugaggcuuuaccagagcugaaguuggugaucgaccagauugauaacggcuucuuuucccccaaacagccugacuuguucaaggauaucauuaauaugcucuuuuaccacgaccgcuucaaagucuuugccgauuacgaagcguauguuaagugucaggacaaagugagccaacuguacaugaacccaaaggccuggaauacaauggugcuaaagaacaucgcugcaucggguaaauucucuuccgaucgaaccauaaaggaguaugcccagaauauuuggaacguagaaccgucagaccugaaaaucagucucagcaaugaguccaacaaggucaaugggaacuga

SEQ ID NO: 61443 - RNA, 2265 nt, Artificial Sequence
  derived and/or modified sequence opt3 from PYGM__Homo_sapiens__NP_001158188
augagcagaccccuguccgaccaggagaagaggaaacaaaucucugugcggggccucgccggggucgaaaacguuaccgagcuuaagaaaaauuucaaccgccaucugcacuuuacauuggugaaggaucgaaauguagcuacuccucgugacuacuauuucgcauuagcccacacggugagagaucaucuggucggaagguggauucggacccagcagcacuacuaugaaaaagacccaaagaagauaucagguggcuggcagauggaggaagcggaugacuggcuacgcuacgggaacccgugggagaaagcuagacccgaguuuacacucccugugcauuucuauggacacguugaacacaccagucaaggcgccaaguggguggauacccaggucgugcuggcaaugccauacgacacacccguaccugguuauaggaauaacguugugaauaccaugcggcuuuggagcgccaaagcuccaaacgauuuuaaucugaaggacuucaacgucgggggauacauccaggcaguguuggaucgcaaucucgccgagaacauuucccgagugcuguaccccaaugacaacuuuuucgaaggcaaagagcugagacucaagcaggaguauuuugucguugcugccacuuuacaagauaucauuaggcgguucaagucuucgaaauuuggcugccgugacccugugcgcacaaauuucgacgcguuuccagauaagguagcaauccagcugaacgacacccauccgucacuugccauacccgaauugaugagaauccugguggaucuagagaggauggacugggauaaggcuugggacgucacggugcggacuugugccuacaccaaccacacaguucucccugaagcacuggagcgauggccagugcaucuucuggaaacuuugcucccccgccaucugcagauuaucuaugagauuaaucagagauucuuaaacagggucgcugccgcguucccuggggauguggaccggcugcgcagaaugagccucguagaggaaggagccguuaaaaggaucaauauggcacaccuuugcauagcugguagucacgccgugaacggcgucgcucguauucacuccgagauccugaaaaagaccauuuuuaaagauuucuacgaauuggagccacauaaguuucaaaauaagacaaacgggaucacuccccggcgauggcuagugcuguguaauccgggacucgccgaagucaucgcagagagaauuggcgaggacuucauaucugaucuggaccagcuuaggaaacuguugagcuuuguggacgaugaagccuucauccgcgacguugcuaaggugaaacaggagaacaagcucaaauuugcggcauaucuggaacgggaguacaagguacacauuaauccuaacuccuuauucgauauccaagucaagagaauacaugaauauaaaaggcagcugcuaaauugccuccacgugauuacgcuguacaaccgcaucaagcgagagcccaauaaauuuuucguuccacggacugugaugaucggugggaaggccgcuccuggauaccacauggccaaaaugauuauccgucuugucacagcaauuggcgacgugguaaaccaugaucccgccgugggcgacagauugaggguuauauuucuggagaauuaucgcgucucacucgcugaaaaggugaucccagccgcagaucugagugagcagauuagcaccgcggggacugaggcuucuggaacagguaacaugaaguucaugcuuaacggcgcccugaccaucgggacgauggacggagcaaauguggaaauggccgaggaagcuggcgaggaaaacuuuuucaucuucgguaugcgggucgaggauguugacaaauuggaucagagaggguacaaugcccaagaauauuacgacaggauucccgagcuccgacaggugauagagcagcuguccucaggcuuuuucagcccuaagcagccagauuuauuuaaagacaucgugaacaugcugaugcaccaugaccgcuucaagguauuugcagauuaugaagacuacauuaaaugucaagagaaggucagugcucuauauaagaauccgcgggaauggaccagaauggugaucaggaacauugccacaucuggaaaauucuccagcgaucguacuaucgcgcaguacgcccgcgagauauggggcguugaacccucgcggcagagacucccugcuccagacgaggcaaucuga

SEQ ID NO: 61444 - RNA, 1260 nt, Artificial Sequence
  derived and/or modified sequence opt3 from PYGO1__Homo_sapiens__NP_056432
augcccgccgagaacagcccugcuccagcauacaagguguccucucacggcggggacucaggacuggauggucucggcgggccgggaguccagcuuggcagucccgacaaaaagaaaagaaaggccaauacccaagguccuagcuucccaccccuguccgaauaugcgccuccacccaacccuaauucugaucauuugguugcugccaacccauuugacgauaauuacaacacaaucucguauaaaccguuacccucaagcaauccuuaccuggggccaggauaucccggcuucggcggguacaguacuuuuaggaugccuccacacgugcccccgcggauguccucuccuuauugcggacccuacagccuacgcaaccagccacauccuuucccccagaauccacucgguaugggcuuuaaccgaccccacgcauucaauuuugggccucaugacaacuccucauucggaaauccaaguuacaacaaugcccugagccagaacguaaacaugccgaaucaacacuuucgucagaaccccgcugagaauuucucucagauuccuccacagaacgcaucccaagugucaaaucccgaucuugccagcaacuuugucccuggcaauaacaguaauuucacgucuccacuggaauccaaccacagcuuuauacccccgccuaauaccuucggucaggcuaaggccccacccccuaagcaggacuucacacagggggcgacuaaaaacaccaaucaaaacucgucugcacaucccccacacuugaauauggaugacacagugaaccaguccaacaucgagcucaagaauguuaacagaaauaacgccgugaaucaggaaaacucaaggaguagcuccaccgaggcuacuaauaacaauccugccaacggaacacaaaauaaaccccggcagccacgcggcgcagcugaugccuguaccacggagaagucuaacaaaagcucacugcauccgaauagacacggccacaguuccagcgacccugucuaucccugcgggauuuguacuaacgaagugaaugaugaccaggacgcgauccugugcgaggccucuugucagaagugguuucauaggauuugcaccggaaugacagaaacugcauacggucucuuaaccgcugaggccucagcuguauggggcugugauacaugcauggccgacaaggauguucaacugaugcggacccgcgagacguucgggccaagugcagugggaagcgacgccuga

SEQ ID NO: 61445 - RNA, 1221 nt, Artificial Sequence
  derived and/or modified sequence opt3 from PYGO2__Homo_sapiens__NP_612157
auggccgcuagcgcacccccuccaccggacaagcuggagggcgggggaggucccgccccuccacccgcgccuccauccaccggcagaaaacaggggaaggcuggacuccaaaugaaaucucccgaaaagaaaaggcggaagucaaacacacagggcccugccuacagucaccuuacugaguucgcaccaccgcccacgccuaugguggaucaucuggucgccagcaauccauuugaagacgauuucggugcucccaagguugggguggcagccccuccauuuuugggaucccccguaccguucggcggcuuucgcgugcaagggggaauggcuggucaggucccucccggcuauucuaccgggggaggcggugggccacagccuuuacgacgucagcccccacccuucccuccaaacccgaugggacccgccuuuaauaugccuccacagggccccggcuacccuccacccgggaacaugaauuucccgucgcagccuuuuaaccaaccacugggacagaauuucucacccccuagcggucagaugaugcccggcccaguugggggauuuggcccuaugaucagucccacaaugggucagccaccgagagcggagcuagggccucccucccucucucaaagguucgcacagccaggcgcccccuuuggaccuagcccacugcagcggcccggccaagggcuuccuucccugccgccaaacacuucacccuucccuggaccagaccccgguuucccuggcccagggggagaagauggcgguaaacccuugaauccgccugcuaguaccgccuuuccccaggagccacacagcgggucuccugcagcugccgugaacggcaaucagcccuccuucccaccgaacucaagcggacgcggcgggggaacaccugacgcgaauagucucgcacccccagguaaggccggcgggggaucuggcccccagccuccacccggucugguguauccuugcggggcuuguagauccgaggucaacgaugaccaagaugccauucugugcgaagcuagcugucagaaaugguuucauagggagugcaccggcaugacugaaucggccuacggacucuuaacaaccgaggcaucugccgugugggcuugugaccugugccuuaagacgaaagagauacaguccguauauauccgggaaggcauggggcaguugguugcggcaaaugauggauga

SEQ ID NO: 61446 - RNA, 1479 nt, Artificial Sequence
  derived and/or modified sequence opt3 from PYHIN1__Homo_sapiens__NP_689714
auggccaacaauuacaagaaaaucgugcugcucaagggccuugaggucauuaacgacuaucacuucagaauaguuaaaagccuguuguccaaugauuuaaagcugaaccccaaaaugaaggaagaguacgacaagauccagauugcugaucuaauggaagagaaauuuccuggggacgcaggacucgguaagcugaucgaguucuuuaaagaaauuccaacccuuggcgaucuggccgagacauugaagagggaaaaacucaagguggcgaauaagaucgagucuauaccgguaaaagggaucauucccucaaagaaaacuaagcaaaaagaaguguauccugcuacgccagccugcacccccaguaaccggcugacagcaaagggagccgaggagacucugggcccucagaaacgcaagaagccaagcgaagaggaaaccgguacaaaacgauccaagaugucuaaagagcagacccgucccucguguucagcuggggcaagcaccaguacagccaugggaagauccccuccaccgcagaccucuagcuccgcucccccuaauacgucaaguacugaaagccucaagccauuagccaacaggcaugcgaccgcaucuaaaaauaucuuccgggaggaccccauuaucgccaugguccugaacgcuacaaagguguuuaaguacgaguccucagaaaaugagcaacgcagaauguuccacgccacuguugcaacccagacacaguuuuuccaugugaaaguccuuaacauaaauuugaagaggaaauuuauuaagaaacggaucauuaucaucagcaacuauaguaagcgcaauucucugcuagaagugaacgaggcuuccagcguaucggaagccggcccugaucagaccuucgagguuccaaaggacauuauaagacgagcgaaaaagauccccaaaauuaacauccuccacaagcaaacgucuggcuacauaguguaugggcuguuuaugcuucauacuaaaauugucaauaggaagacaaccaucuacgagauccaggauaagacuggauccauggccgugguggguaaaggcgaaugccacaacauuccgugugagaagggggacaaacugcgguuguucugcuuucgucuccgcaagagagaaaauaugucaaaacugaugagugagaugcacagcuucauccagauucagaagaacacaaaucaaaggucccaugauucucggagcauggcauuaccucaggaacagucacaacaccccaaaccaagugaggcuuccaccacgcugccugagagccaucucaagacuccccagaugccacccacaacuccuucuucaaguagcuucaccaagaaagacgaaacacacccaggagcccaguccucuccggcuaacuuucgaauaacuucgcccaccgucgccccuccacuuagcuccgauacaucaaccaaucgccaccccgcaguuccuuga

SEQ ID NO: 61447 - RNA, 1503 nt, Artificial Sequence
  derived and/or modified sequence opt3 from PYROXD1__Homo_sapiens__NP_079130
auggaggccgcuagacccccuccaaccgcaggcaaguucguggucguugggggagguaucgccggcgugacaugcgcggaacagcuggcuacucacuuuccgagcgaggacauucuccuuguaacggccucccccgugauaaaagcagucaccaacuucaagcaaaucucuaaaauucuggaagaguuugauguggaagaacagucaaguacaauguuggggaagagguucccuaauaucaaaguuauugagagcggagugaagcaguuaaaguccgaggagcauuguaucgucacugaagacggcaaccagcacguguacaaaaagcugugccuaugugccggugcuaaaccaaagcucauaugcgaggggaaucccuauguacugggaauccgggauaccgacucugcacaagaguuucagaaacagcuuacaaaggccaagcgcauuaugaucauuggcaacggcgggaucgcucuggaauugguuuacgagauagaaggaugugaggugauuugggccaucaaagauaaggcgauugguaauaccuucuuugacgcaggcgccgcugaguuccucacuucgaaacugaucgccgaaaagucagaggcaaaaaucgcucauaagcgaacacguuauaccacggaagggaggaaaaaggaggccagaagcaagaguaaagcggauaacgucggauccgcccugggcccugacuggcacgaaggucucaauuuaaaggggacuaaagaguuuucucauaagauucaccuggaaaccaugugcgaggugaaaaagauauaccuucaggaugaguuccggaucuugaagaaaaagagcuuuacauucccacgcgaccacaaauccgugacugcagauaccgaaauguggcccgucuauguugagcugacaaacgaaaagauuuacggaugugacuuuaucgugucagcuaccggcguaacgccuaauguggagccauuccuacauggcaacaguuucgaucucggggaagacggaggucugaaagucgacgaucacaugcauacuagccuuccggacauauaugccgcuggcgauauuugcacaaccucuuggcaacugucccccguguggcagcagaugagauuguggacucaggccaggcaaauggggugguacgcagccaaguguauggcugcggcaucaagcggagacaguaucgauauggacuuuucuuucgagcucuuugcccacguuacaaaguucuuuaauuacaaagugguccuguuaggcaaguauaacgcucagggucugggguccgaucacgagcucaugcuucggugcaccaaaggccgcgaauacaucaaggugguaaugcagaauggacgaaugaugggcgccguucugauuggggagacggacuuggaagagaccuucgagaaccuaauccugaaucaaaugaaccucagcucguauggagaagaucugcuugacccuaacauugauauagaggacuacuuugacuga

SEQ ID NO: 61448 - RNA, 294 nt, Artificial Sequence
  derived and/or modified sequence opt3 from PYY__Homo_sapiens__NP_004151
augguguucgucagaaggcccuggccugcccugaccacaguucuccuugcucuguuggugugcuuaggcgcacugguagacgccuacccaaucaagccggaggcgcccggggaagaugcuagcccugaggaacuaaaccgguauuacgccucccuccgccacuaucugaaucuugugacucgacagcguuacggaaaaagagacgguccagauacgcuguugucuaagaccuuuuuccccgacggcgaggauaggccuguccggucacgcagugaagggccagaccucugguga

SEQ ID NO: 61449 - RNA, 4449 nt, Artificial Sequence
  derived and/or modified sequence opt3 from PZP__Homo_sapiens__NP_002855
augagaaaggacaggcugcuccaccuuugccugguguuguuacugauccuacucagcgccuccgauucuaacucaaccgagccccaguacaugguccugguuccuagucuucugcauacagaagcuccaaagaagggcuguguguugcucagccaccugaaugagacuguaacgguguccgcaucucuggaaucggggcgggagaaccgcucacucuucaccgacuuagucgccgaaaaagaucuguuucauugcgugagcuucacacuuccgcgaauuagugcguccucugagguugccuuuuugagcauacaaaucaagggacccacucaggacuuccguaaaagaaauaccgugcugguccuaaacacacagucccucguguuuguacagaccgauaagccuauguauaagccaggucaaacuguuagguuccggguggucucaguggacgagaauuuucgccccagaaacgaacugauuccucuuaucuaccuggagaauccaaggcggaaccgcauugcucaguggcagaguuugaaacucgaagcaggcaucaaucagcugagcuuccccuuaucuuccgagccuauacaagggucauaucgaguggucguucagacagagagcggaggcagaauccagcacccauuuaccguggaagaguucguacugccgaaguuugaagugaaaguccaggugcccaagauuaucaguauuauggaugagaaaguuaacaucacgguguguggugaauacacuuaugggaagccugucccaggacucgccaccgugucucuuugcaggaagcugucccggguauugaauugugacaaacaagagguuugcgaggaguucagccagcagcuaaacucgaauggcuguauaacacaacaggugcauacuaagaugcugcagauuaccaacacaggcuuugaaaugaaacuccgugucgaagcucgcaucagagaggaagggaccgaucuggaggugacggcaaauaggauuucugagaucacuaacaucgucuccaaacuuaaauucgugaagguugacucacacuuccggcaggggauucccuuuuucgcccaagugcuguugguagaugguaaaggcgucccuauaccaaacaagcucuuuuucaucagugugaaugacgcuaacuacuauagcaaugccacaaccaacgaacaggggcuggcgcaguuuuccauuaauacuacaucuaucagcguuaacaaguuauucgugcgagucuuuaccgugcaccccaaucugugcuuccauuacucauggguagcagaggaucaccagggagcccaacauacggcuaaccgcguguuuagucuauccggcagcuacauacaccucgaaccgguugccgguacccugccuugugggcacacagagacuauuaccgcacauuauacacuuaauagacaggcuaugggagaauugucugagcugucauuccacuaccucaucauggccaaaggcgucaucgugaggaguggcacucauacccugcccguggagagcggggacaugaagggauccuuugcgcuuucuuucccagucgaaucggacguugccccuauugcacggauguuuaucuucgcuauucugcccgauggugagguggugggcgacagcgaaaaauucgagauagagaacugcuuggccaauaagguagaucucuccuuuucaccagcucagagucccccugccucucacgcacaucugcaggucgccgcugcgccacagagcuuaugugcacugcgcgccguggaccaauccguucuacucaugaaaccggaagcugagcugucagugagcucugucuauaaccuuuugacagugaaggaucugaccaauuuccccgacaacguugaucagcaggaagaggaacaagggcacugcccuagaccauuuuucauccacaauggagccauuuacgugccccucuccaguaacgaggcagacaucuauagcuuucugaagggcauggguuuaaaaguauucacuaacucuaagaucaggaaaccuaaguccugcucagucauuccaagugugagcgccggggcugugggccagggauacuauggcgccgggcugggagucguugagcgucccuacgugccgcagcuugguacguacaauguaauaccuuugaacaaugaacaaucguccggcccagugcccgagacaguccggucuuauuuuccugaaaccuggaucugggagcucguggcaguuaacagcucagggguggcggaagucggagugacuguucccgauaccauuacagaguggaaagcuggcgccuucugucugagugaggacgcaggucuagggaucuccucuaccgccagccugcgagcuuuucagccauucuuuguggaacucacuaugccuuacuccgucauuagaggcgagguauucacacugaaggccacggugcuuaauuauuugcccaagugcaucaggguuucagugcagcugaaagcaagcccagccuuuuuagcuagucagaacaccaagggagaagagucuuacuguauaugcggcaaugaacgccaaacucucuccuggacagucaccccgaaaacacuggggaacgugaauuucagcguaucggcggaggccaugcagucacuugagcuguguggaaacgaaguggucgagguuccugaaaucaagcggaaagauacugugauuaagaccuugcucguggaggcugaggguaucgaacaggagaagacguucucuaguaugaccugcgcauccggcgccaaugucagcgaacagcugucucuaaaacugcccagcaacgugguuaaggaguccgcuagagccucauuuaguguacucggggacauucugggaagcgcaaugcaaaauauccagaaccuuuugcagaugccauauggcuguggugaacagaauauggugcuguucgcgcccaacauauacgucuuaaacuaucucaaugagacacaacagcugacucaggagauuaaagccaaggcugugggguaccuuaucaccggcuaccaaaggcagcugaacuauaaacaucaggacggaucuuacuccacauuuggcgaacgcuaugggcgaaaucagggaaacacuuggcuaaccgccuucguucucaagacguuugcacaagcucggucauacauuuucaucgaugaggcccacauaacacagagucugaccugguugagccagaugcagaaagacaauggcugcuuucguuccucugguucgcuguuaaacaaugcaaucaagggaggaguggaagaugaggccacucucagcgcuuaugucacaauugcgcugcuugaaaucccucugccagugaccaaccccauuguaagaaaugccuuguucugucucgagucagcauggaacgucgcuaaggagggcacucaugguucccacguguacaccaaagcccugcuagccuaugcuuuuagucugcuuggcaagcaaaaucagaacagggaaauccucaauucucuggacaaagaggcaguuaaggaagauaacuuggugcacugggagcgcccucagcggccgaaagccccagucgggcaucuguaccagacacaagcgcccagcgcugaaguggagaugacguccuacguuuuacucgccuaucugaccgcacagccugccccaacuucaggagaccuuacaucugcuaccaauauagugaaguggauuaugaagcagcagaacgcacaaggcggguucagcaguacacaggauacugucguggcccugcacgcguuguccagauacggagcugccaccuuuacgaggacagagaaaaccgcacagguaacugugcaagacagccagaccuucucuacaaacuuccagguugauaauaacaaucuccugcuacugcagcaaaucucacuucccgaacucccuggcgaguaugucaucacugugaccggugaacgaugcguguaccugcagacauccaugaaguauaacauuuugccggagaaagaggacagucccuuugccuuaaagguccagacgguaccacagaccugugaugggcauaaagcucacacuagcuuccaaaucucgcugacaauuucuuacaccggaaaucgcccugccuccaacauggugauaguugacgugaagauggucagcggcuuuaucccccucaagccaacugugaaaaugcuggaacggucaaguucuguuuccagaacagaggugagcaauaaccauguccuuauuuauguggaacagguaaccaaucagacgcugucauucaguuuuaugguguugcaggauaucccuguuggugaccuaaagcccgcaauugucaaaguguacgacuacuaugagacugaugaaagcguggucgcugaguacaucgccccaugcuccaccgacacagagcacggcaacguuuga

SEQ ID NO: 61450 - RNA, 2295 nt, Artificial Sequence
  derived and/or modified sequence opt3 from QARS__Homo_sapiens__NP_001259002
auggccgcucuggacagccucucccuuuucaccucucugggcuugucagagcagaaggcaagagaaacacugaaaaacagugcccugagcgcgcaacuaagggaggcugccacucaggcacagcagacgcucggguccaccaucgauaaggccacaggaauuuuacuuuacggucuggcuucucgguugcgcgacacucgacgucucucguuucuggugucauauauagcaaccgcccuggaauacgucagaagccacccccucgauccuaucgacacaguugauuucgagagggaaugcggcguggggguaauugugaccccagagcaaaucgaggaagcugucgaggccgcgauuaaucggcaucgcccgcaguuacugguggaaagauaucacuuuaacaugggacuuuugaugggcgaggcaagggccguucugaaaugggcugacgguaagaugaucaaaaaugagguggauaugcagguccuacaucuccuggggcccaaacuugaagccgaccuggagaagaaauucaagguggcaaaagcucgguuggaagagacugaucgccgaacagccaaggacguaguugaaaacggagagaccgcggaucagacgcucagucugauggagcaauuaagaggcgaagcccugaaauuucacaagccuggcgagaauuacaagacuccaggguauguggucacaccccauaccaugaaccuccuuaaacagcaccuggaaauaacuggaggucaggugaggacccgguucccuccagagcccaauggcaucuugcacauugggcaugcaaaggcuaucaacuuuaauuucggauacgccaaagcuaacaauggcauuuguuuucuacguuucgacgauacaaacccugaaaaggaggaggccaaauuuuucaccgcaaucugcgacaugguggccuggcuggguuauacgccauacaaggucacuuacgcuuccgacuauuuugaucagcucuacgcgugggcaguugaacugauacgcagagggcuugccuaugugugucaccaaaggggagaggaacugaaaggccauaauacauugccgucucccuggcgggaccgaccuauggaggaaagccuccuguuauucgaggcuaugcgcaagggcaaguucuccgagggggaagccacccugagaaugaagcuaguaauggaggauggaaagauggacccaguggcauacagggucaaauauacuccccaccaccggacaggugauaaguggugcauuuacccuaccuaugacuacacgcauugucucugcgauucaaucgaacacauuacccauagucuguguacaaaagaguuucaggcccgcagaagcucuuacuucuggcuuugcaacgcuuuggacguguauuguccaguucagugggaguacggcaggcugaaucuccacuaugccguggucuccaagcguaagauccugcaacuuguggcaacuggggcgguacgggauugggacgauccccgacuguuuaccuugacagcucucagaaggcgcggauucccgccugaagccaucaacaacuuuugcgcacggguuggcgugacugucgcccagaccacaauggagccccaucuguuagaggcuugugugagagacguccugaaugacaccgccccaagggcaauggcugugcuagaaucacuccgcguuauuauaacuaacuucccugccgcgaaaagccuggauauccaggugcccaauuuuccagccgacgaaacgaaggguuuccaccagguacccuuugcuccuauugucuucaucgagcgaacagauuuuaaagaggaaccagagccgggguucaagcggcuugcauggggccaacccgugggauugcgucacaccggcuacguuauagaacugcagcauguggucaaagggccuaguggaugcguggagucucucgaaguaacuugcagaagggccgacgcuggugagaagccaaaggccuuuauucacugggugucccagccccugaugugugagguucgcuuauaugaacggcuguuccagcauaaaaacccugaggauccaaccgaaguccccggcggguuccuuagcgacuugaaucucgcaucgcugcacgugguggaugcggcccuagucgacugcucuguugcucuggccaagccguuugauaaauuccaauuugagagacucggauacuucuccguggacccugauucacaccagggcaagcugguguuuaacaggacaguaacccuuaaagaagacccagguaaggucuga

SEQ ID NO: 61451 - RNA, 735 nt, Artificial Sequence
  derived and/or modified sequence opt3 from QDPR__Homo_sapiens__NP_000311
auggccgcugcagccgcggcuggcgaggccagaagggugcuggucuacgggggacggggugcacucggcagccgcugcguucaggccuuccgagcucguaacugguggguggcauccguagacguggucgaaaaugaggaagccucugcuucaaucauugugaagaugacagauaguuuuacagagcaagccgaccagguuacugcggaaguggggaaacuucugggagaggagaaggucgaugcaauauuguguguggccggcgguugggcugggggaaacgccaaaagcaaguccuuauucaaaaauugcgaccugauguggaagcagucuaucuggacgucgaccauuucaagccaccuagcaacaaagcaucucaaagaaggcggccugcuuacucuggcuggggccaaggcggccuuggauggaacccccgguaugaucggcuaugggauggcaaaaggagcuguacaccagcucugucaaagucuggccggcaagaacuccgguaugccuccaggggcugccgcaauugccguucugccggugacacucgacacccccaugaauagaaaaucuaugccugaggcugauuuuagcuccuggacuccauuagaguuccuggucgaaacauuucaugacuggaucaccggaaagaacaggcccucaaguggcagccuuauacagguggugacgacugagggccggaccgaauugaccccugcguacuucuga

SEQ ID NO: 61452 - RNA, 1002 nt, Artificial Sequence
  derived and/or modified sequence opt3 from QKI__Homo_sapiens__NP_001288014
auggugggcgagauggaaaccaaggagaaacccaagccuacaccagacuaccugaugcagcucaugaacgauaaaaagcugaugagcucccuuccgaauuucugcgggaucuuuaaccacuuggaaagauuacuggacgaggaaauuucuaggguccggaaagauauguauaaugacacucuaaacggaucaacggagaagcgcagugccgagcuccccgaugcuguugguccuauagugcaacugcaggaaaaacuuuacguaccagugaaggaguaucccgacuucaauuuugucggccgaauccuggggccucguggauugaccgcaaagcagcucgaagccgagacaggcuguaaaauuauggugagagguaaggggagcaugagggauaaaaagaaggaggaacagaaccggggaaaaccaaauugggagcaucugaacgaagaccugcacguucucaucacuguggaggaugcgcaaaaucgcgcugaaauuaaguuaaaaagagccgucgaggaggugaagaaacugcuuguacccgcagccgaaggcgaggacuccuugaagaaaaugcagcugauggaacuagcuauccucaacggcaccuacagggaugcaaauauaaagucuccuacagcccaggcugccccacggaucauuaccgggccggcgcccguucugccuccagcagcccuucgcacucccaccccugcuggaccaacaaucaugccccugauucgacagauccaaacggccgugaugccgaacgguacuccucaucccaccgcagcuauagucccaccuggccccgaggccggguugauuuauacaccauacgaauaucccuacacucucgcgccugccaccucgauccuggaguacccaauugagccgucaggaguguuaggcgcaguggcuacaaaggucagaaggcacgacaugcggguucaucccuaucagcguaucgugaccgccgaucgcgcugccacggguaauuga

SEQ ID NO: 61453 - RNA, 1086 nt, Artificial Sequence
  derived and/or modified sequence opt3 from QPCT__Homo_sapiens__NP_036545
auggccggcgggagacacaggcggguggucggaacccugcaucuccuucuguugguugcugcauuacccugggccagccgcgguguguccccuucugcgucagcuuggccagaggaaaagaacuaccaccagccggccauccugaauaguagcgcacuacgacaaauugccgagggcacauccauaucugaaauguggcagaacgaccuccagccccugcuuaucgagcguuauccugggucgccaggaucauacgcugcaagacagcauauuaugcaaaggauccagcggcugcaggccgauuggguauuggaaauugacacuuuccucagccagacgcccuauggcuaccgcaguuuuuccaauaucauaucuacccugaacccuacagcuaaaagacaccuggugcucgccugccauuaugauagcaaguacuucucccacuggaauaacagggucuuugugggugcgacugacucagcaguuccaugugccaugauguuagagcuggcucgggcccuugauaaaaaguugcugagucuaaaaaccgugagcgacucuaagcccgaucucucccugcaacuuaucuucuuugacggggaggaagcauuccugcacuggucaccucaggauagcuuguauggaagucgccaucucgcugccaagauggcgucuacaccacacccgcccggcgcccgaggcaccucccagcugcaugggauggacuuacugguccuccuugaucugauuggagcaccuaauccaacuuuucccaacuucuuuccuaauagcgcuagaugguucgagagguugcaggccaucgaacacgagcuacacgagcugggucuccugaaagaccauucgcuugaaggccgguacuuucaaaacuacucuuaugggggagugauucaggaugaccacaucccauuccugcgucgcggcguacccguuuugcaucucauaccguccccuuuucccgagguguggcacacaauggacgauaaugaagagaaccuggacgaaucaaccauugauaauuuaaacaagauccugcaggucuucgugcuagaguaccuccaucuguga

SEQ ID NO: 61454 - RNA, 867 nt, Artificial Sequence
  derived and/or modified sequence opt3 from QPCTL__Homo_sapiens__NP_001156849
augagaagcggcgggaggggacggccccgccugcgacucggugagcguggccuuauggaaccucuguugccaccgaagagaagguuacugccccgggugcgccuacucccucugcuucuggccuuggcugucggguccgcauucuacaccaucuggucuggauggcacagaaggacagaggaacucccacugggccgggagcugcgcguuccccucauugguucauuaccugaagcccgacugagaagggugguagggcagcuugacccacaacgguuguggaguacuuaucugcguccccuacucgugguccgcacgccuggaagcccaggcaaccuucaggugagaaaagcggcuccgguuacccugcagcuguuguuucucgauggcgaggaggcccugaaggaaugggggcccaaagacuccuuauacggaucuaggcaucuggcacagcucauggagucgauaccucacucaccaggucccacacggauccaagccauugaacuuuucaugcuguuggaucuacugggcgcuccuaauccaacuuuuuauagccauuucccccgaaccgugcgcugguuucacagacucaggaguaucgagaagcggcugcaucgccuuaaccuguugcagucccacccgcaggaggucauguacuuccagccuggggaacccuuuggaucuguggaggacgaucacauuccauuccucagaaggggcguaccuguucugcauuuaaucagcacacccuuuccagcaguguggcacacccccgccgacacugaagucaaucugcauccuccaacagugcacaaccuaugccguauacucgcuguguuccuggccgaguaucuugguuuguga

SEQ ID NO: 61455 - RNA, 894 nt, Artificial Sequence
  derived and/or modified sequence opt3 from QPRT__Homo_sapiens__NP_055113
auggacgccgagggccuggcucuccuucugcccccugugaccuuggcagccuuagucgauagcuggcugagagaagacugcccagggcuaaacuacgcggcucucguuuccggagccgguccgucucaggcagcccugugggcuaagucacccggcgugcuugcagggcaaccuuucuuugaugccaucuucacacagcugaauugucagguaaguugguuuuugccagagggaagcaaacucgugcccgucgcuaggguggccgaaguucggggcccugcgcacugccugcugcucggugagcgcguggcauuaaacacucuggcccgauguuccgggauugcuucugccgcagcugccgcggucgaagccgcacguggagcuggcuggacgggccauguggccgggaccagaaagacaacuccaggauucaggcuuguagagaaauaugguuugcugguuggcggggcugccucgcaccgguacgaccuaggaggccucgugauggucaaggauaaucaugugguggcagccgguggggucgagaaagcuguucgcgcggcaagacaggccgcugacuuugcccugaagguggaaguagagugcucaagccuucaagaagcagugcaggccgcugaggccggagcagaucuggucuugcucgacaacuucaagcccgaggaacugcacccuaccgcgacaguguuaaaagcucaguuuccaaguguugccguggaggcauccggcggcauaacccuggauaaucucccgcaguucugugggccccauaucgacgucauuucuaugggaaugcuuacucaagccgcuccugcccuggauuuuagcuugaagcuauucgcaaaagaaguggcuccaguacccaagauccacuga

SEQ ID NO: 61456 - RNA, 411 nt, Artificial Sequence
  derived and/or modified sequence opt3 from QRFP__Homo_sapiens__NP_937823
auggugagacccuacccucugaucuauuuccucuuucuuccacugggcgccugcuucccguuguuagacaggcgggagcccaccgaugcuaugggagggcugggugcaggcgaacgcugggccgaccuagcgauggggccucgaccacacagcgucuggggauccucucguuggcucagagcuucacagccccaagcccugcuuguuauugcaaggggccugcagacaaguggucgggagcaugccgggugucgcuuuagauucggaaggcaggaugaaggcagcgaggcuacuggcuuuuugccugcagccggggaaaagacguccggaccacucgguaaccuggcugaggagcugaauggcuacucucggaagaaagggggauucucguuucgcuucggccgaagauga

SEQ ID NO: 61457 - RNA, 1296 nt, Artificial Sequence
  derived and/or modified sequence opt3 from QRFPR__Homo_sapiens__NP_937822
augcaggcccugaacaucacccccgagcaauucagcagacuccuuagggaccacaaucugacacgggaacaguuuauugcuuuguaccgcuuacgaccucugguguauacuccagagcuaccgggccgugcaaagcucgcccugguccuuacggggguucugauauucgcguuggcucucuuuggaaacgcccugguguucuacguagugaccagauccaaagcaaugaggacagucacuaauaucuuuauuugcucucuggcccucucagauuuacugaucaccuucuuuuguauucccgugacaaugcuucagaacaucagugacaauugguuggguggcgcuuucauaugcaagaugguuccuuuugugcagagcaccgcagucgugacugaaauccugacaaugaccuguauugccguagagcggcaucaagggcuaguucacccauucaaaaugaaguggcaguauacgaaccgcagagcuuuuacuaugcucggaguggucuggcugguggccgugaucgucggcucccccauguggcauguucagcagcuugaaauuaaauacgauuuccuguaugagaaggagcacaucugcuguuuggaagaguggaccucuccugugcaucaaaagauauacacaacuuuuauucucguaauccuguucuuacugccacucauggugaugcuuauucuguauucgaaaaucgguuacgaauuguggaucaagaaaagggucggggacggaucagugcuacggaccauucacggcaaggagaugagcaaaauagcgcgcaagaagaaacgagcaguuaucaugauggugacagucguggcccuguucgcuguaugcugggcccccuuucacguugugcauaugaugauugaguacaguaauuucgaaaaggaguaugaugacgucaccaucaaaaugauauuugcaauugugcagaucaucggcuucuccaacucuauuuguaauccuaucgucuacgcuuuuaugaacgaaaauuucaagaaaaacgugcucagcgccguuugcuauuguauugugaauaagacguuuuccccagcgcagagacacgggaacucaggaauaacuaugaugaggaaaaaggccaaguucagucugcgggagaauccgguagaagagacaaaaggugaggcauuuagcgauggcaacaucgaagucaaacuuugcgagcagaccgaagagaagaagaaacugaagcgucauuuggcucucuuccgcucugaacuggccgagaacucccccuuagacucagggcacuga

SEQ ID NO: 61458 - RNA, 1587 nt, Artificial Sequence
  derived and/or modified sequence opt3 from QRSL1__Homo_sapiens__NP_060762
augcugggcagaagccucagggagguguccgccgcucuuaagcaggggcaaaucacccccacagaacugugccagaaauguuugucuuuaauuaagaaaacuaaguuccugaacgcauacauaacggucucagaggaaguugcccuaaaacaggcggaggaaagugagaagcgguauaagaauggacagagccucggugaccuggauggcaucccuauugcugugaaagacaacuuuuccaccucugggaucgagacaacuugcgccucgaauaugcuuaagggauacauuccaccguauaacgcaaccguagugcaaaaacuguuggaucagggcgcccuccugauggguaagacaaaucuggacgaguucgcuauggggucaggaagcaccgauggcgucuuuggccccgugaaaaacccuuggaguuacuccaagcaguaucgcgaaaagcgaaaacagaauccacacucugaaaacgaggacagcgauuggcucaucacugggggauccucagguggcagugcagccgcuguuagcgccuucacauguuacgcggcauuagggucugacaccggaggcuccacgcguaaucccgccgcucauugcggucuggugggguuuaagccuucauauggacuugucagcagacacggcuugauaccacuggugaacaguauggauguacccggcauccuaacuagguguguugacgaugccgcaauugugcucggggcucuggccggaccugacccacgggauucuaccacaguccaugagccgaucaauaaacccuucaugcuuccuucccuggcggacgugagcaaguugugcauugguaucccaaaagaauaccucgugcccgagcugucgucugaaguccaauccuuauggucaaaggccgcagaccuguuugagagugaaggcgcuaaaguuauagaggugagccucccucacacuuccuacucuauuguauguuaucaugugcuuugcaccagcgaggucgccucaaacauggcucgcuucgaugggcugcaguacggacacagaugugacaucgaugugaguacagaagccauguaugcagccaccaggcgggagggcuuuaaugacguugugcgcggucgaauuuuguccgggaacuucuuucuacugaaggaaaauuacgagaacuauuucgucaaggcucagaaagugagaaggcucaucgcgaacgauuuuguaaaugcauucaacagcggcguugacgugcugcuuacgccaacuacacugucugaagccguccccuacuuggaguucaucaaggaggauaaucggacccguucagcucaggacgauauuuuuacucaagccgugaacauggcaggacucccggccgucaguauaccuguggcucugagcaaucagggcuuacccaucgggcugcaguucauuggacgcgccuuuugcgaccaacagcuacucacaguugcaaaaugguucgaaaaacaggugcaguuuccaguaauccaacugcaggagcuuauggaugacuguuccgcggucuuggaaaacgagaagcuggcuucugugucgcucaagcaguga

SEQ ID NO: 61459 - RNA, 1815 nt, Artificial Sequence
  derived and/or modified sequence opt3 from QSOX1__Homo_sapiens__NP_001004128
augagaaggugcaacagcggcuccgggcccccuccaucucugcuccuucuguuguuauggcugcuagccgugccgggagcuaaugcagcgccccggucagcccucuauaguccuagcgacccacugacccuucugcaggcugauacaguccgcggugccguuuugggcucccgaucugcaugggccguggaguucuuugcuucguggugugggcacugcaucgcauucgcccccacuuggaaggcucucgccgaagacguaaaagcguggcguccugcacuguaucuggccgcucucgauugugccgaggaaacgaacucagcagugugcagagacuuuaauauuccaggauuccccaccgucagguuuuucaaggcuuuuacuaaaaacggcagcggugccguguucccuguugcgggggccgaugugcaaacauuacgggagcgccugauagacgcacuugaaagucaucacgauaccuggccaccggcuugucccccuuuggagccagccaagcuggaggaaaucgacggauuuuucgcuagaaauaacgaggaauaccuagcccucauuuuugagaaaggcggcuccuaucuggggagggaggucgcacuugaucugucucagcauaagggaguggccguacggcgcguuuugaauacagaagcuaacgugguccgaaaguucggugugaccgacuuucccagcugcuaccuccuguucagaaauggcuccgugucaagggucccuguuuuaauggagagucggagcuucuauacugcguaccugcagcgucucucugggcuuacacgcgaagcagcccagaccacgguggcuccaacuaccgccaacaaaaucgcacccacaguauggaagcuggccgauagauccaaaauuuauauggcugacuuggagucagcccuacacuacauccugaggauagaagugggacgguuuccgguccucgagggccaacgacugguggcacuuaagaaauucguugcggugcuggcuaaguacuuuccuggucgccccuugguccagaauuuccuccauagcgugaacgaguggcugaagagacagaaaaggaauaagaucccauauaguuucuuuaaaacugccuuagaugaccggaaggaaggggcaguacuggccaaaaagguuaacuggauuggaugucagggcucugagccucacuuucgcggcuuccccugcucccuaugggugcucuuucacuuccugaccguccaagcugccagacagaauguggaccauagccaggaagcagcuaaagccaaggagguccuuccagcgaucaggggguacgugcacuacuuuuucggaugucgugauugcgccucgcauuuugaacagauggcugcagccucuaugcaccggguugguucccccaacgcugccguguuguggcuguggucaagucacaaccgaguaaaugcaagacucgcgggcgccccuagcgaggacccacaauucccgaagguccaguggcccccuagggagcuguguuccgcuugccauaacgaacgccuugaugugccaguuugggacguggaggccacacugaauuucuugaaagcacacuuuucucccagcaacauuauccucgauuucccugcugccgggucagcagcccggagagacguccagaauguggcugcggccccagaacuggcaaugggagcuuuagagcuggaaaguaggaacuccacccuagaucccggcaagccggagaugaugaaaagcccuacgaauacuacaccacauguacccgccgaggguccugaacucauauga

SEQ ID NO: 61460 - RNA, 2097 nt, Artificial Sequence
  derived and/or modified sequence opt3 from QSOX2__Homo_sapiens__NP_859052
auggccgcugcaggcgccgcgguggcuagaagccccgggaucggagccgguccugcacugagggcccggcgcuccccaccgccccgagcugcacgucucccuagacuucuggucuuguuagccgcugccgcgguuggcccaggggcaggaggcgccgcuaggcuguaccgggccggugaggacgcaguguggguacuagauucugggucagugcgcggagcuaccgccaacaguagcgcggccuggcucguccaguucuauuccucuuggugcggccacuguauuggcuacgcacccacauggagagcucuggccggggacgugagggauugggcuucggccauacggguugcagcccuugacugcauggaagagaagaaucaagcugugugucaugauuaugacauccacuuuuacccuacuuuccgcuauuuuaaagcguucacgaaggaauuuaccacaggagagaacuucaaagguccagaucgagaacugagaacugucaggcagaccaugauugacuuuuugcagaaucauacagagggcucacggcccccugcaugcccacgucucgauccgauccagcccagcgacgugcugagucugcucgauaaccgcgggucccacuacguagccauuguuuucgagucuaauagcuccuauuuaggaagagaagugauccuggaccuuauaccuuacgagucaaucgucgugaccagggcuuuggauggcgacaaggccuuucuggaaaaacuaggugugaguagcgucccaucuuguuaccucauuuaucccaacgggucccauggacugaucaauguugugaagccucuucgggcauucuuuucaagcuaccugaagaguuugccagacguacgcaaaaagucucucccccugccggagaaaccucacaaggaggaaaacuccgagauuguggucuggcgagaguucgauaaaagcaaguuauauacuguggaccuggaaucgggccuccacuaccuucugagaguugaauuggccgcucauaagucucuagccggcgcagagcugaaaacacucaaggauuuugugaccguccuggcgaaacuuuuccccgggaggccaccugugaagaaacuguuggagaugcuccaagaauggcuggcuuccuuaccccuggaccggaucccauauaaugccguacuagaucucguuaacaauaagaugcgcauaucaggaauuuuccugacgaaccacaucaaauggguggguugccagggcaguagaagcgagcuuaggggguaccccuguuccuuguggaagcuguuucauacucucaccgucgaagcaucuacacacccugacgcccuggugggaacuggcuucgaggaugacccacaggcuguccuucagaccaugcgucgguaugugcacacauuuuucgguugcaaggaauguggggagcauuuugaggaaauggccaaagagagcauggauucaguuaagaccccggaccaagcaauucugugguuguggaaaaagcacaauauggugaacggccgacucgcuggacaucugagugaagaucccagauucccuaaauuacaguggccaacgcccgaccugugcccugccugucacgaggaaaucaagggccuagcguccugggacgaggggcauguacucacuuuucugaagcagcacuacggaagggauaaucuuuuggacacauacagcgccgaucagggugacucuucagagggcgggacccuggcucgcggagaagaggaagagaaacggcucacuccacccgaggucagucacggcgauagagacacacaaagcgugaggccgccuggugcacuggggccacgccccgccuuaccugaaucccugcaucacucucuugauggcaaguugcagucgcucgacggacccggcgcucauaaagagguugggggagccgcaccauuccuggguguggauuuuagcucccuagacaugucacugugcgucgugcucuauguagcgaguucucuguuccuuauggugauguacuuuuucuuucgaguucggagccguagauggaaggucaaacaccaccauccugccguguga

SEQ ID NO: 61461 - RNA, 1212 nt, Artificial Sequence
  derived and/or modified sequence opt3 from QTRT1__Homo_sapiens__NP_112486
auggccggcgcugcaacccaggccagccuggaguccgcgcccagaaucaugaggcucguggcugaaugcucucggucacgcgcccgagcaggggagcuuuggcugccucacggaacagucgccacuccaguuuucaugccgguggguacgcaagcuaccaugaagggcauuacaacugaacaguuggacgcauuagggugucguauaugccugggaaacaccuaccaucuaggccucagacccgguccugagcugauccagaaagccaaugggcuucacggauuuaugaacuggccacauaaucuguugacagauaguggcggcuuccagaugguaagccucgugucccugucugaagucaccgaggagggggugagguuucggucgcccuaugacggaaacgaaacucugcucucaccugaaaagagcguucaaauucagaaugcuuuagguagugauaucauuaugcagcuggacgauguggucuccucuacagugaccggcccacgcguagaggaggccauguacagaagcaucagguggcuugaccgguguauagcggcacaccagcgccccgauaaacaaaacuuguucgccaucauucaagggggacuggacgcugaucuacgagccacgugccucgaggaaaugacuaagagagacguuccuggcuuugcaaucggugggcuguccggaggcgagucaaaaagucaguucuggaggaugguggcucuuagcaccucucggcugccaaaggauaagccgcguuauuugaugggcgucggguacgccacagaccucguggugugugucgcgcugggaugcgauauguuugacuguguuuuccccacucgcaccgccagauuugguuccgcauuagugccuacaggcaaucugcagcucaggaaaaagguauucgaaaaagacuuugggccaauugaucccgagugcaccuguccuacgugccagaagcauucacgggcuuuccuucacgcccuguugcacagcgacaacacugcugcccuacaucaccugacagugcauaauaucgcauaucagcuccagcugaugagugccguccgaaccucuauaguggaaaaacgcuuuccagauuucguuagagacuucaugggagcuauguacggcgaucccacucuuuguccgacaugggcgaccgacgcacuggccuccguggguauuacguugggguga

SEQ ID NO: 61462 - RNA, 1323 nt, Artificial Sequence
  derived and/or modified sequence opt3 from R3HCC1__Homo_sapiens__NP_001129580
auggcccugcucugccuugacggcguguuccugagcuccgcugagaacgauuuuguccacagaauccaggaagaguuggacagguucuuacugcaaaagcagcuaucuaaaguucuccuguuucccccucuuucaagucggcugcgcuacuugauucaucgaaccgcagaaaauuucgaucuccugagcuccuuuucugugggggagggauggaagcguagaacaguaauaugucaccaggacaucagggugccaucgucagauggucugagcggcccgugccgggcccccgcgaguuguccuucccgcuaucaugggccaagacccauuucuaaccagggagcugccgcagucccuaggggcgcccgggcuggucgcugguaccgagggagaaaaccagaccaaccccucuaugugccuaggguuuuacggcgucaggaagaguggggacugacuagcacguccgugcuuaagcgcgaggcaccagccggcagagauccggaagaacccggcgacgucggggcuggagauccuaauucagaccaggguuugccagugcugaugacccagggcacagaagaucuaaaagggcccggacaaaggugcgagaacgagccucuccuggacccaguaggccccgaaccgcuugguccugagagucagagcgggaagggagauaugguugaaauggccacucgguucggcucuacccugcaguuggaccucgagaagggcaaagaaucccuguuagagaagcgacugguggcggaggaagaggaagacgaggaagaggucgaggaagaugggcccucaagcuguagugaggacgauuacucugaacuccuucaggagaucacagacaaucugaccaaaaaggaaauucaaaucgagaaaauacacuuggauacuuccagcuuuguggaggaacuaccaggagagaaggaccuggcacauguggucgaaaucuaugauuucgagccugcccucaagacagaggaccugcuugcuaccuuuucggaguuccaggagaaagguuuucgcauucaguggguugaugacacgcacgcccugggcaucuuccccugcuuggcaucugcugccgaagcgcucacuagagaguuuuccgugcugaagauuaggccauuaacccaagggacaaaacagucaaagcugaaagcccuacagcggcccaagcuccugcgccuuguaaaagaaagaccucagacuaacgcaaccguggcuaggcguuuggucgcccgggcucugggacuccaacacaagaagaaagagcgaccagccgugagaggcccgcugcccccuuga

SEQ ID NO: 61463 - RNA, 2379 nt, Artificial Sequence
  derived and/or modified sequence opt3 from R3HCC1L__Homo_sapiens__NP_001243548
augcagcaagagagcgaaagaugcagggugcgggcccgccgacccgacauggcucuguacgucccuaaggcacguagaggcgccguucuccuuaaaaccggggaugaggaagaguccuguggaucuccaaacucagugguaaaggaaaaacagaaggagaguagccugucccagaaagagguguucaaggacaagccggaagcgaggcgguugaauaucaaccccgaucgcaaagagcacaauugcagagaagagaagaaaucuucgacaaaguuaaggauggacacuugucugcagaaaacgaaccgggucugcucaaagcgcgguaccacagagagcaaggaagugcuaagucaaggccagcagcagggggcuccuaaugccggaguuauuacuaacgcaccacuccaacgacauuuuaaacccaagaaaguggagugucuggaagucgagaccacagaugugaccggccacgaaagaauacuucugucccaggccugcuuggagaucucugaggcucagguaccuagcaagccauuccagaauguugaauuuugugacuucuccaggcaugagcccgauggugaagcauuugaggacaaagaucucgaagggcggauugagacugacacaaaggugcuggagauccuguaugaauuuccucgugucuuuucaagugugaugaaaccagagaacaugauugugccgaucaagcucagcucugauuccgaaauaguccaacagucaaugcagaccagcgacggaaucuuaaaucccaguucuggcggcauuacgacuaccuccguuccugggagcccagauggaguguucgaccaaacaugcguagacuuugagguggaaucggucgguggcaucgccaacucuacuggguucauucuggaucagaaggacaccgauuccauccccgcuacaaugggacacauaucacuuagugagagcaccaaugacacgguguccccuguuaugauucgcgagugugagaaaaacgauucuacugccgacgaguugcaugugaagcacgaaccacccgauacagcgguccuggcacacgagacccauagagacagcggcuuuaaaaaugugggugauaucacuaacaaggccugcaugauggacacaaccgggaugucauguagugaucacguaacgguugacuccccguacguggucgcugugaggauugccgacgagaccagcaucaauacacggucuuucucaaaauuugucggaaugagugcagaugcuacuccucuacauguggcccgaagcggcaacgacaccgaagauuucuccaaccccucugcgugcucggacaucuauggcgagagcauuuccucacacuucacagaaaguacugggaagcucauagagucucugagcgauugcgccuccucacuuccaaucaagaaaauugcaggaagcaauuacaacaccuuucuggacucugaauuguccaugcucaaugguacaaagguucugagugauagcgcugugggcaucgacuuagggucuaccggagauacuacggaggcccugcacgagcuccgcacagcugaagaguucaaaaccgaagaacaggacgauuccggcucaauagaauuugguguaaguuucccugacagagagagcucguccauggagacuucuauugaacccaaggccaccgagacaagccauaccgaagggaucacugcaaucgaggaaucaugggagaguauguuuaacgaugacggcgacugucuugauccaaggcuguugcaggagggcauucuaaugcacaucaaacccgaaaaucauugcuccaagcugucuggaaacacaaagagccgggaguccauucaagaaccucgcucagacuauuacaaucacgaggucccagauauagaccucagcgauugugaguucccgcaugugaucgaaauuuaugacuuuccccaggaguucagaacggaagaucugcuuaggguuuucugcaguuaccagaaaaagggguucgacaucaaauggguggaugacacccacgcccugggagucuuuucuuccccuaucacugcucgugaugcguuggguauuaagcacacaauggugaaaauacggccacucagccaggcaacccgagccgcuaaggccaaggcaagagccuacgcugaguuccugcaacccgccaaagaaaggccugagacaucggcagcguuagcucgccggcugguaaucucagcccuaggcgugagaucuaagcagaguaaaacugagagggaagcagagcucaagaaacugcaggaagcccgcgagcgaaagcggcuugaagcuaaacagcgugaggacauuugggaggggagagaucaauccaccguuuga

SEQ ID NO: 61464 - RNA, 2916 nt, Artificial Sequence
  derived and/or modified sequence opt3 from R3HDM1__Homo_sapiens__NP_001269728
augagaaugagcgacaccgugacagucaaggaugagacugccacgaugaaagaccuggaagcugagguuaaggauaccacaaggguggaaaaccucaucaaauccgagaauuacggcaagauucuuguagagaaaaacgaacacugcauagagaauaacaucgaccugcaggaaaagauucaaauccaguugacucagucuuucgagaaggaagagaaacccucaaaggaugaggcagaaaaagagaaggccagugacaaauuaccucggaagaugcugagccgcgauuccucucaggaauauaccgacucgacagggauugaucuacaugaguuucucgugaauacccugaagaacaauccacgagaccguaugaugcuucugaaauuggaacaagagauccucgauuucauaggaaacaaugagucaccgagaaagaaauuucccccuaugacuagcuaccacaggaugcugcugcaucgggucgcggcuuauuucggucucgaccacaacguggaucagaguggcaaguccguuaucgugaauaaaacaucuaacacccgcauuccagaccagaaguuuaaugaacauaucaaagacgauaagggggaggacuuccagaagagauacauuuuaaaaagggauaacagcuccuuugacaaggaugacaaucaaaugcggauccgccugaaagaugaccgaagaucaaagaguauagaagagagggaagaggaguaucagcgggcccgugaucgcauuuucagccaggacucucuuuguucccaggaaaacuacaucauugauaaaagauugcaagacgaggacgcaucaagcacgcagcagaggcggcaaaucuuucgagucaacaaggaugccaguggacgcucuacuaauucccaccagagcucgaccgaaaacgagcugaaguauucugaacccagaccuugguccucaacagacagugauagcucccuaaggaaucucaaaccagcugugacuaaggcaucuagcuucucaggcaucaguguacugacccggggugacuccagcgggucuucaaaaaguauuggacgccuuagcaagacaggccagcccuuuauaaacccugauggcuccccaguuguguacaauccgcccaugacccagcaaccugucagaucucaggugccagggcccccucagccaccccugccggccccuccccagcaaccagcugccaaccacaucuucucgcagcaggacaauuugggaagccaguuuucccauaugucacucgcgaggcaaccuagugcagaugguucugacccccacgccgcuauguuccagagcacggugguccugcaguccccacagcaaucaggcuacauuaugacugccgcacccccuccacauccgcccccuccacccccuccacccccgccuccacccccuuuacccccagggcagccuguucccacagcuggauauccagccagcggccacccggugucucagccuguacugcaacagcaggguuacauccagcaacccuccccacagaugcccgcgugcuauugugccccugggcacuaccauaguagccagccacaguaucgucccgugccuucuguccacuacaacucccaucucaaucaaccgcuuccacagcccgcacagcagaccggauaucaagugauaccuaaccagcagcaaaauuaccagggcauuguuggcgugcagcagccacaaucacagagucuggucagcgggcagcccaacucgaucggaaaucagauccaaggugugguaauuccuuacacuuccguuccgacauaucaggugucuuugccccagggcagccaggggaucccacaccaaaccuaccagcagccugucauguuccccaaccagucaaaucaaggaaguaugccaacgaccggcaugccuguguauuacuccgucauucccccaggucagcagaacaaccuaucuagcuccgugggguaucugcaacauccgggcucagagcagguucaguuuccucggacaacuagccccugcaguucucagcaacuccagggacaccaguguaccgcuggcccacccccuccacccgggggagguauggugaugaugcagcuguccguaccuaauaacccgcaaagcugcgcccacucgccaccccaguggaaacagaauaaguacuauugugaucaucagcgaggccaaaagugcgucgaguucucaucuguggacaacauaguucagcacaguccucagcuuuccagccccaucauuucuccagcucaaagcccugcccccgcacagcuguccacauugaaaacugugagaccaucagggccuccgcucaguaucaugccccaguuuagcaggccauucgucccuggacagggcgauucucgcuacccccuguuaggucaaccacugcaguacaauccucccgccgugcuacaugggcacaucccgaaccagcagggccaaccaggaucccggcacggcaauagagggaggcgccaggcuaagaaagcggcaucaaccgaccucggagccggugaaacaguagugggcaagguucuggagauuaccgaacuuccugaugggauaacucgaauggaggcugagaaauuguuuggagaacuguucaagaucggcgccaagauucgguggcuccgugacccccagagucagccaagaaggcauccccuguguugcgguagcggggacaacacggcaaauccugagcgcuccaaaccgucugaucuugccucgacauauaccguccuggcuacuuuucccagcaucucagccgcacaaaacgcguugaagaaacagauuaauuccgugaacaaguucaaacuccggaccaguaagaaacacuacgacuuucauauccuggaaagagcuucuagccaguga

SEQ ID NO: 61465 - RNA, 762 nt, Artificial Sequence
  derived and/or modified sequence opt3 from R3HDML__Homo_sapiens__NP_848586
augccccugcucccuagcaccgugggccuugccgggcuguuguucugggcuggacaggcagucaacgccuuaaucaugccaaaugcgacaccggcucccgcccaaccugaguccacugcaaugagacugcuaucuggucucgaaguuccaagguaccggcgcaagcgacacauuucagugcgugacaugaacgcccugcuugauuaucauaaucacauaagagcuaguguauaucccccugcagccaacauggaguacauggugugggacaaaaggcuggcucgggccgcggaagcaugggccacgcagugcaucugggcucauggcccaagccaguugaugcgcuacgucgggcagaaucucuccauucacucuggacaauauagaucggugguugaucugaugaagucauggagcgaggaaaaauggcauuaccuguuucccgccccuagggacuguaacccacacugcccguggcggugugauggcccuaccugcagucacuauacacagauggugugggcauccucuaaucgccucgguugugcuauccauacuugcagcuccauuucagucugggggaacaccuggcaccgagccgcguacuuaguguguaauuacgccaucaagggaaacuggauaggcgagagucccuauaaaaugggcaagccaugcagcucuugucccccuuccuaccaggggucaugcaauagcaacauguguuucaagggacugaaaaguaauaaguuuacaugguucuga

SEQ ID NO: 61466 - RNA, 468 nt, Artificial Sequence
  derived and/or modified sequence opt3 from RAB11A__Homo_sapiens__NP_001193765
augggcaccagagacgaugaguacgacuaucuguucaaggugguccucaucggggauagcggaguugguaaauccaaccuucugucuagguuuacacggaaugaguucaacuuggaaucaaagaguacuauuggcguggaauuugccacgcgcagcauacagguagacgggaaaaccaucaaggcucaaauuugggauacagcaggacaggagcgauaccgugccaucacuuccgcguauuacagaggcgcugugggugccuuacuggucuaugacauugcaaaacaccuaaccuacgaaaauguggagagguggcucaaggagcugcgggaucaugccgacucuaacaucguuauaaugcuuguggggaauaagucggaucugcgccacuugagagcuguccccacagacgaagcaagggccuucgcugagaaaaacgaagccaaugugcggcagacccgcaaguga

SEQ ID NO: 61467 - RNA, 657 nt, Artificial Sequence
  derived and/or modified sequence opt3 from RAB11B__Homo_sapiens__NP_004209
augggcaccagagacgaugaguacgacuaucuguucaaggugguccucaucggggauagcggaguugguaaauccaaccuucugucuagguuuacacggaaugaguucaacuuggaaucaaagaguacuauuggcguggaauuugccacgcgcagcauacagguagacgggaaaaccaucaaggcucaaauuugggauacagcaggacaggagcgauaccgugccaucacuuccgcguauuacagaggcgcugugggugccuuacuggucuaugacauugcaaaacaccuaaccuacgaaaauguggagagguggcucaaggagcugcgggaucaugccgacucuaacaucguuauaaugcuuguggggaauaagucggaucugcgccacuugagagcuguccccacagacgaagcaagggccuucgcugagaaaaacaaucucucauuuaucgaaaccagcgcccuggauaguacuaacguggaggaggcguucaagaauauucugacagaaaucuaucggauuguaucccagaaacagaucgcagaccgcgccgcucaugaugagucuccuggaaacaauguuguggacauaagcgucccaccgaccacggacggccaaaagcccaacaaacuccagugcugucagaauuuauga

SEQ ID NO: 61468 - RNA, 3852 nt, Artificial Sequence
  derived and/or modified sequence opt3 from RAB11FIP1__Homo_sapiens__NP_001002814
augagccugaugguguccgccggcagagggcucggagcugucuggucucccacccacguucaggugacaguacuucaagcaaggggucugcgggccaagggcccugggggaacuucagacgcguacgcugugauccaggucggcaaagagaaguaugccacgagugugagcgaacgcuccuugggugcaccaguuuggcgagaggaagccaccuucgaguuaccgucucugcuaucgucagggcccgcugcagccgcuacacuccagcugacugugcuucaucgugcccuguugggacucgauaaauuucugggcagagcggaagucgaccugagggaucuccaccgggaccagggccgcagaaagacccaaugguacaaauuaaagagcaagccugggaaaaaggauaaagagaggggagagauugaaguggacauacaguucaugcggaacaauaugacagcaaguauguuugaucuguccaugaaggacaaaucucgcaacccauucgguaaacuuaaggauaaaaucaagggcaaaaauaaggacagcggguccgauaccgccucagcuauuauccccaguacuacaccuagcguagacucugaugacgaguccguugugaaagacaagaaaaagaagucaaaaauuaagaccuugcugagcaaaaguaaccuacagaagacgccacucucucaguccaugagcguccugcccacuucgaaaccugaaaaggugcuucugcgaccaggagauuuucaaucucagugggacgaggaugacaaugaggaugaauccucaagugccagcgacgugaugucccauaagagaaccgcaucuacagauuugaaacagcucaaccaggucaauuucacucugccgaagaaagagggccugagcuuuuuaggugggcucaggucaaagaacgacguucuuagucgguccaaugugugcaucaacggaaaucacguauaucuggaacaacccgaggcuaaaggcgaaauaaaggauagcucuccuucaaguagcccaucccccaagggcuuccguaaaaagcauuuguuuucuucgaccgagaaccuagccgcggggagcuggaaagagccugccgaaggagguggccuguccucagaccgccagcucagugagucuagcacaaaggauucccugaaaucaaugacccuuccaagcuacagacccgcaccgcuggugucuggggacuugagggaaaauauggcuccugccaacuccgaggcuacgaaggaagccaaggagaguaaaaagcccgagagccggcgaucuucccuccugucauuaaugacuggaaagaaggacgucgcaaaaggcagugaaggugagaauccacugacagugccugggcgcgaaaaggagggcaugcuaaugggaguuaaacccggcgaagaugccagcgggccagcugaggaccucgugagaaggucggagaaggauaccgcggcagucgugucccggcagggaucuagccugaaccuuuucgaagacguacaaaucacugagcccgaagccgagccugagucaaagagugaaccacgcccgcccauuuccucuccuagagcuccacagacaagggccguuaaaccccguuuggaggugagcccugaagcacagccaaccgcccggcugcccuccccgacggauucaccuagcagucucccaccccugccuucuuccagcggucaggcuucgguccccucagagcuuggccacggggccgacacccaaucuagugaauccccaagcguguuuucuagccuguccucaccuaucgcagcgcccauuaguacaagcacuccaaucgagucuuggccguuggucgaucgaggacaggcuaaguccgagggcccuccccuccugccaaaagccgaauuacagaccgagucacugacacccgugccuaacagugguagcuccgcacuagggucucucuucaagcagccaucguuucccgccaauaaaggcacugaagacagccugaugggaagaaccagggagacaggcaccgaaaagaacacuucaucccuugaguuggaggaaagucugccugagcaaccggaaacggggcgccaggaggaggaacucccacgguuccccuguaagaaacaggauuauucuccuagcuccggagaggcucaggaaguuccauucgcccugucauuaucuagcgacggugcagugagucccguaggcgagcuggcugccgggggagauagagaccuugaaucccaagcgggcagcuuggucgagucuaaggccagggaugcugcagaggaaguggccccuccgcuccccaugggugcuucaguuccauccauagacaguaugaugcgcaaacuggaggaaauggggcuaaaucugcgaaaggaccagaaaaagacaaagaaacgggugagcuuuucggagcaacucuucaccgaagaggccgucgcaggcgcggcccugcuuguggagggacacucuuccugcccucaggaauugaaccccgcuuggagcguagccggcaaugcaucagauggggagccaccugaaaguccccaugcugaggacucugaacgugaguccgugacuaccccaggaccggccacauguggcgcuccugccagccccgcugaucaccuguuacucccaucacaagaggaaaguuuuagcgagguucccauguccgaagcgucuagcgccaaggacaccccucuguucagaauggagggugaagaugcacuugucacucaguaccaguccaaagcaucagaccaugaggggcuguugucugauccacucagugaccugcagcuagugucggauuuuaagagccccauuauggccgaccugaaccucucccugccuucuaucccggagguggccucagaugacgaaaggauugaucaggucgaggacgacggagaucagguugaagacgauggcgagacagcuaaaagcuccacgcuugacaucggugcauugagucugggcuuaguggugccaugccccgagcgcgggaagggaccuucuggcgaagccgaucggcucguacugggggagggacuuugugacuucagacugcaggcgccccaagcuagcgucaccgccccaucagaacagacuacagaguuuggcauccacaagccucaccuagguaaauccaguagccucgauaagcagcugcccgggccaucuggaggcgaagaggagaaaccuauggguaauggcuccccgucacccccaccugggaccagcuuggacaaccccgugccaucgccuucucccagugaaauuuucccgguuacacauuccuuuccaagcucagcacacuccgauacucaucacaccucuacggccgagagccagaagaaagcuaccgcagaaggaagugccggcaggguggagaauuucgggaagcgaaaaccucuguuacaagcgugggucucccccagcgaaacacauccagugucugcucagcccggagccggcacugguucagcaaagcaccgccuccacccuguuaagccgaugaacgccauggcuaccaaaguggccaauugcagucuggggacagcaacuauaaucuccgagaaccuuaauaacgagguaaugaugaagaaauauagccccucugacccagcuuuugccuacgcgcagcugacccaugaugaauugauucagcucguccugaagcaaaaagagacgaucucgaagaaggaguuccaggugcgggaacuagaagacuacauagacaaucugcuugugagagucauggaggagacaccuaacauucucaggauccccacccagguuggcaaaaaggccggaaaaauguga

SEQ ID NO: 61469 - RNA, 1539 nt, Artificial Sequence
  derived and/or modified sequence opt3 from RAB11FIP2__Homo_sapiens__NP_055719
augaugcugagcgagcaggcccaaaagugguuccccacccacgugcaggucacaguucuccaggcuaaagaccuuaagccuaaaggcaaguccgggacuaacgauacguacaccaucauucagcugggaaaagaaaaguauucuacaucaguggcagagaagacuuuggaaccaguauggaaagaggaagccaguuuugaguuaccgggucugcuaauacaaggcagccccgagaaguacauccucuuccugauugugaugcauagaucccuugucgggcuggacaaauuuuugggacagguggcgaucaaucucaacgauauuuucgaagacaagcagaggcggaaaaccgagugguuucgccuggaaucuaagcagggcaagcgaaucaaaaaucguggugagauaaagguuaacauccaauucaugagaaauaacaugacagcuucgauguuugaucugucaaugaaagacaagaccaggagcccuuucgccaaacucaaggauaaaaugaaggggcggaagaaugacggaacuuuuagugauacauccucugcaauuaucccaagcacccacaugcccgacgccaacuccgaguucucaaguggcgaaauucagaugaaaagcaagccuaaaaagccauuuuuacugggcccccagcgccuuucuuccgcucauucaaugagcgauuugagugggucucacauguccagcgagaaacugaaggcaggaacgaucggucagacucaucuacucggccaccaacuggacucguucgggaccgugccugaaucuggaucccuuaagucaccacacagaaggacacugaguuuugauacuagcaaaaugaaucagccggacuccauagucgacgagggcgaauugugcuucggucggcagaacgaucccuucaccaaugugacagccucucucccucaaaaguuugcuacccugccacgcaaaaagaaccccuucgaggagagcucagaaacgugggacaguuccaugaauuuauuuagcaaaccuauugagauccgaaaggaaaacaagagagagaaaagggaaaagguaucucuguucgagcggguuacugggaaaaaggauucacgucgcagugacaaacucaauaacggaggcagcgauuccccaugugaccuuaagucucccaacgccuuuucggagaauagacaggauuauuucgacuacgaaagcacaaacccguuuaccgcgaaguucagggcauccaauauuaugccuucaaguucuuuucauaugagccccacuuccaacgaggaucugcggaaaaucccagacucaaauccuuucgaugccacagcuggcuaucgcagcuugaccuacgaagaggugcuacaggaacuggucaagcacaaagagcuccugcgaagaaaggacacgcauaucagggagcuugaagacuauauugauaaccuguuggugcgggugauggaggaaacccccucuauacuccgcgucccauacgagcccuccagaaaagccgggaaguuuaguaauagcuga

SEQ ID NO: 61470 - RNA, 1383 nt, Artificial Sequence
  derived and/or modified sequence opt3 from RAB11FIP3__Homo_sapiens__NP_001135744
augcccuuccugaaggccaacgaggugaccgacagcgcuuacaugggcuccgaaucuacauauucagagugcgaaacuuuuacggaugaggacaccaguacacucguccacccugaacuucagccagagggggaugcagacagcgccggagguuccgcgguuccgucugagugucuggaugcuauggaagaacccgaccauggcgccuuguuacugcuaccugggagaccacacccccauggacaaucggugaucacuguaauuggcggugaggagcacuucgaggauuacggggaaggaucagaggcagaacucagcccugagacccugugcaauggccagcuuggcuguagugacccagccuuucugacacccuccccuaccaaaagguugucuagcaagaaaguggcucgguaucuccaucaguccggggcacugacuauggaagcccuggaggauccaucaccggagcucauggaaggacccgaggaagacauagcugauaaggucguguucuuagagcgccgaguucuggaacuugagaaagacacagccgcgaccggugagcagcacagucguuugagacaagaaaaccugcagcuagugcacagggcaaaugcccucgaggaacagcugaaggagcaggaacuucgggcuugcgagaugguccuggaggaaacgcgcagacaaaaggaguugcucuguaaaauggaaagggaaaagagcaucgagauugaaaaccugcagacucgguuacagcagcuggaugaggaaaauucugagcuccgcuccugcaccccuugucuuaaagccaacaucgaacgacuggaggaggaaaagcaaaaauugcuagacgagauugaaucacugacacucagacugagcgaggaacaggagaauaagaggcggaugggcgaccgucuuagucaugagcgccaccaguuucaaagagauaaggaagcaacucaggagcugaucgaagacuugaggaaacagcucgagcaucugcaguuacugaagcuagaagcugagcaacggcgagggagaucuuccagcaugggacuccaggaguaccacucgcgcgccagggaaucugagcuggaacaggaggugcggcgccuuaaacaggauaacagaaauuugaaggagcaaaacgaggagcugaauggccagauaaucacccucuccauucagggugcgaaaucacuguucaguacagccuuuagcgaaucccuugcagcugagaucucuagcguaucaagggacgaacugauggaggccauucagaagcaagaggaaaucaacuuccguuugcaggauuauauagaccggauuaucguugcuauuauggagaccaauccaaguauccucgaagugaaauga

SEQ ID NO: 61471 - RNA, 1914 nt, Artificial Sequence
  derived and/or modified sequence opt3 from RAB11FIP4__Homo_sapiens__NP_116321
auggccggcggggcuggauggagcggugcacccgccgcgcugcucagauccgugaggcggcuucgcgaggucuucgaaguuugcggccgagacccugauggguuucugcguguggagagaguagcugccuugggauuaagguucggccagggugaagagguggaaaagcuggucaaauaccuagacccaaacgaucucgggcggaucaauuuuaaggacuucugucgcggaguguuugcaaugaaaggcugcgaggagcugcuuaaggauguucugucuguggaaucagccggcaccuugccgugugcucccgagauuccugacugcgucgaacaagggagugaggugacaggaccaacuuucgcagauggugagcucauacccagagaaccuggcuuuuucccagaggacgaagaggaagccaugacgcuggcucccccugaggggccacaggagcuguauaccgauagcccgauggaauccacacagucucucgagggaucgguaggcucacccgccgaaaaagacgguggguuaggaggccuguuucuuccugaggauaagagcuugguucacacuccaaguaugaccacauccgaccugucuacccauagcacuacaucccuaaucucaaacgaggaacaguucgaggauuacggcgaaggggacgacguggauugugcgcccaguagcccuugcccagacgaugagaccaggacgaaugucuauucugaccucggauccucagugagcaguucugcaggucaaacuccccggaagaugcgccacguguacaacuccgaacugcuugaugucuauuguagccagugcuguaaaaagauuaaucuguugaacgaccucgaggcccgacugaaaaauuuaaaggcuaacucgccgaauagaaaaaucucuuccaccgccuuuggcaggcagcugaugcauucaaguaacuucagcuccucuaaugggagcacagaagaucucuuucgggacucaauugauaguugcgacaacgauaucacugagaagguuuccuuccuugagaagaaagugaccgaacuggagaaugacagcuugacaaacggagaccuaaagucuaaacugaagcaggaaaauacccaacucguacaccgugugcaugagcuggaggaaauggucaaagaucaggagacgacugcagaacaggcucuugaggaagaggcccgcagacacagggaggcguacggcaagcuggaacgggagaaagccacagaaguggaguugcucaacgcacgaguucagcaacuggaagaggagaacaccgaauuacgcacuacagugaccagacugaagucacagacggagaagcuagacgaagagaggcagcggaugagugaucgccucgaagacaccagccugagacuuaaagaugagauggacuuguauaagaggaugauggauaaacugcgucaaaaucggcucgaguuccagaaggaacgagaggcuacacaggaacugauagaggaccuuagaaaagagcuggaacacuugcagauguacaagcucgauugugagaggccuggucgcgggcgguccgccucuucgggccugggagaauuuaacgcuagagccagggaggucgaauuagagcaugaggugaagcgccugaaacaagaaaauuacaagcuacgagaccagaacgaugaccucaauggccagauccugagccuuuccuuguaugaggccaaaaaccuguucgcagcucagacuaaggcgcaaucacucgcagccgaaauugauaccgcuagucgggacgagcugauggaagccuuaaaagagcaggaggaaaucaauuuucgucugagacaguacauggacaagauuauccuugcaauauuggaucacaaccccucuauucucgagaucaagcauuga

SEQ ID NO: 61472 - RNA, 1962 nt, Artificial Sequence
  derived and/or modified sequence opt3 from RAB11FIP5__Homo_sapiens__NP_056285
auggcccuggugagaggcgcugagcccgcagccgggccuaguagguggcucccaacccacguccagguuacagugcuucgggcgcgcggacugcgagguaaguccucuggcgcugggucaacuagcgacgccuacacgguaauccaagugggacgugaaaaauauagcaccuccgucguggagaagacacauggcugcccggaauggagagaggaauguucuuucgaguugcccccuggugcauuagaugggcugcuaagggcccaggaggcugacgcaggaccagcccccugggcugccucgucagcggcagccugcgaacucguucugacuaccaugcaccggagccuuauuggcguggauaaauuucugggccaggcuacagucgccuuggacgagguguucggggcaggacgcgcucagcauacccaaugguacaagcuccacaguaaaccugguaagaaggaaaaagagagaggcgagauagaaguaacuauccaguuuacaaggaacaaucuguccgccucuauguucgaucugagcaugaaggacaaaccacggucccccuuuucaaagauucgcgauaaaaugaaggggaagaaaaaguaugaccucgagagugcgagcgccaucuuaccuucuuccgcaauugaagauccagaccugggaucacuuggcaaaauggguaaggcuaaaggguucuuuuugcgaaacaagcugagaaaaagcagucuaacccagucuaauacgucccucggaagcgauucgacucugucuuccgccucaggcagucuugcuuaccagggcccgggggccgagcuguugaccaggagccccucccggucuagcuggcucucaacagaaggaggucgugacagugcacaauccccuaagcuguucacucauaagcgcaccuauagcgaugaggccaaccagaugagaguugcuccacccagggcguuacuggaccuccagggccaccuugacgcagccucucggucaagucugugugugaaugggagccacaucuacaacgaggaaccucagggaccaguccgacaucgcuccucuauaucgggcagcuugcccuccucagguagucuacaagcugugucuagcagauuuuccgaggaagggccgaggucaacagaugacaccuggccucggggcagccgcucuaauuccaguagcgaggccgugcugggacaggaggaacucucugcacaggccaaaguccuggcucccggcgccucccacccaggggaggaagagggagcaagacuuccugaagguaagcccguucaaguggcgacgccaaucguagcuucaagugaggccguggcagaaaaagagggcgccaggaaggaggaacguaaaccccggauggggcuguuccaucaccaccaucagggauugagccgaucggagcucggcagaagguccucucugggugaaaaagggggcccuauuuuaggagcuagcccacaccauucaaguuccggcgaggagaaggccaagucuagcugguuugggcugcgcgaagcaaaggauccgacucagaaacccuccccucacccagucaagccccuaucagcugccccuguggagggaagcccagaccggaaacagaguagaucuucccucagcaucgcgcugucgucaggucuugaaaaguugaagacaguuaccucuggcaguauucaacccgugacucaggccccgcaggcugggcagauggucgauacaaaaaggcugaaggacuccgcagugcucgaucaaagcgccaaauauuaccaucugacccacgacgagcuuaucucucuguugcuccagcgcgaacgagagcugagccagcgggaugagcacguacaggaauuagaguccuacauagaccgucugcuaguuagaauuauggaaacgucaccuacccuccugcaaaucccacccggaccucccaaguga

SEQ ID NO: 61473 - RNA, 735 nt, Artificial Sequence
  derived and/or modified sequence opt3 from RAB12__Homo_sapiens__NP_001020471
auggaccccggcgccgcucugcagagaagggcagggggagguggcgggcucggagccggcagcccugcgcuuuccggugggcaaggacggcgccgaaagcagccaccgcgucccgcugauuucaaacuacaggugaucauuauaggcucuagaggcgucgggaagaccucauugauggagagguuuacagacgauacuuucugcgaagccuguaaaaguacgguuggaguggacuuuaagaucaaaaccguagaguuacgggguaagaagauucgccugcagaucugggauacagcaggccaagaaagauucaacagcauuacuuccgccuacuauaggucugcuaaagggaucauacugguguacgacaucaccaagaaagagacauuugaugaccucccuaaguggaugaaaaugauugauaaguaugcaucggaagacgccgagcugcuucuggucggaaauaaguuggauugcgagaccgaccgggaaaucacucgccagcagggcgagaaauucgcucagcaaauuacagguaugcgauuuugugaagccucagcgaaggauaacuucaauguggacgagaucuuucucaaacugguugacgauauacugaagaaaaugccacucgacauuuuaagaaacgagcugagcaauaguauccuuuccuugcagcccgaaccugagauuccacccgaacugccuccaccgaggccccacgugcggugcuguuga

SEQ ID NO: 61474 - RNA, 648 nt, Artificial Sequence
  derived and/or modified sequence opt3 from RAB14__Homo_sapiens__NP_057406
auggccaccgcucccuacaacuauagcuacaucuucaaguauauuauaaucggcgacaugggggugggaaaauccugccugcuccaccaguuuacagagaagaaauucauggcagauuguccucauacuauuggugucgaauuuggcacgagaaucauugagguuucugggcaaaagaucaaacuucagauaugggacaccgccggacaggaaagguuccgggcggugacacgcucauacuaucgaggcgcugccggugcacugaugguauacgauaucacucguagaaguaccuauaaucacuugagcuccugguuaacagacgccaggaaccugaccaauccaaacacugugauuauccuaauugggaauaaggcugaucucgaggcacagcgggacgucacauacgaagaggccaagcaauuugcugaggaaaacggacugcuuuuccuggaggccucugcgaaaaccggcgaaaauguggaggaugcauuuuuggaggccgcuaagaaaaucuaccagaacauacaggacggcucgcucgaucugaaugccgcagaaucagggguucagcauaagccgagcgcuccccaaggaggucgccugacgagugagccucagccacagagagaaggcugcggguguuga

SEQ ID NO: 61475 - RNA, 627 nt, Artificial Sequence
  derived and/or modified sequence opt3 from RAB15__Homo_sapiens__NP_941959
auggccaagcaguacgacgugcuguucagacuccuucugaucggcgauagcggggucggaaaaaccugcuuguuauguagguuuacagacaacgaguuccacuccucucauauuucaacuauagguguugauuuuaagaugaaaacgaucgaaguggacggcauuaagguacggauccaaauuugggauaccgcugggcaggagcgcuaucagacaaucacuaaacaguacuaucgacgugcacaaggaauauuccugguguacgacaucaguagcgaaagauccuaucagcacauuaugaagugggucucugauguggacgagguuggcgaugccaccucgcuacccgguugcggggaaggagcgucaccuggcaaggcuaggcggggcccagacgggaaagccaaugcaagccgcaagcucugucugccgcagcccuggaugaaaacaaguggaacccaucagaaggccuccagaaggucucuucuggguauccgguugaugcgcagccgaaacggcagaugggaggaguccaaagggucaaguuggaggcggagcauggcuuggacuucuaugaagcaagugccugcaccaacauccacccucaagucacacagccgugucuga

SEQ ID NO: 61476 - RNA, 708 nt, Artificial Sequence
  derived and/or modified sequence opt3 from RAB18__Homo_sapiens__NP_001243339
auggacgaggaugugcugaccacacucaagauccuuauuauaggcgaaagcggggucggaaaauccucucuguuguuaagauucacugacgauacguuugaccccgagcuggccgcuaccaucgguguugauuucaaggugaaaacaauuucaguagacggcaacaaggcaaaacuagccaucugggugacucuccaccagcaaaccgcgaacuuuuuccugaagagucagauugggaauagcccuauccuuaagugggcuauguggcaguacgauacagccggacaggaaagguuucggacccugacuccauccuauuaccgcggcgcacaaggugucauauugguguaugacguuacacgacgugauaccuucgugaaacucgacaauuggcugaacgagcuggaaacguacugcacuagaaaugauaucgucaacaugcucguggggaauaagauugacaaagagaacagggagguagaucggaaugaaggauuaaaguuugcccgcaaacauucuaugcuguucaucgaggcuucggcaaagaccugugacggcguucagugcgccuuugaggaacuuguggagaagauuauccagacaccgggcuugugggaaucagagaaccagaauaaaggggucaagcugagccacagagaagagggacaagguggcggggcuuguggaggcuauugcagugugcuauga

SEQ ID NO: 61477 - RNA, 618 nt, Artificial Sequence
  derived and/or modified sequence opt3 from RAB1A__Homo_sapiens__NP_004152
augagcuccaugaaccccgaguacgacuaucuguucaagcuccuucugaucggcgauucuggggugggaaaaucaugcuuguuacugagauuugccgacgauaccuacacagaaaguuauauuagcacuauaggugucgacuucaagaucaggacgauugagcuagauggcaaaaccaucaagcuccagauuugggacacagcugggcaagaacgguuucgcacuaucaccuccucuuacuaucgaggagcacacggcauaaucguuguguacgauguaacagaccaggagucguucaauaacgugaaacaguggcugcaggaaauugaucguuaugccucagagaaugucaacaaacuucugguggguaauaagugugacuugaccacuaagaagguuguggauuacacaaccgcgaaagaguuugcugacagccucgggaucccuuuccuggaaacgagugccaagaacgcaacuaaugucgagcaauccuuuaugaccauggccgcugaaauuaaaaagagaaugggaccaggcgcaacagccggcggggcugagaagucuaacgugaaaauccagagcacuccgguaaagcaguccggagguggcugcuguuga

SEQ ID NO: 61478 - RNA, 606 nt, Artificial Sequence
  derived and/or modified sequence opt3 from RAB1B__Homo_sapiens__NP_112243
augaaccccgaguacgacuaucuguucaagcuccuucugaucggcgauagcggggugggaaaauccugcuuguuacugagauuugccgacgauaccuacacagaaucuuauauuucaacuauaggugucgacuucaagaucaggacgauugagcuagauggcaaaaccaucaagcuccaaauuugggacacagcugggcaagaacgguuucgcacuaucaccaguagcuacuaucgaggagcacacggcauaaucguuguguacgauguaacagaccaggaguccuaugccaaugugaaacaguggcugcaggaaauugaucguuacgcgucugagaacgucaauaaacuucugguggguaacaagucggacuugaccacuaagaagguuguggauaauacaaccgcuaaagaguucgccgacucacucgggaucccuuuucuggaaacgagcgcaaagaacgccacuaaugucgagcaggcuuucaugaccauggcagccgaaauuaaaaagagaaugggaccaggcgcugccaguggcggggagaggccgaaccugaagaucgauuccacacccgugaaaccugcgggagguggcuguugcuga

SEQ ID NO: 61479 - RNA, 705 nt, Artificial Sequence
  derived and/or modified sequence opt3 from RAB20__Homo_sapiens__NP_060287
augagaaagcccgacagcaaaaucgugcugcucggcgauaugaacgucgggaagaccucccuucugcagagguacauggagcggcgcuucccugacacaguuucuacugugggaggugccuuuuauuugaaacaauggcgaucauacaauauuaguauaugggauacggcuggccgugaacaguuccacggguuaggaagcauguauugcagaggcgcagccgcgaucauucugaccuacgacguaaaccauaggcagucccuaguggagcucgaagaucgguuucugggucuuacagacacugcuucuaaggauugucuguucgccaucgucgggaauaaaguggacuugaccgaggaaggagcacucgccggccaggagaaggaggaaugcucgccaaacauggaugcuggcgaccgcguuucaccgagagcacccaagcaagugcagcuggaggaugccgucgcucuguauaaaaagauucucaaauacaagauguuagacgaacaggaugugccugccgcggagcagauguguuuugagacaagcgcaaaaaccggguauaauguagaccugcuuuucgaaacuuuguuugaccugguugugccaaugauccuacaacagagggccgagcggcccagucacacagucgauauauccucucauaagccuccaaagcgcacccgaagcggaugcugugcuuga

SEQ ID NO: 61480 - RNA, 678 nt, Artificial Sequence
  derived and/or modified sequence opt3 from RAB21__Homo_sapiens__NP_055814
auggccgcugcaggcgggggagguggcggggccgcggcugccggcagagcauacagcuucaaggugguccugcucggagaggguugcguugggaaaaccucccuugugcugagguauugugaaaacaaguuuaaugacaaacacaucacaacuuugcaggccucuuucuuaacgaagaaacugaacauuggaggcaagcggguaaaucuagcuauaugggauaccgcaggccaagagcgcuuucaugcccucgggcccaucuacuaucgagacucaaacggagcuauucugguguacgauaucacagacgaagauaguuuccagaaggucaaaaauugggugaaggagcuucguaaaaugcuggguaacgaaauuugcuuguguaucguuggcaauaagauagaccucgagaaagagagacacgugagcauccaggaagccgaguccuaugcggaaucugucggggcaaagcauuaccacacuucggccaagcagaacaaaggaauugaggagcuguuucuggaucucugcaagaggaugaucgaaaccgcucaaguggacgagcgggccaaaggcaaugguucaagccagccugggacagcacgcagaggaguacagauuaucgaugacgaaccacaggcucaaaccaguggcggcggguguugcuccucuggauga

SEQ ID NO: 61481 - RNA, 585 nt, Artificial Sequence
  derived and/or modified sequence opt3 from RAB22A__Homo_sapiens__NP_065724
auggcccugagagagcucaaggugugccuucugggcgacaccggggucggaaaaagcuccaucguuuggagguucguggaagauucuuuugaccccaacauuaauccuacaauaggugcuucauucaugacuaagacgguacaguaccaaaacgaguugcacaaauuuuuaaucugggauaccgcaggccaggaacgguuccgcgcccuggcgccaauguauuaccgagggagugcugccgcaauuaucguguaugacauuacaaaggaggaaacuuuuagcacccucaaaaauugggucaaggagcuacgucagcauggaccgcccaacaucgugguugccauagcuggcaauaagugugaucugaucgacgugagagaggucauggaaagggaugcaaaagacuacgccgauuccauucacgcuaucuucguggagacaucugccaagaacgcgauuaauaucaacgaacuuuuuauagagauuucgcggcgcaucccuucaaccgacgcaaaucugccaagcggugggaaaggauucaaguugagaaggcagcccagugagccuaaacgguccugcuguuga

SEQ ID NO: 61482 - RNA, 714 nt, Artificial Sequence
  derived and/or modified sequence opt3 from RAB23__Homo_sapiens__NP_001265595
augcuggaggaagacauggagguggccaucaagauggucguugugggcaacggggcuguaggaaaaagcuccaugauucagagauacugcaaggguauauucaccaaagauuauaagaaaacaaucggcguggacuuucucgaaaggcaaauucaggucaaugaugaggacgugcggcuuaugcugugggauacugcagggcaggaagaguucgacgccaucacgaaggcguacuaucgcggagcucaggccuguguuuugguguuuucuaccacagaucgagagucauucgaagcagucaguagcuggcgugagaaggugguagccgaaguuggcgacauucccacuguguuaguccaaaacaaaaucgaucugcuagacgauuccugcauaaagaaugaggaggcugaagcacucgccaaaagacugaaacuuagguuuuaccggaccucugugaaagaggaccugaacgugaaugaagucuucaaguauuuggcugagaaguaccuccagaaacugaagcagcagaucgccgaagauccugagcugacacacucgucaagcaacaaaauugguguuuuuaauaccagugggggaucccauucuggccaaaacagcggcacucucaaugggggagacgugaucaacuuacgcccaaauaagcagagaacaaagaagaacaggaauccguucuccucauguaguauucccuga

SEQ ID NO: 61483 - RNA, 612 nt, Artificial Sequence
  derived and/or modified sequence opt3 from RAB24__Homo_sapiens__NP_570137
augagcggccagagaguggacgucaagguugugaugcuggggaaagaguacguaggaaagaccucccucguggaaagguauguccacgaucgguuccuugugggucccuaccaaaacacaaucggcgccgcuuuuguugcaaaagugaugucugucggggaccgcacugugacgcugggaauuugggauaccgccggcucagagcgauaugaagcgaugagucguauauacuauagaggugcuaaggccgcaaucguaugcuacgacuugacagauagcuccucuuucgagagggccaaauuuuggguuaaggaauuacggucgcuggaggaggggugucagauuuaucuaugcggaacuaagucagaccuccuggaagaggaucgcagaaggcggcgcguggacuuccaugauguccaggacuacgcugauaauaucaaagcacagcuuuuugaaaccagcaguaagacaggccaauccguggacgagcuguuccagaaaguggccgaggauuacgucucuguugcugccuuucaggugaugaccgaagacaagggcguagacuuggggcagaaaccuaacccauauuucuacagcuguugccaccauuga

SEQ ID NO: 61484 - RNA, 642 nt, Artificial Sequence
  derived and/or modified sequence opt3 from RAB25__Homo_sapiens__NP_065120
augggcaacgggaccgaggaagacuacaauuucguguuuaaggucguucugaucggagagagcggugugggcaaaacaaaccuccuuuccagauucacuaggaaugaauuuucucacgauucacggacgaccauugggguagaguucaguacacgcacugugaugcugggaaccgccgcugucaaggcacagauaugggacacagccggcuuggaacgauaucgugcgaucaccagcgcuuacuauagaggugccgugggggcauuacugguuuuugaucuaacuaaacaucaaacauacgccguggucgagagguggcucaaggagcuguaugaccacgcugaagcaaccauugugguaaugcuuguuggaaacaaauccgaucugucucaggcccgggaggugcccacggaagaggcucgcauguucgccgagaauaacggcuugcucuuucuggaaacuucggcgcuggacucaaccaaugucgagcucgcauucgaaacaguguuaaaggagaucuuugccaaggugagcaaacagagacagaacaguauuaggacuaaugcuaucacccugggcuccgcccaagcagggcaggaaccuggaccaggugagaagcgggcuugcuguauaucucuuuga

SEQ ID NO: 61485 - RNA, 666 nt, Artificial Sequence
  derived and/or modified sequence opt3 from RAB27A__Homo_sapiens__NP_899059
augagcgacggcgauuacgacuaucugaucaaguuccucgcccuuggggauuccggaguggguaaaaccucuguccuguaccaguauacagacggcaaguuuaacucaaaauucauuacuacgguugggauagauuuuagagagaagagggugguauaccgggcuaguggacccgacggcgcaaccggucgcgggcaacgaauccacuugcaguuaugggauacagccggacaggaacguuucagaagccugacuaccgcguuuuucagggacgcuaugggcuuucuacuccuguucgaucuuacaaaugagcaguccuuucugaacgugcggaauuggauuucucaauugcagaugcaugccuauugcgaaaacccugacaucguccucuguggcaauaaaucggaucuggaggaccagcgcgugguuaaggaagaggaggcaauugcccuggcugaaaaguacgggaucccauauuucgagaccucagcagccaacggaacuaauauaagccaggcuaucgaaaugcucuuagaucugauuaugaaaagaauggagaggugcguggacaagaguuggaucccggagggugucgugcgguccaacggccacgccucuacagaccaacuuagcgaagagaaagaaaagggggcguguggaugcuga

SEQ ID NO: 61486 - RNA, 657 nt, Artificial Sequence
  derived and/or modified sequence opt3 from RAB27B__Homo_sapiens__XP_005266790
augaccgacggcgauuacgacuaucugaucaagcuccuugcccugggggauagcggaguggguaaaacaacuuucuuguacagauauacggacaacaaguuuaaucccaaauucauuaccacagucggcauagauuuuagggagaagcggguuguguacaacgcucaggggccuaauggauccucuggcaaagcauucaagguacacuuacaacugugggacacugccggucaggaacgcuuucgaucacuaaccacagcguucuuucgugaugcuaugggguuccuccugauguuugaccuuaccagucagcagagcuuccugaacgugagaaauuggaugucccaauugcaggccaacgcauauugcgagaauccagauaucguccucauuggaaacaaggccgaccugccggaucagagggaagugaaugagcggcaggcucgcgaacuggcagacaaauacggcauccccuauuuugagacuucugccgcuacaggccaaaacguugagaaggccguggaaacccucuuagaucugauuaugaaaagaauggagcagugugucgaaaagacgcagaucccugacacugugaaugggggaaacucggguaaucuugacggcgagaaaccacccgagaagaagugcauauguuga

SEQ ID NO: 61487 - RNA, 666 nt, Artificial Sequence
  derived and/or modified sequence opt3 from RAB28__Homo_sapiens__NP_001017979
augagcgacuccgaggaagagucucaggauagacaacugaagaucgugguccucggcgacggggccucaggaaaaaccagucuuacaacuugcuucgcucaggaaacguuugguaagcaguacaaacagaccauuggccuggauuucuuuuugaggcggauaacauuacccgggaaccugaauguuacucuacaaaucugggacauuggaggccagaccaucggugggaagaugcucgauaaauauauuuacggagcacagggcgugcugcuuguauaugacaucacaaacuaccagagcuucgagaaucuggaagauugguauaccguggucaagaagguguccgaggagucugaaacucaaccuuugguugcccucgugggcaacaaaauagaccuggagcacaugcgcacaaucaagccagaaaaacaucugcgauuuugucaggagaauggguucucgucacacuuugucagcgcgaagaccggagauaguguguuccucugcuuucagaaaguagcugccgagauuuuagguaucaagcugaacaaggcagaaauugagcagucccaacguguugugaaagccgacaucgucaauuacaaccaggaaccgaugucuagaacggugaaucccccuaggagcuccaugugugcugugcaguga

SEQ ID NO: 61488 - RNA, 540 nt, Artificial Sequence
  derived and/or modified sequence opt3 from RAB29__Homo_sapiens__NP_001129135
augggcagcagagaccaccuguucaaggugcucgucguuggggaugccgcugugggaaaaaccucccuuguacagagguacucucaagacucauuuaguaagcauuauaaaagcacaguggguggccaggagcgguucacuuccaugacgcgccuguacuaucgagaugcaucugccugcgucaucauguuugacgugaccaacgcgacaacuuucagcaauucacagcguuggaagcaggauuuggacagcaaauuaacccugcccaacggggaaccuguuccaugucuacuccuggcuaauaagugcgaucuuaguccgugggccguguccagagaccaaauugauagguuuucuaaggagaacggauucacaggcuggaccgaaacuagcgucaaagagaauaagaacauaaaugaagcaaugcgggugcugaucgagaaaaugaugcgcaacuccacagaggacauuaugucauugaguacccagggugauuacaucaaucuccagacgaagucgucuuccuggucauguugcuga

SEQ ID NO: 61489 - RNA, 567 nt, Artificial Sequence
  derived and/or modified sequence opt3 from RAB2A__Homo_sapiens__NP_001229573
auggccuacgcuuaucuguucaaguacaucauuauaggcgacaccgggguggaguuuggagcaagaaugaucacaauugaugguaaacagaucaagcuccaaauuugggacacugccggccaggagagcuucagguccaucacgcggucuuauuaccgcggggcggcuggagcccuucuggucuaugauauaacccgacgugacacauuuaaccacuugacuaccugguuagaagaugcaagacagcauucaaauaguaacaugguuaucaugcugauuggcaauaaaagcgaccuagaauccaggcgggaggugaagaaagaagagggugaggccuucgcucgcgaacacgggcucaucuuuauggagacaucugcaaagaccgccucgaacguagaagaggcuuucauuaauacugccaaggagaucuacgagaaaauacaggaaggaguguuugauauuaacaaugaagcgaacggcaucaagauuggcccccaacaugcagccacaaaugcuacccacgccgggaaccagggaggucagcaggcaggcgggggaugcuguuga

SEQ ID NO: 61490 - RNA, 588 nt, Artificial Sequence
  derived and/or modified sequence opt3 from RAB31__Homo_sapiens__NP_006859
augauggccaucagagagcugaaggugugccuccuuggcgacaccggggucggaaaaagcuccauuguuuguagguucgugcaggaucacuuugaccauaacauaucucccacaaucggugcuucauucaugacuaagacgguaccuugcggcaaugaacugcacaaauuuuugauuugggauaccgcagggcaagagcgguuccauaguuuagccccaauguacuaucgcggaagcgcggcugccgugaucgucuacgacauuacaaagcaggauuccuuuuauacucugaaaaagugggugaaggaacuaaaagagcacggcccggaaaacaucguuauggcaauagccgguaauaagugugaccucucugauauccgagaggugccccugaaagacgcuaaggaguacgcagaaucgauuggggccaucgucguggagaccucagcuaaaaacgccauuaauaucgaggaacuuuuccagggaauaagccgucagauuccuccacuggauccccaugagaacggcaauaacggcacaaucaagguagaaaagccuaccaugcaagcgaguagaaggugcuguuga

SEQ ID NO: 61491 - RNA, 678 nt, Artificial Sequence
  derived and/or modified sequence opt3 from RAB32__Homo_sapiens__NP_006825
auggccggcgggggagcuggugaccccggccugggggcagccgcggcuccugccccagagaccagagaacaccucuucaaggugcuugucaucggagagcugggcguugguaaaacaagcauuauaaagagguacgugcaucaguuguuuucccaacacuaucgggcaacuaucgggguagauuucgccuuaaaagugcugaacugggacucucgcacgcuaguccgacuccagcugugggauauugcuggacaggaacguuuuggcaauaugaccagaguguacuauaaggaggcaguuggcgccuucguggucuuugacaucucaaggaguagcacauucgaagcugugcuuaaauggaaguccgaucuggacucuaagguacauuugccgaacgggucgcccauuccugccguucuccuggcgaauaaaugcgaucagaacaaggacucaagccaaaguccaucccagguggaucaguuuuguaaagagcacggauucgcagguugguuugagacuucugccaaggacaauaucaacauagaagaggcugcccgguuccuggucgagaaaauccucgugaaucaucagagcuuucccaacgaagagaaugauguggacaagauuaaguuagaucaagaaacccugcgcgcagagaacaaaucccagugcuguuga

SEQ ID NO: 61492 - RNA, 690 nt, Artificial Sequence
  derived and/or modified sequence opt3 from RAB33B__Homo_sapiens__NP_112586
auggccgaggaaauggagagcucccuggaggcuucuuucucaaguagcggcgcaguguccggggccucuggauuucuucccccugcgagaucgaggaucuucaagauuauagucaucggugacucaaacguuggcaaaaccugccucacauaccgguuuugugcugggcgcuucccagaucgaacugaagccacgauuggaguggacuuucgugaaagagcaguagagaucgauggcgagaggauuaagauccagcugugggacaccgccggucaagaacgguuccgcaaaagcauggugcagcacuauuacagaaauguccaugcugugguuuuuguguaugauaugacaaacauggcaaguuuccacuccuugccgucuuggauagaggaaugcaagcagcauuuacuggccaaugacauccccaggauucuagucgggaacaaaugugaucuccggagcgcuauccaggugccuacugaccuggcccaaaaguuugcggauacccacuccaugccacuuuucgagacaucagcaaagaaucccaacgacaaugaucauguagaggccauuuuuaugacccuggcucacaaauugaagagucacaaaccucucaugcugagccagccacccgacaacggaaucauacugaagccugaaccaaaaccggccaugacuugcugguguuga

SEQ ID NO: 61493 - RNA, 927 nt, Artificial Sequence
  derived and/or modified sequence opt3 from RAB34__Homo_sapiens__NP_001136096
augagccaucugcccggccucgagcuuagaagggaagccccuccacuguuggggccguuacugucccccuucccucuaccagcuggaucuuggcaccggcagaugcuccgcucaagucugcgauuucccaucaccaacagcgccggugcaccuugcaaggcggcuggccguaugaauauucuugccccagugagaagggaccggguccuggcagaguugccccaaugucuccgcaaagaagccgcucugcacgggcauaaggauuuccacccuagaguuacaugcgcaugucaggagcauaggacuggaacggugggcuuuaaaauauccaagguaaucguggucggugaccugucuguggggaaaaccugccucauuaaccgguucuguaaggauacauuugacaagaauuacaaagccacuaucggaguugauuucgaaauggagcgcuuugagguguuaggcauuccauucucgcugcagcuuugggacaccgcuggccaggaacgauuuaagugcaucgccucaacauauuacagaggggcgcaagcaauaaucauugucuucaacuugaaugauguggccagccuggagcacaccaaacaguggcuagcugacgcccucaaggaaaacgauccgaguuccguacugcuuuuucugacucccgcacaguaugcuuugauggagaaagacgcccuccagguugcgcaagagaugaaggccgaauacugggcagugucuagccugacaggagagaaugucagggaguucuuuuuccggguggcugccuuaaccuucgaagcuaacgugcuggccgaacucgagaaguccggugcacgucgcaucggcgaugucguuagaauuaauucagacgauaguaaccuuuaucugacggccagcaaaaagaaaccuacuuguugcccauga

SEQ ID NO: 61494 - RNA, 459 nt, Artificial Sequence
  derived and/or modified sequence opt3 from RAB35__Homo_sapiens__NP_001161078
auggccagagacuacgaucaccuguucaagcuccuuaucauuggcgacagcggggugggaaaauccucucuguuguuaagguuugcugauaacaccuucucagguaguuauauaacaacuaucggcgucgacuuuaagauucggacgguugagaucaauggggaaaaagugaagcugcagauuugggauaccgcaggacaagagcgcuuccgaacaaucacuagcaccuacuaucguggcacacaugguguaauaguggucuacgacgugaccuccgccgaaucuuuuguuaacgugaaaagauggcuacacgagaucaaucagaacugcgaugacgucuguaggauucucgaugugcagcugcaucacggggcgggacccccuucgaaggaacggcagccaggcaagacugcugccgcaacaaccgagcgcugcggcgaggcccaugaggaacaauga

SEQ ID NO: 61495 - RNA, 1002 nt, Artificial Sequence
  derived and/or modified sequence opt3 from RAB36__Homo_sapiens__NP_004905
auggugaucgccggcgcuagcuggaugcuggggagagcagccgcgucccccacccagacaccuccaacuacgucuaccauuagggucgcucggcgcucacgaguugcccucguggcaaugguaauagccgcugcaggaagugguggcccggggcgugccgagccccaacuuagccagccuucccuggacugcggaagaaugaggucuucguugacaccauuaggucccccugugucacgggaucgcgucaucgcuagcuucccaaagugguacacucccgaagccugucugcagcuaagagagcacuuucauggccaggugagugcggcaugccaaaggcggaacaccgggacaguuggacucaaacuguccaagguggucgugguaggcgaccuuuauguuggcaaaaccucucugauucaccgcuucuguaagaauguguuugaucgagacuacaaagccacuaucggggucgauuucgaaauugagagauuugaaaucgcuggaauaccuuauagcuugcagaucugggacacagccggucaggagaaguucaagugcauugcauccgcuuacuauaggggcgcccaggugaucauuaccgcguuugaucucacggacgugcaaacucuggagcauacccggcaguggcuggaagaugcccuccgugagaacgaagcagggucauguuucaucuuuuuagucggaacuaaaaaggaccugcuuaguggcgcugccugcgagcaggcugaggccgaugcaguucacuuggcccgcgaaaugcaggcugaguacuggagcgugucugcgaaaacaggugaaaauguaaaggcauucuuuuccagaguggccgcucuggccuucgagcaaucaguccuacaggaccucgaaaggcagagcagugcacggcugcaaguggggaacggagaucuuauacagauggagggcucuccaccggagacccaggaauccaaacgacccagcucgcugggcuguugcuga

SEQ ID NO: 61496 - RNA, 672 nt, Artificial Sequence
  derived and/or modified sequence opt3 from RAB37__Homo_sapiens__NP_001006639
augaccggcacacccggggccguggcuacuagagacggagaggcaccugaaaggagcccaccgugcucccccucuuacgaucugacggguaaggucaugcuccuuggcgacaccgggguuggaaaaacauguuuccugauccaguuuaaggauggcgccuucuugucagguacuuuuauugcgaccguggggauagacuuccggaacaaaguagugacagucgauggagugcgcguuaaguuacaaaucugggacaccgcuggccaggagcgauuucguagugugacucacgccuauuacagagaugcacaggcccugcuacuccuguaugacauuacaaauaaaagcuccuucgauaacaucagggcuuggcuuaccgaaauucaugaguacgcacagcgggacgucgugaucaugcuguugggcaauaaggccgauaugucuucggaacgcguaauaagaucagaggacggggagacgcucgcuagggaauauggaguuccuuuucuggagacuagcgccaagaccgguaugaacguggaacuggcguuccucgcaaucgccaaagaguuaaaguaccgggcuggccaccaagccgaugagccaaguuuucagauucgcgacuaugucgaaucccagaaaaagcgaucuagcugcuguuccuucauguga

SEQ ID NO: 61497 - RNA, 636 nt, Artificial Sequence
  derived and/or modified sequence opt3 from RAB38__Homo_sapiens__NP_071732
augcaggcuccccacaaggagcaucuguacaaacuccuugugaucggcgaccugggggucggaaagaccagcauuauaaaaagauauguucaccaaaacuucuccucucauuacagggccacaaucgguguggauuuugcauugaagguauuacacugggacccugaaacugugguccggcugcagcuaugggauauugccggccaggagcgcuucgggaauaugacgcgaguguauuaccgugaagcgaugggagcuuuuaucguuuucgacgugaccagaccagccacauuugaggcagucgccaaauggaagaacgaucucgacucaaagcugagucuuccgaauggcaaacccgugagcguaguucuguuggcuaacaagugcgaucaggguaaagacgugcucaugaauaacgggcugaagauggaucaauucuguaaagaacauggauuugucggcugguucgagacuuccgcaaaggagaauauuaacaucgacgaagccucuaggugccuggugaagcacauacucgcuaaugagugugauuuaauggaaucgaucgagccugacguggucaaaccacaccugaccucaacaaagguugccagcugcaguggcugugcgaaauccuga

SEQ ID NO: 61498 - RNA, 654 nt, Artificial Sequence
  derived and/or modified sequence opt3 from RAB39A__Homo_sapiens__NP_059986
auggagaccaucuggauuuaccaguucagacugauagugaucggcgacagcacagucgggaaguccugccuccuucacagguuuacucaaggacgguuccccggucugcgcucuccugccugugauccaacgguuggcguggacuuuuucucacgauuguuagaaauugagccggggaaacguaucaagcugcagcuaugggauaccgcuggacaggaaagauuuaggaguauuacacggagcuauuaccgcaacuccguaggcgguuuccucguguuugacaucacuaauagaaggucuuucgagcaugucaaagauuggcuggaagaggcaaagauguaugugcagcccuuucggauaguuuuccuucugguggggcacaaaugcgacuuggccucgcaacgccaggucacccgagaggaagcggagaagcucucagcugauuguggaaugaaguacaucgaaacaagcgccaaagacgcaaccaacguggaggagaguuuuacuauucugacaagagauaucuaugaacugauuaagaaaggcgagaucugcauacaggacggcugggaagggguaaaguccggauucguuccuaauaccgugcauucuagcgaggaagccgucaaaccaaggaaggaguguuuuugcuga

SEQ ID NO: 61499 - RNA, 642 nt, Artificial Sequence
  derived and/or modified sequence opt3 from RAB39B__Homo_sapiens__NP_741995
auggaggccaucuggcuguaccaguucagacucauugugauaggcgacagcaccgucgggaaguccugccuuaucaggcgguuuacagaaggacgcuucgcucaaguuucugaucccacuguggguguagacuuuuucucacgacugguggagauugaaccuggcaaacguaucaaguugcagauuugggauacggcagggcaggagagauuuaggaguaucacccgggccuauuaccgcaacagcgucggaggcuuacugcuauucgacauaacaaauagaagguccuuucagaacgugcacgaauggcucgaggagacuaaaguucaugugcaaccauaucagaucgucuucgugcugguaggucacaagugugaucuugacacccagcggcagguuacacgccaugaagcggagaaacuggcugccgcauacgggaugaaguauauugaaaccucugcccgagaugcuaucaauguggagaaggcauuuacugacuugacaagagauauuuacgagcucgucaaaaggggagaaaucaccauacaagagggcugggaaggcgugaagucgggguucgugccgaacgucguucacucaagcgaggaagugguaaaaagugagcggcguugccuguguuga

SEQ ID NO: 61500 - RNA, 663 nt, Artificial Sequence
  derived and/or modified sequence opt3 from RAB3A__Homo_sapiens__XP_011526466
auggccagcgcuaccgacuccagauacggccagaaggagucuucagaucaaaacuucgacuauauguuuaaaauccugauuauagggaauaguagcgugggaaagacauccuuccucuuuagguacgcagaugacucuuucacucccgccuuugucucgacgguugguaucgauuucaaagugaagaccauuuaucggaacgacaaacgcaucaaacuucagauuugggauacagcgggccaggaacgauaccguacuaucaccacagcuuauuacagaggggccaugggauuuauacugauguaugacaucaccaaugaggaaucauucaacgcaguacaggauuggagcacucaaauuaagacauacaguugggacaaugcccagguguuguuagucggcaacaagugcgauauggaggacgaaagggugguuuccucugagcggggucgccagcuggcugaucaccuaggguuugaguucuuugaagcaagcgccaaggacaauaucaacgugaaacagaccuucgagagacucgucgacgugauuugugaaaagauguccgagucacuggauacggcugacccugccguaacuggagcgaaacaaggcccacagcuuagugaucagcagguuccgccccaucaagacugcgcauguuga

SEQ ID NO: 61501 - RNA, 660 nt, Artificial Sequence
  derived and/or modified sequence opt3 from RAB3D__Homo_sapiens__NP_004274
auggccagcgcuggcgacacccaggcagggcccagagaugccgcggaccaaaacuucgauuacauguuuaagcugcuccuuaucggaaauuccucuguggguaaaacaucauuccuguuuagguaugcugacgauaguuucacuccugccuuugucagcacgguuggcauugacuucaaggugaaaaccguauaccggcacgauaagcgcauaaaauugcagaucugggacacagcagggcaggagcgauaucguacuauuaccacagccuacuauagaggagcuaugggcuuuuuacugauguacgauaucgcaaaccaggaauccuucgccgcugugcaagacugggccacccagauuaagacuuauucuugggauaaugcgcaggucauccuaguggguaacaagugcgaccucgaggaugaaaggguugugccagcagaggacgggcggcgccuggccgacgaucuuggauuugaauuuuucgaggcuucggccaaagagaauauaaacgucaaacagguguucgaaagacugguagacguuaucugugagaagaugaaugaaucauuggagccgagcaguuccucuggcagcaacggcaaggggcccgcagugggagaugcuccugccccacaacccuccucaugcaguuguuga

SEQ ID NO: 61502 - RNA, 2967 nt, Artificial Sequence
  derived and/or modified sequence opt3 from RAB3GAP1__Homo_sapiens__NP_001165906
auggccgcugacagcgagcccgaauccgagguguucgaaaucaccgauuuuacaacugcaucugagugggaaagauucauuucaaaggucgaggagguucugaacgacuggaaacucauaggcaauagucuugggaagccucuggaaaaaggaaucuuuacgagcgguaccugggaggaaaaguccgaugagauuucuuucgccgacuuuaaauucucggugacacaccauuacuugguacaggagucaacugauaaggaaggcaaggacgaguuacuggaagauguggucccacaaagcaugcaggaccuacucgggaugaacaaugauuuuccgcccagggcgcacugccuggugcggugguauggacuucgcgaguucguugugaucgcuccugccgcacauagugacgccguccuguccgaaucuaaauguaacuugcuccugagcuccgugucaauugcucugggcaauaccgguugccagguaccacucuuuguucagauccaccauaaguggcgacguauguacgugggggagugucaaggacccggcgucagaacagauuucgagauggugcacuuaaggaaagugccuaaccaguauacccaccugaguggccuuuuggacauauuuaagagcaaaaucgggugcccacugacuccccuaccuccagucucuauugcaauccgguucacauacguucuccaggauuggcagcaauauuuuuggccgcagcagcccccugacauugacgcccuggugggaggugaaguaggcgggcuugaguucggaaagcugccauucggcgcuugugaagaucccaucuccgaguugcaucucgccaccacguggccucaccugacugaagguauaauuguggacaaugaugucuacucagacuuagauccaauccaggcgccccauuggagcgugcgcguuagaaaggcagagaacccgcaaugccugcucggggacuuugugaccgaguucuuuaaaauuuguaggcggaaggaaaguacagaugagauccuuggacgcucugccuucgaagaggaaggcaaagagacugcugacaucacccacgcccuguccaaguugacagagccugcaagcguccccauucacaaacuaucggugucuaauaugguacauaccgcuaagaaaaagauacgaaagcacagaggcguugaagaguccccacugaacaaugaugugcucaacacgauccugcuuuuucuguucccugacgccgucucagaaaaacccuuggaugggacuacaaguaccgacaauaacaauccacccagcgaguccgaggacuauaaccucuacaaccaguuuaagucugcgccuagcgauucacugacuuacaaauuagcccugugccuauguaugauuaauuucuaucauggaggucucaagggcguggcacaccuguggcaggaauuuguccuugagaugagguuccggugggaaaacaacuuuuugaucccagggcuggcuaguggaccgcccgaccuccguugcugucugcuucaucaaaaacugcagauguugaauugcugcauagagcgcaagaaggccagagaugaaggcaaaaagacauccgcuagcgacgugaccaauauuuacccuggugaugccgggaaagcaggcgaccagcucguuccagauaaccugaaggagacggacaaagagaagggagaagugggcaagucuugggauucauggagugacagcgaggaagaguucuuugaauguuuauccgauaccgaggagcugaaagggaauggacaggaaucugguaagaaaggcgggcccaaggagauggccaaccuaaggccugaaggacggcucuaucaacacggcaaacugacacuuuugcacaauggugagccacuguacauccccguaacucaggaaccggcuccuaugaccgaggaccuccuggaggaacagucggaggucuuagcgaagcuggggacaagcgcagaaggcgcccaucuucgagcucgcaugcaguccgccugcuugcucucagauauggagaguuucaaggcagccaacccaggauguucucuggaggacuucgugagaugguauagccccagggacuacaucgaagaggaaguuauugaugagaaaggcaaugugguccuaaagggggaacuguccgcucggaugaaaaucccuucaaacauguggguggaggccugggagacugcaaagcccauuccagcgcgcagacaaaggcgucucuuugacgauacccgggaagcugagaaaguacugcacuaucuugccauacagaagccugcagacuuggcccgacaucuguuacccugcgugauccacgcugccguucucaaagucaaggaagaggaaagccuggagaauauuucuuccgugaagaaaaucaucaagcagauuauaagucacagcucuaaagugcuucauuucccaaacccggaggauaagaaacuggaagagaucauucaccagaucacaaaugucgaagcauugauugcuagagccaggucccucaaggcgaaguuuggaaccgagaaaugugaacaagaggaggaaaaggaggaccuggaacgcuucguuucaugccuacuggagcagccugaggugcucgugacuggugccggccgggggcaugcuggaagaaucauacacaaacuguuuguaaacgcacagaggcuuacggaaaguagcgaugaggccgcugccaugacacccccagaagaggaauugaagcgcaugggcucgcccgaggagcgacggcagaacuccgucucugacuucccuccacccgcaggucgugaauuuauccugagaaccacugugccuaggccggcgccauacagcaaagccuuaccccaacgcauguacucaguucucaccaaggaggauuuccggcuggcuggggccuuuaguuccgacacaucuuucuuuuga

SEQ ID NO: 61503 - RNA, 4182 nt, Artificial Sequence
  derived and/or modified sequence opt3 from RAB3GAP2__Homo_sapiens__NP_036546
auggccugcagcaucgugcaguucuguuacuuucaagaccugcaggcugcaagagauuuccucuuuccccaccuuagggaggaaauucuguccggcgccuugcggcgcgacccuucuaagucaaccgauugggaggacgauggguggggagcgugggaagagaacgaaccacaggagccggaggaagaggguaauacaugcaaaacucagaagacgaguugguuacaagacuguguccugagccuaucccccaccaacgaucucaugguuauagcucgagaacagaaagccguguuccugguaccuaaguggaaauauucugacaagggcaaggaggagaugcaguuugcagugggguggucgggaucacuuaaugucgaagagggcgaaugcgugacaagcgcccuguguaucccauuggcuagucagaaacguuccucuacugguagacccgauuggaccugcauuguugugggguucacaagcggauacgucagguuuuauaccgagaacggcgugcuccugcuggcacaacucuuaaaugaagacccuguacugcagcuuaagugucggacuuacgagaucccacgccaucccggcguuacagagcagaacgaagaguuguccauucuguauccugccgcuaucgugaccauagauggguucucacuauuucagagucucagagccugcaggaaucaagucgcgaaagcagccgcuagcggaaacgaaaauauccagccaccgccccuggccuacaagaaauggggucuucaggacauugauacgaucauugaccacgcaucugugggcaucaugacucuguccccuuucgaccaaaugaagaccgcuucaaacauagggggauuuaaugccgcgauuaagaacagcccacccgccaugagucaguauaucacagugggcucuaauccuuucacuggguuuuucuacgcauuggaggguuccacccagccacuccugagccaugucgcuuuagccguugcuucgaaacugacaucugcccucuucaacgcagccuccggauggcuuggcuggaagucaaaacacgaagaggaggcugugcagaagcaaaaacccaagguagaaccggcgaccccucuggcagugcgguuuggcuugcccgauagucgccgacauggggagagcauuugucuauccccaugcaauacgcuggccgcugucacugacgauuucggaagagugauccuccuggacguugccagggguaucgcaauucggauguggaaaggcuaccgugaugcccagauaggguggauccagacaguggaagaccuucacgagcgcgucccugaaaaggcugauuuuucucccuucggaaacagccagggcccaucaagaguggcccaauuucugguaauuuaugcacccaggcgggguaucuuggagguuuggaguacccagcaggggccucgagugggcgcguucaacgucggaaagcacugucgccuccuguacccaggcuauaaaauaaugggguuaaauaacgugacuucccagagcuggcaaccgcagacauaccagauuugccuggucgaccccgugucuggaucaguuaagaccgugaauguaccuuuucaucuagcucucagugauaaaaagagcgagagagccaaagacaugcaccuggucaagaaacuugcagccuugcugaaaacgaaguccccaaaccucgaucugguggaaaccgagaucaaagaacuuauccuggacauuaaguaucccgcuacaaagaagcaggccuuggagucuauccucgcaucggagaggcugccuuucagcugcuuacggaauauuacucaaacccugauggacacacuaaagucccaggaacucgagucaguugaugaaggucugcuucaguuuugugcuaacaaauugaagcugcuccaacuguacgagagugugucucaguuaaauagccuggacuuccaucuugauacuccauuuuccgacaacgauuuggcccuccugcuacgccuggacgaaaaagagcuccugaaacuucaggcguugcuggagaaauauaagcaggaaaauaccagaacaaacgucagguucucagaugacaaggauggcguguuacccguaaaaaccuuucucgaguaccuggaauacgagaaggacgugcuuaauauaaagaagaucagcgaagaggaguauguugcccuggggucuuucuucuuuuggaaaugcuugcacggagaauccaguacugaggauaugugucacacgcucgaaagcgcuggccugucuccgcaacuacugcucucccugcuuuugucagucuggcugaguaaggagaaagacauuuuagauaagccucagagcaucugcugucuccauacaaugcugucgcuucuguccaagaugaaaguggcaaucgacgaaaccugggacucucagagcgugucaccaugguggcagcaaaugcguacugccugcauucagagugagaacaauggugcugcccuacucuccgcacacgucgggcauucuguugcggcccagauaagcaacaauaugaccgagaagaaauucucccagacagugcugggcgcugauucagaagccuugaccgacagcugggaggcacugaguuuagauacugaauacuggaagcuccugcuuaaacaacuggaggacuguuugauccuccagacacugcuacacucuaagggaaacacgcagaccuccaaggugagcucgcugcaagcugagccccuuccucggcucucagucaaaaagcuguuggaaggcgggaaaggagguauugccgauucuguagcaaaguggaucuuuaaacaggacuucagucccgaggugcugaaguuagccaacgaggaacgagaugcugaaaauccagacgagccuaaggagggcguuaacagauccuuucucgaagugagcgagauggaaauggaucugggggcgauucccgaccuucugcauuuggccuaugagcaguucccaugcucucucgaacuggauguccuacacgcacacuguugcugggaguacgugguucaguggaauaaagacccggaggaagcuagguuuuucgugcgcagcaucgagcaucugaagcaaauauuuaacgcccacguacagaauggaaucgcccuuaugauguggaacacuuuccucgucaaacgguuuuccgcugcaacauaucugauggauaaggugggcaaaucaccuaaggacagauuguguaggcgcgacguggguaugagugauaccgccaugacaucguucuuagggucuugccuggaccuccugcagauucuuauggaagcggaugucucccgagacgagauccagguucccgugcuggauacugaagacgcuugguugucaguagagggcccaauuaguaucguggagcuagcccuggaacaaaagcauauacacuacccccucgucgagcaccauagcauucugugcuccauccuuuaugcagugaugcgguuuucuuuaaaaaccguuaagccucugagccucuucgauagcaaaggaaagaaugccuucuuuaaagacuugacgucaauucagcugcucccauccggcgaaauggaucccaacuucaucagugugcgucagcaguuucugcuuaaggucgugucugcugcaguucaagcccagcacagcgcgaccaaagugaaggacccuacagaggaggcuacuccgaccccauucgggaaggaucaggacuggcccgcccuggcagucgacuuggcccaucaccuacagguauccgaagaugugguuagaaggcauuacgugggagagcuguacaauuauggcgucgaccaccucggugaagaggcuauauuacaagugcacgauaaagaaguacuggccucacagcuucuggugcucacagggcagcgcuuggcacaugcucugcuccacacucaaaccaaggagggaauggagcugcuugcccggcuaccuccaacgcuguguacaugguugaaagcgauggacccccaggauuuacagaacaccgaagucccuaucgccacuacagcaaagcugguuaauaaagugauugagcuccugccggaaaagcauggccaguacggucuugcucugcaccucaucgaggccguggaagcuauuucuuugcccagccuguga

SEQ ID NO: 61504 - RNA, 1071 nt, Artificial Sequence
  derived and/or modified sequence opt3 from RAB3IL1__Homo_sapiens__NP_001258615
auggacagcuccgaggaacacgccggcugccccgcuagagggaccuguccuguguuccuggcaaugucugccggaacagucagguacgcgccaucaggucucugcccgguucuugagggcaaccugcgggaagaacccugggggacugauaguccuccacagcccgaccaaggauugccuccacccuuagcugccgugccuguaccauggaaaagcacggauccgugucagggccaucgcgaaucccccggugcacugguggagaccucugccggggaggaagcucagggacaggagggcccugcagccgcucaacuagacguccuccgacugcguucgucaagcauggaaaucagagagaagggcagugaguuucuuaaggaggagcugcacagggcccagaaagaauugaagcucaaagaugaggaaugcgagcggcuguccaaggugcgcgagcagcuggaacaggagcucgaagaguuaacagcgucucuguucgaagaggcacauaagaugguuagagaggccaauaugaaacaagcugccagcgaaaagcagcuuaaagaggcaagggggaagguggacacuauuuuguuugcugaguuccaggccuggcgggaauccccaacccuggauaaaacaugucccuuucuagaacgcgucuaucgagaggacgugggaccuugccucgauuucaccaugcaggagcugucaguacuuguuagagcggccguggaagacaacacucugacaauagagccagucgcaagucaaaccuugcccacggugaagguggcugaagucgauuguagcucuacuaauaccugcgcccucuccggucugacaaggacuugucggcaccguauccgcuuaggcgacucaaagagccauuacuauauuaguccgucuuccagagcuaggaucaccgccguuugcaacuuuuucacauacauucgguauauccagcaggggcuggugcgacaagaugcagagccuauguuuugggagauaaugcgccucagaaaagaaaugagccuugccaagcugggauucuuuccccaggaggcuuga

SEQ ID NO: 61505 - RNA, 765 nt, Artificial Sequence
  derived and/or modified sequence opt3 from RAB3IP__Homo_sapiens__NP_001019818
auggugagagaggccaacaucaagcaggcuaccgcagaaaaacaacugaaggaggcccagggcaaaauugacguccuccaggcggaaguugcugcccuuaagacacugguguugagcuccucucccacuucaccuacgcaggagccauuacccgggggaaaaaccccguucaagaagggucacacaaggaauaaaaguacuagcuccgcaaugucuggcucgcaucaagaucugucaguaauacagccuaucgugaaggacugcaaagaagccgaucuaagccucuacaacgaguuucggcuguggaaggacgagccaaccauggaucgcacaugucccuuccuugacaaaauuuaucaggaagauaucuuuccuugccugaccuucaguaaguccgaguuggcuucugcaguccucgaagccguggagaauaacacucugagcauugagccaguugggcugcagcccauccgauuugugaaggcuuccgccgucgaauguggaggcccuaaaaagugcgcgcucacaggucaaucaaaaaguuguaagcaccguauaaaauuaggggacagcucuaauuacuauuacaucuccccauucugcagauauaggauuaccucaguguguaacuuuuucacguacauccgguauauucagcagggacugguaaagcagcaagauguugaccagauguuuugggaggugaugcagcuucgcaaagaaaugagcuuggcaaagcugggcuacuucaaggaggaacuauga

SEQ ID NO: 61506 - RNA, 837 nt, Artificial Sequence
  derived and/or modified sequence opt3 from RAB40AL__Homo_sapiens__NP_001027004
augagcgcccccggcuccccugaccaggcuuacgauuuccugcucaaguuucuucuggugggggacagagaugucggaaaaucugagaucuuggaaucauuacaagacgguaccgcagagaguccauauagccaccugggcgggauugauuacaagacaacuacgauacuacucgacggacagaggguuaaacugaaacuuugggauaccuccggccagggucgguucugcacaaucuuucgcucuuauucgcgaggggcccagggagugauucugguauacgacaucgcgaaccguuggucauucgaaggcauggauagauggauuaagaagaucgaggaacaugcuccgggcgugcccaagauauuggucgggaauaggcuccaccuggccuuuaaacggcaagugccucgcgagcaggcacaggccuaugcugagagacugggaguuacuuucuuugaagugagcccacucuguaacuucaauaucauugagaguuuuaccgaauuagcaaggaucguccugcuucggcaucgcuugaacuggcugggucgacccuccaaggugcuaucucuccaggaccugugcuguagaacaauuguaagcugcaccccuguucaccuuguggauaaacugccauugcccaucgcccucaggucccaucugaagucauucaguauggcuaaaggcuuaaaugcccggaugaugcgugggcugagcuacucucucacuacauccucaacccacaagcgcagcagucuuuguaaggucaaaauagugugcccuccacaaucuccgcccaagaacuguacgagaaauuccugcaaaauuagcuga

SEQ ID NO: 61507 - RNA, 837 nt, Artificial Sequence
  derived and/or modified sequence opt3 from RAB40B__Homo_sapiens__NP_006813
augagcgcccugggcucccccgugagggcuuacgacuuccuccuuaaguuucuguuggucggggauucugacguuggaaaaggugagaucuuagcaucacugcaggauggcgccgcggaaaguccuuaugggcacccagcuggaauugacuacaagaccacaacuauacuacucgauggcaggcgggugaaacugcaacuuugggacacgagcggucaggggcgcuucugcaccaucuuucgauccuauucucguggagcccagggcguaauucugguguacgauaucgcaaacagauggucguucgacggcauugauagguggaucaaggagauagacgaacaugccccggggguccccaaaaucuuggugggaaaucggcuccaccuggcuuuuaagcgccagguuccuacagagcaagcacaggccuaugcugaaagacugggugugacuuucuuugaggucucaccacucuguaacuucaauauuaccgagagcuuuacagaauuagccaggaucgugcugcuucggcauggcauggaucgcuuguggcgacccaguaagguacugucccuacaggaccucugcuguagagcgguugugucuugcaccccuguccaccugguggauaaacuuccacugcccauugcauugaggagccaucucaaguccuucucaauggccaacgggcugaaugcucggaugaugcacggaggcaguuacagcuuaacuacaucuuccacccacaaacguucaagccugcgcaaggugaaacucgucagaccuccacagaguccgcccaagaacuguacgagaaauucuugcaagaucuccuga

SEQ ID NO: 61508 - RNA, 846 nt, Artificial Sequence
  derived and/or modified sequence opt3 from RAB40C__Homo_sapiens__NP_001166136
augggcagccaggggucccccgugaagucuuacgacuaucugcucaaauuccuucuggucggagauucagacguugguaagggcgagaucuuggaaaguuuacaagauggggccgcugagagcccuuacgcauauuccaacggaauugacuacaaaaccacaacuauacugcuagauggcagaagggugaagcucgaacugugggacacgucuggucaggggcgguuuugcaccaucuuccgcucguauucacgaggagcccagggcauucuucugguauacgauaucacaaaucguuggagcuuugacggcauugauagauggaucaaagagauagacgaacacgcgccaggggugccgaggaucuuggucggaaaccggcuccaucuggcuuucaagcgccaggugcccacugagcaagccagagcauaugccgagaagaauuguaugaccuuuuucgaaguuaguccucugugcaacuuuaaugugauugaguccuucacagaacucucuaggaucgucuuaaugcggcacgguauggagaaaauuuggcgcccaaaccgaguguuuagccugcaggaucuuuguugcagagcuaucguauccuguacccccguucauuugauagacaagcugccucuaccagugacuauuaaaucacaccucaagaguuucagcauggcaaauggcaugaacgccgucaugaugcaugggaggucuuacucccuggcuucaggagccggcggugggggaagcaaaggcaauagucuuaagcggucuaaguccauccgucccccucagagcccaccgcagaacugcucgcgcucuaauuguaaaauuuccuga

SEQ ID NO: 61509 - RNA, 657 nt, Artificial Sequence
  derived and/or modified sequence opt3 from RAB4A__Homo_sapiens__NP_004569
augagccagaccgccauguccgagacauacgacuuccuguuuaaguuccucgugaucggcaacgcugggacuggaaaaucuugccuucugcaccaauuuauugaaaagaaauucaaggaugacucaaaucauacgauaggugucgaguuuggcaguaaaaucauuaacguugggggaaaguaugugaaguugcagaucugggauaccgcaggccaggaaagauucaggagcguaacacgguccuacuaucgcggugccgcgggggcuuuacugguguacgacauuacuucucgagagaccuauaaugcccuaacaaacuggcucaccgaugcacguaugcuggccucgcagaauaucgucauaauccuuuguggaaacaaaaaggaccuggaugcugacagagaagugacauuuuuggaggcaucaagguucgcccaagagaaugaacucauguuucuggagacuagcgcucugaccggcgaaaacguugaggaggccuucgugcagugcgcgcggaaaauucucaauaagaucgaaaguggcgaguuagaucccgaacgcaugggguccgguauucaguacggagacgcagcccugagacagcuuaggucuccucggcgcgcucaagccccaaacgcacaggaguguggcugcuga

SEQ ID NO: 61510 - RNA, 642 nt, Artificial Sequence
  derived and/or modified sequence opt3 from RAB4B__Homo_sapiens__NP_057238
auggccgagaccuacgacuuccuguuuaaguuccucgugaucggcagcgccgggacaggaaaauccugccuucugcaccaguuuauugaaaacaaguucaaacaagauucuaaucauacuauaggugucgaguuuggcucaagaguugugaacguagggggaaagacggugaaauugcagaucugggacaccgcaggccaggaaagguuccggagugucacacgcagcuauuaccgaggugccgcgggggcuuuacugguguaugauauuacuucccgugagaccuacaauucucuagccgcauggcucacagacgccagaacccuggcuucgcccaacaucguugugauucuuuguggaaauaagaaggaucuggacccugaaagggaggucacauuuuuggaggcaucacgguucgcccaggaaaacgagcucauguuucuggaaacuagcgcucugaccggcgagaauguggaggaagccuuccucaaaugcgcgcgcacgaucuuaaacaagauagauaguggcgagcuggacccagaaagaaugggguccggaauccaauauggugaugcaucucuuaggcaguugcggcagccgcgcagcgcccaggcuguagcuccccaaccuuguggcugcuga

SEQ ID NO: 61511 - RNA, 606 nt, Artificial Sequence
  derived and/or modified sequence opt3 from RAB5A__Homo_sapiens__NP_001278977
auggccagcagaggcgcuaccaggcccaacgggccuaauacaggaaacaagaucugccaguucaaacuggugcuccuuggugaguccgcagucggcaagucuucacugguuuugcgguuugugaaagggcaauuccacgaauuucaggagaguacuauuggaguaaaguucgaaauaugggacacggccggccaggagcgcuaccauagcuuagcgccaauguauuaccgaggugcucaggccgcaaucguggucuaugauauuaccaaugaagaguccuuugcccgugcuaaaaacugggugaaggagcugcaaagacaggcaucuccgaauaucguuauugcccuaucggggaacaaggcugaccucgccaauaaaagggcgguggauuuccaggaagcacagucauacgccgacgauaacagccugcuuuuuauggagacaagugcuaagacuuccaugaaugucaacgaaaucuucauggccauagcuaaaaagcugcccaaaaaugagccucaaaacccaggagcaaauucugcccggggccgcggcguggacuugaccgagcccacacagccuaccagaaaccaguguugcagcaauuga

SEQ ID NO: 61512 - RNA, 525 nt, Artificial Sequence
  derived and/or modified sequence opt3 from RAB5B__Homo_sapiens__NP_001238966
augaccagcagauccacagccaggcccaacggccagccucaggcuucuaagaucugccaauucaaacuggugcuccuuggggagucagcagucggaaagaguagccugguuuugcgguuugugaaaggucaguuccacgaauaccaggaguccacuauuggcgccgcguuuuuaacgcaaucuguaugucuggacgauaccacagugaaguucgaaauaugggacacugcugggcaggagcgcuaucauucgcuagccccaauguacuaucgaggagcacaggccgcuaucgucguguacgauauuaccaaucaggaagcacaagccuaugcugacgauaacucacuccuguuuauggagacaagcgccaaaaccgcgaugaauguuaacgaccuuuuccuggcaaucgccaagaaguugccgaaaagugagccccagaaucucggcggugcugccgggcguuccagaggaguggaucugcacgaacagucucagcaaaacaagagccagugcuguuccaauuga

SEQ ID NO: 61513 - RNA, 750 nt, Artificial Sequence
  derived and/or modified sequence opt3 from RAB5C__Homo_sapiens__NP_001238968
auggagcugagcuggagaucccccucuccucucucagccagucuucacagcaccuccccacauccgcacgcucuguggacaacuacggcaggcagggccauggcggggcggggaggugcugcccgccccaacggcccugcagccgggaauaagaucugccaguucaaauugguguuacugggagaaucugcugucggcaagucgagccuaguucuccgauuugugaaaggucaauuccaugaguaccaggaaucaaccauuggggcagccuuucugacacagacuguaugucuugacgauaccacagugaaguucgagauaugggacaccgcuggacaggaacguuaucacagucuggccccaauguacuauagaggcgcgcaagcagccaucgucguguacgauauuacuaacacagacaccuuugcuagggccaaaaauuggguuaaggaguugcagcggcaggcaucccccaacaucgugauugcucucgccggcaauaaggcggaucuggccucuaaacgcgcagucgaguuccaggaagcucaagccuaugcugacgauaacagccugcucuuuauggagacguccgccaagacugcaaugaaugugaacgaaaucuucauggccauagcuaaaaaguuaccuaaaaaugagccacagaacgcgaccggggcacccggaagaaauagggguguagaccugcaggagaacaauccugccucacggagucagugcuguagcaacuga

SEQ ID NO: 61514 - RNA, 315 nt, Artificial Sequence
  derived and/or modified sequence opt3 from RAB6A__Homo_sapiens__NP_001230647
augagcaccggcggggacuucggaaacccccugagaaaguuuaaacucguguuccuuggugagcaguccgucggcaagacaucucugaucacuagguuuauguacgauucauucgacaauacguaucaagccaccauugggauagacuuuuugaguaaaacaauguacuuagaagaucggacucuguuccgccgaguugcugcagcccuaccuggaauggagagcacccaggaucguuccagagaagacaugaucgauauuaagcucgagaaaccacaggaacagccggugucugagggcgguugcucguguuga

SEQ ID NO: 61515 - RNA, 627 nt, Artificial Sequence
  derived and/or modified sequence opt3 from RAB6B__Homo_sapiens__NP_057661
augagcgccggcggggacuucggaaacccccugagaaaguuuaaacucguguuccuuggugagcaguccgucggcaagaccucucugaucacaagguuuauguacgauucauucgacaauacuuaucaagcuacgauugggauagacuuuuugaguaaaaccauguacuuagaagaucggacaguucgccugcagcuaugggauacugcaggacaggagcgauuccguagccucaucccuuccuauauuagagacucuaccguggccguaguggucuacgauaucacaaaccugaauagcuuucagcaaaccucaaaguggauugacgaugugaggacugaacggggcagcgacguuaucauaaugcuuguggguaacaaaacagaucuggcggacaagcgccagaucaccauugaggaaggggagcagagagcuaaggaguugagugucauguucaucgaaacguccgccaaaacuggauauaaugugaagcagcucuuuaggcggguagcaucugcccugccaggcauggagaacguucaagaaaaaucgaaggagggcaugauugauaucaaacuggacaagccgcaggagcccccugcuuccgaagggggaugcucauguuga

SEQ ID NO: 61516 - RNA, 765 nt, Artificial Sequence
  derived and/or modified sequence opt3 from RAB6C__Homo_sapiens__NP_115520
augagcgccggcggggacuucggaaacccccugagaaaguuuaaacucguguuccuuggugagcaguccgucgcuaagaccucucugaucacaagguuucgguacgauucauucgacaauacuuaucaagcaauuauaggcaucgauuuucucaguaaaacgauguacuuagaagacgggaccauuggacugcgccuaugggauacagccggccaggagcgacuccguagccugaucccuagauauauuagggacuccgcggcugccguugugguauacgauaucacuaacgucaauucuuuccagcagaccacaaaguggauagacgaugugcggaccgaacgcgguucggacgugaucauuacucuuguugggaacagaacagaucuggcagacaaaaggcaagugucagucgaggaaggagagcggaaggccaagggcuugaaugugaccuuuaucgagacgcgcgcuaaagcaggcuauaacguaaagcaguuguuccgaagaguugccgcugcccugccagggauggaaagcacucaggauggaaguagggaggacauguccgacauuaaacuggaaaagccgcaggagcaaaccgugucugaggguggcugcagcuguuacucccccaugucaaguagcacacucccucagaaaccacccuauucuuuuaucgauugcuccgucaauauaggguuaaaccuguucccuucacuuauuacuuuuuguaauagcaguuugcugccagugucuuggcgguga

SEQ ID NO: 61517 - RNA, 624 nt, Artificial Sequence
  derived and/or modified sequence opt3 from RAB7A__Homo_sapiens__NP_004628
augaccagcagaaagaaagugcugcucaaggucaucauucuuggcgacuccgggguuggaaaaacaucucugaugaaccaguacgugaauaagaaauucucaaaccaauauaaggccacuauaggugcugacuuuuugacgaaggagguaaugguggaugauagguuagucaccaugcagaucugggacacagcaggccaggaacgguuccagagucuggggguggccuuuuaccgcggagcggauugcuguguucuaguguucgacgucacugcucccaauaccuuuaaaacacucgauagcuggcgagacgaguuccugauucaagccuccccucgugauccagaaaacuuuccguucgugguacuuggcaauaagaucgaccuggagaacagacagguugcaaccaaaagggcccaggcuuggugcuauucuaagaauaacauucccuacuuugaaacuucggcaaaagaggccaucaauguggagcaggcuuuccaaacaauagcccggaacgcguugaagcaggaaaccgaggucgaacucuauaaugaguuuccugagccaaucaagcuggauaaaaacgaccgcgcaaaggccucagcugaaagcuguaguugcuga

SEQ ID NO: 61518 - RNA, 624 nt, Artificial Sequence
  derived and/or modified sequence opt3 from RAB8A__Homo_sapiens__NP_005361
auggccaagaccuacgacuaucuguucaaacuccuucugaucggcgauaguggggugggaaagacaugcgucuuguuuagauucuccgaggacgcuuuuaacucuacuuucauuucaacgauagguaucgauuuuaaaauuaggaccaucgaauuagacggcaagcggauuaaacugcagaucugggauacagcagggcaagagcgcuuccgaacuauaaccacagccuacuaucguggagcgaugggcaucaugcuaguuuacgacauuaccaaugaaaagaguuuugauaacaucagaaauuggauuaggaacaucgaggaacacgcuagcgccgacguggagaagaugauacucgguaauaaaugugauguaaacgacaagcggcaaguguccaaagagcgcggggaaaagcuggcacuugauuauggaauuaaauucauggagacuucugccaaggcuaauaucaacgucgaaaaugcauuuuucacacuggccagagacauuaaggcuaaaauggauaagaaauuggagggcaacucgccccagggcucaaaucagggggugaagaucaccccugaccagcagaaaaggagcagcuuuuuccggugcguucuccuguga

SEQ ID NO: 61519 - RNA, 624 nt, Artificial Sequence
  derived and/or modified sequence opt3 from RAB8B__Homo_sapiens__NP_057614
auggccaagaccuacgacuaucuguucaaacuccuucugaucggcgauagcggggugggaaagacaugcuuguuauuuagauucuccgaggacgcuuuuaacacuacguucauuucuaccauagguaucgauuuuaaaauuaggacaaucgaacuggacggcaagaaaauuaagcuacagaucugggauacugcagggcaggagcgguuccgcaccauaacaaccgccuacuaucgaggagcgaugggcaucaugcucgucuacgacauuacuaaugaaaagucauuugauaacaucaaaaauuggauucguaacaucgaggaacacgcuaguagcgacguugagagaaugauacuggguaauaagugugauaugaacgacaaaaggcaaguguccaaggagcgcggggaaaaacuugccauugauuauggaaucaaguuccuggagacaucugcaaagucgucagccaauguagaagaggcauuuuucaccuuggcucgggacauuaugacgaaacucaacagaaagaugaaugauagcaacagugccggcgcuggcgggcccgugaaaaucacugagaauagguccaagaaaaccagcuuuuuccggugcucucugcuguga

SEQ ID NO: 61520 - RNA, 606 nt, Artificial Sequence
  derived and/or modified sequence opt3 from RAB9A__Homo_sapiens__NP_001182257
auggccggcaagagcucccuguucaaagugauccuccuuggggacggaggugucggcaagucuucacugaugaacagauacguuaccaauaaauuugauacacaguuguuccacacuauugggguggaguuuuuaaacaaggaccuggaaguagauggacauuucgugacgaugcaaauaugggacaccgcuggccaggagagguuucggagucuacgcacacccuucuaucgagguagcgauugcugucuccugacuuuuuccgucgacgauucucagucguuccagaaucuuucaaacuggaaaaaggaauuuaucuacuaugcagacgugaaggagccugagagcuucccauuuguuauucuggggaauaaaaucgauauuagugaacgucaaguguccaccgaggaagcccaggcguggugcagagacaacggagauuacccguauuucgagacaucugcuaaggacgccaccaaugucgcagccgcuuuugaagaggcagugaggcggguauuggccacugaggaucgcagcgaccaccucauccagacagacaccguuaaccugcauagaaaacccaagccuuccucaaguuguugcuga

SEQ ID NO: 61521 - RNA, 558 nt, Artificial Sequence
  derived and/or modified sequence opt3 from RABAC1__Homo_sapiens__NP_006414
auggccgcucagaaggaccaacagaaagaugcagaggccgaaggccugagcgggaccacacuccuucccaagcugaucccuuccggagcggguagagagugguuggaaaggcggcgcgcuacuauucgaccauggucuacguucguggaccagcagcguuuuucaagaccgaggaacuuaggcgagcugugccaacggcuaguccgcaauguugaauacuaucagaguaacuacguguucguauuucucgggcugauacuuuauuguguggucaccagccccaugcuguugguggcccucgcaguuuucuuuggagccugcuacauccuguaucugagaacacucgaguccaaauuagugcuguucggcagggaggucucuccugcucaccaguacgcacuugccggugggauuucguuuccauucuuuugguuggcuggagccggcucagcgguguucuggguacugggcgcaacucuaguugugaucgggagccaugccgcuuuucaccagauugaagccgucgauggagaggaacuccaaauggagcccguguga

SEQ ID NO: 61522 - RNA, 2490 nt, Artificial Sequence
  derived and/or modified sequence opt3 from RABEP1__Homo_sapiens__NP_001077054
auggcccagcccggcccugcuagccaaccagacgugucccugcagcagagagucgcagagcucgaaaagaucaacgccgaguuccuuagggcgcagcaacagcuggaacaggaguuuaaucagaaacgggcuaaguucaaagaauuguacuuagccaaggaggaggaucugaaacgccaaaacgcaguucuacaggccgcucaggacgaucucgggcaccuacgaacccagcuuugggaagcacaagccgagauggaaaauauuaaggcuauagccacagugucugagaacacuaagcaggaggcgaucgacgaaguaaaacgucaguggagagaggaaguggcaucacugcaagccgucaugaaggagacggugagggauuaugaacaucaguuucacuugcggcucgagcaggagcgcacccagugggcucaauacagagaaagugccgagagggaaauugcagaccugcggcgccgacugagcgagggacaggaagaggagaaucucgaaaacgagaugaaaaaggcucaggaagaugccgagaaauuaagauccguugugaugccgauggaaaaggagaucgcggcccugaaggacaaacuuacagaggcagaagauaagauuaaagaguuggaggcuucuaaggucaaagagcugaaucauuaucuagaggccgaaaagucgugcaggacugaccucgagauguacguggcuguacugaacacccagaaaucaguucuucaagaagaugccgagaagcugcggaaggaauugcacgaggugugucaucuccuggagcaggaacgucagcagcacaaucaauuaaaacacacauggcagaaggcaaacgaccaguuccuggagagccagcgccuccuuaugagagauaugcaaaggauggaaaucguccugaccagugagcaguugcgacagguggaagaacugaaaaagaaagaccaagaggacgaugaacagcagcggcugaauaagcgcaaggaccauaaaaaggccgauguggaggaagagauaaaaauccccgucguuugcgcucucacucaggaagaguccucugcgcaacugagcaacgaggaggaacaccuugacuccacaagagguucagugcauagucuggaugcaggcuugcuccugccuagcggggacccauuuucuaaguccgauaaugacauguucaaagauggauuaaggcgggcccagucaaccgacagccugggcacgagugguucucuacaguccaaggcucucggguauaacuacaaggccaaaagcgcaggaaaucuggaugaaucggacuuuggcccccuuguaggcgccgacucuguguccgagaacuucgauacugcuucauuggggagucugcagaugccuagcggauuuaugcucaccaaggaccaagagcgcgccauuaaagcaaugacaccagaacaggaggaaacugcgucccugcuuucuagcgucacccaggguauggagucagcuuaugugagucccuccggcuacagacugguuagcgaaacagaguggaacuugcuccagaaggaggugcacaaugccgggaacaaacugggaaggcguugugauaugugcucuaauuacgaaaagcaauuacagggcauccagauucaagaggcagaaacccgggaccaggucaagaaacugcagcuaaugcuccgacaggccaacgaucaacuggagaagacgaugaaagacaagcaggaacuugaggauuucaucaaacagucaagugaggacagcucccaccagauaucugcuuuggugcugagagcccaagcaucggaaauucuccuggaggaauuacagcagggucugagccaggcuaagagggauguacaagagcagauggccguucuuaugcagucccgcgaacaggugucagaggaguugguccggcuccaaaaagacaaugauagucugcaggggaagcauucucuacacgugagccugcagcaagcggaagacuuuauccucccugauacuacagaggcccugagagaacuugucuugaaguauagggaggacauuaucaacgugcgcaccgcugcagaccauguugaggaaaaacugaaggccgagaucuuauuccucaaagaacagauucaggcugagcagugucugaaggaaaaucuugaggagacucugcaauuggaaauagagaacugcaaagaagagaucgccuccauuucaagccucaaggcagaacuggagcgaaucaagguggagaaaggacaggcgacaguagaacagcuaauguuugaggaaaagaauaaagcccagcggcugcaaaccgagcucgaugucucugaacaggugcagcgugacuucguuaagcugucccagacgcuucaagugcaguuggagagaauaaggcaggcugauagucuggagcgcauucgggccaucuuaaacgacaccaaacucacagauaucaaucaacugccagaaacuuga

SEQ ID NO: 61523 - RNA, 1710 nt, Artificial Sequence
  derived and/or modified sequence opt3 from RABEP2__Homo_sapiens__NP_079092
auggccgcugcagcccccguggcggcugacgaugacgagagaaggcggcgcccuggcgccgcacuggaagauagccgaucccaggagggggccaacggagaagcugagucuggugaacucucacgucuuagagcagagcuggccggcgcuuuggccgagauggaaaccaugaaggcggucgcagagguuagugaaagcacaaaagccgaggcuguggccgcaguacaaaggcagugccaggaggaaguggcuuccuuacaggccauccugaaggacucuauuucgucauacgaggcgcaaauaacugcccuaaaacaggaacggcagcagcaacagcaggauugugaggaaaaggagcgcgagcucgggagacugaaacagcuucugagcagggcauauccauuggacagucucgaaaagcaaauggagaaggcucacgaagauuccgagaaacugcgggaaaucguccugccgauggagaaggagauugaagaacucaaagccaaguuacugcgcgcugaggagcuuauccaggaaauucagcgaagacccaggcaugccccuucuuugcacggaagcacggagcugcuaccacucucccgggaccccucaccuccacuggagccccuugaggagcugaguggcgauggugggccugcagccgaagccuucgcgcauaauugcgacgauagcgcaucuaucuccucauuuagcuugggaggcggcguggggaguucuuccagccucccacaaucgcgucagggacugucuccggagcaggaggaaaccgccuccuuaguuucaacagguacucuggugcccgagggcauauaccucccuccacccggguaucagcuugucccugacacccaaugggaacagcugcagacagagggacgccaguugcaaaaagaucuagaaagugugagcagagagagggacgagcugcaggaaggccuccggcgauccaacgaggacugugcuaagcagaugcagguacugcuugcccaaguucaaaauucugaacagcuguugcgcacccuccaggguacugugagccaggcacaggagagaguccagcugcaaauggccgaauuagugacaacccacaagugccugcaucacgaggugaaaaggcuaaacgaggaaaaucaggggcuccgggcugagcagcugccaucaagugcuccccagggaucccaacaggaacagggcgaggaagagagccuuccgucuucagucccugaguugcagcaacugcucuguugcacgcgccaggaagcaagagcgaggcugcaggcucaggagcacggcgccgaacgucuucggaucgagauuguuacucugcgagaggcauuggaagaggaaaccguggccagagcuagucucgaggggcaacugaggguacagcgcgaagagacagagguguuagaagccagccuguguucccuacggacugagauggaaagaguccagcaagagcagucuaaggcacagcuccccgaucugcuuucggaacagagggcuaaaguguugcgccugcaagccgagcucgagaccagcgaacagguucagcgagacuucgugcggcugucccaggcguuacaaguccgucuggagagaaucaggcaggccgaaacacuugaacaggugcgcucaauuauggaugaagcuccauugaccgacguacgggauaucaaggacacguga

SEQ ID NO: 61524 - RNA, 1119 nt, Artificial Sequence
  derived and/or modified sequence opt3 from RABEPK__Homo_sapiens__NP_001167623
augaagcagcugcccgugcucgagccuggcgacaaaccaagaaaggccaccugguacacacuuacugucccgggggauagccccugcgcuaggguuggacacuccuguucuuaucugccuccaguggguaacgcaaaacggggcaagguauucaucgucgggggagccaaucccaaccgcucauuuagugacgugcauacgauggauuugggcaaacaccaaugggacuuagauaccugcaagggucugcuaccucgauacgaacaugcgagcuucauuccauccuguacacccgaccguauauggguguuugggggagcuaaucagucuggcaacagaaauugccuccagguucugaacccugagacuaggaccuggacaaccccagaagugacuucgccgcccccuucaccacggacauuccacaccagcagugccgcaaucggcaaucagcuuuaugucuuugggggaggugagcgcggcgcccaacccgugcaggauacgaagcugcauguauucgacgcuaacacuuugaccuggucccagccugaaacacucgggaauccacccucuccgagacacggacacguuaugguggcagccggcacuaaacuguuuauucauggugggcuggcuggagauagguucuacgacgaucuccacuguaucgacauuagcgauaugaaguggcagaaauuaaacccuaccggcgccgcgcccgcaggcugcgccgcucauuccgccgucgcaauggggaagcacguguauaucuuuggagguaugacaccagcuggcgcccuggacaccauguaccaauaucacacggaggagcagcauuggacucuuuugaaauucgacacacugcuaccucccgggcggcucgaucacucaauguguauaaucccauggcccgugaccugcgcgagugaaaaggaggacagcaauucucugacucuuaaccaugaagccgagaaggaggauuccgcagacaaagucaugucacacagcggagauagucaugaagagucucagacagcuacccuguugugucucguuuuuggcgguaugaauacggaaggggagauuuacgacgauugcaucgugaccguaguggacuga

SEQ ID NO: 61525 - RNA, 219 nt, Artificial Sequence
  derived and/or modified sequence opt3 from RABGAP1L__Homo_sapiens__NP_001230692
augauggaggaaaucagcauuaugguggccuacgacgcucacgucuucucccagcugcaugaugaggacuuucucaccucucuuguugcaauaucaaagcccagaaguauggugccuacuaaaaagcugaaaaaguaugaaaaagaguaccaaacaaugagggaaagccaguugcagcaggaggauccaauggaccgguauaaguucguauacuuauga

SEQ ID NO: 61526 - RNA, 900 nt, Artificial Sequence
  derived and/or modified sequence opt3 from RABGEF1__Homo_sapiens__NP_001273989
augcagaccagaggcaaggugcccccugagagggucgagaaaaucauggaccaaauugaaaaguacauaaugacacggcuguauaaauacguuuucugcccagaaacuacggaugacgagaagaaagaucucgccauccagaagcgcauucgagcacuucguugggugaccccgcagaugcuguguguacccgugaacgaagacaucccugaggucagcgauauggugguuaaggcuauuacagacaucauagagauggauuccaaaagagugccaagggacaaguuggccugcaucacuaaauguucuaagcacauuuuuaaugcgaucaaaauuaccaagaacgaacccgcuucagccgaugacuucuuaccuacacugaucuauauaguccuaaaggggaauccaccccggcuccagaguaacauucaauacaucacccgcuuuugcaauccuagcagacugaugacuggagaggaugguuauuacuucacaaaccuuuguugcgcaguggccuuuauugaaaaacuggacgcucaguccuugaaucucucucaggaggauuucgacagguauaugucgggccagaccucaccacggaagcaagaggcagaaagcuggaguccggacgccugucuggggguaaaacagauguacaagaaccuggaucucuuaucccagcugaaugagcgccaggaacgaaucaugaacgaggcuaaaaaguuggaaaaagaccuuaucgauuggacggacggaauugccagagagguucaagauauaguggagaaguacccccuggaaaucaagccuccaaaucagccccuagcggcaauugacucugagaacgucgaaaaugauaaacucccuccaccccugcagccgcaaguguaugccggcuga

SEQ ID NO: 61527 - RNA, 372 nt, Artificial Sequence
  derived and/or modified sequence opt3 from RABIF__Homo_sapiens__NP_002862
auggagcccgccgaacagccuagcgagcugguguccgcugaaggcagaaacaggaaggcaguccucugccaacggugugggucucgcguucuucagccaggaaccgcccuguucucacgacgucaguuguuuuuaccgaguaugaggaaaaagcccgcgcugagcgacgguuccaauccugauggcgaccuacuccaggagcacuggcugguggaagauauguucaucuuugagaacguaggguucacaaaagacgugggaaauauuaaguuucuugucugcgcugauugugagauaggcccaaucgguuggcauugccuggacgauaaaaacucuuucuacguggccuuggaaagaguuucgcacgaguga

SEQ ID NO: 61528 - RNA, 2193 nt, Artificial Sequence
  derived and/or modified sequence opt3 from RABL6__Homo_sapiens__NP_001167459
auguucagcgcccugaagaaacucgugggcuccgaccaggcucccgggagagauaagaacaucccugcaggacuucaaucuaugaaucaggcccugcagaggcgguuugcgaaagguguccaguacaacaugaagauuguuauacgcggcgaccgaaauaccgggaaaacagcuuuguggcaccguuuacaaggaagaccauucguggaggaauauaucccgacucaggagauucagguaacgucaauccauuggaguuacaagaccacagaugacauugugaaggucgaagugugggauguuguggacaaaggcaagugcaaaaagaggggugaugggcugaaaauggagaacgacccccaggaagccgagagcgagauggcacuagaugccgaauuucucgacgucuauaagaauuguaacggagugguaaugauguucgauaucacuaagcaauggaccuuuaauuacauacugcgggagcuuccuaaaguuccaacacacgugcccgucugcgugcugggcaacuaucgcgacaugggcgaacauagagugaucuugccugaugacgucagggacuucauugauaaucucgacucccggccacccgggucuucguacuuucgcuaugcugagucaagcaugaagaacaguuucggacugaaauaccugcacaaguuuuucaauaucccuuuucuccaguuacagcgagagacccugcuuagacaguuggaaacuaaccaacuggauauggacgcaacacuagaggaacucuccguucagcaggagaccgaagaucaaaauuacgguauuuuccuggagaugauggaggccaggucucggggccaugcuagcccacuugccgcgaacgggcaguccccgucacccggaagucagagcccugugguaccagcaggcgccgugucuacggguuccucaagccccgggacuccucagccagcuccccaacugccguugaaugccgcaccucccaguucugucccaccugugcccccauccgaagcucucccuccuccagccuguccgagcgcgcccgccccucgucgcucgaucauaucuagacuguuuggaaccuccccagcaacagaggcugcacccccuccacccgaaccgguuccugcugccgagggcccagcaacugugcagucagucgaagacuucgugcccgaugacagguuagaucggaguuuccuggaggacaccacacccgcccgagaugagaaaaagguaggcgcuaaagcggcacagcaggacagcgacuccgauggggaagcccucggagguaaccccaugguugcuggcuuucaagacgauguggaccuugaggaucagccacgcgggucuccuccccugccagccggaccggucccuagccaggacauuaccuugucaagugaagaggaagcagagguggccgcucccacgaagggcccagcccccgcaccucagcaaugcuccgagccagaaacuaaguggagcucuauccccgcgucaaaaccuagaagggguacagcuccgacccggacugccgcaccacccuggccugggggcgucagugugcgcacaggaccagagaagagaagcuccaccaggcccccugccgaaauggagccgggcaaaggggagcaggcuucuucgagcgaauccgaucccgagggaccaauugccgcacagaugcuaucauucguuauggacgauccugacuuugaaagugaggguucugauacgcagcgucgggcugacgauuuccccgugcgagacgacccaagcgauguaaccgacgaagaugagggcccugccgagcccccaccgccucccaagcugccacuccccgcguuuagacugaaaaacgacuccgaucuuuucgggcugggauuggaagaggccggcccuaaggaaucaagcgaggaagguaaggaggggaaaacaccaucuaaggagaaaaagaaaaagaagaaaaagggcaaagaagaggaagagaaggcugccaaaaagaaguccaaacacaagaaaaguaaggacaaagaagagggaaaggaggaaaggcgccggagacaacagaggcccccucgcagccgagagcggacugccgcugaugaacucgaggccuuucugggcgggggagcaccggguggccgucacccagggggaggcgacuaugaggaauuauga

SEQ ID NO: 61529 - RNA, 579 nt, Artificial Sequence
  derived and/or modified sequence opt3 from RAC1__Homo_sapiens__NP_008839
augcaggccaucaagugcguggucguuggcgacggggcugugggaaaaaccugucugcucauuagcuacacaacuaacgcauuccccggugaguauauaccuacgguauuugauaauuacuccgccaacgugauggucgacggcaagccagugaaucuugggcugugggauaccgcgggacaagaagacuaugauagauugaggccguuaucuuacccccagacagacguuuuccugaucugcuuuucacucgugaguccugcuagcuucgagaacguccgggccaaaugguauccagaagugcgccaccauugucccaauacuccuauuauccuaguaggcaccaagcuggaucuucgagacgauaaagacacaauugagaagcugaaggagaaaaaguugaccccaaucacuuacccccagggucucgcaauggccaaagaaauaggggcuguuaaguaucuggagugcuccgcacugacacagcguggacucaaaaccguguuugaugaagccaucagagcugucuuauguccuccaccggugaagaagaggaaacggaagugccugcuuuuguga

SEQ ID NO: 61530 - RNA, 579 nt, Artificial Sequence
  derived and/or modified sequence opt3 from RAC2__Homo_sapiens__NP_002863
augcaggccaucaagugcguggucguuggcgacggggcugugggaaaaaccugucugcucauuagcuacacaacuaacgcauuccccggugaguauauaccuacgguauuugauaauuacuccgccaacgugauggucgacucuaagccagugaaucuuggccugugggauaccgcggggcaagaagacuaugauagauugaggccguuaucauacccccagacagacguuuuccugaucugcuuuagucuagugagcccugcuuccuaugagaacguccgggccaaaugguucccagaagugcgccaccauugucccucuacuccuauuauccucguaggaaccaagcuggaucuucgagacgauaaagacacaauugagaagcugaaggagaaaaaguuggcaccaaucaccuacccccagggccucgcccuggcuaaagaaauagauucgguuaaguaucuggagugcucagcacucacucagcgugguuuaaaaacaguguuugacgaagccaucagagcuguccuguguccucaaccaaccaggcagcagaagcgggccugcagccuuuuguga

SEQ ID NO: 61531 - RNA, 579 nt, Artificial Sequence
  derived and/or modified sequence opt3 from RAC3__Homo_sapiens__NP_005043
augcaggccaucaagugcguggucguuggcgacggggcugugggaaaaaccugucugcucauuagcuacacaacuaacgcauuccccggugaguauauaccuacgguauuugauaauuacuccgccaacgugauggucgacggcaagccagugaaucuugggcugugggauaccgcgggacaagaagacuaugauagauugaggccguuaucuuacccccagacagacguuuuccugaucugcuuuucacuugugaguccugcuagcuucgagaacguccgggccaaaugguauccagaagugcgccaccauuguccccacacuccuauucuccugguaggcaccaagcuagaucugcgagacgauaaagacacaaucgagcguuugagagauaagaagcucgcaccaauuaccuacccccagggucuggccauggcuagggaaaucggguccguuaaauaucuggagugcucugcacucacucagcggggauuaaagacaguguuugacgaggccauacgcgcuguccuguguccuccaccggugaaaaagcccggcaaaaagugcaccguguucuga

SEQ ID NO: 61532 - RNA, 1935 nt, Artificial Sequence
  derived and/or modified sequence opt3 from RACGAP1__Homo_sapiens__NP_001306935
augagcugccccuguuucugcccuguggcccugagaauggacaccaugaugcucaacgucaggaaucuuuuugagcagcugguucggcgcguggaaaucuuguccgagggcaacgaaguacaauucauucaguuagcuaaggauuuugaggacuuccgaaagaaguggcagcguacagaucacgaacuggggaaauacaaggaccuacucaugaaagcagagacugagagaucugcccuggaugugaaacuuaagcaugcgaggaaucaggucgacguggaaauaaaacggcgccaaagagcugaggccgauugugaaaagcuggagaggcagauccaguugauucgggagaugcucaugugcgacacgucaggaaguauccagcugagcgaggagcaaaaauccgcacuggccuuucucaaccgcggucagccaucuucgucaaaugcuggcaacaagcgauuaagcaccauugaugaaaguggguccauccugucugacauauccuucgauaaaacagacgagucccuugauugggacucaaguuugguuaagacuuuuaagcugaaaaagagagagaaaaggcggagcaccucucgucaguucguggacggaccgcccggcccugucaagaaaacacgcuccaucgguucagcaguggaucaggggaaugaaagcauuguagccaagaccacuguuacagugccaaacgacggaggccccaucgaggcugucaguaccauugaaacggugccuuauuggacuagaucuaggcggaaaaccggcacacuacaaccauggaauagcgauagcacucucaacucgcgacagcuggagccccgcaccgaaacagacucuguggggaccccucaguccaauggagguaugagacuucacgauuuugucucaaagacgguuaucaagccagagaguugugugccgugcggcaaaaggauaaaguucgggaaacugagcuugaagugucgggacugccgcguagugucccaucccgaauguagagauaggugcccucucccauguauucccacucugaucggaacaccugucaaaauuggcgaggguauguuagccgacuuugugucucaaaccagcccaaugauccccucaaucguugugcacugcgucaacgagauugaacagcgugggcugacugagacaggacucuaccggauaaguggcugcgaucgaaccgugaaggaacuuaaggagaaauuccugagaguaaagacgguuccguugcuauccaaaguggacgauauccaugcgauuuguagccugcucaaggacuuucugaggaaucuuaaagaaccucuguugaccuuccgccucaaccgggcauucauggaggccgcugagaucacagacgaagauaauucuauagccgcaauguaucaggcugucggcgagcugccccaggccaacagagacacuuuagcguuucugaugauucaccuacaaaggguggcccagucaccacacaccaagauggaugucgcaaaccucgcuaagguguucgggccuacaaucguugcccaugcugugcccaauccagaccccguaacuaugcugcaggauaucaaacgccagccuaaggucguggaacgacuuuugagucugccacucgaguacuggagccaauuuaugaugguugagcaggaaaacauugacccgcugcacgugaucgaaaauuccaacgccuucucuacaccccagaccccugauauuaaagucucgcuucugggaccagugaccacucccgaacaucaguugcucaagacgccuagcuccucaagucugucucaacggguacguagcacauuaaccaaaaauacuccaagauuugguuccaagucaaagagcgcaaccaaccugggcaggcaggggaauuucuuugccucucccaugcuaaaauga

SEQ ID NO: 61533 - RNA, 2046 nt, Artificial Sequence
  derived and/or modified sequence opt3 from RAD17__Homo_sapiens__NP_579917
augagcaagaccuuccugagacccaaaguguccucuacaaaggucacugacuggguugauccuucauuugacgauuuccucgagugcaguggcgugagcacgaucaccgccacaucccuugggguaaacaauucuucgcacaggcggaaaaacggaccaucaacucuggaaagcagucgcuuuccggcucgaaagcgugguaauuuguccucuuuagagcagauuuacggccuggaaaacagcaaagaguaucuauccgaaaaugagcccuggguggacaaguacaagccugagacccaacaugaacucgcaguccacaaaaagaaaauagaggaaguggagacauggcugaaggcccagguucuugagagacagccaaaacaagggggaucaauccuguugauuaccggacccccugguugugggaagacuacaacccucaagauccugaguaaagaacauggcauucaggugcaggaguggaucaacccaguccugcccgauuuccagaaggacgauuuuaaaggcauguucaauacggaaagcucuuuucacauguucccuuaucagucccaaauagcgguguuuaaggaguuccucuuaagggcuacuaaauacaacaagcugcagaugcuuggcgacgauuugcggaccgacaaaaagaucauucugguagaagaucuaccaaaucaguuuuaucgcgacucacauacacuccacgagguucugagaaaguacgugaggaucgggcggugcccgcuuauuuucaucauaagcgauagucugucuggagacaacaaucagcgcuugcucuuucccaaagagauucaagaagaguguuccaucagcaacauuucguucaauccugucgccccaacuaucaugaugaaguuccugaaccgaaucgugaccauugaagcaaauaaaaacgguggcaagauaacagugcccgacaaaaccucuuuagagcugcucugccagggguguuccggagauaucagaucagccauuaacagucuucaguuuagcuccucuaagggcgaaaauaaccugaggccucggaagaaagguaugagcuugaagucagacgcuguccuaaguaaauccaagcgucgcaaaaagccagauagaguuuucgagaaucaagaggugcaggcaaucgggggaaaggacguaagccuguuucucuucagggcccugggcaaaauacuuuauugcaagcgggcuucucugacggaauuggauucaccccgacucccgagucaccugagcgaguacgaacgcgacacuuuacugguggagccugaagaggucguggagaugucccauaugcccggcgaucuauuuaaccucuaccugcaccagaauuauauugacuucuuuauggaaaucgaugacaucguuagagccucugaguuccuuucguuugcggauauuuugagcggggacuggaacacaaggucccugcuccgggaauacucaaccaguaucgcaacucgcggagugaugcauucuaauaaagccagagguuaugcucacugucagggcgggggaagcuccuucaggccacugcacaagccucaaugguuucuuauuaacaaaaaguaccgugagaauugccuggccgcaaaggcuuuguuccccgacuuuugucucccagcccugugcuuacagacacagcugcuacccuaucucgcgcugcuuaccauaccuaugcggaaccaggcccaaaucucauucauucaggauaucggccgauugccacugaaaagacauuucgguaggcucaagauggaggcacugacggaccgcgaacacgggaugaucgauccggacagcggcgaugaggcucaguuaaauggaggccauucugccgaagagucccugggggaacccacccaggcuacagucccugagacuuggagucuuccauugagccaaaacucugccuccgagcuccccgcaucacagccucagccauuuagugcccagggagacauggaagagaauauuauaaucgaagauuacgagagcgacgguaccuga

SEQ ID NO: 61534 - RNA, 1488 nt, Artificial Sequence
  derived and/or modified sequence opt3 from RAD18__Homo_sapiens__NP_064550
auggacagccuggccgaguccagauggcccccuggccucgcugugaugaagaccaucgaugaccuucugaggugcgggauuuguuucgaauacuuuaacauagcaaugaucauuccacagugcucucacaauuauuguucauugugcauccggaaauucuuaaguuacaagacacaauguccgacuugcugugucacgguuaccgagcccgaucugaaaaacaaucgcauucuagacgaacucgugaagagucugaacuuugcccgaaaucaucuucugcaguucgcguuggaguccccugcuaaaucuccagccucgucaagcaguaagaaccucgcaguaaagguguauacacccgucgccucccgucagucucugaaacagggaagcagacugauggauaauuuucucaucagggaaauguccgguucaacuagcgaguuacugauaaaggagaacaaaagcaaguucucuccucaaaaagaagcuagcccagcagccaagaccaaggagacacggucaguggaagagaucgcucccgacccuagcgaggccaaacgcccagaaccgcccaguaccucuacucuuaagcagguuacaaaaguggauugcccugucuguggcgugaauauuccagagucccacaucaacaagcauuuggacagcugccugucgagagaagagaaaaaggaaucucuaagguccucaguacacaaacggaagccccucccuaagaccguuuacaaucugcuuagugaucgcgaccugaaaaagaaauugaaggagcaugggcucagcauucagggaaacaaacagcaacugaucaagcgacaccaggaguuugugcacauguauaaugcgcagugugaugcauuacauccaaaguccgccgcugaaauagucagagagauugaaaacaucgagaaaacgaggaugcggcuggaagccucuaagcucaaugagagcgugaugguguucacuaaagaccagaccgagaaggaaauugaugagauccacucaaaauaccguaagaagcauaaaagugaauuucaacuucuggucgaccaggcacgcaagggcuauaaaaagaucgcugguaugucccagaaaacaguuacuauuaccaaggaggacgaaagcacagagaaguugucuucagugugcauggggcaagaggauaacaugaccaguguaacgaaccacuucagccaguccaaacuagacucucccgaggaacuggaaccggauagagaggaggacucgagcuccugcauagauauccaggaagugcucucaaguucugagagcgacuccuguaauucauccucuuccgauauuaucagggaccugcuugaagaggaagaggccugggaggcgagucacaagaacgaucugcaggacacugaaauaagcccucggcaaaaucgacgcacaagagccgcagagucugcugaaauugagcccaggaacaaacggaaucgcaacuga

SEQ ID NO: 61535 - RNA, 849 nt, Artificial Sequence
  derived and/or modified sequence opt3 from RAD1__Homo_sapiens__NP_002844
augccccugcucacccagcaaauccaggacgaggaugaccaguacagccuuguggccucccuggauaacgucagaaauuugucuacaauuuuaaaggcuauacacuucagggaacaugcaacuugcuuugccacgaaaaacggcaucaagguuaccguggagaaugcgaaauguguacaggcuaacgccuucauucaagcagggaucuuucaggaguucaaggugcaggaagaaucagucacauuucggauuaaucugacugugcuacucgacugccugaguaucuucggaagcuccccuaugccagguacccuuacagcccugcgcauguguuaucagggcuacggguauccguugaugcucuuucuggaggagggaggcguugugaccgucugcaaaauaaacacucaagaacccgaggaaacacuggauuucgacuuuuguucuaccaaugugaucaacaagauuauccuccagucggaggguuuacgagaggcuuucucagaacuggauaugacgagcgagguacuucagauuacuaugaguccugacaagccauacuuucguuuguccaccuucgggaaugcaggaucuagccaccuggauuaucccaaagacuccgaucuaauggaagccuuucauugcaaccagacacaaguuaauagauacaagaucucacuccugaaaccuaguacuaaggcucuugugcugagcuguaaagucucuauaaggaccgacaaccggggcuucuugucccuccaguauaugauucgcaaugaggauggccagaucugcuucguggaauacuacuguugcccagacgaggaggugcccgaaucagagagcuga

SEQ ID NO: 61536 - RNA, 1896 nt, Artificial Sequence
  derived and/or modified sequence opt3 from RAD21__Homo_sapiens__NP_006256
auguucuacgcccacuuugugcugagcaagagaggcccccucgcuaaaaucuggcuugcagcccauugggacaagaaacugaccaaggcgcacgucuucgagugcaacuuggaauccucuguugagucaauuauaaguccuaaagugaagauggcuuuaaggacaagcgggcaucugcuacucggaguagugcggaucuaucaccgcaaggccaaauaccugcuugcagauuguaaugaagccuuuauuaagaucaaaauggcuuuccgaccaggugucguggaccugccggaggaaaaccgugaggcagccuauaaugcuauuacuuugcccgaggaauuucaugauuucgaccagccucucccagaucuggacgauaucgacguugcccaacaguuuucccugaaccagucuagaguggaggaaauaacgaugagggaggaggucggcaauaucucgauucuccaggaaaacgauuucggggacuuuggaauggaugaccgggagaucaugcgcgaaggcucagcguucgaggaugacgacauguuagugagcaccacaacuucgaaucugcuuuuggaauccgagcaaucuaccagcaaccugaaugagaagauuaaccaccuagaauacgaggaucaguauaaagacgauaauuuuggugaagggaacgacggaggcauccucgaugacaagcugauauccaauaacgauggcgggauuuucgacgaucccccugcacuuucagaggccggaguaaugcugccagaacagcccgcucacgacgauauggacgaggacgauaauguuaguauggguggcccugacagcccagauucuguggacccggucgagcccaugccuacaaugaccgaucagacuacauuggugccaaacgaagaggaagccuuugcacucgagcccaucgacauuaccgugaaggaaacgaaagcuaagagaaaaaggaagcugaucgucgauuccguuaaagaguuagacucaaagacuauccgggcccaacugagcgauuacagugacauugugaccacacucgaucuugcgccuccaacuaaaaagcugaugauguggaaggagaccgggggaguagaaaaauuguucucucuacccgcccagccgcuguggaacaaucgccuccugaaacuuuucacacgaugccugaccccuuuggugcccgaggaccucagaaagaggcggaagggcggugaagcagauaaccuggacgaguuuuuaaaagaguucgaaaauccagaggucccucgugaagaccagcagcaacagcaucagcaacgcgaugugauagacgagcccaucauugaagaaccauccagacugcaggagagcguuauggaagcuaguaggacgaacaucgaugagucugccaugcccccuccaccgccccagggggugaagcggaaggcuggacagauagacccugaaccagucaugcccccucaacagguggagcagauggaaauuccacccguagagcuaccgccugaggaaccacccaauaucugucagcucaucccugagcuggaacuuuugcccgagaaagaaaaggagaaagagaaggaaaaagaggaugacgaagaggaggaagaugaggacgccuccggcggcgaucaagaccaggaggagcgacgcuggaacaagagaacucagcagaugcugcacgggcuccaaagggcacuggccaagacaggagcugaaucaauuagucuucuggaguugugccggaauaccaaccgcaaacaggcggcagccaaguuuuauagcuuccucguucugaaaaagcagcaggcuaucgaguuaacucaagaggaaccauacuccgauauuauagccacaccuggucccagauuucauaucauuuga

SEQ ID NO: 61537 - RNA, 1671 nt, Artificial Sequence
  derived and/or modified sequence opt3 from RAD21L1__Homo_sapiens__NP_001130038
auguucuacacccacgugcugaugagcaagagaggcccccucgccaaaaucuggcuugcugcacauugggagaagaaacugacaaaggcccacgucuuugaaugcaacuuggagauuacuauagagaaaaucuuauccccuaagguuaagauugcgcugaggacgucugggcaucuacuccugggagugguacggaucuauaaucgcaaagcuaaguaccuucuggccgacuguucagaagcauucuugaaaaugaagaugaccuuuugcccaggucucguggaucugccgaaagaaaacuucgaggccaguuauaaugcuauuacacugcccgaggaauuucacgacuucgauacucagaacaugaaugcaaucgacgucagcgagcauuuuacccaaaaccagucccgaccugaagagauaacacuccgugagaauuucgauaacgacuuaaucuuucaggccgaaucuuucggcgaggaaucggagauucugagaaggcacucauuuuucgaugacaauauccuuuugaacagcagugggccacugauugaacacuccucuggaagccuaaccggcgagcggucccucuuuuacgauucaggugacggguucggagaugagggcgcugccggcgaaaugaucgacaaucugcuucaggaugaccaaaacauacuguuggaggacaugcaucucaaucgcgaaauuagucugcccagcgagccuccaaacucuuuagcgguggaacccgauaauuccgaguguaucugcguuccugagaacgaaaagaugaacgagacuauucugcucucaacagaagaggaaggguucacccuugacccaaucgauaucagcgacauugcagagaagagaaaaggaaagaaaaggcggcuguugauagauccgaucaaggagcuaaguucuaaagugauucacaagcagcugacguccuuugccgacacucucaugguccuggaacuugcucccccuacccagcgccugaugauguggaaaaagcgagguggcgugcauacauugcucagcacugccgcacaggaucugauccacgcugaguuaaagaugcuguucaccaaauguuuucuaucgucuggguucaagcucggaagaaaaaugauacaaaaggaauccguaagggaggagguuggcaaucagaacauuguggaaacaucaaugaugcaggagccaaauuaucagcaagaacugaguaaaccccagaccuggaaggacgucaucggugggagccagcacuccucucaugaggauacgaacaagaauaucaacagcgaacaagacauuguggagauggugucacuugccgcggaggaaaguuccuugaugaaugaucuguuugcccaggagaucgaauacagcccugucgagcucgaaucucugucaaacgaggagaauauugaaacugagcgguggaacggacguauacuucagaugcugaaucgcuugagagaaaguaacaaaaugggcaugcagagcuucucccucaugaagcugugcaggaacucugaccggaaacaagcagcugccaaguuuuauucguucuuaguucugaaaaagcagcuagcuaucgagcucagccaguccgccccauacgcagacauuaucgccacaaugggccccauguuuuacaauaucuga

SEQ ID NO: 61538 - RNA, 927 nt, Artificial Sequence
  derived and/or modified sequence opt3 from RAD23A__Homo_sapiens__NP_001257292
auggccgugaccaucacacugaagacucuccagcaacagacguucaaaauuaggauggagcccgacgaaaccgucaagguucuuaaagagaagauagaagcugagaaaggcagggaugcauuuccuguggccgggcagaagcugaucuacgcgggaaagauuuugagcgacgauguaccaauccgggacuaucgcauugaugagaaaaacuucguggucgugaugguuacaaagacuaaagcuggucagggcaccuccgccccgcccgaagcaucuccuacagccgcuccagagucaaguaccagcuuucccccugcaccaacuuccgggaugucucaucccccuccagccgcucgagaagacaagucgccgucagaggaaagcgcccccacaaccaguccugaguccgugucuggaagcgucccauccucaggcaguagcggucgugaggaagaugcggcaucuacguuagugacuggguccgaguacgaaaccaugcugacagagaucaugucaaugggauaugaaagagagaggguaguugccgcucuacgggccagcuacaauaacccccaccgcgcaguggaguaucuccugacuggcauaccuggcaguccagaacccgagcacgggucuguccaagaaucccaggugagcgagcagccggcuaccgaagccgcgggagagaauccucuugaguuccugagagaccagccccaauuucagaacaugagacaggugauccagcaaaauccagccuugcucccugcacugcugcagcagcucggucaagaaaacccccaguuacugcagcuuaaagccuugggcuucccagagucgcuggucauucaggcuuacuuugcuugcgaaaagaaugagaaccuagccgcaaauuuccuccugucucaaaacuuugaugacgaauga

SEQ ID NO: 61539 - RNA, 1167 nt, Artificial Sequence
  derived and/or modified sequence opt3 from RAD23B__Homo_sapiens__NP_001231642
auggugaaggcccugaaagagaagaucgaaagcgagaaaggcaaggacgcuuuccccgucgcagggcagaaacucauuuacgccggaaagauacuuaacgaugacaccgcgcugaaggaauauaaaaucgaugagaagaauuuuguugugguaauggugacaaaaccuaaggcugucuccacuccagccccggcaacgacccaacagucugcccccgcuucaacaacugcagugaccaguagcacaaccacuacaguugcccaggcuccuaccccagugcccgccuuggcgccuacguccacuccagcaucuauuacccccgccucggcuacagccucaagcgaaccugcaccagcuagugccgcgaaacaggagaagccggccgagaagcccgcagaaacuccugucgcuaccuccccaacagccaccgacucuacgagcggugauuccucaagaaguaacuuauucgaggacgcuacuagcgcccuggugacaggccaaucuuacgaaaauaugguaaccgagaucauguccaugggguaugagagggaacagguuauugcagcccuacgggcuucauuuaacaaucccgaucgcgcgguggaguaccuccugaugggaaucccuggcgaccgagaaagccaggcagucguggauccaccccaggccgcuaguacuggugccccgcaaucuuccgcaguggccgcugccgcagcgacaaccacggcuaccacaacuaccacaagcucugggggacacccucuugaguuccugcguaaccagccccaguuucagcaaaugagacagauaauccagcaaaauccaucguugcucccugcccugcugcagcagauuggcagggaaaacccccagcucuuacaacagaucucccagcaucaggagcacuucauucaaaugcugaaugagccaguccaggaagcaggcgggcagggagguggcgggggaggcgguucagggggaaucgccgaggcuggcaguggccauaugaacuauauacagguuacuccccaagaaaaagaggccauugaacggcuuaaggcauugggguuuccugagggacuggugauccaggcuuacuucgccugcgagaaaaaugaaaaccuagcggccaauuuucuccugcagcagaacuucgacgaggauuga

SEQ ID NO: 61540 - RNA, 3939 nt, Artificial Sequence
  derived and/or modified sequence opt3 from RAD50__Homo_sapiens__NP_005723
augagcagaaucgagaagauguccauucugggcgugaggucuuucgggauagaagacaaagauaagcagaucauuaccuuuuucucaccccucacaauccuugucggaccuaacggugccggcaaaacuacgauuaucgagugccugaaguacauauguaccggggacuuuccaccgggaacaaaaggcaauacuuucguucacgaucccaagguggcucaagaaaccgacguacgggcacagauccgcuugcaguuucgagaugugaacggugaguuaauugccguccagcguaguauggugugcacacaaaagagcaaaaagaccgaguucaaaacucuggaggggguuaucacaagaaccaagcauggagagaaagugucccuaucuucgaagugugcggaaauugacagggagaugaucucaagccucggcgucaguaaggcugugcugaauaacguaauauuuugccaccaggaagauuccaauuggccucuuucugagggcaaagcccugaagcagaaauucgacgagauuuuuagcgcaacgcgguauaucaaggccuuggaaacucuccgccagguuagacaaacccaggggcagaaagugaaggaguaccagauggaacugaaauaucugaagcaauacaaggagaaggcuugugaaauuagggaucagaucacauccaaggaggcacagcucacuucaaguaaagagaucgucaagagcuaugaaaacgaguuagacccacugaaaaaucggcuuaaggaaauugagcauaacuugucuaagauaaugaaacuggauaaugaaaucaaggcccuagacucccgcaaaaagcaaauggagaaagauaacucagagcucgaagagaagauggaaaagguguuccagggaaccgacgagcagcugaaugaccuuuaccacaaccaucagcgaacagugagagaaaaagagaggaagcuggucgauugccaccgggaguuggaaaaacucaauaaggagagccgucuguuaaaccaagagaaaagugaacugcucguugagcagggucgccuucagcugcaggcugacagacaccaagaacauauuagggcccgggauucuuugauccagucccuagcgacccagcuggagcucgacggcuuugaacgagggcccuucagcgagcgccagauaaagaauuuucacaagcuggugagagaaaggcaagagggagaggcaaaaacggccaaccagcuuaugaacgauuucgcugaaaaggagacucugaaacagaagcagauugacgaaauccgggauaaaaagacaggcuugggucgcaucauugagcucaaaucggaaauccugucuaagaagcaaaaugagcucaaaaacguaaaguaugagcugcagcagcuagaaggguccucagacagaauuuuagagcuggaucaagaacuuauaaaagccgagagggaauugaguaaggcagagaaaaauagcaacguggagacccugaagauggaagucaucucccuccagaaugagaaggcugaccuggaucguacucuucggaaacuggaccaggaaauggagcaguugaaccaucacacaaccacgcgaacccaaauggagaugcucacaaaggacaaagccgauaaggacgaacagauuagaaaaaucaagucuaggcacagcgaugagcugacuucauuacugggauacuucccuaauaagaaacagcuagaagacuggcuccauaguaaguccaaagagaucaaccagacccgcgaucggcuggcgaaacuuaauaaagaauuggccagcucugagcaaaacaagaaucacauuaacaaugagcugaagagaaaagaagaacagcucucaaguuacgaagacaagcuguuugauguguguggcagccaggacuucgaguccgauuuagacaggcugaaagaagagauagagaagucuucgaaacagcgcgcaaugcuugcuggcgccacagcuguuuauagccaauuuaucacucaguugaccgaugaaaaccaguccugcuguccagugugccaacgagucuuccagacagaggccgaacuccaggaggugauuucagaccugcagaguaagcuacggcuggcacccgauaaacucaagucuaccgaaagcgagcugaagaaaaaggagaaacguagagacgaaaugcuuggguugguaccuaugaggcaauccaucauugaccugaaggagaaagaaaucccagaguuacgcaauaagcuccagaacguuaaccgggauauacagagacugaagaaugacaucgaggaacaggagacucuucugggaacgauuaugccggaagaggaaucagccaaaguguguuugacagaugucaccaucauggagagguuucaaauggagcucaaggacguggaacgaaaaauugcucagcaggcggcaaagcugcaggguaucgaucuagaccgcacuguccaacaggugaaccaggagaaacaggaaaagcaacauaagcuggauaccguuagcucuaaaauagagcucaaucggaagcugauucaggaccagcaagaacagauccagcaccuuaaauccacaaccaacgaguugaagagugagaaacugcagauuagcacuaauuuacaaagaaggcagcagcucgaggaacagacaguggaacugucuacggagguacaaucccuuuaccgugaaaucaaggaugccaaggagcaggucucaccccuggagaccacucuagaaaaauuccagcaggagaaggaggaacucauaaacaaaaagaauacaaguaacaaaaucgcucaagacaagcugaaugauauuaaggagaaagugaagaacauccauggcuauaugaaagacauugaaaauuacauccaggaugggaaggacgacuauaaaaagcagaaagagaccgaauugaacaagguuauagcccaacugagcgagugcgaaaagcacaaagagaagauuaaugaggauaugcgcuuaaugcggcaggacaucgauacacagaaaauccaggaaagauggcuccaagacaaccugacucuuaggaagcgaaaugaggaacugaaagagguggaagaggagcggaagcagcacuugaaggaaaugggacagaugcagguccuccaaaugaaaucggagcaucagaagcuggaagagaacauugauaacaucaaacgcaaucacaaccuagcacugggcagacagaaggguuacgaagaggagauuauacauuuuaaaaaggaacuuagggagccucaguuccgggacgccgaagagaaguaucgagagaugaugaucgugaugagaaccacggaacucguaaauaaagaucuggacauuuacuacaagaccuuggaucaagcuaucaugaaauuucacuccaugaagauggaggaaauuaacaaaaucauacgcgaccuguggaggucuacauaucgugggcaggauaucgaguacauugaaauccggagcgacgccgacgagaaugugucagcaagugauaagagaaggaacuauaauuaccgcguugucauguuaaagggcgacacugcgcucgauaugcgaggaagaugcuccgcuggccagaaagugcuggccucucuuauuauccggcuggcauuggccgagaccuucugucucaacugcgggauaauugcucuggacgaaccaacaacuaaucuagauagggagaacaucgaaagccuggcccacgcacuuguggagaucauuaagucccgcucacagcaacguaauuuucagcuccuggucauaacccaugacgaagauuucguugaguuguuaggaagaagcgaguauguggaaaaauuuuaccggaucaagaaaaacauugaccaguguagugagaucgugaagugcucuguauccagccuggguuucaauguccacuga

SEQ ID NO: 61541 - RNA, 1059 nt, Artificial Sequence
  derived and/or modified sequence opt3 from RAD51AP1__Homo_sapiens__NP_001124334
auggugagacccgucaggcacaagaaaccuguuaacuacagccaguucgaccauuccgauucugacgaugacuuugugucagccaccguaccacugaauaagaaaagucggacagcuccgaaggagcucaaacaagauaagcccaagccuaaccuuaauaaccugcgcaaagaagagaucccagugcaggaaaagacucccaaaaagcgauugccugagggcacguucagcauuccagcauccgccguccccugcaccaaaauggcguuagacgauaagcuguaucagcgugaccuagaaguggcucucgcccugucuguuaaggagcuuccuacagugacuaccaauguccagaacucgcaagauaaaucaauagagaagcacgggagcaguaaaaucgaaacaaugaauaaguccccacauauuucuaacuguagcguggcauccgacuaccuggauuuggacaaaaucaccguagaggaugacguuggaggugugcagggcaagagaaaagccgcuucaaaggcagccgcucagcagaggaagauucuccuggaagggagugacggagauagcgccaaugacacugagccggauuuugcgcccggcgaggacucugaagaugacuccgauuucugcgagucagaagacaacgaugaggacuuuagcaugcggaaaaguaaggucaaagaaaucaagaaaaaggaggugaaggugaaaucuccugucgagaagaaagaaaagaaauccaagagcaaguguaaugcacugguuacaucgguggauucugccccagcugccguaaaauccgagucacaaagucuccccaagaaagugagcuuauccucugacaccacgcgcaagccucuggaaauaagaagcccaucagcagagaguaaaaagcccaagugggucccgccugcugccuccggugggagcaggucuucaaguagcccccuugugguuguguccgucaaaucuccaaaccagucguugcggcugggacuaagccgccucgcgcgagugaagccucugcaccccaaugccacuuccaccuga

SEQ ID NO: 61542 - RNA, 1053 nt, Artificial Sequence
  derived and/or modified sequence opt3 from RAD51B__Homo_sapiens__NP_002868
augggcagcaagaaacugaagagaguggggcucucccaagagcuuugcgacaggcugucucggcaccaaaucuugaccugucaggauuucuuaugccugucaccccuagaacucaugaaagucacaggacugaguuaccgcgguguucaugagcuucuguguauggugagccgagccugcgcuccuaagaugcagacugcauauggcauuaaagcccagcguuccgcggacuuuucuccagcuuucuugucgacgacccucucagcccuggaugaagcacugcacgggggaguagccuguggcagccucacagagauaacugguccgcccgggugcggaaagacccaauuuuguaucaugaugaguauuuuagcuacacugccuaccaacaugggcggccuugaaggggcaguggucuacaucgacacugaguccgccuucucugcugagagauugguggaaauugccgagagcagguuuccacgguauuucaauacagaagagaagcugcuacucaccuccucaaaaguucaucuguaccgcgagcuuacgugcgaugaagugcugcagagaaucgagaguuuggaagaggaaauaaucagcaagggaauuaaacucgucauccuggacucuguggcguccguaguuaggaaggaguuugaugcacaguuacaggguaaccugaaagagcggaauaaguuccucgcccgcgaggcuucaagccuuaaguaucuggccgaagaauuuaguauucccgugaucuugacuaaccaaauaaccacacaccuaucuggcgcacuggcuucccaggccgaccucgucagcccugcggaugaccugucgcuuucugaggggacuuccggaucaaguugugugauugccgcacugggcaauaccuggagccauuccgugaacacacgauugauccuccaguaccuggauucugaaagaaggcagauuuuaaucgcuaaaagcccacuggcccccuucaccucauuugucuauacgaucaaggaggagggucuaguucuccaggcuuacgggaauaguuga

SEQ ID NO: 61543 - RNA, 408 nt, Artificial Sequence
  derived and/or modified sequence opt3 from RAD51C__Homo_sapiens__NP_002867
augagaggcaagaccuucagguuugagaugcagcgggaccuggugagcuucccccucuccccugccguccgcguuaaacuugugucugcuggguuucaaacagcagaggaacuguuggaaguaaagccaucagaguuaaguaaagaagugggaaucagcaaggccgaggcgcuggagacucuacagauuauacgacgugaaugccucacgaacaaaccgagauacgcugguaccuccgagucucacaagaaguguacagcccuggaacuucuggagcaggagcauacucagggcuucaucauuaccuuuugcucggcauuggaugacauccucgggggaggcgucccccugaugaaaacaaccgaaauuuguggugccccuggggugggaaagacucaacugugguga

SEQ ID NO: 61544 - RNA, 1047 nt, Artificial Sequence
  derived and/or modified sequence opt3 from RAD51D__Homo_sapiens__NP_001136043
augggcgugcugagagucgggcucugccccggacuuaccgaggaaaugauccagcuguugaggagccaccggauuaagacaguuguggacuuaguauccgccgaucuggaggaaguggcucaaaaauguggucuaucuuacaagacuuggcgcgcacauucaaguggcaaccucgggggacugcagcuuccucaggucccagccggccgaagcugguccggugugcguaaugcgcugaaaaaggcuggguugggacacggcggcacggacgggcucucucugaacgccuucgaugagagaggaaccgcaguuucgacaucaaggcuggacaaacucuuagaugccggucuguauacuggcgaagugaccgagauagucgggggaccgggcagcgguaagacacaggugugccuuuguauggcugcaaauguagcccauggguugcaacagaacguucuguacguggacaguaauggaggccuaaccgcuucccggcuccugcagcuucugcaggccaagacucaagaugaggaggaacaggcggaagcauugcgcagaauccaggucgugcacgccuuugacauuuuccagaugcucgaugugcugcaagaguuaaggggcacagucgcucagcagguuaccgggucuagcggaacggugaaaguaguggucguggacuccguuacugccguggucucaccccugcucgguggccaacagcgggaggggcuugcacugaugaugcaguuggcucgcgaacuaaagacccuggcccgagaucucggaauggcggugguaguuacaaaccauaucacuagagacagggauaguggccggcugaaaccugcccuuggucguagcuggucuuuugugccauccacccgcauucuguuggacacaaucgagggggcaggcgcuucaggaggcagaaggauggccugccucgcuaagagcagucggcagcccaccggguuccaagaaauggucgacauaggaacgugggguacuucugagcaguccgccacacugcagggcgaucagaccuga

SEQ ID NO: 61545 - RNA, 843 nt, Artificial Sequence
  derived and/or modified sequence opt3 from RAD51__Homo_sapiens__NP_001157742
auggccaugcagaugcaacuggaggcuaacgcagacaccagcguggaagaggaauccuucggcccccagccuaucucuagacucgagcagugcgggauuaaugccaacgaugucaagaaacuugaagaggcgggauuucacacaguugaggcuguggccuacgcaccaaagaaagaacugauaaauaucaaggguauuucagaggccaaagcugacaagaucuuggcagaagccgcuaaguuaguaccgaugggcuucacuacggccaccgaguuucaucagaggcggagugagauuauccaaauaacaacugggagcaaagaacuggauaagcuacuccagggaggcaucgagaccgguuccauuacagaaauguucggggaguuucgcaccggaaaaacucagaucugucacacacuggcggugaccugccagcuucccauugaccgaggcggcggggaaggaaaggcaauguauaucgauacggaggguacuuuccguccugagagacuguuggccgucgcugaaagguacggccucucugggucggacgugcuggauaacguugccuaugcacgggcuuuuaauaccgaccaucaaacacagcugcucuaccaggccucagcgaugaugguggagagccgcuaugccuuacugauagucgauagugcaacugcucuuuacagaaccgacuauuccggaaggggcgaauugucugcccggcagaugcaccuggcucgcuuccuacgaaugcuccugagacuugccgaugagauugugagcgaagagaggaaacgggguaaccaaaaucugcagaacuugcgucucucccugucaaguuga

SEQ ID NO: 61546 - RNA, 1257 nt, Artificial Sequence
  derived and/or modified sequence opt3 from RAD52__Homo_sapiens__NP_001284348
augagcggcaccgaggaagccauccuggguggaagagacucccaccccgcugcagggggcgggucugugcucugcuucggacagugucaauacacagccgaggaauaucaggcgauucagaaggcucuuaggcagcggcugggcccugaguacauaucaagucgcauggccggugggggacaaaaagucugcuauaucgaaggccaucgaguuauuaacuuggcaaaugagauguuuggcuacaacgggugggcccacagcaucacucagcagaauguggauuucguagacuuaaacaauggaaaguuuuaugugggugucugugcuuucgugcguguucagcugaaagauggcuccuaccaugaggacgugggguauggagucucugaaggccuaaagucgaaagcacucucacuggagaaggccagaaaggaagcugugacggauggucuuaaaagggcccugcggagcuuugggaacgcguugggaaauugcauucucgacaaggauuaccugcgcagucugaacaaacucccaagacaauuaccgcuggagguagaccuuaccaaggcaaaaaggcaggauuuggagcccuccguugaagaggcccgguacaauucuugucgcccuaacauggcucugggccacccacagcuacagcaagugacaagccccucccgaccuucacaugccgucaucccagcagaccaggauugcaguagcagaucucucuccucaagcgcuguggaaagugaggccacucaccagaggaagcugcggcaaaagcagcuucagcagcaauuccgugaacgcauggagaaacaacaggugagagucucuacccccuccgcggaaaagagcgaggccgcaccuccagcuccgcccguuacacacucgaccccugugacuguaucugagccacuguuggaaaaagacuuucucgccggcgugacacaggagcugauaaagaccuuagaagauaauuccgagaaaugggcugucacgcccgacgccggggacggagugguuaagccuucaaguagggcagauccagcccagacuagcgacacccuggcucucaacaaucagauggugacacagaaccggacuccccauuccgucugucaccagaaaccgcaagcgaagucugguagcugggaucuucagaccuauucagcagaccagcgaacaaccggcaauugggagagucaucgcaagucccaggauaugaaaaagagaaaauacgacccuagcuga

SEQ ID NO: 61547 - RNA, 354 nt, Artificial Sequence
  derived and/or modified sequence opt3 from RAD54B__Homo_sapiens__NP_001192191
augagaaggagcgccgcucccucccagcugcaaggcaacucuuucaagaaaccuaaguuuaucccaccggggcggucaaaucccggacucaacgaggaaauuaccaaacuuaauccugacauaaagcuguucgaggguguggcaaucaacaauacauuuuugccaagucagaacgauuuacgcauuugcagccugaaucuacccuccgaagagucuacucgagaaaucaacaaucgugacaacuguucgggcaaauacugcuucgaggccccuacgcucgcgacccuggauccaccccacacaguccagacuuggaugagaaggcaucggcuuguuccugugcacuaucgcuga

SEQ ID NO: 61548 - RNA, 1176 nt, Artificial Sequence
  derived and/or modified sequence opt3 from RAD9A__Homo_sapiens__NP_004575
augaagugccuggugaccggcgggaacgucaaaguucucggaaaggccgugcacagccuuuccagaaucggugacgagcuguacuuggaacccuuagaggauggccugucucuaaggacaguaaauucaagucggagcgcuuaugcauguuuccucuuugccccucuguucuuucagcaauaccaggcggcuacuccagggcaggaccuucugcgcugcaaaauuuugaugaaguccuuccucucuguguuucgaucgcuggccaugcuggagaaaacggucgaaaaguguugcauaucacucaacggacguagcaguagauuagugguucagcugcauuguaaguucggcgugaggaaaacccacaaucuuuccuuucaagauugcgaaucuuugcaggcagucuucgacccggccagcuguccccauaugcugcgggcuccugcacgcgugcuaggugaggccguacucccauuuucccccgcucuggccgagguuacacuugggaucggaagaggcaggcgggugauucugcgcucauaucacgaagaggaagcggauaguacugcaaaggccauggucaccgagaugugcuugggcgaggaagacuuccagcagcuccaagcucaggaggggguggccaucacauuuugucugaaagaguuccgaggauuacugagcuuugcagaaucugcuaaccucaaucuuuccauucauuucgaugccccugguagaccagcgaucuucaccauaaaggacucacuguuggauggccacuuugugcuagccacucugagcgacacagauagucacucucaggaccucgggucccccgaaaggcaucagccugucccacaacugcaggcacacagcaccccgcaucccgaugacuucgcuaacgacgauaucgacucguacaugauugccauggagacgacuaucggaaaugagggcucucggguucuuccuuccauuucacugaguccagguccccagccuccaaaaagccccgggccgcacuccgaagaggaagaugaggcugaaccuucuaccgugcccggaacaccaccucccaagaaguuucguagcuuguucuuuggcucaauccucgccccaguacgcaguccccaaggcccuuccccagugcuggcagaggacagcgagggggaaggauga

SEQ ID NO: 61549 - RNA, 1038 nt, Artificial Sequence
  derived and/or modified sequence opt3 from RAD9B__Homo_sapiens__NP_001273461
augagcgagaacgaacuggacaccacacuccaccuuaagugcaaacugggcaugaaguccauuuugcccauuuucagauguuuaaauucucuggagaggaacauagaaaaaugccggaucuuuacucgcucagauaaguguaaaguggucauucaguucuuuuaccgacaugggaucaagcguacgcacaauauuugcuuccaagagagucagccucuacagguuaucuuugacaagaacguguguaccaauacacucaugauacagccaagacugcuugccgaugcuaucguacuguucacuagcucccaagaagaggugaccuuggcagucacaccgcucaacuuuugccugaaaucuucgaaugaggaaucaauggaccugagcaacgccgugcauagugagauguucguuggauccgaugaauuugacuucuuucagauugguauggauaccgagaucacuuucuguuuuaaggagcucaaaggcauuuuaacauucucugaagcgacccacgcucccaucagcauauauuucgacuuuccugggaagccacuggcccuuuccauugaugacauguugguggaggcaaauuucauccuggccacgcuagcugaugaacagucaagggcaaguagcccccagucucucugccugucccaaaaacggaagcgcucagaccuuauugagaagaaagccggaaagaacgucacuggccaggcucuggaauguaucagcaaaaaggccgcgccuagaagguuguacccaaaagagacccucacaaauaucagugcacuggagaacugcgguucucccgccaugaagcggguggauggggacguauccgaaguuagcgagucgucuguguccaauacugaagaggucccuggaucauuaugucugcgcaaauuuaguugcauguucuuuggcgcugugagcuccgaccagcaggaacauuucaaccacccauuugauucucucgcccgagcaagcgacucagaggaggauaugaauaacggcaguuucuccaucuuuuga

SEQ ID NO: 61550 - RNA, 1221 nt, Artificial Sequence
  derived and/or modified sequence opt3 from RAE1__Homo_sapiens__XP_005260640
auggcccccgcugaggcagaacugccuccaggcagcgcccuccuuagagacgcgggggcuagggccggacuguugaccaaguuacgguacugggcacuggaggcccgcuucaaaaugucccuauuugguacaacuucuggcuucgggacgucaggaaccaguauguuuggcagcgcuacaacugauaaccacaauccgaugaaggacaucgaagugaccuccucucccgaugacucgauugguugccucucauucagcccuccaacacugcccgggaacuuucuuauagcaggaaguugggccaaugauguccgauguugggagguucaggacuccggccaaaccaucccuaaagcucagcagaugcauacuggcccagugcuggauguaugcuggucugacgaugggagcaagguguucacagccuccugugacaaaaccgcgaagaugugggauuugucaaguaaccaggcaauucaaaucgcccagcacgacgcucccgucaagacgauucauuggaucaaagccccuaauuauagcugcgugaugacuggaucuugggauaagacccucaaauuuugggacacacguuccucaaacccaaugaugguucugcagcugccggaaagauguuacugcgcagacgugauauaucccauggcugucguggccacugcggagaggggucucaucguauaccaguuagagaaucaaccuagcgaguuccggcgcauugagaguccacugaagcaccagcauagauguguugccaucuuuaaagauaagcagaacaagcccaccggcuucgcacuugggucuauugaaggaaggguggcuauccacuauauaaauccuccaaaccccgccaaagacaauuuuacauucaagugccaccgguccaacggcaccaauacgagcgcuccgcaggauauuuacgccgucaacgguaucgcauuucauccugugcacgggacuuuggccacagugggaucggacggccgcuucucuuucugggauaaagacgcucgaaccaagcugaaaacuuccgagcaacuagaucagcccauuucagcguguugcuuuaaucauaacggcaacaucuucgcauaugccaguagcuacgacugguccaaggggcacgaguuuuacaauccacagaaaaagaacuauaucuuccucagaaaugcugccgaagaacugaagccuaggaacaaaaaguga

SEQ ID NO: 61551 - RNA, 684 nt, Artificial Sequence
  derived and/or modified sequence opt3 from RAET1E__Homo_sapiens__NP_001230254
augagaaggaucagccugaccuccucucccgugcggcuccuucuguucuuguuacugcuacucauugcccuggagauaauguacaacucagacaauaacauggucaagccucuuggccuguuggggaaaaagguuuaugcuacaaguacuuggggagaacucacgcagacccugggugaggugggccgcgaucugcgaaugcucuuaugcgacaucaaaccacaaauuaagacaagcgauccguccacucugcagguagaaauguuuugucagcgugaggcagaaagaugcaccggggccucuuggcaguucgcgacaaauggagagaaaucgcuuuuguuugacgcuaugaacaugaccuggacugugaucaaucacgaggccucaaagauuaaggaaacauggaaaaaggauaggggccuggagaaauacuuccggaagcuaagcaaaggugacugugaucauuggcuccgcgaauuucuggggcacugggaggcaaugcccgagccuaccgucaguccagugaacgccuccgacauccauuggucuagcuccucacuucccgauagauggauaauccugggagcuuucauuuugcucguucugaugggcaucguguuaauuugcgucugguggcaaaauggcgaauggcaggcagggcuguggccucucaggacgaguuga

SEQ ID NO: 61552 - RNA, 741 nt, Artificial Sequence
  derived and/or modified sequence opt3 from RAET1L__Homo_sapiens__NP_570970
auggccgcugcagccauccccgcgcugcuccuuugccugccuuuguuauuccugcuauuuggcuggagcagagcuaggcgggacgauccacacucccucuguuacgacauuaccgugauaccgaaguuccgccccgggccucgauggugcgccguccagggacaaguugaugagaaaacauuucugcauuaugacugugguaacaagacugugacgccaguaucuccccuuggcaaaaagcugaaugugaccauggcauggaaagcccagaacccugucuugcgugaagugguugauauccucacagagcagcugcuggacauucagcucgaaaauuacacuccaaaggagcccuuaacccugcaagcuagaaugucaugcgaacagaaggcagaggggcacaguagcggauccuggcaguucucuaucgauggccagacauuucuuuuguucgacucggagaaaaggauguggaccacugugcauccuggugcccggaagaugaaagaaaagugggagaacgauaaagacgucgcuaugucauuucacuauauuagcaugggggauuguaucggauggcuggaagacuuccuaaugggcauggauaguacacucgagccauccgccggcgcgccgcuggcaaugucuagcgggaccacgcaacuucgcgccacugcuaccacacugauauugugcugucuccugaucauuuuacccugcuuuauccugccuggaauuuga

SEQ ID NO: 61553 - RNA, 1947 nt, Artificial Sequence
  derived and/or modified sequence opt3 from RAF1__Homo_sapiens__NP_002871
auggagcacauccagggcgccuggaagaccauuagcaacggguucggauuuaaagacgcuguguucgaugguuccucuugcauaucacccacaaucguccaacaguuuggcuaccagagaagggcaagugacgaugggaagcugacugacccuagcaaaacguccaauaccauucggguuuuccucccaaacaagcagcgcacagugguaaaugugcgaaacggaaugucucuucaugauugucugaugaaagccuugaagguccguggcuuacaaccggaaugcugugcgguguuuagacugcuacacgagcauaaggguaaaaaggcuaggcucgacuggaauacugaugccgcaucgcugaucggggaagaacuucagguugacuuccuggaucacgugcccuugaccacacauaacuuugcccggaaaaccuuccucaagcuggcuuuuugcgacauuugucagaaauuccugcucaauggauuucgcugccagacuuguggcuauaaguuccacgaacacugcucaacaaaggucccuaccauguguguggauuggagcaacaucagacaauuacugcuuuuuccaaauaguacgauaggcgacuccgggguacccgcauugccuucucugacuaugaggcggaugcgcgagagcguuucccgaaugccagugucaagucagcauagauacagcacaccccacgccuucaccuucaacacuucuuccccuucaagcgagggaagucuaucucagaggcagcgguccaccagcacaccaaauguccauauggugucgaccacgcucccgguggauucucguaugaucgaagacgcuauucgcucccacucagagagugccagccccuccgcgcugucuagcucaccuaacaaucuuaguccaacugguuggucccaacccaaaacaccugucccagcacagagagaaagggcccccguuagcggcacccaggagaagaacaaaauccggccgcgagggcaacgcgacucuucauauuacugggagauugaagcuagugaggugaugcugagcacuagaaucggauccggcucuuuugguacaguauauaaggggaaauggcacggagauguggccgucaagauauugaaagugguugacccuacccccgaacaguuccaggcauuuaggaaugagguggcuguccuccggaagacgcgccaugugaacauucuguuauucaugggcuacaugaccaaggauaaccuggccaucguaacacaguggugcgaaggcucgagccucuauaaacaccuucauguucaagagacuaaguuucagauguuccagcugauugacaucgcgagacagaccgcccaagggauggauuacuugcacgcuaaaaauaucauucauagggacaugaaguccaacaauauauuucuacacgagggacugacagugaaaaucggugauuucggccucgcaacugucaagucacguuggagugggucucaacagguggaacagccaaccggaagcguccuguggauggccccugaggugauucggaugcaggacaacaaucccuuuuccuuccagucagauguuuacagcuauggcaucgugcuuuacgaacugaugacaggugaguugccauauucucacauaaacaaucgagaccagauuaucuuuaugguagggagaggcuacgcuucccccgaucucaguaagcuguauaaaaacuguccuaaggccaugaaaagguuagucgcagacugcgugaagaaaguuaaggaggagcgcccacuguucccgcagauccuaagcucuauugagcuccugcaacauucccuucccaagaucaaucggucagccagugaaccuagcuugcacagagcugcgcauaccgaggacauuaacgcaugcacucugacgacaucgccaaggcuccccguguuuuga

SEQ ID NO: 61554 - RNA, 3132 nt, Artificial Sequence
  derived and/or modified sequence opt3 from RAG1__Homo_sapiens__XP_005253098
auggccgcuagcuuucccccuacccugggccucuccucugcaccagacgagauccagcacccgcauauuaaguucucagaauggaaauucaaacuuuuuagagugaggaguuucgagaaaacacccgaagaggcccaaaaggaaaagaaggauagcuuugaggggaagccuucccuggagcagucuccagcggucuuggacaaagcugauggacagaagcccguuccuacucagccauuacugaaagcccaccccaaguucucgaaaaaguuucaugacaacgaaaaggcacgggguaaagccauacaccaagcuaaucuacgccaucucugccgaaucuguggcaacucauuccgugcagaugagcacaauagaagguacccugugcacgggccaguagacggaaagacgcugggccuucugcggaaaaaggaaaaacgcgccaccagcuggccggauuugauugcuaagguguuuagaaucgacgucaaagccgauguggacaguauucaucccacagaguucugccacaacuguugguccaucaugcauaggaaguuuucuagcgcgccuugcgagguuuauuucccacggaaugugacuauggaauggcacccccacaccccuuccugugauauaugcaacacagcacgccgaggucucaagagaaaaucacugcagccaaaucugcagcucaguaagaaauuaaagaccguccuggaccaggccaggcaagcucggcagcauaaacgucgcgcccaggcaagaaucagcucuaaggaugugaugaagaaaauugcuaacuguuccaagauccaccuuucaacuaaauugcuggccguagacuuucccgagcauuucguuaagagcauuaguugccagaucugugaacacauacuagcggacccgguggagacaaauugcaaacaugucuucuguagggugugcauucuccggugccugaaggugauggggucuuacuguccuuccugccgauaucccuguuuuccaaccgaucuugaaagcccugucaagucguuccugucuguuuugaacucccucauggugaaaugccccgccaaggaguguaaugaggaaguaucacuggagaaauacaaccaccacaucaguagccauaaggaauccaaagagauuuuugugcacaucaauaagggaggccgcccaagacaacauuuacugucucucacgaggcgggcacagaagcaccgccuuagagaacugaaauugcaggucaaggcuuucgccgacaaagaggagggcggggaugugaaaagcguuugcaugacucuauuucugcucgcucugagggcccguaacgaacaccggcaagcagacgagcuugaagccaucaugcagggaaaagguucaggccugcagcccgcuguguguuuggcgauucgagucaauaccuuccucaguugcucccaguaucauaagauguacagaacagugaaagcaauaacugggaggcaaaucuuucagccucugcacgccuuacgcaacgcugagaagguacugcuaccaggauaucaucacuucgaauggcagccgccccucaagaacguuucuagcucaaccgaugugggcauuaucgacggucugagugggcuuagcuccucugucgaugacuacccuguggauacaauagccaaacgguuuagauacgacucggcauuggucagcgcccugauggauauggaggaggacauucucgaaggaaugaggucccaggaccuggaugacuaucuuaauggcccauucaccgugguugugaaggagucaugugauggcaugggggacguaagugaaaaacauggaucuggucccgucgugccugagaaggcuguucgcuuuagcuucacgaucaugaaaaucacuauugcccacuccucacaaaacgugaaggucuuugaggaagcaaagccaaauagcgagcugugcuguaaacccuugugccucaugcuggcggaugaaucugaccacgagacauuaaccgcuauccuguccccgcuaauugccgaacgagaggcaaugaagaguagcgagcucaugcuggaacuuggcgggauauugcggacuuucaaauucaucuuucguggaacaggcuacgaugagaagcuggugagagaaguagagggucucgaagccucuggguccguguauauuugcacccugugugacgcuacgagguuagaggccucacagaaccugguuuuccauaguaucacccgcagccacgcagagaaucuugaacgguacgaggucuggagaucgaacccuuaucaugaauccguggaggaauugagggaucgagugaaaggcgucucugcuaagccauuuaucgagacaguucccagcauugacgcccuccacugcgauauaggaaaugcggccgaguucuacaagaucuuucagcuggaaauuggcgagguguauaaaaacccuaaugcuucaaaggaggaacgcaaacgguggcaggcaacucuagacaagcaucugagaaagaagaugaaccucaagcccaucaugaggaugaaugggaacuucgcccguaaacugaugaccaaggagacaguggaugcuguaugugaacuuauuccaagugaggaacgccacgaggccuugcgggaacugauggacuuauaccucaaaaugaagccugucuggagauccucuugccccgcaaaagaguguccagagagccugugccaauacuccuuuaauucacagagguucgcggaacuucugagcacuaaguuuaaauaucgauacgagggaaagaucaccaacuauuuccacaagacauuggcccaugugccggaaauaaucgagcgggacgguaguauuggcgcuugggccucugaagggaaugaguccggaaacaaacucuuucgcagauucaggaagaugaacgcacggcagagcaaauguuacgagauggaagauguucugaagcaccauuggcuauauaccucgaaauaccugcagaaguuuaugaaugcucacaacgcccucaagacuucaggcuucacgaugaauccucaagcaucucugggugacccccuugggaucgaggauaguuuggaaucccaggacagcauggaguucuga

SEQ ID NO: 61555 - RNA, 1584 nt, Artificial Sequence
  derived and/or modified sequence opt3 from RAG2__Homo_sapiens__NP_001230714
augagccugcagauggugaccgucuccaacaauaucgcacucauucaacccggcuucucucuuaugaacuuugacgggcagguuuucuuuuucggacagaaggguuggccuaaaagaucaugcccaacaggcguguuucaccuggauguaaagcauaaucacgugaaauugaagccgacuauauucaguaaagacagcuguuacuuacccccucugagguauccagcuacgugcaccuuuaaggggucccuagagucugaaaagcaucaguacaucauucacggaggcaaaacacccaacaaugaggucucggauaagaucuaugugaugucaauuguuuguaaaaacaauaagaaagugacuuuccggugcaccgaaaaggaccucgucggugaugugccugaggcacgcuacgggcauagcaucaacguaguuuauagucgaggaaaguccaugggcgugcuguuuggcgggcguucuuacaugccaagcacacacagaaccacugaaaaauggaacuccgucgccgacugucuucccugcguguuccugguggauuuugaguucggaugugcgacaucauauauauugccugagcuccaagacggucugaguuuucacgucagcaucgcuaagaaugauaccauuuacauccugggcgggcauucucucgccaauaacauuaggccagcaaauuuauaccggauccgcguugaccugccgcuuggaucccccgccgugaacugcacgguauugccuggcgguauaucagugagcagugcuauucugacucagaccaauaacgaugaguucgucaucguugggggauaucagcuagaaaaccagaaaagaaugauuuguaauaucaucucucucgaagacaacaagauugagauaagggagauggaaacaccagauuggacucccgacaucaaacacuccaagauuugguucggcagcaauaugggcaacgggaccguguuucugggaaucccuggugacaauaaacaaguggucucggagggcuucuacuuuuauaugcuuaagugcgcagaagaugacacaaacgaggaacagaccacguucacuaauucucagacauccaccgaggauccaggggacucaacucccuuugaggauagugaagaguucuguuuuagcgccgaagcuaacuccuucgacggagaugacgaguuugauacauacaaugaagacgaugaggaggacgaaucugagaccggcuauuggauaacgugcugcccgaccugugacguggauauuaacacauggguaccuuucuacagcacugaacugaauaagcccgccaugaucuauugcucacauggugacgggcacuggguucacgcgcaguguauggauuuggcagagcggacccucauccaucugagugccggcuccaacaaauacuacugcaaugaacacguggagauugcucgcgccuuacauacaccacaacgaguccugccucucaagaaacccccaaugaaaagccuuagaaagaagggaucuggcaagauccugacucccgccaaaaagucauuuuugaggcggcuauucgacuga

SEQ ID NO: 61556 - RNA, 2943 nt, Artificial Sequence
  derived and/or modified sequence opt3 from RAI14__Homo_sapiens__NP_001138992
augaaaagccugaaggccaaguucagaaaauccgacaccaacgaguggaauaagaacgaugacaggcuccuucaggcuguggaaaauggcgaugcagagaaagucgccucucuguuggggaagaagggagcgucagcuacaaaacacgacagugaagguaagacugccuuucauuuagcagccgcuaaaggccacguugagugccugcgggugaugaucacgcaugggguagaugugaccgcacaagacacaacuggacacagcgcccuacaucucgcugccaagaacucccaccacgaauguauucgcaaacugcuucagucuaagugccccgcggagucggucgauucaagcggcaagaccgcacugcauuacgccgcugcccaggguuguuugcaggcagugcaaauacucugcgagcacaaaaguccuaucaaucugaaggaccuggaugggaacauuccacucuuacuggcuguucagaauggacauuccgaaaucugucacuuccuuuuggaccacggcgccgaugugaacucucgaaauaaaagcggccguacagcgcugaugcuagccugcgagauuggguccucaaacgcagucgaagcucucaucaagaaaggagccgaccugaaucuuguggauagucuggguuauaacgcuuugcauuacagcaagcucucugagaaugccggcauacagucccuguuacugucaaaaaucagccaggacgcagaccucaagaccccgacuaagcccaaacaacacgaucagguaaguaagauuucuuccgagagaagcgggacaccuaaaaagaggaaagccccacccccuccaaucucgcccacccagcuuucugacguuuccucaccucggaguauuacgagcacuccacuguccggaaaggaaucuguguuuuucgcugagccgcccuuuaaggcggaaaucagcucaauacgcgagaacaaagauagauugagugacuccaccacaggcgcagauagccuacuggacauuucuucagaagccgaucagcaagaccuccugagucuucugcaggcuaaggucgccagcuugacucuccauaauaaagagcugcaggauaaguuacaagcaaaauccccuaaggaggccgaagcugaccugucuuucgauucguaucacagcacccagacagaccuagguccaucccucgggaagcccggagagaccucaccuccagacaguaaaucuagccccuccgugcugauccauucacuuggcaagagcacgacugauaacgacgugaggauucagcaguugcaagaaauccugcaggaucuccagaaacggcuggagucuuccgaagccgagcgcaagcagcuucaagucgagcugcagaguagacgagcagaauugguuugucucaacaauacagagaucagcgaaaacucuuccgaccugucacagaaauuaaaggagacccagaguaaguacgaagaggcgaugaaagaggugcugagcguacaaaagcagaugaaacuaggccucgugucgccggaauccauggauaauuauucucacuuucacgagcugagggucacugaagaggagauuaacgugcuuaagcaggacuugcagaaugcucuggaagagagcgaacggaacaaagagaagguucgugaacucgaggagaaacugguggaacgcgagaaggggacagucauaaagccucccguggaagaguacgaagagaugaaaucaaguuauugcuccguaaucgagaauaugaacaaggaaaaagccuucuuauuugagaaguaccaagaagcacaggaggaaauuaugaaacugaaggauacccuuaagucucagaugacgcaagaggccagcgacgaggcugaagauaugaaagaggccaugaauagaaugaucgacgaauugaacaagcagguuuccgagcucucacagcuguacaaagaggcacaggcugaacuagaggauuauaggaagcggaaaagccuggaagacgugaccgccgaguacauacauaaggcggaacacgagaagcucaugcaacugacaaaugucagucgagccaaagcugaggaugcacuuucugaaaugaagucccaguauagcaaaguguugaacgagcugacucaguuaaagcagcucgucgacgcccaaaaagaaaauucggugucaauuaccgagcaucugcagguuaucacaacucuucgcaccgcugccaaggaaauggaggagaagaucucuaaccugaaagaacacuuggcaaguaaggagguggaaguagcgaaacucgagaagcagcugcuagaagagaaagccgcuaugacagacgccauggucccaagauccagcuacgagaagcugcagucuagccucgaauccgaggugucaguucuggcaaguaaacuuaaggaaagcgugaaggagaaagagaagguccacucugaagugguacaaauuagguccgaggugucacagguuaaacgggaaaaggagaauauccagaccuugcugaaaaguaaggaacaagaggucaacgaguuacuccagaaguuccagcaggcucaagaggaacuggccgaaaugaaacgcuaugcagagagcuccucuaagcuggaagaggauaaagacaagaaaauuaacgagaugucgaaggaagugacuaagcugaaagaggcccuaaauagccucucacagcuguccuacaguacgucuagcuccaagagacagucacagcaauuggaagcucugcagcaacaggugaaacaguuacagaaccagcucgcggaguguaagaaacagcaucaagaagucauaucuguuuauaggaugcaccuucuuuacgccgugcagggacagauggaugaggacgugcaaaagguacugaagcagaucuugacaaugugcaaaaaucagagccagaagaaauga

SEQ ID NO: 61557 - RNA, 5721 nt, Artificial Sequence
  derived and/or modified sequence opt3 from RAI1__Homo_sapiens__NP_109590
augcagagcuucagagagaggugcggcuuucacgggaagcaacagaacuaccagcagaccucccaagaaacaucucggcuggagaauuaucgccagcccucacaggccggacucaguugugaccgacagcgucuucuggcuaaagauuacuauaacccucaaccauacccgagcuaugaagguggcgcagggacucccuccggaacggccgcggcuguggccgcagacaaguaccauagaggcucuaaagccuugccuacccagcaggguuuacaggggaggccagcuuuccccggauauggcguccaagauucgucaccuuacccaggccgguacgcaggggaggaaagccugcaggccuggggagcuccccagccuccaccgccccaaccucagccacuacccgccgguguugcgaaguaugacgagaaucucaugaaaaagacagcagugccuccaagucgccaguacgccgagcagggcgcucaaguacccuuuagaacucacucccugcaugugcagcagccgccucccccacagcaaccucuugccuaucccaagcugcagaggcagaaauugcagaacgauaucgcaucuccacuccccuucccucaagggacccacuuuccacagcauagccaguccuucccgacaucaaguaccuacagcucuuccguccagggaggcggucaaggggcucacucauauaagagcugcacugcccccacagcgcagccucacgaccggccacugaccgccaguucuucccuggcacccggacagcgcgugcaaaaucuccaugcuuaccagagcggccgauuaucguaugaucagcagcaacagcagcagcaacagcagcagcaacagcagcaagcccugcagucuagacaccaugcucaggaaacgcuucacuaccagaacuuggccaaauaccaacacuauggccagcaggggcagggauacugucaaccugacgcagccguuaggacuccagagcaguauuaccagaccuuuucccccucaaguagccauuccccggcucggucugugggucguagcccuucauauaguuccacaccaagcccccugaugccuaaucuagaaaacuuccccuacucucagcaaccacucucaacuggcgcguuuccugcagggauuaccgaucacagucauuucaugccccugcuuaauccaagcccgacagacgccaccuccucugucgauacgcaggcuggaaacugcaagccucugcagaaagacaaguugcccgagaaucuccugucggauuuaagccugcagucccucacugcccuuacaucacaaguggagaacauaaguaauaccguacagcagcuguugcuaucuaaggcagccguuccacaaaaaaagggcgugaaaaaccuggucagccgcacucccgaacagcacaagucccagcauuguucaccugaggguagcggguauucugcugaaccagccggcacaccccucuccgagccuccgaguagcaccccacagucuacgcacgcagaaccccaagaggcggacuaccuguccggaucagaggacccucuugaaagaaguuuucuguacugcaaucaggcuaggggcagcccagcccgggugaacucgaacuccaaagcaaagcccgagucugugagcaccuguucagucacaaguccugaugacauguccacuaaaucugaugacagcuuccaguccuugcacgggucacucccgcuggauagcuuuaguaaguucguugccggagaacgagacugcccccgcuuacugcuaucugcucucgcccaggaggaucuggcauccgaaauccuugguuugcaagaggcuauuggcgagaaggccgacaaagcgugggccgaagcuccaagccuggugaaggauucgucaaaaccucccuucucucucgagaaucauagugcaugucuggacuccguagccaagagcgcuuggccaagaccuggggaacccgaggcccuuccagauucucugcaguuggacaaaggaggcaacgcaaaggacuuuagcccgggucucuucgaagauccuuccguggcguuugccacccccgacccaaagaaaacaacugggccccugucauucggcaccaagccuacauuaggagucccagcucccgauccuaccacugccgcauuugacugcuucccggauacgacagcugccaguagcgcagacucugccaauccauuugcuuggcccgaggagaaccugggcgaugcguguccuaggugggggcuacaccccggagaacucaccaaaggucuggagcagggcgggaaggccuccgacggaaucucaaaaggcgauacucaugaagcaagugcuugccuugguuuccaggaggaggacccaccuggggaaaagguggccagcuugcccggcgauuuuaagcaagaggaaguuggaggcgugaaagaggaagccgggggacugcuccagugcccagaggucgcuaaggcagaccgguggcuggaggauucccgccacuguugcucuaccgccgacuucggcgacuuaccucugcuuccgcccacaucgagaaaagaagauuuggaggcggaagaggaauauagcucacucugugagcugcuagguuccccagagcagaggccugggaugcaagacccccugaguccaaaggcuccucucauuugcaccaaagaagagguggaagagguacuggauucuaaggccggauggggcagccccugucaccuuuccggugaaucaguuaucuugcugggcccgacuguggggacagagucuaagguccagagcugguuugagaguuccuuaagccauaugaaaccaggagaagagggcccugacggggaacgugcacccggagauucuacgaccucagacgccucccucgcucagaagccaaauaaacccgcagugccugaggccccgauagcgaagaaagagcccgucccacggggcaagagucugcgaagcagaagggugcaccgcggucuuccugaagcugaggauucgcccugccgggccccuguucugccaaaagacuugcuccugcccgaaucuuguacugggccuccacagggacaaauggagggcgcaggugcccccggcagaggggcuuccgaaggacuaccgaggaugugcacacgcagccugaccgcccucucagagccucgaacaccaggccccccugggcugacuaccacgccagcacccccggauaagcuuggaggcaagcagcgggcugccuucaaaagugguaagcguguggggaaaccuucucccaaggcggccuccagcccaucaaacccugcagcuuugcccguagccagugacagcuccccaaugggaucuaaaaccaaggagacagauagccccuccacuccuggcaaggaccagagaucaaugauccugaggucucgcaccaaaacacaggaaauuuuucauaguaagcggagaaggccaucggagggucgauuaccgaauugucgcgcuacuaaaaagcuccuggauaacagccaccuucccgcaaccuucaaagucuccucuucaccucaaaaggaaggccgggugagccagagagccaggguuccaaagcccggggccggauccaaacugagugaccguccucuacaugcucucaagcgcaaaucugcguucauggcaccagugcccacgaagaaacggaaucuggucuugagaagcaggucauccaguagcucuaacgccuccggcaaugggggagacggcaaggaggaacgaccugaggguucaccgacacuguuuaagcggaugagcucgccaaaaaaggcuaaacccaccaaggggaacggagagccugccacuaaauuacccccaccugaaacacccgaugcaugccucaagcuggccucucgcgcugcguuccagggcgccaugaaaaccaaggugcuuccaccgagaaagggcagggggcugaaauuggaggcaaucguacagaagauuacuaguccuucccucaaaaaguuugcuuguaaagcccccggagcaagcccagguaauccccugucaccuucccuaucugacaaggaucggggccugaagggggccggaggcagcccaguggguguugaagaggggcuugucaacgugggaaccggccaaaaacuccccacaaguggcgcugacccucugugccgaaauccgacgaacagauccuugaaggggaaacugaugaacagcaagaaauuaucuucaaccgauugcuucaagacugaagccuuuacaaguccagaggcgcuccagcccggagguaccgcacuggccccuaagaaacgcuccaggaagggccgugcuggggcccacggacuuagcaaaggcccacuggagaagcggcccuacuuggguccugcucuccugcuaacacccagagacagggcaucugggacucagggagccucggaagauaauucaggcggcgggggaaaaaagccaaagauggaggaacugggucuugcuagccagccgccugagggccgccccugucaaccacagacccgagcccagaaacaaccugggcacacgaacuauuccaguuacucuaagagaaaacggcucacaaggggacgcgcaaagaauaccacuagcucccccugcaaaggccgugcgaagagacggaggcagcagcaggugcugccauuggacccugccgagcccgaaauccgcuuaaaguauauaucaaguuguaaacgacugagaucugauagccggaccccggcuuucuccccauuugucaggguugagaagcgcgacgccuucacaacuauuugcaccguggugaacucaccuggugaugcacccaaaccacauagaaagcccagcucuuccgcuaguagcucguccucuucaagcaguuuuucccucgacgccgcaggggccucucuggcuacacuuccuggaggcagcauccugcaaccgaggccaucauugccccuauccaguacgaugcaccugggcccuguagucagcaaagcgcucucuaccucaugucuggugugcugucuuugccagaaucccgccaacuucaaggacuuaggggaucuguguggaccauacuauccugaacauugccuccccaaaaagaagccaaaauugaaggagaaaguucggccugaagguacuugugaggaggcaucccugccgcucgaacguacacugaagggccccgagugcgcugccgccgcaaccgcugggaaaccaccucgccccgacggaccagccgauccugcgaagcagggcccccuucgaacuagcgcuagaggucugucuaggcgguugcagaguugcuacuguugcgacgggcgcgaagauggaggcgaggaagccgcaccggccgacaagggcagaaaacacgaguguucgaaggaggcuccagcagaaccugggggagaggcccaagaacauugggugcacgaggcgugcgcugucuggacagguggcguguaccuaguugccgggaaacuguuuggacuccaggaagcaaugaagguggccguagauaugauguguuccagcugccaggaggcuggcgccaccauugguuguugccacaaaggguguuuacauacguaucacuaccccugcgcaucagacgcuggcuguaucuucaucgaggaaaauuuuucucugaagugcccaaagcauaaaaggcuucccuga

SEQ ID NO: 61558 - RNA, 1443 nt, Artificial Sequence
  derived and/or modified sequence opt3 from RAI2__Homo_sapiens__NP_001166203
auggacgaucugcagagccaaaaccucuccauggacaugaccgauucucccccugcccuugcuaauaacagacuggagaauggcauggcacaguugaucacaacugaagccuggaacauuaauucaacggacuuaguggaggggaguagcgcgccagaacugaacccgaauggaaacgcuaccuacgucaugacaacucagggucccguucagcuaccugugguacucgagcaacacguguuccagcaucuuaauuccccacugguccugccccaggaagccccuuguucuucgucaaccauacacaacaauuuguuucagggcgcagaggauccagaggcccaaccccagcuccuggaccugaggaucccuagccagccacaggaaccgacacuccccuucgaggcuguguuacaaaaccuguuuccuagucaggggacccuuggaccacccccuugccagccacccccgggcuaugcaccuguucccccacaaccuuucuccucucccuugagcccacuggugcccccugccacucuacucgucccauacccggugauuguaccccugccuguuccagugcccaucccuauuccaauccccgucccgcaguccucagaaaguaaguuuucaucuuccuucccuaaaccacccagcagcuuuggucuucauccuuucaaggggacacagacaccccuggagaaagaugaguugaagccauuugacauacuccagccuaaagaauauuuccaacugagucggcacacggugaucaagaugggaucugagaaugaagcauuagaucuguccaugaaaagcgugcccuggcucaaggccggcgaggucucgccaccgauuuuucaggaagacgcggcacuugaucugucuguugccgcucaucgcaaguccgagccucccccagagacuuuguacgacucaggcgccaguguggauagcuccgggcacaccguaauggaaaaacuacccucuggaauggagaucagcuucgcuccugcuacaucacacgaagccccagcgaugauggacagucauauuuccagcucugacgccgcaacugagaugcugucacagcccaaccacccuaguggugaagugaaggcugagaauaacaucgagauggucggcgaaagccaggccgcuaaagugauaguuuccguggaggaugccgucccgaccaucuuuugcgggaagauuaagggacucucuggcgugucgaccaaaaacuucagcuucaagcgagaagacuccguacugcaagguuaugauauuaauucacagggggaggaaaguaugggaaacgcagagccacuucguaaacccaucaagaauagaucuaucaaacugaagaaaguuaacagccaggagauucauauguugccuauaaagaagcagaggcucgccaccuuuuucccacggaaauga

SEQ ID NO: 61559 - RNA, 621 nt, Artificial Sequence
  derived and/or modified sequence opt3 from RALA__Homo_sapiens__XP_006715825
auggccgcuaacaagcccaaaggccagaauagccuggcacuccacaaggugaucauggucggguccggagguguuggcaaaucugcccuuacccugcaauucauguacgacgaguuuguggaagauuaugagccuacaaaggcggacucauacaggaaaaagguaguguuggauggggaagagguccagauugacauauuagauacugcuggacaggaagacuaugccgcaaucagagauaacuacuuccggaguggcgaggguuuucugugcguguucagcauuacggagauggaauccuuugccgcuaccgcagacuuccgcgagcagauccuacgaguuaaggaagaugagaaugugccauuucuccuggucgggaacaaaucugaccuugaggauaagcgucaagugucgguagaagaggccaaaaauagagcugaacaguggaacguuaauuauguggagacaucagccaagacuagggcgaacgucgacaaaguguucuuugaucugaugcgggaaauucgcgcaagaaagauggaggacagcaaggagaaaaauggaaagaaaaagaggaaaaguuuggccaagcggauccgcgaacgauguugcauacucuga

SEQ ID NO: 61560 - RNA, 621 nt, Artificial Sequence
  derived and/or modified sequence opt3 from RALB__Homo_sapiens__NP_002872
auggccgcuaacaagagcaaaggccaguccucucuggcacuccacaaggugaucauggucgggucaggagguguuggcaaaagugcccuuacccugcaauucauguacgacgaguuuguggaagauuaugagcccacaaaggcggacagcuaccguaaaaagguaguguuggauggggaagagguccagauugacauauuagauacugcuggacaggaagacuaugccgcaaucagggauaauuacuuccgguccggcgaggguuuucugcuaguguucucuauuacggagcaugaaucguuuaccgccacagcugaguuccgcgaacagauccuccgaguuaaggcagaggaggacaaaauuccucugcuuguggucgggaacaagucagaucuggaagagagaagacaagugccaguagaagaggccaggagcaaagcugaagaguggggaguucaguauguggagaccagugccaagacucgggcgaaugucgacaaaguguuuuucgauuugaugcgcgaaaucagaacaaagaagauguccgagaacaaagacaagaauggcaaaaagucuagcaaaaacaagaaauccuuuaaggaaaggugcugucuccuguga

SEQ ID NO: 61561 - RNA, 1968 nt, Artificial Sequence
  derived and/or modified sequence opt3 from RALBP1__Homo_sapiens__NP_006779
augaccgagugcuuccugcccccuacaagcuccccaucugaacacagaaggguggagcauggcucagggcucacucggacgccgaguagcgaagagaucucccccaccaaguuuccuggacuuuaccgcacaggugaaccaucucccccucacgacauucugcaugagccacccgaugucguuucggacgaugagaaagaccacggcaagaaaaaggggaaauucaagaagaaagaaaagcgaacugagggauaugccgcuuuucaggaagauucaagcggcgacgaggcagagaguccuuccaaaaugaagcguucuaaagguauacauguguucaagaagccgagcuuuuccaaaaagaaagaaaaggauuucaaaaucaaggagaaaccaaaggaagagaagcacaaagaagagaagcacaaagaggaaaagcauaaagagaagaagucaaaagacuugaccgccgcggauguagugaagcaauggaaagaaaagaaaaagaagaaaaagcccauucaggagccugaagucccacagaucgacgugcccaacuuaaaaccuauuuuugggaucccacuggcugaugccguugagagaacaaugauguacgacggaauaaggcuacccgcaguguuccgggaguguaucgauuaugucgaaaaguacggcaugaaaugcgagggcauuuaucgcgugagugggaucaagagcaagguagacgaacucaaagccgcuuacgacagagaggaaucuaccaaucuggaggauuaugagccgaacacuguugcaucccuucugaagcaguacuugagggaccucccugaaaaucugcugacaaaagagcucaugccccgguuugaagaggccuguggacgcaccacggagacugaaaaggugcaagaguuccagcgauuacugaaagaacuuccagagugcaacuacuugcugauuucauggcuaaucguccacauggaucaugugauagcuaaggaacucgagaccaaaaugaauauucagaacaucagcauugugcugaguccuacaguccagaucucuaauagaguucuuuauguguuuuucacucacguacaagagcuguuugguaacguggucuugaaacaggugaugaagccccucaggugguccaauauggccaccaugccaacacugcccgaaacccaggcgggcaucaaggaggaaauucggcgucaggaguucuuacugaacugucuccaccgcgaccuucaagggggaauaaaggaucugagcaaagaagagagauugugggagguucagaggauccuaacggcacugaagcggaaacuccgagaagccaagcgccaggagugcgaaacuaagauugcucaagagaucgccucgcugucuaaagaagacguguccaaggaggagaugaaugaaaacgaggaagucauaaauauucuucuggcacaggagaacgagaucuugacagaacaggaggaacuccuggcuauggagcaguucuuaagaaggcaaaucgccucagaaaaagaggagauugaacggcugcgcgcggagaucgccgaaauucagaguagacagcagcauggcaggagcgagaccgaagaguacuccucugagagcgaaucagagagugaagaugaggaagaacuacaaauaauccucgaggaccugcagcgucagaaugaggagcuugaaauuaagaacaaccacuugaaucaggcaauccaugaggagcgggaagcuaucauugagcugcgagugcaacucagacugcuucagaugcagagggccaaagcugaacagcaagcccaggaggaugaggaaccugaguggcgcgguggggcaguacagccaccgcgggacggaguucuggaacccaaggccgcuaaggagcaaccuaaagcgggcaaggaaccagcaaaacccuccccuagcagagauaggaaggagacuucuauauga

SEQ ID NO: 61562 - RNA, 6150 nt, Artificial Sequence
  derived and/or modified sequence opt3 from RALGAPA1__Homo_sapiens__NP_001269972
auguucagcaagaaaccccacggcgacgugaagaaauccacccagaagguccuggauacaaaaaaggacgcccucacuagacuuaagcaucugaggaucguuauugagaacgcugaaucuauagauuugaaacaauuuuucgaccagcacuuuucacauaucuacuauguguucuuugagaauuucguaacgauugaagcaaguuuaaagcagaaagggcacaagagccagcgggaggaacuggaugccauccuauuuauuuucgagaaaauccuccaacugcuuccugagcgcauacaucagcgauggcaguuucacuccaucggacugauuuugaagaagcuccugcacaccgguaacucucugaaaauccguagagaaggcgugaggcucuucuuacuguggcuucaggcguugcaaaauaacugcucgaaggagcagcuguggauguuuucaugucuaauuccaggguucagcgcuccgcagagugaacauggaccccggacacucgacaaucugaucaacccuccacuuaaucugcaggagacucaagucaccauagaggaaauuacacccuuggugccuccacaguccggcgauaaaggucaggaggaccucaccucuuacuuucuggaagccuuacugaaguauaucguuauucaagugaaaagccucgaguggaagaacaaagaaaaucaggagcgcggguucuccuuccuuuuuucacacuucaagaaguacuaucugcccuacaucuuuccuaacaucugcaaagagaauaguuuguaucauccaauucuagauauaccgcagaugagacccaagccucacuacgucgugaucaaaaaggacgcagaaacuaacgaggccauuuacuguacaaaagaaccauucaucaaggcuaggguaauaguuauucgguggcuggugagcuuuuggcucgagcccaagccucacaccggaccacauauccccggcauggaaggcgagguccugccgaaaaauauccagcgcgcagccgcuucucuugugucccgagaggaaucaaagaacgauaaugccgacaaaacggauagaacuaccgagccugaacaaagccacaguaacacaucuacucugaccgagagggaacccuccagcucgucuuugugcuccauugacgaggagcaucucacagacaucgaaauugugcggcgugucuucucaaguaagcgcagcaacguuaauuuugugaccgagauauucagacaggcguuucuguuaccaaucugugaagcagccgcuaugaggaaaguagugaaggucuaucaggaguggauucagcaagaggaaaagccucuguucaugcaggagcccgaagagaucgugaucacguccucugaucuaccaugcauugaaaacguuacugaccacgauauaagcauggaggagggggaaaaacgggaggaagagaauggaacaaacaccgccgaccaugugcgaaauucaaguugggcaaagaacgguuccuaccagggcgcucuccacaaugccagcgaagaggcgacugagcagaacauccgcgccgggacacaagcaguccugcagguguuuauuaucaauucuucaaacauuuuccuuuuggaacccgcuaaugagaucaaaaaccugcucgaugaacacaccgacauguguaagagaauacugaauaucuauagguacaugguaguucaggugaguauggauaaaaagacgugggagcagaugcuucuggucuugcuccgggugaccgaaagcguccugaagaugccuucccaagccuuuuuacaguuccagggaaaaaagaacaugacacuggcuggccgccuagccgguccacucuuccaaacucugauuguggcauggaucaaagccaaucuuaacguuuauauuucuagagaguugugggacgaucugcucucggugcugagcuccuuaaccuacugggaggaacuggcuacagaguggucacuuacuauggaaaccuugacaaagguacucgcgaggaaccuguauagucuagaccugucugaucucccgcuggacaaacuuagcgagcagaagcagaaaaagcauaaggggaaaggagucggccacgaguuucagaagguguccguugacaaaucauucagccguggcuggucucgggaucaacccgggcaggcaccuaugcgacagagauccgccaccacuacgggaaguccagguacagaaaaggcuaggagcaucgugcgccagaaaaccgucgacauagaugacgcccaaauuuugccccggucuacuagagugaggcauuuuucccagucagaggaaaccggcaaugagguauucggggcacugaacgaagagcagccuuuaccacgcaguagcucgacauccgauauccucgagcccuuuaccguggaacgagccaaggaggcugaacagaaugccacucggggaucuacagagggcagcguucaaucaugcaacggucuguucuggaaggaaaguuguuccgacauugggggcucuagcgcaaaugucccggaucuuauggacgaguuuaucgcggagcgucugagauccggaaacgcuucaacgaugaccaggcgcggcagcaguccugggucuuuggaaauaccaaaagaucuccccgacauccugaauaagcagaaccagaugcggccuauugaugaccccggagugccauccgaguggacuagcccugccucggcagguucaucugaucuaaucaguuccgacagccacucugacagcuucuccgccuuucaauacgauggcagaaaauucgacaauuuuggguucggaacagauaccggcgugacaucaagugcugacgucgauagcgguucugggcaccaucaguccgccgaagagcaggaaguugcaucacugacuacccuccacauugacagugagacgagcucccugaaccagcaagcuuuuucugccgagguggcgaccaucacaggcucggaaagcgccucacccgugcauuccccacuuggaaguaggucucagacuccgagcccuuccaccuugaauauagaucacauggagcagaaggaccugcaguuagaugaaaaacuccaucacucaguacugcaaacacccgacgaucuugagauuucugaguucccaagcgaaugcuguagugucauggcuggcgggacucugaccggauggcacgcagacguggccacgguuauguggcgacgcaugcuagguauccucggcgaugugaacuccaucauggaccccgagauucaugcucaggucuucgacuaccugugcgaauuguggcagaaucuggccaagauccgggauaacuuagggauuagcacagacaaucucaccucuccuucaccacccgugcugauaccuccgcuuagaauccugacuccaugguuguuuaaggcaacaaugcucaccgauaaauauaagcagggaaaacugcacgcguacaagcuaauuugcaacacuaugaaaaggcgucaagacguuucccccaaccgcgauuuccugacccauuuuuauaauaucaugcacuguggccuucuccauauugaccaggauaucgugaacacaauaaucaagcacugcaguccucaguucuuuagccuggguuugccaggggccacgaugcugauuauggacuucaucguagcugccggccgggucgcaucgucugcuuuuuuaaaugcccccagaguggaggcacaggugcuccugggaucccuugucuguuucccuaaccuguacugcgaauugccgagccuccaccccaauauuccagauguugccgugucacaauuuaccgacguaaaggagcugaucauaaaaacugugcuaaguucugcuagggaugagccuuccggccccgcgcgaugugucgcccugugcagccuugggauuuggaucugugaagagcucgugcaugaaucacaccauccacagaucaaggaggcacugaacguuauuugcgugaguuugaaauucacaaauaagaccgucgcucacguggccuguaacauguuacacaugcugguucauuaugugccucggcuccagauauaccaacccgacagcccacugaaaaucauucagauccuuauugccacaaucacucaccuguugccguccaccgaagcuucuagcuaugagauggacaagcgccuagucguaucccugcuccugugccuuuuagauuggauaauggcacugccucucaaaacguugcugcagcccuuucaugccacaggagcggagucagacaagaccgaaaagucugugcucaauuguaucuacaaaguucugcacggcugcguguacggugcucagugcuucaguaacccaagauauuuccccaugucgcuuagcgaucuggccuccgucgacuacgauccuuuuaugcauuuggagucucuaaaggaaccagagccccugcacucaccugacagcgaaagguccaguaaacuccaaccggugacugagguaaagacccagaugcagcacggguuaauuucuaucgcagcccggacagugauuacucaucuggucaaucaccuuggacauuauccaaugagcggcggucccgcuaugcugaccucacagguuugugagaaccacgauaaucacuacuccgaaaguacagagcucagcccugaauuguucgagucucccaacauccaauuuuucgugcugaauaacacgacccucguguccugcauacagauucgaucagaggaaaacaugccaggcgggggacugagcgcaggccuugccucggcgaauucuaacgucagaaucaucgugcgcgaccuaagugggaaauauuccugggauagcgcuauucuguacggaccucccccaguuucaggcuuguccgagccuacuucuuuuauguuaagccugagucaucaggaaaagccggaggaacccccaacauccaaugagugucucgaggacaucaccguaaaggauggucugagccuucaguucaaaagguuucgugaaacugugccuacaugggacaccauacgggaugaggaagacguccuggacgagcucuugcaauaucugggggugacgucucccgaaugccuacagagaacuggaauuucacugaacaucccagccccucagcccguuuguauuagugagaagcaagagaaugaugugaucaacgcaauacucaaacagcacaccgaagagaaggaauucgucgagaaacauuuuaaugaccuuaacaugaaggccguggaacaggaugagccgauuccacagaagccucaauccgcuuucuacuacugcaggcuguuauugagcauccugggcaugaauucuugggacaaacgccgaucguuucaccuccugaagaaaaacgagaagcuucugagagaacuccggaauuuggauucaaggcagugucgcgagacacauaaaaucgccguauucuaugucgcagaaggucaggaggacaagcacagcauucugaccaacacuggcgggucccaggcuuacgaggauuuuguggccggauuaggcugggaaguuaaucuaacaaaccacugcggguucaugggaggccugcaaaagaauaaaaguaccggucucacaacucccuauuucgcgaccucuacgguggaggucaucuuucaugugagcacacguaugccauccgacucagaugacagucuuaccaagaaacugagacacuuggggaacgaugaaguucauauuguguggucugagcacacucgggacuacaggcgcggaauaauccccaccgaauucggcgauguccugauugugaucuauccuaugaagaaucacauguuuagcauccagauuaugaaaaagccggagguacccuucuuugguccacucuucgacggcgccauagugaacgggaagguucugccuaucaugguccgagcaacagcuauuaacgccuccagagcucuuaaaucacucaucccccuguaccagaauuuuuaugaggaacgggcaagguacuugcagacuauugugcaacaucaccuggagccuaccacguucgaagacuuugccgcccagguguucagcccagcucccuaccaucacuuaccuucugaugcggaccauuga

SEQ ID NO: 61563 - RNA, 5622 nt, Artificial Sequence
  derived and/or modified sequence opt3 from RALGAPA2__Homo_sapiens__NP_065076
auguucucacgcaggucccacggcgacgugaagaaaucuacccagaagguccuggaucccaaaaaggacguucucacucggcuuaaacaucugcgcgccuuguuagauaacguggacgcuaaugaucugaagcaauuuuucgagacuaacuacucacagaucuauuuuauuuucuacgaaaauuuuauagcacuggagaacagucucaagcugaaagggaauaacaagucccagcgagaagaacuugacuccauccuguucuuguuugagaagauucuccaguuccugccugagcguaucuuuuucagauggcacuaucaaucuauuggaucgacgcugaagaaacucuuacauaccgguaauucaaucaagauaaggugcgagggcauccggcuguuucuuuuguggcugcaggcccuacagacaaacugugcggaagaacagguucucauuuucgcuugccuggugccaggguuuccggccgucaugagcagucgcggacccuguacucuugaaacccugaucaauccuuccccaucuguggcagauguuaagauuuaccccgaggagaucacaccuuugcucccagccauaagcggcgagaaaauugcugaggaccaaaccugcuucuuccugcagaucuuacugaaguauauggugauucaggcagccucccucgaauggaaaaacaaggagaaucaggauacugguuuuaaauuccuuuuuacacuguucagaaaguacuauuugccccaccuauuuccuucauucaccaaacugacgaacaucuacaagccaguccucgacaucccgcaucugaggcccaagccuguguacauuacuaccacacgggauaaugaaaacauauauaguacuaaaaucccauacauggcugcccgcguaguuuuuauuaaguggaucgugaccuucuuucuugagaaaaaguaucugacagcgacccaaaauacgaaaaacggggucgacguguugcccaagauaauucagacugugggaggcggcgcaguccaggagcgagccccugaacucgaugggggagguccaacagagcaagacaagagccacucuaacuccucaacccugagcgacagaagguuaaguaauucuucccuguguagcaucgaagaggaacaccggaugguuuacgagauggugcagcguauccuacucucgacucgcggcuauguaaacuucgugaaugaggucuuucaucaggcuuuccugcuucccucuugcgaaauugccgugacaagaaaaguugugcaggucuacaggaaguggaucuugcaagauaaaccgguguuuauggaggaaccugaccggaaggauguagcacaggaggacgcugaaaaacugggguucuccgagaccgauucaaaggaggccaguagcgaauccucuggacacaagcgaagcucaaguuggggccgcacguauuccuucaccagcgcgaugucuagagguuguguuacagaggaagagaacacuaaugugaaagccgggguccaggcacuccuacagguguuucuuaccaacucagcuaauauuuuccuguuggagcccugcgccgaagucccagugcuccugaaggagcaaguugacgcuuguaaagccguguuaauaaucuuuaggcggaugauuauggaacugacaaugaacaagaaaacuugggagcagaugcuacagauccuccugcgcaucaccgaagcaguaaugcagaagccuaaggauaaacaaauuaaggaccuuuucgcccagaguuuggcuggacugcucuuuagaacacugauggucgcguggauaagggcaaauuuaugcguguacaucagccgugagcugugggaugacuuccuuggcguuuuguccucucucaccgagugggaggaacugauuaacgaaugggccaauaucauggauucgcuaacugcugugcuggcccggacggucuacggcguggagaugacaaaccucccccuggacaaacuuagcgaacagaaggagaaaaagcagcgagggaaaggauguguauuggacccacaaaaggguaccacugugggcagauccuuuucacugaguuggaggucucaucccgauguuaccgagccuaugcgcuuccggagcgcaacaaccuccggggccccaggagucgaaaaggcuagaaauauugugaggcagaaagccacugagguggaagagugccagcaaucagaaaacgcaccggcggcuggcagcggucacuuaacagucgggcagcagcagcaaguucucagaucuuccaguacgagcgacauccccgagccucugugcucugauuccucacagggccagaaggccgagaauacccagaacaguagcucguccgaaccacaacccauacaggagaacaaaggacacgugaagcgagaacaugagggcaucacuauucuugugcggcguucuagcagcccugcagagcuggacuugaaagaugaccuccagcagacacaagggaaguguagagaaaggcagaagagugaguccaccaauucugauacaacucugggaugcaccaacgaagccgagcuaagcauggguccauggcagacgugugaagaggaccccgagcugaauaccccgacagauguagucgcugacgccgaugcacgccacuggcuccaacuguccccuacugacgcuucaaaccuuaccgauagcagugaaugcuugacagacgacuguucuaucauugccggcgggucccugacuggauggcauccagauagcgcggccguguuauggcggagaguucucggcauccugggugacgugaauaacauacagucgcccaaaauucacgcuagggucuuuugcuaucuuuacgagcugugguauaagcuagcaaaaauccgagauaaucucgccauuucacuggacaaccagucuaguccuucucccccaguguugaucccuccccugcgcauguucgcuagcugguuauuuaaggccgcaacccucccaaaugaauacaaagaggggaagcugcaggcguaucggcuuauaugugccaugaugacgagaaggcaagauguucugccgaacagcgacuucuuggugcauuuuuaccucguaaugcaccugggccuaacaagcgaagaucaggacauccugaauaccauuauccgucacugcccuccccgcuucuucucccuuggauuuccaggcuucucaaugcucgucggggauuuuauuacugcugccgcacgggugcugaguacagacaucuugaccgcucccagaagcgaggccgugacuguccugggaucuuuaguuuguuucccuaacaccuaucaggagauaccacuccugcaguccgugcccgaaguaaaugaggcaauuacagguacggaagaugugaagcauuaccuuaucaacauccuguugaaaaaugccaccgaggaaccuaacgaguacgcuaggugcauugcggucuguucacucggcguguggaucugcgaggaacuggcccaaugcacaagucacccgcagguuaaggaggcaauuaacgugauaggggucacacuaaaauuuccaaauaagaucguggcucagguugccugugacgugcugcagcuucucgucagcuauugggaaaaacugcaaauguucgagaccuccuugccccgaaagauggccgagauuuuaguagcuacaguggcauuucugcucccuucugccgaauacucgagcguugagacugauaagaaauucaucgugucacugcuucugugcuugcuagacugguguauggcgcugccagucuccgugcuccugcaucccguaaguaccgcugugcuugaggaacagcacucugcccgggcaccuuuacuggacuauauuuaccgcguccuccacugcuguguuugcggaagcuccacguauacacagcagucacauuacaucuugacccuggccgaucucucuagcacugacuaugauccguuucugccccuugcuaacgugaagaguuccgaaccagugcaauaccacagcucugcagagcugggcaauuugcuaaccgucgaggaagagaaaaagagaaggucacuggaacucauaccuuuaacagcccggauggugauggcgcaucugguuaaccaccuuggucauuacccccuguccgggggcccagcuauccuccacaguuugguaagcgagaaucacgacaacgcccauguggaaggaucggagcugucuuucgaggucuuucgauccccuaaucuccagcuguucguguucaacgauagcacucuuauuucauaucuacagacccccacagaaggcccaguugggggaaguccggugggcucucuguccgacgucagagugaucguacgcgauauuagcgguaaauacucaugggacgggaaggucuuguauggaccuuuagagggcugucuggcacccaaugguaggaacccaaguuuucucaucagcuccuggcaccgugauacguucggcccccaaaaagacucuagccagguggaagagggggaugacguucuggacaaacuucuggaaaauauaggacauaccuccccugagugccucuugccaucacagcugaaccuaaaugagcccucucugacuccuuguggcaugaacuacgaucaggaaaaggagauuaucgaagugauccuccggcaaaaugcccaggaggacgaguauauucagagucacaacuuugauucggcuaugaaagucacaagccaggggcaaccguccccaguggaacccagaggaccuuucuacuuuugcaggcuucuguuagacgauuugggcaugaacucuugggaccgccgaaagaauuuccaucugcucaaaaagaacucaaaacugcuuagagagcugaagaaucucgauagccggcaguguagggaaacccacaagauagccguauuuuauaucgcagagggucaggaagacaaaugcuccauuuugaguaacgagcgcgggucucaggcuuacgaggauuucguggccggacugggcugggaagucgacuuaagcacucacugcgguuuuaugggcgggcuacaacguaauggaucaacaggccagaccgcgcccuacuaugccacguccacuguggagguaaucuuccaugugaguaccagaaugccaagcgauucugacgauucccugacaaagaaacuccggcaccuugggaacgacgaaguucauauugucuggucagagcacagcagggacuaccgccgaggaaucauaccuaccgcauuuggcgaugugucgaucauuaucuaucccaugaagaaucacauguucuuuauugcuaucacuaaaaagccagaagugccuuucuucgguccgcuguuugacggggccauagucucuggaaaguugcugcccagucucguaugugcuacaugcauuaacgcauccagagccgugaaaugucugaucccacuuuaccagagcuucuaugaggagcgggcccucuaccuggaagcuaucauucaaaaucauagggagguuaugaccuuugaagauuucgcggcacagguguuuucaccuucccccucuuauagcuugaguggcacagacuga

SEQ ID NO: 61564 - RNA, 4476 nt, Artificial Sequence
  derived and/or modified sequence opt3 from RALGAPB__Homo_sapiens__NP_001269847
auguacagcgaguggagaucccugcaccucgugauccagaacgaccaaggccauaccucuguccuucacucauaucccgaaaguguugggagggagguggccaaugcuguagugcggccucugggacaggucuuggguacaccaagcguggcaggcuccgaaaacuuacugaagacugauaaagagguuaaguggacgauggaagugauuugcuacgggcuaacccucccgcuggacggagagacagucaaauauuguguggauguauacacugacuggauaauggcccuuguucugcccaaggauucuaucccuuugccagugauuaaagagcccaaucaguauguccagaccauccucaagcaucugcaaaaccuguucgugccucgccaggaacagggcucgucacagauucgacucugcuuacaagugcugcgugcgauccagaaguuagcuagagagagcaguuugauggccagggaaacaugggagguccugcuacucuuucugcuucagauaaaugacauccuguuggcaccacccaccguucagggugggauugccgagaaccucgcugaaaaacugaucggaguguuauucgagguauggcugcucgcauguacucggugcuuuccuacaccaccguacuggaagaccgccaaagaaaugguggcuaauuggcgccaccaucccgccgucguggagcaaugguccaagguuauuugugcgcuuacgucuagacuguugagguucacuuauggcccuagcuuuccagcauucaaagugcccgaugaagacgccucccuaaucccuccagagauggauaacgagugcgucgcucagaccugguuucgguuccugcacaugcucucaaaucccguggaccugaguaacccggccauaauuagcucuacaccuaaguuucaggaacaauuccuuaauguauccggcaugccccaggagcugaaccaguacccauguuugaagcaccucccucagaucuuuuuccgcgcaaugcgagggauuucaugccugguugaugccuuuuuaggaaucagcagacccaggagugacucugccccacccacuccugugaaucggcuguccaugccacaaagcgcggccgucucgaccacaccgccccauaaccgucgccacagagcagugaccgucaauaaagcuacgaugaagacuucuacaguguccaccgcccaugcuucaaaaguucagcaccagacuagcagcacauccccucuaucuagcccaaaccagaccucaagugaacccaggccucucccagcuccccggcgaccgaaggugaacuccauccugaaucuuuucgguagcugguuguucgaugcagccuuuguacacuguaaacugcauaacggcauuaaucgcgacucuucaaugacggcuauaaccacacaagcgaguauggaguucagaaggaaggggagccagauguccacugacaccauggucucuaacccuauguuugaugcaucggaguucccagacaauuacgaagccggacgggcugaggccugcggcacacucugucgcaucuuuugcagcaaaaagacuggugaagagauucugcccgcauaucuuuccagauucuacaugcuguugauccaggggcuccagauaaacgauuaugugugccacccuguucuggccucagugauuuuaaauagucccccacuguuuuguugcgaccuaaagggaaucgaugucgugguaccuuacuucaucucugcucucgaaaccauucugcccgacagggagcuuagcaaauuuaaguccuaugugaacccaacagaauugcgucggucaagcaucaauauucugcucucucuguuaccgcugccucaucacuucggcaccguuaaauccgaggucgugcuugagggcaaguuuaguaacgaugacaguucuuccuacgauaaacccauaacuuucuugucacucaagcugaggcuagugaauauccugauuggggcccuccaaacggaaacagacccaaacaauacccagaugauccugggagcaaugcuuaacaucguccaggauagugcguugcuggaggcuauugguugucagauggaaaugggcgggggagagaauaacuuaaagagccauucgagaacuaacuccggcauaucuagcgccucaggugggaguaccgagcccacaaccccugacuccgaaaggccagcacaagcccuccugcgcgacuaugauucugcugccggccuucugauccggagcauucacuugguuacucagagacucaauucccaguggaggcaagacaugucaaucagccuggcagcucuagagcugcucaguggacuggccaaagugaaggugaugguagauucuggcgaccgcaaacgagcgauuuccagcgucugcacauacaucguguaccaguguucgcggcccgccccucuucacucacgugauuugcauucuaugauaguugcugcauuucagugccugugugugugguuaacggaacacccggacaugcucgaugagaaggacugccugaaagaaguccuugagaucguggagcuggggauuaguggauccaagagcaagaacaaugaacaggagguuaaauauaagggugauaaagaaccaaaccccgccucuaugagagugaaggacgcugccgaggcaacccuaacuuguaucaugcaacuccugggcgcguucccuagcccauccgggcccgccucaccuugcaguuugguaaaugaaacaacccugauuaaauacagcagguuaccgacaaucaacaagcauucuuuccgcuauuuuguccucgauaauuccgugauacuggcuaugcuugagcagccccugggaaacgagcagaaugacuucuuuccaucagugacugucuugguucggggcaugagugguagacucgccugggcacagcaacugugucuacugccucgaggggcuaaggccaaccagaaacuuuucgugcccgaaccacgaccuguacccaagaaugaugugggcuuuaaauacagcgucaagcaccgcccauucccggaggaaguggacaaaauuccuuuuguuaaggcagaccucuccauccccgaucugcacgagauugugaccgaagaguuggaggaacggcaugagaaacugagaucuggaauggcccagcagaucgcuuaugaaauacacuuagagcaacagucggaggaggaacuccagaagaggagcuucccagaccccgucacggauugcaagccuccacccccugcgcaagaauuucagaccgcccgucuguuccuuucacauuuuggcuuccuguccuuggaggcacucaaagaaccggcuaacagucgccugccaccccaccuaaucgcccuggacucuacaauuccuggguuuuucgaugacaucggauaccuugaucuccugcccugccggccauucgacacuguguuuauuuucuauaugaagccuggucagaaaaccaaucaggagaucuugaagaacguugagagcuccagaacagugcaaccccauuuucuugaguuccugcucucacugggcuggucugucgauguagggaggcacccaggauggacuggccacgugagcaccaguugguccauaaauuguugcgacgauggugaagggagccagcaggaagagguuauuucuucagaagacaucggcgccuccaucuuuaacggacagaaaaaggugcuuuacuacgcugaugcacugacggagauugccuucgucgugccuaguccgguagagagcuugacagacucgcuagaaucuaacaucuccgaccaagauagcgacucaaauauggaucugaugcccggcauucucaagcagccaagucugacccuugaguuauuuccuaaccauacugacaaucugaacucuucccagcgacucagccccucaagucggaugcgcaaauugccacaggggagaccugugcccccgcugggaccagaaacaagggucagcguuguguggguggagcgguaugaugacauagaaaauuucccucucuccgagcugaugaccgagaucucuacuggcgucgaaaccacagcgaacagcuccacgucacuucgaucuaccacucuggagaaggaagugcccguuauuuuuauccacccauugaauacaggucuauucagaauuaaaauccaaggggcuaccggaaaguuuaacaugguaauaccccugguggauggcaugaucgucagucgcagggcccucgguuucuuagugcgucagacaguuauuaauaucugucggagaaaaaggcuggagucggacagcuacuccccuccgcaugugcgccgaaagcagaagauuacugauaucgucaacaaauauagaaauaagcagcuugagcccgaguucuacaccucucuguuucaagaagugggccucaaaaacugcucaagcuga

SEQ ID NO: 61565 - RNA, 2580 nt, Artificial Sequence
  derived and/or modified sequence opt3 from RALGDS__Homo_sapiens__NP_001035827
augaugguggacugccagagcuccacccaagagaucggcgaagaacugauuaacggggucauauacucuaucucacucagaaagguucagcuucaccauggagguaauaaaggccagagguggcugggguaugaaaacgagagugccuugaauuuauacgaaacauguaaggugcggacuguaaaagcuggaacgcuggagaagcuaguggagcaccucguccccgcauuccagggcagcgaucuguccuaugugaccauuuuucuuugcacauaccgcgccuucacuaccacacaacagguucuggacuugcucuuuaaacgauauggucguugugaugcgcugaccgcuucuucgagauacgggugcauccugccuuauucagacgaagauggaggcccacaggaccagcucaagaacgccauuagcaguaucuuaggcacuuggcuggaucaauacuccgaggacuucugucagccgcccgauuuuccuugccuuaagcaguugguggcauacguccagcugaauaugccagggucugaccuagaaaggcgggcccaucuccugcuugcucaacuggagcacagcgagcccauagaagcagagccugaagccuuguccccagugcccgcucucaaaccuacaccagagcuggaauuagcccugaccccggcgcgcgcacccucaccuguaccagcccccgcuccugagccagagcccgccccgacgccugcacccggaagugaacucgagguugcuccagccccugcgcccgaacuucagcaggccccagagcccgcagugggucuggaaagcgcuccugccccagcuuuggagcuagagccggcccccgaacaagauccugcaccaucucagacucuggagcucgaacccgccccugcuccaguccccucccugcagccgucauggccuagcccagugguggcggagaacggccuuagugaagagaagccccaucuguuggucuucccucccgaccucguugcagagcaguuuacccugauggaugccgaauuauucaaaaaggugguaccauaucacugucuggggucuaucuggucccaaagagacaaaaagggaaaggagcaccuagcuccuacaauuagggccacugugacccaguuuaauagcgucgcaaacugcgugaucacaaccugucucggcaaucggucgacgaaagcccccgaccgcgcucgaguuguggaacauuggauugaggucgccagagagugcaggauccugaagaacuucucuucccuuuacgcaauauugucagcgcugcagaguaauagcauucaccggcucaaaaagacuugggaagaugugucccgugacucuuuucgcaucuuccagaaacugagcgagaucuuuucagaugaaaacaauuauagucuuuccagagagcuguugauuaaggaagguacaagcaaauucgcuacccucgagaugaacccaaagagggcccaaaagcggccgaaagagacugggaucauucagggaacaguaccuuaccugggcaccuucuuaacggaccugguuaugcuagauaccgcaaugaaggacuaucucuacggccgacugauaaauuuugaaaaacgcagaaaggaguucgaagugaucgcccagauuaaacuuuugcagucugcuuguaacaacuauucaaucgcccccgaugagcaauuuggggcaugguucagggcugucgaacggcugagugagacagagagcuacaaucucuccugcgaacuggagccacccucugaaucggccagcaacacuuuacgcaccaagaagaauacagcgauagugaaaagaugguccgacaggcaggccccuucaacugagcugaguaccucuggaagcucccauucaaagagcugcgaucagcuucguugugguccauacuugucuuccggcgacauugcugaugcacucaguguccacagcgccgggucuuccucaagugacguggaagagaucaacaucagcuuuguucccgagucgccugacggacaggagaaaaaguucugggaguccgcuucucaaagcucaccggaaacaaguggcauuuccucugccagcuccucaaccagcaguucuuccgcaagcacuacgccaguggcggccacacggacccacaaacgaucgguaucaggucugugcaauucuaguuccgcucuaccccuguauaaccagcaggucggggauuguugcaucauuagagugagccucgacguugauaauggcaacauguacaagucuauacuggugacuagccaagacaaggccccugcagucaucaggaaagcuauggauaagcauaaucuugaggaggaggaaccagaagacuaugaguugcugcagauuuuauccgaugaccgcaaacucaagauccccgaaaacgccaauguguuuuacgcaaugaacucaaccgccaauuaugauuucguacugaaaaagcggacauuuaccaagggagugaaaguuaagcacggcgcuaguagcacucuuccuagaaugaaacagaaggggcugaaaaucgcgaagggaauuuucuga

SEQ ID NO: 61566 - RNA, 1590 nt, Artificial Sequence
  derived and/or modified sequence opt3 from RALGPS1__Homo_sapiens__NP_001177657
auguacaagagaaacggccugauggccagcgugcucgucaccuccgcuacaccccaggggucuucaaguagcgacucccuugagggacaaucuugcgauuaugcaucgaaaucauacgacgccguuguguucgauguacugaaggugacuccugaagaguuugcgagccagaucacguugauggacauuccagucuucaaagcuauacagccggaagaguuagccaguugugguugguccaagaaagaaaagcacucucuggcacccaaugugguugccuuuaccaggcgguucaaccaggugagcuuuugggucgugcgcgagauccuaacagcucaaacucucaagauucgagcagagauccugucccauuucguaaaaauugccaagaaacuucuggaauugaauaaccuccacucacugaugaguguugugagcgcucugcagucugccccuaucuuucgucucaccaagacaugggcguuacugaauagaaaagauaagaccacuuucgagaaacuugacuauuugauguccaaggaagauaacuacaagaggacacgggaguauauacgcucacugaaaauggucccaagcauccccuaccuaggcauuuaucuccuggaccuuaucuacauugauagugcauacccugccucuggguccaucauggagaaugaacagagaagcaaccagaugaauaacauacugaggauuaucgcugacuugcaagugucgugcucuuaugaucaucucaccacgcugccacacgugcagaaguacuuaaaauccguccgguauauugaggaacugcagaaguuuguugaggacgauaauuacaaacucucacuucgcaucgaacccggaaguagcuccccucgacuggugucuagcaaggaggacuuggccggcccaucagcagguaguggguccgcuagauucagcaggcggccgacuugucccgacaccucuguagccggaucacuaccuacaccacccgugccucgucaucgcaagagucacagccugggcaacaauagaggcaggcucuaugcgacucuggggccaaacuggcggguccccgugcgaaauuccccgcgcaccagaucuugcguuuacucgccuacaggacccuguaucugcagccuugguaacuccgccgcagugccaaccauggagggcccucugaggcggaaaacguugcucaaggaagggcgcaaacccgcucugucaaguuggacuagauauugggucauuuuaucuggaagcacacugcuauacuacggcgccaagucccucagggguaccgaucguaaacacgugucaauaguaggguggaugguucagcugccagacgaucccgagcauccugacaucuuucaacuuaacaauccagauaagggaaacguguauaaguuccagacuggcagccgguuucacgcuauuuuguggcauaaacaccuggacgaugccuguaagucuaaucgaccgcaggaagcaggcgccgcucccgggccuacaggaaccgacucccacgaggucgaucaucucgaagguggcgcggggaaagaggcaggaccaugcgccuga

SEQ ID NO: 61567 - RNA, 873 nt, Artificial Sequence
  derived and/or modified sequence opt3 from RALY__Homo_sapiens__NP_031393
augagccugaagcuccaggccuccaacgugaccaauaaaaacgaccccaagucuaucaauucaagagucuucauuggcaaccuuaauacagcucugguuaaaaagagugauguggagacuauauuuagcaaauacgggaggguagcaggaugcuccgugcacaaggguuaugccuucguccaauacucuaacgaacggcaugcgcgcgcugccguguugggcgagaaugggcgaguuuuagcaggacagacgcuggacaucaacauggccggcgaaccuaagccagaucguccgaaaggucuaaagagagcugcaucggccauuuauaggcucuuugacuaccgggggcgccugucacccgugccugucccaagagcugugcccguaaaaaggccucggguuaccgugccacuuguccgccgagugaagacaaaugugcccgucaaacuguucgccagaagcacugcgguuaccacaaguuccgcaaagaucaaguugaaaucuagcgagcuccaggccauuaagaccgaacugacucagaucaaauccaacauagaugcucugcucucaagguuagagcaaaucgccgcagagcagaaggcuaauccugacggcaaaaagaaaggagauggcgggggagccgguggcgggggaggcggugggggaaguggcggcgggggaagcgguggcgggggaggcggugggucuucccggccaccggcgccccaggaaaacacaaccucagaggccggccugccucagggagaagcacguacgcgcgacgauggcgacgaggaggggcuuuugacucacagcgaagaggaacuggagcauagucaagauaccgacgcugaugacggagcccuacaguga

SEQ ID NO: 61568 - RNA, 915 nt, Artificial Sequence
  derived and/or modified sequence opt3 from RALYL__Homo_sapiens__NP_001093861
augagcaagagaaggcggcugaaacagggcgagcccaucaugaccgggaagacacaaacuuccaacgugacgaauaaaaacgacccuaagucuauuaauucacgcgucuucauaggaaaccucaauaccgccaucguuaaaaagguggauauugaagcuaucuuuaguaaguacgguaaaauuguaggcugcagcgugcacaagggguaugcauucguccaguacauguccgagcgacaugcccgugcggcuguggccggagaaaacgcaagaguuaucgccggccagccacuugacauaaauauggcuggugagccgaaacccuauaggccuaagccagggaacaaacggccccugucugcauuguaccgcuuagaaucgaaggagccuuuucugucagugggaggcuaugucuucgauuacgacuauuacagagaugacuuuuacaauaggcuauucgauuaucacggccgggugccacccccuccacgcgccguaaucccgcucaagcgacccagaguugcugugacaacuaccaggcgggggaaaggagucuuuagcaugaaggguggcagucguuccacagccucugggagcaccggauccaaacugaagucagacgagcuucagacuauuaaaaaggaacugacacaaaucaaaaccaagauugauaguuugcucggccgccuggagaagaucgaaaaacagcagaaggcggaggcagaggcccagaaaaagcaacuggaagagagccucguguuaauacaggaagagugugugucugaaauugcugaccauuccacggaggagccugccgaaggugggccagaugcagacggagaggaaaugacugauggcaucgaggaagacuucgacgaggauggcgggcacgagcuguuucuucagauuaaauga

SEQ ID NO: 61569 - RNA, 447 nt, Artificial Sequence
  derived and/or modified sequence opt3 from RAMP1__Homo_sapiens__NP_005846
auggccagagcucugugcaggcucccccggcgcggccuuuggcuguuguuagcacaccaucuguucaugaccacagccugucaggaggcgaacuacggggcucuacuccgagaacugugccuuacucaauuucagguggacauggaggccgucggagaaacgcuguggugugauuggggucguaccaucagaagcuauagggaguuggcagacugcacauggcacauggccgaaaagcucggcuguuucuggccuaaugcugagguugaucgguuuuuccuggcagugcaugggcgcuacuuuagauccugcccaauuucuggaagggccguacgggacccgcccggcucaauacuguauccuuucaucguggucccaauuacugugacccucuuaguuacagcucugguggucuggcagaguaaacgcaccgaggguaucguguga

SEQ ID NO: 61570 - RNA, 528 nt, Artificial Sequence
  derived and/or modified sequence opt3 from RAMP2__Homo_sapiens__NP_005845
auggccagccugagaguggagagggcuggcgggccccggcucccucgcacccgagucggacguccagcagcccuuagacuguuguuacugcuaggugcgguucucaacccgcacgaagcucuggcccagccccuuccuacaacuggcacgccaggguccgagggaggcaccgugaagaauuacgaaacagcaguacaauucugcuggaaccauuauaaagaccagauggaucccaucgagaaggacuggugugauugggccaugauuucuaggccuuacucaacucugcgggacugcuuggaacacuuugcugaguuguucgaucuggguuuuccaaauccccuggcagagcgcauaaucuucgaaacccaucagauucacuuugccaacuguagucucgugcagccuacauucagcgacccaccggaggaugucuuacuggcuaugaucauugcccccaucugccuuauaccuuuucucaucacccuggugguuuggagauccaaagacucugaagcgcaagcauga

SEQ ID NO: 61571 - RNA, 447 nt, Artificial Sequence
  derived and/or modified sequence opt3 from RAMP3__Homo_sapiens__NP_005847
auggagaccggcgcccugagaaggccccagcuccuuccucuguuguuacugcuaugcgggggauguccacgggcugguggcugcaacgaaacagggaugcucgagcgccugccgcuuuguggaaaggcauucgccgacaugaugggcaaaguggaugucuggaaguggugcaaucugagcgaauuuaucguuuacuaugaguccuucacuaacuguacggaaauggaggcgaaugugguagguugcuacuggcccaacccuuuggcucaaggguuuauuaccggaauacaccgacaguucuuuucuaauuguacaguggaccguguccaucucgaggauccacccgacgaagugcugaucccucugauuguuaucccagugguccucacuguggccauggcaggcuuaguaguuuggagaucaaaaaggaccgauacacugcuuuga

SEQ ID NO: 61572 - RNA, 1863 nt, Artificial Sequence
  derived and/or modified sequence opt3 from RANBP10__Homo_sapiens__NP_065901
auggccgcugcaaccgccgaccccggcgcggggaacccucagccaggagauagcuccgguggcggggcuggaggcggucugccgucucccggggagcaagaacucucaagaaggcuucagcggcuguacccugccgugaaucagcaggagacaccauugccccgcaguuggagcccuaaggacaaauauaacuacaucggauuaucccaaggcaaucugcgaguccacuauaagggccaugggaaaaaccacaaggaugcagccucuguucgugcuacucauccaauucccgcagccugcggaauauacuauuucgaagugaaaaucguaucgaaggguagagacggcuacauggggauuggacuaucagcucagggcgugaauaugaacaggcucccugguugggauaagcacagcuauggguaccauggagacgauggccacaguuuuuguuccucuggcacggggcagccauacggaccgaccuucacaacuggugacgucaucggcugcugugugaaucugauuaacgggaccugcuuuuauaccaaaaauggacacagccuuggcaucgccuucacagaucugcccgcgaacuuguacccuacuguuggucuccagacaccaggggagauaguggacgcaaauuuuggccaacagcccuuccuguuugauaucgaagacuauaugcgggaguggcgcgccaagguccagggaaccgugcauuguuucccuauuuccgcuagacugggcgaguggcaggccguacuccaaaacaugguuucaaguuacuuagugcaccauggguauugcgcaacggcuacugccuuugcgaggaugaccgaaacaccaauccaggaggaacaggccagcauuaaaaaucggcaaaagauccagaaacugguccuugagggacgcgugggugaggcaauagaaacuacccagcgauucuaccccggcuugcuggagcacaacccgaaucuacucuuuaugcugaaguguagacaguucguggaaauggucaacgggacagauucugagguuaggucccuuucaagccggaguccuaagucucaagacuccuaucccggaagcccaucgcugucuccucgucacggccccuccucaagucauaugcacaacaccggugcugacagcccauccugcucuaaugggguggccagcacgaaaucaaagcagaaccauaguaaauaccccgcuccuuccucuagcucaaguagcuccucuucgagcuccucaaguucuccaagcuccguaaauuacucagaaagcaacucuacugauuccacaaagagucagcaccauagcucuaccuccaaucaggagacuucagacagugagauggaaauggaggccgaacacuauccgaacggcguguugggaagcaugucgacacgcauugucaauggcgcauacaaacacgaggaucuccaaaccgacgaauccucuauggaugacagacaucccaggcggcagcugugugggggaaaccaggccgcuacggagcgaaucauuuuauuuggucgcgagcugcaggcgcucagcgaacaacuuggcagagaguaugggaagaaucuggcacacaccgaaauguugcaggaugccuucucacuacuggcuuacagugacccuugguccugcccagugggacagcagcucgaucccauccaaagggagccuguuugugccgcacugaacucugccauccuugaaagccagaaucugccaaaacagcccccguugaugcucgcucugggccaagccuccgagugcuuacggcugauggcacgcgcgggucuagggucaugcagcuucgcuagaguggacgauuaucuccauuga

SEQ ID NO: 61573 - RNA, 3267 nt, Artificial Sequence
  derived and/or modified sequence opt3 from RANBP17__Homo_sapiens__NP_075048
auggcccugcacuuccagagccucgcugagcuugaagugcugugcacccauuuguacaucggcacagacuuaacucaaagaauugaggcagaaaaggcccugcuagagcucauagauucccccgaaugucugucuaaaugccagcuucuguuggagcaggggacgaccucauaugcgcagcuccuggcugccacaugucugaguaagcucgucagcaggguuuccccuuuaccaguggagcaacggauggacauccgcaacuacauucugaauuauguagcaucucagccgaaacuugcccccuuugugauccaggcuuugauucaggucaucgcaaagauaacuaaacugggaugguucgaagugcaaaaggaucaguuuguuuuccgagagaucauugccgacgugaagaaauuucuacaggguaccgucgaacacugcaucauuggcgugaucauacucucggagcugacacaggagaugaaccuuguagauuacucacguccuagcgcuaagcauagaaaaauugccaccaguuucagggacacuucccugaaggauguuuuggugcucgcguguucucuguuaaaagaagucuuugcaaagccacugaaucuccaagaccagugccagcaaaaccuugugaugcaagugcugaaguugguccuaaauugucugaacuucgauuuuaucgggagcuccgccgacgagucagcugaugaccucugcacaguucagauucccaccacguggcggacuaucuuccuggaaccugagacccuugaucuguuuuucaauuuguaucacagucucccaccccuguuaagccagcuggcccuaucuugucucgugcaguuugcauccacacgcagaucacuguucaacagcccugaaagggcuaaauaccuuggaaauuugaucaagggcguaaaacggauucuggagaacccacagggucucagugacccggggaauuaucaugaguucugccgcuuucuggcccgacuuaagacuaacuaccagcugggagaauuggugauggucaaagaguaccccgaagugauaagacucaucgcgaauuucaccauuacaucucugcagcacugggaguuugccccuaacuccguucacuauuuacugacccuauggcaaaggaugguggcaagcgucccauucgugaagucgacggaaccccaucuccuggacacuuacgcuccugagaucacaaaagccuuuauaaccucucggcuugauuccguagcuauuguugugcgugaccacuuggaugacccacuggaugacacugccacagucuuccagcagcucgagcagcuguguaccgugucacgcugcgaauaugagaagacgugcgcauuacugguccaacuuuuugaucagaaugcccagaacuaccagaaguugcuccaucccuauaguggcgugaccguugacaucacaauccaagaaggcagacuggcuuggcuaguguaccugguagggacugucgugggagguaggcucaccuauacaagcacugaugagcacgacgcgauggauggcgaacuguccugucggguuuuccagcuuauuucuuugauggacaccgggcugccgcgaugcuguaacgagaaaaucgaguuagcaauucucugguuucuggaccaguuccgcaagacauacgugggagaucaacuucagagaaccagcaaagucuacgccaggaugucagaagugcugggcauaacugacgauaaucacguauuggagacguuuaugacaaagaucgugaccaaccucaaauauuggggucgguacgaaccuguuauuagucgcacucugcaguuccuaaaugaccuguccgucggguauauccuccugaagaaacuugugaagaucgaugcugugaaguuuauguugaaaaaccauaccagcgagcacuuccccuuccugggaauuucugacaaucauucauuaagugauuuuagaugcaggacaaccuucuacacugcccucacacgucugcuuauggucgaccugggcgaggaugaagacgaguuugaaaacuucaugcuaccacucacgguugcauuugagaccgugcugcagauauucaauaacaauuuuaagcaagaagaugugaaacggauguugaucggccuggcccgagacuuaagagggauugcuuucgcccucaacacuaagacaagcuauaccaugcuguuugauuggauguacccuacauaucuuccccuguugcagaaugcaguagagaggugguacggagagccaacuuguaccacgcccauccucaagcugauggcggaacuaaugcagaaccgcucccagcggcugaauuucgacgucucuucgccuaacgguauucuucucuuuagagaggcuagcaaaauggugugcaccuacggcaaucaaauccuguccuuggggucacugaguaaggaccagauauauccaaugaaauuaaagggaaucucuauuuguuacagcgcccucaaauccgcacugugcggcaacuauguuucauucgguguguuuaaacuuuacggggauaaccacuucgacaauguccugcaggccuucgugaagauguugcucagcguuucucauuccgaucugcuacaguauaggaagcugagucaaagcuacuauccgcuucucgaaugucugacacaggaccacaugucuuuuaucauuaacuuggagcccccuguguuaauguacguacugacuuccaucucagaaggccucaccacacuggauacugucgugaguagcucgugcuguaccucccuugacuacauagugacguaucuguucaagcacauugcuaaagagggaaagaaaccauugcgcugccgagaggccacacaggcaggccaacggcuacugcauuuuaugcagcagaaucccgauguccuccagcaaaugaugucuguucugaugaacaccaucguguucgaagacugccguaaucaguggagcguaucaagaccucuuuuagggcugauucucuugaacgagaaguacuuuagugaacugagggcuucccucaucaauucucagccacugcccaaacaggaggugcuugcccaauguuuccgcaaccugauggaaggagucgagcagaauuugagcgugaagaaccgggauagauuuacucagaaucuauccguuuucaggcgagacguggcggaggcccugcgcucagaugguaacacagaaccgugcagccucgacaugaugaguuga

SEQ ID NO: 61574 - RNA, 606 nt, Artificial Sequence
  derived and/or modified sequence opt3 from RANBP1__Homo_sapiens__NP_002873
auggccgcugcaaaggacacccacgaggaucaugacacaagcacugaaaacacggaugaguccaaucacgacccccaguucgaaccuaucgugucucugccagagcaagaaauuaaaacccucgaggaggaugaagaggaacuuuuuaagaugagagccaaacuguucagguuugcgucagagaacgacuugccggaguggaaggaacggggcacaggggaugucaaauuacugaagcauaaggagaaaggagcuauacgccuacucaugcgacgugacaagacucugaaaaucugcgccaaucacuacauuacccccaugauggaacuuaagccuaacgcagguagugauagagccuggguuuggaauacacaugcugacuucgcagaugaguguccaaaacccgaacuguuggccaucagguuucucaacgcugagaaugcccagaaguucaagaccaaauuugaggaaugccggaaggagauugaagaacgcgagaaaaaggcgggcagcgggaaaaacgaccacgcagagaagguggccgagaaacuggaagcucuguccguaaaggaggaaacuaaggaggaugccgaagagaaacaguga

SEQ ID NO: 61575 - RNA, 9675 nt, Artificial Sequence
  derived and/or modified sequence opt3 from RANBP2__Homo_sapiens__NP_006258
augagaagguccaaggccgacguggaacgguacaucgcuuccguccagggcucuacccccucaccucgccagaagaguaugaagggguucuauuuugcaaaacuguacuaugaagccaaggaguacgaucucgcgaaaaaguauauuugcacuuacauaaacguucaggaacgagacccaaaggcucaccguuuccuuggacuguuguaugaguuagaagagaauacugauaaagccguggaguguuacagaaggagcguagaacugaacccgacgcagaaggaccuagugcucaaaaucgcagagcugcuuugcaagaaugaugucaccgacggucgggccaaauacuggcuggaacgcgcugcaaaguuguuucccggcuccccugccauuuauaagcucaaagagcagcugcuggauugugagggggaagacggauggaacaaacucuucgauuuaauccaaucugagcuguacgugagaccagacgauguucaugugaauauuaggcuugucgaaguguaucggucgacaaaacgcuugaaggacgcuguagcccacugccaugaggcggaacgaaacaucgcacugagaucaagccuagaguggaauaguuguguugugcagacucucaaagaguaccuggaaucccuucagugccuggagucugauaagagcgacuggagggccaccaacacagacuugcuccuggcuuaugccaauuuaaugcugcucacccuuuccacucgggauguccaggaaucacgugagcuguugcaaaguuuugacagcgcacuacagucugugaaaucccugggcgguaacgaugaacucucagcuacauuccuggagaugaaggggcacuuuuacaugcaugccggaagccuucuguugaagaugggccagcacaguucuaaugugcaguggcgcgcgcucuccgagcuggccgcauuauguuaucugauagcuuuccaaguccccagaccuaaaaucaagcuaauuaaaggcgaagccgggcagaaccuccuggagaugauggcuugcgacaggcuuagccagucgggacacauguugcugaaucucucucgggguaagcaagauuuucugaaagaaaucguugagaccuucgccaacaaguccggccagucagcacuuuacgacgcccuguuuaguagccaguccccaaaggauacgucuuucuuggggagcgacgauauuggaaauaucgacgugcgagaacccgagcucgaggaucugacucgcuacgacguaggcgcuauaagagcgcauaacgguucauuacagcaccugaccuggcuagggcuccaauggaacagucugccugcacuuccaggaauuaggaaaugguugaagcagcuguuucaucaccucccgcacgaaacaucccggcuggagacuaaugcccccgaaagcaucuguauuuuagaccuggagguguuccuuuugggcgucguguauaccucucaucuccagcugaaagagaagugcaacucacaccauaguagcuaccagccucuaugucugccacuccccguuugcaaacaacugugcacagaacgccagaaguccuggugggaugcuguguguacccuuauccacagaaaggccgucccuggcaauguggcaaaauugaggcuguuaguacagcaugagaucaacacgcuccgugcccaggaaaagcacgggcugcaaccagcacuucugguucacugggccgagugcuugcagaaaacuggaucuggucucaauucguucuaugaccagcgggaauacauuggccgaagcgugcauuauuggaagaaaguccugccccuacugaagauaaucaagaaaaagaacuccauuccggagccuaucgauccccucuuuaaacacuuccauucaguggacauacaggcaagugagauugucgaauacgaggaagaugcgcacaucacauuugcuauccuggacgccgugaaugggaacauugaggaugcaguuaccgccuucgaaucuaucaagagcgugguauccuauuggaaucuugcuuugauuuuucacagaaaagccgaggacauagagaacgaugcacugucaccagaggaacaagaagaguguaagaauuacuuaaggaaaacucgcgacuaccucaucaagauuaucgaugacagcgauucuaaccuguccgucgugaagaaacuuccuguuccccuggaaagugugaaggagaugcuaaauagcgucaugcaggagcucgaagacuauucugagggaggcccacuguacaaaaacgguuccuugcggaaugcugacucagaaaucaagcauaguacacccagcccuaccagauauucgcuguccccaucuaaaagcuacaaguauucaccgaagacgcccccuaggugggccgaggaucagaacaguuuacucaaaaugauuugccaacagguggaggcgauaaagaaagaaaugcaggagcugaaacuuaacuccucuaauagcgccuccccacaccgcuggcccaccgaaaacuacgggccugacucaguaccagauggcuaucagggaagccaaacauuccauggcgcuccccugacuguggcaaccacagggccgaguguuuacuacucucaguccccugccuauaauagccaguacuugcuccgaccagcugccaacgucacucccaccaaaggaccuguguaugguaugaaucggcugcccccacagcaacacaucuacgcauauccucagcagaugcauacacccccagugcagucgucaucugcguguauguuuagucaagagauguacggcccgccugcccuacguuucgaaucccccgcuaccgggauucugagcccaagaggagacgauuauuuuaacuacaauguccagcagacuucuacgaacccaccucuuccagagcccggcuacuucacaaagccuccgaucgccgcacacgcuagcagguccgccgagucaaagaccauugaauuugguaaaacuaauuucguucaaccaaugcccggggagggccuccgcccuagucugccaacccaggcacacacaacccagcccacuccuuuuaaguucaacagcaauuucaaaucuaacgacggagauuuuacauucuccucaccgcaaguggugacgcaaccacccccugccgcuuauaguaauagcgaauccuugcugggcuuacucaccucugacaagccccugcagggggauggauacucgggugcgaaaccaaucccuggcgggcagacuauaggaccccggaacacauuuaauuucggcagcaagaacguaucagguaucuccuuuaccgagaacauggggaguucucagcaaaagaauagcggcuucagaagguccgacgauauguuuacauuccauggaccaggcaaaucagucuuugggacuccgacccuugaaacggccaacaagaaucacgagaccgacggaggcucugcacauggugaugacgacgaugacgggccucacuucgagcccgugguuccacugcccgauaaaauugaagugaagacaggagaggaagacgaggaagaguuuuucugcaaccgagcuaaauuguuucgcuucgaugucgagagcaaggaauggaaagagcggggcaucgguaaugugaagauucucagacauaagacaaguggcaaaaucaggcugcuaaugcgucgcgaacagguucugaagauaugugccaaccacuauauuuccccugacaugaaacuuaccccaaaugccgggagcgaucggucuuucguguggcacgcucucgacuacgcagaugagcugcccaagccugagcaguuggccaucagauuuaaaacaccggaagaggcggcuuuauucaagugcaaguuugaagaggcccagucaauucugaaagcaccaggaacuaacguagccauggcuuccaaucaagcagucaggaucgugaaggaacccaccagucaugacaacaaagauauauguaagagcgacgccggcaaucucaacuucgaguuucagguggcgaaaaaggaggggucgugguggcacugcaauucuuguucccugaagaacgcuagcacggccaaaaagugcgucucaugccagaaucuuaacccuaguaacaaagaacugguuggacccccauuggcagagacaguguucaccccuaagacuucucccgaaaauguacaggaccgauuugcccuagugacacccaagaaggagggccauugggauuguuccaucugccugguccggaacgaaccuaccgugagccgcuguauugcuugccaaaauacuaagucagccaacaaaagugguagcuccuucguucaccaggcaucuuuuaaguucgggcagggagaccucccgaaacccaucaauagcgauuuuagauccguguucucaaccaaggagggccaaugggacuguucugcuugccugguccagaacgaggguaguucgacaaaaugugccgcgugccagaauccaaggaagcagagccuuccugccacguccauucccaccccagcaucuuucaaguuuggcacuucagaaacaagcaaaaccuuaaaguccggguucgaggauauguuugcuaaaaaggaaggacaaugggacuguaguucuugccuggugcggaacgaggccaaugcuacacgauguguugcaugccagaacccugauaaacccagcccgucaacuuccgugccagccccugccaguuucaaguuuggcaccagcgaaacgucuaaagcucccaaguccggguucgagggaauguuuacaaagaaagagggccagugggacugcucagucugucucguaagaaaugaagcgagcgcaaccaagugcaucgccugucagaacccagguaaacaaaaucagacuaccucggcugugucuacacccgccaguuccgagacuagcaaggcaccuaaaucaggguucgaaggaauguuuaccaagaaggagggccagugggauugcuccguuuguuuggugcgcaacgaggccucugcuacaaaaugcauagcgugucagaauccggguaagcaaaaccagacgaccagcgccgucaguacucccgcauccagcgaaacaucuaaagcuccaaagucaggcuucgaggggauguuuaccaaaaaggaaggacagugggacugcagugugugucugguaaggaaugaggccuccgcaacuaagugcauugccugucaaugcccuagcaaacagaaccagacaaccgcuaucucuacgcccgccucgucagaaaucagcaaggcgccuaaauccggcuucgaggggauguuuauucguaagggacagugggauugcaguguguguugcguccaaaacgagucuagcucccucaaauguguugcaugcgacgccucaaagccaacucacaagcccaucgcugaagccccuagugcuuucacccugggcucugagaugaaacuucaugauagcuccgguucacagguggggacaggauucaagagcaauuuuucugaaaaagcauccaaguucggcaacaccgagcagggcuuuaaauucgggcacguggaccaggaaaauagucccagcuuuauguuccaaggaucguccaacacugaguuuaagucuacaaaagaggguuucucaauucccgucagcgccgacggcuuuaaguucgggauaagugaaccgggaaaucaggagaagaaauccgaaaagccucuggagaacggcaccgguuuucaggcucaggauaucucugggcagaagaauggacggggcgugauuuucggccagacaagcucaacuuuuaccuucgccgacuuggcaaaguccacgaguggggaaggauuccaguuugguaaaaaggauccaaacuucaagggcuuuagcggggcgggagagaaacuauucucuucacaguauggcaagauggccaauaaagcuaacacauccggugacuuugagaaggaugacgaugccuacaaaaccgaagacagcgaugacauccauuucgagcccguuguacaaaugccugaaaagguggagcuggucacuggggaggaagaugagaaggugcucuauucucagagaguuaaauuauuuagguucgacgcagaagugagucaguggaaggagcgcggacugggcaaucuuaaaauucugaagaacgaagucaauggcaaacuccgaauguugaugagacgggagcaagugcugaagguaugugcuaaccacuggaucaccacaacuaugaaucucaagccacugucgggguccgauagggccuggauguggcuugcaagcgacuuuucagacggagaugccaaacuagagcagcuggcugcgaaguucaaaacccccgaauuggccgaggaauuuaagcagaaauucgaggaaugccagcgcuuacugcucgacauaccgcugcaaacgccucauaaacuugucgauacaggucgugcagcuaaacugauccagagagccgaggagaugaagucuggccucaaggacuuuaaaaccuucuugacuaacgaucagacaaaggugaccgaagaggaaaacaaagggagcggaacuggcgccgcuggugcuuccgacacaaccauuaagcccaauccagagaacacggggccuacucuggaaugggauaauuacgaccuacgggaggaugcccuggacgauaguguuucaucuagcuccgugcacgcgaguccccucgcuagcuccccagucaggaaaaaccuuuuccgcuuuggagagucuaccacaggcuucaauuuuucauucaagagcgcccugucgcccuccaagaguccugcaaaauuaaaccagucuggcaccagcguggggacagacgaagagucagacguuacucaagaagaggagcgagauggacaguacuuugaaccaguggucccguugcccgaccugguggagguauccucuggugaagagaaugaacaggugguuuucagucacagagccaagcucuaucgguacgauaaagacgucggccaguggaaggagagggggaucggagauauuaaaauccugcaaaacuaugacaauaaacaggugcgcauagugaugagaagggaucagguccuuaagcugugugcuaaccaucggauuaccccugacaugacgcuccaaaauaugaagggcacagagcguguaugguuguggacugcaugcgauuuugccgacggugaacgcaagguggagcaccuggcgguucgauucaaauuacaggauguggcugacagcuuuaagaaaaucuucgaugaagccaagaccgcacaggagaaggacucccuaaucacaccacaugucucaagaagcucuacccccagggaaaguccuugugggaaaauugccguggcuguucuggaggagacuacccgggaacgcacagacgugauacagggagaugacgucgccgaugcaacguccgagguggaaguaagcucaacuucugagaccacaccaaaggcugugguuagcccaccuaaauuugucuucggcucggaaagcgugaagaguaucuuuucuuccgagaaaagcaagccguucgccuucggcaacucaagugcgaccgggucccucuuuggauucagcuuuaaugccccacuuaagucuaacaauucagagacuagcuccguggcacaaucugguagugaaucgaaagucgagcccaagaaaugcgaacugagcaagaacuccgacauugagcagucaucugauagcaaaguuaagaacuuguucgcuaguuuuccuacagaggaauccucaaucaauuacaccuucaaaacgcccgagaaggccaaggagaaaaagaaaccagaggacucuccuagcgaugacgaugugcugauuguauaugaacucacucccacagcagagcagaaggcucuggccaccaaacuuaagcucccaccgaccuuuuucuguuacaagaacagaccugacuauguguccgaggaagaggaagaugacgaggacuuugaaacugccgucaaaaagcugaauggcaaauuguaccuggaugggagugagaagugcaggcccuuagaggaaaacacagcggacaaugagaaagaaugcaucauagugugggagaagaagccaaccguugaagagaaagcuaaggcagauacacuaaaacugcccccuacuuucuuuuguggagugugcagcgacacggaugaggacaacggcaauggugaagauuuccagucugagcuccaaaagguccaggaagcccagaaaucacagaccgaggagaucacauccacuaccgacagcguauacacagggggcaccgaagugaugguuccaaguuuuuguaagucugaggaacccgauuccauuacuaagucgaucagcucaccuuccgugucuagugagacgauggacaaaccggucgaucuuagcacccggaaggaaauugacacagauucaacuucccaaggagagagcaaaaucgugucuuucggcuucgggaguuccaccggacugagcuuugcugacuuggccucaucuaacucgggugacuucgcauuuggcagcaaggauaaaaauuuccagugggccaacacaggggcugcggucuuuggaacccaguccgugggcacucaaagugccgguaagguuggggaggacgaagauggcucugacgaggaagugguacacaaugaggauauacacuucgaaccaauugugucacugcccgaggucgagguuaaaagcggagaagaggacgaagagauccucuuuaaggaacgagcaaagcuguauagaugggaucgcgacgugucccaguggaaagagaggggcgucggggauaucaagauucuuuggcauacaaugaaaaacuacuaucggaucuuaaugcguagagaccagguguucaagguaugcgcuaaucacgugauaacgaaaaccauggagcugaagccucucaacguuaguaauaacgccuugguguggacugcaucugauuacgccgacggagaagcuaaggucgagcagcuggccgugagguuuaaaacaaaggaagucgcggauuguuucaaaaagaccuuugaggagugccaacagaaccuaaugaaacugcagaagggucaugugagccucgcagccgaacuuuccaaggagaccaauccaguuguauucuuugacgugugugcugacggcgaaccccuggggcgcauuacaauggaguuguucucaaacaucgucccucggacugccgaaaauuuccgagcacugugcacgggagagaaaggcuuugguuucaagaacagcauuuuucacagagugauccccgauuucguuugucaagggggcgacauaaccaaacaugauggaacaggcgggcaaucuauuuauggagacaaguuugaggaugaaaauuucgacgugaaacacacuggcccaggucuccuguccauggcuaaccaggggcagaauaccaacaauagucaguuugucaucacauuaaagaaggccgagcaccuugauuucaaacaugugguauuuggauucgugaaggacggcauggauaccguuaaaaagaucgaaucauuugguagcccgaaaggcucggucugcaggcgcauuacuaucacggagugugggcaaauuuga

SEQ ID NO: 61576 - RNA, 1689 nt, Artificial Sequence
  derived and/or modified sequence opt3 from RANBP3__Homo_sapiens__NP_003615
auggccgaccuggcuaacgaggaaaagcccgcaaucgccccuccaguguucgucuuucagaaagauaagggccagaaaagcccggcggagcaaaagaaucucuccgacucuggggaagaacccagaggagaagcugaggccccucaccaugguaccggccacccagagucagcaggggaacaugcccuugagcccccugcuccagcaggagccagugcuagcacacccccuccaccggcccccgaagcgcagcugccuccauuccccagggaguuggcaggccgguccgccggugggucuucgccugagggaggcgaagauucagaccgcgaggauggcaacuacugcccacccguuaaacgagaacguacuagcaguuuaacgcaguuuccgccuucccaaucugaggaaagaagcuccggguucaggcugaagcccccaacccuaauucacggacaggcuccuucagccggucuccccagucagaagccaaaagagcagcaacggagcgugcugcgccccgcaguacuucaggcuccucagccaaaggcccugucucagacagugccguccucaggcacuaauggggucagcuugcccgcggacuguaccggagccgugccugcagcuaguccagauacagccgcuuggagaucucccuccgaggccgcagacgaagagaaagaaccucaaaagaacgagagcucgaaugccucugaagaggaggcuugcgagaaaaaggauccagcgacccagcaggcauuuguuuucggccaaaaccucagggaccgggugaagcugauaaaugaguccgucgaugaagccgacauggagaacgcuggucaucccucagccgauacuccgacagcaaccaauuauuuucugcaguacaucaguagcucccucgaaaacucuacgaauagcgccgacgcuucaaguaacaaauucguguuugggcagaauauguccgagcgcguauuaagcccuccaaagcugaacgagguuucuucagacgccaaucgagaaaacgcagcggcugagaguggaagcgaauccucuucgcaggaggccacucccgagaaagaaagccuugcagaguccgccgcugccuauaccaaggcaacagcuagaaaauguuugcuggaaaagguggaggucauuacuggcgaagaggccgagucaaacgugcuacaaaugcagugcaaacucuucguguuugauaagaccagucagucuugggucgaaaggggccgggggcugcuucgucugaaugacauggcgagcacagaugacggaaccuugcagucccgccucguuaugagaacgcaagguucacugagguuaauccugaacacuaagcucugggcccagaugcagauugauaaagcuagcgagaagucuauccggauaacagcaauggacaccgaagaucagggcgugaaaguauuccuuaucuccgccaguagcaaggacacugggcaacuguacgcugccuugcaccaccgcauucuagcacugcgaucuagaguggagcaggaacaggaggcgaaaaugccugcccccgagccaggagcugccccuuccaaugaagaggaugacucagaugacgacgauguccucgcacccaguggcgcuacagccgccggugcaggggacgaaggcgauggacagaccacgggcagcaccuga

SEQ ID NO: 61577 - RNA, 1473 nt, Artificial Sequence
  derived and/or modified sequence opt3 from RANBP3L__Homo_sapiens__NP_001154901
augaccacaauccccagaaagggcagcucccaucugccugggucucuccacacuugcaaacuuaagcugcaggaggacaggcggcaacaggaaaaaucagugauugcccagccaauauucgucuuugagaagggagaacagacguucaaacgcccggcugaggauaccuuguacgaagcagccgagcccgaguguaacgguuuuccuacaaagcgaguucguaguagcuccuucacuuuucacaucaccgacucucaaucgcagggcgugucaacauuaagccagaagcagaugagaugcaguuccguaaccaaucugccaacuuucccccauucugggccugugaggaaaaacaaugucuuuaugacaagcgcgcuagugcaauccucaguugauauuaagagugcugaacagggaccagugaaacacagcaagcaugucauccggcccgccauucuccagcugccucaggcacgcucuugugccaaagugagaaagaccuucggccacaaggcucuugaguccugcaaaacgaaggagaaaacuaacaauaagaucucagaagguaacagcuaucuguugagugagaaucucucuagggcacggauauccguacaacugagcaccaaccaggacuuucugggggccacaucgguuggaugucagccaaaugaagauaaaugcucuuucaaguccuguucaaguaacuuuguguucggcgagaauauggucgaacgcgugcucggcacucaaaaauuaacccagccgcagcuggagaacgacagcuacgcuaaggaaaagcccuuuaaauccaucccuaaguucccagugaauuuccuuucuagccgaacagauucaauuaaaaacaccaguuugaucgaguccgccgcggcauuuagcucucagcccucaagaaagugccugcuagagaaaauugacgucaucacgggggaagagacugaacacaauguucucaagauaaacuguaagcuguucauuuuuaacaaaacaacccaaaguuggaucgagaggggacgggguacucuucgucugaaugauacagccagcaccgacugcggcacguugcagucccgccucauuaugagaaaccaggggucucugagguuaauccucaauucgaagcugugggcucagaugaaaauccaacgggccaaccauaagaaugugcgaauuaccgcaacagaucuugaagacuauagcauaaaaaucuuccugauucaggcuuccgcccaggauacugcguacuuguaugccgcaauccaccaucgccuaguagcucugcagucauuuaacaagcaaagagacgugaaucaggccgagagucucucugagaccgcucagcagcugaacugugaaagcugcgacgagaaugaagaugacuucauacaagucacaaagaacggauccgauccuucaagcuggacucacaggcagucuguggccugcuccuga

SEQ ID NO: 61578 - RNA, 3318 nt, Artificial Sequence
  derived and/or modified sequence opt3 from RANBP6__Homo_sapiens__NP_036548
auggccgcuaccgcaagcgccggcgugcccgcgacagucuccgagaagcaggaauuuuaccaacugcucaaaaaccuuaucaauccuucuugcaugguuagaaggcaggcugaggaaauuuaugagaacauaccagggcuguguaagacuacguuuuuguuagacgccgugcggaaucgccgagcaggauacgaaguacgucagauggccgcugcacugcuaagaaggcuccugucaagugguuucgaggagguguauccgaaccuucccgccgauguccagcgggacgugaaaaucgaacugauuuuggcuguuaagcucgagacccacgccagcaugcgcaaaaagcugugcgauaucuuugcggugcuggcaagaaaucucauugacgaagauggcacaaaccauuggccugagggguuaaaguuccugaucgacuccauauacucuaaaaaugucgugcuuugggagguagccuugcacguuuucuggcauuucccaggaaucuuuggcacucaagaaaggcacgaucuggacauuaucaagcggcuacucgaucaguguauucaggaccaggagcaucccgcuauccgcacccugucggcccgagcagcugccgcguucgugcuugccaacgaaaauaacauagcacuguuuaaagauuucgcugacuugcucccugguauucugcaagccgucaaugauucaugcuaucaggacgacgauagcguguuagagagucugguggaaaucgcugacacagucccaaaguaccucgggcccuaucuugaggauacccugcaguugucccuaaaacuguguggagacucuagacucagcaaccugcagaggcaacuugcccuggagguuauugugacuuuguccgaaacagcaaccccuaugcucaagaagcacacgaauaucaucgcccaggcuguaccacacauucuggcgaugaugguggauuuacaggacgaugaggacugggucaacgcagaugaaauggaggaagacgauuuugacucaaaugccguggcugccgagagugcacuggaccggcuagccugcggccucggcgggaaaguugugcugccgaugacuaaggagcauauaaugcaaaugcuucagagccccgauuggaaauaccgucacgcuggauugauggcccugucugcaaucggugaaggcugucaucagcagauggaguccauucucgacgaaaccgucaacucagugcugcuuuuccugcaagauccucacccacgcguaagagcggcugccugcacaacuuuggggcagauggcaaccgacuuugcccccaacuuccagaagaaauuccacgagacaguuaucgcugcccuccugaggaccauggaaaaucagggaaaccaacgggugcagagccaugcagcuagugccuuaauaauuuuuaucgaggauuguccuaagucucugcuaguccucuacguggacuccauggucaaaaaucugcacagcgugcuuguuaucaaguugcaggagcugauucgaaacggcacgaagcucgcgcuggaacaguuagugacuacaaucgccucgguagcugauaccauugaggaaaaauucgucccauauuacgacauauuuaugcccucucugaagcauaucguggagcuugcaguucaaaaagaguugaagcuccugcgcgguaaaacuauugaaugcaucucccacaucgggcuagccgugggaaaggagaaguucaugcaggaugcuucaaaugucaugcagcugcuccugaaaacacagagugaccuuaacaauauggaagaugacgauccgcaaaccagcuauaugguguccgccugggcaagaauguguaagauuuugggcaaagacuuucagcaguaccugccuuuaguaauagagccccucaucaagacggcgucugccaaaccagacguggcucugcuugauacccaagacguugaaaacaugagcgaugacgauggcuggcaguucgucaaucugggggaccagcagucauuuggaauuaagacaagugguuuggaggccaaggcaacugcuugccaaaugcucguguauuacgccaaagagcugagggaaggcuucguggaguauaccgaacaggucguuaagcuaauggugccucugcucaaauuuuacuuccaugauaacgugcggguagcagccgcugaguccaugcccuuucugcuugaaugcgcgcgcaucagagggccagaguacuuggcccagauguggcaguucauuugugacccccugaucaaggcaauaggaacagagccugauacugacgucuuaagcgaaaucaugaacucuuuugcuaaaucaauugaggugaugggcgaugguugccucaaugacgaacaccuggaggaacuugggggcauccugaaggccaagcuagagggacacuucaaaaaucaagagcucaggcagguuaagcgucaggaagagaacuaugaucagcaaguggaaaugagucugcaggacgaggacgagugugaugucuacauuuugaccaaagugagcgacauccugcauuccuuauucucuacauauaaggagaaaauacucccaugguuugaacagcugcuuccgcugauuguuaauuugaucugcucgagccggcccuggccugaucgacaauggggccucuguauuuucgacgauaucauagaacacugcuccccaaccucauuuaaguacguggaguauuucagauggcccaugcugcuaaacaugagggacaacaauccugaaguacgccaggccgcugcauacgggcugggagucauggcccaguuugguggcgaugacuaucggagucuuuguucugaggcggugccacuccuggugaaagucaucaagugcgcuaacagcaagacuaaaaagaauguuauugccacggagaacuguaucuccgcaauugggaaaaucuugaaguucaaacccaauugcgugaacguagaugaagugcugccgcauugguuaucauggcucccucugcacgaggacaaggaagaggccauacagacacuuagcuuucugugugauuugauugaaucuaaucacccagucgugaucggacccaacaauuccaaccucccuaagaucauuaguaucauugcugagggcaaaauaaaugagaccaucaacuacgaagaccccugcgcaaagagacuggccaauguugugaggcaaguccagacuagcgaggaccuauggcuggaaugcgugucucagcuugaugacgagcagcaagaagcgcuccaggagcuguugaacuucgcuuga

SEQ ID NO: 61579 - RNA, 2190 nt, Artificial Sequence
  derived and/or modified sequence opt3 from RANBP9__Homo_sapiens__NP_005484
augagcggccagcccccuccaccgcccccucaacagcagcagcaacagcagcagcuguccccacccccuccagccgcucucgcacccgugucuggggucguucuuccugccccaccggcggugucagcuggaaguagccccgccgguuccccuggcgggggagcaggcggugaggggcugggagccgcugcagccgcuuuguuacugcacccacccccuccacccccgccugccaccgcggcacccccaccucccccacccccuccaccgcccccugccucugcugccgcaccagcuucgggacccccugccccacccggccuagcggccgggccgggaccugcugguggcgcaccaacacccgcccucguagcugggucaagcgccgcagccccuuucccccauggagacagugcucugaacgaacaagagaaggaacuucagagaaggcugaaacgguuguacccagcgguggaugagcaggaaacuccucucccccgcuccuggucuccaaaggacaaauuuagcuauaucggccugucccagaauaaccugcgaguccacuacaagggucaugggaaaacgccgaaggaugcagccucagugcgugcuacccacccuauucccgccgcaugcggaauauauuacuucgagguuaagaucgugaguaaaggcagagacggcuauauggggauuggacucagcgcccaaggugucaauaugaacagguuaccaggcugggauaagcauucuuacggguaucacggagacgauggccacuccuuuuguucaagcgguacagggcagcccuacggcccuacuuucaccacaggagacgugaucggcugcuguguaaaucugauuaacaauaccugcuuuuacacuaaaaacgggcauagucuuggaaucgcuuucacagauuugccacccaaucuguauccuaccguuggucuacagacgccgggcgagguggucgacgccaacuuugggcaacacccauucguguuugauauagaagacuacaugcgggaguggcgcacuaagauccaggcacagauugauagauuccccaucggagacagggaaggcgaguggcagaccaugauucagaaaauggugucuuccuaucucguccaucacgguuacugugcgacagcugaggccuuugcacggagcacugaccaaaccguucuggaggaacuugccucgaucaagaaucgccagcgaauacagaagcugguguuggcugggagaaugggcgaagccauugagacaacccaacagcucuauccuucucuguuagaaaggaacccaaaucugcuguucacgcuuaaaguacggcaguuuaucgagauggugaacggaacugauuccgagguccguugccugggcgggcgcucacccaagagucaggacagcuacccuguguccccgagacccuucucuagcccaucaaugaguccuucccacggaaugaauauucauaacuuggcaagcgguaaaggcucuacagcucacuucucaggguuugaaaguuguagcaacggaguuaucuccaauaaggcccaucaaucuuauugccacucgaacaaacaucagagcuccaaucuaaacgugcccgagcucaauucaaucaacaugaguaggucucagcaggucaauaacuucaccagcaaugauguggacauggaaacugaucacuacuccaacggcguaggugagacaucaagcaauggguuucucaacggaucuuccaagcacgaccaugaaauggaggauugugacaccgagauggaaguugauaguagccaacugcggcgacagcuuugcggcggcucucaggcggccauugagcgcaugauacacuucgggagagaacugcaagcuauguccgagcaguugaggcgggacuguggcaaaaauacggcaaacaagaagaugcucaaagaugccuuuucacuguuagcuuacagugacccauggaauagcccugugggcaaccagcuggaccccauccagcgcgaaccagucugcucggcccuaaacuccgcaauucucgagacccauaaucugccgaagcaaccuccccuugcguuggccaugggucaggcuacacagugccuggggcucauggccagaucuggaaucggcagcugugcauucgcuacuguggaggauuaucugcacuga

SEQ ID NO: 61580 - RNA, 1764 nt, Artificial Sequence
  derived and/or modified sequence opt3 from RANGAP1__Homo_sapiens__NP_001265580
auggccagcgaggacaucgcuaagcuggcagaaacccucgccaaaacacagguggcgggcgggcaacuuuccuucaagggaaaaucucugaaguugaacacugcugaggaugccaaagacgucauuaaggaaauagaggauuuugacucauuagaagcacugagacuagaggguaauacgguuggcguggaggccgcuaggguaaucgcaaaggcccucgagaaaaagagugaacugaaacggugccacuggagcgauauguucaccgggcgccuucgaacagaaauucccccugcucugaucuccuugggagagggccucauuacugccggugcgcagcugguggagcuggaccucucugauaacgcauuugggccagacggaguccagggcuucgaagccuuacugaagucgucagcuuguuuuacccuucaggaguugaaacugaauaacugcggcauggggaucggagguggcaagauacuagccgcagcucucacagaaugucaucguaagagcagugcccaagggaaaccgcuggcgcuuaagguguucguugccggaagaaauaggcuggagaacgauggcgcaaccgcuuuggccgaggcuuuucgggugaucgguacucucgaagagguccacaugccccagaaugggauuaaccauccuggaaucacagcccuggcacaggccuucgcugugaauccauuacugcgcguaauuaaccucaaugacaacaccuuuacggaaaaaggcgcgguugcaauggccgagacucuuaagacccugagacagguggaagucaucaauuucggcgauugcuuggugagguccaaaggggcuguggccauagcagacgccauucggggaggucuacccaagcugaaagagcucaaccugucuuuuugugaaaucaagcgcgaugcugcccuugcagucgcggaggcuauggccgacaaggcagagcuggaaaaauuggaccucaauggcaacacacugggggaggaaggaugcgagcaauuacaggaaguucuggagggcuucaacauggccaaggugcuagcuagccucuccgaugacgaggaugaagaggaagaggaggaaggugaggaagaggaagaggaggccgaagaggaagaggaagaggacgaggaagaggaagaggaagaggaggaagaggaagaggaggaaccucagcagcgagggcaaggcgagaaaucagcaacuccaaguagaaagauucuggaucccaauaccggagaaccugcuccaguacuuagcucuccgcccccugccgacguguccacauuuuuggcguucccaucacccgagaaacugcucaggcugggcccuaagagcaguguccuuaucgcccagcagaccgauacgucugacccagaaaaggugguuuccgcuuuccugaaagugagcucggucuuuaaggaugaggcaacugugcggauggccguacaagacgcuguugaugccuugaugcagaaagcauucaacucuuccucauuuaauaguaacacauuccucacccgucuguuagugcacauggggcugcuaaagagcgaggacaaagucaaggcgaucgccaaucucuacggaccccugauggcucuuaaccauauggugcagcaggacuauuuuccgaaggccuuggcaccucugcuccuggcuuucgucacuaaacccaauuccgccuuagaaucuuguagcuuugcacgccacucacugcuucaaacauuguacaagguguga

SEQ ID NO: 61581 - RNA, 441 nt, Artificial Sequence
  derived and/or modified sequence opt3 from RANGRF__Homo_sapiens__NP_001171272
auggagcccaccagagacugcccucuguucggcggggccuuuagcgcuauccucccaaugggagcaauugauguguccgaccuuaggccgguccccgauaaccaggaaguuuucugucacccugugacagaccaaucucugauaguagaguuguuagaacugcaggcccaugugcggggugaggcggcugcccgcuaccacuuugaagaugucggcggggugcagggagcacgagccguucauguggagucaguccagccacuaagucucgagaaucuggcucugcguggcagaugccaagaagcaugggugcuuagcgguaagcagcagaucgccaaagagaaccagcaaguagcuaaggacguuacuuugcaccaggcccuccugaggcugccccaguaucagacggaucucuuacugaccuucaaucaaccuccauga

SEQ ID NO: 61582 - RNA, 387 nt, Artificial Sequence
  derived and/or modified sequence opt3 from RAN__Homo_sapiens__NP_001287725
auguucgacgugaccagcagagucacauacaagaacguucccaauuggcacagggaucuggugcggguaugcgagaacaucccuauugugcucuguggcaauaaagucgacauaaaggaucgcaaagugaaggccaaauccaucguuuuucaucgaaagaagaaccuucaguauuacgacauuucugcuaaaucaaauuauaacuucgaaaagccauuucugugguuggcacguaaauuaaucggggauccgaaucuggaguucguggccaugcccgcgcuagcuccuccagaagucgugauggaccccgcccucgcagcccaauacgagcacgaucuggaaguagcucagacuacggcacuuccugacgaggaugacgaucuguga

SEQ ID NO: 61583 - RNA, 555 nt, Artificial Sequence
  derived and/or modified sequence opt3 from RAP1B__Homo_sapiens__NP_001010942
augagagaguacaagcuggugguccucggcagcgggggaguugguaaauccgcccuuaccgugcaguucguacaaggcaucuuuguggaaaaguaugaccccacaauugaggauucuuacaggaaacaggucgaaguggacgcucagcagugcaugcuggagauauuggauacugcagggacggaacaauucaccgccaugcgggacuuauauaugaagaacggacagggcuuugcgcugguuuacucaaucacagcucagaguacuuucaaugaucuacaggaccuccgcgagcaaauucugcgagugaaagauaccgacgaugucccuaugauccuuguggguaacaagugugaccuggaggaugaacguguaguugggaaggagcagggacagaauuuggccagacaguggaacaauugcgcauuucucgaaagcuccgccaaaucuaagauuaacgugaaugagaucuucuaugaccuggucaggcaaauaaaccggaaaacaccagugccgggcaaggcucgcaaaaagucgucaugucagcugcucuga

SEQ ID NO: 61584 - RNA, 2148 nt, Artificial Sequence
  derived and/or modified sequence opt3 from RAP1GAP2__Homo_sapiens__NP_001093868
auguucggcagaaagaggagcguguccuuugggggauucgguuggaucgacaaaaccaugcuggccucucucaaggucaaaaagcaggagcuugcuaacucaagugaugcaacacugcccgaccggccuuugagcccaccguuaacugcucccccuacgaugaaauccucugaauuuuucgagaugcuggaaaagaugcaagaugacuacauuccauaucccucgauagaugagguuguggaaaagggcgggccuuacccacagguaauccuaccccaguuuggaggcuauuggauugaggacccugagaauguggguaccccaacaucacucgggagcaguaucugcgaagaggaagaggaggauaaccuguccccgaauacuuucggauacaaacuugaauguaagggcgaggcgcgcgcuuaucgacgucacuuucugggcaaagaccauuugaacuucuacugcaccgggucuagccucggaaaucugauucuguccgucaagugugaagaggccgaagguaucgaguaucucagagugauauuaaggucaaaacugaagacaguucacgagcggaucccccuugcaggcuugaguaagcugccuagcgugccacagauugccaaagccuuuugcgaugacgcagucgggcuacgcuucaaccccgugcucuacccuaaggccucucaaaugaucguauccuacgaugaacaugagguuaauaacaccuuuaaauucggagugauuuaucagaaggcuagacagacucuggaagaggaacuuuuuggcaauaacgaggagucaccagccuucaaagaguuccuggacuugcucggugauacaaucacccugcaggacuuuaagggguucaggggaggcuuagacgucacgcacggccaaacugggguggaaagcguguacaccacauuucgggaucgcgaaauaauguuccaugucaguacuaaacugcccuuuaccgacggagaugcgcagcagcuccagcgaaagagacacauugguaaugacaucguugcaauuaucuuccaagaggaaaacacaccguuugugccugauaugaucgccucuaauuuccuucacgcuuauauuguagugcaggucgagacccccggcacggagacuccauccuacaaggugagcguuacagccagggaagacgugccuaccuuugggcccccacugcccucgccuccagucuuccagaaaggaccggaguuucgggaguucuugcuaacuaagcugacaaacgcagaaaaugcuuguugcaaaucugauaaguuugccaaacucgaggaccguacccgcgcggcccugcuugauaaccugcaugacgaauugcacgcacauacgcaagcuaugcucggccugggucccgaggaagauaaguucgagaacgggggccacggaggcuucuuagaauccuuuaagagagccauaagggugcggucacacaguauggagaccaugguagggggacagaaaaagagccauuccgguggcaucccugggucucugagcggaggcauuucacacaauaguauggagguuacaaaaacuaccuucuccccacccguggucgcugccacagugaagaaccagagccgaucuccuaucaaacgcagaucaggucuauuuccaaggcuccauacugggagugaaggccagggagacagccgggcacgcugugacuccaccucuucgacacccaagaccccggauggcgggcacagcucccaagagauaaagucagaaacuagcucuaauccuagcuccccagagauuugccccaacaaagaaaagccuuucaugaaacugaaggagaaugguagagccaucucaaggaguucuuccaguacgagcucugucuccucaacagcuggagagggcgaagcgauggaggaaggggacaguggaggcagccagcccucgaccacuuccccauuuaaacaggagguguucguuuauucuccuagccccucaagugaauccccaucucuuggugcagccgcuaccccgaucauuaugagccguuccccuacagaugccaagucacggaacagcccccgaaguaauuugaaguuuagauucgacaaacugucucaugcauccagcggggccggccacuga

SEQ ID NO: 61585 - RNA, 1827 nt, Artificial Sequence
  derived and/or modified sequence opt3 from RAP1GDS1__Homo_sapiens__NP_001093896
auggccgacaaccugagcgauacccucaagaaacuuaagaucacagcuguggacaaaacugaggauucccuggaaggcugcuuggacuguuuacugcaggcacuagcccaaaauaacacggagaccucugaaaagauucaggcgucagggauacuccagcuguucgcuagucuucugacaccccagagcuccugcaaagccaaggucgcaaauaucauugccgagguugcuaagaacgaauuuaugagaaucccuuguguggaugcaggauugauuucuccacucguacaacugcucaauucgaaagaccaggaggugcuguuacagacugguagggcccugggcaacaucugcuacgauucacacgaggggcggagcgcugucgaccaggccggaggcgcgcaaauagugaucgaucaucuucgcaguuuguguuccauuaccgacccggcaaaugaaaagcugcuaacaguuuucugcgguaugcucaugaacuauucuaaugagaacgauagccugcaggcccagcuuaucaauaugggggugauucccacccuggucaaauugcucggaauccacugucagaacgcugcccugacugaaaugugcuuaguggcauuuggcaaucuggcugagcucgaguccucaaaggaacaauucgccaguacaaacauagcggaggaacuuguaaaacuguuuaagaagcagauugagcaugacaaacgagaaaugaucuucgagguuuuggccccucuagcagagaaugaugcuauuaagcugcagcucguggaagccggccuggucgagugucuucuggaaaucgugcaacagaaaguggacagcgacaaggaggaugacaucaccgaauugaaaacggggucugaucucaugguccuguuacugcuaggagacgaguccaugcagaagcucuuugaggguggcaaagggucaguuuuccagcgugugcugagcuggauuccaaguaacaaccaccaacuucaguuggcuggagcccuggcaauagccaauuuugcuagaaacgaugcgaauugcauccauaugguagacaacggcauuguggaaaagcucauggaucugcuugacaggcacgucgaggaugguaaugugacuguucagcacgcagcccugucugcuuugcggaaccucgccauccccgugauaaauaaggcaaaaaugcuguccgccggggucaccgaagcuguguuaaaguuccugaaaagcgagaugccuccaguacaguuuaagcuacucggaacacugcgcaugcuuauugacgcccaagcagaagcggcugagcaguugggcaaaaacguuaagcugguggagagacucgucgaauggugugaggccaaggaucaugcaggcgugaugggggaaucgaauaggcuguuaucugcccugauccggcacuccaaaucaaaggacgucaucaaaacuauugugcagaguggagguaucaagcaucuuguuaccauggcuacaagcgagcacgugauuaugcagaacgaggccuugguagcacucgcucugauagccgcgcuagaacugggcaccgccgagaaagaccucgaauccgcuaagcugguccaaauccuucaccgcuugcuggcagaugagcgaucugcccccgaaauuaaguacaauagcaugguguuaaucugcgcucucauggggucagagugccugcauaaagagguucaggaccuugccuuccuggauguggucaguaaguugagaucccacgaaaacaaaagcguggcacagcaggcgucucucacggagcaaaggcugacuguagaaucauga

SEQ ID NO: 61586 - RNA, 552 nt, Artificial Sequence
  derived and/or modified sequence opt3 from RAP2A__Homo_sapiens__NP_066361
augagagaguacaagguggucguucugggcagcgggggaguggguaaauccgcccucaccguacaguucgugacaggcacuuuuaucgaaaaguaugaccccacgauugaggauuucuacaggaaagaaauagaggucgacucuucaccuagugugcuugaaauccuggauaccgcugggacagagcaauuugcaagcaugcgggacuuguauauuaagaacggacagggcuucaucuuaguuuacucccuggugaaucagcagucuuuucaagauauuaaaccaaugcgcgaccagaucauacgagucaagcguuaugagaaggugccgguaauccuaguugguaacaaaguggaucucgaaucggagagagaagucucaagcagugaggggagggcccuggcggaggaauggggaugccccuucauggagacuuccgcuaagucuaaaaccaugguggacgaacuuuuugccgagauugugcggcagaugaauuacgcagcccagccugauaaggacgauccauguugcagcgcuuguaacauccaauga

SEQ ID NO: 61587 - RNA, 552 nt, Artificial Sequence
  derived and/or modified sequence opt3 from RAP2B__Homo_sapiens__NP_002877
augagagaguacaagguggucguucugggcagcgggggaguggguaaauccgcccucaccguacaguucgugacaggcucuuuuaucgaaaaguaugaccccacuauugaggauuucuacaggaaagaaauagaggucgacucaaguccuagcgugcuugaaauccuggauacggcugggaccgagcaauuugcauccaugcgggacuuguauauuaagaacggacagggcuucaucuuaguuuacucucuggugaaucagcagucguuucaagauauuaaaccaaugcgcgaccagaucauacgagucaagcguuaugagagagugccgaugauccuaguagguaacaagguugaucucgaaggggagagggaagugucauacggagagggcaaagcccuggcggaggaauggagcugccccuucauggagacaagugcuaagaauaaagccuccgucgacgaacuuuuugcagagauugugcggcagaugaacuaugccgcucagccuaauggcgaugaaggguguugcucugcaugugugauccuguga

SEQ ID NO: 61588 - RNA, 3285 nt, Artificial Sequence
  derived and/or modified sequence opt3 from RAPGEF1__Homo_sapiens__NP_001291204
augagcggcgggcugggacucagaaggucccccgaaaugucugguaagaucgaaaaagccgacucacagcggagucaccuuagcuccuucaccaugaagcugauggauaaauuucauucuccuaagauuaaacgcacaccaucgaagaagggcaaaccggcugaggugucagucaagauacccgaaaaaccuguuaacaaggaggcaacugaccgauucuugccagaaggguaccccuuaccucuggaucuagagcaacaggccguggaguuuaugagcacgagugcgguagcuucccguucucagagacagaaaaaucucagcuggcuggaagagaaggaaaaggagguggucuccgcccuuagguauuucaaaaccaucguggacaagauggcaauugauaaaaagguucuggagauguugccaggaucagccaguaaagugcucgaagcuauccugccccugguccaaaacgacccucggauucagcacagcucugcacucuccucaugcuacagccgcguguaucagaguuuagccaaucugaucagauggucugaucagguaaugcuugagggcguuaacuccgaagacaaggagauggugacaacugucaaaggugugauaaaggcuguguuggauggggucaaggaacugguuaggcuaaccaucgagaaacaaggacggccaagcccgacaucgcccgugaagccuucuuccccagccucaaaacccgacggcccugcggagcucccacugaccgaucgcgaaguagagauucuuaauaagacuacaggcaugagucagagcaccgaacuguugcccgacgcaacggaugaggaaguggccccgccuaaacccccacucccugggauccgagucguggacaacucucccccacccgcucugccuccaaagaagagacagucugccccgagccccacuaggguugcaguggucgcuccuaugucacgggccaccaguggauccagcuuaccaguggguauuaaucgucaggacuuugauguagacuguuacgcgcaacgcagacugucuggcgggucacauaguuauggaggcgagagccccaggcucuccccuugcuccucgaucgguaaacuuagcaaguccgaugagcagcugucaaguuuggaccgggauucugggcaguguagccgaaacacauccugcgaaacucuagaccacuacgauccagacuaugaguuccugcaacaggaucucucaaaugccgaccagauaccccagcaaaccgcauggaaccugagcccgcuuccugaaucucugggagaguccggcaguccauuuuuggggcccccuuuccagcucccccugggcggacauccacagccugauggucccuuagcuccaggccagcaaacagacaccccgccugcccugcccgagaaaaagcgcagaagcgcugccucucagacggcagacggguccggauguaggguuucauacgaacggcacccaagucaguacgauaauauuagcggcgaggaccuacagucgacugcccccaucccuuccgugccauaugcucccuuugcggcaauucucccuuuccaacacggugggucuagcgccccggucgaauuugugggcgauuucacagcuccagagucaaccggagaccccgaaaaaccuccaccccugccugagaagaagaacaaacauaugcuugccuacaugcaguugcuggaggauuauagugaaccgcagcccuccauguuuuaccagacuccacaaaaugagcacaucuaucagcagaagaacaaacuccugauggaagucuacggcuucucugacagcuucuccgggguggauucaguucaagagcuugcaccucccccagcccugccucccaagcagcgccaguuggaaccaccggcuggaaaagacggucauccuagagaucccagcgccgugaguggcguaccagggaaggacucuagggauggauccgagcgugcacccaagagcccugacgcgcucgagucggcucagucagaagaggaagucgaugagcugucuuuaaucgaccacaaugaaauuaugagucggcugacacuaaaacaagagggcgacgaugguccagacgugcgagggggcuccggagauauacuccugguucacgccaccgagacggacagaaaggaucuuguguuguauugcgaagcauuucugaccacauacaggacuuucaucagccccgaggaacucauuaaaaagcugcaguaccgcuaugagaaauuuucuccuuucgccgacaccuuuaagaaacgggucagcaagaacacauucuuuguguuaguaagagugguugaugaacugugucuugucgaguugacugaggaaauccucaagcugcuaauggagcugguguucaggcucgugugcaacggcgaacugucccuugcucgcgucuugcggaaaaauauacuggacaagguugaucagaaaaaguuacuccgaugugccaccucaagucagccgcuggcagcucgugggguggccgcgagaccaggaacacuucaugacuuucacagccaugagauugccgagcaacugaccuugcucgaugcugaacuguucuacaaaaucgagauccccgaagugcuacugugggcaaaggagcagaacgaagagaagucuccuaaucucacucaguuuacggagcacuucaacaauauguccuauuggguaaggucaauuaucaugcugcaggaaaaagcccaagaccgcgagcggcuuuugcugaaguuuauuaaaauaaugaagcauuuaagaaaacucaacaauuucaacaguuaccuggcuauccuuagcgcccuggauuccgcacccauuaggcgacuagaauggcagaagcagacaucugagggucucgcggaauauugcacccugaucgacucgagcucauccuuccgcgccuaccgggcugccuugagugaggucgagccaccuuguauccccuaucugggcuuaauucuccaagaccugacuuuugugcaccuugggaauccagauuacauagacggaaagguuaacuucucuaaaagauggcagcaguuuaauauccuggauagcaugaggugcuuccagcaagcacacuacgacaugcgucgcaacgaugacauuaucaacuuuuucaaugauuuuuccgaccauuuggcugaagaggcccucugggaacugucacuaaagauuaaaccucggaauaucaccagaaggaagacagaucgagaggagaaaaccuga

SEQ ID NO: 61589 - RNA, 4500 nt, Artificial Sequence
  derived and/or modified sequence opt3 from RAPGEF2__Homo_sapiens__NP_055062
augaagccccuggccaucccugcuaaccacggcgugauggggcagcaagagaaacauagccucccagcagacuucaccaagcugcaccugacagauuccuugcauccgcaggucacucacguuucuucaagucauagcggaugcuccauuacgucugacucggguucaagcaguuuauccgauauauaccaggccaccgaaucugaggcgggcgacauggaucugagcgggcuacccgaaacagcuguggacuccgaggaugacgaugacgaagaggauaucgagagagccucagacccucucaugaguagggauauuguacgggacugucuggaaaaagacccaaucgaucgcacugacgaugacauugagcagcuucuggaauuuaugcaccaauugcccgcauucgccaauaugaccaugagcgugcgacgugagcucugcgcugucaugguguuugcaguuguggagagagccggaacaaucguccugaacgauggcgaggaacuggacucuugguccgugauacucaaugguucaguagaaguuaccuauccugaugggaaggcugagaucuuauguaugggaaacagcuucggcgugaguccaacuauggacaaagaauacaugaagggcgucaugaggacaaagguggaugacugccaguuuguguguauugcccagcaggauuauugccggauccugaaucaagucgagaaaaacaugcagaagguugaggaagagggggaaauugugaugguaaaagagcaccgcgaacuugacagaaccggaacgaggaagggucauaucgugauaaaaggcacuucugagcgguugaccaugcaccuggucgaggaacauuccgugguugaccccacauucauugaggauuuucuacucacuuaccgcaccuuccugagcucgccuauggaaguggggaagaagcugcuggagugguuuaaugacccaucuuugcgagauaaagucacaagagugguacuccuguggguuaacaaucacuucaacgacuuugaaggagauccggcgaugaccagguucuuagaggaguuugaaaauaaccuggagcgggaaaagaugggcggucaccuccgucuucugaauaucgcaugugccgcuaaagccaagcgcagauugaugacgcuaacuaaacccuccagggaggcaccucugccauucauucuccuugggggaucagagaagggcuucggcaucuuuguggacagugucgauagcggguccaaagcuacagaagccggacuuaagcggggugaccagauccuggaggugaacggccagaauuucgaaaacauucaauugucuaaggcgauggagauacuccgaaacaauacccaucugagcaucacugucaaaacaaacuuauuuguguucaaggaacugcuaacccgccucucagaggagaaaagaaauggggcaccccaucugccuaagauuggagauaucaaaaaggcaaguagguauuccauaccagaccuugcuguugauguggaacagguaauuggcuuggagaaggucaacaaaaagagcaaagccaauacggugggugggcggaacaagcugaaaaagauccucgacaagacccgcaucucuauucugccccagaaaccguacaaugauaucggcauuggacaaucacaggacgacaguauaguuggccuuagacagacaaagcacaucccuacugcucugcccgugagcgggaccuuguccucuucgaacccagaucuccugcagagccaccauaggauuuuagacuuuuccgccacaccugaucugcccgaccaaguccuacguguguucaaagcagaucagcagucacgguauaucaugaucaguaaggacacuaccgccaaagaaguagugauucaggcuauacgagaguuugcgguuacagcaaccccagaucaauacucucucugcgaagucagcgugacucccgagggagugaucaagcagagaaggcugccugaccagcuuuccaaguuggccgaucgcauucagcugucaggucgguacuaucucaaaaauaacauggagacggaaacacuguguagcgacgaggaugcucaagaauuacugagagagucucagaucucccuuuugcagcucaguaccgucgaaguugccacucagcugagcaugaggaauuucgagcuauuucgcaacauugagccaaccgaauacaucgacgaucuguucaagcuccgaucuaaaacauccugcgcaaaucugaagcgguuugaggaagugauaaaccaagagaccuucuggguggccucagagauccuucgugaaacuaaucaguugaaaagaaugaagauuaucaaacacuuuauuaagaucgcucugcacuguagggagugcaagaacuucaacaguauguucgccauaauuagcggcuuaaaucucgcaccgguagcgcgccugcggacaacgugggaaaaacuucccaacaaguaugagaaacuguuucaggacuugcaagaccucuucgauccuucgagaaauauggcuaaguacaggaacguccuuaauucccagaaccuacagccacccaucauuccucuguuuccagugaucaaaaaggaccucaccuuccugcaugaagggaaugauucuaagguugacggacuugugaacuuugagaaauugcgaaugauagccaaggagauccgccacgucggccggauggcaagcgugaauauggaucccgcccugauguucagaacuaggaaaaagaaauggcguucauuagguagucucucccaggggucuacaaacgcuaccguucuggacguggcccaaacaggcggacauaagaagcgcguacggagaagcuccuuucuuaaugccaaaaagcuguaugaagaugcucagauggccaggaaagucaagcaguaccuaucaaaccucgagcuggaaauggacgaggagagcuugcagacucugaguuuacaaugcgaaccggcgaccaauacgcucccuaaaaacccaggcgauaagaagcccgugaaaucugagaccuccccuguggcuccccgagccgggagccagcagaaggcacagucgcugccacaaccucagcagcaacccccaccggcccacaaaauuaaucagggacuucaggucccugcuguuucacuguaucccucucggaagaaagugccaguaaaggacuugcccccuuucgguaucaacaguccacaggcccucaaaaagauucugucccuaagcgaagagggcucucuggaacgccacaagaaacaagcagaggauacaaucagcaacgcguccucacagcuuaguucucccccuacuagcccgcaguccucaccaagaaagggguacacccucgcccccaguggaacaguggacaauuuuagcgacuccggccauucugaaauaucgagcaggucauccauugucaguaacucuagcuucgauuccgugccuguuucacugcacgacgagcggcgacagagacauucugugagcaucgucgagacuaauuuggguauggggcgcauggaaaggcguaccaugaucgagccagaucaauacagucugggcuccuaugcucccaugagcgaaggacggggcuuauacgccacggcaacagugauuucuucaccuuccaccgaggagcucagucaggaccagggggauagagcuagccuggacgccgcagauucgggaaggggcucuuggacuuccuguagcucagguagucacgacaacauccagacaauucaacaucagcgcucuugggaaacccuuccguuugggcacacucacuucgauuauuccggagaccccgccggccugugggcuagcucaagucauauggaucagauaauguuuagcgaccacuccaccaaauacaaucgacagaaccaaucuagagagagcuuggaacaggcgcagucccgggccucaugggcaucuaguacagguuauuggggcgaggauucggaaggggacacgggaaccaucaagaggcgcggcgggaaagacguuagcauugaggcugaguccucuucacucacuagcgugacaaccgaagagacaaagccagucccuaugcccgcccauaucgccguagcuuccaguacuaccaagggacugauugcacguaaagaaggcagauaccgggagccaccucccacgccaccggguuauaucgggauaccuaucacagauuuccccgaaggacacucucauccagccaggaagcccccugacuacaauguggcgcuacaacgcagccgaaugguugcuagaucauccgauaccgccggcccaaguagcgugcagcagccccacggucacccuacuucuucccggccggucaacaaaccacaguggcauaagcccaaugagucagacccuaggcuggcacccuaccaaagccagggcuucucgaccgaggaagaugaggacgaacaggugucugccguauga

SEQ ID NO: 61590 - RNA, 2772 nt, Artificial Sequence
  derived and/or modified sequence opt3 from RAPGEF3__Homo_sapiens__NP_001092001
augaaggugggcuggcccggggagagcugcuggcaggucggacuggccguugaagacuccccugcucucggugcaccaagagugggcgcccuuccggauguagugcccgaggggacccuguugaacauggucuuaaggcggaugcaccgcccucgaucuuguucauaccaacugcuacucgaacaucagcguccaaguugcauccagggacugagauggacaccccuuacuaauagcgaggaaucccuggacuucucugagucguuggagcaggcgucaacggaaagggugcuccgggcuggccgccaacugcacagacaucugcucgccaccuguccuaacuuaauuagggaucggaaauaucaucugcgccuuuaccgacagugcuguagcgguagagaguugguugacgggauacuggcacuaggacucggcgugcacaguaggucccaggucgugggcaucugccagguacugcuugaugaaggggcccugugucacguuaagcacgacugggcuuuucaagaucgggacgcacaguucuaucguuuuccaggacccgagccugagccaguggguacacaugaaauggaggaagaguuggccgaagcugucgcccuccugucucagcgcggcccggaugcguuacugacuguggcacucagaaaacccccugggcagaggaccgacgaggagcuugaucugauuuucgaagaguugcuacacaucaaggccguggcucaucugagcaauuccgucaaacgggaacucgccgcaguucugcuuuuugagccacacucaaaggcuggaacagugcuguucagucaaggcgacaaggguaccagcugguacauuaucuggaaagggucuguaaacguggucacucacggaaagggcuuggugacaacccuccaugaaggcgaugacuuugggcagcuggccuuaguuaaugacgcgccccgagccgcaacgauaauccugcgcgaggauaacugccacuuccuaagaguggacaaacaggauuuuaauaggauuaucaaggacgucgaggcuaaaacuaugcggcucgaggaacauggaaaggugguacugguucuugaacgcgccucccaaggugcuggcccuucaagaccacccaccccggggaggaaccguuauacagugaugagcggaacuccugagaagauuuuggaacugcuccuggaggccaugggccccgauaguucugcacacgacccaaccgagacauuccuuuccgauuuucuguugacccaucgggucuucaugccuagcgcccagcucugugcugcgcuguuacaccacuuucauguggaacccgccggugggucggagcaggaacgaucuacguacgucugcaauaaaagacagcaaauccugaggcuagugucccaguggguugcacucuauggcucaaugcugcacacugacccaguggcuacaaguuuccuucagaaguugagcgaucugguaggacgcgacacccggcucuccaaccuguuaagagagcaguggcccgagaggcgccgaugucaucggcuggaaaauggcugcgggaacgccucuccucaaaugaaagcacguaaucuuccagucugguugccgaaccaggaugagccccucccuggaagcucaugcgccauacaggugggugacaagguuccauacgacauuuguagacccgaucacagugugcugacucuacagcugccugucacagcuuccgugagggaaguaauggccgcacucgcgcaagaggacggcuggaccaaaggacaggugcugguuaaggucaauagcgcuggggaugccaucggccuucagccagacgcacgcgguguggccacgucuuuggggcugaacgaacgguuauucguggucaacccccaggagguucacgagcucauuccgcauccugaucaacugggcccaaccgugggaucagcugaaggccuugaccuggugagugccaaagauuuggcagggcagcucacagaccacgauuggagccuguuuaauuccauccaucagguagagcuaauccacuacguccugggaccccaacaucucagagacgugacuaccgcuaaccuggaaagguucaugcgacgcuuuaaugagcuucaguauuggguugccacagaauugugccuguguccugugcccgguccacgggcgcaguuacucagaaaguucauuaagcuggccgcucaccuuaaagagcagaagaaccuaaauucguuuuucgcagucauguuuggccuaucuaacagcgccauauccaggcucgcucacacuugggagcgucugccucauaaagugcgcaaguuguacucagcccuggaacgguuacucgaucccaguuggaaucacagaguuuauaggcuggcacuugcgaaacugucuccaccggugaucccuuucaugcccuugcuccugaaggacaugaccuuuauucaugaggggaaccacacacugguagaaaaucugaucaacuucgagaagaugcgaaugauggcccgggcugcccgcaugcuucaucacugcagaagccacaauccagucccccucuccccucugaggucacgggugagccauuugcacgaagauucucaaguggcacgaauauccaccuguagugagcagagccugucuacuagauccccagcuucaacgugggccuacguccagcaguuaaaaguuauugacaaccaacgcgagcucaguaggcugagccgugaacuugagcccuga

SEQ ID NO: 61591 - RNA, 2604 nt, Artificial Sequence
  derived and/or modified sequence opt3 from RAPGEF4__Homo_sapiens__NP_001093867
augcuguacaagaaauauagacaguacauggccggccuccuugcucccccuuauggggugauggagaccggaagcaacaaugacaggaucccagauaaggaaaacacaccgcugauugagccccacgucccuuugcggccagcaaauacuauaacgaaaguucccuccgaaaagaucuuacgcgccgguaaaauucugcgaaacgcgauccuaucucgugcuccucauaugauuagagacaggaaguaccaccucaagaccuaucggcaaugcugugugggcacagagcugguagauuggaugaugcagcagacuccaugcgugcauucacgcacccaggccgucgggauguggcaagugcuucuggaagacggaguuuugaaucacguggaucaggagcaucacuuccaggacaaauaccucuuuuauagauuccuggaugacgagcacgaagaugcaccccugccuacagaggaagagaagaaagagugugacgaggaacuccaggauaccauguuacugcuuagucaaaugggcccagacgcccauaugaggaugaucuugcggaagccgcccggucagcgcacugucgaugaccuggaaauaaucuacgaggaacuacuccacauuaaagcucugagccaucuuuccacaaccgugaagcgagagcuggcagggguauugaucuuugagucucacgccaagggaggcacgguucucuucaaccagggcgaagaggggacuucgugguacauuauccugaaaggaucagugaaugucgugauauaugguaagggcguggucugcaccuuacacgaaggggacgauuuuggaaaacuggcucucguuaacgacgccccuagagcggcaagcauugugcuuagggaggauaauugucauuuccugcggguagacaaggaagauuuuaaccguaucuugcgcgacguggaggccaauacagucagacuaaaagagcacgaucaggacgugcugguucucgaaaaggugccagcuggcaacagggccaguaaucaagguaacucccagccccagcaaaaauacacugucaugucugggaccccugagaagauucuggaacauuuccuugagacaauccggcuggaagcaaccuugaaugaggcuacggauagcgugcucaacgacuuuaucaugaugcacugcguauucaugccaaacacucagcugugucccgccuuaguugcgcauuaucacgcccagccgucccagggaacagagcaagaaaagauggauuacgcacugaauaacaaacgacgcgugauuagauugguccuccagugggcugccauguauggcgaccugcuucaggaggacgaugugucaauggcuuuucuagaagaguucuacgucagugugagcgacgaugccaggaugauagcagcccugaaggagcagcucccugaacuggagaaaaucguuaagcaaauuucugaagacgcuaaagcgccccagaagaagcacaaagugcuucugcagcaguuuaauaccggcgaugagcgggcacaaaagcgccagccaaucagaggguccgacgaaguauuguucaaagucuauugcauggaucauacuuacacaaccauaagggugccuguugccacgucagugaaggaggucauuagcgcuguggccgacaaacucggaaguggugagggccugaucaucguaaagaugucuuccgggggagaaaaggugguuuuaaaacccaacgaugucagcguguucaccacacugacuauuaauggccgucuauuugcauguccacgggagcaguucgacucgcucacaccccugccugaacaggaggguccaaccguggggacugucggcaccuuugaacuuaugucuuccaaggauuuggccuaccaaaugacaaucuaugacugggagcuguucaacugcguucacgagcucgaacugauuuaccauaccuuuggacgacacaauuucaaaaagacuacggcuaacuuagaucuguuucuuagaagguucaaugagauacaguuuuggguggugacagaaaucuguuugugcucacagcucaguaaacgcguacaacugcuaaagaaguucauuaaaaucgccgcacacugcaaggaguauaaaaaccugaauagcuuuuucgcgaucgucaugggccucuccaacguggcuguuucucggcuggcccuuaccugggaaaaguugccgagcaaauuuaagaaauucuacgcagaguucgagucacugauggaccccaguagaaaucauagggccuaucgcuuaacuguggcuaagcucgaaccuccacugauucccuuuaugccucuucugauaaaggacaugaccuucacacacgaggggaacaaaaccuuuaucgauaauuuggucaacuucgaaaagaugcgaaugauugccaacacugcacggacagugcguuacuauagaucccagccauuuaaucccgacgcugcccaggcgaacaaaaaucaucaggauguuaggagcuacgugcgccaacucaacguaaucgacaaucagcggacgcugucucagaugucacacagacuagagccgaggcgaccuuga

SEQ ID NO: 61592 - RNA, 2193 nt, Artificial Sequence
  derived and/or modified sequence opt3 from RAPGEF5__Homo_sapiens__NP_036426
auggccaucggcguguggcagcugcuccuugacauggggauuaugcugagcgucgaucaacacuuguacuuccaggacaccuauguguuuuaccaguucuccucugaugagugcucauauuuauacugugaauuugagagagaagaggaauggcagaacggaguuaagcugcuacuccaacugguaccccuuauaccugcuagggguggcaucugcgagcugagucaucagaaaauugaggacagcgaagaguccucugaugaaaucuuggugcggcucacaucggcaguccagcgcgagcuggccgcggugauugcucugaaggcccgaaaaucagcaaucgagcaggacgaagagaauaacgauaagcacguugccgugacugaagcugagagcgucccagacagucaagcaggggugauguguaaacuccaggaacgugaugagauaggaagaaucgaguuaguacagaagcuggccaaggaaaauuaucaguuccuucaaacggacaaaaaggagcaggaaaaauccgagcaucaggaugacgaaguuaccacagugcaagucaaggagcaggaucagucuguguuggugcugaaaaagguccagugcuguggcccggcucccacugccgguagcgcggagucccacuggagguacguugugguaucagggaccccugaaaagauucuagagcaucuccugaacgaccuucaccuggaagaggugcaagacaaagaaacagagaccuugcucgaugacuuucuguuaacuuauacagucuucaugaccacggaugaccugugccaggcacuccuucggcacuacagugccaagaaauaccagggaaaggaggaaaauagcgaugugccacgcagaaaaaggaagguucugcauuuggugucucaguggaucgcucuauauaaagacuggcugcccgaggaugaacacuccaagauguuucucaagacuauuuaccggaacguccuggacgauguguaugaguacccuauccuugagaaagaacugaaggaguuccagaaaauauugggcaugcaucgccgacacaccguagacgaauauucaccacaaaagaaaaauaaggcccucuuucaccaguucagccugaaggagaacugguuacagcauagaggcacaguuacugaaaccgaggagaucuuuugucacguguacauuacagaacauaguuaugucucugugaaagcaaaggucuccagcauugcucaagagauccugaaagugguugccgaaaagauccaguacgcggaggaagaucuagcccucguggcaauuaccuucucgggggagaaacacgagcugcagcccaaugaccuuguaauaucuaaguccuuggaggcuucaggaaggaucuacgucuaucggaaggaccuggccgauacgcucaacccuuuugcugaaaaugaagagagucagcaacguagcaugcgcauucuggguaugaacacuugggaccuugcccuggaauugaugaauuucgauuggucccucuucaacucuauccaugagcaggagcugauauacuuuacauucagcagacagggcucaggggaacacaccgcaaauuuaagucugcuacuccaaaggugcaacgaggugcagcuguggguugccacugaaauucuuuuguguucccagcugggaaaacgggugcagcucgucaagaaauuuaucaagaucgcugcgcacugcaaagcacaacgaaaccugaauagcuucuuugccauugugaugggcuuaaacacagcuucuguaucacgccugagucagaccugggagaagaucccagguaaguucaaaaaguuguuuagcgagcuugaaucccucacggacccgucucugaaucauaaagccuauagagaugcauucaagaaaaugaagcccccuaaaauuccauuuaugccccuacugcucaaggacgugaccuucauacacgaggggaacaagacauuucuggauaaucuuguuaacuucgaaaaauugcauaugaucgccgacacugucaggacccugcggcacugucgcacaaaucaguuuggagauuuaucgccuaaggagcaccaggaacucaaaagcuacgugaaccaucuguaugugauugacucccaacaggcucuuuucgagcugucacacagaaucgagccaagggucuga

SEQ ID NO: 61593 - RNA, 1935 nt, Artificial Sequence
  derived and/or modified sequence opt3 from RAPH1__Homo_sapiens__NP_976241
auggagcagcugagcgacgaagagaucgaucacggcgccgaagaggacuccgauaaggaagaccaagaucucgacaaaauguucggggcuuggcuuggagagcuggauaaguugacccagucuuuagacucagauaaacccauggagccugugaagagaaguccacugaggcaggaaacaaacauggcaaauuuuagcuaccgguucuccauuuauaaccuaaaugaggcccucaaccagggugaaacugucgaccuggaugcgcuuauggcugaccugugcucuauagagcaagaguugucgucaaucggcagcgggaauaguaaacgccagauuacggaaaccaaggccacacagaagcucccgguuucccgacauacucugaaacacggaacccugaagggccucucuagcuccucaaaccguaucgcaaaacccagucaugccagcuacucuuuagaugacgugacagcucagcuggagcaagcaucccuuucaauggacgaagccgcucagcagagcguauuggaggauaccaagccucuggugacuaaucagcacagaaggacagccagugcggguaccgucucugacgcagaagugcauuccauuagcaacucgucucacuccucaaucacgagugccgcuagcuccauggauucucuagacauagauaaaguuacucggccacaagagcucgaccugacccaccaggggcagcccaucacagagcaugccauuagccuucgcuguucaaguaagcaagcaaagagacacaucgauuuuacugaagaacaggcugaacugaccccucauuccuauuuggacagggagacaagccuccuguuacggaauauugccggaaaaccaucucaucugcucaccaaggaggagcaggcggccaaacuuaaggcagagaaaauccgcguggcucuggaaaagauaaaagaggcccaggucaagaaguuggugauucgaguacacaugucagaugacaguagcaaaacgaugaugguugaugaaagacaaacugugaggcagguccuagacaaccugauggacaagucccacugcggcuacucucucgauuggucgcugguggagacagugagcgaacuucagauggagcggaucuucgaggaccacgaaaaucuggucgagaacuugcucaauuggacccgugauucccagaacaaacugauuuuuauggaacgcaucgagaaguaugcuuuauucaaaaauccccaaaacuaccugcuaggcaagaaggagacugccgaaauggcagacagaaacaaagagguucuccuggaagaguguuuuugcgggucaagugugacaguaccugaaaucgagggagugcuuugguugaaggaugacgguaaaaagucuuggaaaaagagguauuuccugcuccgggccagcggcauuuacuacgucccaaaggggaaagcuaaggugucccgagaucugguuuguuuucuucagcuggaccaugugaaugucuauuacggacaggauuaucgcaacaaauacaaggcgccgaccgacuauugcuuggugcucaaacacccccagauacaaaagaagucacaguacaucaaauaucuguguugcgaugacguaagaacguuacaucaguggguuaauggcauuaggaucgcaaaguacgguaaacagcuguacaugaacuaucaagaggcccuaaagcggaccgaaagcgcuuacgauuggacaucucucuccaguagcucuauaaaauccgggucaaguagcucguccauuccugagucucagagcaaucacucaaaccagagugacuccggagugucugacacucaaccagccggccacguccgcagccaguccaucgugucaagcgucuucagugaagcauggaagagaggcacccagcuggaggaaucuuccaaauga

SEQ ID NO: 61594 - RNA, 1239 nt, Artificial Sequence
  derived and/or modified sequence opt3 from RAPSN__Homo_sapiens__NP_005046
augggccaggaccaaaccaagcagcagaucgagaaagggcugcagcucuaccaaagcaaccagacagaaaaggcccuucagguguggacuaaaguccuggagaaguccucugauuugaugggaagauucaggguuuuagguugccuggugacggcucacucagaaaugggccgguauaaagagaugcuaaaguuugcaguagugcagauugacaccgcccgcgaacucgaggaugcggacuuccugcuugagaguuaccugaauuuggcucgaagcaacgaaaagcucugugaguuucauaaaacaauauccuauugcaagacuugucuggggcugcccggaacccgugccggcgcacaacucggugggcaggucucuuuaucgaugggaaaugccuuccugggccuuucaguguuucagaaggcuuuggagagcuucgaaaaagcacugagauacgcccacaacaaugaugacgcuaugcuagagugcaggguuuguugcagucucggcuccuuuuaugcccaggugaaagauuacgaaaaggcgcuguucuuuccuuguaaggcagccgagcuugucaacaauuaugggaaaggauggucucugaaguaccgggcuaugagccaauaccauauggccguggcauaucgcuugcucgguagacugggcuccgcuauggaaugcugugaggaaucaaugaaaaucgccuuacagcacggggacaggccacugcaggcgcucugccuucuguguuucgccgauauucaucggagucgcggagacuuggagacagcauuuccgcgauacgauagcgcuaugucuaucaugaccgagauuggcaacagacuaggucaaguacaggcccugcucgggguugcuaagugcuggguggccaggaaagcacuggacaaggcccuugaugcuaucgaacgggcgcaggaccuggcagaggaagucggaaauaaauugucccagcucaagcugcacugcuuaucagagagcauauaucguaguaagggccugcaacgcgaacuaagagcccacguggugagguuccaugagugugucgaggaaacugagcucuacugcggccuguguggggaaucuaucggagagaaaaacucccggcuucaggcuuugcccugcagccacauuuuucaucugcgaugucuccagaauaacgguacacgcucgugcccuaauuguagaaggucuuccaugaagccaggcuucguuuga

SEQ ID NO: 61595 - RNA, 1374 nt, Artificial Sequence
  derived and/or modified sequence opt3 from RARA__Homo_sapiens__NP_001019980
auguacgagagcguggaagucggcgggcccaccccuaacccauuccugguuguggacuuuuauaaucagaacagagccugccuccuuccggagaagggacugcccgcuccugguccauacuccacacccuugaggacuccuuuauggaauggcucuaaccacucaaucgaaacgcaaaguagcuccucugaggaaauuguaccaucgcccccuucaccaccgccccugccucggauauauaaaccauguuucgugugccaggauaagagcaguggguaccauuauggagucuccgcaugugagggcugcaaaggguuuuuccgccgaucuauccagaagaauaugguguacaccugucaccgugacaaaaacugcauuaucaauaagguuacaagaaacaggugucaguauugccggcuacaaaaguguuuugagguggguaugagcaaagaauccguccgcaaugauagaaacaagaaaaagaaagaggugcccaagccugaaugcucagagaguuacacucucaccccagagguaggagaacugauugagaagguuaggaaagcccaucaggaaacauuccccgcgcuuugucagcugggcaaguacaccacuaauaacagcucugagcagcggguguccuuggacaucgaucucugggacaaauuuucagaacugagcacaaagugcauaaucaaaaccgucgaguucgcuaagcaacugccgggcuuuacgacucucaccauugccgaucagaucacauuacugaaagcagccugccuugacauuuugauccugcgcauauguacucgauauaccccugagcaggauacaaugaccuucagugacgggcuaacgcucaauagaacucagaugcacaacgcuggauuugguccccugacagaucuuguguucgcauuugccaaucaacuguugccacucgaaauggacgaugcugagaccggccuguuaucugccauuugccugaucuguggggacaggcaggaccucgaacagccugaucggguggacaugcuucaagagccccuguuggaagcgcuaaaggucuacguucguaagcgcagaccauccaggccccauauguucccuaaaaugcugaugaagauuacugaucuccggagcaucucggcaaaaggagccgagcgagugaucacacugaagauggagauuccaggcucuaugccgccccuuauacaggaaaugcuggagaacuccgaagguuuggacacccucucagggcagccuggaggcggcgggcgcgauggagguggccuggcuccacccccugggaguugcagcccauccuuaucucccagcucaaacagaaguuccccggccacgcacagcccuuga

SEQ ID NO: 61596 - RNA, 1347 nt, Artificial Sequence
  derived and/or modified sequence opt3 from RARB__Homo_sapiens__NP_000956
auguucgacugcauggaugugcugagcgucucccccggccagauccucgacuuuuacaccgccucuccuucaaguuguaugcuucaagagaaggcucugaaagcaugcuucagcggguugacacagacugaauggcagcacagacauacggcccaguccauugagacccaaucuacaucgucagaagaguuaguuccaagcccgcccaguccucugccacccccuaggguguauaagccauguuuuguaugccaggauaaauccucuggauaccacuauggugugagcgcgugugaaggcugcaagggguucuuucggcgcuccauacagaaaaacaugaucuacacuugucaucgagacaagaauugcgucauuaacaaggugacccguaauagaugucaguauugcaggcuacaaaaauguuucgagguuggaaugucaaaggagagugugcggaacgaucgcaauaaaaagaaaaaggaaacaagcaagcaggagugcaccgaaucuuacgagaugacugcugagcucgacgaucugacagagaaaaucagaaaggcccaccaggagaccuuucccucccuuugccagcugggcaaauauacgacuaacucaagcgcagaccauaggguccgguuggaucucggucugugggacaaguucagugaacuggccaccaaauguauuaucaagauaguggaguuugcuaaacgccucccuggguucacaggauuaacuaucgcagaucaaauuacccugcuuaaggccgcuugcuuggacauccugauucuacgaaucuguacaagauacaccccagaacaggauacgaugacuuuuucugacggccucacacugaauaggacccagaugcacaacgccggcuucgggccgcuuacugaccugguauuuacauucgcgaaucaauugcucccccuggagauggaugacaccgagacgggauuacuguccgcaauaugccucauuuguggugaucggcaggaccuugaagaaccuaccaagguugauaaacugcaggaaccauugcuagaggcccugaagaucuacauucguaaacgcagacccagcaagccucacauguucccaaaaauccucaugaagaucacagaccugaggucgauuucugcuaagggcgccgaacgggugauaacucuuaaaauggagauccccggguccaugccgccucugauucaggagauguuggaaaacucagagggacaugaaccccucaccccaaguagcuccggcaauacagcagagcacucuccuagcaucucacccaguuccgucgaaaacagcggugugucucaaucaccacuggugcaguga

SEQ ID NO: 61597 - RNA, 1332 nt, Artificial Sequence
  derived and/or modified sequence opt3 from RARG__Homo_sapiens__NP_001036193
auguacgacugcauggagaccuucgcccccggcccuagaaggcuguauggggcugcaggaccaggugccggccuccuucggcgcgcgacagggggaagcuguuuugcuggccuggaauccuucgccuggccgcagcccgcaucuuugcaaucaguggagacucagaguacgagcuccgaagagauggucccuucuucgccaucacccccuccacccccucgaguuuacaagccaugcuuuguguguaacgauaaaagcagugguuaucacuacgggguauccucuugcgaaggauguaagggcuucuuucguagaagcauccagaaaaauaugguguauaccugccauagggacaagaacuguauuauaaauaaagucacacggaaccgcugccaguacuguagauuacaaaagugcuucgaggugggcauguccaaggaggccguuaggaaugaucggaacaaaaagaaaaaggaagugaaagaggaagggucaccggacaguuaugagcugagcccccagcuagaggaacucaucacuaaggucucuaaggcucaccaggagaccuuuccuucccugugucagcuuggaaaauacacaaccaauucaagcgcagaucaucgcgugcaacuggacuugggucucugggauaaguucagugaacuggccacuaaaugcauuaucaagauuguagaguuugcuaaacgacugccaggcuucacagggcucucuaucgccgaccagauaaccuuacugaaggcggcaugccuugauaucuugaugcugagaauuuguacgagguacacucccgaacaggacaccaugacauuuuccgauggacuaacucucaaccggacccagaugcacaaugccggcuucgguccucugacagaccuuguuuuugcuuucgccgggcaacuguugccacucgagauggaugacaccgagacgggacuguuaagcgcaaucugccugauuuguggcgaccguauggaucucgaggaacccgaaaaaguggacaaacuucaggagccgcuguuggaagcucuacgccuguaugccagaaggcggcgaccuucgcagcccuacauguucccacgcaugcucaugaagaucacugaucugagaggcauaucuacaaagggggcggagagggccauuacccuuaagauggagaucccuggacccaugccaccccugauucgggaaauguuggagaacccugaaauguuugaggacgauuccucacaaccagguccgcaucccaaugcaaguagcgaagacgaggucccuggcgggcagggaaaaggcggucucaaguccccagcuuga

SEQ ID NO: 61598 - RNA, 687 nt, Artificial Sequence
  derived and/or modified sequence opt3 from RARRES1__Homo_sapiens__NP_002879
augcagcccagaaggcaacggcugccugccccauggagcggcccgcgcgggccccgaccuaccgcuccacuccuugcacuguuguuacugcuagcccccguggcggcuccugccggauccggugacccagaugaccccggccagccucaggaugcaggggucccacguagacuccugcagcaagccgcuagggcagcccuucacuucuuuaacuuccggucuggaucaccgagugcucugcgcguuuuggccgaggugcaggaaggcagagcguggaucaaucccaaggaggguugcaaaguacauguggucuuuagcacagaaagguacaacccugagucccuccugcaggaaggggagggacggcugggcaaguguucugcacgcguguucuuuaaaaaucagaagccacgacccacuauuaacguuacgugcaccagacucauagagaaaaagaagaggcaacaggaagacuauuuacuguacaaacagaugaagcagcuuaaaaauccuuuggagaucgugucgauuccagauaaccacggccauaucgaccccucacugcggcuaauuugggaucucgccuuccuggggagcaguuaugucaugugggaaaugacaacucaagugucccacuacuaucuugcucagcugaccucuguacgucaguggguucgcaagacauga

SEQ ID NO: 61599 - RNA, 492 nt, Artificial Sequence
  derived and/or modified sequence opt3 from RARRES2__Homo_sapiens__NP_002880
augagaaggcugcucaucccccuugcccugugguugggcgcugugggggucggaguugcagaguuaaccgaagcccagcggcgcggucugcaaguggcgcuagaggaguuccacaagcauccuccaguacagugggcuuuucaggaaacaagcguggaauccgccgucgacacuccguuccccgcaggcauuuuugugcgacucgaguucaaacugcagcaaacgucuugccguaagagagauuggaaaaagccugaguguaaaguuaggccaaacgggcggaagcgcaagugccuugccuguauaaaacugggaucagaagacaagguguugggcagacucguccacugccccaucgagacccaggugcugagggaagcugaggagcaucaggaaacacagugucugcggguacaacgcgccggugaggauccucacaguuuuuacuucccagggcaguuugcauucagcaaagcucucccccgauccuga

SEQ ID NO: 61600 - RNA, 495 nt, Artificial Sequence
  derived and/or modified sequence opt3 from RARRES3__Homo_sapiens__NP_004576
auggccagcccccaccaggagccuaagccaggcgaccugaucgaaauuuucagacucggguacgagcauugggcucuuuauauaggagaugguuacgugauccaccuggcaccgcccuccgaauauccuggcgccgggucuucaagugucuuuagcguuuuguccaacucugcggaggugaaaagggaacgguuagaggacguagugggaggcugcuguuaccgcgucaauaacucgcuggaucaugaguaucaaccacgacccguggaaguuauuaucucaagcgcuaaggagauggugggucagaaaaugaaguacaguauugucucccguaauugcgaacacuucgugacccagcuaagauaugggaaaucuagguguaagcagguagagaaggccaaaguugaggugggagucgcaacagcccucggcauccuggugguggcuggcugcagcuuugcaauacggcgcuaccaaaagaaagccacugcuuga

SEQ ID NO: 61601 - RNA, 1737 nt, Artificial Sequence
  derived and/or modified sequence opt3 from RARS2__Homo_sapiens__NP_064716
auggccugcggcuucagaagggcuaucgcaugucagcugagccgggugcucaaccuucccccugagaaucugauuaccuccauaucugccgucccaaucucacaaaaggaagagguugcggacuuucaguugaguguggauagcuuacuggaaaaagacaacgaucacucccgcccggacauucagguacaggcuaagcgacuagccgagaaacuccguugcgauacaguggucucugaaaucucgacugggcaaagaacggugaauuucaagauuaacagggagcugcuuaccaaaacaguucugcaacaggugaucgaggacggaucaaaguacgguuugaaaagcgaacucuuuaguggccugccccagaaaaagauagucguggaguucuccucuccuaauguagcaaagaaguuucauguugggcacuuacggagcacuaucauuggaaacuucaucgccaaucucaaagaagcucugggccaucaagugauucgcaucaacuaucugggugauugggggaugcaguuuggacuuuugggcaccggcuuccagcuguuuggguacgaggagaagcuacaguccaauccacuccaacaccuguucgaagucuauguccaggugaacaaggaggcagccgacgauaaaucaguggcuaaggccgcgcaggaauuuuuccaaagacuugagcugggagacguucaggcauugagucucuggcagaaauuuagggaucugagcauagaagaguacauucggguguauaagcgcuuagguguauacuucgacgaguauucuggcgaauccuucuaccgagagaaaucacaggaagugcugaagcuccuugagagcaaagggcuguugcuaaagacaaucaagggaaccgccgucguggaucugaguggcaauggugaccccucuuccauuuguacuguuaugagaagcgacgggacaucgcucuacgcuaccagggaucuggccgcagcuaucgaccggauggauaaauauaacuuugacacgaugaucuacgugacugauaagggacagaaaaagcauuuccagcaggucuuucagaugcuuaaaauuaugggcuaugacugggccgaacguugccaacacgugccuuucggcguaguucaggggaugaagacccgcagaggagaugugacauuucuggaggacgucuugaaugagauacagcucaggaugcugcagaacauggcgucuaucaagacuaccaaagaauuaaagaauccacaagagacagccgaacgggugggucuggcagcucuaauuauccaggauuucaaaggccuccugcuuuccgacuacaaguuuucaugggaucgagucuuccagagucgcggggacaccggaguguuuuugcaguauacgcacgccagacugcauagccucgaggaaacuuucggcugugguuaccugaacgacuuuaacacagcuugccuucaagagccccaguccguuucuauacugcagcacuugcucagguucgaugaggugcuguauaaaagcucacaagacuuucagccucggcauauuguaaguuacuuacugacccuaucccaccucgccgcagucgcccacaagacucugcagaucaaggauagcccaccggaaguggcuggggcgcgccuucauuuguucaaagcaguuagaucugugcuggccaauggcaugaagcuccugggaaucacacccgucuguaggauguga

SEQ ID NO: 61602 - RNA, 1983 nt, Artificial Sequence
  derived and/or modified sequence opt3 from RARS__Homo_sapiens__NP_002878
auggacgugcuggucagcgagugcuccgccagacuccuucagcaagaagaggaaaucaagucucugaccgcugagauugauagguugaaaaacuguggcugcuuaggggcaucacccaaucuggaacagcuacaggaggagaaccucaagcugaaauaccggcuuaauauacugcgcaagaguuugcaggccgaacgaaacaaaccuacaaagaauaugaucaacauuaucagccgucuccaagagguuuucggacacgcgauuaaggcugccuauccagaccuggaaaauccgccccugcucgugacuccuucccagcaggcaaaauuuggugauuaccaguguaacucugccaugggcaucucgcaaauguuaaagacgaaagagcagaagguaaauccaagagagauagcugaaaacaucaccaaacaucugcccgacaaugagugcauugaaaagguggagaucgcagggccuggauucauuaacguccaccuuaggaaggauuuugugucagaacaguugacaagccugcuaguuaauggcgugcagcucccagcccugggugagaacaaaaaggucaucguggacuucaguucccccaauauagcuaaagagaugcauguagggcaccuucggucuacuauuaucggagaaagcauuucccgccuguuugaguucgccggcuaugauguuuugagacucaaccaugugggcgacugggggacccaauuuggaaugcugaucgcgcacuuacaggauaaguucccugacuaccugacagucucaccaccgaucggugaucuccagguguuuuauaaagaaaguaagaaaagguucgacaccgaggaagaguuuaagaagcgggcauaccaaugugugguccuucugcagggcaaaaaccccgauauuacuaaggccuggaaauugauaugcgacguuagccgccaggagcuaaauaagaucuaugacgcucuggaugugucucucauugaacgaggggaguccuucuaccaggacagaaugaacgauaucguaaaagaauuugaggacaggggauucgugcaagucgaugacggccggaagauaguguucguuccugguuguucaauuccacugacaaucgugaaguccgaugggggauacaccuaugacacgagugaucuugccgcaaucaaacagcgucuguuugaagagaaggcugacaugauuaucuacgucguggauaauggccagucuguacacuuccagacuauuuuugccgcggcccaaaugauaggcugguaugaccccaaaguuacccgcguguuccaugcaggguuuggagucguguugggugaggacaagaaaaaguucaagacaagauccggcgaaacugucaggcucauggaucuguuaggggagggacugaaacggagcauggacaagcuaaaagaaaaggagcgagauaaagugcucaccgcugaggaacugaacgccgcucagacaucgguugccuacggcugcaucaaguaugcagaccuuucucacaaucgcuugaacgauuacauuuuuagcuucgacaagaugcuggaugacagagguaauaccgccgcuuaucuccuguacgcguuuacgaggauccggucaaucgcacgccuugccaacauugaugaggaaaugcugcagaaagcugccagagagacuaagauauugcucgaccaugaaaaagaguggaagcuggggagguguaucuuacguuucccugagauucugcagaaaauccuagaugaccucuuucugcacacacuuugcgauuacauuuaugaauuggcaaccgccuucacugaguuuuacgacaguuguuauugcguggaaaaggaccggcaaacaggcaaaauccugaagguaaauauguggcgaaugcuccugugcgaggcugucgccgcagugauggcgaagggauucgauauauuaggcaucaaaccaguucagagaauguga

SEQ ID NO: 61603 - RNA, 3144 nt, Artificial Sequence
  derived and/or modified sequence opt3 from RASA1__Homo_sapiens__NP_002881
augauggccgcugaggcaggcagcgaagaagggggacccgugaccgccggugcgggcgggggaggcgcugccgcagguuccucugccuacccugcugucugcagaguuaagaucccagcagcccugccgguggcugccgcgcccuauccugggcucguagagacaggaguggcaggcacucuuggcgggggagccgcucuggguucagaguucuugggcgccgggagugucgcaggagcuuuaggcggugccgggcugacgggaggcggcaccgcggccgggguggcaggagcugccgcugguguugccggcgcagccguggcugggccaagcggagacauggcgcuaacaaaacuccccacuucccugcuugcagaaacccugggcccuggugggggcuuuccacccuugccuccaccgcccuaccucccuccacugggagccggccuggggacagucgaugagggagacucucucgauggucccgaguaugaagaggaagagguggcuauuccuuuaaccgccccacccacuaaccagugguaccacggcaagcuggacaggacaauagcagaggaacggcuucgccaagccgggaaaucgggaucauauuugauccgagagagcgaucguagaccgggcaguuucguacuguccuuucuaucucagaugaauguugugaaccauuucaggauuaucgcuauguguggugacuacuauauugggggccggcgcuuuagcucccucucagaucugaucggauacuacagucacgucagcugccuucugaagggcgaaaaauugcucuauccuguggcacccccagagccuguggaagacagaaggcggguccgcgccauacugcccuacaccaagguuccagauacggacgagaucucuuucuuaaagggggauauguuuauugugcauaaugagcuggaagacggauggauguggguaacuaaccuccgaaccgaugagcagggucuuaucguggaagaccuggucgaggaagugggcagagaggaggacccccacgaagggaaaauuugguuccauggaaagaucuccaaacaggaggcguauaauuugcuaaugacaguuggccaaguguguucauuucuggucaggccuagcgauaacacuccaggugacuacagucucuauuuccggaccaaugaaaacauacagcguuuuaagauuugcccgacacccaauaaccaguucaugaugggcgggcgcuacuauaauucuaucggagauauuaucgaccacuacagaaaagagcagaucguggaaggcuacuaucugaaggagccuguaccaaugcaagaucaggagcagguucuuaacgacaccguggaugggaaggaaauuuacaauacgauaaggcggaaaacuaaggacgcuuuuuauaaaaacaucgucaagaaaggauaccuguugaagaaaggcaaggguaagcgauggaaaaaucucuauuucauucuggagggguccgaugcccaguuaaucuacuucgaaagcgagaagcgcgcaacaaaacccaagggacugauagaccuaucgguguguucugucuaugugguucacgauucccucuuuggcagaccuaacugcuuccaaauugugguacagcauuuuucagaggaacacuacaucuucuacuuugccggugagaccccagaacaggcugaggacuggaugaaaggccugcaagccuucuguaaccuuaggaagaguagccccgggacuuccaauaagcgguugcgccaggucucuagccuggugcuccauaucgaagaggcacacaaacugccgguuaagcacuuuacaaacccuuauugcaauauuuaccuuaacucagugcaggucgcuaaaacccaugccagagagggacagaauccaguguggagugaagaguucguauuugacgaucugcccccugacaucaacagguucgaaauuacguuguccaauaagaccaaaaagagcaaggaucccgacauacucuuuaugcguugucaacugucucgguuacagaaaggccacgcgacagaugagugguuccugcuaucaagucauaucccacucaaggggauugaaccuggaagccugcgagugagagccagguauuccauggagaaaaucaugcccgaggaagaguacucugaauuuaaggagcuuaucuugcagaaagaacugcacguugucuaugcucucucgcaugugugcggccaggaccgcacucuguuagcaagcauucugcuucggauauucuugcacgagaagcucgagucccugcuacuguguacccucaacgauagagaaaucucaauggaggacgaagccacaacucuguucagggcuaccacacuugccaguaccuugauggagcaauacaugaaggcaacugcgacgcaguuugugcaccaugcccugaaagauucuauuuuaaagaucauggagagcaaacaguccugcgaacucucaccaagcaagcuggagaaaaaugaagacgucaacacaaaucuuacccaccuguugaacauucucucugagcugguugaaaagaucuucauggcuuccgagauacuaccgccuacucugcgcuauaucuacgguugccuccagaaaagugugcaacauaaguggcccaccaauacaaccaugcgaacucgggugguaagcggguuugucuuccugcgucuuauuuguccagccaucuugaaccccagaauguuuaauauuaucucugauuccccuucaccaauagcagcuaggacacugauuuuaguggccaagaguguucagaaccucgcaaaccugguggaguucggagccaaagaacccuacauggagggcgucaauccuuuuaucaagagcaacaaacaccgcaugauuauguuccuugacgaacuggguaaugugccggagcuaccagauacgaccgaacacucgcggacugaccucuccagagaccuggcugcguugcaugagaucugcguugcccacucugaugagcugaggacauuaagcaacgaacgaggcgcacagcagcaugugcucaagaaacugcuugcuauaaccgagcuguugcaacagaagcagaaucaauauacaaagacuaacgacguacgcuga

SEQ ID NO: 61604 - RNA, 2553 nt, Artificial Sequence
  derived and/or modified sequence opt3 from RASA2__Homo_sapiens__NP_001290174
auggccgcugcagcccccgcggcugccgcagccagcuccgaggcuccugcagccucugcuaccgccgaaccagaggcgggcgaccaggauucaagagaagugaggguccugcaaagucuccgggggaagaucugcgaggccaaaaaccuucugccguacuugggaccccacaagaugcgcgacuguuucugcacaauuaauuuagaucaggaagagguuuaucgaacucaggugguagagaaaagccuguccccauuuuucucugaagaguuuuacuucgaaauaccucguacguuucaguaucuaucguucuacguguaugacaagaacguccuccaaagagaucugaggaucgguaaaguggcaauuaagaaggaggaccuuuguaaucauucaggcaaagagaccugguuuagccugcagcccguugauaguaacuccgaagugcaggggaagguccacuuggagcucaaacugaaugaacugaucacagagaacggaacugugugccagcaacucguaguucauauuaaggcuugucacggcuuaccucugaucaauggucagucuugcgacccauacgccaccgugagccuugucgggcccucccggaacgaucagaaaaagacaaaggugaaaaagaaaaccucaaauccucaguucaacgaaauauuuuauuucgaggugacucgcaguagcucuuacacaagaaagucccaauuucaggucgaggaagaggacaucgaaaaauuggagauuaggaucgaucuguggaauaacggaaaucuaguucaggacguguuccucggcgaaauuaagguaccagugaacguccugcggaccgauucaagccaucaagcaugguaccuucugcagccgcgcgacaauggcaacaaaaguucuaagacggacgauuuggggucccuccgacugaacaucuguuauacugaggacuacguguuacccagcgaguauuacggaccucugaagacccuccuucugaaaucgccagauguucagcccauaucugcuuccgccgcguauauuuugucagaaaucugcagagacaagaaugaugccgugcuaccucuggucaggcuccugcuucaccacgacaaacuggugccauuugcaacagcuguagccgaguuggaucucaaggacacucaggaugcuaacaccauuuuccgggguaauagucuggccacacguuguuuagacgaaaugaugaaaaucguuggcgggcauuaccugaaggugacccuaaagcccauccucgaugagauuugcgacagcuccaaaucuugugaaauagacccgaucaagcugaaagagggagauaacgucgagaauaacaaggaaaaucuucgcuauuacguggacaaauuguucaacacgauugucaagagcucaaugaguugcccuacugugaugugcgauaucuuuuacucccugagacaaauggcaacacagagguuccccaaugacccacacguucaguauagcgccgugucuucauuuguauuccuccgguuuuucgcugucgcggugguuaguccucauaccuuucaucugcgaccccaccacccagaugcacagacuauacgcacacuuacccugauuagcaagacgauccaaaccuugggcuccugggguucucucucgaaaagcaaguccucauucaaagagacauuuaugugugaguucuuuaagauguuccaggaagagggguacaucauugccgugaaaaaguuucuggacgaaaucaguucuacugagaccaaggaaagcuccggaacaucagagcccguccacuuaaaagaaggcgagauguauaagagagcucagggcaggacucggauugggaaaaagaacuucaaaaagcgcugguucugccugaccagcagagagcuaacauaccauaaacagccuggaucuaaggaugccauauauaccaucccagugaagaauauucucgcaguagaaaaacuggaggaauccaguuuuaacaagaaaaauauguuccaagugauccacacugagaagccgcuuuacguucaggccaacaauugugucgaagcuaacgaguggaucgacguguugugcagggugagccguuguaaccagaaucggcugucuuuuuaucaucccuccgucuaccucaacgguaauuggcugugcugucaggagacgggcgaaaacacauuagggugcaaaccuuguaccgccggaguuccagcagauauucaaauagacaucgaugaggaccgagaaacugagagaauuuacucacuguucacccuuaguuugcucaagcugcagaagauggaagaggcgugcggcacaaucgcuguguaucaggguccccaaaaagagccugaugacuacagcaauuuugugauugaagacucgguaaccacuuucaagacaauccagcagauaaaauccaucauugagaagcuagaugaaccacacgagaaauauaggaagaagcgcucuagcucagccaaauacgggaguaaggagaaccccaucgucggcaaagcauccuga

SEQ ID NO: 61605 - RNA, 2421 nt, Artificial Sequence
  derived and/or modified sequence opt3 from RASAL1__Homo_sapiens__NP_001180449
auggccaagagcuccucucugaacgugagagucguugagggcagggcucuccccgcaaaagacgugucagggaguagcgauccuuacugccuuguaaagguggacgaugaagucguggcccggaccgcgacaguuuggcgcucccugggaccauucuggggugaggaauauacugugcacuugccguuagacuuucaucagcuggcuuucuacguccuagaugaggacacggugggccacgaugacaucauugggaaaauaucucucucgcgagaagccaucaccgcagauccccguggaauugacucauggaucaaucugagcagaguagauccugacgccgagguucaaggcgagauuugucuuagugugcagaugcuggaagauggucaggggaggugcuugcggugucauguccuccaggcucgcgaccuggcaccaagagacaucuccggaacaucugaucccuuugccaggguguucuggggcagccaaucccuggagacuucaaccauaaagaaaacacgguuuccucacugggacgaagugcucgaguuacgcgagaugccaggcgcucccaguccucugcgagucgaacuuugggauugggacaugguugggaagaacgauuucuugggaaugguggaguuuagcccaaagacccugcagcagaaaccgcccaaggguugguucagacuacucccuuuuccaagggccgaagaggacucuggcgggaaucugggagcgcuucggguaaaagugcgucugaucgaagaucgcgucuugcccucccagugcuaucaaccucucauggagcuguuaauggagucagugcagggcccagcagaagaggacacugccagcccccuggcucuccuugaggaacugacauugggugauuguagacaggaccuagccaccaagcugguuaaacucuuccuggggaggggacuugcaggccgguuucuggauuacuugacgcgacgcgaaguggcuagaacuauggacccgaacacccucuucaggaguaauucucuggccuccaagagcauggagcaguuuaugaaguuagucggcaugccuuaucugcaugaggugcuaaaacccguaauuucgcggguuuucgaagagaagaaauacauggaacucgacccaugcaagauggaucuggggcgcacaagaaggaucucuuucaaaggagcgcuuuccgaggaacaaaugcgugagacuucauugggucugcucaccggcuaucuggggccuauuguggacgccaucgucggaagugugggccggugucccccagcaaugcgacuugcuuuuaagcagcugcacagaagggucgaggaacgcuucccccaggccgagcaccaacaggaugugaaauacuuggcuauaagcgguuuucucuuccugcgguuuuucgccccugcaauuuuaacaccaaagcuguuugaccuaagagaucagcaugccgacccgcagaccuccaggucucuccugcuuuuggcuaaggcgguucaaagcaucgggaaccugggccagcagcucggacagggcaaagaacuguggauggcacccuuacacccuuuccugcuucaaugcgugucacgcguacgagauuucuuggaccggcucgucgauguggacggggaugaggaggccggaguuccagcucgugcccuguuucccccuagugcaauugugagagaagguuaccuacugaagaggaaagaggaaccagccggccucgcuacgcgcuuugccuucaagaaacgguaugucuggcuguccggggagacucuuagcuuuucuaagucacccgaauggcagaugugucauaguaucccggugagccacaucagagcaguagagaggguggacgagggagcguuccaguugccucacguuaugcaggucgugacacaagauggcaccggugcucugcauacuacauacuuacagugcaagaaugugaacgaacucaaucaguggcuguccgcccuucgaaaagcaucugccccaaaccccaauaagcuggcugccugucacccuggggcauuccgcucggcucgguggaccugcugcuugcaggccgagagaagcgcggccggcuguuccaggacgcauucagcugucacccucggagacuggagugacccccuggauccagacgcagaagcccaaacaguuuaucgucagcuacugcucggccgcgaucagcugcggcuuaaauugcuggaggacucuaacauggauacuaccuuagaagcugacacaggggccugcccugaggugcucgcaagacaaagggcggccacugcucgacugcuugaggugcuggccgaucuagaccgggcacacgaagaguuucagcagcaggaacgcggaaaggcugcccucgguccccugggcccauga

SEQ ID NO: 61606 - RNA, 3420 nt, Artificial Sequence
  derived and/or modified sequence opt3 from RASAL2__Homo_sapiens__NP_004832
augcagacccccgaggugccugccgaaagaagcccaaggcggcgcuccaucucuggcacaucaacuagcgagaagccgaacagcauggacacggcuaauaccucccccuucaaagucccuggguuuuucucuaagcgacugaaaggaucgauuaagcguacaaaaucacaaagcaagcucgauagaaacacuucuuuuaggcuuccaucccugcggucuaccgacgaucgcagcagagguuugcccaaguuaaaagaauccaggucacacgagagucugcuaagcccuugcucuacaguugaaugucucgaccugggccgcggggagccaguguccguaaagccccuucauucaagcauacugggacaggauuucugcuuugaggugaccuacuugaguggcucuaaauguuucuccugcaauagcgcaucggaacgggacaaguggauggagaaccuccgaagaacuguccagccuaauaaagauaacuguaggcgggccgaaaaugugcugcgucuguggaucauugaggcgaaggaccucgcuccaaagaaaaaguauuuuugcgaguuaugucuggaugacacacuuuucgcccgcaccacgucuaaaacuaaggcagauaacaucuuuuggggugaacacuucgaguuuuucuccuugccgccccugcauucaauuaccguucacaucuacaaagacguggaaaagaaaaagaagaaagauaagaauaacuaugucgggcuagugaauauaccuacagccaguguaacuggaagacaguuuguugagaaaugguacccagugagcacccccacaccuaacaagggcaaaaccggcgggccauccaucaggauuaagucucgguuccaaacgaucacuauucuccccauggaacaguauaaggaguucgcugaguuugucacaagcaauuacaccaugcugugcucagugcuugaaccggugaucaguguccgaaacaaagaggaacuggcaugugccuugguucauauacuccaguccacuggacgcgcuaaggacuuccugacagacuuagugaugagcgagguagauagaugcggugaacacgacgugcugauuuuuagggagaauaccaucgccacgaaaucuauugaggaauaucucaaguuagucggccagcaauaccugcacgaugcguugggggaguucaucaaagcacuauacgaaucagacgagaacugugaaguggauccuaguaagugcagcuccucugagcugaucgaccaucagucgaaccucaagaugugcugugagcuggccuuuugcaaaauuauaaauagcuauuguguuuucccccgggaacuuaaggagguguuugcuuccuggaaacagcagugccugaaccgcggaaagcaagauaucucagaaagauugauuagugccucucucuuccugagguuuuuauguccagcaaucaugagcccuucccuguucaaucuaaugcaggaguaccccgacgaucguaccucacggacacucacucugauagcuaaagucauucagaaccuugccaauuuugcgaaguucggcaacaaggaggaauauauggccuuuaugaaugacuucuuggagcacgaauggggugggaugaaacgauuccugcucgagaucagcaacccagauaccaucucuaauacacccggauuugacggcuacauugaccugggcagagaacuuuccgugcugcauaguuugcucugggagguaguuagccaacuggauaagggggagaacucuuucuuacaggcaacuguggcuaaacugggaccucuaccaaggguccucgccgacaucaccaagucccugacaaauccgacccccauucagcagcaacuucgccgguuuacugaacacaacucaaguccuaaugugagcgguucguuguccucuggccugcagaaaauauucgaggauccaacggacagcgaucuccacaagcugaaaucacccagucaggacaacacagauuccuauuuuagagggaagaccuuacugcuuguccagcaagcuaguagccaguccaugacuuacucagaaaaggacgagagggaaagcaguuugccuaauggacgcucugugucccucauggaucugcaggacacccaugccgcacagguugagcacgccagcgugaugcuagauguaccaauccgacugacaggcucgcaacucucaauuacccaggucgcuucuaucaaacagcugcgggagacucagaguacaccccaauccgcgccucaggugcguagaccgcuucauccagcauugaaccagcccggugggcugcaaccucuuagcuuccagaaccccguuuaucaccucaauaacccaaucccugccaugcccaaggcuucuauugacagcucccuggaaaaucuuucaacggccaguagcaggucucaguccaacucagaggauuuuaaacugaguggcccaagcaauuccucuauggaagacuucaccaagcgcucgacucagagcgaggacuuuucacggagacauacagugccggauaggcacauaccuuuggcacucccccgacaaaacuccaccggacaggcccagauccgcaaagucgaccagggcgggcugggagcucgggccaaggcaccacccagucuaccucacucugcgagccugagauccacagguucaaugucugugguaagcgcugcccucguggcagaaccaguucaaaauggcaguaggucccgucagcagaguucuucaucccgcgagagucccgucccuaaggugcgggccauucagagacaacagacucagcaagugcagagcccggucgauucggcuaccaugucuccaguugagaggacggccgcaugggugcugaacaaugggcaguacgaagaggacguggaagagaccgagcagaaccuugaugaagcuaaacaugccgagaaguacgaacaagagaucacaaaauugaaggaacgacugcggguauccagccgcagauuagaggaguaugaaaggcggcuccugguccaggagcagcagaugcaaaaacuucugcuagaauacaaggcgcgacucgaggacucagaagagagacugcgcaggcagcaggaggaaaaggauagucagaugaaaucuauuaucucccguuugauggccguggaggaggaacugaagaaagaccacgcugaaaugcaagcaguuauagaugccaagcagaaaaucauugacgcucaggagaagcggaucgugagcuuagauucagccaauacuagacucaugagugcacugacccaggucaaggagagguauagcaugcaagugcgcaacggaauuucccccacaaauccuacuaaacuuucuaucaccgaaaacggcgaguucaagaauagcuccugcuga

SEQ ID NO: 61607 - RNA, 369 nt, Artificial Sequence
  derived and/or modified sequence opt3 from RASD1__Homo_sapiens__NP_001186918
augaagcuggccgcuaugaucaaaaagaugugccccagcgacuccgagcucucuauuccugccaaaaacuguuacagaauggugauacuuggcucaaguaaggucgggaaaaccgcaaucguuagcagguuccugacaggacgguuugaagaugcguauacuccaacgauugaggacuuccaccgcaaguuuuacuccauccgaggugaaguguaucaguuggauauuuuagacaccucuggcaaucauccguuccccgcuaugcguagacugucgauccuaacagauccuaggcaccaaguacucccacaggagcagaaccagggggaacggggacgcgcccccggccaucugagacaacaggguuga

SEQ ID NO: 61608 - RNA, 801 nt, Artificial Sequence
  derived and/or modified sequence opt3 from RASD2__Homo_sapiens__NP_055125
augaugaagacccugagcuccggcaacugcacacucucugugcccgccaaaaauucauacagaauggucguucuuggggcuaguagggugggaaagagcuccaucguaucucgguuccugaacggucgcuuugaggaccaguauacuccuacgauugaagauuuccaccgaaaaguguacaauauacguggcgacauguaucaauuggauaucuuagacaccucggggaaccauccauuuccggcaaugagaaggcugucaauucuaacaggagaugucuucauccucguguuuagccuggacaaucgggagaguuucgaugaaguuaagcgccuucagaaacagauucuggaggugaaguccuguuugaagaacaaaacuaaggaagccgcggagcuccccauggucaucugcggcaauaaaaacgaccacggugagcuguguagacaggugccuaccacagaagcugagcugcucguaucuggggaugaaaauugcgccuacuuugagguuagcgcaaagaaaaacaccaauguggacgagauguucuaugucuuauuuuccauggccaagcugccacaugaaaugucacccgcacuucacaggaagauaagugugcaauacggagaugcuuuccauccucggccauuuuguaugcgccgagugaaagagauggacgccuauggcauggucagccccuucgcuagaaggccuucuguuaacuccgauuugaaguacaucaaagccaaggugcugcgggaaggccaggcgcgugagcgcgacaaaugcacuauucaguga

SEQ ID NO: 61609 - RNA, 2223 nt, Artificial Sequence
  derived and/or modified sequence opt3 from RASEF__Homo_sapiens__NP_689786
auggaggccgacggcgauggggaagaacuggcuagacucaggagcguguucgcagccugcgacgcgaaccgguccggacgccuugaacgagaggaauuucgugcucuguguaccgaguugagagucaggcccgccgaugcagaggccguuuuccagcgguuagacgcugaucgcgacggugcaaucacauuucaagaguucgccagaggcuuucuggggucucuaaggggaggccggcgccgagauugggguccucucgacccagcuccggccgugucagaggcggggcccgaaacucacgauagugaggaggacgaaggagaugaggacgcagccgcugcccuggcaacgagcugcggcccugcuuccccaggcagagccuggcaggauuuccaggcgaggcuuggggacgaagccaaguuuauuccccgggaggaacagguaucuacccuguaccaaaauauaaacuugguggagccucgucucauccagccauaugagcaugucauuaaaaauuucauccgcgaaauuagacugcagucgacagagauggaaaaccuggcaaucgcugugaagagggcccaggacaaagcugccaugcaacucucagaguuagaagaggagauggaucagcggauacaggcagccgaacacaagacucgaaaagacgagaagcgcaaggcugaagaggcgcugagcgaucuuagaaggcaguacgaaaccgagguuggagacuugcaagugacaaucaaaaagcugcggaaacuagaggaacagaguaagcgcgucucccagaaagaggauguggcagcccucaagaagcaaauuuaugaccugucuauggaaaaucagaaaguaaagaaagaucuucuggaggcucagaccaacaucgccuuuuugcagagcgagcucgacgcacugaaguccgauuacgccgaccaaucauuaaauacugaaagagaucuggagauuaucagggcuuauacagaagaccguaacagucucgagcggcagauagaaauucuucagaccgccaaucgaaaacugcaugacagcaacgaugguuugagaucugcacuagaaaauuccuacucaaaguucaacaggagccugcacaucaauaacauuagucccggcaauacgaucucucgcuccagcccuaaauuuaucgggcauucgccacagccgcucggauaugaccggucuuccagaucaaguuacguugaugaggacugugauagccuggcgcuuugcgacccccugcaaaggacuaacugugaaguggauuccuugccugagucuugcuucgacagcggccucucaacccugcgcgauccaaacgaauacgacagugaggucgaauauaagcaccagcgagguuuucagcggucccacggggugcaggagagcuucggaggcgaugcuucugacacagaugugcccgacauucgugacgaggaaacuuucggcuuagaggaugucgccucaguucuggacuggaagccucaagggagugugagcgaaggauccauaguaucuucgagcagaaaaccaaucuccgcacuaucaccccagaccgaucucguggacgauaaugccaagaguuuuucuagccagaaggcuuacaaaauuguccuggccggugacgcagcugugggcaaauccucauuccuuaugagguuguguaagaacgaguuucgcgaaaauaucagcgccacacuggggguugauuuccagaugaagacccucauaguggacggagagcggacgguccugcaacuuugggauacugcgggccaggagagauuuaggucuauugccaaauccuauuuccgaaaggcugacggugugcuguugcucuacgauguaacaugcgagaaaaguuuucugaacauccgcgaguggguugacaugaucgaagaugcagcccaugagaccgugccgauuauguuagucgggaauaaggcugacauccgggacacugccgcaacagagggccagaaaugugugccuggacacuucggcgaaaagcuggcgaugaccuauggggcccuauuuugcgagacgagcgcuaaggauggaucuaacauugucgaagccgugcuccaucuggcaagagagguuaaaaagaggaccgacaaagaugacucccguucaauaacaaaucuuacugguaccaacaguaagaaaagcccccaaaugaagaauuguugcaacggcuga

SEQ ID NO: 61610 - RNA, 1470 nt, Artificial Sequence
  derived and/or modified sequence opt3 from RASGEF1A__Homo_sapiens__NP_001269791
auguuccuggagccccaggaaaccaugccucaaacaagcguggucuuuuccucuauccucggcccaucaugcagugggcagguucagccgggaaugggugagagaggcgggggagccggcggugggagcggagaccuuauuuuccaggauggccaccugauauccggcucuuuggaggcuuuaauggaacaucuggugcccacuguagacuacuauccugauaggacguacaucuuuaccuuccuacucucgucacggguguuuaugccaccccacgaccugcuugcacgcgucgggcaaauuuguguggaacagaagcagcagcuggaggccggaccugagaaagcgaaguugaaaaguuucagcgcuaagaucguucaacuccugaaagaauggacagaggccuuuccauaugauuuccaggacgaaaaggcaauggccgagcugaaggcuauuacucaucgagugacccagugcgaugaggaaaacgguacagucaaaaaggcaaucgcccagaugacccaaucccucuuacugucucuugcugcccguagccaguugcaggagcugagagaaaaacuaaggcccccugcgguggacaagggcccaauacucaaaacuaagccgcccgcagcccaaaaggauauccuggggguauguugcgacccucuuguucuggcucagcaguugacacacauugagcucgaucggguguccucaaucuacccagaagaccugaugcagauugucagucauauggauagcuuagacaaucaccgcuguagaggagaccugaccaaaacguauucucucgaggccuacgauaacugguuuaauugccuuuccaugcugguggcaacugagguguguagggucguuaagaaaaagcaccggacccgcauguuggaguucuuuaucgacguggcucgagaaugcuucaacauaggcaauuuuaacucaaugauggccauuaucagcgguaugaaucuaagucccguagcgagacugaaaaagacauggucuaaagugaagacugccaaguucgauguccucgaacaucacauggacccuuccagcaacuucuguaauuauaggaccgcacugcaaggggcuacacagcggucgcagauggccaacucuucccgugagaaaauugugaucccaguuuuuaaucuuuucgugaaggauaucuacuuucugcauaaaauucacaccaaccacuugcccaauggacauauaaacuucaagaaauuuugggaaaucucacgccagauucacgaguucaugacguggacucaagucgagugcccguuugaaaaggacaagaaaauccagaguuaccuccugacagcuccuauauauagcgaggaagccuuauucguggcauccuuugagucugaaggccccgagaaucauauggagaaggauagcuggaaaacccugagaacuacacuacucaacagggccuga

SEQ ID NO: 61611 - RNA, 1401 nt, Artificial Sequence
  derived and/or modified sequence opt3 from RASGEF1C__Homo_sapiens__NP_778232
augccccagacccugagcgccuccgacauggugacaccuggcucucucucaccaccgcccacugagccuacggauggggaacaagcuggacagccacuucuggacggugcacccaguagcgccuccuuggagaccuuaauccagcaccuggucccuacagcggauuacuauccagaaaaggcuuacauuuucacuuuucuacucucuucgagacuguucauagagcccagggaacuucuggcccggguuugccauuuguguaucgagcagcaacagcucgacaaaccugugcuggauaaggcacgcguacgaaaauuuggcccaaagcugcuccaguuacuggccgaguggaccgaaacauucccgcgugacuuucaggaggaaucaaccauugggcaccuuaaagauguggucggaagaaucgcucccugcgacgaggcauauaggaagcggaugcaucaauugcugcaggcccuacaccagaagcucgcugcccugcgccagggcccugagggucuugugggggcggauaaaccaauuagcuacagaacuaagcccccugcaaguauccauagggaacuguugggaguuuguuccgacccauauacacucgcccaacagcugacccacguggaguuagaacggcugcgccacauaggccccgaggaguucguccaggcuuuugugaacaaagauccgcucgccucuacgaagccuugcuucagcgacaaaacuuccaaucuugaagcauacguaaagugguuuaaccgacuguguuauuugguugcuaccgagaucugcaugcccgccaagaaaaagcaaagagcccaggugauugaguucuuuaucgaugucgcgagggaauguuucaauauuggcaacuuuaauucacuaauggcaaucauaagugggaugaacaugagcccagugucucggcugaaaaagacaugggcuaaagugcguacugccaaguucuucauucucgaacaucagauggacccuaccggaaauuuuugcaacuaccgcacagcucugagaggugccgcacacaggucccuuaccgcccauucaagccgggagaaaaucgucauucccuucuuuagucuguugaucaaggacaucuacuuccucaaugaaggcugugcuaaccgacugccaaaugggcacguuaacuuugagaaguucuuagagcuggcgaaacaggugggagaauuuauuacguggaagcaaguagagugccccuucgaacaggaugcaucuauaacucacuaucuauacacagccccuaucuuuuccgaggacggccucuaucuggcuagcuacgaaucggagucuccagagaaucagaccgaaaaagagcgcuggaaggcccuuagauccucaauuuuggguaaaacuuga

SEQ ID NO: 61612 - RNA, 3774 nt, Artificial Sequence
  derived and/or modified sequence opt3 from RASGRF1__Homo_sapiens__NP_001139120
augcagaagggcaucagacugaacgacgggcacguggccagccucggacuucuggcuaggaaagaugguacccggaagggcuacuuguccaaacgaucuucagacaauacaaaguggcaaacuaaaugguucgcauuacugcagaaccuacucuuuuauuucgagagugauagcuccucucgccccucggggcuguaccuucuggaaggaugcgucugugaccgugccccuucaccaaagccggcguugagcgcuaaggagccccucgaaaaacagcauuauuuuacgguuaauuucagucacgagaaccagaaggcccuggaacugagaaccgaggaugcaaaagacugcgaugaguggguggccgcuauugcacaugccuccuacaggacacucgcuacugaacacgaggccuuaaugcaaaaguaucugcaucuuuugcagauaguagaaaccgagaaaacaguggcgaagcagcugcggcagcaaaucgaggacggcgaaauugagaucgaacgccuaaaggcagagauuaccucucuccugaaagauaaugaaagaauccagagcacucagacagucgccccuaacgacgaggauuccgacauaaagaaaaucaagaaagugcagucauuucuuagggguuggcugugucggcgcaaguggaaaaccauuauccaagauuacauucgaaguccacacgcugacagcaugagaaagaggaaucagguuguguucucuauguuggaggccgaagcagaguauguccagcaacuccacauccuggugaacaauuucuuacggccccugcguauggcugccuccucaaagaaaccuccaauaacgcaugacgauguaagcaguauuuuccucaacucugaaacuaucauguuucuucaccagauuuucuaccaggggcugaaggcgcgcaucuccagcuggcccaccuugguucuagccgaccuguuugauauccuccugccuaugcuuaauauuuaccaggaguucgugagaaaccaucaauauucgcugcagauauuggcacacugcaaacagaauagggacuuugauaagcuccugaaacacuacgaagcuaagccagacugugaggagcggacauuagaaacuuuccugaccuauccgauguuccagaucccccgauacauucuaacacuccaugagcugcuugcccacaccccucaugaacacgucgagcgcaacucuuuggauuaugcuaaguccaaacuggaagaacucucaagaaucaugcaugacgaggugagugaaacggagaauauaaggaagaaccuggccauugaacggaugaucaucgagggaugcgagauucuucuggauacuagccaaacauuugugcgccagggcuccuugauccaggucccaaugucugaaaaaggcaagauuaccagagggaggcucggaagccugucacugaaaaaggagggugaacgucaguguuucuuauuuaguaagcaccuaauaaucugcacucggggcuccgggggaaaacuccaccugacaaagaacggcguuauuagccuuaucgacuguaccuugcuggaggaacccgagucuacggaggaagaggcaaaagguucagggcaagauaucgaccaucucgacuucaagauuggaguggaaccuaaagauaguccacccuuuaccguaauacugguggccagcucccgacaggagaaggcugcguggacaucugacaucucgcagugcgucgauaauauuagauguaacggcuuaaugaugaaugcauucgaagagaacagcaaggugacuguuccgcagaugaucaaauccgacgccucacuguacugcgaugacguggauauuagguuuaguaagaccaugaacucuugcaaaguccuucaaauccgcuaugcuagcguggagcgguugcucgaaagacugacagaccuaagguuccuguccauagauuuucucaauacuuuccugcacucauaccgcguauuuaccacagccaucguugugcuugacaaguugauuaccaucuacaaaaagccuauuagcgcaauccccgcccgaucucuggaguuacucuucgcuuccggccagaauaacaaacugcuuuauggggaaccaccuaagaguccccgggccacucguaaguuuagcucuccacccccucuguccauaacgaaaacaucaaguccaagcagaaggcgcaaguugucgcucaauauuccgaucauuaccggagguaaagcacuggaucuagcggcucuguccuguaacucuaauggcuacacuagcauguauucagccaugagucccuucuccaaggcaacccucgacacaucuaaacuguacgucagcuccucauucaccaacaagaucccugaugagggggacacuacaccagaaaagcccgaggacccuagcgcccuuaguaaacagucuuccgaggugagcaugcgggaagagucggauauagaccaaaaucagucagaugacggagauacggaaaccucuccaacuaagagucccacaaccccgaaauccgucaagaacaaaaauagcucugaguuuccuuuguucagcuauaacaacggcgugguuaugacauccugcagagagcuggacaauaacaggucagcuuuaagugccgcaagcgcuuuugccaucgcgacugccggugcuaaugaagggaccccaaacaaggagaaguaccgacgcaugucucucgcauccgccggcuuucccccugaucagcggaauggagacaaagaauuugugauuagaagggcugccacgaaccguguacugaauguccuucgccauugggugucaaagcacagucaggauuucgagaccaacgacgaacugaaauguaagguuaucggcuuucuagaggaggugaugcacgaucccgaacuccugacacaagagcggaaagcagcggccaauauuaucagaacuuugacccaggaagacccaggggauaaccagauaacacuggaggaaauuacucagauggcugagggagucaaggccgagccuuucgaaaaucauagcgcauuagagaucgcugaacaacucacccugcuugaccaccugguguuuaagaaaauccccuaugaggaguucuuuggucagggcuggaugaaguuggagaaaaacgagaggacgccauacauuaugaagacaaccaaacauuucaaugacaucuccaaccucauugccucugaaauaauccgaaaugaggauauuaacgcacggguaucggccaucgaaaaguggguggcuguugcggacauuugccgcugucugcacaacuacaaugccguccuagagaucacuagcucaaugaacagauccgcaauauuuaggcugaaaaagacauggcuuaaggugaguaaacagaccaaggcucucaucgauaaacugcagaaguuggugucuagcgaggggcgguucaaaaaucugcgagaagccuuaaagaacugcgacccgccuuguguccccuaucucggaauguaccugacugaucuugccuucauugaggaaggcaccccaaauuauacagaggacggucugguuaacuuuuccaagaugagaaugaucucacauauuauccgcgaaauaaggcaauuccagcagacggcuuacaaaauugagcaccaagcaaaggugacccaguauuugcucgaucagucuuuugugauggacgaggaaagccuguacgagaguucccuacguaucgaacccaaacugccuacuuga

SEQ ID NO: 61613 - RNA, 3714 nt, Artificial Sequence
  derived and/or modified sequence opt3 from RASGRF2__Homo_sapiens__NP_008840
augcagaaguccgugagauacaacgagggccacgcccuguaucucgcuuuccuugcaaggaaagaagggaccaagcggggauuucuguccaaaaagacagccgaggcgucucgcuggcaugaaaaaugguucgcuuuguaccaaaaugucuuauuuuauuucgagggugaacagucaugccgacccgccggcauguaccugcuagagggguguaguugcgagcguacuccugcaccaccgagagccggagcuggccagggugggguuagggacgcacucgauaagcaguauuacuuuacggugcuguucggacacgaaggccaaaagccccuugagcugcggugugaagaggagcaggacggcaaagaauggauggaggccauccaucaggcuagcuaugccgauauuuugauagaacgcgagguacucaugcagaaguacauccaccuggugcaaauugucgaaaccgagaaaaucgcggcaaaccagcugagacaucagcucgaggaccaggauacagaaauugagagguuaaaguccgaaaucauagcccugaauaaaacuaaggagcggaugcgcccuuaccaaucuaaccaggaagacgaggauccagacaucaagaaaauuaagaaagugcagucguuuaugcgaggguggcuuugcagaaggaaguggaaaaccaucguucaagauuauauuuguucaccccacgcugagagcaugcggaagcguaaucagaucguguucacaauggucgaagccgagagugaauacgugcaccaguuguauauacugguaaacggauuucuacgcccucucagaauggcagcuuccucuaaaaagccacccauuagccaugacgauguuuccucaaucuuccugaauagugagaccauuauguuucuucacgaaaucuuccaucagggucugaaggccaggaucgcgaacuggccuacuuugauucucgccgaccuguuugauauauuacugccaaugcucaauaucuaccaagaguucgugcggaaccaccaguauagccuucagguccuggcaaauugcaaacagaaccgagacuucgacaaguugcuaaaacaauacgaggcuaauccggccugugaaggccgcaugcuggagacauuucucaccuaucccauguuccagauuccuagauacaucauaacgcugcacgaacuucuggcucauacuccacacgagcauguggagaggaagucuuuggaauuugccaaauccaagcucgaggaacugucacgggugaugcacgaugaggucagcgacaccgaaaacauucgcaagaauuuagcaaucgagagaaugaucguugaggggugcgauauucugcuagacacaagucagacuuucaucaggcagggaucucucauucaagugcccuccguagaacguggcaaacugagcaaggugcggcuugguucguugucucugaaaaaggagggggaacgacaguguuuucucuucaccaaacauuuucugauaugcacaagauccucaggaggcaaacuucaccuguugaagaccggcgggguccucagucugaucgauuguacguuaauugaggaaccugacgccagcgaugacgauuccaagggaucuggucagguguucggccaccuggacuuuaagaucguuguggagccacccgaugcugcggcauucacugucgugcuacucgccccgagcaggcaggagaaagcugccuggaugucagacaucagucaaugcguagacaacauucgcugcaacgggcugaugacaauaguuuuugaagaaaauuccaaggugaccgucccucauaugaucaaaagcgaugcacggcuucacaaggacgauacugacauuuguuucucuaagacauugaacucaugcaaagugccccagaucagauacgccagugucgagaggcugcucgagcgccugaccgauuuacgauuucugagcauugacuuccuuaauacguucuugcauaccuaucggaucuuuacaacugcugccgugguucucggaaagcuguccgauauauacaaacguccauucaccucuaucccugugagaucgcuagaacuguuuuucgcaacaagccagaacaauaggggcgagcaccucguagacgguaagagcccccgccugugucggaaauuuucaaguccacccccucuugcggucucuagaacuagcuccccagugagggcucgaaaguugucacugaccagcccguuaaacucuaaaauuggggcccucgaucugacaaccuccaguagccccacuacgacaacccaaucuccugcagccuccccacccccucacacuggccagaucccacuugaccugucacgcggauugaguagccccgagcagucgccgggcaccguugaagagaauguggauaacccucgggucgaccucugcaauaagcugaagagauccauucagaaagcugugcuagaaucugccccagcagauagggcugggguagagagcucacccgccgcggacacaaccgagcugaguccuugucguucccccucuacuccacgccaucuccgguauagacaaccuggaggucagacagccgacaacgcucacugcagcgugucccccgcaucagccuucgcuaucgccacggcagcggccggccaugggagcccaccgggauuuaauaacaccgaaaggacuugugauaaggaguucauaauucgacggacagcuaccaaucgcguucugaacguccuuagacacugggugaguaaacaugcccaggacuuugaauugaauaacgagcugaagaugaacguguuaaaucuccuggaagagguccuuagggauccugaccugcuaccccaggagcggaaagcagcugccaacauccuccgagcacugucucaagaugaccaggaugacauucacuugaagcuggaagauaucauacagaugacagacugcaugaaggccgaguguuucgaauccuuaagcgcuauggagcucgcggaacagaucacucugcuugaucacguuauuuuuagaucgaucccauacgaggaguuccugggccaagguuggaugaaauuggacaagaaugaacgcacccccuauauuaugaaaacgucacagcauuuuaacgauaugucuaaucucguggccagucagaucaugaacuacgcagacguguccagcagggcuaaugccauagagaaguggguagccgucgcugacauuugccguugucugcacaacuauaauggggugcuagaaaucaccucugcacugaaccggagcgccaucuacagacuuaaaaagacaugggcgaagguuuccaaacaaacuaaggcucucauggauaaacugcagaagaccgugucaagugagggcagguucaaaaauuugcgcgaaacacugaagaacugcaauccuccagccguccccuacuuaggaauguaucucacugaccuggcauucauugaggagggcaccccuaacuuuacggaagaggggcuugugaauuucagcaagaugcgaaugaucucucauauuauaagagaaauccggcaguuucagcaaacauccuacaggauugaucaccagccgaaaguugcccaguaucuguuggacaaggaucucaucauugacgaggauacccuguacgagcuaucacugaaaaucgaaccacgccuucccgcuuga

SEQ ID NO: 61614 - RNA, 2289 nt, Artificial Sequence
  derived and/or modified sequence opt3 from RASGRP1__Homo_sapiens__NP_001122074
augggcacccuggggaaggccagagaggcucccaggaaaccuagccacggaugccgggcagccuccaaggcgcgccucgaagcuaaaccagccaacucuccguuccccucacauccuagucuugcacacaucacacaguuucgaaugauggugagccugggucauuuggccaagggcgcuuccuuagacgaucugauugacucuuguauacaaucguucgaugcagacgggaaucuaugccguucaaaccagcuccugcaggucaugcuuacuaugcacagaaucguuauuagcagugccgagcuguugcagaaagugaucacgcucuacaaggaugcucuggccaaaaauuccccaggacugugucucaagauuugcuauuuuguaagguacuggaucaccgaguucugggugauguuuaagauggacgcgucuuuaacagauacuauggaggaguuccaagagcuggucaaagcaaagggcgaggaacuucauugucgguugauagacaccacacagaucaacgcccgcgauuggagcagaaaacugacccagaggauuaaguccaauacuucaaagaaacggaaggugagucuacucuuugaccaccuggagcccgaagaacuuagcgagcaccugacauauuuggaguucaaaucuuuucgccgaaucuccuucucagauuaccagaacuaucucguuaauagcugcgugaaggaaaacccuaccauggaaagaaguauugcucuguguaaugguaucucucaauggguccaguuaauggugcuguccaggccaacgccccagcuccgggccgagguauuuauaaaauucauucagguugcacaaaaacuucaucagcugcagaacuuuaauacuuugauggcugugaucgggggacuaugccacagcucgauuucucgucugaaggaaaccuccucacaugucccucacgagaucaacaaggugcucggcgagaugacagaacugcuuaguagcucccgcaauuacgacaacuauagaagggccuacggcgaguguacugauuucaagaucccaauucugggggugcacuugaaagaccucauaucucuguacgaagcgaugccggacuauuuagaggauggaaaggucaauguucauaaacugcuagcccucuacaaccacaucagcgaacuggugcaacuucaggagguagcacccccuuuggaggcuaacaaggaccuggugcaucuccugacccuuucacuggauuuguauuacacagaagacgagauuuaugaacucaguuacgcccgggagccacgaaaucaccgcgcucccuccgucuucaaaaacuaugaucaugaccaggaugguuacaucagccaggaagaguuugagaagauagccgcaucuuucccuuuuucauucugcgugauggacaaggauagagaaggccugauuaguagggacgagaucaccgccuacuuuaugcgggcuagcuccaucuauucuaaauuagggcugggauucccacacaauuuucaagaaacgacuuaccuaaagcccacauucugugauaacugcgcgggcuuucucugggguguuauuaaacagggguaucgcugcaaggacuguggaaugaauugccacaaacaguguaaggaccugguggucuucgagugcaagaaaagagcaaagaacccgguggccccuaccgagaauaacacuucgguaggccccguuagcaaucuuuguuccuugggcgcuaaagaucugcuccaugccccagaagaggggccuuuuacauuccccaacggagaagcaguggagcacggugaagagucaaaggacaggaccaucaugcugaugggcgucaguucucagaaaauuagcuuacgucugaagcgggccguggcucauaaggccacgcaaaccgagucccagccauggauagggucagaaggacccagcggcccuuuuguccuuucuuccccacgaaaaacagcacaggauacuuuguacgugcucccgagucccaccagcccuugcccaucucccguucuggugagaaagagggcguucguaaaaugggagaauaaggacucccuaaucaaaucaaaggaagaacugcgccaccuccggcugccuacauaucaggaacuugagcaagagauuaacacuuugaaagcugauaaugacgcccugaagauccaguuaaaguacgcacagaaaaagaucgaaagucuccagcuggagaaaagcaaccacguccuugcccaaauggaacagggugauuguucguga

SEQ ID NO: 61615 - RNA, 1830 nt, Artificial Sequence
  derived and/or modified sequence opt3 from RASGRP2__Homo_sapiens__NP_001092141
auggccggcacccuggaccucgauaaggggugcacaguggaggaacuucugagaggauguaucgaggcuuucgacgauagcgguaaagucagggacccccaguugguucggauguuuuuaaugaugcacccuugguacauuccauccucucaacuggcagccaagcuacuccauauauaucagcagucacgcaaagauaacaguaauagccuucaggugaagacuugccaccugguacgauacuggaucuccgcguucccggcugaauuugaccugaaccccgaguuggccgaacaaauuaaagagcucaaggcacugcuggaucaggagggcaaucguagacauucuucgcucaucgacauugauucagugccuacguauaaguggaaaaggcaggucacccagcggaacccaguggggcaaaagaaacgcaagaugagcuuacuguucgaccaccuugaacccauggaguuggccgaacaucugacauaccuagaguauagaaguuuuuguaaaauccucuuccaggauuaccacuccuuuguuacucacggaugcaccguggacaauccuguccuggagagguucauaucucuuuuuaacagcgugucccaguggguacagcugaugaucuugucaaagccaacagcuccccaacgggcacucguuauuacccauuucgugcacgucgccgaaaagcuguuacagcugcagaauuuuaacacucucauggcuguggugggcggucuuagucauagcucuaucucccgccugaaagagacacacucacacgucagcccugaaaccauuaaguugugggaggggcuaacggaacugguuacugccaccggaaauuauggcaacuaccgaagaaggcucgcggcaugugugggcuuccgguuuccaauccuggggguacaucuuaaagaucugguggccuugcaacucgcucugccggacugguuagaccccgcccguacacgccugaauggagcaaagaugaaacagcuauucaguauacucgaggagcuggcuauggucacuucucuuagaccuccagugcaggccaaccccgauuugcugucccuccugaccguuagccuugaccaguaccaaacagaagaugagcuguaucaguugucgcuccagagggaaccucggucuaaguccucaccaaccagucccacgagcugcacuccgccuccccgaccaccugugcuggaggaauggacauccgcggccaaacccaaguuagaccaggcacuggucguggagcacauugagaagaugguagaaucuguuuuccgcaauuuugauguggacggugauggccauaucagccaagaggaguuccagauuaucagagggaacuuuccauaccuaucagcuuucggagaccucgaucagaaucaggacggcuguaucaguagggaagaaauggucuccuauuuucugcggucuagcucagugcuuggugggcgcaugggauucguccacaacuuucaagagaguaacagcuugagacccguggccugcaggcauuguaaagcucugauucucggcauauacaagcagggccugaaaugccgugccugugggguuaauugccacaagcagugcaaagaucgguuauccguggagugucgaagaagggcacagucuguaucgcuggaaggaagcgccccuuccccaucaccgaugcacagucaucaccaucgcgcuuucucuuuuagccuuccccggccugguagaaggggcucccgcccacccgagauccgagaagaggagguccaaaccguggaagacgggguuuucgacauucacuuguga

SEQ ID NO: 61616 - RNA, 2070 nt, Artificial Sequence
  derived and/or modified sequence opt3 from RASGRP3__Homo_sapiens__NP_056191
augggcagcuccgggcugggaaaggccgcuacccucgacgagcuucugugcacauguaucgaaauguucgaugacaacggugaguuggauaauucuuacuuacccagaauugugcugcuaaugcacaggugguaucucucaaguacugaacuggcagagaaacuucugugcauguaccggaacgccacgggcgaaagcuguaaugaguuucgcuugaagauaugcuauuucaugcgauacuggauccucaaauuuccugcggaguucaaccuggaccuggggcucauucguaugaccgaagaguuuagagaagucgcuucccaguuaggauaugagaagcauguuucucugaucgauauuucgucaaucccaagcuacgacuggaugaggcgggugacacaacgcaaaaagguaaguaagaaaggcaaggccugucuuuuguucgaucaccuggagccgauagaacuagcagagcaucucacuuuucuggaacacaaauccuucagaaggaucucuuuuaccgacuaucagagcuacgugauucaugguugccuugagaauaaccccacacuggaacgguccaucgccuuguucaaugggauuucaaaguggguccagcucauggugcugaguaaaccuaccccacagcaacgcgcugagguuaucacuaaguuuauaaacguggcaaagaaauuacugcagcucaagaauuucaacacacuuauggccgucgugggaggccugagccacucuuccauuucacgauugaaagagacccacagccaucuaaguucugaaguaacgaagaauuggaacgagaugacugaacugguuuccagcaauggcaacuacuguaauuauagaaaggcuuuugccgauugcgacggguucaaaauccccauucucggagugcaccugaaagaucuuaucgcgguccaugugaucuucccugacuggaccgaggaaaacaaggugaacauugucaagaugcaccagcugucgguuacauugucugagcucgugucccugcagaaugcaucacaccauuuagagccaaacauggaucugauaaaucuacucacucugagucuugacuuguaccacaccgaagacgauaucuauaaacugagccucguacuggagcccaggaacuccaagucuccuacaagcccaaccacgccgaauaaacccguggucccucuugaaugggcccugggugugaugccaaagcccgacccuacuguuauuaacaaacauauccggaaguugguggagucagucuuucguaauuacgaucacgaccaugauggcuauauaagucaagaagacuucgaguccauugcugccaacuuuccauuccucgauagcuuuugugugcuggacaaggaucaggacggguuaaucucuaaagaugagaugauggcauacuuccugcgcgcuaagucacagcuacacugcaaaaugggacccggcuuuauccacaauuuccaggaaaugacauaucucaagccgaccuuuugugagcauugcgccgguuuccugugggggauuaucaaacaaggauacaagugcaaggacuguggcgcgaacugccacaaacaguguaaggaccuuuugguacuggccugcagaagguuugcacgggcuccuagucucagcuccggccaugggucucugcccggaucgccuagcuuaccacccgcccaggaugaaguuuucgaguuuccaggugugacugcuggccaccgagaccuggauucccgcgccauuacacuugucaccgggucaaguagaaaaauaucugugagguugcaacgggcaacgaccagccaggccacacagacugagcccgucugguccgaagcuggauggggcgacucagguagccacaccuucccuaagaugaaaucuaaguuccaugauaaggcggcaaaagacaagggguuugccaaaugggagaaugaaaagccacgcgugcacgcuggcguugaugugguagacagaggaacagaguucgaacucgaucaggacgagggcgaggaaacuaggcaagauggggaggacggauga

SEQ ID NO: 61617 - RNA, 1980 nt, Artificial Sequence
  derived and/or modified sequence opt3 from RASGRP4__Homo_sapiens__NP_001139674
augaacagaaaggacagcaaaaggaagucccaccaggagugcaccggcaaaaucgggggacggggucgcccccgacaagugcguagacauaagacauguccuucuccaagggaaauuucaaaagucauggccaguaugaaucugggccuccuuagcgaagggggaugcuccgaagaugagcuguuggaaaaguguauacagucuuucgacucggcuggcucauuaugccacgaggaucauaugcugaacaugguucuagcaaugcacagcugggugcucccgagugccgaccuggcggcucggcuucugacuuccuaccagaaggccacgggugauacccaggaguugcgcagacuccaaaucugucaucugguaagguauuggcugaugcggcaccccgaagugaugcaccaggacccucagcucgaggaagucauugggcgcuuuugggcaacaguggcccgagagggaaauucugcucagagaagguuaggcgauagcuccgaccugccaggccuugggaaaaagcggaaaguuucauugcuguucgaucaucuagagacuggagaacucgcacaacaccugaccuaccuugaguuucguaguuuccaggccaucacaccccaggaccugcgcagcuauguguugcaggguucugucagaggcugcccugcucucgaaggguccgugggacugucaaacagcguaaguagguggguucaagugauggucuuaucucggccaggcccccugcagcgagcccaggugcucgauaaguuuauucauguggcgcaacgccuucaccagcugcagaauuucaacaccuugauggcagucacuggugggcuaugucacuccgccaucagcagacugaaagacucgcaugcucaccucucuccugauuccacaaaggcccugcuugagcugaccgaauugcucgcaucacauaauaacuacgcuagguaucggcgcacgugggccggaugcgcgggcuuuagacugccaguuuuaggcgugcaccugaaggaccuaguaagucuccaugaggcccagccggacaggcugcccgaugggcgucuucacuugccuaaacugaauaaccucuaccugcggcuucaagagcugguggcauugcagggacagcacccacccuguagcgcuaaugaagaccuccugcauuuacugacucuaucccucgaucuguucuauaccgaggacgaaauauacgagcuuucuuacgcccgagaaccuagaugcccaaagagcuugcccccgucaccuuuuaacgcuccccuggucguggagugggccccagguguuacaccuaaacccgauagggugacucucggccgccacgucgagcagcugguggaaaguguauucaagaauuaugacccagaggggcggggaaccaucucccaagaagauuuugagagauuaagcggcaacuuccccuuugcaugucauggucugcacccuccaccgaggcaggggcgcggcucuuucucacgagaggagcuuacaggauacuugcuccgggccagugcuauuugcagcaaacugggccuagcguuccugcacaccuuucaugagguuacguuccguaagcccacuuuuugcgacuccuguucuggguuccucuggggagugacaaaacaggguuauagaugcagggaauguggccugugcugucacaagcauugccgcgaucaggucaagguggaguguaaaaagcggccuggggcaaaaggagacgccggcccacccggugcuccugucccaucgacccccgccccgcacgcaagcugcggguccgaagagaaucauucauacacucuuaguuuggagccugaaacaggcugucaacugagacacgccuggacccagacggagucuccacaccccagcugggaaaccgauacagugccuugccccguuauggacccaccuuccacugcuucaagcaaguuagacucuuga

SEQ ID NO: 61618 - RNA, 2892 nt, Artificial Sequence
  derived and/or modified sequence opt3 from RASIP1__Homo_sapiens__NP_060275
augcugagcggcgagagaaaagaagggggaucccccagguucgguaaacuccaccuuccugugggccuguggaucaacucuccacggaagcaguuggccaaauuagggcgccgauggccgucagcugcaagugucaagagcuccucuucggacaccggaucacguagcagugagccccugccuccacccccuccacauguugaacuaagaagggugggcgccguaaaagcggcugguggggccuccggaucucgggcaaagcgcauuagccaacucuuuagaggcuccggcacagggacuacgggaucaaguggugccggcgggcccggaaccccuggcggugcucagaggugggcaagcgagaagaaacugccagaacuugccgcugggguggccccggagcccccucuggcgacacgggcaacugccccacccggagucuugaagauauucggcgcuggccucgccucuggggcaaauuacaaauccgugcuggcuaccgcccgcucaacagcgcgagagcugguugccgaagcacucgagagauauggauuagcugguagcccuggcgggggaccaggcgaaaguucuugcguggaugccuuugcucugugugacgcccuugguaggcccgcagccgcuggggucggcuccggagaguggcgggcggagcacuugcgugugcugggcgauagcgaacgcccgcuacucguacaggagcuguggagagcaaggccugggugggcccggcgauucgaacuucgcggaagagaggaagcuaggcggcuggagcaggaggccuuuggugcagccgacucggaaggcaccggggcucccucuuggcgcccacaaaagaacagauccagggccgcaucaggaggcgcggcuuuggccaguccuggucccgggacuggcagcggagcaccagccggcuccgggggaaaagagcguucugaaaaucucagccugcggcgaucaguuagugaguuaucccugcaggguagaaggcgccggcagcaggaaagaaggcaacaggcucucagcauggcccccggcgcagcugaugcccagaucgggacagcggacccuggagauuucgaccagcuuacccaaugccugauucaggccccaucuaaccgcccguacuuuuugcuacugcagggcuaucaagaugcucaggacuucguggucuacgugaugacgcgagagcagcauguguuuggucgugggggcaauucaaguggacggggcgggagccccgcaccuuaugucgauacuuuccucaacgccccagacauccugcccagacacuguaccguuagggcuggaccugagcauccagccauggugcgccccucccggggcgcaccgguaacacacaaugguugccuucuguugagagaagcggagcuccacccuggggaucuguuaggacugggcgaacauuuucuauucauguacaaggacccaaggacugguggcucugggcccgcccgaccucccuggcucccagcucgcccuggagccacacccccaggcccggggugggcauuuucgugucggcugugcggaagaggccuucaggagaggggugaggcuuuggccgcauaucuggacgggcgugaaccugugcuccgcuuccggcccagagaggaagaggcccugcuuggagaaauugucagggcugcggccgcaggcagcggugaucugccacccuugggcccugcuacccuccuggccuuaugugugcaacacuccgcccgagagcuggagcuagggcaucucccacggcugcuuggacgcuuggcuagacugaucaaggaagcaguuugggagaaaauaaaggaaaucggcgacaggcagcccgagaaccacccugaaggggugccggaggucccacucacccccgaggccgugucaguagaacugcggccuuuaaugcuguggauggcgaauacgacugagcuuuugaguuucguucaggaaaaagugcucgagauggaaaaggaggcugaucaggaggacccacaacugugcaacgaucuagaacugugugacgaggccauggcacuccuggaugaagucauuaugugcacauuucagcagucuguguacuaccuuaccaaaacuuuguauagcacacugcccgccuuacucgacuccaauccuuucaccgcuggagcagagcugccgggccccggugccgaacuuggggcgaugccaccuggacugcgacccacguugggcgucuuucaggcugcccucgagcugaccucacaaugugagcuacacccagaucuggugagccagacauucgguuaccucuuuuucuuuucuaacgcaucccugcuuaauaguuugauggaaagaggccaggggcgcccuuucuaucaguggagcagggccguucaaauccguacuaaccuggacuuagugcucgauuggcugcagggagcuggccuuggggacauugccaccgaguuuuuccggaagcugucuauggcaguaaaucuacucugcguccccagaacaucccuguugaaggcuucauggaguagccugaggacugaccauccaaccuuaacaccggcccagcuccaccaucugcuuucgcacuaccaacugggaccuggccgcggucccccagcggccugggaucccccuccagcagaacgagaggcuguggacaccggggauaucuuugaguccuucucuagccaucccccuuugauacucccgcugggaucaaguagacuacggcugacuggcccaguuacggacgaugcccuucacagggaacuccgccgucugagacgguugcugugggacuuagagcagcaggaacuccccgcuaacuauaggcacggcccucccguggcaacauccccauga

SEQ ID NO: 61619 - RNA, 612 nt, Artificial Sequence
  derived and/or modified sequence opt3 from RASL10A__Homo_sapiens__NP_006468
augggcgggagccugagaguggccguccucggagcucccgguguuggcaagaccgcaaucauuaggcaguuccuuuuuggggacuacccugagcggcaccgcccaacagauggaccgcgacuguaucgucccgccguguuguuagacggcgcgguauacgaucuguccauaagagacggugauguggcugggccuggaucuucaccaggcggccccgaagaguggccugacgccaaagauuggagucuacaagacacugaugcauucguccucguguaugacaucugcagcccagauuccuuugacuacguuaaggcccugaggcagcggauugcugaaacgcgccccgcaggggccccugaggcuccaauccuuguggucggaaacaaaagagauaggcagcggcugcgcuucgguccgagacgagccuuggcggcacucgugaggcggggcuggcguuguggguaucuggaaugcucugccaaguacaauuggcauguacugcgccucuuuagagaguuacugaggugugcucuuguucgggcccgacccgcacacccugcuuugcgccugcagggagcccuacauccagcgagaugcucgcucauguga

SEQ ID NO: 61620 - RNA, 612 nt, Artificial Sequence
  derived and/or modified sequence opt3 from RASL10B__Homo_sapiens__NP_201572
auggugagcaccuacagagucgccguucugggcgcuaggggaguggggaaguccgcaaucguacggcaguuccucuauaacgaguuuucugaagugugcguccccacaacugcccgccgacuuuaccugccugcggugguuaugaauggucacgugcaugacuugcaaauuuuagauuucccaccgauaucagcuuuucccgucaacacgcugcaggagugggccgacaccuguugccguggccuaagaagugugcacgcauauauccucguauacgauauuuguugcuucgacagcuuugaauauguuaaaacaaucaggcagcagauucuggagacucgggugaucgggaccuccgaaacaccuauaaucauugucggaaauaagcgcgaucuucaaagaggcagggugaucccacgguggaacgugucucaucugguccgcaaaaccuggaagugugguuacguugagugcucggccaaauauaauuggcacauuuugcuccuguucucagagcugcucaagagcguggggugugcucgaugcaagcauguacacgcagccuuaagauuucagggagcucugaggcggaaccguugugccaucauguga

SEQ ID NO: 61621 - RNA, 729 nt, Artificial Sequence
  derived and/or modified sequence opt3 from RASL11A__Homo_sapiens__NP_996563
augagaccccugagcauguccggccacuuccuccuugccccuaucccagagucuucaagugacuaccuguugccgaaggauauuaaauuagcugugcugggggcaggaagggucgguaagagcgccaugauaguucgguuucuaaccaaacgcuucaucggcgacuaugaacccaacacagggaagcucuacucccgacugguguauguagagggagaucagcuuucucugcaaauucaggacacuccuggcggugugcagauccaggauucguugccacaagucguggacucacucagcaaaugcguucagugggcggaaggguuucugcugguguacaguauuacggauuaugacuccuaccucucuauccgucccuuauaucagcauauaagaaagguccacccugauagcaaggcuccagugaucauuguaggaaauaaaggcgaccugcuucaugccaggcagguucaaacccaggauggcauccaguuggcaaacgagcuggggucccuauuccucgaaauuucaacaagugagaauuacgaggacgugugugaugucuuucagcaccugugcaaggaagugagcaaaaugcauggacuuucuggugagcggcgcagagccuccaucauacccaggccucggucaccaaacaugcaagaccugaagcgccgauucaaacaggcuuugagcccgaaggugaaggcacccagugcccucggcuga

SEQ ID NO: 61622 - RNA, 747 nt, Artificial Sequence
  derived and/or modified sequence opt3 from RASL11B__Homo_sapiens__NP_076429
augagacugauccagaacaugugcaccauugccgaauaccccgcuccuggcaaugcagccgcgagcgacuguugcgugggggcugccggaaggcggcucgucaagauagcaguugugggugccuccggcguagggaaaacagcucuugugguccgcuuccugacuaagcgauuuaucggagauuaugaacguaacgcaggcaauuuguacacgagacaagugcagauugagggugaaaccuuagcccugcagguucaggacacaccagggauccaagugcacgagaacucucuaucauguagugaacagcucaauaggugcauucggugggcugaugccgucgugaucguauucagcauaacugacuauaaauccuacgagcugaucucucagcuucaucagcacguucaacagcugcauuugggaacccgccucccgguggucgugguggcgaacaaggcagaucugcugcacauuaaacaggucgacccccagcucggcuuacaacuggccucgaugcuuggcuguucauuuuaugagguuagcgugagugaaaauuacaacgauguauauuccgcuuuccauguguugugcaaggaggucucucacaagcagcagccuagcuccacaccagagaaaagaaggaccucacugaucccccggccuaagaguccaaauaugcaagaccuaaaacgccgauuuaagcaggcccucagcgcaaaagugagaacuguuacaucuguguga

SEQ ID NO: 61623 - RNA, 801 nt, Artificial Sequence
  derived and/or modified sequence opt3 from RASL12__Homo_sapiens__NP_057647
augagcuccguguucggcaagcccagagccgggucuggaccucagucagcuccacuggaggucaaccucgcaauccuugguaggcggggcgccgggaaaagugcgcugaccguuaaguuuuugacaaaacgcuucauuagcgaauacgacccgaauuuagaggauacuuauuccucugaagagacgguggaccaccaacccguacaucugcgagugauggauaccgcugaccuagauacaccucguaacugcgaaagauaccucaauugggcccacgcauuucuggucguguauucgguugacucaaggcagagcuucgauaguuccucuagcuaccuugagcuguuggcccuccaugcuaaggagacucagcgguccauaccagcacugcugcucggaaacaaauuagacauggcccaguaucgccaagugaccaaggcugaaggcgucgcccuggcggguagauuugggugucuuuucuuugaggugucagcaugcuuggauuucgaacacguacagcauguuuuucacgaggccgugagggaggcucggcgcgaacuggagaagaguccccuaacacgaccucucuucaucagcgaagagagagcccugccacaccaggcaccccuuaccgcuaggcauggacuggccucuuguacuuuuaauacauuguccaccauuaaccucaaagaaaugccuacggucgcgcaggccaagcuggugacugugaaaucaagccgggcacaaaguaagcguaaagcuccaaccuuaacacugcucaagggcuucaagaucuuuuga

SEQ ID NO: 61624 - RNA, 570 nt, Artificial Sequence
  derived and/or modified sequence opt3 from RASSF1__Homo_sapiens__NP_001193886
augagccugaacaaggacggcuccuacaccggguucaucaaagugcagcucaaacuugucagacccguuucugugccuucaaguaagaagccaccgagccugcaagaugccaggcggggacccggucgcggcacauccguacgacguagaacuucuuuuuauuugccuaaagacgcugugaagcacuuacauguccugucgaggacgcgggcacgcgaggugauugaagcccuacucagaaaguuccugguuguggaugacccaaggaaauuugcgcuuuucgagcgggcugaacgccacgggcaggucuaccugcgaaaguugcucgaugacgagcagccccugagacugaggcucuuagccggaccuucagauaaagcacugagcuuugugcuuaaggaaaaugacaguggcgagguaaacugggaugccuucuccaugccagaguugcauaauuuucugcggauacuacagcgugaagaggaggaacaccuccgccaaauccugcagaaauauucuuacugcagacagaagauucaggaggcacuucaugcuuguccccuggguuga

SEQ ID NO: 61625 - RNA, 981 nt, Artificial Sequence
  derived and/or modified sequence opt3 from RASSF2__Homo_sapiens__NP_055552
auggacuacagccaccagaccucccuggugcccugcggccaagauaaguauaucucuaaaaacgagcuccuucugcauuugaagacauacaauuuauauuacgaagggcagaaccugcagcuaagacacagggaggaagaggacgaguucauugucgaaggacuccugaauauaucauggggucuucggcgcccuauccgacugcagaugcaagaugacaacgagcguauuagaccaccgcccaguagcuccucuuggcauucgggcuguaauuugggggcccagggaacuacgcucaaaccucugaccguuccaaaggugcagaucucagaaguagaugcucccccugagggcgaccagaugccaagcaguacagauuccaggggucugaaaccccuccaagaagacacuccucaguuaaugcggacccgcucugaugugggggucagaaggcggggaaacgugcgcacaccaagcgaccagcgaagaauuaggcggcaccguuuuuccaucaauggccauuucuauaaccacaagaccucaguuuuuacuccggcauacggcagugugacaaauguccgcauaaacagcaccaugacgacuccccaggugcugaaguuguugcugaauaaauucaagaucgagaacucugccgaggaauuugcgcuauauguaguucacaccuccggggagaaacaaaagcucaaagcuacagauuacccucugauugccagaauccuucagggaccaugcgaacagauuucaaagguguuccugauggagaaggaccaagucgaagaggugacuuacgauguggcacaguauaucaaauuugagaugcccguccuuaagagcuucauacagaaacuccaggaagaggaagacagggagguuaagaaacugaugcggaaguacaccguguuacgacugaugauucgccaaagacucgaagagaucgccgagaccccugcuacaauuuga

SEQ ID NO: 61626 - RNA, 717 nt, Artificial Sequence
  derived and/or modified sequence opt3 from RASSF3__Homo_sapiens__NP_835463
augagcuccggcuacucuucacuggaggaagacgccgaggauuucuuuuucaccgcuagaacaucguuuuucaggcgggcaccccaggggaagccucgcagcggacaacaggacguggaaaaagagaaggaaacucacuccuaucucucuaaagaggagaucaaggaaaaaguccauaaguacaaccuugccguuacggauaagcugaaaaugaccuugaauaguaacgguauuuauacaggcuuuauaaaggugcagauggaguuaugcaaaccaccgcagacuucacccaauagcgggaagcugaguccuuccucuaacggauguaugaauacccuacacaucagcuccacaaacaccguaggcgaagugauugaggcgcuccugaaaaaguuccuugucacugagucaccagcuaaguuugcccuguacaaacgaugccaucgugaagaccaaguguaugcauguaaguugagugauagagagcacccccucuaccugaggcugguugccgguccucggacagacacccucagcuucguguuacgcgaacaugagaucggggaaugggaggcuuuuucucugccagagcuucagaauuucuugaggauucuggauaaagaagaggacgaacagcuacagaaccucaagagacgguauacggcauaccgccaaaaacuggaggaagcccuucgagaggucuggaagcccgauuga

SEQ ID NO: 61627 - RNA, 966 nt, Artificial Sequence
  derived and/or modified sequence opt3 from RASSF4__Homo_sapiens__NP_114412
augaaggaggacugccugcccagcucccacgugccuaucucugauucaaaaaguauucaaaagagcgaacuccuuggccuguugaaaaccuacaacuguuaucaugaggggaaguccuuccaguuaagacacagggaagaggaaggaacacugauaaucgagggucuacucaauauugccuggggccugcggcgcccaauccgacuucagaugcaggacgaucgugagcagguccaucugccgucuacuucguggaugcccagaaggccuucaugcccauugaaagaacccagcccucaaaacgggaauauuacggcucagggaccaaguauccagcccguucacaaggcagaguccucuaccgacagcuccggcccucucgaagaggccgaggaagcgccacagcugaugcggacaaagucagaugcuaguuguaugagccaacgcagaccgaaaugcagggcccccggugaggcacagcggauacgccgacauagauuuucuaucaacgggcacuucuacaaucacaagacuuccguguuuaccccugccuauggaucaguaacaaacgugagggucaauagcaccaugacuacacuccaggugcugaccuuacugcuuaacaaauuccggguugaagacggcccaagugaguuugcuuuguacauugugcaugaaucuggcgagcguacgaagcugaaagauugugaguauccccuaaucucccgcauucuccacgggccuugcgaaaagaucgcaagaauauuccugauggaggccgaccuuggagucgaagugccacaugagguagcucaguacauuaaguuugaaaugcccguucuggauagcuucguggagaaauugaaggaggaagaggaaagggagaucauuaaacucacuaugaaguuucaagcccugcgguuaaccaugcugcagcgacucgaacagcuugucgaggcgaaauga

SEQ ID NO: 61628 - RNA, 1257 nt, Artificial Sequence
  derived and/or modified sequence opt3 from RASSF5__Homo_sapiens__NP_872604
auggccauggcuagccccgcaaucggccagagaccuuacccacugcuccuugacccggagcccccuagguaucugcaauccuugucugggccagaauuacccccuccacccccugaucggucaagucgccugugcgugccagccccgcuaagcaccgcgcccggagcucgagagggucguuccgccagaagggcagcccggggcaaccucgaaccuccaccccgcgcuucuagaccugcaaggccacugcggcccgggcuucagcagcgccugcgaagaaggccgggagccccucggccccgugacguccgcucgauuuucgagcagccacaagauccuagaguucccgcugaaaggggcgagggucacuguuuugccgaguuggugcucccagggggacccggcuggugcgaccuguguggccgggaaguacugcgacaggcgcuccgcugcacaaauuguaaguucacuugccauccugaguguagaucauuaauacagcuggauugcagccagcaagaagggcuuaguagggaccggccauccccggagucuacguugaccgugacauuuagccagaacgucuguaaacccguggaggaaacucagcgcccuccaacccugcaggagaucaagcagaaaauugauuccuacaauacaagagaaaagaacugccuaggaaugaaacucucagaggacgguaccuauacuggcuucaucaagguucaccugaaacuuaggcgucccgugacagucccugcagggauucggccacagaguaucuacgaugccauaaaggaagugaaucuggcugccaccacggacaagcgaacuagcuuuuauuugccccucgaugcaaucaaacagcugcauauuucuuccaccacaacuguaucagagguuauccaaggauuacugaagaaauucaugguggucgacaacccgcagaaguuugcucucuucaagaggauucacaaagauggccaggugcuuuuucagaagcugagcaucgccgacagaccuuuguaccuacgccugcucgcggguccagacaccgaggugcugaguuucguccuuaaagaaaaugagacaggggaaguugagugggaugccuuuucuauacccgaacugcaaaacuucuugaccauucucgagaaggaggaacaggacaaaauccaacaggugcaaaagaaauaugauaaguuucggcagaagcuggaggaagcauuaagagagucccagggaaaaccuggcuga

SEQ ID NO: 61629 - RNA, 912 nt, Artificial Sequence
  derived and/or modified sequence opt3 from RASSF6__Homo_sapiens__NP_001257320
augaccaugauggcccaccaguaccccagcuggaucuucauuaacgagaagacauuuauaacuagagaacaacugaauagccuccuuaaaacguauaacaucuucuacgagaaucagaagaaccugcauauuuuguauggcgaaaccgaggacgggaaauuaaucguggaaggaaugcuggauaucuuuuggggugucaagaggccuauucagcuaaaaauacaggacgagaagccauucucuucauuuacaaguaugaaguccuccgauguuuucucuucgaaaggcaugacucgguggggagaguuugacgaucucuaccgcaucucagaacuggaccgaacccaaauuccgaugagcgagaagcguaauagucaggaagauuaucuuuccuaccacucuaacacacugaaaccccaugcuaaggacgagccugauagcccaguguuguauagaaccauguccgaggcagcccucguaaggaaacggaugaagccccugaugauggaccgcaaggaaagacagaaaaauagggcgucaaucaacgggcacuucuacaaucaugagauugaaaacaguccucaggauuuugcucugcacaucauauucgccacuggcgagcaacggcgccucaagaaaacagacauuccauuacugcagcgacuuuugcagggucccagcgaaaagaaugcaagaaucuuucugauggauaaagacgccgaggagauuucuuccgacguggcucaguacaucaacuuccacuuuucacuacucgaaagcauccugcaaaggcuuaaugaggaagagaagcgggaaauucagcguauagucaccaaauucaacaaggagaaggcaaucauucugaaaugcuugcagaauaagcucgugaucaaaacggagacuaccguuuga

SEQ ID NO: 61630 - RNA, 1014 nt, Artificial Sequence
  derived and/or modified sequence opt3 from RASSF7__Homo_sapiens__NP_001137465
augcugcugggccuugccgcuauggagcugaaggugugggucgacgggauccagagaguugugugcggaguaagcgaacaaaccacaugucaggagguggucauugcauuggcccaggcgauaggucagacuggcagguucguguuaguucaacggcugcgcgaaaaagagcgacagcuacucccccaggaaugcccugugggggcucaggccacguguggacaauuugcauccgauguccaguucgugcugcguagaaccggcccaucucuugccgguaggccgucaagugacagcugucccccuccagagcggugccugauccgcgcuuccuugcccguaaagccuagagcagcccucgggugcgagccaaggaaaacacugacucccgaaccugcuccaucucugucgcggccgggacccgccgcgccuguuaccccaacacccggcuguugcaccgaucuccgcggcuuagagcugcgagugcagagaaacgcagaggaacuugggcacgaggccuuuugggaacaggaguugaggcgggaacaagcucgugagcgcgaaggacaggccagacugcaggcacuaucagcugccacugcggagcaugccgcaaggcuccaagcucuggacgcccaggcucgggcccuugaggcagaacugcaguuggccgcugaggcgccugguccacccagcccgauggcaagugccacagaacgacuccaccaggaucuggcuguccaagagcgccaguccgccgaagugcagggcucuuuagcacuggugagcagagcccucgaggcugccgagagggcacuucaggcgcaagcucaggaacuggaggaauugaaucgggagcuacgccaguguaaccugcagcaauucauucagcagaccggggccgcacucccucccccaccuagacccgacaggggaccacccggcacgcaggucgguguugugcucgggggaggcugggaaguacguacuuggccuuccccaaccccgucauga

SEQ ID NO: 61631 - RNA, 1260 nt, Artificial Sequence
  derived and/or modified sequence opt3 from RASSF8__Homo_sapiens__NP_001158219
auggagcugaaggugugggucgacggcguucagagaaucgugugcgggguaaccgaagugacaacuugucaagaggucgugauugcccucgcucaggcaauaggaaggacgggucgguacacccuuaucgaaaaauggcgcgauacagagcgacaccuggcgccccaugaaaacccuauuaucagcuugaauaaguggggccaguaugccuccgacguucaguuaauucugcguagaacugggccaucucuaucagagaggccgaccagugauagcguggcucggauccccgagcgcacacucuacagacaaucccugccuccacuugccaaacugaggccccagauagacaagucuaucaaacggcgcgaaccuaagcgaaagucguugaccuucacuggaggcgcaaaaggucucauggauauuuuugggaagggaaaagagacagaguucaagcagaaaguccugaacaauugcaagaccacggccgacgaacugaagaaacucaucagauuacagacugagaagcugcaaucaauugaaaaacagcuugagagcaacgaaaucgagauaagguuuugggaacagaaguauaauaguaacuuggaggaggaaauugugcggcuggagcagaaaaucaagcguaaugauguagaaauugaggaagaggaguucugggaaaacgagcuacaaaucgaacaggagaaugaaaaacagcucaaggaccaacugcaggagauccgccagaagauuaccgagugugaaaacaaacuuaaggauuaccuggcucagauaagaacaauggaguccggcuuggaagcagagaaacuccaaagggagguucaggaagcccaggugaaugaggaagaggucaagggcaaaaucgggaaggugaagggagaaauugacauccagggucaacagucucugcgguuagagaacggcauaaaagcuguggagcgaagccuggggcaggccacuaagcgccuccaggauaaagaacaagagcuugaacagcugaccaaggaguugagacaggucaaucuacagcaauuuauucagcagacaggaaccaaaguuacggugcugccagcggaacccaucgagaucgaggcaucccacgccgacauugaaagggaggcuccuuuccaaucaggcagucucaagcggccagguagcucucgccagcugccguccaaccuuagaauccugcagaaucccauuucaagcggguuuaacccugaaggaauauauguauga

SEQ ID NO: 61632 - RNA, 555 nt, Artificial Sequence
  derived and/or modified sequence opt3 from RAX2__Homo_sapiens__NP_116142
auguuccugagccccggcgaggggccugccaccgaaggagguggccucgggccaggagaggaagcuccgaagaaaaagcacagaaggaaccggacaacuuuuacgaccuaccagcuucaucaacuggagcgcgcauucgaagccucccacuaucccgacguguacucucgagaggaguuggcggcuaaaguccauuuaccugaaguucgugugcagguaugguuucagaauagaagggccaaguggcggcgccaggagagacuggaaucaggcaguggugcaguggccgcuccaaggcuacccgaggccccugcacucccauucgcucggcccccugccaugagccugccacuugagccguggcuggggcccggaccuccagcgguccccggcuugccucgccuccugggcccagggcccggacugcaagcauccuuugguccgcacgccuucgcuccuacauuugccgauggcuucgcacucgaagaggcuucuuuacgacugcuugccaaagaacaugcgcaggccuuggacagagcauggcccccagcuuga

SEQ ID NO: 61633 - RNA, 1041 nt, Artificial Sequence
  derived and/or modified sequence opt3 from RAX__Homo_sapiens__NP_038463
augcaucugcccggcugcgccccugcuauggcagacgggagcuucucccucgccggacaccuucugagaucuccagguggcucaaccaguagguugcacagcaucgaggcgauuuuaggguuuacaaaggaugacggaauacugggcacuuucccggcugaacggggugcccgcggggcaaaagagcgagaucguagacuaggagccaggcccgcuuguccuaaggcaccagaagagggcuccgaacccucuccuccacccgccccugcuccagccccggaguacgaggcgccccggccuuauugcccaaaagaacccggcgaggcacgcccuucgccagggcuccccgugggaccggccacgggugaagcuaagcugucagaggaggaacagccuaaaaagaagcauagaaggaaccggaccacauuuacuaccuaccaacuucacgagcuggaacgcgccuucgagaaaagccauuaucccgacgucuacagucgagaagaguuggcaggcaagguuaaucucccagaggugagaguacaggugugguuucagaacaggcgggcuaaauggcgucgccaggaaaagcuggaggucuccucuaugaaacugcaagauagcccucucuuauccuucucaagaagucccccaagcgccacacugucuccccuuggggcgggaccuggcuccggugggggaccagccggcggcgcauugccgcuggaaucauggcuagggcccccucucccaggagguggcgcuaccgcccugcagagccuucccggguuuggaccuccagcucagagucugcccgccucuuauacuccgccuccacccccucccccauuccucaauuccccucccuugggcccaggucugcagccguuagcaccucccccacccagcuacccuugugggccaggcuuuggagacaaguucccccuggaugaggccgacccuaggaacucgucuaucgcugcgcuccggcuuaaggcaaaagaacacauucaagccaucggcaagccguggcaggcucuguga

SEQ ID NO: 61634 - RNA, 4776 nt, Artificial Sequence
  derived and/or modified sequence opt3 from RB1CC1__Homo_sapiens__NP_001077086
augaagcuguacguguuccucgucaacaccggcacaacucuuacguuugacaccgagcugacaguucagacuguggccgauuugaaacacgcuauccaaagcaaguauaaaauugcaauacagcaucagguauuaguggucaaugggggagaaugcauggccgcggacagaaggguguguaccuacuccgcugguacagauaccaaccccaucuuccuguuuaauaaggagaugauucuaugcgaccggccuccagccaucccgaaaacuacauucucuaccgaaaacgauauggagauuaagguugaagagucacucaugaugcccgcaguguuucacacggucgccagucgcacucagcuggcucuugagauguaugaaguggcaaagaaacuguguagcuucugcgagggcuugguacaugacgaacaccuccaacaucaggggugggccgcuaucauggccaaucuggaggauuguuccaacucuuaccagaagcugcucuuuaaauucgagucgauauauucaaauuacuuacagagcaucgaagacauuaagcugaaacuuacccacuugggaacagcgguuagugugauggcaaagaucccucugcuagagugccucacucgacacuccuaucgugaaugucugggcagacuugauucucugccagagcaugaagacagcgagaaggccgagaugaaaagguccaccgaauugguccucucacccgauaugccucggacaaccaacgagagucuguuaacgagcuuuccaaagucuguggaacacgugucccccgacacugcugaugccgagucagguaaagaaauucgcgagagcugccaaaguacaguccaucagcaggacgagaccacuaucgacacaaaggauggggaccugccuuucuuuaauguuucucuccuugauuggauaaacgugcaggacagaccaaaugauguagaaucccuggugaggaaauguuucgacagcaugucgcgguuggauccgcgcauuauccgacccuuuauugcagagugcagacaaaccaucgcuaagcuagacaaccagaauaugaaagccaucaagggacuggaagauaggcucuacgcgcuggaccagaugauugccucuuguggccggcuugucaacgagcaaaaggaacuggcacagggcuucuuggcuaaucagaaacgugccgagaaccucaaggaugcuuccgugcugccugacuuaugccugucacacgccaaccagcuaaugauaaugcuccaaaaucaccgcaaacugcuugacaucaagcagaaaugcacgaccgcaaagcaggaguuggccaacaaucugcauguuagacucaagugguguugcuucgugaugcugcacgcugaucaggacggggaaaaacuucaagcgcuguugaggcucgucauugagcuguuagaacgggugaagaucguagaggcacugaguacaguuccacagauguacugucuagccguggucgaggugguccgacgcaaaauguuuauaaagcauuauagagaaugggcuggagcccucgugaaagaugguaagaggcuguacgaggcagaaaagagcaaacgggaguccuucggcaagcuguuucgcaaaucuuucuugagaaacaggcuguuucgugggcucgacagcuggcccccuucauucugcacucagaagccacggaaauuugauugugaacugcccgacauuaguuuaaaggaucugcaguuccuucaauccuuuugcccgagcgagguucagccuuucuugcgagugccccuccugugugacuuugagccacuacaccagcauguacuggcccuccacaaucuggucaaggcugcccagucucuugaugaaaugucacaaaccaucacagacuugcugagugagcagaaagcaagcgugucccagacuucuccucaaucggcgagcucccccagaauggaaucaaccgcuggaaucacaaccacuacgaguccaaggacacccccuccauuaaccguucaggauccgcucugccccgccguguguccucuggaggaacuuucuccagacagcauugaugcacacacuuucgacuuugagaccaucccccauccuaacauugagcagacaauacaccaggucucccuggacuuggauucacucgccgaaagcccagagucugacuucauguccgcugugaaugaguucguaaucgaagaaaaccugaguagccccaauccgauuucugauccucaauccccagagaugaugguggagucacuauauaguagcguuaucaacgccaucgacucgcgccggaugcaggauaccaaugucugcggcaaggaagacuuuggugaucauacuucccugaacgugcagcucgagagauguaggguggucgcacaggacucucacuucagcauucaaacaauaaaagaagaucugugccacuuucgcacguucguucagaaggagcagugcgacuuuucaaauagucuuaaauguaccgcuguggagauccgaaacauuaucgaaaaggugaaaugcuccuuggagauuacucugaaggaaaagcaucagaaagaguuacucucucugaagaaugaauacgaggggaaacuugauggacugaucaaggagacagaagagaacgaaaacaaaauaaagaagcuaaaaggcgagcucguaugucuggaagaggucuugcaaaauaaggacaacgaguucgcccuggugaaacacgaaaaggaggcgguuaucugcuuacagaaugaaaaagaucagaagcuccuggagauggaaaacauuaugcauagccaaaauugugagaucaaggagcuuaaacagucccgggaaauugugcuggaggacuugaagaaacuccacgucgaaaacgacgagaagcugcagcuacugcgugccgagcuucagucacucgaacaaagccaucugaaagaguuggaagauacccuucaggugagacacauccaggaguuugaaaagguuaugacagaccacagggugaguuuagaggagcucaagaaagaaaaucagcaaauaauuaaccagauccaggagucucaugcugaaauuauccaggagaaggaaaaacaacugcaggagcuuaagcugaaaguauccgauuugagcgacacucgcugcaagcucgaggucgaacuggcacuaaaagaggccgaaaccgaugagauaaagauccugcuugaagagucgcgggcucagcagaaggagacgcucaaaucacuguuggaacaagagaccgaaaauuuaagaacagagauuucuaagcugaaccagaaaauccaggacaauaacgagaauuaucaagugggccucgccgaacugaggacucuuaugaccauugagaaggaucaguguaucagugaacugauaucccgacacgaggaagagagcaacauuuugaaagcagagcuaaauaaggugacaucucugcauaaccaggcguucgaaaucgagaagaaccucaaagaacagaucauugagcugcaaagcaaacuugacuccgaauuaucagcccuggagcgccagaaagaugagaagaucacucagcaggaagagaaauacgaagcuauuauacaaaaucucgagaaggaccggcagaaguuggucaguagccaggaacaggauagagagcaacugauccagaaacucaacugcgagaaggacgaagccauucagaccgcacugaaagaguuuaaacuugaaagggagguuguggagaaggaacuguuggagaagguaaagcaccuagaaaaucaaaucgcuaaaucucccgccauugacuccacgcguggggauucaaguagccugguggcagagcuccaggaaaaguuacaggaggagaaagccaaguuccuggaacagcuugaggaacaagagaaacgcaagaacgaagagaugcagaauguccggacaucccugaucgcugagcagcagaccaacuuuaauacugugcucacaagagaaaagaugaggaaagagaacauaaucaaugacuugucugauaagcugaaaucgaccaugcaacagcaggaacgagacaaggaucucauugagagccugucagaagaccgggcgcgccuucuagaggagaaaaagaaacuggaagaggaaguuuccaaguugagaaguucuagcuucgugccuucccccuaugucgccacugcaccagaguuauacggagcuugugccccugagcugcccggugaaucagauaggucugccguggagaccgcugacgaaggccggguugauagcgcaauggagacaaguaugauguccgugcaggaaaacauccauaugcucagcgaggagaagcaacgaauuaugcugcuugaaagaacgcugcagcucaaagaggaagagaauaagcgcuugaaccagaggcugaugucucagucaauguccagugucagcucgcgucacucugaaaagaucgccauacgggacuuucaaguaggggaucuagugcugauuauccucgacgagagacacgauaauuacguucuuuucaccguguccccaacucuguauuucuuacauagcgagucauugccggcgcuggaccucaagccugcuaguggagccucuaggcgccccuggguccugggcaaagugauggaaaaggaguacugccaggcaaagaaagcccagaaccgauuuaagguaccacuugguacaaaauucuauagagugaaggcugucuccuggaauaaaaagguuuga

SEQ ID NO: 61635 - RNA, 2787 nt, Artificial Sequence
  derived and/or modified sequence opt3 from RB1__Homo_sapiens__NP_000312
augcccccuaagaccccaagaaaaacagccgcuacugcagccgcggcugccgcagagccgcccgccccuccacccccuccacccccugaagaggacccagaacaggauagcggcccggaggaccugccccucgugaggcuugaguucgaggagacggaagaaccugauuuuaccgcucugugccaaaaguugaaaaucccagaccacguccgggaacgcgcaugguuaacaugggagaagguuuccucuguggaugggguacugggagguuacauucagaaaaagaaggagcuauggggcauauguaucuucauugccgcuguggaccucgaugaaaugucauuuacuuucaccgagcugcagaaaaacaucgaaauuaguguccauaaguuuuucaaucuucugaaagagaucgacacaagcaccaagguggauaacgccaugucccgauugcucaaaaaguaugacguucuguuugcgcuguucucuaagcucgaacguacuugcgaguuaauauaccugacacagcccucgucaagcaucaguaccgagauuaauuccgcacuuguguugaaagucucuuggaucacguuucugcuagccaagggggaagugcuccaaauggaggaugaccugguaauuagcuuccagcuuaugcuguguguuuuggauuauuuuaucaaacucuccccuccaaugcuguuaaaggaacccuacaaaacugcugugauaccgauuaacggaucaccuagaacccccaggcggggccagaaucgcagugccagaaucgcaaagcagcuggagaacgacacaaggauuaucgaaguccucugcaaagagcacgaguguaauaucgacgaagugaagaacguguauuucaagaauuuuauuccauucaugaacagccuuggucuggucacuucuaauggguugccugagguugaaaaccuauccaaacgguacgaggaaauauaucugaagaauaaagaucucgacgcucgccuguuccuugaucaugacaagacccugcaaacagauucaaucgacagcuuugagacccagcgaacgcccagaaaaaguaacuuggaugaggaagugaauguaauuccaccccacacuccugugaggacagucaugaacaccauccagcagcucaugaugauacugaacucugccuccgaccaaccaagcgagaauuuaauuucguacuucaacaauugcacugugaacccgaaggaaucuauccugaagcggguuaaagauaucggauacauuuuuaaggagaaauucgcgaaggccgugggccagggcugugucgagaucgggucccagcguuauaaacuaggagugcgccucuacuauagaguaauggaaucaaugcugaagagugaggaagagaggcuuagcauucaaaauuuuuccaaguugcugaacgacaauauauuccauaugucucuccuggcaugcgcucuugaaguugugauggccacauacagccggucaaccagucagaaccuggauuccgguacggacuugagcuuucccuggauccucaauguccugaacuuaaaggcuuucgacuuuuauaaagugauugagucuuucaucaaagccgagggcaaucugacccgagaaaugaucaagcaccuagagcgcugugaacacagaauuauggagucacucgcauggcugagugauagcccucuuuuugacuugauaaaacaguccaaggauagggaagggccaacagaccaucuggagucugccugcccccucaaccugccuuuacagaauaaccacacugcugcggauauguaccugucgccaguccggagccccaagaaaaagggauccaccacacgcgugaacucaacugcaaacgccgagacccaagcuacaagugccuuccagacccagaaaccgcuuaagucuacuagcuugucccucuuuuauaaaaagguuuacagacuggcauaccuaaggcugaacacgcucugugaacgucugcuuucagagcauccugaauuggagcacaucauuuggacacuguuccagcacaccuuacaaaaugaauaugagcucaugcgggaccgacaucuggaucagaucaugaugugcagcauguacggcauuugcaaagugaagaacaucgaccuuaaguucaaaauaaucguaacugccuauaaggaucugccacacgcuguccaggagaccuuuaaaagaguguugauuaaggaagaggaauacgacucuaucauuguuuucuauaauuccguguuuaugcagaggcucaaaacaaacauccugcaauacgccaguacccggcccccuacucuaagccccauaccacauauuccucgcucucccuauaaguucccauccucaccgcugagaaucccuggugggaauauuuacaucaguccccucaagagcccauacaaaauaucggagggacugcccacaccuacgaagaugaccccaaggucccgcauccuugucucuauuggcgagagcuuuggcacuucagaaaaauuccagaagaucaaccagaugguguguaauagugaucgaguauugaaacgguccgcagaggggucuaaucccccuaagccgcugaagaaauuacguuuugacauugaaggaagcgaugaggcggacgguuccaagcaccucccaggcgaaucaaaauuccagcaaaagcuggcugagaugacaagcaccagaacaaggaugcagaaacagaagaugaaugacaguauggauacuucuaacaaggaggaaaaauga

SEQ ID NO: 61636 - RNA, 2145 nt, Artificial Sequence
  derived and/or modified sequence opt3 from RBAK__Homo_sapiens__NP_066986
augaacacccugcagggccccgugagcuucaaggacgucgccguugauuuuacacaagaggaauggcagcagcucgacccugaugagaaaaucacuuacagagacgugaugcuugaaaauuauucccaccugguaucugugggguacgauacgaccaagccaaacgucauuauaaaauuggagcagggagaagaaccguggaucauggguggcgaguuccccugccaacauucaccugaggcuuggaggguggacgauuuaauugagcggauccaggaaaaugaggacaagcacagucgccaggcagccuguauuaacagcaaaacacugacugaggaaaaggagaauaccuuuucccagaucuauauggaaacaucucuaguuccaucgucaauaaucgcgcauaacugcgugagcugugggaagaaucucgagaguauuucccaacugaucucuagcgauggauccuacgcucgaaccaaacccgacgaaugcaacgaguguggcaagacuuaucacggugagaaaaugugcgaguucaaucagaacggggauacauacucacauaaugaagaaaacauucuucagaagaucaguauacuggagaaaccuuuugaauauaaugaguguauggaggccuuggacaacgaagcagucuucauugcccacaagcgugcuuacaucggagagaagccauacgaauggaaugauagcggccccgacuuuauucagaugucuaacuucaacgcauaucaaagaucccagauggagaugaaaccuuuugaaugcucagaguguggcaagagcuucugcaaaaagaguaaauuuaucauccaccagagggcccauaccggggagaagccauacgaauguaaugugugcggaaaaucuuucucccaaaaggguacgcucacuguacaccggcgcagccaucuggaggaaaagccguauaaaugcaacgaguguggcaagaccuuuugccagaaacugcaccucacacagcacuuaagaacucauucgggggagaagcccuacgaauguucugagugcggaaaaaccuucugucagaagacacaccugacccuucaucaaaggaaucacuccggcgaacggccuuauccaugcaacgagugugguaagucauucagucgcaaaagcgcuuuguccgaccaucagcgaacgcacacuggggaaaagcuguacaaaugcaaugaguguggaaagucuuauuacagaaaaagcacacuaauuacccaccagaggacucauacaggcgagaagcccuaccagugcucagaauguggcaaguuuuucagucggguuuccuaucucaccauacacuaccguagccaucuggaggaaaaaccuuaugagugcaacgaaugcgggaagacguuuaaucuuaacucugccuucauccgccacagaaaagugcacaccgaggagaagucacaugaauguagugagugcggaaaauuuagccaacuguacuugacagaucaccauacugcgcaccucgaagagaagccauaugaauguaaugagugcgguaagaccuuccuggucaacuccgcauuugacggccaucagcccuuaccgaaaggggagaagucuuacgaauguaaugugugcggaaaacuguucaacgagcucucguauuacacagaacacuacaggagccacuccgaggagaagccuuauggcuguucagaaugcgguaaaacuuuuagucauaauucuagccuuuuccggcaccagcgagugcauaccggggagaagcccuacgaauguuaugagugcggcaaauuuuucucccagaagucauaccugacaauucaccaucgcauccacagcggagaaaagccauaugaguguucuaaaugcggcaaggucuuuuccagaaugaguaacuugaccguucacuacaggagccauucuggggagaaaccuuaugaaugcaaugaguguggaaagguguucucccaaaaaucauaccuaacuguacacuaccggacgcauaguggugaaaagcccuaugagugcaacgaauguggcaagaaauuccaccaccgcagcgccuuuaacucgcaucagagaauacacaggcgugggaauaugaacgugcuggaugucgagaaucucuga

SEQ ID NO: 61637 - RNA, 1503 nt, Artificial Sequence
  derived and/or modified sequence opt3 from RBBP5__Homo_sapiens__NP_001180201
augaaccuggagcuccuugagagcuucggccagaauuaccccgaggaagccgacgggacccuggauugcaucuccauggcuuugacauguacuuuuaacagauggggaacguuacuggcaguggguugcaaugacggcaggauugucauaugggauuuccuaacccgggggaucgccaagauuaucucugcgcacauucauccuguuuguucacucugcuggagucgcgacggacacaaacuggugagcgcuuccacagauaacaucguaucucaaugggacgugcuuucgggcgauugugaccagcgauuucguuucccaucaccgauacugaagguccaguaucaucccagagaucagaauaaaguguugguuugcccuaugaaaagcgccccagugaugcucacucugagugacuccaaacacgucgugcugcccguagaugacgauucugaccucaacguuguggcgagcuuugacaggcggggugaguacaucuauaccgggaaugccaagggaaagauuuuaguccugaaaacagauucccaagaccuuguggcuucauuccgcgugaccacuggcacaaguaacaccacggcaaucaagagcauugaauuugccagaaaaggcucuuguuucuugaucaauacugcugauaggauaauucgggucuacgacgggcgcgagauccugaccugcggacgagauggugagccugaaccaaugcagaagcuacaggaccucguuaacagaacacccuggaaaaaguguugcuuuuccggcgauggggaguauauuguggccggaucagcgaggcagcaugcacuguacaucugggaaaagagcaucggcaaucuuguaaaaauucugcacgguacucggggcgaguugcuccuggacguggccuggcacccuguccguccaauaaucgcuaguauuucuuccggagugguuagcaucugggcccaaaaccagguggagaauuggucggcauucgcuccggauuuuaaggaauuagacgagaacgucgaauaugaggaacgcgagucugaguucgauauagaagacgaggacaaauccgaacccgagcagaccggcgccgaugcggccgaagacgaggagguggauguaacaucaguugacccuauugcagcuuuuuguaguagcgaugaagaacuggaagacuccaaggcccuccuuuaccugccaaucgcucccgagguggaagauccugaggagaauccauacgggcccccgccugacgccguccagaccucuuugauggaugaaggggcaagcucagagaaaaagagacaaaguuccgccgacggaagccagcccccaaagaagaagccuaaaacgacuaacaucgaacuacagggugugcccaacgaugagguccauccacugcucggcgugaagggggacggaaaaucuaagaaaaagcaagcuggcaggcccaaggguucaaaagcagggggcgcaauuagugagcugcuuuga

SEQ ID NO: 61638 - RNA, 5379 nt, Artificial Sequence
  derived and/or modified sequence opt3 from RBBP6__Homo_sapiens__NP_008841
augagcugcgugcacuacaaguucuccucuaaacugaacuaugacaccgucacauuugauggccuccauaucucacuuugugaccugaagaaacagauuauggggagagagaaguugaaagccgcugauugcgacuuacaaauaacuaaugcacagacgaaggaagaguacaccgaugacaacgcccugauccccaagaauaguagcguuauugugaggcggaucccuauuggagguguaaaauccacaucuaagacuuaugugaucucgcgcaccgaaccagcgauggcuacaaccaaagccauagaugacucaagcgcaaguaucucccuagcccagcucacuaagacagcuaaccuggcagaggccaaugcuucugaagaggauaaaauuaaggccaugaugagccaguccggccacgaguacgacccgaucaacuauaugaagaaaccccuugggccuccacccccuucauacaccuguuuccgaugcggaaagccaggccauuauauuaaaaauugucccacgaacggugauaagaauuuugaaagugggccucguaucaaaaagagcacuggaauaccaagaucuuucaugauggaggucaaagacccgaacaugaagggcgcgaugcugaccaauacaggcaaguacgcaauucccacuaucgaugccgaagcuuacgccauugggaaaaaggagaaaccuccauuuuugcccgaggaaccuuccucaagcagugaggaagacgacccaauccccgaugagcuccugugccugaucuguaaggacauuaugaccgaugcagugguuauaccgugcuguggaaacucuuauugcgacgaauguaucaggacagcucucuuagaguccgaugagcacaccugcccuacgugccaucaaaaugacgugagccccgaugcccugauugcgaacaaauuccuucggcaggccgucaauaacuuuaagaacgaaacugguuacacaaagcgcuugagaaaacagcugccaccucccccacccccuaucccaccgcccaggccucuaauacagcggaaucuccaaccacugaugcgcucgcccauuucucgacagcaggacccucuuaugaucccagugaccuccucaaguacucaccccgcaccgagcaucuccucucugacaagcaaccagucaaguuuggcuccuccaguauccggcaaucccagcucugccccugcucccguuccagauauuaccgccacggugucaaucaguguccacagcgagaaguccgacgggccuuucagagauucugacaacaaaauucuccccgcagccgcucuggcgucggaacauagcaagggaaccuccucaauagcaaucacagccuuaauggaggaaaaaggcuaucaagugccagugcuggguacuccgagucuccuugggcagucucuguugcacggacagcuaauuccuaccacaggccccgucaggaucaauacugcucggccaggcgggggacgucccgguugggagcauagcaacaagcugggcuaccucguuuccccuccacaacagauccgcagaggggagaggucauguuaucggagcauuaaucgaggacgccaccacucugaaagaucccagaggacccagggccccagucugccugccacaccgguguuuguaccagugcccccuccaccccuuuacccuccgcccccacauacccugccuuugcccccaggugucccucccccacaauucagcccgcaguuuccucccgggcagccacccccugcaggcuauucugugccacccccuggauucccgccagcccccgcuaaccucuccacuccuuggguuucaaguggcgugcagacggcccacagcaauacaauacccaccacucaagcaccaccucugucgcgggaggaauuuuaccgcgagcagagaagguuaaaggaagaggagaaaaagaaauccaagcuggacgaauucaccaacgauuucgcgaaagagcuaauggaauacaagaagauccagaaagagcgucggcgaucuuuuagcagaucaaagagucccuauuccgggucuagcuacuccaggucaagcuauacauacaguaaaucucgcuccggaagcacccggucgagaucauauucuaggaguuucucccgcagccauucucgaagcuacucccggucaccaccuuauccgcguagagguaggggcaagagucgcaauuaccggagcagaucuaggucccacggguaccaucgaucacgcagucggagccccccauauagaagguaccacucccguucucgcucgccucaggcuuuucggggacaaagccccaacaaaagaaaugucccacagggcgagacugaaagggaguauuucaaccgauaccgggaagugccucccccguaugacaugaaggccuacuauggucgcucaguagauuuuagagacccauucgagaaagaaagguaccgggagugggagcgaaaguacagagaaugguaugagaaguacuauaaaggguacgcagccggcgcucagccucgccccuccgccaauagggaaaacuuuaguccagagcguuuccucccccugaacauucggaauucuccuuuuacaagaggaaggcgcgaagauuauguuggcgggcagagccaccgauccagaaacaucggaucaaauuacccggagaagcuuucugcacgggacggucauaaccaaaaagauaauacgaagagcaaagagaaggaaagugagaacgcucccggcgacgggaagggaaauaaacacaagaaacauaggaagcgccguaaaggcgaagaguccgaagguuucuugaacccagagcugcucgagaccagcagaaagucucgggaaccuacugggguggaggaaaauaagacagauucacuguuuguccuucccuccagggacgaugccaccccugugcgcgacgagccaauggaugcggagaguauuacauucaaaagcgucucggaaaaggacaaacgagagagagacaagcccaaagccaagggcgauaagacuaaacggaagaacgacggaucugcuguguccaaaaaggaaaauaucguuaaaccugcaaagggcccacaggagaaaguggauggggaaagggagcgcagccccagaucagagccgccuauaaagaaggccaaagaagagaccccaaagacggacaacaccaaaaguucuuccagcucacagaaggaugaaaaaaucacaggaacucccaggaaggcucacaguaagagcgccaaagagcaccaagaaaccaagccuguaaaagaggagaaggucaaaaaggacuauuccaaggaugugaaaucugaaaagcugacaacuaaagaggaaaaggcaaaaaagccaaaugagaagaacaaacccuuggacaauaagggcgaaaaacggaagcguaaaaccgaggagaaggguguugauaaggacuuugaaagcuccucaaugaaaauuucuaagcucgaggugacggaaaucgucaaaccgaguccuaagcgcaaaauggagcccgauacagagaagauggaccgaaccccagaaaaagauaagauuucgcugagcgcgccugccaagaaaaucaaguuaaacagagagacugggaaaaagauaggauccacagaaaacauuucuaauaccaaagagcccucagaaaagcuggagagcacuuccaguaaggugaaacaggagaagguaaaaggcaaggugaggcggaaaguuaccgguacagaaggcucuagcucaacgcuagucgacuacaccuccacuaguagcacagggggaucuccagugcgcaaguccgaggaaaagaccgacacaaaaagaacugugaucaagaccauggaggaauacaacaaugauaacacggcucccgccgaggacgucauuaucaugauacagguuccucagucaaaaugggauaaggacgauuucgagagcgaagaggaagacgugaaaucgacacaaccaaucucuagugugggcaagccggcauccguaauuaagaaugucagcaccaaacccucaaacaucgugaaguauccugagaaagaauccgagccaucugagaagauucagaaauucacuaaggauguuagccaugaaaucauacagcacgaggugaaaaguuccaagaauagcgcuucuucagaaaaggggaaaaccaaggacagggauuacaguguccucgagaaagagaaccccgaaaagcggaaaaauuccacacagccugagaaggaaagcaaccuggaccgacuuaaugagcaaggaaacuuuaagucuuugucgcagucaagcaaagaagccagaacuuccgauaagcaugacaguacccgcgcaucuagcaauaaagacuucacaccaaacagggauaagaaaacggacuaugauacccgggaguacuccucaaguaagcguagagacgagaagaaugaacugacuaggcgcaaagauucucccagccggaacaaggacuccgccucaggccagaaaaacaagccucgagaggaaagagaucucccgaaaaaggguacaggggacagcaagaaaucuaauuccaguccaagcagggaucgcaagccccacgaccauaaagcuaccuaugauacuaagcggccuaacgaggaaacaaaaucgguggacaagaaucccugcaaagauagagagaagcacguucuggaggcgcguaacaauaaggaauccucuggaaacaaauuacuguacauucuuaauccaccugagacccagguggaaaaggagcaaaucacgggccagaucgacaaaucaacuguaaagcccaaaccacaguugagccacaguuccaggcucucuagcgaccugacccgggaaacagaugaggccgcauuugagccggacuauaacgaaucagauuccgagaguaaugucagcgugaaggaagaggagucuucagguaacauuuccaaggaccuaaaagauaagaucguggaaaaagcuaaggagagccuggacaccgccgccgucguucaagugggcauuucucgcaaucagagucauucguccccuagcguaucacccucucgaagccacuccccaagugggucacagacuagaucucauagcuccagugcuagcuccgcagaaucucaggauucaaaaaagaagaaaaagaaaaaggagaaaaagaagcacaaaaagcauaaaaagcacaaaaagcacaagaaacaugccggaacagaaguggagcucgagaagagccaaaaacacaagcauaaaaagaaaaagucgaagaaaaacaaggacaaagaaaaggagaaagaaaaggaugaccagaaggucaaauccgugaccguuuga

SEQ ID NO: 61639 - RNA, 1410 nt, Artificial Sequence
  derived and/or modified sequence opt3 from RBBP7__Homo_sapiens__NP_001185648
auggccgcugaggcaggcguggucggggccggagcgagccccgacggugauuggagagaccaggcuugcggccugcuccuucacguucaucuguccucuagguuggggcgggccgcaccugugcgcaccggacgacacuuacguacaguauucgaagauacuguggaggaaagagucaucaacgaggaauacaagauuuggaaaaagaauacgccauuucuguaugaccuagugaugacccaugcccuccaauggccgucacugacaguucaguggcuucccgaggugacuaaaccugagggcaaggauuacgcucugcacugguugguccucgguacccauacaagugacgaacagaaccaccuggugguagcaaggguucacauaccaaaugaugacgcccaguucgaugcuagccauugugacuccgauaaaggggaguuuggaggcuucggcucugugaccgggaagaucgaaugcgagauuaagaucaaccacgagggagaagucaaucgggcccgcuauaugccccaaaacccucauauuaucgcgacuaaaacaccaucgucagacgugcugguguuugauuacaccaagcaccccgcaaaaccugacccaagcggugaguguaauccggaccucagauuaaggggccaccagaaggaaggguauggacugaguuggaacuccaaucuuucuggccauuugcugagcgccuccgaugaccacacggucugccuaugggauauaaacgcuggucccaaagaggggaagaucguugacgccaaggcaauuuucacuggacauucagcugugguagaagauguggccuggcaccuccugcaugagagucuuuuuggcagcgucgcggacgaucagaaacugaugaucugggacacccggucuaauacaacuuccaagccuucacacuugguggaugcccacaccgcagagguuaacugucucagcuucaauccauacagugaauuuauucuggcuacaggcucugccgacaaaaccguggcuuuaugggaucugcgcaaccucaaacuuaagcugcauacguucgagucccacaaggacgaaaucuuucagguccauuggagcccccacaaugagacuauauuggccucgucugggacagaccgaagacuaaacgugugggaucuguccaaaauuggagaggaacaaucagcagaggacgccgaagaugguccuccagagcuccuguucauccacggcgggcauaccgcuaagauuagugacuuuagcuggaaccccaaugaaccguggguaaucugcuccguuucugaggauaacaucaugcagauuuggcagauggcggaaaauauauauaacgacgaggagagcgaugugacuacaucagaacuugagggacagggcaguuga

SEQ ID NO: 61640 - RNA, 2604 nt, Artificial Sequence
  derived and/or modified sequence opt3 from RBBP8__Homo_sapiens__NP_976037
augaacaucagcggcuccucuugcgggucacccaauagugccgacaccagcuccgauuucaaggaccuguggacaaaacucaaggagugucacgauagagaagugcagggacuucaagucaaaguuacuaagcugaaacaggagaggauuuuggacgcucagcgguuagaagaguuuuucacgaagaaccagcaacugcgcgaacagcagaaggugcuacaugagaccauaaaaguacucgaggaucgacugcgugcaggucuuugcgacagaugugccgugacagaagaacacaugaggaagaaacagcaagaauuugagaauauccggcagcagaaccugaaguugauuacugagcucaugaaugaacgcaacacccugcaggaggaaaauaaaaagcugucugagcaacuccagcagaagaucgaaaacgaucaacagcaucaggcggcugaguuagagugcgaagaggacgucauuccugauucgccaaucacagccuucucauuuagcggcgugaauagacugaggcggaaagaaaacccgcacguucgcuacauagagcagacccauacuaaacuugaacacagugugugugcaaaugagaugcgaaaggucuccaagucuagcacacacccccaacauaacccuaaugagaacgaaaucuugguggccgacaccuaugaucagucccagucaccaauggcuaaagcacacgggacgaguagcuacacucccgacaagucuuccuucaaucuggccaccguaguugcugagacacuaggacucggcgugcaggaagagucagaaacucaagguccuaugagcccacugggggaugagcuuuaucauugccuggagggaaaccacaaaaagcagcccuuugaagagaguaccagaaacacagaagacucuuugagguucuccgacagcaccucgaagacgccuccacaggaggagcucccgacucgggucucuucccccguguuuggcgccacaucaaguauuaaaagcggccuggauuuaaauaccucccugucuccuagccuccuucagccagggaagaaaaagcaccugaaaacuuugcccuucucaaacacauguaucagucgucuagaaaagacccgcuccaagagcgaggacucugcgcuguuuacgcaucacucacucggaagugaagugaauaaaauuaucauacaaagcuccaacaagcagauucugaucaauaaaaacauuucugagucgcuuggugaacagaauagaaccgaguacggcaaggauagcaacacagacaaacaucuggagccuuugaagucccucgggggaaggacuucaaagcggaaaaagaccgaagaggaaagugagcacgaagucucuugcccacaggcaucuuucgauaaagagaaugccuuucccuucccgauggacaaccaauucuccaugaauggcgauuguguuauggacaagccucuggauuuaucagaccgauuuagcgcuauccagcgccaggagaaaucucaagguuccgaaacaaguaagaacaaguucagacaggugacucuguaugaggcccuaaaaaccauccccaagggguuuagcagcuccaggaaagcaucagauggaaauugcacacucccaaaggacaguccuggcgaacccuguagccaggagugcauuauacugcagccacuuaacaaaugcucgcccgacaauaagccuuccuugcaaaucaaagaagagaacgcuguauucaagauuccacugcggccgcgcgagucucucgaaaccgagaacgugcuggaugacaucaagagcgccggcucacaugaacccauaaaaauucagacuagaagugaucacgggggaugugagcuugcguccguccugcaguugaauccuugcaggacggguaagaucaaaucucuccagaacaaucaagacgugagcuuugagaacauccagugguccauugauccaggcgccgaccugucacaguacaagauggauguuacagugaucgacaccaaagaugggagccagaguaaguuaggaggcgaaacugucgacauggauuguacccuggugucugagacaguacuacucaagaugaaaaagcaagaacagaaaggugagaaguccagcaaugaggagcguaaaaugaacgacucgcuggaggauauguucgaccggaccacucacgaagaguaugaaucaugccuugcagacucuuuuagucaggcugccgaugaggaagaggaguuguccacagcuacgaagaagcugcauacccacggggacaaacaagauaagguuaaacagaaggccuucguggaacccuacuuuaaaggcgacgagagcauuaugcagauaugucagcaaaagaaggaaaaacgaaauuggcucccugcacaggauacugacucugccacauuccauccaacccaccagagaaucuuuggaaagcuggucuucuuaccccugaggcuuguguggaaagaggucauuuugcgcaagauccucauccuggugcuaguucagaaagaugugagccugacaacucaauacuuucuccagaaggcucgguccagaaggcaccgccgauga

SEQ ID NO: 61641 - RNA, 561 nt, Artificial Sequence
  derived and/or modified sequence opt3 from RBBP9__Homo_sapiens__NP_006597
auggccagccccuccaaggcugugaucgucccuggcaacgggggaggugacguuaccacacacggcugguacgggugggugaaaaaggagcuggagaaaauuccaggauuccagugccucgcaaagaauaugccggaucccauaacugccagagaaucuaucuggcuuccuuuuauggaaacggagcugcauugugacgagaaaaccauuaucauuggccacucaaguggugcgaucgcugccaugagguaugcagaaacacaucggguauacgccauaguguuggucagcgcuuauacuuccgauuuaggggacgagaacgaacgcgcaucuggauacuucacccgaccauggcaaugggagaagaucaaggccaauugccccuauauugugcaguuuggcucgacagaugacccuuuccugccauggaaagaacagcaggagguugcugaucgucuagagaccaagcuccacaaauuuacugacuguggccauuuccaaaacacagaauuucacgagcugaucaccguggucaagucacuucugaaagugcccgccuga

SEQ ID NO: 61642 - RNA, 1407 nt, Artificial Sequence
  derived and/or modified sequence opt3 from RBCK1__Homo_sapiens__NP_006453
augggcaccgccacacccgacgggagagaggaucaggaaaggcugugggugagcgucgaggacgcucaaaugcacacuguuacgaucuggcucaccgugcggccugauaugacaguagcaucccuuaaggacaugguguuccuggauuacggauuuccaccggucuugcagcagugggugauuggucagcgcuuagcccgagaccaagaaacucugcauucucacggcguucgucagaacggggauucagcguaucuauaccuccugagugcuagaaauaccagccuuaacccccaggagcugcagagggaacggcaauugcgcaugcucgaggaccugggauucaaagaucugacacuccagccuagaggcccauuagagcccgguccuccaaagcccggggugccucaggaaccaggaaggggccagccggacgccguccccgagccuccacccgugggcuggcaaugcccuggguguaccuuuauaaauaaaccaacucggcccggaugcgaaauguguugccgcgcacgaccggaggccuaucagguaccugcuuccuaccagcccgaugaggaagagagagcaaggcuggccggugaagaggaagcccuucggcaauaucagcagcguaagcagcaacagcaggagggcaacuacuugcagcauguucaacuggaccagcgcucucuagugcucaauacagagccagcugaauguccugucugcuauucggugcuggcgcccggggaggcagugguccuuagagaaugucugcacaccuucugcagggaguguuugcagggaacgauccggaacucacaggaagccgagguuagcugcccauuuauugauaauacuuacaguuguuccggcaaacuccuggagcgagaaaucaaggcuuuacugacccccgaggacuaccaacgcuuccucgaccuugguauuucuaucgccgaaaacagaagcgcauuuuccuaucauugcaagacaccugauugcaaagggugguguuucuuugaggacgaugugaaugaguucacuugcccaguauguuuucacgugaacugccuguuguguaaggcuauacacgaacagaugaauugcaaagaguaccaggaagaccuagcccugagggcgcagaacgaugucgccgcacggcaaaccacagagaugcucaaggugaugcugcagcagggagaagcuaugcgcuguccgcaaugccagaucguugugcagaaaaaggacggcugugauuggauuagaugcaccgucugucauacggagaucugcugggugacuaagggccccaggugggggccuggagguccaggcgacacaucagggggaugccguugucggguaaauggcauucccugccacccuaguugucagaacugccauuga

SEQ ID NO: 61643 - RNA, 1113 nt, Artificial Sequence
  derived and/or modified sequence opt3 from RBFOX1__Homo_sapiens__NP_001135805
augaacugcgagagagaacagcugaggggcaaucaagaggccgcugcagcccccgacaccauggcgcagccuuacgcuagcgcccaguucgcaccaccgcagaacgggauccccgccgaauauacagcuccucacccacaucccgcaccugaguacacuggacaaacgaccgugccagaacacacacucaaucuuuaucccccugcccagacucauuccgagcagucuccagcugauaccucagcccagacagucagugguaccgcgacucaaacagacgaugcagccccgaccgacggccagccccagacgcagccuagcgagaacacugaaaauaagucccaaccaaaacggcugcacguuucuaacauucccuuucgcuuccgagauccugacuugcgucagauguuugggcaguucggaaagauauuagauguggagaucauuuuuaaugaaagaggcucgaaagguuucggguuuguaaccuucgagaacucagcugacgccgauagggcacgggagaagcugcauggaacaguggucgaaggccgcaaaaucgaggugaauaacgcuacugccagaguuaugaccaauaagaagacagugaacccauacaccaauggcuggaaacuaaaccccgucgugggggcgguauauagcccggaauuuuacgccguuccuggauuccccuauccagcagcuacggccgcugccgcauacaggggugcccaccuccggggccgcgggcgaacuguguacaauacauuuagagcugcggcaccucccccacccauuccugccuauggaggcgucguguaccaagacgguuucuauggggcugauaucuacggaggcuaugccgcauacagguaugcccagccaaccccggcuacugccgcagcguacagugacuccuacggccggguguaugcugccgaucccuaccaccaugcacuggccccugcuccaacauauggggucggagccaugaacgcauuugcuccccuuaccgacgccaagacgcguucucacgcggacgauguuggucugguguugagcucccuccaggccucaauauaccgcggcggguauaacagauucgcuccuuacuga

SEQ ID NO: 61644 - RNA, 1143 nt, Artificial Sequence
  derived and/or modified sequence opt3 from RBFOX2__Homo_sapiens__NP_001026865
auggagaagaaaaagauggugacccagggcaaccaagaacccacaacuacgccugacgccaugguccagccauucaccacaaucccguuucccccuccaccccagaaugggauuccuacugaguacggaguuccacacacccaggauuaugcuggucaaacaggcgaacauaaccugacccucuacgggagcacucaggcacacggagagcaguccucuaauucacccaguacacagaacggcagccuuaccacggaagguggggcccaaacugacggacagcagucccagacccaaucuucggaaaauucagagagcaaaaguacaccuaagagacugcauguguccaacauaccauucagguuucgggauccggacuugcgccagauguucggccaguuuggcaaaaucuuagauguagagauuaucuucaaugagcgagggucuaagggauuugguuucgugacuuuugaaaacagcgcggacgcugaucgugccagagagaagcugcacggcaccgucguggaggggaggaaaauugaaguuaauaacgcaacagcccgggugaugaccaauaagaaaauggucacgcccuaugcuaacggauggaagcuauccccugugguaggcgcaguuuacgguccagagcucuaugccgcuucaaguuuccaagccgacgugagccuggggaaugaugcggcagucccccuuucuggacgcggcggcaucaacacuuacauaccucugaucuccuugccacucgugcccggguuuccguauccuacagccgcuaccacugccgcagcuuucagaggagcccaucugaggggucggggccgcacaguguacggggcgguccgagccguucccccaaccgcaauuccugcuuaccccggagugguauaucaggacggcuuuuacggugccgaucuguaugggggcuacgcugccuauagauacgcacagccagccacggcuaccgcggcaacagccgcugccgcagccgcugccgcauauucagacggauacggcaggguguacacugcggaucccuaucacgcucucgccccugcagccagcuacggggucggagcuguggccaguuuauaucgggguggcuacucucguuucgcaccauauuga

SEQ ID NO: 61645 - RNA, 939 nt, Artificial Sequence
  derived and/or modified sequence opt3 from RBFOX3__Homo_sapiens__NP_001076044
auggcccagcccuacccuccagcucaauauccgcccccuccacagaacggcauccccgcagaguacgccccuccacccccucacccaacccaggacuauagcgggcagacaccggugcccacugaacauggaaugacgcuguacaccccugcgcaaacacacccagagcagcccgguuccgaggcuucuacucagccuauugccggcacccagacagucccacaaaccgaugaagcagcccagacugacucacagccccuccauccgagugauccuacagaaaagcagcaacccaaaagacuucacguuagcaauauaccauucagguuucgggacccugaucugcgccagauguucgggcaguuuggaaagaucuuggacguggagauuaucuucaacgagcgaggcuccaaagguuuuggguucguaaccuuugaaacgucuucggaugcugaccgugcaagagagaaguuaaauggaacuauuguggaaggcaggaaaaucgaggucaacaaugccaccgcucgggugaugacaaacaagaagacuggcaaucccuauaccaacggguggaaacugaauccaguugugggagccgucuacggucccgaguucuaugcggugacaggcuuuccuuacccaaccacggggacugcaguagccuaccgcggagcucaucuaagaggcaggggucgggccguuuauaacacauuccgcgcagcuccgcccccuccacccauaccuaccuacggggccguggucuaucaagauggauuuuacggcgcggaaaucuauggcggguacgccgcauaucgauacgcucagccagccgcugccgcagccgcuuacucagacagcuauggaagaguguacgcggcagccgaucccuaucaccacacuauugguccggcugccacauacaguaucggcaccauguga

SEQ ID NO: 61646 - RNA, 3207 nt, Artificial Sequence
  derived and/or modified sequence opt3 from RBL1__Homo_sapiens__NP_002886
auguucgaggacaagccccacgccgaaggcgcugcaguggucgccgcggcuggggaggcccugcaggcacucugccaagaacuuaaccuggaugagggaagcgccgcugaagcauuggacgauuuuaccgccaucagagguaauuacuccuuagagggcgagguuacacauuggcuggcuuguucucuauauguggccugcaggaaaucaauuauaccuacuguagggaagggaaucauggaaggcaacugugugagucucacgcggauucugcgcagcgcgaaacuuucccugauccaguucuuuucuaagaugaaaaaguggauggacaugucgaauuugccacaggaguuccgagaacguauugagagacucgagaggaacuuugaagucucaaccgugaucuucaagaaauacgagccgauauuucuggauaucuuccagaaucccuaugaagaaccuccaaagcugccccggagccgcaaacaaagaaggauuccuugcaguguuaaggaccucuuuaacuucuguuggacauuauuuguguacacuaaagguaauuuccggaugaucggggaugaccuggucaacuccuaucaccuuuugcugugcugucuagaucucauuuuugcaaaugccaucaugugcccaaaccgccaggaccugcuuaaucccucuuucaagggacugccuagcgauuuccauaccgcugacuuuacagccuccgaggagccaccguguauaauugcaguguugugcgagcuccacgauggccuguuaguagaagcuaagggcaucaaagagcauuacuucaagcccuauauuucaaaacuguuugaccgaaagauccucaaaggggaaugucuucuggacuugaguagcuucaccgauaacucuaaggccguuaauaaagaguacgaagaguacgugcuaacugucggagacuuugaugagagaaucuuccugggugcggacgccgaagaggaaauuggcacaccuaggaaguuuacccgggauacgccacucgggaagcugacugcacaggcuaacguggaguauaaucuucagcaacacuucgaaaagaagcguuccuuugcccccucaaccccucugacaggacgcagauacuugagggagaaagaggcugugauaacuccagucgccagcgcaacccagaguguuucucggcuccaguccaucguggccggccugaagaacgcucccagcgaccaguuaauuaacaucuucgaaucgugcguacgaaauccgguggagaacauaaugaaaauucugaaggguaucggggaaacauuuugccaacacuauacccagucuacggaugagcagccuggaucccauaucgacuucgcggucaaucgccuaaagcucgcagagauucuguacuauaaaauccuugaaacugugaugguucaagagacaagaagguugcacggcauggauaugucagugcugcucgaacaggacauuuuucaucggagucugauggccuguugccuugagauaguccuguucgcuuacagcucuccccgcaccuucccauggaucauugaaguguugaaccuccagccuuuuuauuucuacaagguaaucgagguugugaucagauccgaggaaggccugagcagggauauggucaaacacuuaaauucaauugaggaacagauacuggagagucuagccuggucccacgacagcgcacucugggaagcccugcaagugucugcuaacaagguccccacuugugaggaggugaucuuuccaaauaacuucgaaacagggaauggagguaacguucagggccaucuucccuugaugccuaugucaccacugaugcacccgcgugugaaagagguacggaccgacagugggagccuccgaagagauaugcagccccuguccccuauuucuguccaugaaagguacucgagcccaacggccggauccgcaaagcgccgguuauuuggcgaggaucccccuaaggaaaugcugauggacaaaaucauuaccgaggguacaaaacuuaaaaucgcgccaucaaguucuauaacugcugagaaugugagcaucuugcccgggcagacccuccugacaauggccacugcaccgguuaccggcacaaccggacacaaggugacuauuccucuacauggcgucgccaacgacgcuggggaaaucacgcugauuccacucuccaugaauacaaaccaagagucaaaaguaaagagccccgugucucugaccgcccacucccuuaucggagcaaguccuaagcagacuaauuugaccaaagcucaggaagugcacagcacagguauaaacagacccaagaggaccggcucucuggccuuauucuaucgcaaaguuuaccaucucgcguccguccgacugcgggaucuuugccugaaguuggacgugucaaacgagcuccguagaaaaauuuggacuuguuuugaguucacacuggugcacugcccagaucuaaugaaggacaggcaucuggaucagcuccugcuuugugccuuuuauaucauggcuaaagucacgaaggaggaacgcaccuuccaagaaauuaugaagaguuaccggaaucagccucaggcaaacagccacguuuauagaucgguguugcugaaauccauccccagggaggugguagccuacaauaagaacauaaaugacgauuuugaaaugaucgacugcgauuuagaggacgcuacuaaaacaccagacuguucuagcgggccggucaaggaggaacgaggagaucucauuaaauucuauaacaccaucuacgugggccgcguuaagucauuugcccugaaguacgaccuugcaaaucaggaucacaugauggacgcgccuccccugaguccauucccccauauuaaacaacagccugguuccccacggagaaucucucagcaacacagcauauauauuucaccccauaagaacggguccggccuaacaccuaggagcgcccuccuguacaaauucaauggaaguccgucuaaguccuugaaagauaucaacaauaugauccgucagggcgagcagcgcacuaagaagcgggugauugcuaucgacagcgaugccgaaucgccagcaaaaagagucugccaggagaacgacgaugugcuguuaaagaggcuccaagacguugugucagaacgagcuaaucacuga

SEQ ID NO: 61647 - RNA, 3198 nt, Artificial Sequence
  derived and/or modified sequence opt3 from RBL2__Homo_sapiens__XP_005256140
augcagagccugaccaagggcaacgaccuccacuggcuugccugcgcucuguacguggcauguagaaaauccguccccacaguuucuaaggggacuguggagggaaauuauguaucauugacgaggaucuuaaaaugcagugaacaaagccugauugaguucuuuaacaagaugaaaaagugggaagauauggccaaucuaccuccacauuuccgggagcgcaccgaacgacucgagcguaacuuuacaguguccgcggucauauucaagaaauacgagccgaucuuucaggacauuuucaaguauccccaggaggaacagccuagacaacagaggggucggaaacagcgcagacagccauguacugugucugaaaucuuucacuucugcuggguucuguuuauuuacgcuaagggcaauuuccccaugaucucggaugaccuugugaacucauaucaucuguugcucugugcccuggaucuggucuacgggaaugcacuccaaugcagcaacaggaaagaguuagugaauccuaacuuuaagggacugagugaggacuuccacgccaaggauuccaaaccaucuagcgacccuccuuguauaaucgaaaaacuuugcuccuugcaugauggccugguacuagaggcuaaggguauuaaggaacacuuuuggaaaccauauauccggaagcucuacgagaaaaagcugcuuaaggggaaagaagagaaucugaccggauucuuggagccgggcaacuucggcgaaucauuuaaggcaauuaauaaagccuacgaggaauauguucucaguguggggaaccuggacgagcgcaucuucuuaggagaagaugcugaggaggaaauagguacacugagccgaugucucaaugccggcucugggaccgagacugcggaaagaguccagaugaagaacauucuucagcagcacuuugacaaauccaaggcacugaggaucucaacacccuugaccggagugcgguacauuaaggagaacagcccuugcgugacgccagucaguacugccacccauucucuaucccgucugcacacaaugcucacuggccugcgcaaugcucccagcgaaaaacuugagcaaauccugagaaccuguucgagggauccuacacaggccaucgcaaaccgguugaaggagauguucgaaauuuauucucagcauuuucaaccagacgaggacuucuccaauugcgcuaaagaaauagccucaaagcacuuucgauucgcggagaugcucuacuauaaaguucuggagagugugaucgaacaggagcagaagcgcuuaggugauauggaccugagcgggauucuagaacaggaugccuuucacagaucccuccuggcaugcugucuugagguagugaccuucucuuacaagcccccgggaaacuuuccuuucaucacggaaauauuugacguccccuuguaucauuucuacaaagugauugagguuuucaucagggcugaggauggccugugccgggaaguggucaagcaccucaaucaaaucgaggaacagauucuggaccaucuugccuggaaaccagagagcccucugugggaaaagauccgcgauaacgagaauagagugcccacuugugaggaaguaaugccaccccagaacuuggagagggcugacgaaauuugcauagccggcucaccucucacaccacgucggguuaccgaggugcgagcagauacugggggacuggguagaaguaucacauccccgaccacguuauacgacagguauagcucucccccugccucaaccacacgccggagacuguuugucgaaaaugauaguccaagcgacggcgggacucccggaaggaugccuccacagccccuagugaacgcugucccggugcaaaauguuuccggcgagaccgugucuguaacaccugucccaggucagacucucgugaccauggcgacagcaaccguuacugccaacaaugggcagacggugacaauucccguccagggcaucgcuaacgagaauggaggcaucaccuucuuuccugugcaaguaaacguugggggacaggcccaggcagugacugguucgauucagccccugagcgcccaagcucuugccggcuccuugucaagucagcaggucaccgggacaacccugcaagugccaggacagguggcaauacagcagaucucuccuggcggucaacagcagaaacaggggcaaagcgucacuuccucaagcaaccgcccccgaaagacaucuucccucagucuguucuuucggaagguuuaccacuuagcggcugugcgucugagagaccuuugugccaaauuggauauuagcgacgaacucaggaagaaaaucuggacgugcuucgaguuuucuauuauccaguguccagaacugaugauggaucgccaucuagaccagcugcucaugugcgcaauauaugugauggccaagguaaccaaagaggauaaguccuuccagaauaucaugcgguguuacagaacucaaccgcaggcuaggucacaggucuaucgaagugugcugauuaaaggcaagcgcaagcggagaaacagcggaucguccgacucuaggagccaccaaaauucaccuacagagcuuaacaaagaucguaccagucgcgacuccucucccguuaugcggagcuccucaacauugccagugccccagccuagcagugccccacccacuccuaccagacugacgggcgcaaauucugauauggaagaggaagagaggggagacuuaauccaguuuuacaacaauauuuauaucaagcagauaaaaaccuucgcuaugaaguacucccaagccaacauggaugcgccgccacucagccccuacccuuuuguccgaacagggucgccacggcgcauucagcugucacagaaucaccccguguauaucucuccucauaaaaacgaaacuaugcuuaguccgagagagaagauuuucuacuauuuuuccaauagccccucuaagaggcugcgggagaucaacagcaugauacgaaccggugaaacaccaacuaaaaagagaggcaucuugcucgaggacggguccgaaucacccgccaaacgcauuugccccgagaaucacagugcucugcuaaggcgucugcaggauguugcaaacgaccggggaagccauuga

SEQ ID NO: 61648 - RNA, 2988 nt, Artificial Sequence
  derived and/or modified sequence opt3 from RBM10__Homo_sapiens__NP_001191397
augagcggcucccccucucugaccgccagagcugagaaggugucagucgacgcagggaggggagguggcgaaagucuccaggaggccagcccucggcuugcggaucacggguccucuucgggaggcgguugggaaguuaaacgcucacaacgacugcguagagggccaagcaguccgaggcggcccuaccaggacauggaguaugaacgcagaggaggcaggggcgaucggacagggcgcuacggagcuacugaccgaucccaggaugacgguggcgagaacagaucuagggaucaugacuaucgggauauggacuaccguagcuauccucgcgaguacgggucccaggaaggaaagcacgauuaugacgauucaagugaggaacaaagcgccgaggacucuuacgaggcauccccaggcucagaaacgcagagaaggcggcgacgcagacauaggcacagccccaccgguccuccaggguucccccgggacggagauuaccgcgaccaggauuauagaacagagcagggcgaagaggaagaggaggaagaggacgaagaggaagaggagaaagccaguaauaucgugauguugaggauguuaccucaagcugcaacugaagaugacauucguggccagcugcagucucaugggguacaggcccgggaggugcgacuaaugagaaacaaguccagcggacaaucgagggguuuugcuuucgucgaauuuucucaccuccaggaugccacccgcuggauggaggcgaaucagcacucccugaacauacuuggccaaaaagugucaaugcauuacagugacccaaagccgaagaucaaugaagauuggcugugcaacaaaugugggguucagaauuucaagcggagagagaaaugcuuuaaguguggagugcccaaaagcgaggcagaacagaaguugccucucggcacaaggcuggaccagcaaacccugccacucggugggcgcgaguuaucccagggccugcuucccuugccucagccauaucaggcccaaggaguccuggcuucucaggcccuaagccagggcucagaacccaguuccgagaacgcaaaugauacuauuauccuccgaaaccugaauccgcacagcacaauggacucuauucuuggggcucuggccccuuacgcgguguugucaaguagcaacguacggguuaucaaggacaaacagacccaacucaaucguggauucgccuuuauacagcuguccacgaucguggaggcagcucaguuacugcagauucuccaagcccuucaucccccacugacuaucgaugguaagaccauuaacgucgaguucgcuaaaggcucuaagagagacauggccucgaaugaagggagcaggaucuccgcagccucaguggcuaguacagcgauagcagccgcucagugggccauuucucaggcaagccaaggaggcgaagguacuugggccaccuccgaggaaccucccguggauuauucauacuaucagcaggacgagggguacggcaacagccagggaacagagucuuccuuguacgcucacggcuaucuaaaagggaccaagggaccagguaucacgggcacuaaaggggaucccacaggagccggcccugaagcaagucuggagccaggugcggacagcgucucuaugcaggcuuuuucccgcgcccaaccgggggcagcccccggcauuuaccagcagucagcugaagccaguagcucgcaaggaaccgcagcuaacucccagucuuauacuaucaugagcccugccguucucaagucagagcugcagaguccaacacaccccuccucugcgcuuccuccagccaccagccccacggcucaggaauccuacucacaauauccggugccugauguaagcaccuaccaguaugacgagacaaguggcuacuacuaugauccacagacugggcuguacuaugaccccaauucucaauacuauuacaacgcacagucccagcaguauuuguacugggauggagagcggagaaccuacgugccugcccucgaacaaagcgcugacggccauaaggagacaggugcccccucgaaagaagggaaggagaaaaaggaaaaacacaagacuaagaccgcacagcagaucgcgaaagauauggagaggugggcccgaucacugaauaagcagaaagagaacuucaaaaauucuuuucaaccaauuaguuccuuacgcgacgacgaacggagagagagcgcuacagccgaugcaggauaugcuauacuggaaaagaagggcgcccuagcagagaggcagcauaccucuauggaccucccuaagcuggccagcgaugaccgucccuccccaccgcgcggucuugucgcugcguacucaggcgagagugauagcgaagaggaacaggagagagggggaccugaacgggaggagaaauugacugacuggcagaagcuggccugccuccuguguaggcgacaauuccccucuaaagaagcacuuauccggcaccagcagcuguccggcuugcauaagcagaaccucgagauucaccgcagagcucaccugucagaaaaugaguuagaagcccuggagaaaaacgauauggagcaaaugaaguauagggaccgggccgcugaacgaagagagaaguacgggaucccagaacccccugagccaaaacgcaggaaguauggaggcauaaguacggcaagcguggauuuugaacagcccacacgugacggucuaggguccgauaauauuggaucucggaugcuccaggccaugggcuggaaagaggguucgggccuggggagaaagaaacaaggaaucguuaccccuaucgaggcgcagacuagggugcgcggcagcgggcuuggagcucgaggcucauccuacggugucaccaguacagaaucuuauaaggagaccuugcauaaaacuauggugacaagauucaacgaagcccaguga

SEQ ID NO: 61649 - RNA, 2799 nt, Artificial Sequence
  derived and/or modified sequence opt3 from RBM12__Homo_sapiens__NP_001185769
auggccguggucaucagacugcagggccuccccauuguugcugggaccauggacauaaggcacuucuuuagcggacuuacaaucccugaugguggcgugcauauuguagggggagagcugggcgaagcauucaucguguuugccacugacgaggaugcgcgguuggguaugaugcgcacgggcggaaccauuaagggcuccaaagucacauuacugcuaucuucaaagacugaaaugcaaaacaugaucgagcucagucgacguagauucgaaaccgcuaaucuggacauaccaccggccaacgcaagcagguccgggcccccuccaucuucggggaugucaagccgggugaaucuucccacaaccguuaguaacuuuaauaacccuuccccaucuguggucacugccacaaccagcgugcacgaguccaauaaaaacauccagacguucucaacugcuaguguaggaaccgcacccccuaauaugggugccagcuuuggcucuccaacauucuccucaacuguuccgagcaccgcuagucccaugaacacagugccuccacccccuauuccacccaucccggccaugccuucucugcccccaaugccuuccauucccccaauccccgucccuccaccggugcccaccuugccuccagugcccccugucccacccauaccgccuguuccaagcgugcccccuaugacgccccucccaccuaugucggggaugcccccacugaauccgccucccguagcgccacugcccgcaggaaugaacggcucuggugccccuaugaaucucaacaauaacuuaaacccaauguuucuggggccccuuaauccugugaacccgauucagaugaauagccagucaagugucaagccauugcccaucaacccugaugaccuguacgugagcguucauggaaugccauucuccgcuauggagaaugaugugcgcgacuuuuuccacggccuaagagucgaugccgugcaucuccugaaagaccacguaggcaggaacaaugggaacggacuuguuaaguuucugucuccccaagauacuuucgaagcauugaagcggaaucgcaugcucaugauucagcgauauguggaggucagcccugcuacagaaagacaguggguggccgcggguggccacaucaccuucaaacagaacauggggccgucaggacaaacucaucccccaccucagacacugcccaggaguaaguccccaagcggccagaaacggucucguucacgcaguccucacgaggccgguuuuugcgucuacuuaaaggggcugcccuucgaggcagaaaauaaacaugugaucgacuuuuucaagaagcucgauauuguugaggacagcauauauaucgcuuacggcccaaacggaaaagccaccggcgaaggguuuguggaguucagaaaugaagcugacuauaaggccgcacuuuguaggcacaaacaguacaugggaaaccgguuuauucaaguacacccgaucacgaagaaagguaugcuggagaagauagauaugauucgaaaacgcuugcagaauuucuccuaugaccagagagagaugauccuaaacccugaaggcgaugucaacucugccaaggugugcgcucauaucaccaauauucccuuuucgaucacaaagauggacguucugcaauuccucgaggggauuccaguggaugaaaacgcgguccacgugcugguagacaauaacggacagggccuuggucaggcacuggugcaguuuaaaaaugaggaugacgccaggaaguccgaacgguugcaucgcaaaaagcucaacgggagagaggcuuucguucacgucgugacucuggaggauaugagggaaauagagaaaaaucccccugcccaaggcaagaagggauuaaaaaugccagugcccggcaacccugcagucccggggaugccaaaugccggacugcccgguguuggccuaccuuccgcugggcuccccggagccggccugccaucaaccggucuuccugggagugcaaucacaucugcgggcuugcccggagcuggcaugccaagcgccgggauuccuuccgcaggaggcgaggaacaugccuuucugacuguggguucaaaggaagcuaacaaugggccgcccuucaacuucccaggaaauuuuggcgguagcaacgccuucggcccucccaucccaccucccgggcucggaggcggggcauuuggagacgcucguccgggcaugccaucuguggguaauuccgggcugccuggacuuggccuggauguacccgguuucggcgggggaccaaacaacuugaguggccccagcggguuuggaggcgguccucagaauuucgggaacggaccgggcucucucggugggcccccaggcuuuggauccggcccucccgggcugggaucagccccuggccacuuaggugggccacccgcguucggaccuggcccaggccccgggccgggaccugguccaauccacauuggcgggcccccuggauuugccaguagcucgggcaaaccaggucccaccgucauaaaggugcagaauaugccguucacaguuuccaucgacgagauucuggacuuuuucuacggguaccaggugaucccuggaucugucugucuaaaauauaacgagaagggcaugcccaccggcgaagcuaugguggcauuugagagccgggaugaagccacugcugccguuauugaccucaaugaucgaccaaucgggucaagaaaggugaaacugguacuuggauga

SEQ ID NO: 61650 - RNA, 471 nt, Artificial Sequence
  derived and/or modified sequence opt3 from RBM14__Homo_sapiens__NP_001185765
augaagaucuucgugggcaacgucgacggggccgauaccacacccgaggaacuggcugcacucuuugccccuuacggaacuguuaugagcugcgcggugaugaaacaguucgcuuuuguacacaugagagagaaugccggugcacuuagggccauugaagcucugcauggccacgaguugcggccagggcgcgcauuaguggucgaaaugucccgaccgcguccccugaacacguggaagauauucgugggaaauguuucugccgcuuguaccucacaagagcuaagaagucucuuugagaggcggggccgcgugaucgaaugcgacgucgugaaagauuaugccuucguacauauggagaaggaagcggacgcaaaagccgcuauugcccagcugaacgguaaggagguuaaggggaaaagaaucaauguggagcuuagcacaaagggaauggucccuacuggcguguga

SEQ ID NO: 61651 - RNA, 1020 nt, Artificial Sequence
  derived and/or modified sequence opt3 from RBM14-RBM4__Homo_sapiens__NP_001185774
augaagaucuucgugggcaacgucgacggggccgauaccacacccgaggaacuggcugcacucuuugccccuuacggaacuguuaugagcugcgcggugaugaaacaguucgcuuuuguacacaugagagagaaugccggugcacuuagggccauugaagcucugcacggccacgaguugcggccagggcgcgcauuaguggucgaaaugucccgaccgcguccccugaacacguggaagauauucgugggaaauguuucugccgcuuguaccucacaagagcuaagaagucucuuugagaggcggggccgcgugaucgaaugcgacgucgugaaagguaagagaaugcauguacagcugagcacauccaggcuucggacugccccugggaugggagaucagucuggcuguuaucgcugcggcaaagaggggcacuggucgaaggaauguccaauugaccgaucaggaagaguugcggaucugaccgagcaguacaacgagcaauauggugcagugaggacacccuacaccaugagcuauggcgacaguuuguacuauaauaacgccuacggggcucucgaugccuacuauaagcggugccgugcagcucgcuccuacgaagccgucgcggccgcagcugccucuguguauaauuacgcugagcagacucugagccagcugccucaggugcaaaacacagccauggcaucccaucucaccucaacgaguuuagacccauaugauagacaucugcuucccacuagcggagccgcugcgaccgcagccgcugccgcagccgcugccgcagcggucacagcugccucuacuuccuacuauggcagggaccggucaccuuugcgacgcgcaaccgccccaguuccgacagugggugaaggguacggauacggccacgagagcgaacugagucaggcuucugccgcagcuagaaauucccuauaugauauggccagguacgagcgggagcaguaugcggaccgcgccagauacagcgcuuucuga

SEQ ID NO: 61652 - RNA, 2934 nt, Artificial Sequence
  derived and/or modified sequence opt3 from RBM15__Homo_sapiens__XP_011540270
augagaaccgccggcagggaccccgugccucggcgcagcccacgauggcguagagcugucccgcugugcgagacauccgcagggaggcggguuacucagcuccgcggagaugaccuuagaaggcccgccacgaugaaggguaaagaacggucuccugugaaggcgaaacgcucacgaggcggggaggauaguaccagcagaggagaaagguccaagaaacugggcgguucugggggaucgaacggcucaagcaguggcaagacagacuccgggggagguucucggcguagcuugcacuuagauaaguccucaagucgcggcgggagcagagaguacgacacuggaggcgguucuuccucaagcaggcugcauaguuauucuuccccaagcaccaaaaauucgucugggggaggcgaaucccggucaaguagccgaggcgggggaggugagucccgcucuagcggcgcugccucaagugcacccgggggaggcgauggugccgaguacaagacacuaaaaaucuccgaacucgggagccaacugucugacgaggcuguagaagauggccuuuuccacgaguuuaagagauucggagacgugucagucaaaauuagucaucugagcggcuccgggucuggagaugagaggguggcauuuguuaacuuccggcgcccugaagacgccagagcugccaagcacgcgaggggucguuuggugcucuaugaucggccacugaagauagaggcagucuacgugucgcgaagaaggagccgcaguccccuggacaaagacaccuauccuccaucagccaguguaguuggcgcuucugucgggggacaucggcacccgcccggcggugggggcggacagagaagccucuccccuggcggggccgcauuaggauacagggauuaucgccugcagcagcuugcuuugggucgacugccacccccuccacccccgccucuaccccgggaccucgaacgugagagagauuacccauuuuacgaaagggugcgcccugccuauucacuggagccccgggugggcgcgggggccggagcagcuccauucagagagguggacgaaaucagccccgaggaugaccaaagggccaaucgaacucuuuuucugggcaacuuggauauuacagucaccgaaucugaccuccgccgggcuuucgauagauuugguguuaucacggagguggacauuaagaggccuucccgugggcagacuuccaccuacggcuuccugaaauuugaaaauuuagauaugagccaccgcgccaagcuggcaaugucuggaaaaaucauaauccggaacccaauuaagaucggcuaugggaaagccacaccgacuaccagacucuggguaggaggccuuggucccugggugccucuggcugcguuggcaagggaguucgaccgauuugggacaauucggaccaucgacuaccgcaagggagauuccugggccuauauacaguacgagucacuagacgcugcccaugcagccuggacgcacaugagaggcuucccacuggguggccccgauaggcggcuccgagucgacuucgcugauacugaacauagauaucagcaacaguaccugcagccucuuccacugacacacuacgaguuggugaccgacgccuuugggcaccgcgcacccgauccgcucaggggagcgcgugaccggacuccuccacuguuauauagagauagggaccgcgaucuguaccccgacagugauuggguuccucccccaccucccgugcgagaaagaagcacacggaccgcugccacgucggucccagcauaugagccgcuagacucccucgacaggcgccgugauggcuggucucuggacagagaucggggagacagggaucuuccuagcucacgcgaccagccccgaaagagacgguugccagaagagagugggggcaggcaucuggaucgcucccccgagucugacagaccuaggaaacggcacugugccccaagccccgaucguuccccugaacucucaagcagucgcgaccgauacaauucugauaacgacagauccagcaggcugcuucuggagcggccgucgccaauucgcgauagaagggguucauuggaaaagucucaaggggacaaacgggaccgaaagaauagugcuuccgccgagagagaucgcaaacauaggaccacagcacccacugagggaaagagcccucucaagaaagaagaccggucugauggcagcgcuccauccaccucaacagccaguagcaagcugaaaucucccucccagaagcaggacgguggcacugcgccuguggccucagcuaguccgaaauuaugccuggcauggcaagggaugcuacuccugaagaacagcaauuuccccuccaacaugcaccuuuugcagggagaucugcagguagccucuucgcuccugguugagggcagcaccgggggaaagguggcucaguuaaaaaucacacaacgucugagacuugaccagccaaaguuggaugaagucaccaggcgcauuaaaguggccggcccuaaugguuaugcaauccuccuggcgguccccgggucauccgacagucggucuagcuccucaucugccgcuagcgauacugccacgaguacacagcgaccacuaagaaaccugguguccuaccucaagcagaaacaagcagcuggaguuaucagccugccugugggcgguaauaaggacaaggagaacaccggcguacuucaugccuuucccccaugugaguucucucagcaguuuuuggauucaccggcaaaagcccuggcuaaguccgaagaggacuauuuagucaugauuauagugaggggguucggauuucagaucggcguucgcuacgaaaacaaaaagcgggagaaucucgcgcugacucuucuguga

SEQ ID NO: 61653 - RNA, 1206 nt, Artificial Sequence
  derived and/or modified sequence opt3 from RBM17__Homo_sapiens__NP_001139019
augagccuguacgacgaucucggcguggagaccuccgacucuaagacagaaggguggucaaagaacuucaaacuucugcagagucaauugcaggucaaaaaggccgcuuuaacucaggcaaaaagccagagaacgaagcaauccaccguucuggcccccgugaucgaucuaaagaggggagguucuucggacgaucggcagauuguagacacaccuccacacguggcggcuggccucaaagauccgguccccucaggguuuagcgccggagaggugcugauaccucuugcagacgaauaugauccaauguuccccaaugacuacgagaagguugugaaacgccagcgagaagaacgucagagacaaagggagcuggaacggcagaaggagaucgaggagcgcgagaaaagaaggaaggaucggcaugaagccaguggcuuugcucgccgaccugacccagauuccgacgaggacgaagauuaugagagagaaaggcggaagcguucuauggguggggcagccauugcucccccuacuagcuuggucgagaaagacaaggagcucccacgcgauuucccguacgaagaggacuccagacccaggucacagaguagcaaagccgcgaucccuccacccguguaugaggaacaggaucggccucgaucuccaaccggacccuccaacucauuucuggcaaauaugggcggcacaguagcccacaagauuaugcaaaaauacggguuccgcgaaggacagggucugggcaagcaugagcaggggcucagcaccgcuuuaaguguugagaaaacuucuaagagaggaggcaagaucauagugggugacgccacagaaaaagaugcauccaagaaaagcgacucgaacccgcugaccgagauccuuaagugcccuacgaaagucguguugcugaggaauauggugggggcuggagaagucgaugaggaccuagaaguugagacuaaggaggaaugugagaaguauggcaaagugggcaagugcguaauuuuugaaauccccggggccccagaugacgaggcggugcggauuuuccucgaguuugaacgcgucgagucugccaucaaagcagugguugaccugaacggaagauacuucgguggcaggguggucaaggcuuguuuuuacaaucuugauaaauuccgugugcuggacuuggccgaacaaguauga

SEQ ID NO: 61654 - RNA, 3684 nt, Artificial Sequence
  derived and/or modified sequence opt3 from RBM20__Homo_sapiens__NP_001127835
auggugcuggccgcugcaaugagccaggacgccgaucccuccggcccugagcaaccagacagagucgcgugcucuguuccgggggcuagggccucacccgcaccuaguggaccacgggguaugcagcagcccccuccacccccucagccaccgcccccuccacaagccggccucccccagaucauucagaacgcugcaaaacuucuggauaagaauccuuucagcguguccaacccaaaucccuuguuaccgucuccugccucgcugcagcuagcucaacuccaggcccagcugacccuucaccgccugaaguuggcgcagacagcaguaacuaacaauacggccgcugccaccgugcucaaccaaguccugucaaaaguggcaaugagccagccccuguuuaaucagcuccgacauccaaguguuauaacagggccucacggacaugcuggcgugccccaacacgccgcggccaucccauccacucguuuccccucuaacgcaauugcuuuuagcccuccaucccagaccagagguccggggcccucaaugaauuuaccuaaccagccacccagugccauggucaugcauccuuucacaggagugaugccacagacccccggccaaccggcuguaauccugggcauugggaagacuggaccugccccagcaacagccgguuuuuacgaauauggcaaagcuagcucugggcagaccuacggacccgagacggacggccagccugguuuccuucccuccucagcgagcacuuccgggucuguuaccuaugaaggacacuacucccacacaggccaggauggccaagcagccuuuagcaaggacuucuaugggccaaauucgcagggaucucauguggcuuccgguuuuccugccgagcaggcaggcggguugaagucagaagucggaccccugcuacagggcacuaacagucaaugggagagcccacacgguuucuccgggcagucuaaaccggaucucaccgccggcccuauguggcccccaccccauaaucagccuuacgagcuguaugacccagaagaacccacaagcgauaggaccccuccgucauuuggaggccggcuuaacaauaguaagcagggguucaucggagcuggucgcagagccaaagaagaccaagcacuguuguccgugaggccacuccaggcgcacgagcugaacgauuuucacggcguggcucccuuacaucugccucacauauguagcaucugcgacaagaaagucuucgaucucaaggacugggagcuucauguuaaggggaaacugcacgcccagaaguguuugguguucucugaaaacgcaggcauucggugcauccuaggaucagccgaggguacgcugugugcuaguccaaauagcacugccguauacaaccccgcagggaaugaagacuacgcuuccaaccucggcacaucuuaugugccuauuccggcccgcucguuuacccaaagcucccccacuuucccacuggcgucagucggaacaaccuuugcccagcgaaaaggcgcugggagagugguucauaucugcaaucuuccugagggaaguuguacggaaaacgaugugauaaaucuggguuugcccuucggcaaggucaccaacuacauucucaugaaaucuacaaaucaggcauuucuggagauggccuauacugaggcugcccaggcaauggugcaauacuaucaggaaaagagcgcgguaaucaacggggagaaauuacugauuaggauguccaagcgguacaaggaacuacagcucaaaaagccaggaaaagccguugcugccaucauccaggacauucacucacaacgugagcgcgauauguucagagaagcagacagguauggcccugagcggccccgaagccgcucuccaguguccagaagucugagcccgaggucucacaccccuuccuuuacaucaugcaguagcucgcauagucccccaggucccucucgggcugauugggggaauggccgcgacagcugggagcacucaccuuacgccagaagggaagaggaacgugauccagcacccuggcgggacaacggagaugacaagcgagauagaauggacccuugggcccaugacaggaaacaccacccgcgccagcuugauaaggcugaguuggacgaacggccagagggcgggagaccccauagggagaaguacccucgcaguggaucccccaaucugccacacucugucagcuccuauaaaucacgagaagauggcuacuaucggaaggagccuaaagccaagagcgacaaauaccucaagcagcagcaagaugcgcccggucguaguagaaggaaggacgaagcacgccugcgggagucuagacauccacacccugaugacuccgggaaagaggauggacuuggcccgaaggugacuagggcucccgaaggugccaaagccaagcagaacgagaaaaauaagaccaagcgaacagaccgcgaucaggaaggcgcugacgaucggaaagagaacaccauggcagaaaacgaggccgggaaggaggaacaagagggaauggaagagagcccacagucggucggcagacaggaaaaagaggcggaguucucagacccugaaaauacuaggacgaagaaagagcaggacugggaaucugagagugaagcugagggggaguccugguaucccacaaacauggaggagcuggugaccguugaugaagugggagaggaggaagacuuuauaguagagccagauaucccugaauuggaggaaauuguccccaucgaccaaaaggauaaaauauguccggagacuugccucugugugaccacaacccuggacuuagaucuggcccaggacuucccaaaggagggcguuaaggcaguggguaauggggccgcugaaauuagccuaaaaucuccucgugagcuccccagcgcauccacuucaugcccaagugauauggacgucgaaaugcccggacugaaccuugaugccgagcgcaagccugcggaaagcgagacaggcuugucucuggaggacuccgauugcuacgaaaaagaggcuaaggguguggaaucaagugacguacauccggcccccacggugcagcagaugagcuccccaaaaccugcagaggaacgggccagacaacccucuccuuuuguugacgauuguaagaccaggggcacuccagaggacggggcuugcgagggaucgccccucgaagagaaggccagcccuccaaucgaaacagaucugcagaaucaggcaugucaggaggucuuaacccccgagaacucacgauauguggaaaugaaaucccuggaggugcggaguccggaauacacagaggucgaacuuaagcaaccuuugucucucccaagcugggagcccgaggacguuuucuccgaacugucaaucccucuaggcguggaguuugugguaccacgcacuggguucuacugcaaacuguguggacucuucuauaccucugaagagacggcuaagaugagccacugcagaagugccguccacuacaggaaucugcagaaauaucuuucccaguuggcggaagagggccugaaggagaccgaaggugccgauagcccccggccggaggacucugggauugugccucgauuugaaagaaagaaauuauga

SEQ ID NO: 61655 - RNA, 2532 nt, Artificial Sequence
  derived and/or modified sequence opt3 from RBM25__Homo_sapiens__XP_011535346
augagcuuucccccucaccugaacagaccaccgaugggcauccccgcccucccuccagggauucccccuccacaguuccccggauucccuccaccggugcccccugguaccccaaugauacccgucccuauguccaucauggcuccagcacccacaguucuugugccgacuguaucuauggugggcaagcaucugggggccaggaaagaccacccuggauugaaggcgaaagagaaugaugaaaacugcggccccacgaccacagucuuuguggguaauauuucagagaaggcuagugacauguuaauccggcaacugcuagccaaaugugggcucguucugagcuggaagcgcgugcagggagcauccggcaaacuucaggccuucggcuuuugcgaauacaaagagccagaaucuacucugcgagcuuugcgucuccugcaugaucugcagauuggggagaagaaacucuuagucaagguggacgcaaaaaccaaggcccaacuggaugaguggaaggcuaaaaagaaagccucgaacggaaaugcgagaccugaaacaguaaccaacgacgaugaggaagcacuugacgaggagacuaagaggcgggaucagaugaucaaaggugccauagaaguuuugauccgcgaguauucaagcgaacugaaugcucccagucaggaguccgacucucacccaagaaagaaaaagaaggaaaagaaggaggauauuuucaggcgguuucccguggccccucuaaucccauacccgcucauuacaaaagaggacaucaacgcaauagaaauggaggaagauaagcgcgaccugauuagccgagagaucuccaaauucagagacacccauaagaaacuugaagaggagaaaggcaagaaagaaaaggagaggcaggaaauugagaaagaacggcgugagcgcgagagagaaagggagcgggaacgagagcgcagagagagggaacgggagcgcgaaagagagagggaacgugagaaggagaaggaacgggagcgagaaagagagagggaucgcgaccgggauagaacgaaagaaagggaccgcgaucgagaccgggagcgugauagagacagggaucgcgagcggucaagugacagaaauaaggauaggagccgaucucgcgaaaaaucccgggacagagagagggaacgugagcgcgaacgggagagagagagggaacgagagcgggaacgcgagagagagagggaacgggagcgagaaagagagcgcgaaagggagcgugagaaggacaaaaagcgggauagagaagaggacgaagaggaugcuuaugaaaggcgcaagcuggagcgaaaauugagagagaaggaagccgcguaccaagagcggcucaaaaacugggaaaucagggagcgcaagaaaacucgugaauaugagaaggaggccgaaagagaggaagaacggaggcgcgagauggcaaaagaagcuaagcgacugaaggaguuuuuagaagacuacgaugacgauagagacgaucccaaauauuaccgggggucagcccugcagaagaggcuccgcgacagagagaaagaaauggaggcugaugagagggaccggaagcgugaaaaagaggaacuugaggaaauccgccagcgacuguuggccgagggacacccugauccagacgcagagcuacagagaauggaacaagaggccgaaaggcggcgccagccccagauuaagcaagagccugaaagcgaggaggaagaggaagagaagcaggagaaagaagagaagagagaggagccaauggaagaggaggaggaacccgaacagaaaccgugucugaagccuacccucaggccaauaaguucugcucccuccgucagcucggcgucuggcaaugcaacaccuaacacucccggugacgaguccccaugcgggaucauuaucccucacgaaaauucacccgaucagcaacagccagaggagcaucggccgaaaauaggacugagucuuaagcugggcgccagcaacuccccuggccagcccaauucugugaagcgaaagaaguugccaguggacagcgucuucaacaaauuugaagaugaggacucagaugacguucccagaaagcgcaaacucgugccucuggauuacggggaagacgauaagaacgcuaccaagggaacaguaaauaccgaggagaaaaggaagcacauuaaaaguuuaaucgaaaagaucccaacggccaaacccgagcuguucgcauauccucuagacugguccauuguggauagcauccucauggaacggcguauuagaccguggauaaacaagaaaaucauugaguacaucggugaagaggaggccacucuggucgacuuuguguguucuaagguuauggcucauucaaguccacagagcauccuugaugacguggccauggucuuggacgaagaggcagaaguguucauuguaaagauguggaggcugcucauauaugagacagaagcgaaaaagaucggccugguuaaauga

SEQ ID NO: 61656 - RNA, 2952 nt, Artificial Sequence
  derived and/or modified sequence opt3 from RBM26__Homo_sapiens__NP_001273561
auggugagcaagaugaucauugagaacuucgaagcccugaaauccuggcucucuaagacccuugagcccauaugcgacgcugauccuucagcacuggccaaauacgucuuggcguuaguuaagaaagacaagagugaaaaggagcugaaagcucuauguaucgaucagcucgacguguuucugcaaaaggaaacacagauuuucguagagaaacuuuuugaugccgugaauacuaagagcuaucugccaccgcccgagcagccuuccucuggcucguugaaagucgaguucuuuccacaccaggaaaaggacaucaagaaagaagagauuacgaaggaggaagagagagaaaagaaguucucaaggcggcucaaccauagcccgccucaaaguuccucucgcuaccgagagaaucguagcagagaugaaaggaaaaaggacgaucggucccgcaaaagagacuaugauaggaacccaccccggcgcgacucauaccgagauagauauaauaggcggcgugggcgcaguagaagcuacucuaggucccggucacgaagcuggaguaaggagcgccugagagagagggaccgggaccgcucuagaaccaggucccguagccggacacgaucgagagaaagggaucuggugaagccuaaauaugaccucgaucgcacugacccauuagagaacaauuacaccccgguuucuuccgugcccucaaucaguagcggacacuacccugucccaacacuguccucuaccauaacugugaucgcacccacacaucacgguaacaauaccacggaaagcuggucagaguuucaugaagaucagguagaccacaacaguuauguucggccuccaaugcccaagaaaagaugcagggauuacgacgagaagggcuucuguaugcgcggggauaugugcccguuugaccacggauccgauccuguggucguggaggacgugaaucuucccggcauguugccauucccugcccagcccccagucguugaaggucccccuccaccggggcugcccccuccacccccuauucuaacuccacccccggugaaccuccgaccuccaguacccccucccggaccacugccucccagccuuccaccggugaccggcccucccccaccccugccuccauugcagcccucuggcauggacgcuccucccaauucagcaacaaguagcgucccaacugugguuaccacagggauccaucaccaacccccuccagcucccccuucccucuuuaccgccgauacguaugacacugauggauacaacccggaggcccccucuauuacaaauaccucgcggccaauguaucgucauagagugcacgcgcagaggccuaaccugaucgguuuaacuagcggcgacauggaucugcccccacgcgaaaaaccucccaacaaguccucaaugcggauagucguggacagugagucuagaaagaggacaauugggagcggagaaccaggcguaccgaccaaaaagacgugguucgauaaaccuaauuuuaaccgaaccaauucccccgguuuccagaagaaaguucaguucgggaacgagaauacaaagcucgagcuucgcaaggugccacccgaacugaacaauaucucaaaauugaacgagcacuuuagccgguucggaacucuagucaaucugcaaguggcauacaacggcgacccugaaggcgcccucauucaguuugcuaccuaugaggaggccaagaaagcaaucucuuccacagaagcuguccugaauaacagauucaucaagguguacuggcauagggaggggaguacucagcaacuucagaccacaagcccaaaaguuaugcagccccuggugcagcaaccuauuuugccgguagucaagcagucugugaaggaacgucucggaccaguucccuccucaaccauagagccugccgaagcgcagagugccagcucggaucugccccagguguuauccacuucuacgggucugacaaaaaccgucuacaauccagcagcucuaaaggccgcucagaaaacucuccuggugagcaccucagccguagacaacaaugaggcacaaaagaaaaagcaggaggcccuuaaauugcagcaagaugugcgcaagcggaagcaggaaauccuggagaaacacauugaaacacagaagaugcucaucaguaaacuggagaagaacaaaaccaugaaguccgaagacaaggcugagauaaugaaaacucuugagguucugacaaagaacauuacgaaauugaaggaugaagucaaagcggcaucuccuggcagaugucuccccaagagcaucaagaccaaaacucagaugcaaaaggagcuguuagacacagaacuggaccuauauaaaaagaugcaggccggggaggaagugaccgagcucaggcgaaaauacacagagcugcagcuugaagcugccaagcggggaaucuuguccucaggccgcgguagagggauucauagcaggggccggggagcagugcacggccgagggagaggacgcgguaggggccguggggucccaggacaugccguuguggaucaccggccuagagcucuggagaucagugccuuuacugaaucugacagggaggaucuccugccgcacuucgcacaauauggcgagauugaagacugccagauagaugacuccagcuuacaugcggugaucaccuuuaagacgcgcgcugaggccgaagcagccgcuguacacggugcccgauucaaagggcaggaucugaaacuugcauggaauaaacccgucaccaacauuucggcuguggagacagaagagguugagccagacgaagaggaauuucaggaggaaucauugguggaugacucucuccugcaagaugacgaugaggaggaagaggacaaugaaaguagauccuggcggagguga

SEQ ID NO: 61657 - RNA, 3183 nt, Artificial Sequence
  derived and/or modified sequence opt3 from RBM27__Homo_sapiens__NP_061862
augcugaucgaggacguggaugcccucaagagcuggcuugcuaaacuguuggaacccauuugcgacgcagauccuuccgccuuagcgaacuacgucguugcucuggugaagaaagacaagccagagaaagaacuaaaggccuucugugcagaucagcucgacguauuucugcaaaaggagaccucuggcuucguggauaaacuuuuugaaucacuguauacaaagaauuacuugccgcuccuggagcccgucaaaccugagccaaagccccuggugcaggaaaaagaggaaauaaaggaggagguuuuccaggaaccugccgaggaagagagagacgggaggaagaaaaaguauccaaguccccagaaaacucggagcgaauccucugagcgccgaacgcgugagaagaaaagagaagauggaaaguggagggacuacgaucgguauuacgagcgcaacgaacucuauagagagaaauacgacuggaggcggggucgcucgaagucacgaagcaagaguagaggcuuauccaggucucggagccguucccgcgggagaucaaaagauagggacccuaaucggaacguggaacaccgagagcgcaguaaguuuaaaagcgagagaaaugaccuggaaucuuccuacgucccagugucagcuccgcccccuaacagcagugagcaauauucuuccggagcacagagcaucccaucgaccguaacaguuauugcccccgcucaucacucugaaaauacuaccgaguccuggucaaacuacuauaauaaccauaguagcuccaauucuuucggcaggaaccuuccuccaaagcggcgcugcagagauuacgacgaaagggguuuuuguguguugggggaucugugccaguucgaccacggaaaugauccccuagucguggacgagguggcccucccgagcaugaucccuuuucccccaccucccccaggccugcccccuccaccgcccccuggcaugcuuaugccacccaugccugggccaggacccgguccgggcccugggccaggacccggcccuggucccgggccaggaccuggccauucaaugcgucugcccgucccacagggccacgggcaaccgccucccaguguuguguugccaauuccccggccuccaaucacacaguccagccucauaaacucucgagaucagcccggaaccucagcgguaccuaaucuggcaaguguggguacuagauuaccgccaccccugccucagaaccuccuuuauacagucagcgagaggcaaccaauguacucccgcgaacacggcgccgcugccucugagcggcugcaguuggggacgcccccuccgcuacuggcagcuagacucgugcccccaaggaaccugaugggaucgagcaucggcuaucauaccuccguuucaaguccuacuccccuugugccagacaccuacgaaccugaugguuacaaucccgaggccccaucuauuacaagcuccgggcgcucacaguaucgacaauucuuuagccggacucagacccagcguccgaaccugaucggcuugacaucuggagacauggaugucaauccuagagcggccaacauugugauccagaccgagcccccaguacccguuuccauaaauaguaacauuacgagggugguccucgaaccugacagccgcaaacgggcaaugucuggccuggaggggccauuaacuaagaagcccuggcugggaaaacaagguaauaacaaucagaacaagccuggcuuccuaagaaagaaucaguacacaaacaccaagcucgaagugaaaaagaucccgcaggagcugaauaacauuacuaaacuuaaugaacacuuuuccaaauucgggacaaucgucaacauccaaguggcuuucaagggagacccagaggccgcuuugauucaguaucugaccaacgaggaagccaggaaagcaauaucaaguacggaggccguucucaauaaccgauuuauccgcgugcuguggcaucgggaaaauaacgagcagcccacccuucagagcucggcucaacuguugcuccagcagcagcaaacacugucccacuuaucucagcagcaccaucaucugccucaacaccuacaccagcagcagguacucgucgcgcaaagcgcacccucaacugugcauggcgguauucagaagaugaugaguaaaccacagaccuccggggccuacguucugaauaaggugccugucaagcacagacuuggccacgcuggaggcaaccagucugaugccagccauuugcugaaucaauccgggggagccggugaagacugucagaucuucucaacacccggccacccaaaaaugauauauagcaguucuaaccucaagacuccuuccaaacugugcagcgggucgaagucacaugaugugcaggagguacugaaaaagaaacaggaggcaaugaaguuacaacaggacaugaggaagaaacgucaggaagugcuugagaagcaaauugaaugucagaaaauguugaucucuaagcucgagaaaaauaagaacaugaagccggaagaacgcgcuaauaucaugaaaacccugaaggagcuaggagagaaaauuagucagcugaaggaugagcucaaaacauccagcgccguuucuacccccagcaaggucaagacuaaaacggaagcacagaaggagcugcuugacacagaguuggaucugcacaaacgguuauccucaggcgaagacaccacugagcucagaaagaaacugagucaacuucagguggaagcggcuaggcuggguaucuugccaguggggcgaggcaagaccaugagcucucagggacggggccgcgggagaggaaggggcggucgggggcgaggaucccucaaccacauggucguugaucauagaccuaaggcccugacagugggcgguuuuauugaggaagagaaagaggaccuacugcagcacuucucaaccgcaaaucaaggccccaaguuuaaagaucgcaggcuccagauaaguuggcauaagccaaaagugccuagcaucuccacugaaacagaggaagaggaaguaaaggaggaggaaacggagaccucugaccuguuccuucccgaugacgacgaugaagacgaggaugaauacgagucgcguagcuggcggagauga

SEQ ID NO: 61658 - RNA, 1857 nt, Artificial Sequence
  derived and/or modified sequence opt3 from RBM28__Homo_sapiens__NP_001159607
auggccggccugacccucuucguggggagacuucccccuagcgcuagguccgagcagcuggaagaguuguuuucucaagucggaccaguuaagcagugcuucgugguaacagaaaaaggucggacuguggcagucgacugggccguggcgaaggauaaauacaaggacacgcagucaguuagugcuaucggcgaggagaaaagccacgaguccaagcaucaggagucugugaagaaaaaggggcgcgaagaggaagauauggaggaggaagagaacgacgaugacgaugacgaugacgaugaagaggacggagucuuugaugacgaagacgaggaggaagagaauauugaaucgaaagugaccaagccgguacaaauacagaaacgagccguuaagcgucccgccccugcaaagucaagcgaucacagugaggaagacuccgauuuagaggagucugacagcaucgaugacggcgaagaacuggcucaguccgauacaucaacugaagaacaggaagacaaagcagugcaagucaguaacaagaaaaagagaaaacuaccaagcgaugugaaugaggguaagaccguguucauuaggaaccucucuuuugacuccgaggaagaggaacugggggagcuucugcagcaguucggagaguugaaauauguccggaucguucuccaucccgauacagaacacucaaagggcugugccuuugcucaguucaugacccaagaggccgcgcagaagugccugcuggcagccagcccugaaaaugaggcuggcgggcucaaauuagacggacgccagcugaagguggaccuugccguaacuagagaugaagcagcuaaauugcaaacaaccaaggugaaaaagccaacggguacuaggaaccuguaccuagcccgggagggccucauucgcgcggggaccaaggccgcagagggagucagugcugccgacauggcuaaacgagaaagauuugagcugcuuaagcaucagaaacugaaggaucagaauaucuucgugucuaggacacgguugugucuccacaaccugcccaaagccguugacgauaagcaguuacguaagcugcuccuuuccgcaacuagcggcgaaaaaggugugcgcauaaaggagugcagagucaugagggaccugaaaggggugcacggaaauaugaagggccaaucguugggcuaugccuuugcugaguuccaggagcaugagcacgcgcuaaaagcacugcggcucaucaacaauaacccugaaauuuuugggccacugaagcgaccgaucguagaguucucucuugaagaucgcagaaagcugaaaaugaaggaguugaggauucagcggucccuccagaaaaugcgcucaaagcccgccaccggagaaccucaaaaaggucagccagagcccgcuaaggaccagcagcaaaaagccgcacagcaucacacagaggaacagaguaagguuccuccagagcagaagagaaaagccggcagcaccuccuggacgggguuccaaacuaaggcugaaguggagcaggucgagcugcccgauggaaagaagaggcguaaaguguuagcccugccgucucaccggggcccuaagauccgacuaagagacaaggguaaagucaagcccgugcauccuaaaaagccaaaaccccagauaaaucaauggaagcaggaaaagcagcagcucagcucagagcaaguuaguaggaaaaaggcaaaagggaacaagacagaaacccgcuuuaaucagcugguggagcaguacaaacagaaacuuuugggcccauccaagggagcgccccuggcuaaacggagcaagugguucgauucuuga

SEQ ID NO: 61659 - RNA, 816 nt, Artificial Sequence
  derived and/or modified sequence opt3 from RBM38__Homo_sapiens__NP_001278709
augcugcuccagcccgccccuugcgcuccaagcgcaggcuucccgagaccccuugccgcgccuggggcuaugcacggaucccaaaaggacaccacauuuacuaaaaucuucguggguggccugccauaccauacgaccgaugccucuuugaggaaguauuuugagggguucggagacauugaagaggcagucguuauaacagaucggcagacuggcaaaucacgcgguuacggguuuggaaucauuuucguguuagaaggccacaucagucaggcccugaacuuugacggccgaagcuggaaucccgggggaauuuucguaggugagccucaggugaccauggcugaucgugcagccgcugaaagagccuguaaggacccaaaccccaucauagauggcaggaaagcgaaugucaaccuagcauaucucggggccaagccucggucccugcaaacaggauuugcuaucggcgugcagcagcuucauccaacccugauucagcgcacuuacgguuugacaccgcacuauaucuaucccccugccauuguucaaccaucuguggucauccccgcagcuccugugccaucgcucucaagccccuacauagaguacaccccggccaguccugcguacgcccaguaucccccagcaacguacgaccaguauccuuacgcugccucccccgcuacugccgcaucuuucguaggguauagcuacccagccgcuguuccccaggcgcuguccgcagccgcuccugccggaaccacauuugugcaauaucaggcaccacagcugcaaccggauagaaugcaguga

SEQ ID NO: 61660 - RNA, 1527 nt, Artificial Sequence
  derived and/or modified sequence opt3 from RBM39__Homo_sapiens__NP_001229528
auggccgacgauaucgacauugaggcuaugcuggaagcacccuacaagaaagaugagaacaagcucagcuccgccaauggccacgaagagagaucuaaaaagaggaaaaagucaaagagucggagccgcucccaugaacgaaaacguucuaagucgaaagagagaaagaggucacgggaccgcgagaggaaaaagagcaagaguagggaacggaaacgcucccgaucuaaggagagaaggcggagccguucccgcucaagagauaggcgguuccgagggcgcuauagaaguccuuacaggcggcgcagcagaucuaaauccccauuuaggaaggacaaaucaccggugcgugaacccauagauaaccuuaccccugaggagcgggacgcgcgaacagucuucugcaugcagcuggcugccagaaucaggccacgcgauuuggaagaguuuuucagcacuguuggaaaggugcgggacguaagaaugauuagugauagaaauucucgccgauccaaagguaucgcauauguggaauuugucgacgugagcucgguucccuuagccauuggccugacggggcaacgggugcuaggagucccuaucauagugcaggcuucucaggcagagaagaaccgugccgcugccauggcgaauaaccuccagaagggcuccgcagguccaaugagacuguacguagggucacuucacuucaauaucaccgaagauaugcugaggggaauuuuugagcccuucggccgcaucgagaguauucaauugaugauggacagcgaaacaggccgguccaaaggguauggauuuaucacuuucucugacagcgagugugccaagaaagcucucgaacagcugaacgguuuugagcuggccggcagaccuaugaagguugggcaugugaccgaaaggacagaugcaucaagugcuuccagcuuccucgacucugaugaguuagagcgaaccggaauagaccugggcacuacaggucgccuucaguugauggcccggcuggcggaagggaccggacuacagauuccaccggccgcacaacaggcucuccagaugucaggcagucuggccuuuggcgcugucgccgaguucagcuucgugaucgaucuucagacgagacugucccaacagacugaagcaucugccuuggcugcggcagccucggugcagccccucgcuacccaaugcuuucagcugagcaauauguucaacccucagacagaggaagaggucgggugggacacugagauuaaagaugacguuaucgaagaguguaauaagcacggaggugugauccauauuuacguagauaagaacuccgcccagggcaauguguaugucaaaugcccaucaauagcagccgcuaucgccgcagugaacgcguuacacgggaggugguuugcuggaaagaugauuaccgccgcauacguuccccugccuacauaccacaaucucuucccagacaguaugaccgccacgcaacuucuggugcccucucgucgcuga

SEQ ID NO: 61661 - RNA, 474 nt, Artificial Sequence
  derived and/or modified sequence opt3 from RBM3__Homo_sapiens__NP_006734
augagcuccgaggaaggcaagcuguucgucgggggacucaacuuuaauaccgacgagcaggcccuugaagaucacuucucuucauuuggucccaucagugaggugguugugguaaaagacagagaaacacaaaggagccggggcuucggguuuauuacuuucacgaacccugagcaugcuuccguggcaaugcgcgccaugaauggagagucucuggauggccgacagauacgugucgaccacgcggguaagucggcuagagggaccaggggaggcggcuuuggggcccauggacggggucgcucauacagcagaggcgggggagaucagggcuaugguagugggagguacuaugacucccggccaggaggcuacggcuauggguacggacgcucucgagauuauaacgguagaaaucagggcggguacgacagguacagcggaggcaacuaucgggauaauuacgacaacuga

SEQ ID NO: 61662 - RNA, 1425 nt, Artificial Sequence
  derived and/or modified sequence opt3 from RBM45__Homo_sapiens__NP_694453
auggacgaggccggcagcuccgcuucugggggagguuucagacccggcguggauucacuggacgaaccuccaaacaguaggaucuuucucgucauuagcaaguacaccccggaguccguucuucgggaacgcuucucucccuuuggggauauacaggacaucugggugguacgagauaaacacacaaaggagucgaaaggaauugcauucgugaaguuugcccguucaagccaagcgugcagagcuauggaagagaugcauggccagugucuggguccuaaugacacuaaaccaaucaaggucuucauugcccagaguagguccucugggagccaccgggauguggaggacgaagaguugacgcgcaucuuuguuaugauacccaaguccuauaccgaagaggauuuaagagagaaauucaagguguacggagacaucgaauauugcucaauuaucaaaaacaaggucacaggcgagaguaaaggccugggguacgugagguaucuaaagccuagccaggcagcccaagcuauugaaaauugugaucggucuuuucgcgcaauccucgccgagccaaagaacaaggcuuccgaaucaagcgagcaggacuacuauaguaauaugcgacaggaggcccugggacaugaacccagaguaaacauguucccuuuugagcagcaaucugaguucuccagcuuugauaaaaaugacucgaggggucaggaggcgauaucuaaacggcuuuccguugugucacgugucccauucacugaagaacagcuguucaguauuuuugacaucgugccgggcuuggaguacugcgaagugcagcgcgaucccuacagcaacuaugggcacggagucguucaauacuucaauguggcauccgccauuuaugcuaaguacaaacuccauggcuuucaguauccuccagguaacagaaucgggguaucuuucaucgacgauggaagcaaugccaccgaccugcugaggaagauggcaacacagaugguggcugcccaacucgcgucaauggucuggaacaaucccagucagcagcaguuuaugcaauucggcggcuccagcgggucucaguuaccucagauucagaccgaugugguucugccaucauguaaaaagaaggcccccgcagagacuccggugaaagaacggcuuuuuauagucuucaacccucaccccuugccacuggacgugcuagaggauaucuuuugccgauucggaaaucucauugaaguauaccugguuagugguaagaacgugggcuaugcuaaauacgccgaccgcaucagcgcuaacgaugccauagcaacacuucacgggaagauucugaauggagucagauugaaagugaugcucgccgacuccccuagggaggagucuaacaagcggcaacgcaccuacuga

SEQ ID NO: 61663 - RNA, 1602 nt, Artificial Sequence
  derived and/or modified sequence opt3 from RBM46__Homo_sapiens__NP_659416
augaacgaggaaaauaucgacggcaccaacgggugcagcaaggugagaacagguauucagaaugaggccgcucugcucgcacuuauggagaaaacuggauacaacaugguccaagaaaauggccagaggaaguucgggggacccccuccaggcugggaagguccgcccccuccacgggggugugagguuuuugugggaaaaauaccccgcgauauguaugaggacgaacugguaccuguguucgagcgagccggcaagaucuacgaauuucguuugaugauggaguucuccggcgagaacagaggguaugcguuugucauguacacgaccaaagaagaggcucaguuagccauuaggauccugaauaacuaugaaauucggccaggaaaguucaucggugugugcguuucucuagauaauugucgccucuuuauaggcgcaauccccaaggagaaaaagaaagaagagauucuggacgagaugaagaaagugacagaaggggucguggauguaaucguuuacccuucagccacugacaagaccaagaacagaggauucgcuuuuguggaguaugaaagucacagggcagccgcuauggcccggcgcaaacuuauuccaggcacauuccagcuguggggucauaccauccaagucgauugggcggacccggagaaggaaguggaugaggagacuaugcagcgagugaaagucuuguacguuagaaaucucaugauaagcacaaccgaagagacgauuaaggcagaauuuaacaaauucaagcccggggccguggagagggugaaaaagcugcgggacuacgcuuuuguacacuucuucaaucgugaagaugccgucgcagcuauguccgugaugaacggaaagugcaucgacggcgccucuauugagguuacucuggcgaaaccugugaauaaggagaacaccuggcgccagcaucucaacggccagaucucgccaaauucagaaaacuuaaucgucuuugccaauaaagaggaaagccaccccaagacacuggggaaacuuccuacuuugccagcaagacugaacggacaacauagucccuccccgccugagguggagagguguaccuaucccuucuacccagguacaaagcuaaccccuauuucuauguauagccucaaguccaaucacuuuaacucagcuguaaugcaccuggauuacuauugcaauaaaaacaauugggcucccccagaauacuaucuuuacaguacgacuagccaggacggcaagguucuguugguguacaaaauagucauccccgccauugccaacgggucucaguccuauuucaugccugacaagcucuguacaacccuggaggaugcaaaagaauuagccgcucaguuuacucugcuccaucuugacuacaauuuccaccggucaagcaucaacagucugucuccaguguccgcgacauugagcucgggaaccccgucuguccuacccuauacgucccgaccuuacucauauccaggcuacccccugaguccuaccauaagccucgcaaaugguucccauguggggcaacgccugugcauuucuaaccaggccagcuuuuucuga

SEQ ID NO: 61664 - RNA, 1782 nt, Artificial Sequence
  derived and/or modified sequence opt3 from RBM47__Homo_sapiens__NP_001092104
augaccgccgaggacagcacagcugcaauguccucugauucagccgcgggcaguagcgcuaaggugcccgaaggggucgccggagcaccuaacgaggccgcucugcucgcacuuauggaaagaacugguuacuccaugguucaggagaauggccaaaggaaauaugggggaccaccgcccggcugggaagguccucacccacagcgggggugcgagguguucguaggaaagaucccccgcgacguguacgaggaugaacuggucccuguguuugaggccguuggccgaauuuaugaauugcguuuaaugauggacuucgauggcaaaaacagaggguacgcuuuugugauguauugucauaagcacgaggccaaaagggcgguccgggagcugaauaacuacgaaauacgcccaggaagacuacucggugugugcuguucuguagacaauugcaggcuguucaucggcgggauucccaagaugaagaaacgggaggaaauccuugaggaaauugcaaagguuacggagggagugcuggaugucaucguguaugccucggcugccgacaaaaugaagaaccgcggcuuugcauucguggaguacgaaucacaucgagcugccgcgauggccagaaggaaauugaugccuggucggauacagcucugggggcaccagaucgcagucgauugggcugagccagaaauugacguugaugaggacgugauggaaaccguaaagauccuguacgugcguaaucugaugauugagacaacugaggauaccaucaagaaaaguuuuggacaauucaacccgggcugugucgaacgcgugaagaaaauaagagacuaugccuuuguucauuucacaagcagggaggacgcugugcacgccaugaauaaccucaauggcaccgaauuagagggguccugccuggaagucacucuugcaaagcccguggauaaagagcaguacucucgguaucagaaggccgcucgaggagguggcgcggcagaggccgcucagcaaccuagcuacguauauuccugugacccauacacauuggccuauuacggguaccccuauaacgcacugauuggaccuaaucgcgauuacuuuguuaaagccggcucaaucagagguagggggcggggcgcugccggaaaccgcgcaccaggccccagagggaguuaucuaggagguuacagcgcgggcagggggauuuauucucguuaccacgaaggaaagggcaagcagcaggagaaagguuaugaacucgugccgaaucuggagaucccuaccgucaaccccguggcuaucaagccagggacggucgccauuccugcaauaggcgcccaguacuccauguuccccgcugccccagcacccaaaaugaucgaggacggaaagauucauacuguggaacacaugaucucaccuauagcuguucaaccagauccggccagcgcggccgcugcagccgcugccgcagcggccgcugccgcagcugugauucccaccguaaguacaccuccacccuuucagggccggccuaucacuccagucuacaccguggcccccaacguucagcgaaucccgacagcagggauuuauggagccucuuacgugccuuucgcugcgccagccaccgcaacgaucgcuacucuucagaaaaaugccgccgcugcagccgcgauguaugguggcuacgcuggguauauuccccaagccuucccugcagccgcuauacagguccccaucccagacguguaccagacauauuga

SEQ ID NO: 61665 - RNA, 432 nt, Artificial Sequence
  derived and/or modified sequence opt3 from RBM4__Homo_sapiens__NP_001185772
auggugaagcuguucaucggcaaccuccccagagaggccaccgaacaggagauuaggagccuuuuugaacaauacgggaaaguccuggagugcgacauaaucaagaauuauggauucguucacauugaagauaaaacagcugcagaggacgccauccggaacuugcaucacuacaaguuacauggugugaauauuaacguagaggcguccaaaaauaagucuaagacuucaacgaaacugcacgugggcaacaucaguccuaccuguacaaauaaggaacuacgcgcuaaauuugaggaauaugggccagucauagagugcgauaucgugaaggacuacgccuucguucauauggagcgagcagaagaugccguggaggcuauucguggacucgacaacacugaauuucagggcgguaugugugucggguga

SEQ ID NO: 61666 - RNA, 2448 nt, Artificial Sequence
  derived and/or modified sequence opt3 from RBM5__Homo_sapiens__NP_005769
augggcagcgacaagagaguguccaggaccgagcggucugggcgcuacggaucaaucauugaucgagacgaucgugacgaaagagagaguaggagccggcgcagagauuccgacuauaaaaggucuucggaugaccggcgcggugaucgauacgacgauuauagagacuacgauucacccgaaagggagcgggaacgucgcaacagcgacagaagugaggacggcuaucacuccgauggggacuacggagagcaugauuauaggcacgacauaucugaugaacgggagagcaagacaaucaugcugcgaggccucccuauuacuaucacggaauccgacauucgcgagaugauggagucauucgaagguccacagccggccgaugucagacuuaugaaaaggaagaccgggguuagucggggauuugcuuucguggaguuuuaccaucugcaagacgcaacaagcuggauggaagccaaucagaaaaaguugguaauccagggcaagcacauagcgaugcauuacucuaacccccgcccuaaauucgaggauugguuaugcaauaaguguugccugaacaauuuuagaaaaaggcuaaaguguuuccguugcggcgcugacaaauuugauuccgaacaggaggugccacccgggacuaccgagucaguccaaagcguggacuauuacugugacacaaucauucuccggaacaucgccccucacaccguuguggauaguauuaugacugcacugucuccauaugccucccuugcugucaauaacauccgacugauaaaggacaagcagacacagcagaauagaggauucgcauuugugcaauugagcucggccauggaugcuucucagcuccugcagauucugcagucccuccaucccccuuuaaaaaucgacgguaagaccauuggcguagauuucgccaaaucagcgaggaaggaccugguucuuagugaugggaaccgcgugagcgcauuuuccgucgccucuacggcuaucgccgcagcucaauggagcucaacucagagucaguccggagaaggcgguagcguggacuacucuuauuugcaaccagggcaggauggauacgcccaguaugcgcaguacucacaagacuaccagcaguucuaucagcaacaggccggcggccuggagagugaugcaagcuccgcuucugggaccgccgugacaacuaccucggcugccgucguuagccaguccccgcagcuauacaaucaaacaucaaaucccccuggaaguccaaccgaagaggcacagcccucuacgagcacuuccacacaggccccugcugcgucaccaaccggugugguacccggcacuaaauaugcagugccggacacaagcaccuaccaguaugaugaaucuuccggguacuauuacgacccuacgaccggacucuacuaugaccccaauagucaauacuauuacaacagccugacacagcaguaucuuuacugggauggcgagaaggagacuuaugucccagccgcugaaucuuccucacaccaacagaguggucugccucccgccaaagaggggaaggaaaagaaagagaagccaaaaagcaagaccgcacagcagaucgccaaagacauggaacggugggcuaagucguugaauaagcaaaaagagaacuuuaagaacuccuuccagcccgugaacucucucagagaggaagagaggcgcgaaagcgccgcagcggaugcuggcuucgcccuguuugagaaaaagggagcauuagccgagcgacagcagcugauuccugaacucguucggaacggcgacgaggaaaauccacuuaaacgugggcugguggcugccuacucaggagauagugacaacgaggaagaguuggucgagagacuagaauccgaggaagagaagcuggcagauuggaagaaaauggcuugccuccuguguaggcgccaauucccgaauaaggacgcccuugugcggcaccagcagcugucugauuugcauaaacagaacauggacauauacagaaggagccgacucuccgaacaagagcuggaggcguuagaacugcgcgagcgggaaaugaaguauagagauagggccgcugagcgucgcgaaaaauacgguauccccgagccuccagagcccaagcggaagaaacaguuugacgcaggcacaguaaauuaugaacagccuacuaaggaugggauugaccacucaaacaucggaaauaaaaugcuacaagccaugggcuggagagaggguagcgggcucggcaggaagugccagggaauaaccgcuccaauugaagcccagguucgacugaaaggcgcagggcuuggagcgaaggguagugccuacggcuugucuggggcugacuccuauaaagaugccgugcggaaggcaauguucgcucgcuuuacagagauggaguga

SEQ ID NO: 61667 - RNA, 3372 nt, Artificial Sequence
  derived and/or modified sequence opt3 from RBM6__Homo_sapiens__NP_005768
auguggggcgacagcagacccgccaacaggaccgggccuuuccggggaucccaggaggaacgcuuugcuccagguuggaaucgagauuacccgcccccuccacugaagucucacgcacaagagcgucauucaggcaacuuccccgggagagacagucucccuuuugauuuccagggacacagcggcccacccuuugccaauguggaagaacauuccuucucuuauggugcgagggacgggccucacggagauuaccggggcggcgaagggccaggacaugacuuucgcgguggcgauuucucgucaagcgacuuucagaguagagauuccucucagcuugacuucagggggcgggauauccacagcggagacuuucgcgaucgagagggcccgcccauggacuauagagguggggacggaacauccauggauuacaggggccgggaggcuccucacaugaacuaucgugaccgcgaugcccaugcagucgacuucagaggcagggaugccccacccucagacuuucgggggcgaggaacuuacgaucuggacuuccgcgguagagauggcagucacgcugacuucagggggcgggauuugagcgacuuagacuuucgcgcaagagaacaaucuagguccgauuuccguaaucgggacguuucagaucuggacuuucgagauaaagacggaacccagguggauuucagaggcagggguagcgggacgacagaccuagauuuucgcgaccgggauacuccucauagugacuucagaggcaggcaccgcucucgaaccgaucaggacuuucggggacgugagaugggcuccugcauggaguucaaggacagagagaugccacccguagauccgaacauucucgacuauauacagccuagcacacaagauagggagcacucggggaugaaugugaaccgccgggaagagucuacccaugaccacacuaucgaaagacccgccuuugguauucagaaaggagaguucgaacauuccgagacaagggagggcgaaacccagggggucgcuuuugagcacgaaucaccagccgauuuccagaauagucaaagcccugugcaggaccaggauaagucccaacugucuggacgagaggaacagagcucagacgcgggccuuuuuaaagaggagggugggcuggauuucuugggccgccaggacacggauuaccggaguauggaauacagagacguugaucauaggcuccccggaucccagauguucggcuaugggcaaagcaagucuuuuccagagggaaagacugcacgugacgcccagcgcgaccugcaggaucaggacuaccggaccggucccucagaagagaaaccuaguagacugaucaggcucagcggcgugccagaagaugcuacaaaggaggagauuuuaaacgccuuccgaacuccggacgggaugcccgucaaaaaucugcaacuuaaggaauauaacaccggauacgauuauggcuacguguguguagaguuuuccuugcuggaagacgcaaucgguugcauggaggcuaaucaggggacacuaaugauacaggauaaagagguuacccucgaauaugugucuucgcuggacuucugguacuguaagcggugcaaggccaacaucggcggacaccgcagcuccuguucauuuugcaaaaauccuagagaggucacggaagcgaagcaggagcuuauuacuuacccacaaccccagaaaacaaguaucccugccccacuggaaaagcagcccaaccagccguugaggccugcagauaaagagccagagccccggaagcgagaagagggccaagaaucuagacucgggcaccagaaacgcgaggcugaaagguaucugccucccagccgucgggagggaccaaccuucagaagggaccgcgagcgagaauccuggucaggcgagacuagacaggauggugaaagcaagacaauuauguuaaagcggaucuacaggucuaccccucccgaggugauaguggaaguccuggagccauauguucgccucacgaccgccaacgugcguauuaucaaaaauagaacagggccgaugggacauacuuacggcuuuauugaccuugacucccacgcugaggcccugcggguagugaagaucuugcaaaaccuagauccucccuucaguaucgacgguaaaauggucgcagugaaucuggccaccggcaagaggcgcaacgauagcggggaccauucugaucacaugcacuauuaccagggcaaaaaguauuuucgagacagacggggagggggacgcaauuccgauuggucaagugacacaaacaggcagggccagcaaagcucguccgauuguuacauuuacgacucugcuacugguuauuacuaugauccacucgcggggaccuacuaugaccccaauacacagcaggaaguuuacgugccucaggauccaggacugcccgaggaagaggagauaaaggagaaaaagccuaccagccaaggcaaaucaaguuccaagaaagaaaugucuaagagagacgguaaggagaaaaaggacaggggcgucacucgguuccaggaaaacgcaagcgaagggaaagccccggcugaggauguguuuaagaaaccacuucccccuacgguaaagaaggaggaauccccacccccuccgaaaguugugaauccccugaucggauugcucggcgaguaugggggagacucagauuacgaagaggaagaggaggaggaacagacaccaccuccccagccacguaccgcccaaccucagaagcgcgaggaacagacuaaaaaggaaaacgaggaggacaaacugaccgauuggaauaaguuagcaugccugcuaugucgaagacaauuccccaacaaagaaguccucauuaagcaucagcagcugagcgaccuucacaagcagaauuuggagauccauaggaaaauaaagcaaagugaacaggagcuggccuaccucgagcggcgcgaaagagagggcaaauuuaaggguagggggaacgaucggcgagaaaaacugcagucuuucgacuccccagagagaaagcgcauuaaguauagcagggaaacagauucggaccggaaacuuguggauaaggaggacaucgauaccucaucuaaaggaggcugcguccagcaagcuacugguuggcguaagggcacagggcugggauacggccacccgggguuggccaguuccgaggaagcagagggaagaaugaggggcccuagcgugggugcgucugggcgcacgagcaaacggcaguccaaugaaaccuaucgagacgcuguuagaagggugauguucgcccgcuacaaggagcucgacuga

SEQ ID NO: 61668 - RNA, 801 nt, Artificial Sequence
  derived and/or modified sequence opt3 from RBM7__Homo_sapiens__NP_057174
augggcgccgcugcagccgaggcggacagaacccuguucguggggaaccucgaaacaaaggucacugaggaacuucuguuugaguuguuccaccaggcuggacccguuaucaaagugaagauuccuaaagauaaggacgguaaaccaaagcaauuugccuucguaaauuuuaagcaugaagugagcgucccguacgcaaugaacuuacugaauggcauaaaacuauaugggaggcccaucaagauucaguuccgguccggaucuucacacgccccucaggaugugagucucagcuacccacagcaucacguuggcaacuccucucccacgucgaccucaccuagccgcuaugagcgaacaauggacaauaugacuucauccgcucaaaucauucagcguucuuuuagcuccccagagaacuuccagagacaggcagugaugaauagugcccugaggcaaaugaguuacggugggaaauuuggaagcucuccccuugaucaguccggcuucucaccuagcguccagagucauucucacuccuuuaaccagagcucgucuucccaauggcggcagggcaccccaucaagucagcgcaaggugagaaugaauagcuauccguaccuggcugacaggcacuauucccgggaacaacgcuacacagaucaugggucugaccaccauuaccgaggaaaaagagaugacuucuuuuaugaggauaggaaccacgacgauuggagccacgacuacgacaaucggcgugauucaagucgcgacgguaaguggagauccagcaggcauuga

SEQ ID NO: 61669 - RNA, 1212 nt, Artificial Sequence
  derived and/or modified sequence opt3 from RBMS1__Homo_sapiens__NP_002888
augggcaagguguggaaacagcaaauguacccccaguaugccaccuacuauuacccucaguaucugcaggcuaagcaaagccucgucccagcacacccgauggcgcccccuuccccaucuacaacuucaaguaacaauaacagcuccucuucgucaaauagcgggugggaccagcuuaguaaaacgaaccuguacaucagaggauugcccccucauaccacagaucaggacuuaguuaagcugugccagccauaugguaaaauuguguccacuaaggccauacuagauaagaccacaaauaaauguaagggcuacggguucguagacuuugauucucccgcugccgcacaaaaagccgugagcgcucucaaggcauccggaguccaggcccagauggcuaaacagcaagagcaggacccuaccaaccuguacaucucaaaucuuccacugaguauggaugaacaggaguuggaaaacaugcucaagccguucggccaagugauuagcacuaggauccugcgggacucuuccgguacaucacgcgggguuggauuugcccgaauggagagcaccgaaaagugcgaggcggugauuggccacuucaauggcaaauuuaucaagacgcccccuggggucagugcaccaacugagccccugcucuguaaauucgccgauggaggucagaagaaacgucagaacccuaauaaguauauaccaaacggcagacccuggcauagggaaggggaggcuggaaugaccuuaacauacgacccgacuaccgccgcaauccagaauggcuuuuauccuucucccuacuccauugcuacaaaccggaugaucacccaaacgagcauuacuccauauaucgccucgccugugucugcguaccagguacagucccccucauggaugcagccacaacccuauauacugcagcacccuggugccguucuuacaccaaguauggaacauaccaugagcuugcagccggcauccaugauuucuccccuggcucagcaaaugagccaccuaucacucgggaguacuggaacauacaugccugccaccuccgcuaugcagggcgccuaccugccacaguaugcacacaugcagacgaccgccgugcccgucgaggaggcuagcggccaacaacagguggcgguggaaacaucuaaugaucauucaccuuacacuuuccagccaaacaaauga

SEQ ID NO: 61670 - RNA, 1224 nt, Artificial Sequence
  derived and/or modified sequence opt3 from RBMS2__Homo_sapiens__NP_002889
augcugcucagcgugaccuccagacccggcaucucuacauucggguacaacaggaauaacaagaaaccuuaugucucacuugcccagcaaauggcuccaccgagucccagcaauuccacuccuaacucuucgucaggaagcaaugguaacgaccagcugaguaagacgaauuuguacauucggggcuuacagccagggaccacagaucaggaccugguuaaacuaugccaacccuauggaaagauaguguccacuaaagcaauccucgauaagaccacaaacaaguguaaaggcuacgguuuuguagacuucgauucuccuagcgccgcgcagaaggcugugaccgcccugaaagcauccgggguccaggcccagauggcuaagcaacaggagcaggacccaacuaaucuuuauauuucaaaccugcccuugaguauggaugaacaggagcucgaaggaaugcugaaaccuuuuggccaagugaucagcacacgcauucugcgagacaccucuggcacgucccgugggguuggauucgcaagaauggagucaacugaaaagugcgaggccaucauaacccacuuuaaugguaaguacaucaaaacaccaccgggcgugcccgcuccuagcgauccacucuuauguaaguucgccgacgggggacccaaaaagaggcagaaccagggcaaauuuguccaaaauggucgggcguggccucgcaacgcagauaugggggugauggcccugacuuaugacccaaccacagcccuucagaauggauucuaccccgcuccguacaacauuaccccuaacagaauguuggcacagagugcucugucucccuaucuauccagcccaguaucgucuuaccagaggguuacgcaaacuuccccucuccaggugcccaauccaucauggaugcaucaccauaguuaucugaugcagcccagcggcuccguccuuacaccuggcauggaucacccaaucucucugcagccggccagcaugauggggcccuugacccaacagcucggacaucugucauuaaguuccacugguacauacaugccuaccgcggccgcaaugcagggcgcuuauauuagccaguacacgccagugcccucuucaagugugagcgucgaggaauccucugggcaacagaaccagguugccguggacgcuccuucggagcacggaguauauagcuuucaguucaauaaguga

SEQ ID NO: 61671 - RNA, 1260 nt, Artificial Sequence
  derived and/or modified sequence opt3 from RBMS3__Homo_sapiens__NP_001003792
augggcaagagacuggaccagccccaaauguacccucaguauaccuacuauuacccacacuaucuccagacaaaaagcuacgccccggcuccccauccuauggcaccacccuccccuucuacuaacucaaguagcaauaacuccucuaauaacucgucaggggagcagcuuagcaagacgaaucuguauaucaggggauugccacccgguaccacagaucaagacuuaauuaaacugugccagccuuacggcaagauagugaguacuaaagccauccuagauaagaacaccaaucaguguaagggguacggauucgucgacuuugauuccccagcggcugcccagaaagcaguugccucucucaaggcuaacggcgugcaagcacagauggccaaacagcaggaacaagacccgacaaaucuguauauuagcaaccuucccaucuccauggaugagcaggaacuggagaauauguugaagccuuucggucacguaauuucaacccggauccuccgcgacgcuaacggggugagucgaggagucggcuuugcccguauggaaagcacugagaaaugcgaggugguuauacagcauuucaauggcaaguaccugaagacaccacccgggaucccugcgccaucugaaccccugcucuguaaauuugcagauggaggucaaaagaaaagacagaaccaguccaaguauacccagaauggcaggccguggccucgggagggggaagccggaauggcuuuaacguacgaccccacugccgcaauucaaaacggcuucuauucaagcccauacaguaucgcuaccaaccgcaugauuccucagacaucuaucacucccuuuauagccgcguccccagugagcaccuaucagggugccgucauuacacccaccauggaucacccuaugucgaugcagccagcaaauaugauggggccgcugacgcaacagaugaaccaucuuucuuugggaacuacaggcaccauccagucccaggacagaauuaugauccugcaccaacuacucugccaguacaugacugcugccgcucccaugcagggcacauacaucccucaguauaccccagugcccccuacggccguaucaauugaggggguuguggcagauaccaguccacaaacagucgcccccagcucccaggacacuucuggacagcaacagcagauagcuguggacaccagcaaugagcacgcgccggcauacucauaucagcaaaguaaaccuuga

SEQ ID NO: 61672 - RNA, 969 nt, Artificial Sequence
  derived and/or modified sequence opt3 from RBMX2__Homo_sapiens__NP_057108
augaacccccugaccaaggugaaacucaucaaugagcuuaacgaaagagagguccagcugggcguugccgacaaggugagcuggcacuccgaauacaaagauucugcuuggauuuucuuagggggauugccuuaugagcugacagaaggugacauaaucugcguauuuucacaauacggcgagauugugaauaucaaccuagucagggauaagaaaacugggaagaguaagggauucuguuuucucugcuaugaggaccagcggagcacgauucuggcaguggauaauuucaacggcaucaaaauaaagggucgcaccauccgaguugaccauguguccaauuaccgugccccaaaagauucugaagagauugacgaugucacaagacagcuucaggaaaagggguguggagcgaggacuccgucgcccucacugagcgagaguuccgaggacgaaaaaccuaccaagaagcacaaaaaggauaaaaaggagaaaaagaaaaagaagaaagaaaaggagaaagcugaccgggaagugcaagccgagcagccaucuagcuccucaccccgcagaaagacaguaaaagagaaggaugacaccggcccuaagaaacauaguagcaagaacucugaaagggcacagaaauccgagccacgggaaggccagaaguugcccaaaucacgcacugccuauagcgggggagcugaggaccucgaacgagagcugaagaaggagaaaccuaagcacgaacauaaaaguucuuccagaagggaggcacgggaagagaagacacguauccgcgauagagguaggagcucggacgcccacucuuccugguacaauggccggucagaagggcgaaguuaucgcagcagauccaggucucgggauaaaagccaccgccauaagagagcuaggcguucacgggagcgagagaguuccaacccaagcgacagauggaggcacuga

SEQ ID NO: 61673 - RNA, 591 nt, Artificial Sequence
  derived and/or modified sequence opt3 from RBMX__Homo_sapiens__NP_001158275
augguggaggccgacagacccggcaagcuguucaucgggggacucaacaccgaaacaaaugagaaagcucuugaagcagucuuugguaaguacggcaggauuguugaggugcuguugaugaaagaucgggaaacuaacaagagccgcggguucgccuuuguaacguucgaguccccugcggacgcuaaagaugccgcacgagacaugaauggaaaguuacuguaucacguggaggaaauagucauggaggugcaucuagaaggcaaccguugcccacucguugagauguuuaucuguccgcaggagaugauggguauucugcuuaagaccgccauccaagcugaaauuacacaggugcuggucaucuuggagauaaugcaccaucaccaugaaaucauucucacugugaucaugguaauucccguucacgugaugaccauccaccaggaggauauagcaauugaaauggacauggucgugaucgugacaauucagaucauccaagucgagguuccuaccgagauucauaugagagugaugguaggggauuucgcccacuacggaaggggcgugcugauagacucucaguga

SEQ ID NO: 61674 - RNA, 1179 nt, Artificial Sequence
  derived and/or modified sequence opt3 from RBMXL2__Homo_sapiens__NP_055284
augguggaggccgacagacccggcaagcuguucaucgggggacucaaccuugaaaccgaugagaaagcucuggaagcagaguuugguaaguacggcaggauugucgaaguuuuguuaaugaaagaccgggagaccaauaagagccgcggguucgccuuugugacuuucgaguccccugcggaugcuaaagccgcagcccgagacaugaacggaaagucucuggauggcaaggcuauaaaaguagcacaggccacgaagccagcuuuugaaucaagucguagagguccgcccccuccaaggagccgggggcgccccagauuccuaaggggaacccggggcggcgggggagguccucgccgauccccaucuagaggcgggcccgacgaugacggaggcuauacagccgauuuugaccucaggccuucgcgggcgccaaugccgaugaaacguggucccccuccacgcagaguggggcccccuccaaagagggcagcccccucaggaccggcucggagcaguggcggcgggaugcgaggacgcgcccuggcagucagagguagggauggcuacuccgggccuccccggcgcgagccacuuccucccagaagggacccauaucugggaccccgugaugaaggcuacucuagccgggacgguuauuccucacgagacuacagagagccuaggggguucgcuccaaguccgggcgaguauacucaccgcgauuacggacauagcucugugcgggacgauugccccuugagaggcuacuccgacagggauggguauggaggucgcgaccgagauuacggcgaccaccucucacgggggagccaucgugaaccuuuugagaguuauggagaacugagaggcgccgcgccagguagggggacacccccuucuuacggcggaggcgggcgcuaugaggaauaccggggauauuccccagaugccuacagcgguggcagagacucguacucuuccucauaugggaggagugaucgauacagccgcggacggcacagaguuggcaggcccgaccguggucugucccucucuauggagcgcggguguccgccucaacgggacagcuauucaagaaguggcugcagggugccacgaggaggcgggcgguuaggaggccgccuggagagaggugggggaaggucccgguacuga

SEQ ID NO: 61675 - RNA, 1491 nt, Artificial Sequence
  derived and/or modified sequence opt3 from RBMY1A1__Homo_sapiens__XP_011529738
augguggaggccgaccaccccggcaagcuguucaucgggggacucaacagagaaaccaaugagaaaaugcuuaaggcugucuuugguaaacauggcccuauuagcgaaguucuguugauaaaggauaggacauccaaaucucggggguucgcauuuaucacuuucgagaacccagccgacgcgaagaaugcugccaaggauaugaacggaaaaucauuacacggcaaggcaauuaaaguggaacaggccaagaaaccgaguuuucaaagcggugggcgccgacgucccccugcuuccucuagaaauaggucgccaucaggaagccugcggagugcacgcggcuccagaggcgggacgaggggauggcuacccucucaugagggucaccucgacgauggcggguacaccccugaccugaagaugagcuauucccggggacuuaucccaguaaagcgcggccccucaagucgaagcggugggccuccaccgaaaaagucugcccccuccgcuguggccagaucaaacagcuggaugggaagucagggcccuaugucucagaggcgggagaauuacggcgucccaccccgucgcgcgacaauuuccagcuggagaaacgauaggaugucgacucggcaugacggguaugcaaccaaugauggaaaccacccuucuugccaggaaacacgagacuacgccccacccucccgcgguuaugcuuacagagauaauggccacucaaacagggacgagcauaguagccggggguaucgcaaucacagauccucuagggaaacccgugauuacgccccgccuagccggggacaugcauaccgagacuauggccacucaagaagggacgagaguuacucccgcgguuaucggaacagaaggagcucucgcgagacucgagaauacgcucccccaucacgggggcacggcuaucgugauuacggacauaguagaaggcacgagagcuauucccgcggcuaccggaaucauccuucuucgagagaaacaagggacuacgcgcccccacaccgagauuaugccuaccgcgacuaugggcauagcuccugggaugagcacucaagucggggauacucuuaucacgacgguuacggcgaagcccuggggagagaucauagcgagcacuuguccggaucaagcuauagggacgcacuccaacguuacggcaccucucauggugcucccccugcccgcgggccacggauguccuacggcggaaguacgugucacgcuuauagcaacacuagagauagguacggccgaucuugggaguccuauucaaguugcggggacuuccacuacugugaucgggaacaugugugccgcaaagaccagagaaacccgcccagccugggaaggguucugccugacccacgggaggccugugguucguccucuuauguggcaagcaucgucgauggcggggaaucacgaagugagaagggagacuccucuagauacuga

SEQ ID NO: 61676 - RNA, 474 nt, Artificial Sequence
  derived and/or modified sequence opt3 from RBP1__Homo_sapiens__NP_001124464
auggaucccccugccggcuucgugagagcugggaacccagcagucgccgcgccgcagagcccccuguccccugagggagcucacuuuagggccgcacaucacccacggucuaccgguucacgcugccccggcagucuccaaccuagccgaccacuuguugccaauuggcugcaguccuugcccgaaaugccuguggacuucacaggguacuggaagauguuaguaaacgagaauuuugaagaguaucugcgugcucuagacgugaacgucgcacucagaaaaaucgccaaucugcuuaagccagauaaagaaauugugcaggacggagaucauaugauaaucaggacucugucuacguuccggaacuacauuauggacuuucagguuggcaaggaguucgaggaagauuugaccgguaucgacgaucgcaaauguauggcuggggugcaaucgagagaccucucaagccuguga

SEQ ID NO: 61677 - RNA, 405 nt, Artificial Sequence
  derived and/or modified sequence opt3 from RBP2__Homo_sapiens__NP_004155
augaccagagaccagaacggcacaugggagauggaaagcaaugagaacuucgaaggguacaugaaggcccuggauaucgacuuugcuacuaggaaaauugcagugcggcucacgcaaaccaaggucauagaucaggacggagauaauuucaaaacaaagacuaccuccacauuucgcaacuaugacguugauuucaccguggguguagaguuugacgaauacacuaaaucucuugauaaucgacacgugaaggcccuggucacaugggagggcgacguguugguuugcgugcagaagggggagaaagaaaaccguggauggaagcaguggaucgagggcgauaaauuauaucuggaacuaaccuguggugaccaagucugcagacagguguucaagaaaaaguga

SEQ ID NO: 61678 - RNA, 3744 nt, Artificial Sequence
  derived and/or modified sequence opt3 from RBP3__Homo_sapiens__NP_002891
augaugagagagugggugcugcucaugagcguccuucugugcggcuuggccgggcccacccacuuauuccagccuucccugguucuagacauggcuaaggugcuccuggauaacuacuguuuuccagaaaaucuucugggaaugcaagaggcaauccagcaggccauuaaaucucaugaaauauugucaaucagugacccgcagacacucgcgagcguacugacugcuggugugcaauccucucugaacgaucccaggcucgucauuucguaugagccuucaacgccagaacccccuccacaggugcccgccuuaaccagccugagugaggaggaacuuuuggcauggcugcagcggggccuacgccacgagguucucgaagggaaugugggauaccugcgagucgacuccgugccuggccaggagguacuuucuaugaugggugaguuccugguugcccaugugugggggaacuugaugggaacaagcgcucucguccuggauuuacgucacugcacuggcggccaaguguccgggaucccauauauuaucucauaccugcauccgggaaauaccauacuccacguggacacaaucuauaacagacccaguaauaccacuacagaaauuuggacccuuccucagguccugggugagagguacggcgcagauaaggacguugugguauugacgagcucucagacucgcgggguggccgaagauaucgcucacauucuaaaacagaugcggagagccaucgucgugggagagaggaccggcgguggggcgcuggaccuccggaagcugcgcauaggagaauccgauuucuucuuuacaguuccagugucacgaagccuuggcccccugggcgggggaagucaaacuugggaggguucuggcgucuugccuuguguggggaccccagcagagcaggcccucgaaaaagcucuggccauuuuaacacugagauccgcacuacccggaguaguucauugccuccaggaggugcugaaggacuauuacacccuugucgauagggugccgacguugcugcaacaccucgcuagcauggacuucucgacugucgugucugaagaggaccugguuacaaagcuaaacgccggccugcaggcggccuccgaagauccucgguugcucgugcgugcaaucggucccaccgagacuccaucauggccugcucccgacgccgcugccgaggauaguccagggguagcacccgaacugccugaggacgaagccauucgccaggcuuuagucgauagcguguuucagguuuccgugcugccaggcaaugucggauaccuaagauucgacucuuuugcggaugcaagcgugcucggcguacuggccccguaugugcuuaggcaaguuugggagcccuugcaggacacagaacaucugaucauggaucuccggcacaacccugggggaccaucaagugcugucccccuguuacuguccuacuuccaggguccugaggccggcccagugcaccuuuuuaccacguaugaccgacgcaccaauaucacacaggagcauuucagccacauggaauugcccgggccgagauacucuacucaaaggggaguguaucuccugaccucacaucggacagcaacugccgcugaggaauuugccuuccuaaugcagagucugggcugggcaacccucgucggugagauuacagcggggaaccugcuucacacccgcacuguuccuuugcuggauacgccagagggcagcuuagcucucacagugcccgugcugaccuucauagacaaucauggagaagccuggcuuggcgggggaguagucccugacgcaaucgugcuggccgaggaggcuuuggauaaagcccaggaaguucucgaauuucaccagucccugggugcacuuguggagggcacugggcaucugcucgaggcucacuacgccagacccgaagucgugggacaaaccucugcgcugcuuagggccaaguuggcucagggcgcauaucguacagccguugaccuggagucguuagcuagccagcucaccgccgaucugcaggaaguguccggugaccaccggcuucugguauuccauucaccaggggagcuagucguggaagaggcaccucccccaccgccugcggugcccaguccagaggaacucacuuaccugauugaggccuuguuuaaaacagaaguccugcccggccaauuaggauaccuccgauucgaugcuauggccgagcuggaaacgguuaaggcagugggcccucagcuuguaagacugguguggcagcaauuggucgacaccgcugcccucgugaucgaucugagguauaacccagggucuuacagcacugcaauaccccuacuguguuccuacuuuuucgaggccgagccucgccagcaccuuuauucaguuuuugaccgggcuacaagcaaagugaccgaagucuggacacucccacagguggcgggacagagauauggcucucacaaggaucuguacauuuugaugucccauaccagugguagcgccgcagaggcuuucgcccacacuaugcaagaccugcagagggccacgguuaucggggaaccgaccgcuggaggcgcauuaucuguggguaucuaucaggucggcuccucaccccucuacgccaguaugccuacacagauggcgaugagcgcuacuaccgggaaggccugggaucuggcaggaguagagccagacauuacagugcccaugucggaggcccuuuccaucgcucaagauauuguugcacugcgcgccaaagugccuacugucuugcagaccgcgggcaagcucguggcugacaauuacgccucugcagaacugggggccaaaauggcuacgaagcuaagcggacugcagucacgauauagucggguaacauccgagguggcccuugcagaaauacucggcgcugaccugcagauguugucuggugauccgcauuuaaaagccgcgcacauccccgagaacgccaaggaccguauuccagggaucgucccuaugcaaauccccagcccagaaguuuuugaggagcugauuaaauucuccuuucauaccaacgugcucgaagauaauauaggauaccugagauucgacauguuuggcgauggugagcuucugacucaggugucaagguugcuagucgaacacaucuggaagaagauuaugcacacagacgcaaugaucauugauaugcgcuucaacaucggcgggccuaccagcaguauacccauccugugcucuuauuucuuugacgagggaccaccggugcuccuggauaaaauuuacucccggccugacgauagcguuucggaacuuuggacucaugcucagguagugggcgagagauaugggucaaagaaaucuauggucaucuuaaccaguuccgugacagccggaacggcugaggaauuuaccuacauuaugaagaggcugggccgagcacucguuaucggugaggugacuagcgggggaugucaacccccacagacauaucacgucgacgauaccaauuuguaccugacaauacccacugcccgcucugugggcgccagcgacgguuccucaugggaaggcguaggggucaccccucaugugguugugccagcugaggaagcgcucgcacgggccaaagagaugcugcagcacaaccagcuuagagucaagaggagucccggacugcaagaccauuuguga

SEQ ID NO: 61679 - RNA, 606 nt, Artificial Sequence
  derived and/or modified sequence opt3 from RBP4__Homo_sapiens__NP_006735
augaagugggugugggcccugcuccuucuggcugcauugggcagcgggagagccgagagggacugccgggucuccucuuuccgcguuaaagaaaacuuugauaaggcgcgauucucaggaaccugguacgcuauggccaaaaaggaccccgaggguuuauuucugcaggauaauaucguggcagaguucaguguagacgaaacaggccaaaugagcgccacugcuaaagggcgugugagacuacucaacaauugggaugucugugcagacauggugggaacguuuaccgauacagaagacccugccaaguucaagaugaaauauuggggcguugcuuccuuucugcagaaggguaacgaugaccacuggauuguggauacugacuacgauaccuaugccguccaguacucuugcaggcuucugaauuuggacgggacaugugcggacucguauucauucguguuuagccgggauccaaacggacucccgcccgaggcacagaaaauaguacgccaaagacaggaggaacugugccuggccaggcaguaccggcucaucguucauaauggcuauugugacggccgcagugagcgaaacuuacuguga

SEQ ID NO: 61680 - RNA, 1503 nt, Artificial Sequence
  derived and/or modified sequence opt3 from RBPJ__Homo_sapiens__NP_005340
auggaccacaccgagggcagccccgccgaggaaccuccagcucaugcaccgucccccgggaaguucggagaaagaccuccacccaaaaggcugacacgggaggccaugcgcaacuaccucaaggaacgaggugaucagacugugcuuauccugcacgcgaaagucgcucaaaagucuuauggcaaugagaaaagauuuuucugcccuccacccuguguuuacuugauggggucaggauggaagaagaaaaaggagcagauggaacgugacggcugcagugagcaggaaagccagccuugugccuuuauugguauagggaacuccgaucaagagaugcagcaguuaaaucuggagggcaaaaacuauugcacggcaaagacccuauacaucucugacucggauaaaaggaagcauuucaugcucucagugaagauguuuuauggaaauagcgacgauauuggcguauuccugaguaaacggaucaaggugauuuccaaaccaucuaagaaaaagcagagccuuaaaaacgccgaccuguguaucgcuuccgggacaaaggucgcauuguuuaaucgccucagaucacaaacugugaguaccagguaccugcacguugaaggagguaacuuccaugccagcucucagcaguggggcgccuuuuucauacaucugcucgaugacgaugaguccgaaggggaggaauuuacagugcgggacggauauauccacuacggccagaccgucaaguuagugugcucaguaacugguauggcucugccgcgccuuauuauccgaaaaguugauaagcaaacagcguugcuggacgcagacgaucccgugagccagcuacacaaaugugccuucuaccucaaggacaccgagagaauguaucugugccuuagucaggagaggauuauccaauuucaggcuacgccuuguccaaaagaacccaauaaggagaugauaaacgauggggccucuuggacuauuaucuccaccgacaaggcagaauacacauucuaugagggaaugggcccuguccuggcuccagugacucccgugccggucguugaauccuugcagcucaauggcgggggagauguggccaugcuggaguuaaccggucagaacuucacaccuaaucugcggguaugguuuggcgacguggaggcggaaaccauguaccguugcggggagucgaugcucugugucgugcccgauauuucugccuuccgcgaaggauggagauggguuaggcaaccagugcaggucccugugacgcuuguacggaacgacggcaucaucuauuccacuucacugacauuuaccuacacucccgagccagguccccgaccucacugcagugcagcuggggccauuuugcgcgcuaauagcucccagguuccaccgaacgaaucuaacacaaauagcgagggcucauauaccaacgccaguacgaauagcaccagcgugacaucuucaacugcaaccgucgugaguuga

SEQ ID NO: 61681 - RNA, 630 nt, Artificial Sequence
  derived and/or modified sequence opt3 from RBPMS2__Homo_sapiens__NP_919248
augagcaaccugaagcccgacggcgagcacgggggauccaccgguacaggcucuggggccggaucaggcggugcucucgaagaggaagugagaacucuuuucgucagugggcugccuguugauaucaaaccaagggaguuguacuuacuguuucggccguucaagggauaugaaggcagccuaauuaaacucacggcacgccagcccgugggcuuuguaauauucgacucccgagccggggcggaggcugccaagaaugcacugaacggaauccguuuugauccugagaauccacaaacccuuagacuggaguucgccaaagcuaacacaaagauggcaaagucuaaauugauggccacucccaauccuucgaacgugcauccagcucucggugcccacuuuauugcgagggaccccuacgaucugaugggcgcagcccugaucccugcuucaccagaagccugggcaccguauccccucuacaccacagaauuaaccccugcuauuagccaugccgcguucacuuauccaacagccaccgcagcugccgcugcccugcacgcacagguccggugguaccccaguuccgacacgacucagcagggguggaaguaucgccaauuuugcuga

SEQ ID NO: 61682 - RNA, 2355 nt, Artificial Sequence
  derived and/or modified sequence opt3 from RBSN__Homo_sapiens__NP_001289307
auggccagccuggacgaucccggcgaggugagagaaggguuccucugcccucuuugucugaaggacuugcaguccuuuuaccaauuacacucucauuaugaggaagaacacucaggagaagauagggacgucaaaggucagaucaagagucugguucagaaagcuaagaaagcaaaggaucggcuacucaagcgcgagggcgacgaucgagccgagagcgggacccagggauacgaauccuucucuuauggcgguguggacccauacaugugggagccgcaagaacugggggcgguacguucgcaucuuucagauuuuaaaaagcacagagcugccaggauugaccauuauguggucgaggugaacaaacugauaauccgguuggagaagcucacagcauucgaucgcacuaauacggaaagcgccaaaauuagagcuaucgagaagaguguugugcccugggucaacgaccaggaugugccuuuuugcccagacuguggaaauaaguucuccauuaggaaccggcgccaccacugccgacuguguggcucuaucaugugcaaaaaguguauggaacugauaagccuccccuuagcaaauaaacugaccuccgccucaaaggagagucuuagcacacauacuucuccuucccagucaccaaacagcguacacggcaguagaagggggucuaucuccagcaugucgucuguuuccucaguguuggacgaaaaagaugacgaucggauucguugcuguacccauugcaaggacacacugcuaaaacgcgagcagcaaaucgaugagaaggaacacacccccgacauugucaagcucuacgagaaacugagacuuuguauggaaaagguggaucagaaagcuccugaguauaucaggauggccgcgagucugaaugcaggagaaacuacauacagcuuggagcacgccuccgaccuccggguggagguccagaagguuuacgaacugauagaugcuuuaucuaaaaagauucugacccucggucuuaaccaggacccaccgccccauccuagcaaucugcgauugcaacgcaugaucagauauucagccacgcuauuugugcaggagaagcugcucggccugaugagucuuccaacuaaagaacaguucgaggaacugaagaaaaagaggaaagaggagauggaacggaagcgcgcaguagagagacaagcugccuuggaaucccagaggcgucucgaggagcggcagagcgggcuggcgucucgagccgcaaacggagaaguggcuucauuaagaaggggccccgccccucugcgcaaggcugaggguuggcuaccacucagugggggacagggccaaagcgaagauuccgacccccugcuucagcagauucacaauaucaccucuuuuauccggcaggccaaagcagccggcagaauggacgaggucaggacauugcaagaaaaccugcgccagcuccaggaugaguacgaccagcaacagacugagaaggcuauugaacugucgcgacggcaggcggaggaagaggaucuucagcgugaacaacugcagauguugagagagagggagcucgaacgcgagcgggaacaguucagaguggcaagccugcauaccaggacacgauccuuagacuuucgcgagauagggccguuccaacuggaaccuucacgggagcccagaacccaccuagccuaugcucucgaucugggaaguucuccaguuccuagcuccacggcccccaaaacuccaucacuuagcucuacacagcccaccagggugugguccgguccuccagcagucggccaggagcguuugccgcagaguagcaugccccaacagcaugaagggccuucucugaauccauuugacgaggaagaucucuccucacccauggaggaggccacuacaggaccuccagcugccggcgugagucuggaccccagcgcacgcaucuuaaaggaauacaacccguucgaggaagaggaugaagaggaggaagcgguagcugguaauccuuucauucagccagacucgcccgccccuaaccccuuuuccgaggaagaugagcacccacagcaacggcugucuagcccucuuguucccgggaacccauucgaggagccgaccugcaucaauccuuuugagauggacucagauaguggccccgaagcagaggaaccaauagaggaagaguugcuccugcagcagauugacaacaucaaagccuauaucuucgacgcuaagcagugcggaagacuagaugagguggaaguccugacggagaaucucagggaacugaagcacacccuugccaaacaaaagggcgggacagacuga

SEQ ID NO: 61683 - RNA, 327 nt, Artificial Sequence
  derived and/or modified sequence opt3 from RBX1__Homo_sapiens__NP_055063
auggccgcugcaauggacguggauacccccagcggcacaaacuccggggccggaaagaaaagauucgaggucaagaaauggaaugcgguugcucugugggccugggacaucgugguagauaacugcgcaauuuguaggaaucacauaauggaccucugcaucgaaugucaggccaaccaggcuucugcaacuucagaggaaugcacgguggccuggggugucuguaaucaugcuuuucacuuccauugcauuagucgguggcuuaagacccgccaaguguguccucuggauaaccgagagugggaauuucagaaauacggccacuga

SEQ ID NO: 61684 - RNA, 3378 nt, Artificial Sequence
  derived and/or modified sequence opt3 from RC3H1__Homo_sapiens__NP_001287780
augcccgugcaggccccucaauggaccgacuuccugagcugcccaaucuguacacagacuuuugaugagacgauuagaaagccgauaucccucggcugcgggcacaccgucuguaaaaugugccuuaacaagcugcauaggaaagccugucccuucgaccagacaacuaucaauaccgauauugaauuguuaccuguuaacucugcacugcuacagcucgugggagcccaaguaccagagcagcagcccaucacacugugcucagguguggaagacaccaagcacuacgaggaagcgaaaaagugugucgaggagcuugcucuguauuugaagccucucaguagcgcccggggcguggggcucaauuccacuacacagucuguucugucgcgcccaaugcaacgaaaacucgugaccuuaguccauugccagcugguggaagaggaaggacguauuagagcaaugagggccgcucggucacuuggcgagcgcacgguaacugaguugauccugcagcaccagaacccccaacagcuaagcaguaaucucugggcagccguuagagcuagggguugucaguuucuggggccugccaugcaagaagaggcgcuuaagcugguguugcucgcacuggaagauggauccgccuuaucucggaaaguccugguccucuucguggugcagcgccuugagccacgauuuccgcaggcuagcaagaccuccauaggccauguugugcagcuguuguacagagccucaugcuucaaaguaacaaagagggacgaagauaguagccuaaugcaacugaaggaggaguuucggacuuaugaagcacuccgucgcgagcacgacucucagaucgugcagauugcuauggaagccggccugagaaucgcgcccgaucagugguccucacuucuguacggggaccaaagccacaaaagucauaugcagucuauuaucgauaaguugcagaccccugccuccuucgcacagagcguccaagagcucacaauagcucugcagaggaccggagacccagccaacuuaaaucggcugcgaccccaccuagaacuccuggcuaacauugauccuucgccagacgcucccccgccuacgugggagcagcuugagaaugguuugguggcaguucgcacugugguccauggccugguggacuauauccagaaccacucuaaaaagggggccgaucaacagcagcccccacaacacuccaaauacaagacauauauguguagagacaugaaacagaggggaggcugcccucggggugcuucaugcaccuuugcgcauagucaggaagaacucgaaaaguuccgcaagaugaauaaaagacugguacccaggcguccacuuagcgcaucccuggggcaguugaacgagguuggacuccccucugccgcuauucugccugaugaaggcgccguggacuuaccaagccggaagccgcccgcacugccuaauggcaucgucucaacugggaacacagugacccaacuaaucccacgaggaacggaucccaguuacgacuccagccucaaaccugguaagauugaucaccugucuucaagugccccaggcagcccgcccgaccuuuuggaguccgucccuaaaucuauaucggcucugccagugaauccccauagcaucccucccagagggccagccgaucucccucccaugccaguuaccaagccgcugcagauggugccuaggggaucccaguuauaccccgcacagcaaacagacguauauuaccaggauccacgcggcgcggcucccccuuuugagccagcccccuaucagcaggguauguacuauacuccuccgccacaaugugucucacgguucgugagacccccuccaagugcacccgaaccugccccgcccuaccuggaccacuauccaccuuaccuucaggagaggguugugaacucucaguacgggacccaaccccagcaguauccaccuauuuaccccagccauuaugacggccgccgagucuacccagcuccguccuauacacgggaagagaucuuucgugagucaccuauacccauugaaaucccacccgccgcagugccuagcuacguaccagagucuagagaaagguaucagcaaaucgaguccuacuaccccguggcuccucacccgacucagauucgcccaaguuauuugcgggaacccccuuacagcagacugcccccaccuccccagccacacccuucucuggaugagcuacauaggcgacgcaaggagaucauggcccagcuggaggagcggaaaguuauuuccccgcccccauucgcgccuucacccacccucccaccuacauuccaccccgaagaguuucuggacgaagaucuuaaggucgccggaaaauauaagggcaacgacuacagucaauauagcccguggucgugcgauaccauaggguccuacaucggaacuaaagacgcuaagccaaaggaugugguggcagccgguucugucgagaugaugaauguugagagcaaaggcaugagagaccagagguuggaucugcagcgucgcgcugccgaaacgucagacgaugacuuaauuccuuucggggaucggcccacagugaguagauuuggagcaaucuccaggaccucuaagacuaucuaucagggcgcggguccaaugcaagccauggcuccccagggggccccuaccaaaagcauuaacauauccgacuacucaccguacggcacacauggaggcuggggagcaagccccuauaguccacaccagaauaucccuucucaggggcacuucuccgagcgagaacggauuagcaugucggagguggcuucacaugguaagccccucccuucugccgaacgcgagcaacugagacuugagcugcagcaguugaaccaccaaaucagucagcagacccagcucaggggccuggaacgggaggcaaauacucuagccgggcaaucccagccacccccuccacccccgccuaaauggccaggaaugauuagcucugaacagcugagccucgagcugcaucagguagagcgagaaaucggcaagagaacacgcgagcuuuccauggaaaaccaauguucauuggacaugaagaguaaacugaauacgagcaagcaggcugagaacggucagcccgaaccucagaauaaagucccagcggaggauuuaacccucacuuuuucuuccgacgugcccaacgggucagcccugacacaagagaauauaagucuucugagcaacaagaccuccucucuaaaucucucggaagauccggagggcggaggcgacaacaaugauagccagaggucagggguuacaccuuccagugcacccuga

SEQ ID NO: 61685 - RNA, 516 nt, Artificial Sequence
  derived and/or modified sequence opt3 from RCAN1__Homo_sapiens__NP_001272318
augguguacgccaaguucgagagccuguuuagaaccuaugacaaagauaucacauuccaguacuuuaaguccuucaaaaggguccggauuaacuuuucuaaucccuucucagcugcagacgcccgccuccaacuucacaagacugaauuucugggcaaagagaugaaguuguauuucgcgcagacguuacauauagggaguagccaccuggcuccuccaaacccggauaagcaguuucuaaucucucccccugccuccccacccguuggauggaaacagguggaagacgcaaccccuguaauuaauuacgaucuccuguaugccaucucgaaacuugguccaggcgagaaguacgaacugcaugcugcaacagacacuacccccucaguggucgugcacguuugcgagagcgaucaagagaaggaagaggaagaggagauggaacgaaugcguagaccuaaaccaaagauuauccagacaaggcggccggaguauacccccauacauuugaguuga

SEQ ID NO: 61686 - RNA, 594 nt, Artificial Sequence
  derived and/or modified sequence opt3 from RCAN2__Homo_sapiens__NP_005813
augcccgccccuagcauggacugcgauguguccacccuggucgcuuguguuguggacguagagguguucacaaaccaggaagucaaggagaaauuugaaggccucuucagaacuuacgaugacugcgugacguuucaacuuuucaagucuuuuaggcggguucgcaucaauuucucaaacccaaaaagugcagcccgagcgcguauugagcugcacgaaacccaguuuagagggaagaaauugaaguuauauuucgcucaggugcagacaccggagacugauggagacaagcugcaucuagcacccccucaaccagccaaacaguuucucauaagucccccuuccucuccacccgucgguuggcagccuaucaaugaugccaccccagugcugaacuacgaccuucuguaugcuguagcaaaguugggcccgggggagaaauacgaacuccacgccggaacagagucgacccccucaguugugguccaugugugugauagcgacauugaagaggaggaagauccuaagacuagcccaaaacccaagaucauucagacaaggcggccuggccugccacccuccgugucuaauuga

SEQ ID NO: 61687 - RNA, 1596 nt, Artificial Sequence
  derived and/or modified sequence opt3 from RCBTB1__Homo_sapiens__XP_005266498
augguggacgucggcaaguggcccaucuucacccugcucagcccucaggagauugccuccauaagaaaagcaugcguuuuugggacaucugcuucagaagcccuuuacgugacugauaacgacgagguauucguguuuggacugaauuauaguaacuguuuggguacgggcgauaaucaaagcaccuuagucccaaagaaacuggaagggcuaugcggaaagaaaaucaagucccucucuuacggcucggguccgcacgugcugcuuucaacagaggacgggguuguguaugcguggggacauaacggcuacagccagcugggcaaugggacuaccaaccagggaauugcucccguccagguguguacaaauuugcucaucaagcaaguaguugaaguggccugcgguagucaccauuccauggcacuggccgcugauggcgaggucuucgcauggggguauaacaauuguggacaggugggcucugguagcaccgccaaccagccuacuccaaggaaagugacaaauugccugcacauuaagcgggucguugggaucgcuuguggacagaccuccucaauggccgugcucgacaacggcgagguauacggcuggggguauaauggaaacggucaauuaggccuggggaauaacggaaaccagcuuacgcccgugcgcgucgcggcauugcauagugugugcguuaaucagauaguguguggcuacgcccacacucuggcucuaaccgaugaaggucuccuguacgccuggggcgcaaacacauaugggcagcuuggaacuggcaauaaaaacaaucuguugagcccugcucacaucauggucgagaaggaacgagugguagagauugccgcgugccauucugcccacaccuccgcagcuaaaacacaagggggacauguuuacauguggggucagugucguggccagucagugauccucccacaccugacccacuuuagcugcacggacgaugucuucgccugcuuugcuacucccgccgugaguuggagauuacugucugucgagcaugaagacuuccucacaguggcagagucccuuaagaaggaauuugauagcccugagaccgccgaccugaaauucaggauugaugggaaguauauccacguucauaaagcuguguugaagauacggugugaacacuuucgcucgauguuccaaucuuacuggaacgaggacaugaaagagguaauugaaaucgaccaguuuuccuauccagucuacagagcguuccuacaguaucuguacacugauacaguggaccucccgcccgaggaugcaauuggacugcuugaccuggccaccucauacugcgaaaauagguugaagaaacucugucagcauaucaucaagcggggcauuacgguugagaacgcuuucagucuguuuagcgccgcagugcgcuaugaugccgaagacuuagaggaguucugcuuuaaguucuguauaaaucaccugaccgaagucacacaaacugcugccuuuuggcagauggaugguccucuacucaaagaguucaucgcaaaggcguccaaaugcggggcuuuuaagaacuga

SEQ ID NO: 61688 - RNA, 1671 nt, Artificial Sequence
  derived and/or modified sequence opt3 from RCBTB2__Homo_sapiens__NP_001273759
augagcgcccugcccagagaccucgagcuuuccaacccuagggaaaagcugaccaaaccagugcaggcuacauugucuucauuaaagaugcuggaugucggcaaauggccgaucuucagucuaugcagcgaggaagaacuccaacugauucggcaggcauguguuuuuggguccgccggaaaugaagugcuuuacacuacgguaaacgacgagauauucgugcuggguaccaauugcuguggcugcuuggggcucggagauguccagucuacaaucgagccccgccgacuggacucgcugaacggcaagaaaauugcgugucucucauaugguagcgggccucacaucguguuagcuacuaccgaaggagagguuuuuacauggggccauaaugccuacagucagcugggcaacgggaccacuaaucacggacuugugccaugccauauuuccacaaacuugucuaauaagcaagucaucgaaguggcaugugguagcuaucacucccugguacuaaccucagauggcgagguuuucgccuggggguacaacaauaguggacaggugggcagcgguucuacggucaaccagcccauaccucguagagugacugggugccuccagaauaagguggucguuaccaucgcuuguggacaaaugugcuguauggcagugguagacacaggcgagguguaugucuggggcuacaacgggaauggacagcugggucuuggcaacuccgggaaccagccaacucccugcaggguggccgcucugcaggggauucggguucaacgcguggccugcggcuaugcgcauaccuugguccucacagaugaaggucagguguacgcauggggagccaauucauacggccagcugggaaccggcaacaaaagcaaucaaaguuauccuacgccaguaacuguugagaaggacagaaucauugaaaucgcugccugucacucuacacacaccuccgcagcuaaaacucaagggggacauguguacauguggggucagugcaggggccagagcgucauauuaccgcaccugacacauuuuucguguaccgaugacguguucgccugcuuugcgacgcccgccgucaccuggcggcuccuuucuguggagccugaugaccaccugacaguugcagaauccuugaagcgcgaguucgauaacccagacacugcugaccuaaaauuucugguggaugggaaguauauuuacgcccacaagguacuccugaaaauccgaugugagcauuucagaucaagucuugaagacaaugaggaugacauugucgaaaugagcgaguuuuccuaucccguguacagggcuuuccuggaauauuuguacaccgauucuaucagccucucaccugaggaggccguuggacuguuagaccuggcaacauuuuaccgggaaaaccgucuaaagaaacucugccagcagacuaucaagcagggcauuugugaggaaaaugccauagcucugcuuagugcggcagugaaauaugaugcccaggacuuggaggaguucugcuuccgcuuuuguaucaaccaccugaccgucgugacacaaaccuccgguuucgcugagauggaucaugaccuccugaagaauuuuauuagcaaagccucuagaguaggggcauucaagaacuga

SEQ ID NO: 61689 - RNA, 759 nt, Artificial Sequence
  derived and/or modified sequence opt3 from RCHY1__Homo_sapiens__NP_001009922
auggccgcuaccgcaagagaggacggcgccagcgggcaggaaaggggacaacgggguugcgagcacuacgaucgcggcugucugcucaaggcgcccugcugugacaaacuuuauacaugccgacugugucaugauaacaaugaagaccaccaguuggaucguuucaaggugaaagagguccagugcaucaacugugaaaagauucagcaugcucaacagacuugcgaggaguguuccacguuauuuggggaauacuauugcgacauaugucaccuguucgauaaagacaagaagcaguaccauugcgagaauugcggaaucuguagaauuggcccuaaagaagacuuuuuccacugccuaaaguguaaccucugccuggccaugaaucuucaggguaggcacaaauguaucgagaacguuucucggcaaaauugcccaauuugucuggaggauauccauaccucacgcgugguagcacacguguugccgugcgggcaucuccugcacagaggauauagguguccccugugcaugcacagugcccucgauaugacacgguacuggcgccaguuagacgaugaagucgcucagacuccuaugccaagcgaguaucagaacaugaccguggacauacuguguaaugacugcaacggccgauccacaguucaauuucauauccuuggcaugaagugcaaaauuugugaaucuuacaauaccgcacaggccgggggaagaaggaucucguuggaucagcaauga

SEQ ID NO: 61690 - RNA, 648 nt, Artificial Sequence
  derived and/or modified sequence opt3 from RCL1__Homo_sapiens__NP_001273629
augcccccuggcgggggaggugagguggucuucagcugcccaguuagaaaggugcugaaaccgauccagcucaccgaccccggcaagauuaaaaggauacgggggauggccuacuccguacgcgugucuccucaaauggcuaaccgaaucgucgauucagcacguaguauucuuaauaaguuuaucccagacauuuauaucuacacagaucacaugaaaggagugaacagcggcaagucccccgguuucgggcugucuuugguugccgaaacuacgucgggaaccuuuuuaucagcggagcuggcuagcaauccucagggccagggcgccgcagugcuaccagaagaccucgggagaaacugugccaggcugcuucuggaggaaauauaucggggagguugcgucgauaguacaaaucaguccuuggcucuccugcugaugacucucggccaacaggacgugucuaagguauuacuggggccccuuagcccuuacaccaucgaguucuugcgccaucugaaauccuuuuuccagauuauguuuaagaucgagacaaaaccauguggagaggaacuaaagggcggugauaaaguucucaugaccugcguggggauuggauucucaaaccugaguaagacucuuaaguga

SEQ ID NO: 61691 - RNA, 996 nt, Artificial Sequence
  derived and/or modified sequence opt3 from RCN1__Homo_sapiens__NP_002892
auggccagaggcgggaggggacggcgccugggucucgcucuuggccuguuguuagcacuggugcuagcgccccgaguccuccgugccaagccuaccguuagaaaagagagggugguacggccagacagcgaacugggggagcgcccgcccgaagauaaccaguccuuccaauacgaccacgaggcuuuucuuggaaaggaagauucuaaaacauucgaccagcugacuccugaugagucaaaggagagauugggcaaaaucguggacaggauugauaaugacggugauggguuugucacgaccgaagaacucaagacauggauaaagcgggugcagaaacgcuauaucuucgacaacguugccaagguguggaaagauuacgaccgagauaaggacgacaaaauuaguugggaagaguauaagcaggcaacuuacggauauuaccugggcaauccagccgaguuucaugauagcuccgaccaccauaccuucaagaaaaugcugcccagagaugaaaggcgguuuaaggcugcagaccucaacggcgauuuaacagccacccgugaggaguucacugcuuuucugcacccugaggaguucgaacauaugaaagagaucgucgugcuugaaacauuggaggacauugauaagaauggggacggauuuguagaucaagacgaauauaucgccgauauguucucucacgaggaaaacgguccagagcccgacuggguucugucggagcgcgaacaguuuaaugaguucagagaccuaaacaaagauggcaagcucgacaaagaugaaauaaggcacuggauccugccucaggacuacgaucaugcgcaggcagaggcccggcaccuuguguacgaaucagacaagaauaaggaugagaaacugaccaaggaggaaauuuuggagaacuggaauauguucgucgggagccaagcuacgaacuauggagaagaccucacuaaaaaucaugaugagcuguga

SEQ ID NO: 61692 - RNA, 954 nt, Artificial Sequence
  derived and/or modified sequence opt3 from RCN2__Homo_sapiens__NP_002893
augagacugggccccaggaccgccgcucucgggcuucuguuguuaugcgcagccgcggcuggagccgguaaggcagaggaacugcacuacccucuaggcgagcggcgcagcgacuaugaucgagaagcccuccugggggugcaggaggacgucgaugaauacguuaaacuuggacaugaggagcaacagaagcgucugcaggcuaucauuaaaaagauagacuuggauuccgacggcuuccucacagaaucugagcugucaaguuggauccagaugagcuuuaaacacuaugcaaugcaagaagccaagcagcaguucguggaguacgauaagaacuccgacgauacuguaacgugggacgaguauaauauucagauguacgauagagugaucgacuuugaugaaaacaccgcucuggacgacgccgaggaagagucuuucaggaaacuccauuuaaaggauaaaaagcgguuugaaaaagcgaaucaagacucggguccagggcugucacuugaggaguucauugcauuugaacacccggaggaagucgauuauaugacagaguucgugauccaggaagccuuggaggagcaugacaagaacggagauggcuuuguuagccuggaagaguuccuaggcgacuaccgcugggaucccacugcuaaugaagacccugaguggauacucguggaaaaggauagauuugucaacgacuacgauaaagacaaugacgggaggcuggauccacaggagcuucugcccugggugguaccuaacaaucagggaaucgcccaagaggaagcauugcaccucauugacgagauggaucugaacggugacaagaaauuaagugaagaggagauccuggaaaauccagaucucuuccuuaccuccgaggcuacagacuauggccggcagcugcacgaugacuacuuuuaucaugaugaauuguga

SEQ ID NO: 61693 - RNA, 1458 nt, Artificial Sequence
  derived and/or modified sequence opt3 from RCOR1__Homo_sapiens__NP_055971
augcccgccaugguggagaagggcccugaagucagcgggaaaagaaggggacggaacaaugcugcagccuccgcgucugcugccgcagccucagcugcagccagugcugccugcgcgagcccagcagccaccgcugccuccggugcagcugccucuucggcgucagccgcagcugccagcgcugccgcagccccgaacaauggccagaacaagagucuggcugcggcagcccccaaugggaacuccucuagcaauuccugggaggaaggaucaaguggcucuagcuccgacgaggaacacggugggggaggcaugcgcguuggcccucaauaccaggcugugguaccagauuucgaccccgccaaacucgcacgacguucacaggagagagauaaccuugggaugcugguguggagcccuaaucagaacuugagugaggccaaguuagacgaauauaucgcuauugccaaagagaagcauggauacaauauggaacaagcacuggguaugcuauuuuggcacaagcauaacauagagaaaucucucgcggaucugccaaauuucacacccuuuccugacgaguggacugucgaagauaaggugcuuuucgagcaggcuuuuuccuuccacggcaaaacguuucauaggauccagcagaugcugccagacaagagcauugccucguugguuaaauucuauuacucuuggaagaagacccggacaaaaacuuccgugauggaucgccacgcaagaaagcagaaaagggaacgggaggaaucagaggacgagcucgaagaggccaacgggaauaacccgaucgauauugaagucgaccaaaacaaggagaguaaaaaggaagugcccccuaccgagacaguaccacagguuaaaaaggagaagcacagcacccaggcuaaaaaucgcgccaagcgaaaacccccuaagggaauguuucugucccaagaagauguggaggcagucucugcuaacgccacugcggccacaaccgugcugagacagcucgacauggaauuagugagcgucaaaaggcagauccaaaauauaaagcagacgaacucagcucugaaggagaaacuugacggcgguaucgaaccauaucgguugcccgagguuauucagaaguguaaugcacguuggacuaccgaggaacagcugcuagccgugcaagcuauccgcaaauacgggagagauuuccaggccauuagugacguaaucggaaacaaguccgugguccaggugaaaaacuuuuucguuaauuauaggcggcgauuuaauauagaugaggugcuccaggaaugggaggcagagcauggcaaggaagagacaaacggcccgagcaaucaaaagccugucaaaucucccgacaacucaauuaagaugccagaagaggaagaugaggcgccugugcuggacguacgcuacgccagugcuagcuga

SEQ ID NO: 61694 - RNA, 1251 nt, Artificial Sequence
  derived and/or modified sequence opt3 from RCSD1__Homo_sapiens__NP_443094
auggaggaaagacccgccgagaccaacgcuaauguggacaacagcgcauccccuucugucgcccagcuggcgggcagguuccgggaacaagcugccgcagccaaggagacaccagcuucaaaaccgacucgccgaaagcccccuugcagucucccacuuuuucccccuaaaguugaucuggggcagaauggagaagaaaagagcccacccaacgcaucccacccuccaaaauucaaggugaagucuucgccguugaucgagaaauuacaggccaaucugacguuugaccccgcugcccuacucccuggugcgucaccaaagagccccggccugaaagcaaugguaaguccuuuccauuccccacccucuaccccgagcuccccuggggugcguucaagacccagugaggccgaggaagucccagugagcuuugaucagccucccgagggaucucaccuuccauguuacaacaagguuaggacacggggcuccauuaaacgcagacccccuucaaggcgguuccgccgaagccaaagugacugcggugagcugggggauuuuagagcuguggaaucuucccagcagaauggagccaaggaggaagacggcgaugaggucuugccaagcaagucgaaagcaccgggcucuccccucuccucagaaggggcugccggagagggugugaggacucugggcccugcggagaagccaccccugcggcguaguccuagccgcaccgaaaaacaggaggaagacagagccacagaggaagcaaagaacggggagaaagcuaggcgguccucugaggaaguagauggacaacauccagcccaggaggaaguucccgagagcccgcagaccucaggcccugaagcugagaaucgaugugguaguccacgcgaggaaaagcccgccggggaggaagcagagauggagaaagccacugaagugaagggagagagaguccagaacgaagaggugggcccugaacacgacucccaagagacaaagaaacucgaggaaggcgcugcggugaaggagacgccccauagcccaccugggggagucaaagguggcgauguucccaagcaggaaaaagggaaggagaagcagcaagaaggagcaguguuagagccaggcugcucuccgcagaccgguccugcccagcuggagacuucaagugaaguacagagcgagcccgcugugccaaaacccgaagacgauaccccuguccaagacacaaagauguga

SEQ ID NO: 61695 - RNA, 603 nt, Artificial Sequence
  derived and/or modified sequence opt3 from RCVRN__Homo_sapiens__NP_002894
augggcaacagcaaguccggggcccugucuaaagagauccucgaggaacuucagcugaauaccaaguucucagaagaggaauugugcaguugguaccagagcuuuuuaaaagacugucccacaggaagaauuacucaacagcaguuccaauccauauaugcuaaguuuuucccugauacggacccaaaagcauacgcccagcacguguuuaggucuuucgauucgaaccuggacgguacccuagauuuuaaggaguaugucaucgcgcuccauaugacaacugcuggcaagaccaaucagaaacuggagugggccuucucacuuuacgacguugaugggaacggaacaauuagcaagaaugaagugcuggagaucguaauggcaauuuuuaaaaugaucaccccggaagacgugaaguugcuccccgaugacgagaacacuccugagaaacgggccgaaaagauauggaaguauuucggcaaaaaugaugacgauaagcugacagagaaagaauuuaucgaggguacccuggcuaacaaggaaauucuccgcuuaauccaguucgagccacaaaaagucaaggagaaaaugaagaaugcauga

SEQ ID NO: 61696 - RNA, 588 nt, Artificial Sequence
  derived and/or modified sequence opt3 from RD3__Homo_sapiens__NP_001158160
augagccugaucuccuggcucagauggaacgaagcccccucuaggcuuucaacccggaguccugcugaaauggugcuggagacauugaugauggaauuaacuggccagaugcgcgaggcagaacgacaacagcgugagagaagcaaugccgucaggaagguuugcacggggguggacuacuccuggcuggcgucuaccccacggucgacauaugaucuaucaccgauugagcgccuccagcuggaagacguaugugugaaaauacaccccagcuacugcggaccugcuauccuuagauucaggcagcuguuggccgagcaagaaccagagguccaggaggugagucagcucuuucgguccguucugcaggaagugcuggagcgcaugaagcaagaagaggaagcacauaaacucacucgacaguggucuuuaagacccagggguagccuggccaccuucaagacacgggcucguauuuccccuuuugcaucagauauccgcaccauuagugaggacgucgagagagauacuccacccccucuuaggagcuggucuaugccagaguuccgggccccgaaagcugacuga

SEQ ID NO: 61697 - RNA, 1026 nt, Artificial Sequence
  derived and/or modified sequence opt3 from RDH10__Homo_sapiens__NP_742034
augaacaucguggucgaguucuuuguugugaccuucaagguacugugggccuuugugcucgcugcagccagauggcuugucaggcccaaagaaaagagcguggcgggccagguuugccugauuacaggggcuggauccgguuugggccgguuauucgcccuggaguuugcacgccgacgugcccuacucgugcugugggacauaaauacucaaucuaacgaagagacggcugggauggucagacacaucuacagggaucuugaagcagccgacgcugccgcgcugcaggcaggaaauggcgaggaggaaauuuugccucauuguaaccuccagguguucaccuauacaugcgauguagguaaacgggagaauguuuaccugacugccgaacgcgugagaaaggaggucggggaggugucagugcuggucaacaaugcuggaguugugaguggccaccaucucuuagaauguccagacgagcugaucgaaaggaccaugaugguaaacugccacgcccauuuuuggacaaccaaagcauuccuuccgacuauguuggagauuaaucacggccacaucgugacagucgcuagcucccuggggcuauuuucuaccgccggaguggaagauuauugugcgucgaaguucgguguugugggcuuucaugagucacucagccacgagcugaaggccgcagaaaaagacgggauaaagacgacucuugucugccccuaccugguggauaccggaauguuccggggcugucgcauccgaaaagagauugaaccauuuuugccuccccucaagccugacuauugcguaaaacaggcuaugaaggccauccugacagaucaaccaaugauuuguacucccagauuaauguacaucguuaccuucaugaagaguauacugccuuucgaggcuguggucugcauguauagguuucucggugccgacaaauguauguacccauucauugcacagcggaagcaggccacaaacaauaacgaagcuaaaaaugggaucuga

SEQ ID NO: 61698 - RNA, 957 nt, Artificial Sequence
  derived and/or modified sequence opt3 from RDH11__Homo_sapiens__NP_057110
augguggagcugauguucccccuccuucuguuguuacugccuuuucuacucuacauggccgcuccacagaucagaaagaugcugagcuccggcgucugcaccucuacaguucaacuuccggggaaagugguaguggucacuggagcaaacacggguauuggcaaggaaaccgccaaagagcuggcgcagaggggugcucggguguauuuggccugucgcgacguugaaaagggagagcucguggcaaaagaaauacagacaacuaccggcaaucagcaaguccuggugcgaaagcuggaucucucagacacaaagaguauccgugccuucgcuaaaggguuuuuagcagaggagaagcaucugcacguacuuauuaacaaugccgggguuaugaugugccccuacagcaaaaccgcugauggauucgaaaugcacaucggcgugaaccauuugggccacuuucugcuaacucaucuccugcuugagaagcugaaagaauccgccccuucuagaauugucaaugugucgucauuggcgcaccaccucgggaggauccauuuccacaaccugcagggagagaaguuuuauaaugcagguuuagccuacugucauagcaagcuggcuaacauacucuucacacaggagcuugcccggcgccugaaaggcaguggggugaccacguauuccguccacccaggaacuguucagucugaauuggugagacacagcuccuuuaugagguggaugugguggcuauucucauuuuucaucaagacaccccaacagggcgcacagaccagucugcauugcgcucucacugagggucuggaaauucuuagcgggaaucacuuuucugacugucauguagccuggguguccgcgcaggcccggaacgagaccaucgcacgccgacugugggaugucucaugcgacuugcucggacugccuauugauuga

SEQ ID NO: 61699 - RNA, 951 nt, Artificial Sequence
  derived and/or modified sequence opt3 from RDH12__Homo_sapiens__NP_689656
augcuggugacccucggacuucugacuagcuucuuuuccuucuuguacauggucgcccccucuaucagaaaguuuuucgcugggggaguuugcaggacaaacgugcaguuaccugguaaaguaguggucauuacgggcgcaaauaccgggauaggaaaggagacagcccgggaacuggcgucacgcggcgcucgaguguauaucgccugucgugacguucuaaaaggugagagugcagccagcgaaauuagaguggauacuaagaacucccaaguccucgugaggaaacuggaccuuucugauaccaagucgauccgggcuuuugcagagggguuccuggccgaagagaagcaguugcacauucucaucaauaacgcuggaguaaugaugugcccauacucaaaaacagccgacggcuuugagacccaucugggcguuaaucaccuggggcauuuccucuuaacuuaucugcuuuuggaacgccugaaggugagcgcgccggcaagagucgugaacgugaguuccgucgcccaccauauaggaaaaauccccuuucacgaucuacagucugagaagagguacagccgggguuucgcuuauugucacuccaaacucgccaauguucuguuuacacgcgaacuugcaaagcgacugcagggcaccggggugacgacuuacgcuguacauccuggaguggucagaucagaguuggugaggcacaguagccuccugugcuuacuguggcgucucuucucuccauuuguuaagaccgcccgggagggcgcgcaaacaucccuucauugugcccuggcagaagguuuggagccccuaucagggaaauauuucagcgacugcaagcgcacuugggugaguccuagagcuaggaacaauaaaaccgccgaacggcuguggaacgucucuugugagcuccugggcauucgaugggaauga

SEQ ID NO: 61700 - RNA, 1011 nt, Artificial Sequence
  derived and/or modified sequence opt3 from RDH14__Homo_sapiens__NP_065956
auggccguggcuaccgcagccgcgguccuggcugcccucggcggggcacuuuggcuggccgcuagaagguucguuggaccccgggugcagcgcuugcgacgugguggcgacccuggguuaaugcacggaaagacaguacugaucacuggcgcaaacagcggucuagggagagccacggcugccgagcuccugaggcuuggagcgcgggugauuaugggcugccgcgauagagcaagggccgaagaggcugccggccaacugcggcgcgaauugcgacaggcagcugagugugggccagaaccgggagucuccggugugggcgagcucauaguuagagagcuggaccuggccucucucaggucagugcgggcguuuugccaggaaauguuacaggaggaaccccgucuggauguccuuaucaauaacgccgggauuuuccaauguccuuacaugaaaaccgaggacggauuugagaugcaguucggcgugaaucauuugggucacuuucugcuaacaaaccuccugcuugggcuguugaagaguagcgcaccaucccgcaucguaguugugucuucgaaacucuauaaguacggagauauuaauuucgacgaucugaacucagaacagagcuauaauaaaaguuuuugcuacuccagaucuaaguuagcuaacauccuguucacuagggagcucgcccggcgacuugaaggcaccaaugucacagugaacgugcugcaucccggcauaguccgcaccaauuuggggagacacauccauauuccucuacugguuaagccacucuuuaaccuggugagcugggcuuucuuuaaaacucccguagagggagcccagacauccaucuaucuugcaucaaguccugaaguggagggugucagcggcagguacuucggggacuguaaggaggaggaacuguugccaaaagccauggaugaaucuguggcucggaagcucugggacauuuccgagguuauggugggacuguuaaaauga

SEQ ID NO: 61701 - RNA, 954 nt, Artificial Sequence
  derived and/or modified sequence opt3 from RDH16__Homo_sapiens__NP_003699
auguggcuguaccucgccguguucgucggccuuuauuaccuguugcacugguauagagagaggcagguuuuaagccaucugcgggacaaguacguguuuaucaccgggugcgauuccggauucgguaaacuacucgcucgccaacuggacgcacgaggccuucguguacuggccgcguguuugacagaaaagggggcugagcagcucagaggacagacuucugauaggcuggaaacggugacccuggacgucacaaaaacugagucaguggccgcagccgcucaguggguuaaggaaugcgugcgggauaaaggccucugggguuuagucaacaaugcagggauuagucugcccaccgccccuaacgagcuuuugacaaagcaagacuuugugaccauacuggauguaaaucuacucggaguuaucgacgugacucugagccuucugccauugguccgcagagcuaggggccggguggugaacgucuccucuguuaugggccgcgugucgcuguucgggggagguuauuguauuucaaaguacggcguagaggccuuuagcgauagucugcgaagagaauuauccuauuucggggugaaagucgcgaugaucgagccgggauacuuuaagacagcagugaccucuaaagaaagguuccucaagagcuuucucgagauuugggaccgguccucacccgagguuaaagaagccuacggcgagaaguucguggcugauuauaagaaaagugccgaacagauggagcagaagugcacgcaggaccuuagccuggucacuaauuguauggaacacgcauugaucgcuugccauccucguacccgcuacucugccgguugggaugcgaaacuacuguaucucccaauguccuacaugcccacauuucugguggacgccauaauguauuggguaucaccuagcccagcaaaggcucuuuga

SEQ ID NO: 61702 - RNA, 957 nt, Artificial Sequence
  derived and/or modified sequence opt3 from RDH5__Homo_sapiens__NP_002896
auguggcugccccuccuucugggcgccuuguuaugggcugugcuguggcuacucagagacaggcagagccugccugcauccaacgccuucgucuuuaucaccgggugcgauucuggauucggucggcuucuggcguugcaacucgaccagcgcggcuuucgaguucuggcuucaugucugacaccaaguggggccgaggaucuccagcguguggcaagcuccagauuacacacuacgcugcuugacauuaccgauccgcagucuguacaacaggccgcuaaguggguggaaaugcaugucaaagaggcaggauuguucggccuggugaauaacgccgguguugcugggauaaucggacccacaccuuggcuaacuagggacgauuuucagcgggugcucaaugucaacaccaugggcccaauuggcgugacacuggcccuucugcccuugcuccagcaagcgcgcgggagaguaaucaauauuaccucgguucugggaagguuagcagccaacgguggcggguacugcgugucaaaguucggacuggaggcuuuuagcgacagucuccggcgcgaugucgcccacuucggcauccgaguguccauaguggaaccuggguuuuucagaacuccagucacaaaucuugaaucucuggagaaaaccuugcaggcauguugggcuaggcuacccccugccacgcaggcgcauuaugguggagccuuucugacuaaguaccucaaaaugcagcaacggaucaugaaccugauuugcgacccagaucuuaccaagguuagccguugucuggagcacgcauugacagcucgccauccgagaacuagguauucccccggcugggacgccaagcuccugugguuaccugcuucauaccugccagccagucuaguggaugcaguacucaccugggugcugcccaaaccugcccaggcugucuauuga

SEQ ID NO: 61703 - RNA, 996 nt, Artificial Sequence
  derived and/or modified sequence opt3 from RDH8__Homo_sapiens__NP_056540
augaacggccagagccaagugcugcccgggggaggucacgaguccagagaaggcaucaauauggccgcugcaccuaggaccguccucauuucugggugcucaaguggaauaggccuugagcuggccguucaguuggcgcaugacccaaagaaacgguaccaggugguagcuacaaugcgcgauuuagguaagaaagaaacucuggaggccgcagccggggaagcucuaggacagacgcucaccguggcacaacuggacgucuguagcgaugaguccguggcccagugccuuucuuguauccagggcgagguugacgugcuggucaacaaugcuggcaugggguuggugggaccgcucgaaggucugucgcuggccgcgaugcagaacguauucgauacaaacuuuuucggcgcaguucgacucgugaaggccgucuuacccgggaugaaacguagaaggcaaggacacauuguggugaucucaagcgucaugggccugcaggguguuauuuuuaaugacguguaugcugccaguaaguucgcacuugagggguuuuucgaauccuuggcuauccagcugcuacaguuuaauauauucaucucucucguagagccuggaccaguggucacugaguuugaaggcaagcugcuugcccaagugagcauggcggaguuccccggcaccgauccugaaacacugcauuacuuucgggacuuguaucucccagccucccgcaaacuguucugcucaguugggcagaacccccaggaugugguccaagcaauugugaauguaaucaguagcaccagaccuccauuaaggcggcagacuaacauucgcuacucuccgcugacaacccucaagacgguugacuccucaggaagccuuuaugugcgaacuacccacagacuguuguuuagguguccccggcuacugaaucucggucugcagugccuuaguuguggcugccugccuacacguguccgcccaagauga

SEQ ID NO: 61704 - RNA, 711 nt, Artificial Sequence
  derived and/or modified sequence opt3 from RDM1__Homo_sapiens__NP_001030008
auggccgagcuggugcccuucgcugucccuaucgaaagcgacaagacccuccuuguuugggagcuguccucuggcccaacagcagaagccuugcaccauucauuauuuacugcguucagucaguuugggcugcuauacagcgugagaguauucccgaacgcugccguggcacaccccggauuuuaugccgucauuaaauucuacuccgcuagggcagcccaucgggcucaaaaggccugcgaucgcaaacagcucuuucagaagucuccugugaaaguucgacuggguacgcgucacaaggcggugcagcaucaagcacuugcccugaacucgucaaagugucaggaguuggcuaauuauuacuucggcuuuaaugggugcagcaaaagaauaaucaagcuccaggaacugagugaccuggaggagagggaaaacgaggauuccauggucccacuccccaaacagucuuuaaaguucuuuugugcccuggaagugguacuuccuagcugcgacugucgguccccaggaauuggcuugguugaggagcccauggauaaaguggaagaggguccucugucauuccuaaugaagcgcaagaccgcacaaaaacucgcuauccagaaggcccugagugacgcguuucagaaacuucugauugucguguuggggaagacagugcucaucauacuggaagucuuacaguuccaauga

SEQ ID NO: 61705 - RNA, 1815 nt, Artificial Sequence
  derived and/or modified sequence opt3 from RDX__Homo_sapiens__NP_001247421
augcccaagccuaucaacgugagagucaccacaauggacgccgagcuggaguucgcuauucagccaaauacuacgggcaaacaacucuuugaucagguugugaagaccguagggcuuagggaggugugguucuuuggacugcaguacgucgacagcaaagguuauuccacaugguugaaguuaaacaaaaaggugacucagcaagauguuaagaaagaaaauccgcugcaguucaaguuucgggcaaaauucuuucccgaggacgugucugaagaacuaauacaggagaucacccagcgccucuucuuucugcaagucaaggaagccauucuuaacgaugagaucuacugcccuccagaaacagcggugcuguuggcuucauaugccguacaggcaaaauacggcgacuauaauaaggagauucacaagcccggguaccucgccaacgaucgacugcugccucagcguguucucgagcagcauaaauuaaccaaggaacaaugggaggaaagaauccagaauuggcacgaggaacauaggggaaugcugcgggaggacaguaugauggaguaucuuaaaauagcucaggauuuggaaauguacggcgugaacuacuucgagaucaagaauaaaaaggguacugaacuguggcuaggggucgacgcacucggacugaacauuuaugagcacgaugacaaacuuacaccaaagaucggcuuucccuggagcgaaauucgcaauaucuccuucaacgauaagaaauuugugauaaagccuauugacaaaaaggccccagacuucguguucuacgcuccgagacugaggaucaauaaacggauuuuggcccucuguaugggcaaccaugagcuguauaugcgccgaagaaagcccgauaccaucgagguccaacagaugaaggcgcaggcaagggaagagaaacaccagaagcaauuagaacgggcccagcuggagaaugaaaagaagaaacgugagaucgcugagaaggaaaaggagcgcauugaaagagagaaagaggaacucauggagaggcuuaagcagauagaggaacagacgaucaaagcccaaaaggaacuggaggagcagacucggaaagcauuggaacuagaccaggagcgaaagcgcgcuaaggaagaggccgaaagacuggagaaagagaggcgggcggccgaagaggcaaagucugcuauugccaaacaggcugccgaucaaaugaagaaccaggaacagcucgcagccgagcuggcugaauuuaccgcgaaaaucgcacuucuggaggaggccaagaaaaagaaggaagaggaagcuacagaguggcagcacaaagccuucgcagcccaagaggacuuggaaaagacuaaagaggaacucaagaccguuaugucggcuccuccacccccuccacccccgccugugauacccccaacagagaacgaacaugaugagcacgacgagaauaacgccgaagcaucagcggagcugagcaaugaagggguaaugaaccaucgcagugaggaagagagagugaccgagacgcagaaaaaugaaagggucaagaagcaguuacaagcucuguccucugagcuagcccaggcacgugaugaaacuaaaaagacacagaacgacgugcuccacgccgagaauguuaaagcuggacgggauaaguacaaaacccugcgacagauuagacaagguaacacuaagcagaggaucgacgaauuugaggccauguggggcccuaaacuuuaugcauuguuccagaugcgcagcugccaguccucaaucaaacaaauguga

SEQ ID NO: 61706 - RNA, 1644 nt, Artificial Sequence
  derived and/or modified sequence opt3 from REC8__Homo_sapiens__NP_001041670
auguucuacuaucccaacgugcugcagagacacaccggcugcuuugccacaaucuggcucgcugcaacuagggggagccggcuugucaagcgcgaguaccugcgaguuaaugugguaaaaacgugugaagagauuuugaacuauguguuaguccgugugcaaccuccacagccgggacugcccagaccuagguucucccuauaccucucugcccagcugcagauagguguuauccggguguauucacaacagugccaguaccuugucgaagacauucagcauauccuggagcgcuugcacagagcgcaacuccagauuaggaucgauauggaaaccgagcugccaagucugcucuuacccaaucaucuggcuaugauggagacacuugaagacgccccugauccauuuuucggcaugaugagcguggacccccgguugccuuccccauuugauauaccgcagauccgccaccuccuagaggcagccauucccgaacgaguagaggagaucccuccagaaguucccacugagccuagagaaccagagaggauucccgugaccguccucccgccugaagcuaucacaauacuggaggcagagcccauucggaugcuugaaaucgagggggaacgugagcugccagaagugucucgcagagaguuggaccuccugauugccgaggaagaggaagcuaucuuacuggagaucccuaggcugcccccacccgccccugcggaaguggagggaauuggcgaggcacuugguccagaagaacugcgguugaccgggugggaaccgggagcccuacugauggaggucacucccccugaggaacuccgacugccagcucccccuucgccagagcgcagacccccgguuccuccacccccuaggcggcgcagaaggcgucggcuucuguucugggauaaggaaacacagauaucacccgagaaauuucaagaacaguugcagacccgagcccauuguugggagugcccaauggugcaaccucccgagagaacgaucaggggcccagcagaacucuuccgcacuccgacccugagcggcugguuaccucccgagcugcuagggcucuggacacacugugcucagccacccccuaaggcccugcggagagaacuuccagaggaagcggccgcagaggaggaaaggcgcaaaauugagguacccagugaaaucgaggugccucgagaggcuuuggagccguccgucccacugauggugucucucgagauaagccuggaagccgcugaggaagagaagucccggauuucacuuauucccccugaggaacguugggccuggccagagguugaagcacccgaggccccugcucugccggugguccccgaauugccagaggugccuauggagaugccccucguacugccaccugaauuagagcugcuaagucucgaagcgguucacagagcaguggcccuggagcuucaggcuaacagggaacccgacuuuagcucuuuggucuccccacugucaccgcgccggauggccgcaagaguguucuaucuccuguuaguccugagcgcccagcaaauccuucaugugaagcaggagaaaccuuacggaagguugcucauccagcccgguccacgauuucacuga

SEQ ID NO: 61707 - RNA, 2916 nt, Artificial Sequence
  derived and/or modified sequence opt3 from RECK__Homo_sapiens__NP_066934
auggccaccgugagagcuagccugaggggcgcacuccuucuguuguuagccgucgcggggguugcugagguggccggaggucuggcacccggcuccgccggggcucuaugcuguaaccacucuaaggacaaucagaugugccgggauguaugugaacaaaucuucucaaguaaaagcgagucccgccucaagcaucugcuucagcgagcaccugacuacugcccagaaacaaugguggagauuuggaacuguaugaacucuucgcugccgggagucuuuaaaaagucagauggcuggguggguuuggggugcugugaacucgccauagcucuggagugccgucaggccuguaaacaggcgagcaguaagaaugacaucuccaagguuugcagaaaagaguaugaaaaugcacuguucucuuguauuagcaggaacgagaugggauccgugugcugcucauacgccggccaccauacuaauugucgggaauauugccaagcuaucuuucgcacggauaguagccccggcccuucucagauuaaggccgucgagaacuacugugcauccaucucaccacagcucauacacugcgugaauaacuauacccagagcuaccccaugagaaauccuacagacaguuuauauuguugcgauagggcugaggaccaugccugucaaaacgcgugcaaacggauccugaugucuaagaaaacugaaauggagauuguagaugggcuuaucgaaggauguaagacccagccauugccccaggacccucuguggcagugcuuccuagaguccagccaaucgguucacccaggugugacaguccacccgcccccuucuaccggccucgauggggccaagcugcauuguugcuccaaagcaaauacuucaacaugccgcgaacuuuguaccaagcuguacaguaugagcuggggaaacacgcaguccuggcaggaguuugaccgauucugcgaguacaauccaguggaagugucuauguugacuugucucgcugaugucagagagcccugccaacugggcuguaggaacuuaaccuauugcacaaacuuuaauaaccggccuacugaacuguuccguagcuguaaugcccagucagaccagggugcuaugaacgacaugaaacucugggagaaggggaguauuaaaaugccauuuaucaauauacccguucuugauauuaagaaaugccagccggaaauguggaaggccaucgcauguucccugcaaauuaagccuugccacagcaaaucucgcggaucaaucaucuguaagagugacugcguggagauuuugaaaaagugcggcgaucagaacaaauuccccgaggaccauaccgccgaaagcauaugugagcuacuguccccaacagaugaccucaagaauugcaucccucuggauaccuaccuuagacccucuacgcugggcaacauuguagaagaggugacucacccauguaaucccaacccuugcccagcuaaugaauugugugaggucaacaggaaggggugcccgucgggagaccccugucucccuuauuuuugcgugcaggguuguaaacugggcgaggcgagcgauuucaucguucggcaggggacauuaauacaagugccauccucagcaggagaagucggcugcuacaagauuuguaguugcggucagucugggcugcuagagaauugcauggaaaugcacuguaucgaccuccagaaaagcugcaucgugggcggaaagcgaaaaucccauggcaccucauuuagcauugauuguaacguaugcucuuguuucgccgggaaucugguuugcuccacucgccuuuguuugagugagcacagcucugaggacgacagaaggacauucaccggacugcccugcaacugugcugaucaguuugugccugucugcggucaaaacggccggacguauccauccgccuguaucgcacgcugcguggggcuccaggaccaucaguucgaauuuggaucaugcaugaguaaggaucccuguaauccgaacccuugccagaagaaucaaagauguauuccaaaaccccaggucugccugaccacauucgacaaguuuggcuguagccaguacgagugcgugccuaggcaacuugccugugaucagguucaggaccccgugugcgauacugaccacauggaacauaacaaucuguguaccuuguaucagcgugguaaaucgcucuccuacaaggggccaugccaaccuuucugucgggcuacagagcccguaugcggccacaacggagaaacuuacucuagcgucugcgccgcauauucagaucgaguggcgguugacuacuauggcgauugucaggcuguggggguccugagugagcacuccucuguggccgagugcgcaagcguaaaauguccauccuuacuggccgcuggaugcaagccgauaaucccucccggugccuguugcccacuaugugcaggcaugcucagagugcuguuugacaaggaaaaacuugauaccauugcuaagguuacaaauaaaaagcccaucaccgucuuggagauccugcagaaaauuaggaugcaugugucagugccucagugcgacgucuucggguacuuuagcauagaaagugagaucguuauucucaucauuccaguggaccacuaucccaaggcccugcaaaucgaagcguguaacaaagaggccgagaagauagaaucuuuaaucaauuccgauagcccuacucuggcuucgcaugugccgcuuucagcauugauuaucucucagguacaggucaguuccagcgugccaucugccggaguucgcgcucggcccagcugccacucccuccugcuaccucugucacucggccuggcccuucacuugcuguggacguacaacuga

SEQ ID NO: 61708 - RNA, 1308 nt, Artificial Sequence
  derived and/or modified sequence opt3 from RECQL5__Homo_sapiens__NP_001003715
augagcucccaccauaccacauuccccuuugacccugagagaagggugcggucuacucugaagaaagucuucggcuuugauucauucaagacgccacuccaggaaagugccaccauggcuguugugaaagggaacaaggacguauuugugugcaugccgacaggagcagguaaaagccuuuguuaccaacugcccgccuuguuagcgaagggcaucacuauugucguguccccucugauagcucuaauccaggaucagguugaccaccuccugacccuuaaggugcgcgucucuucgcugaacucaaaauugagcgcccaggagcgaaaggaacuccuggcagaucuggagcgugaaaaaccacaaacaaagauucucuauaucacccccgagauggccgcuaguuccucuuuccagccuacuuuaaauagccugguguccagacaucuuuugucauaccugguaguugacgaggcacacugcgugagucagugggggcaugauuuuaggccagacuaucuacggcucggagcccugcgcagcagacuuggccacgcucccugugucgcccugacagcgaccgcaacgccucaggugcaagaagauguguucgccgcuuugcaccucaaaaagccagucgccauuuuuaagacuccgugcuucagggcaaaucuguuuuacgacguucaguucaaagaguuaaucucugaucccuaugguaaccugaaggacuuuugucucaaagcucuugggcaggaagccgauaagggacuguccggcugcggcauaguguacugucggacccgcgaggcgugcgagcaguuggccaucgaacuaucaugucgagggguaaaugcaaaggcuuaucaugccggacugaaagcuagcgagagaacacucgugcaaaacgacuggauggaagagaaagucccugugauuguugccacuaucaguuucgguaugggcguggacaaggcaaaugucagguucguggcccacuggaacauugcuaagucuauggcgggguacuaccaggaauccggacgggcaggccgugaugguaaaccaagcuggugccgccuguauuacucgagaaaugacagggaucagguaucuuuucuuauccggaaggagguugccaaacugcaagagaagcgagggaacaaggcuuccgacaaagccaccauaauggcauucgaugccuuggugacauuuugugaggaacucggacgcuggggcagaggccaugggaagucacugagggcugccuggugcagucaggucgugagccggcacgcagaauuauga

SEQ ID NO: 61709 - RNA, 1950 nt, Artificial Sequence
  derived and/or modified sequence opt3 from RECQL__Homo_sapiens__XP_006719196
auggccagcguguccgcucugaccgaggaacucgacucuaucacaucagagcuucacgcagucgaaauucagauacaagagcugacugaaagacagcaggaguugauccagaagaaaaagguuuuaacgaaaaagauuaaacaaugccuggaggauagugacgccggcgcgagcaacgaauacgauuccucucccgcugccuggaauaaggaggacuucccuuggucggggaaggugaaagauauccuacagaacguauuuaagcucgaaaaauucaggccacugcagcuugagaccauuaaugugacaauggcaggaaaggaggucuuucuggugaugccgacugguggcgggaaaucauuguguuaucagcuccccgcccugugcagcgacggauucacccugguuaucuguccucucauaaguuuaauggaagaucaacugauggugcuuaagcaguugggcaucuccgcuacaaugcugaacgcaucuagcuccaaggagcaugucaaaugggugcacgccgaaaugguaaauaagaacucagagcuaaaacucauuuacguuaccccagaaaagaucgcuaaaaguaagauguuuaugagccggcuggagaaagccuaugaggcgcgccgauucacucguauugcaguggacgaaguccauugcuguucucaguggggucacgauuuuagacccgacuacaaggcccuugggauccugaagaggcaguucccuaaugcuuccuugauaggacucacagccaccgcaacgaaccaugugcugacugaugcucaaaagauuuuaugcaucgagaaguguuuuaccuucacagccucauuuaaucggccaaaccuguauuacgaagugcgccagaaacccagcaauacugaggacuucauugaagauaucgucaagcucaucaacggcagauauaaaggccagagugggauuauauacugcuuuucucaaaaggacuccgagcagguuaccgugagccuucagaaucugggaauccacgcgggugccuaccacgcaaacuuggagccugaagacaagacaaccguacauaggaaauggucggcuaaugagauucagguggucguggccacgguugcuuucggcauggggaucgauaagccagacgugcgguucgucauacaccauucuauguccaaaucaauggaaaacuauuaccaagagaguggacgcgccggccgagaugacaugaaggcagauuguauucuauauuacgguuuuggggacaucuucagaaucagcuccauggugguaauggaaaacguuggacagcagaaacuguaugagauggugucuuacugccagaauauuagcaaguguaggcggguccucauggcccaacacuuugaugagguguggaacucagaggcuugcaauaagaugugcgacaacuguugcaaagauagugcguucgaacguaagaauaucacugaauauugucgcgaccugauuaaaauacuuaagcaggcagaggagcugaacgaaaaauugacaccgcucaagcugaucgauuccuggaugggcaagggcgccgcuaaauuaagagucgccggggugguugcacccacccugccuagggaggaccuagaaaagauuaucgcccacuuucucauccagcaguaccugaaagaggacuacagcuucacugcuuaugccacaauuucuuaccuuaagauaggaccaaaagcaaauuugcugaacaaugaagcgcaugcuaucaccaugcaagugacgaagucaacccagaacaguuuucgggccgagagcucccagacaugccacucugagcagggugauaaaaagauggaagagaaaaauucgggcaacuuccagaaaaaggcagccaauaugcuccaacagagcggguccaaaaacacuggagcuaagaaacgaaagauugacgaugccuga

SEQ ID NO: 61710 - RNA, 627 nt, Artificial Sequence
  derived and/or modified sequence opt3 from REEP1__Homo_sapiens__NP_001158202
augcagaaggugcugagcaacggccaaaccgaggaagucagauccgggucuaggcucaucuucggaacacuuuaccccgccuauuacucauauaaagcuguuaagaguaaagacauuaaggaguacgugaaauggaugauguauuggauaaucuuugcacuguucacuacggccgaaaccuuuacagauauuuucuugugcugguuuccuuucuacuaugaguuaaagaucgcguuuguagcuuggcugcuaagcccauacacuaaggguuccucucuccuguaccggaaauucgugcacccgacccuuucgucaaaggaaaaagagauugacgauugucugguccaggccaaggaccgcagcuaugaugcauuggugcauuuuggcaaacgagggcucaauguugccgcuacagcagccgugauggcugccaguaagggacagggcgcgcuguccgagcgucugagaucuuucagcaugcaggaccucaccacuaucaggggugauggggcacccgccccuuccggaccacccccuccaggcucaggccgggcuagugggaagcacggacaacccaaaaugagccgcucugccuccgaaucagcaagcaguucugguacagcuuga

SEQ ID NO: 61711 - RNA, 765 nt, Artificial Sequence
  derived and/or modified sequence opt3 from REEP2__Homo_sapiens__NP_001258732
auggugagcuggaucauuuccagacuggucguucucauauucggcacccuuuaccccgccuauucuucauacaaggcugugaaaacaaagaacguaaaagaguaugugaaguggaugauguacuggaucgucuuugcauucuuuacuacggccgaaacccugacagacauuguguugaguugguucccuuuuuauuucgaguuaaaaaucgcguuuguuauuuggcugcuaagcccauacacuaagggguccucugugcucuauaggaaguucguccacccgacccugucgaauaaagaaaaggagaucgaugaauacauaacacaggcucgggacaaaucauacgagaccaugaugcgcgugggaaagcgaggucuuaaccuggccgcaaaugccgcuguaacugcagccgcuaaaggccaagggguuuugagcgagaagcuccguaguuuuuccaugcaggaucugacacugaucagagacgaagaugcccuccccuuacagaggccugacggacggcugcgcccaucucccggcagccuuuuggauaccauugaggaccugggugaugacccugcgcuaucccucagaucaaguacgaacccagcagauagcaggacugaagccucugaggacgauaugggggacaaggcucccaaacgggccaagccuaucaaaaaggcaccaaaagcugagccgcuggccuccaagacccuuaaaacacgccccaagaagaaaacuucaggaggcggcgacagcgcguga

SEQ ID NO: 61712 - RNA, 768 nt, Artificial Sequence
  derived and/or modified sequence opt3 from REEP3__Homo_sapiens__NP_001001330
auggugagcuggaugaucuccagagccgucguucugguguucggcaugcucuaccccgcuuauuacucuuauaaggcaguaaaaaccaagaacgugaaagaguacgucagguggaugauguauuggauuguguuugcccuuuacacaguuauagaaacuguggcggaccagacggucgcuugguucccucuguauuacgaguugaagaucgccuuugugauuugguuacugucaccauacaccaaaggggcaagucuaaucuaucggaaguuccuccacccgcugcuuagcuccaaggaacgcgagauugaugacuacaucguacaagccaaagaacgaggauaugagacaaugguuaauuuuggucgucagggccugaacuuggcugcaacugccgcugugaccgccgcggucaagucucagggggcaauaacagagagacucaggucguucucaaugcaugaucugaccacuauccagggagacgaacccgugggccaacggccuuaccagccacugcccgaggccaaaaagaaaagcaagccugcuccaagugaauccgccgguuaugggauuccccucaaggauggagacgagaaaacagaugaggaagcagagggcccuuacucugacaaugaaauguuaacccacaagggccugcgcagaagccaguccaugaaaucagugaagacgacuaaagggaggaaggagguccgguauggaagucuuaaauacaagguuaagaaacgcccacagguguacuuuuga

SEQ ID NO: 61713 - RNA, 570 nt, Artificial Sequence
  derived and/or modified sequence opt3 from REEP5__Homo_sapiens__NP_005660
augagcgccgcuaugagagagagguucgaccgguuucugcacgaaaagaacugcaugaccgaucuccuugcaaaacuggaggccaagacaggcgugaaucgcuccuucaucgcguugggggucauuggauuaguugcucuguaccuaguguuugguuauggcgccucucuccuguguaaccuuauaggguucggauaccccgcauauaucucaauuaaagccaucgaaaguccuaauaaggaggacgauacucaguggcugacguacuggguaguguauggcgucuuuagcauugcugaguucuuuuccgacaucuucuugucuugguuuccauucuacuauaugcucaaaugcgguuuucugcugugguguauggcaccgucgcccucaaacggggccgaacucuuauacaagcgaauaauccguccuuucuuucugaagcaugagagccaaauggauagugugguuaaagaccuuaaggauaaagcuaaggaaaccgccgacgcgauuacaaaagaggcaaagaaggccacugugaauuugcugggagaagagaaaaaguccaccuga

SEQ ID NO: 61714 - RNA, 555 nt, Artificial Sequence
  derived and/or modified sequence opt3 from REEP6__Homo_sapiens__NP_612402
auggacggccugagacagaggguggagcacuuccucgaacaacggaaccuugucaccgagguucugggggccuuggaagcuaagacaggaguggagaaacgcuacuuagcagccggugcgguaacucugcuaagccucuaucugcuuuuuggcuacggggcuucccuguugugcaaucucaucggauucguguaucccgccuacgcaucuauuaaggccauagaaucaccuaguaaagaugacgauacggucuggcugaccuauugggugguuuacgcucuguuuggccucgcagaguucuuuagcgacuuacugcuuuccugguucccauuuuauuacguggguaagugugccuucuugcuguuuugcauggcuccgcgacccuggaacggggcccuaaugcucuaccagcgugucgugagaccucuguuccuuaggcaucacggagcgguagaucggaucaugaaugaccugucuggccgcgcauuggaugccgcugccggcauuacaagaaacguuaaaccaucgcagacuccccagccuaaggacaaguga

SEQ ID NO: 61715 - RNA, 501 nt, Artificial Sequence
  derived and/or modified sequence opt3 from REG1A__Homo_sapiens__NP_002900
auggcccagaccagcuccuacuucaugcugaucucuugccucauguuucuuucacaaagucagggccaggaggcucagacagaacugccccaagcaagaauuagcuguccugaggggacuaacgccuauagguccuacugcuauuacuucaaugaagaccgggagacguggguggaugcggacuuguauugucagaacaugaacucuggaaauuuagucucgguucugacccaggcugaaggugccuuuguggcaucacuaauaaaggagagcggcacagaugacuucaauguauggaucgggcuccacgauccgaaaaagaaccgccgauggcauuggaguuccggaucucuggugagcuacaaauccuggggcauuggugccccaucaagugucaaucccggguauugcgugagccuuacuucuuccaccggauuucagaaguggaaagacguuccuugugaggauaaguucucauuugugugcaaguucaaaaacuga

SEQ ID NO: 61716 - RNA, 501 nt, Artificial Sequence
  derived and/or modified sequence opt3 from REG1B__Homo_sapiens__NP_006498
auggcccagaccaacagcuucuuuaugcugaucuccucucucauguuccuuucacugagucaaggccaggagagccagacagaauugcccaauccuagaauuuccugcccagaggggacuaacgcuuacaggucuuauuguuacuauuuuaaugaagacccggagacguggguggaugcagacuuauacugccagaacaugaacucgggaaaucuggucucaguucuaacccaagccgaaggugcguucguggcuagccucauaaaggagaguuccacagaugacucuaauguauggaucggccugcacgaucccaaaaagaaccggcgcuggcauuggagcuccgggucacuugugaguuauaaaagcugggacacuggaucuccuuccucagccaaugcaggcuacugugccagccugaccaguugcucugguuuuaagaaauggaaggaugaguccugugaaaagaaauucagcuuugucugcaaguucaaaaacuga

SEQ ID NO: 61717 - RNA, 528 nt, Artificial Sequence
  derived and/or modified sequence opt3 from REG3A__Homo_sapiens__NP_620355
augcugcccccuauggcccucccaagcguguccuggaugcuucugucuugcuugauguuacugucacagguccaaggcgaggaaccgcagagagagcuacccagugcuaggauccgguguccuaaggggagcaaagcauacggaucccacugcuaugcccucuuccugucuccaaagucguggaccgacgcggaucuugcuugucagaaacgccccucagguaaccugguuagcguguugaguggcgccgaaggguccuuuguaucuagccucgugaaguccauuggaaauucauacaguuaugucuggauaggccugcaugacccuacacaggguacugagccaaacggggaaggaugggaguggucuagcuccgaugugaugaauuacuucgcaugggagcgaaaccccucaacgaucagcaguccuggccacugcgccucucugucccguagcaccgcuuuucucagauggaaagacuauaauuguaacguuagguuaccauacgugugcaaguucacagauuga

SEQ ID NO: 61718 - RNA, 1647 nt, Artificial Sequence
  derived and/or modified sequence opt3 from RELA__Homo_sapiens__NP_001138610
auggacgagcuguucccccucaucuuuccugccgaaccagcucaggcaagcggcccguacguggagauuauagaacaacccaagcagagagggaugagguuccgguauaaaugcgagggacgcuccgccgguucuaucccuggcgaacgaucaaccgauacaacuaagacgcacccaaccauuaaaaucaacggguacacaggacccggcacuguccguauuagucuuguuaccaaggacccuccacauagaccccacccucaugagcugguggguaaagauuguagggacggguuuuaugaggcggaauugugcccagaucgguguauccacagcuuccagaauuuaggaauacagugcguaaagaagcgcgaccuggagcaagcuaucucccagaggauucagacaaacaauaacccguuucaggaggaacaaagaggcgauuacgaccuaaaugccgugcggcucuguuuccaggucaccgugcgcgaucccucuggccgaccucugagacuuccacccguucugucgcauccuaucuuugacaacagggcaccaaauacugccgaguugaaaauuugccgggugaaccguaauucagggagcugucucggaggugaugaaaucuuccugcugugcgacaagguccagaaagaggauauagaaguguauuuuacaggccccgggugggaggcucgcggaaguuucucccaggcagacguacacagacaaguugccauuguguuuaggaccccgccuuacgcugaccccucucuccaggccccaguccgggugagcaugcaguuacgacgcccuuccgauagagaacugucagagcccauggaguuccaauaucuuccagacacggaugacaggcaccggaucgaagagaagcgcaaaagaacuuacgaaaccuuuaagaguauuaugaagaaaagccccuucucuggcccuacagauccaaggccgcccccucgucggaucgcggugccaucccgaucaagcgcaaguguccccaagccugccccacagcccuacccguucacuucuuccuugagcaccaucaacuaugacgaguuuccuacaaugguuuucccaucgggucagauuucucaggcuuccgcccuggcacccgcuccuccccaagugcuaccacaggccccugcgcccgccccagcaccggcuaugguaucagcccucgcucaggccccugcacccgugccaguccuggcccccgggccuccacaggcuguggcgcccccugcaccgaaaccaacccaagccggagaaggcacgcuuagugaggcucuguugcagcuccaguuugaugacgaggaucugggcgccuuacuggggaauagcacugaccccgcaguuuucacagaucucgccuccguggacaacucugaauuucagcaacuucugaaucagggaauaccugucgcuccacauaccacugagcccauguugauggaauacccugaggccaucacaaggcuagugaccggugcacagagaccgcccgacccagcgccugcuccccugggcgccccagggcucccuaacggacugcuuagcggcgaugaagacuucucaaguauugcagauauggacuuuuccgcccuguugagccagaucucuucauga

SEQ ID NO: 61719 - RNA, 1740 nt, Artificial Sequence
  derived and/or modified sequence opt3 from RELB__Homo_sapiens__NP_006500
augcugagaagcggccccgccuccgggccuucugugccaaccggaagggcuaugccgucacggcgcgucgcacgacccccugccgcgccagagcucggugcucuuggcagucccgaccugagcuccuugucuuuagccguuucgcguucaacagaugaacuggagaucauugacgaauacauaaaggagaacggguucggacuagauggcggucagccugggccaggagaaggccuccccagacuggugagcaggggcgcagccagucuuuccacuguaacgcuggggccuguggcuccaccggcaacacccccuccauggggaugccccuugggucggcucgucucuccugccccaggccccgggccgcaaccucaccuggugaucaccgagcagcccaaacagcgcggaaugagauuuagguaugagugugaaggccggagcgcugguuccauucugggggagucaaguacugaagccagcaagacccucccagcgaucgaguuacgcgacugcggaggccugcgagagguugaagugacagcaugucuugucuggaaagauuggccucauagagugcacccccauucuuugguaggcaaggacugcaccgaugggauuuguaggguucggcugcguccacacgugucccccagacauucauucaauaaccuaggaauccagugcguccgcaaaaaggagauagaagccgcuaucgagaggaagauucaacucgguaucgacccuuacaaugccggcagccugaaaaaccaccaggaaguggauaugaaugugguccggauuuguuuucaggcaaguuaucgagaccagcaagggcagaugcgcagaauggauccaguucuuucugagccgguguacgacaagaaauccacuaacacaagcgagcugaggaucugccggauaaauaaggaaucgggacccuguaccggcggugaggaauuguaucuccugugcgauaaaguacagaaggaggacauuucuguggucuucucccgcgcuucaugggaagggagagccgacuuuagucaggcggaugugcacaggcaaaucgccauuguuuucaagacgccuccauacgaggacuuagagaucguggaacccgucacugugaacguauuucugcagcgucucaccgauggcguuuguagcgagccucuuccauucacauaucugccccgggaccaugauuccuacggaguggacaaaaagcgaaaaagaggcaugccggaugucuugggggaacuaaauucuagcgacccucacggaaucgagucaaagaggcgcaaaaagaaaccagcaauucuggaucauuuucuccccaaccacgguaguggcccuuuccugcccccauccgcccuucugccugaccccgacuuuuucagcgggacugugucuuugccaggacucgaaccgccuggcggucccgaucuguuagacgauggguuugccuacgacccaaccgcucccacacuguucaccaugcuagaucuccugccuccagcucccccucacgcaucagccgucgugugcaguggcggagcuggcgcgguugugggggagacgccgggaccagagccccuuacuuuggacagcuaucaggcaccugguccaggcgaugggggaacagccucccugguaggcucuaauauguuccccaaccauuaccgggaagcugccuuuggugggggccuccugucgccuggaccggaggcaaccuga

SEQ ID NO: 61720 - RNA, 1764 nt, Artificial Sequence
  derived and/or modified sequence opt3 from REL__Homo_sapiens__NP_001278675
auggccagcggcgcuuacaaccccuauaucgaaauuauagaacagccuagacaaagggggaugcgguuccgcuacaagugcgagggacgauccgcagguucuaucccaggcgaacacucaaccgacaauaaccguacauauccgaguauucagaucaugaauuacuaugggaaaggaaaggugagaauuacucuggucacgaaaaacgaucccuacaagccucauccacacgaccucguuggcaaagauuguagggacgguuauuacgaggccgaauuugggcaggagcggcgcccccuuuucuuucagaaucugggaaucagaugcgugaagaagaaagagguaaaggaagcgauaaucaccaggauuaaagcuggcaucaacccuuucaaugugccagagaagcaauugaacgauauugaagacugugauuuaaaugucgugcggcugugcuuucagguuuuccuacccgacgagcauggcaaccucacaacugcccugccuccaguggucagcaauccgaucuacgauaaccgcgcacccaauaccgccgagcuucgaauauguagagugaacaaaaauugcggguccguaaggggaggugacgaaauuuuucuguugugugauaagguucagaaggacgauaucgaggugcgguucguccucaacgacugggaagcuaaaggcaucuuuucucaggcagacgugcaccgucaaguggccauugucuucaagacaccuccauauugcaaagcuaucaccgagcccguuacugugaagaugcagcugcgcagaccuucggaucaggaaguaucagagagcauggacuuuagguaccugccagaugagaaagacacauaugggaacaaggccaaaaagcagaagaccacgcucuuauuccaaaaacugugucaggaucaugugaauuuucccgaacggccgcgaccuggacuuuugggcaguauuggugaggggcgcuacuucaagaaagaacccaaccuguucucccacgacgcggucgugagagagaugccaacuggaguuucuagccaggcagaauccuauuacccuucacccggcccaauaaguagcggccuaucucaccaugccuccauggcuccccucccuucaagcaguuggucuuccguggcccacccaaccccgaggagcgggaauacaaacccccugucgucuuuuuccacucggacccuuccuucaaauagucaaggaaucccacccuuccugcgcauuccugucgguaacgauuugaaugcaagcaacgcuugcaucuauaauaacgccgacgauauagugggcauggaggcguccucuaugccaagcgccgaccucuacgggauuucagaucccaauaugcugaguaacuguuccguaaauaugaugacaaccagcucugacucaaugggagagacggacaacccgagauuacugaguaugaaucucgaaaacccuagcugcaacuccguucuugauccaagggaccugcgucaguugcaucagaugucuucgagcuccaugucagcaggcgcuaauaguaacacuacaguguuugucucucagagcgaugccuucgaggguuccgacuuuucaugcgcugauaauagcaugaucaacgaaucugggcccuccaauaguaccaacccuaauagccacggcuucgugcaagacucucaguacuccggaaucggcucaaugcagaacgagcagcuaagugauagcuuucccuaugaguucuuucaagucuga

SEQ ID NO: 61721 - RNA, 10383 nt, Artificial Sequence
  derived and/or modified sequence opt3 from RELN__Homo_sapiens__NP_005036
auggaaaggagcggcugggccaggcagaccuuccugcucgcacuucuguugggggcuacuuuacgggcccgcgcggcugccggauacuauccccgauuuuccccuuucuuuuuccugugcacucaccauggugaacuagaaggcgacggggaacaaggagaggugcucaucucucugcacauugcaggcaacccaacguacuaugucccgggucaggaauaccacguuaccauaucaacaaguacauuuuucgaugggcuucuggugaccggauuguauacuagcaccuccguacaggccucucagucgaucggcggcucaagcgcuuuuggguucggaauuaugagugaccaccaauuugguaaucaguucauguguuccguggucgcaucucaugugagccaccuccccacuacaaaccuguccuuuaucuggauugccccuccagcuggcaccgggugcguuaauuucauggccacggcgacucaccguggacaggugaucuuuaaagaugcacuggcccagcaacucugugagcagggcgcucccaccgacgucacagugcauccucacuuagccgagauacauucagauaguaucauucugagagacgauuucgacagcuaccaccagcuucaguugaacccaaauaucuggguagaaugcaacaauugugagacuggugaacaaugcggggcaauuaugcacggaaacgcuguuaccuucugugagcccuauggcccuagggagcugaucacaaccggccuaaauacgacuacagccucugugcuccaguuuuccauagggucaggaagcugccgguucaguuacucugauccauccauuaucguccuguacgcgaaaaacaauagcgccgacuggauucagcuugaaaagauccgcgcaccgucgaacgugucuaccaucauucauauacuguauuugcccgaggaugcuaaaggugaaaaugugcaauuucaguggaagcaggagaaccucagagucggcgaaguuuacgaggccuguugggcucuggacaauaucuuaauuaucaacuccgcccacagacaggugguacuggaggauucacucgacccuguggacacugggaacuggcuuuucuuuccaggagcaacagucaaacauaguugccaaagcgauggcaauuccauauauuuccacgguaacgaagggucugaguuuaauuucgccaccacgcgggacguggaucugagcaccgaagacauucaggagcaguggucagaagaguuugagagucagcccacaggcugggauguuuugggagcugugaucggcacugaaugugggaccaucgaguccggacuaagcauggucuuccugaaggacggugaacgcaagcucugcacaccuucuauggauacuaccggcuacgggaaccugcgauuuuauuucgugaugggaggcauuugcgacccagguaauucacaugagaacgauaucauucuuuacgcgaaaauagaagggagaaaggagcacaucacacuggacaccuugaguuauagcuccuacaaaguacccucucucguuucgguggucauuaauccggagcugcaaacuccugcaacgaaguuuuguuuaaggcagaaaaaccaccagggccauaaucggaacgugugggccgucgauuucuuccacgugcugcccguucuaccaagcacaaugucccauaugauccaguuuucaaucaaucucggaugcggcacccaccaaccugggaacagugugucucuggaguucagcacuaaucacggacguuccuggucacuuuugcauaccgagugucugcccgaaauuugcgcugguccacaccucccccauagcacaguauacucuuccgagaacuauaguggcuggaaucgcauaaccaucccucugccaaacgccgcacuuacuagaaacacaaggauucgguggcgacagacggggccgauccugggaaauaugugggccauugacaacgucuacaucggccccagcuguuugaaguuuugcucuggucgcgggcaguguaccagacacggcugcaagugugacccuggauucuccggcccagcuugcgagauggccucacagacuuuucccauguucauaagugagagcuuugggucguccaggcucucuagcuaucauaauuucuacucaauccggggagcagaggugaguuuuggcugugguguucuggcguccgggaaggcuuuaguguucaacaaggauggacgcagacaacugauuacaucuuuucuagacagcucccagucaagguuccuccaguuuacccugcgucuuggcagcaaaagugucuugucuacaugccgggccccugaucaaccaggugaaggcgugcugcuccacuauuccuacgacaaugggaucacuuggaagcuguuagagcacuauagcuaccugucguaccaugaaccccgaauuaucucaguagagcuuccgggagaugcaaaacaguucggcauacaguucagaugguggcagccuuaucacucuagucaaagggaggacgugugggccauugaugaaaucauuaugaccuccguuuuguuuaacagcaucucucucgacuucacgaaucuggucgaggugacccagagccuaggguuuuaccugggaaacgugcagccauauugcggccaugauuggacacucuguuucacuggugacuccaagcuggcuucaaguaugcgcuacgucgaaacccagagcaugcaaauaggggccucuuauaugauccaguuuucccuuguuaugggaugcggccagaaauacacaccccacauggauaaucaggugaaguuggaguauucaacuaaccauggucugaccuggcacuuagugcaagaagagugucucccuaguaugcccagcugccaggaguucacguccgcaucuauuuaccacgcuucggaauuuacacaguggcggagaguaaucguccugcuuccacaaaagaccuggagcucagccacuagguuccgcuggucccagaguuacuauacagcgcaggacgagugggcccuggauucuauuuacaucggccagcaauguccuaauaugugcagcgggcauggauccugugaccacggcauaugccgaugugaccagggguaucagggaaccgaaugccaucccgaggcugcauugccaucaacuauuaugucugauuuugaaaaccagaauggcugggagagcgacuggcaagaggugaucgguggggaaaucguuaaaccggagcagggauguggcgugauuaguuccgguagcucucucuacuucucaaaggccggcaaacggcagcuggucuccugggaucuagacaccaguuggguggauuuuguucaguucuauauccaaauugggggagaaagcgcuucgugcaacaagccugacucucgugaggagggcgugcugcuccaguacuccaauaacgggggaauacaguggcaucugcuugccgaaauguauuucagcgauuuuucaaaacccagauucguauacuuggagcugccagcagcggccaagacucccugcacgagguuucgcugguggcagccugucuucaguggcgaagacuacgaucaaugggcuguggacgauaucauuaucuuaucugagaagcagaaacagauuaucccagugauaaaccccacccucccucaaaauuuuuaugaaaagccggccuucgacuacccaaugaaccagauguccgucuggcugaugcuugcaaaugaggguaugguuaaaaacgagacuuuuugugcugccacacccagcgcaaugaucuucgggaagucagauggagaccgguuugccgugaccagagaccugacacuaaaaccuggcuauguacuccaguucaagcugaauauuggcugcgcuaaccaguuuaguagcacugcgccaguguugcugcaauacucccacgaugccgggaugucuugguucuuagucaaggaaggauguuaucccgcaagcgcugguaaaggcugcgagggaaauuccagggaacucucagagccuaccauguaccauacgggagacuuugaagaguggacacgaaucaccauugugaucccgcgcucucuggccaguucgaagacucgguucagauggauacaggagagcuccucucagaaaaacguucccccauucggccuugaugguguguauauuucagaaccuugucccagcuacugcuccgggcacggagacuguaucaguggcgucugcuuuugugaucugggcuacaccgccgcucaggggacaugcgugucuaauguuccaaaccauaaugagauguucgacagguuugaaggaaaguugagcccucucugguauaaaaucacuggugcacaagugggcaccggguguggaacacugaacgauggcaagucacuauacuucaauggucccgggaagcgugaggcccgcacggucccacuggacacccggaacauuagacuuguacaguuuuauauacagaucggauccaaaacaaguggcauuacaugcaucaagccgaggacccgaaaugaaggccucauugugcaguacagcaacgauaacgggauccuguggcacuugcugcgggaguuagacuucaugucuuuucucgagccucaaauaaucuccauugaucugccccaggacgcgaaaacuccagcuacagccuuccgcugguggcagccccaacauggaaagcacucagcacagugggcccuugacgauguucugaucgguaugaaugacagcucgcagaccggcuuucaggauaaauucgacgggucuauugauuugcaagcuaacugguauagaauccagggaggccagguggacauagauugccucaguauggacacggcacugauuuuuacugaaaauaucgguaagccuagguacgccgagaccugggauuuccacgucuccgcgagcacauuucuacaguucgaaaugucaaugggguguuccaaaccauucucuaacagccauagugugcaacugcaguauucccuuaauaacggaaaggacuggcaccucguaaccgaggagugcgugcccccuacuaucggcugucugcauuacacagaaagcucuauuuacaccucagagcgguuucagaauuggaagcgaaucacagucuauuugccguuaaguacuauauccccaagaacccgcuucagguggauucaggcuaacuacacgguuggcgccgauagcugggcaaucgacaauguggugcuggccucugggugccccuggauguguucgggacgugguauuugcgaugcuggccggugugucugcgacagaggguuuggaggcccuuauugugugcccguuguaccacucccuucaauccugaaagacgauuucaacgguaaucuucaccccgaccuguggccagaaguguacggggccgagaggggaaacuugaauggcgaaacaauaaagagcggcaccucccuaauuuuuaaaggggagggacugcgcaugcucaucagucgagaucuggacugcacuaacaccauguauguccaauucucucuuagauuuaucgcaaagagcacaccugagcggucccacucaauuuuacugcaguucaguaucucugguggcauuacuuggcaucucauggaugaauuuuacuucccgcagaccacgaauauauuguuuaucaacgugccccugccauauacagcucagaccaaugccacuagguuccgccucuggcaaccuuacaacaacgggaaaaaggaggaaauuuggaucguugacgauuuuaucauugacggaaauaacgugaauaaccccgucaugcugcuugauacauucgacuucggcccacgugaggauaauugguuuuucuacccuggugggaacauaggccuguauugucccuacagcuccaagggagcgccggaagaggacucagccaugguguuuguaagcaaugaggucggcgaacacucuaucaccacuagagauuugaacgugaaugagaacacaauuauccaguucgaaauuaauguugggugcuccaccgacaguagcucggcagacccagugcggcuagaguuuuccagggauuucggagcuacguggcaucugcucuuaccucugugcuaucacucuucaagccaugucaguucccuuuguucuacugaacaccaccccagcucaaccuacuaugccgguacaaugcagggcuggcgccgagaggugguucauuuugggaaacugcaccucugcggauccgugagauuccggugguaccaaggcuuuuauccagcugguagucagcccgucaccugggcaaucgacaacguguacauagggccucagugugaggaaaugugcaauggccagggaagcuguaucaacggcacaaagugcauuugugauccgggguacucuggacccacuugcaaaaucucaaccaagaauccagacuucuugaaagaugacuuugagggucaacuggaauccgauagguuccuccugaugagcggcgggaagccuucucgcaagugugggauucuuaguucgggcaacaaccuauuuuucaaugaggacggucugagaauguugaugacgagggauuuagaccugucccaugcccgguucguacaguuuuucaugcgucucgggugcggcaaaggagugcccgauccucgcagccagccaguucugcuucaguauucacugaacggcgggcucucuuggagcuugcugcaagaguuucuauucuccaauaguucaaacgucggacgauacaucgcccuggaaauaccccucaaggcuagaucuggcagcacaaggcuucggugguggcagccuuccgagaauggucacuuuuauaguccaugggugauugaccagauccugauugggggaaacaucagcggcaauacuguguuagaagacgauuucaccacauuggacucccgcaaauggcugcuccaccccgguggcaccaagaugccggucugugggucuacuggagaugcgcugguauuuauagagaaagcaucaaccagauacgugguuagcacagacguggccgucaacgaagauucguuccuucagaucgacuuugcugccuccugcagugugacggauucuugcuaugcaauugagcuggaguacagcguugaccucggcuugucauggcauccucuggugagggauuguuuaccaacuaaugucgaaugcucccgguaucaccuacaacgaauccuggugucugacaccuucaacaaguggacaagaauuacccucccccuuccuccauacacucgcagucaggccacaagguuucgguggcaucagcccgcuccguucgauaagcaacagaccugggcgaucgacaauguauacauaggggauggauguauugacaugugcagcggccacggucguuguauccaggggaacugcgugugugacgagcaguggggaggccuguauugcgaugacccugaaacguccuugcccacucaacugaaagauaauuuuaacagagccccaucaagccagaauuggcucacaguuaacgguggcaagcugucuaccgucuguggggcaguggcuaguggaauggcccuucauuucuccggcgggugcagcaggcuccuggugaccgucgacuugaaccugacuaaugcagaguucauccaguuuuacuucauguauggauguuuaauuacaccuaacaaucgcaaccagggcguucuacuggaauacucagugaauggugggaucaccuggaaccuccuuauggagauauuuuaugaucaauacucuaaacccggauucguaaauauucuguugccacccgacgccaaggagaucgcuacacgguuucgaugguggcagccuagacacgauggccuggaccagaacgauugggccauugacaaugugcucaucuccggcucggcggaucagaggacugucaugcuggacacguucagcagugcaccagugccgcaacacgaacgcucucccgccgacgcugggccuguuggacggauagccuuugauauguucauggaggacaaaaccuccgugaacgaacauuggcuuuuucacgaugacugcacagucgagagauucugugauagcccagacgguguaauguuaugcggcucacaugaugggcgugaaguguaugcuguuacucacgaccugacccccacagagggauggaucaugcaguuuaagauuagugugggcugcaaagucuccgagaagaucgcacagaaucaaauucaugugcaguacagcaccgauuucggugucucuuggaacuaccucgugccucaguguuugccagccgaccccaagugcucagggagcguuucccagccuucuguguuuuucccgacuaaaggauggaagaggaucacguauccacugcccgaaagucuaguaggcaauccugugcgguuccgcuuuuaccaaaaauauucggauaugcagugggcuauugacaacuucuaccugggccccgggugucucgauaauugccgaggacacggugacugucuuagagagcagugcaucugugacccaggcuauagcgggccuaacugcuaccugacccacacauugaagacuuuucugaaagaaagguucgauuccgaggagauaaagcccgaccucuggaugucacuggaaggaggcucuaccuguacagagugcgguauuuuagccgaagauaccgcacuuuauuuugggggaagcacuguccggcaggcgguuacacaagaccuggaucuccgcggcgccaaguuccuacaguacuggggcagaaucgggagugagaacaauaugacguccugucauaggccaaucugccgaaaagaaggagugcuguuggacuacucaaccgaugguggcauuacuuggacacugcuccacgagauggacuaucagaaguacauaucuguccggcaugauuauauccuucugccggaggacgcuuugaccaacaccacacgucugagaugguggcagccuuuugugauuagcaaugggaucguaguguccggaguugaacgcgcccaaugggcacucgauaacauuuuaaucggcggugcugagauaaaucccagucagcugguggacacuuucgaugacgaagggacgagccacgaggaaaacuggucuuuuuacccaaaugccgucaggaccgcaggauucugcggcaaccccucauuucaccuuuauuggccuaauaaaaagaaagacaagacacauaacgcccuguccagccgggagcuaaucauucagccaggcuacaugaugcaguucaagaucguggucgggugugaggcuacaaguugcggagaucuccacucugugaugcuggaauauaccaaagacgcgagauccgauucguggcaauugguucagacacagugucugcccagcucauccaauucuauugguugcaguccuuuccaauuucaugaggccaccaucuacaacagcguaaauucauccagcuggaagcgcauaacuauucagcucccggaccacgugucuaguuccgcaacgcaguucagguggauccagaaaggcgaagagacagaaaagcaaagcugggcuaucgaucaugucuacauuggggaggccuguccaaaacuuugcucaggacacggcuauuguaccacuggugccauaugcaucugugacgagucuuuucagggggaugacugcucgguguucagccacgaucugcccuccuacauuaaggacaacuuugaaagugcacgaguuaccgaggcuaauugggaaacaauccagggaggcgugauuggcucuggguguggacaguuagccccuuaugcgcauggugauucacuguacuucaacggcugccaaauccggcaggcugccacuaagccauuggaccucaccagagcaagcaaaauaauguuuguccugcagaucggguccaugagucagacagacucuugcaacagcgaucuauccggaccccacgccguggacaaggcuguacuucugcaauauucagugaauaacggcauuacguggcauguuaucgcacagcaccagccuaaagauuucacccaagcccagagggucagcuacaaugugccccucgaggcgcgcaugaagggugugcuguugcguugguggcagccacggcacaacgggacuggacaugaccagugggcucuggaucacgucgagguugugcucguaucuacaagaaaacaaaauuauaugaugaacuuuuccaggcagcauggccuucgccacuucuacaaucgacggagaaggagucugcgcagauacccguga

SEQ ID NO: 61722 - RNA, 897 nt, Artificial Sequence
  derived and/or modified sequence opt3 from REM1__Homo_sapiens__NP_054731
augacccugaacacagagcaggaagccaagacuccccuccacagaagggcuagcacgccucuuccacuguccccgcggggccaucaacccgggcgcuugucuaccgugccuucaacacagagucagcacccacgauuaggacagagcgcaucccugaaucccccuacucaaaaaccaucucccgccccugacgauuggucgucagagagcagugacuccgaagguucuugggaggcgcuauaccgugucguucuccugggcgauccaggggugggaaagaccagccuugcuucccuguucgccggcaaacaggaaagagacuugcaugagcagcucggugaggauguauaugaaaggacacugaccguggacggggaggauacuacacuggucgugguugacaccugggaagcagagaagcucgauaaaucauggagucaggagagcugcuuacaaggaggcucugccuacgugaucgucuauuccauugcugaccggggcucauuugaaagcgcaagugagcugcgcauacagcuuagaaggacgcaccaggccgaucaugugccgaucauuuugguagggaacaaggcugaccuggcccggugucgcgaaguuucuguggaggaaggacgagcgugcgcagucguguucgauuguaaguuuaucgagacuuccgccacccuacagcacaauguggcugaacucuucgagggugucguuagacaacugaggcuucggcgucgcgacagcgccgcaaaagagcccccugcuccaagaaggcccgccucgcuggcgcagcgggcccgacgcuuuuuggcaagacucacagcuaggucugcccggcgcagagcucugaaggccagguccaaaucaugccacaacuuagcagugcuguga

SEQ ID NO: 61723 - RNA, 1284 nt, Artificial Sequence
  derived and/or modified sequence opt3 from RENBP__Homo_sapiens__NP_002901
augagcaagggccugcccgccagacaggacauggagaaagaaagggagacccuccaggcuuggaaggaacggguggggcaagagcuugaucgcgucguugcauucuggauggaacacucccaugaccaggagcacggaggcuuuuucacaugccugggucgagaggggcguguguacgaugacuugaaauauguaugguuacagggaagacaaguguggauguacuguaggcuguaucggacuuuugaacgcuucagacaugcccagcuacucgaugcggcuaaggccggcggugaguuucugcuuagguacgcacgggucgccccuccagggaaaaagugcgcuuucgugcugacgcgcgacggacgaccgguuaaggugcagagaaccaucuuuucugaauguuucuauacaauggcaaugaacgaguuguggagggccacuggcgagguccgguaccagaccgaagcuguggagaugauggaucaaauuguacacuggguucaggaagacgccucaggccucgggcguccccagcugcagggagcgccugcagccgagccaauggcugugcccaugaugcugcucaauuuagucgaacaacugggugaggccgaugaggaacuugcaggcaaauaugcugaguugggggacuggugcgcccgcagaauacugcagcaugugcagagggauggacaagcggugcuagaaaacgucagugagggcgguaaggaacucccugggugucugggacggcagcagaauccaggccacacacuugaggccggcugguuucuguugcgacacugcauccgcaaaggggaccccgagcucagagcacauguuauugauaaguuccuguuacugccuuuucacagcggaugggacccagaccaugguggccucuucuacuuucaggaugcugacaacuucuguccgacccaacuugaaugggccaugaaacugugguggccccacuccgaggcuaugaucgccuucuugaugggguacucugauucgggagacccugugcuacugaggcucuuuuaucagguagcagaauacacuuuccggcaguuucgcgauccagaguauggcgaaugguucgguuaccugucaagagaggggaagguggcccuuagcauuaagggcggacccuuuaaaggcugcuuccacgucccuaggugucuggcuaugugcgaggaaauguugggggcgcuccugagucguccagcacccgccccguccccugcucccacaccagccugucggggagcagaguga

SEQ ID NO: 61724 - RNA, 1221 nt, Artificial Sequence
  derived and/or modified sequence opt3 from REN__Homo_sapiens__NP_000528
auggacggcuggagaaggaugccccggugggggcugcuccuucuguuguggggaagcugcaccuucgguuuaccuacagauacuacgaccuuuaagcgcaucuuccugaaacgaaugccauccauucgugagucucuaaaggaaagaggcguggacauggccaggcucgggccggaguggucacagcccaugaaacggcugacacuuggaaacacuaccaguagcgucauacugacaaauuacauggauacccaauauuacggcgaaaucgguauugggacuccuccacagacauuuaagguuguguucgacaccggauccucuaacguaugggugcccucgucaaaauguagccgcuuguauacggcuugcgucuaccacaagcucuuugaugcaagugacuccucuagcuauaagcauaauggcacugagcugacccugagauacuccacaggcacugugucaggguuccucagucaggauaucauuaccguuggagguaucacagugacccagauguuuggcgaagucacggagaugccugccuuaccauucaugcuggcggaguuugacggggugguaggaaugggcuucauagaacaagcuaucgguaggguuacucccauuuuugauaacaucauuagccagggggugcuuaaagaggacgucuucucuuuuuauuacaaucgggauuccgaaaacucacagagcuugggaggccagaucgugcugggcgggagugacccucaacacuacgagggaaauuuccauuauauaaaccuaauuaagacagguguguggcagauccagaugaaaggcgucucuguuggguccagcacccuccugugugaggauggaugccuugcccugguggacacuggcgcaucguacauuucugguuccacaucaaguaucgaaaaguugauggaggcccucggggcuaaaaagcgccuguucgacuauguagugaaguguaaugaaggcccaaccuuaccggauaucagcuuucaccugggaggcaaagaguacacgcucaccuccgcagacuaugucuuccaggaaucuuacagcucaaagaaacuuugcacacuggccauucaugcuauggauauacccccuccaacugggcccaccugggccuugggagcgacauuuauccgaaaguucuauacugaguuugacagaaggaacaaucggauugguuucgcacuagcccguuga

SEQ ID NO: 61725 - RNA, 2310 nt, Artificial Sequence
  derived and/or modified sequence opt3 from REPS1__Homo_sapiens__NP_001122089
auggagggccugacccucagcgacgccgaacagaaguacuauuccgaucuuuucucuuacugcgacaucgagucaacuaaaaagguggucguuaacgggagagugcuggaauuguuuagggcugcacaauuacccaaugauguagugcugcagauuauggagcuauguggagccacacggcucgguuauuucggccgcagucaguuuuacauagcgcugaaacuugucgcuguggcccagagcggguucccucugcgaguugaauccaucaacacggugaaggacuugccacucccgcguuuugucgcaucuaaaaaugagcaagagucgagacacgccgcuucauauagcagugauuccgaaaaccagggaucuuacagcggcgugauucccccuccacccgguagggggcagguaaagaagggauccguuucacaugacaccgugcagccucggacaagugcagaugcccaagagccagcuagccccgucgugucuccucagcaguccccaccgacuucaccccacaccuggcgcaaacauagcagacacccuaguggcggcaauucugaaaggccacuggccgggcccggaccuuucugguccccauuuggugaggcgcagagcggcucgucugcaggggacgccgugugguccggacauucacccccgccuccccaagagaacugggucaguuucgcugauacaccaccuaccagcacucugcucacaaugcaccccgccuccguucaggaccagaccacggugcggacuguagcaucugcuaccacagccaucgaaauucgccgacaaagcucaaguuaugaugacccauggaagaucacugaugagcagagacaguacuacgugaaucaguuuaaaaccauacaacccgacuuaaacggcuucaucccugguuccgcggccaaggaauuuuucacaaaaagcaagcugccaauucuugaguugucucacaucugggaacugucagacuuugauaaggacggggcacuaacccucgaugaguucugcgcugccuuccaucuggucguggcuaggaaaaauggauaugaccuuccggagaagcugcccgaaaguuugaugccuaaacucauugaucuggaggacagcgccgauguuggcgaccagccaggcgaagugggguacuccggaucucccgcagaggccccuccaagcaagagccccuccaugccgucauuaaaccagacguggccugaacugaaucagaguucugaggauacugcuaucguccacccagugcccauacggaugacaccuagcaaaauucauaugcaagagauggaacucaagcguaccgguuccgaccacacuaaccccacaucaccacuucugguaaaaccuagcgauuugcuagaggaaaauaagaucaacucuuccguuaaguuugcgaguggcaauaccguggcagacggguauucgucuuccgacucauucacgagugaucccgagcagauuggaagcaacgucacccgccagagaucgcacuccggcacaucuccagacaacacugccccgccucccccacccccuaggccacagcccagccauucacggaguuccucucuggauaugaaucgaaccuuuacagugacuaccggucaacagcaggcuggggucguggcccacccuccggcaguuccaccccgcccucagccaagccaagcccccggcccugcugugcauagaccgguagacgccgauggacucaucacacacaccuccacuucaccccagcagaucccagaacaaccuaacuucgcagacuuuagccaguucgaggucuuugcggcuaguaaugugaacgaugagcaggacgaugaagccgagaaacaucccgaaguucugccagcagagaaggccucugacccugcuuccagccuuaggguggccaaaacggauucgaagacagaggagaaaaccgcagcuucagcccccgcgaaugucucuaagggcacuaccccacuggccccgccucccaagccagugcggcgcagauugaaaagugaagacgaacucaggcccgagguagaugaacacacacagaagaccggggugcuggcugcaguuuuagccucccaaccuagcauuccacguucugucggaaaagacaagaaagcuauacaggccagcauccggcgaaacaaggagacuaauacagugcuggcaagacuaaacuccgagcuccagcagcaacugaaggacgugcuugaagagaggauuucauuggaaguccagcuggagcagcuccgccccuucagucaccuguga

SEQ ID NO: 61726 - RNA, 1980 nt, Artificial Sequence
  derived and/or modified sequence opt3 from REPS2__Homo_sapiens__NP_001074444
auggaggccgcugcagccgcggcugccgcagccgcugcagccgcugccgcgggcgggggaugcgguagcgggcccccuccacugcuccuuuccgaaggcgagcagcaauguuacucugaacuguucgcaagaugcgccggagcugccggcggugggccgggaucagggcccccugaggcagcuaggguggccccaggcaccgcgacagccgcagcuggccccgucgccgacuuguuucgggcuagucaguuaccugccgaaacucugcaccagaucacggagcuauguggagcaaagcgcguugguuauuucggcccaacccaguuuuacauugcccucaaacugauagcugcggcacaaagcgggcuucccgugcgaaucgaguccauuaagugcgaacugccuuugccacguuucaugaugucuaaaaacgauggagagaucagauuuggcaauccggccgaacuccaugguacaaagguacagauucccuaucugacuaccgagaaaaacucguucaagaggauggacgaugaggacaagcaggaaacacagucaccuaccaugagcccacuggcuagucccccuuccucuccaccccacuaccaacgggugccgcucagccauggguauuccaaauuacgcucaagugccgagcagaugcacccugcacccuacgaagccagacagccacugguccagccugagggaucaucuuccggcggccccgggacuaagccacuuaggcaucaagcuagcuugauccggagcuuuaguguggaacgcgagcugcaggauaauucuuccuaucccgacgagccuuggcgaauaacagaggaacagagagaauacuacguuaaccaauucaggagccuacagccagauccgucgucuuuuaucuccggaucaguggccaaaaauuucuuuaccaagaguaaacucagcauucccgagcuguccuauaucugggaacuuucugacgcagauugugacggugcgcugacguugccugaguucugcgcugccuuucaccucauugucgcacggaagaacggcuacccacugcccgagggguuaccuccaacucugcagcccgaauaucuccaggccgcuuucccgaagccuaaaugggauugucaacuuuucgacagcuacucagagagucugccagccaaucagcagccccgugauuugaaccgcauggaaaagaccuccgugaaagacauggcagaccuaccuguacccaaucaggauguuacaagcgacgauaagcaagcucugaaaucuacuaucaacgaggcccucccaaaggacgugucagaagauccugcgacccccaaagacaguaauagccugaaggccagaccaaggucccggucuuauucgagcacauccauagaggaggcuaugaagcgaggagaagauccgccuacgcccccaccccgcccucagaaaacccacucaagagcaaguucucuugaccugaacaaggucuuucagccaagcgugcccgccacuaaauccggcuugcucccuccgccacccgcucugccuccaaggcccugcccuucacagagcgagcaagugucugaagccgaguuacugccgcagcuaucccgggcacccagucaggcggccgagagcucuccagcuaagaaagauguccucuacucccagccucccucaaagccaauucgcagaaaguucaggccugaaaaucaagccacagagaaccaggaacccaguaccgcagcuagcgguccagccucggcagccacuaugaaaccgcauccuacaguucagaagcaauccucuaaacagaagaaagcuauccagaccgcgauucguaagaauaaggaggccaacgcagugcuggcucggcuuaacagcgaauugcagcaacagcugaaagagguacaccaggagcgaaucgcccucgaaaaucagcuggagcaacuuagacccgugacgguccuguga

SEQ ID NO: 61727 - RNA, 543 nt, Artificial Sequence
  derived and/or modified sequence opt3 from RERG__Homo_sapiens__NP_001177655
auggccaagagcgcugaggugaaacuggcaaucuucggcagagccggggucggaaaguccgaaucuaccuacaggcaccaggcgacaauugacgaugagguugugucaauggaaauacucgacacugcuggucaagaggauacgauccagcgggaaggccauaugcgcuggggagagggguuuguacuuguguaugacauuaccgaucgaggcaguuucgaggaaguccugcccuugaaaaacaucuuagacgagauuaagaaaccuaagaaugugacacugauccuaguugguaacaaggccgaucucgaccacagccgucagguguccacugaagagggggagaaacuggcaaccgaacuugccugcgcuuuuuacgaguguucugcaugcacaggagaaggcaauauaaccgagaucuucuaugaacuguguagagaggucaggcggcgcagaauggugcagggcaagacuaggcggcgcucgucaacaacccauguaaaacaagccauuaacaagauguugacgaaaaucagcaguuga

SEQ ID NO: 61728 - RNA, 618 nt, Artificial Sequence
  derived and/or modified sequence opt3 from RERGL__Homo_sapiens__NP_079006
augagcaacuuccugcaccucaaguacaaugagaaauccgugucugucaccaaggcccuuacaguuagauuucugacuaaaagguucaucggcgaauaugcuucaaacuuugagaguauuuacaagaaacauuugugcuuagaacggaagcagcugaaucuagagauauaugaccccuguagccaaacgcagaaggcaaaauucucccucaccucugaacugcacugggccgauggguuugugaucguauacgacauuucggaucgcagcucauucgcguuugcuaaggcccuuaucuaucguauucgagagccucagacaagucauugcaaaagagcaguggaguccgccgucuuccuggugggaaacaagagggacuugugucacguucgggaaguggguugggaggaaggccagaaacucgcucuggagaaucgcugccaauuuugugagcugucugcagccgaacagagccucgaggucgaaaugauguucaucagaauaaucaaggauauuuuaaucaacuuuaagcugaaagagaagaggcggccauccgggucaaaaaguauggcuaaacuuauuaauaacguguucggaaagcgccgaaagagcguauga

SEQ ID NO: 61729 - RNA, 3294 nt, Artificial Sequence
  derived and/or modified sequence opt3 from REST__Homo_sapiens__NP_001180437
auggccacccaggugaugggccaaagcuccgggggagguggccuguucacaucuucagggaacaucggaauggcucuccccaaugacauguacgaucuucacgaccugaguaaggcagaguuggccgcgccucaguuaauuaugcuggcuaacgucgcccuaacuggcgaaguuaaugguagcugcugugauuaucucgugggggaggaaagacagauggcagagcugaugccaguaggagacaacaauuuuuccgauucugaagagggcgagggccuugaagagucggccgacauaaaaggggaaccgcauggacuggagaacauggaguugaggucacucgaacugagcguggucgagccccagccuguguucgaagcuaguggugcaccagauaucuacuccucuaauaaggaccugcccccugagacgccaggcgccgaagauaaagggaaaagcuccaaaaccaagcccuuucggugcaagccuugucaauaugaggcugagucagaggaacaguucguucaccauauucgcgugcacagugccaaaaaguuuuucgucgaagagagcgcggaaaaacaggcaaaggcccgagagucuggauccucaacagcugaggaaggcgacuuuagcaaagguccaauccguugcgauagauguggguacaacacuaauagguaugaccauuacaccgcccaccucaagcaccauacacgggcaggagauaacgagcgcguguauaagugcauuaucuguaccuacacuacaguaagugaauaccacuggagaaaacauuuaaggaaucacuucccgcggaagguuuauaccugcggcaaauguaacuacuuuucugaccgcaagaauaacuaugugcagcacguccgaacgcauacuggcgagagacccuacaaaugcgaacuguguccuuauuccagcucgcaaaagacccaccuuacaaggcauaugcggacucacucuggggagaaaccauucaagugcgaccagugcuccuacguggcuucaaaucagcaugaggugacccgucacgcccgccagguccacaacggacccaagccuuugaacuguccacauugcgauuauaaaacagcggacagaaguaauuuuaagaaacacguugaacugcaugugaaccccaggcaauucaauuguccgguaugcgauuacgccgcaagcaagaaauguaaccuacaguaccacuuuaaguccaagcacccuaccugccccaauaaaacgauggacgugucuaaggucaaacucaagaaaacuaagaagcgggaggcugaucugccagacaacauaacaaaugaaaagaccgagaucgagcagacuaagauuaaaggugauguggccggcaagaaaaacgaaaagagcguuaaggcugagaaacgagacgugucaaaggagaaaaagccuaguaauaacgucuccgugauccaaguaacaacccgcacgagaaaaagcguuaccgaagugaaggaaauggauguccauacagggucuaauucagagaaauucaguaagacuaagaaaagcaagaggaaacuugagguggacucccacucucugcauggacccgucaacgaugaagagucgagcaccaagaaaaagaagaaaguggaauccaagagcaaaaauaacagucaggagguuccaaagggcgacucuaaaguggaagagaauaagaagcagaacacauguaugaaaaagagcacuaaaaagaaaaccuugaagaacaaguccagcaaaaagucaucuaaacccccucagaaggagccaguagaaaaagguuccgcccaaauggacccgccccagauggggccugcaccaacagaggccguccagaagggccccgugcagguugaaccuccacccccgauggagcacgcucaaauggaaggagcgcagauucggccugcaccagaugagcccgugcagauggaggucgugcaggaaggcccugcccaaaaagagcuccugcccccaguagaaccugcucagauggugggggcccagaucguuuuagcacauauggagcugcccccaccgauggagaccgcccagacugaagucgcucaaaugggaccugcccccauggagccagcacagauggaaguggcucagguggagagugcgcccaugcaagucguucagaaggaaccugugcagauggagcucagcccacccauggaggugguacagaaggaaccuguccaaauagagcuuucuccgccaauggaagugguucagaaagagcccgugaagauugaacuguccccuccaaucgaggucgugcagaaagagcccguucagauggaauugucaccuccgaugggugugguacaaaaggagcccgcccagcgcgaaccaccucccccaagagagccuccccuacacauggaaccaauuaguaaaaagccgccucugaggaaggacaaaaaggagaaaagcaauaugcagucggagcgugcacggaaggaacagguccucaucgaggugggccuggugcccgucaaagauuccuggcuucugaaggaaucuguuagcacggaggacuugucaccacccaguccuccacuccccaaggagaaccugcgagaagaggccuccggggaucaaaaauuacugaauacaggagaaggcaacaaggaggcuccucuacagaaagugggugccgaagaggcagacgagucucucccggggcuggcugccaauaucaacgaaagcacccacauuuccucaagcggccagaaucuuaacacuccagagggagaaaccuugaauggcaagcaucaaacagauaguauaguaugcgagaugaaaauggacaccgaucagaacacuagagaaaaucugacagggaucaacucuacgguggaggagcccgucuccccuaugcugcccccaagcgcgguggaagagagggaagccguuucgaagaccgcucucgcaucaccucccgccacuauggcugccaaugagucucaggaaauugacgaggaugagggaauccacagucaugaagguuccgaccuuagcgauaacaugucugagggcagcgacgacuccgggcugcacggagcacgcccagugccucaggaaucaagucggaagaaugcgaaagaggccuuggcugucaaggccgcaaaaggcgauuucguguguauauuuugcgacagaucauucaggaaggguaaagauuauucuaagcaucucaaccgccaccugguuaacguguacuauuuagaggaagcugcccaagggcaggaguga

SEQ ID NO: 61730 - RNA, 3219 nt, Artificial Sequence
  derived and/or modified sequence opt3 from RET__Homo_sapiens__NP_065681
auggccaaggcuaccagcggcgcagccgggcugagacuccuucuguuguuacugcuaccccuccugggaaaaguggcgcuuggucuguacuucuccagggacgcuuauugggagaaguuguacgucgaucaggccgcaggcacaccucuccuguauguucacgcccugcgggacgcuccagaagaggugccgucuuuucgccucgggcaacauuuauacggaacuuaucgaacgcgucugcacgaaaacaauuggaucugcauucaggaggauaccggccuuuuguaccugaacagaucacuagaccauaguagcugggaaaaacucuccguaaggaaucgggguuucccccugcuuacaguguaucugaaggucuuuuugucuccuacuucgcuccgcgagggggagugucaguggccaggaugcgcaagaguguacuucucauuuuucaacaccagcuuucccgccuguaguucccugaaaccuagggaauuaugcuucccagagacacggcccucuuuucgcauacgagaaaauagaccuccaggcaccuuccaccaguuuaggcugcucccgguucaauuccuuugucccaacaucagcguggcuuaccggcuguuggagggcgaggggcuaccuuuucguugcgccccagauucccuggaagucucaacucgcugggcgcucgacagagagcagagggaaaaguaugagcugguggcaguauguacaguucaugccggagcucgggaagagguggucauggugcccuucccugugaccgucuacgaugaggacgauagugccccaacguuccccgcugguguugacacugcaagcgccgugguagaauuuaagcgaaaagaggauaccguggucgcgacacuucgcguguucgacgccgauguugugccggcaucuggcgaacuggucagaagguauacuuccaccuugcucccuggggacacaugggcucagcagaccuuucggguggagcacuggcccaaugaaacgucaguacaagccaacggaucuuucguucgcgcuacugugcacgacuacagacuggucuuaaauaggaaccugaguauuucugagaaucguacaaugcagcuagccgugcucgucaacgauuccgacuuucagggcccaggugcaggggugcugcuuuugcauuucaauguuagcgugcugccuguaucgcuccaucugcccucuaccuauucccuuucagucagucggcgagccagaagguuugcucagaucggaaaggugugcguugagaacugucaagcguucagcggcauuaaugugcaguacaaacugcacuccucuggcgcaaacugcagcacuuugggggucgugacaucagccgaagauaccaguggaauccucuuuguaaacgacacgaaggcucugcgccggccaaaaugugccgaguuacacuauauggugguugcaaccgaucagcaaacauccagacaggcccaggcucagcugcuagucacuguggaagguagcuacguggccgaggaagcaggcugcccccucucuugcgcggucucaaagaggcgccuggagugugaggaaugcgggggacuuggcaguccuaccggucgaugugaguggcggcaaggggacggcaagggaauaacacguaauuucagcacuugcuccccaucuaccaaaacauguccggauggccacugcgacguuguggaaacccaggauaucaacauuuguccccaggacugcuugagagggucgaucgugggaggucaugagccuggcgagccaagggggauuaaggcuggauacggcacuuguaauugcuuucccgaagaggaaaaauguuucugcgagccugaagauauccaggacccacugugcgacgagcucugucgcacgguaauagccgcagccguccuguuuagcuucauuguguccguuuuacugucagcuuucugcauccacuguuaucauaaguuugcccacaaacccccgauuaguucugcagagaugacauuccggagaccugcucaagccuuuccagugagcuacuccucaagcggugcgaggcgacccucucuugauuccauggaaaaccaggucaguguggacgccuucaagaucuuggaggauccuaaaugggaauuuccccgcaagaaucucguucuggggaagacccuaggcgagggagaguucggcaaagugguaaaggcuacugcauuucaucugaaagggcgggccggauauaccacagucgcugugaagaugcucaaagaaaacgccagcccaucugagcugagagaccuuuuguccgaguucaaugugcugaagcaggucaaccacccucacguuaucaaguuauacggugcaugcucacaggauggcccccuccugcuuauuguggaauaugcgaaauacgggagucugaggggauuuuugcgugaaagccgcaagguaggcccagguuaucucgggucgggcggaucccggaauagcagcucacuggaccauccggaugagagagcccuaaccaugggcgaccugauaaguuucgcuuggcaaaucucccaggggaugcaguaccucgccgaaaugaaacuggugcacagggaucuugcagcucgaaacauuuuggucgccgagggacggaagaugaaaaucucugacuuuggccugagccgcgauguguacgaggaagacuccuauguuaagagaucacaggguaggauaccugugaaguggauggcaauugagagcuuauucgaucauaucuacacuacacaaagugacgucuggucuuuuggggugcuccugugggaaaucguuacgcuuggaggcaaucccuauccagguauucccccugagcggcuguucaaccuacucaaaaccggccaccgaauggagagaccagacaauuguuccgaagagauguaccgccugauguugcagugcuggaagcaggaacccgauaaaaggccuguguucgccgacaucagcaaggaucuggagaaaaugauggucaagcgucgggacuauuuagaucucgcugcgucgacuccgucagacucucugauuuacgaugacgggcuuagugaagaggagacaccacugguagauuguaacaaugcccccuugccuagagcacucccauccaccuggauagaaaacaagcuguauggaaggaucagccacgcuuuuacacgcuucuga

SEQ ID NO: 61731 - RNA, 327 nt, Artificial Sequence
  derived and/or modified sequence opt3 from RETN__Homo_sapiens__NP_001180303
augaaggcccugugccuccuucuguugcccguguuaggccugcuagucagcuccaaaacccucuguucuauggaggaagcuaucaacgagaggauucaggaaguugcagggucacugauauucagagccaucaguagcauuggacuugagugccaauccgugacaucucggggugaccuggcgacuuguccucgcggcuuugcuguaacggggugcaccuguggaucggccugcggcucaugggaugugcgagcagaaacaacuugucacugccagugugccgguauggacuggaccggggcucguugcuguagaguccagccauga

SEQ ID NO: 61732 - RNA, 336 nt, Artificial Sequence
  derived and/or modified sequence opt3 from RETNLB__Homo_sapiens__NP_115968
augggccccagcuccugccugcuccuuauccugauuccuuuguuacagcugauaaacccagggucuacccaauguucacuagacagugugauggauaagaaaaucaaggacguccucaauagccuggaguacuccccgucucccauuucgaaaaagcugucaugcgccagcguuaaaagucagggaagaccuuccucuuguccagcugguauggcagugacaggcugcgccuguggguauggaugcggcagcugggauguacagcuugaaacuacgugucacugccaguguuccguggucgacuggaccacagcgaggugcugucauuugacuuga

SEQ ID NO: 61733 - RNA, 1833 nt, Artificial Sequence
  derived and/or modified sequence opt3 from RETSAT__Homo_sapiens__NP_060220
auguggcugccccucgugcuucuguuggccgucuuacugcuagcuguucucugcaagguguaccugggccuuuucagcggguccucuccuaacccauuuucagaggacguaaaaagaccgcccgcaccucuggugaccgauaaggaagccaggaaaaaggucuugaaacaggcguucagugcuaaucaagugccagagaagcucgacguuguggucaucggaagcgguuuuggcgggcuggccgcagccgcuauucuggcaaaggccggaaaacgggugcucguauuagaacagcacacaaaggcuggcgguuguugccauacuuucgggaaaaacggacuggaguuugauacgggcauacacuauaucggccgcauggaagagggguccauuggacgauucauccuugaccagauuaccgagggucaguuggauugggcgccccugucuucgccuuuugacaucaugguucuagaaggcccaaaugggcguaaggaguaccccauguauucaggagaaaaagccuacauacaaggccucaaggagaaguucccucaggaggaagcaaucauugauaaauauaucaagcuggugaaagucgugagcaguggugccccacaugcuauucuucugaaguuuuugccgcuccccgugguccagcuguuagacagaugugggcugcucacaagguucuccccuuuucuucaggccucuacucaaagccuggcagagguuuugcagcagcuaggagcuuccucagaacugcaggccgugcucaguuacaucuucccaaccuauggcguaacacccaaccacagcgcguuuucuaugcaugcccugcuugugaaucacuacaugaaaggcggguucuacccucggggagguuccucagagauagcauuccacaccauuccagucauccaacgcgcuggcggggccgugcugacuaaggcuacaguucagagcguguugcucgauagugccggaaaagcaugcggcgucucugugaagaagggucaugaacugguaaacauuuauugucccaucguuguguccaaugccggguuauuuaacaccuacgagcaccuucuaccgggcaaugcuagaugccucccuggagucaaacagcaacugggcacggugaggcccgggcuuggaaugacuagcgucuucaucuguuugcgggguaccaaggaggaccugcaucucccaucgacaaacuauuacguguauuacgauacugacauggaucaggcgauggaacgcuauguuucuaugccucgagaggaagcagccgagcacauuccccugcuguuuuucgcuuuuccauccgccaaagaccccaccugggaagacagauucccuggcaggucaacaaugauaaugcugaucccaaccgcauacgagugguuugaggaauggcaggccgaguugaaggggaaacggggaagugauuacgaaacguucaagaauagcuuuguggaggcuuccaugucuguaguccucaagcuguucccgcaguuagaaggcaaaguggagagcguuacugccgguucaccccugacaaaccaauuuuaucuagcagcgccucguggggcuugcuacggcgccgaccacgaucucggacgccugcauccaugugugauggcaagucuuagagcccagucccccauuccuaauuuguaucugaccggccaggacaucuucacuugcgggcucgucggagcucugcagggugccuuacuguguagcucugcaauacuuaagaggaacuuguacucagaucucaaaaaucuggacagucggauucgagcucaaaagaaaaagaacuga

SEQ ID NO: 61734 - RNA, 3753 nt, Artificial Sequence
  derived and/or modified sequence opt3 from REV1__Homo_sapiens__NP_001032961
augagaaggggcggguggcggaagcgcgccgagaacgacggaugggaaaccugggguggcuacauggcugcaaaagugcagaagcuggaggaacaauuccgaagcgaugccgcgaugcagaaagacgggacauccucuacuaucuuuucaggagucgcuauuuauguuaauggcuacacggaucccagugccgaggaacuccguaagcugaugaugcugcacggugggcaguaucauguguacuauagcagauccaaaaccacacacauaaucgcaacuaacuugccuaaugccaagauuaaggaguuaaaaggagagaagguaaucaggccagaauggauuguggagucuaucaaagcuggccggcugcuaucguacauaccguaucagcucuacaccaagcaaucaagcguccagaaaggccugaguuucaaccccgugugccgcccugaagacccacuucccgggccuuccaauaucgcaaagcagcugaacaauagaguuaaccauauugugaagaaaaucgagacagagaaugaagucaaggugaacggaaugaacucuuggaaugaggaagaugagaauaacgacuuuagcuucguagauuuggaacagaccuccccagguaggaaacaaaauggcauuccccacccucgggggucaacugccaucuuuaacggacauacaccaaguagcaacggcgcucucaagacccaggacugucugguuccgauggucaauucuguggccucccgccugucacccgcguucagccaggaggaggauaaagcagaaaagaguucuacggacuuucgagauugcacucuccagcaauuacagcaguccaccagaaacacagacgcccugaggaauccucaccggacuaacagcuucucgcuuucuccauugcacuccaauaccaaaauaaacggugcucaucacucaacagugcaagggcccaguagcaccaaguccacgucuagcgugucaacuuuuaguaaggccgcaccuuccgucccaagcaaacccucugauuguaauuucauuucaaacuuuuacagucauagccgucugcaccacaucuccauguggaagugcgagcuaacagaguucguuaauacccuccagcgccagucuaacggaauuuuuccgggcagagagaaacugaagaaaaugaagacuggcaggucggcucuugugguaacagacaccggggacaugagcgugcuuaauuccccucggcaucagucauguaucaugcacgucgauauggacugcuucuucgugaguguuggaauccgaaaccgccccgauuugaaggguaaaccaguggccgucacgucuaauagaggcaccgggagggcgccucuccggcccggagccaacccacaacuggaauggcaguauuaccagaauaagauuuuaaaaggcaaggcagacauacccgauagcucccugugggagaacccugacucagcucaggccaacgguaucgauagcgugcucucucgcgcugagauugccuccuguaguuaugaagcaagacaacuugggaucaaaaauggcauguuuuucggacaugccaagcagcugugcccaaacuugcaggcuguaccguacgacuuucacgcguauaaggagguugcacagacacuauacgaaacucuggccagcuauacccauaauauagaggcugugucuugugaugaagcccucgucgacauuacagagauccuggcagagacuaaacuuacccccgaugaguucgccaacgcugugaggauggagaucaaggaccaaacaaaaugcgccgcauccgucggcauugggucaaauauccuguuggcgcguauggcuacccggaaggccaaaccugacggacaguaccaccucaagccagaagagguggaugacuuuauucgaggucagcugguuacuaacuuacccggcguggggcacaguauggagagcaagcuggcaucgcuaggaauaaaaacguguggcgaucuccaguacaugacaauggccaagcugcaaaaagaguucgguccuaagaccgggcagaugcuuuauagauuuugcaggggcuuggacgaucgcccaguacggacugaaaaagaaagaaaguccgucucugcugagaucaauuacggaauuagguucacccagcccaaagaagccgaggcauuucugcucagccugucagaggaaauccaacgccgacuugaggcuacaggcaugaaggggaagcggcugaccuugaaaaucauggugcguaagccgggagccccuguugaaacugcgaaauucgguggccaugggauuugcgacaacauagccagaacagugacgcucgaucaggcuaccgacaaugcaaagaucauuggaaaagccaugcugaacauguuucacacuaugaaguuaaauaucagugauaugaggggcgucgguauucaugugaaccagcugguaccaacaaaucuaaaccccuccaccuguccuucucgccccagcgugcaguccucacacuucccaagcgggaguuauucuguucgggacgucuuucaagugcagaaggcuaaaaaguccacagaggaagaacacaaagagguguucagagccgcagucgaucucgaaaucagcucggcgucaaggacuugcaccuuccugccucccuuuccagcccaucuuccgacgucuccugacaccaauaaggcugagaguuccggcaaauggaacggauugcacacacccguuagcgugcagucucgacugaaccucagcauagaagugccaucccccucacagcuggaucaaaguguauuagaggcccugccuccagaccuucgcgaacaggucgaacaggugugugcaguucagcaagcugagagccauggcgacaagaagaaagaacccgugaaugggugcaacacuggaaucuugccucagccggucggcaccgugcuccugcagauuccagagccccaagaaucuaauuccgaugccgguaucaaccuaauugcacugccugccuucucacagguugacccagagguguuugcugcgcuccccgccgagcugcagcgggaacuuaaggcagcuuacgaucagagacaaaggcagggggagaauaguacacaccagcagagcgccuccgccucuguaccuaaaaacccguugcugcauuuaaaggcugcagucaaagaaaagaagcguaauaaaaagaaaaagacuaucggaucgcccaaacgcauacaaagcccacucaacaauaagcugcuuaacuccccugccaaaacccugcccggcgcgugugguucaccacagaaguugauugacggcuuccucaagcacgaggggccucccgcugaaaaaccacuggaggagcuaagugccucuacgagcggagugccgggccuguccucacuccagucugauccugcagggugcgugcggcccccagcccccaaucuggcuggagcagucgaauuuaacgacguuaagacacuuuugagagaguggaucaccacuauuagcgauccuauggaagaggacaucuuacaggugguaaaauauuguacagaucugauagaagagaaggaccucgagaaacuggaucuugugaucaaguacaugaagaggcugaugcaacagagugucgaauccguguggaauauggccuucgacuuuauucuagauaacguucaggugguccuccagcaaaccuauggcagcacucugaaagugaccuga

SEQ ID NO: 61735 - RNA, 9159 nt, Artificial Sequence
  derived and/or modified sequence opt3 from REV3L__Homo_sapiens__NP_001273361
auggccuucagcaucgacagagcucugaacguggcacucggcaaucccuccucuaccgcccagcacgucuuuaagguuucacuugugagugggaugccuuucuacggauaucaugaaaaagaaaggcacuuuaugaagauuuaccuguauaacccaacaauggugaaacggauaugcgaguuguuacaaagcggugcgaucaugaauaaguucuaccagccgcaugaagcucacauucccuaucugcugcagcucuuuaucgauuacaaccuguauggcaugaaucuuauuaaccuggccgcagugaaauuccgcaaggcccgacguaaguccaauacuuugcaugcuacggggucuuguaaaaaccaccucucgggaaauucacuggcagacacccuguuuagaugggagcaggaugaaaucccuagcagucucauauuagagggcgucgagccacaauccacaugcgaacuggagguggacgccguugcugccgauauccuuaacagguuggacauugaagcgcagaucggugggaaucccggacugcaggcaauuugggaggaugagaagcagcggcgcagaaacaggaaugaaacuucucaaaugagccagccugagucccaggaccaccgguucgugccagccaccgaaucagagaaaaaguuucagaaacgccuacaagaaauccucaagcagaacgauuucagugucacacugagcggcucuguggacuacuccgauggcucacaggaguuuagcgcugagcuuacccugcauagugaaguauugucucccgagaugcuccaauguacuccugccaauaugguugaagugcacaaggacaaagaguccagcaaggggcauacacgacacaaagucgaagaggcacugauaaacgaggaagcuauuuuaaaccugauggaaaauucgcagaccuuccagccacucacgcagagacuuucugaguccccgguguuuauggauucaagucccgacgaggcccuggugcacuugcuagcgggacuggaaagcgacgguuacaggggcgagcggaaccguaugccuuccccaugccgcucuuucgggaauaacaaguauccccaaaauagcgaugacgaggaaaacgagccucagaucgaaaaagaggagauggaacucucacuggucaugagucagagaugggauuccaauauugaggaacauugugccaagaaaaggagccuuugccggaacacucaccgaucuucaaccgaggacgaugacaguagcuccggagaagagauggaguggucugauaauucgcuguugcucgcaagccuguccaucccacaguuagacggcacagcugaugaaaacucagacaauccccugaacaaugagaacagucgcacucauucuagcguuaucgccaccuccaagcuaucagugaagccgagcauuuuccacaaagaugcugccacacucgaaccuucuuccagugcaaagauaaccuuucaauguaaacauacgagcgcccugucuucccacguacuuaauaaggaggacuugaucgaagaccugucacagacuaacaaaaacacagagaagggucucgauaauagugugaccagcuucacuaacgagucgacauacuccaugaaguaucccgggucucugagcucaaccguccacagugaaaauucccauaaagagaacucuaagaaagaaauucuuccagugagcuccugcgagucaagcaucuuugacuacgaagaggauauaccuaguguuacgagacaggugcccucuaggaaguauaccaauauucggaaaaucgagaaggacuccccauucauccacaugcaucgccaccccaacgaaaauacacugggaaagaacagcuuuaauuucucggauuugaaccacagcaagaauaaggucucuagugagggcaacgaaaaaggcaauuccacugcucucagcucucuguuuccuagcuccuucaccgagaacugugaguuacugucaugcaguggggaaaauagaacaauggugcauagccuaaacucuacugcggacgaguccggacucaacaagcugaaaauuagguacgaagaguuucaggaacacaagaccgagaagccaucacuuagucaacaggcagcccauuauauguucuuuccgagcguaguuuuguccaauugucugacacguccccagaaacucucuccugugaccuacaagcugcagccagguaacaaacccucgcgguuaaagcugaauaaacgaaaacuugcuggccaccaagagacuagcacgaaaucauccgaaacagggaguaccaaggauaacuucauccagaauaacccuugcaauucuaacccagagaaggacaaugccuuggcaagcgaucucacuaaaaccacaagaggagccuuugaaaacaagacccccacugacggcuucauugauugccauuucggugacgggacacuggagacggaacaguccuuuggccuauacggaaauaaauauacccugagggcuaagcgcaaagucaacuacgagacugaggauucagaaucuagcuucgugacacacaauaguaagauaucccucccgcacccuauggagaucggcgaaagccuggacgggacccuuaagucucggaaaagaaggaagaugagcaagaaauugccacccgucauuaucaaauauaucauuauaaaccgcuuucgaggacggaagaauaugcuggugaaguuagguaaaaucgacuccaaggagaaacaaguuauucucacagaagagaagauggagcuguacaagaaacuugccccucugaaagauuucuggcccaaagugccagacaguccugcaacuaaguaucccaucuacccauugaccccgaaaaagagccaucguagaaaaucgaagcacaaaucugcgaagaagaaaacgggcaagcagcagaggaccaacaacgaaaauauuaaacgcacacucuccuuucggaagaaaagaagccaugcuauccugucaccucccaguccaucuuauaacgccgagacugaagauugugaccuaaauuacuccgauguaaugagcaagcugggguuccucucagagaggaguaccagccccauaaacuccucuccuccacgaugcuggagccccacagacccucgcgcagaggaaaucauggccgcugccgagaaggaagcaaugcuguuuaaaggaccgaaugucuacaagaaaacugugaacucccggauuggcaagaccucaagagcuagggcccagaucaaaaagucuaaggcgaaacuugccaauccaaguauuguuacgaagaaacguaacaagcgcaaucaaacaaacaaauugguggaugacgguaagaagaaaccccgggcuaagcagaaaaccaaugagaaggggacuucgagaaaacacacaacccugaaggaugaaaagaucaaaagccaguccggcgcagaggucaaguucguguuaaaacaucagaacguaucugaguuugccucaagcuccggaggcagucaacuccuguucaagcagaaagacaugccucuuauggggucugcuguggaucacccacugagcgccucacuacccacuggaauaaaugcacagcagaagcucuccgguuguuuuaguagcuuccuggaaucuaaaaaguccguugacuugcaaaccuuuccuucaagcagggaugaccugcacccgucggucgugugcaacucuauuggccccggggugaguaagaucaauguccagcgaccacauaaccaguccgcgauguucacauuaaaagagagcacgcucauucaaaagaauaucuucgaccugucaaaccaccuuucccagguugcccagaacacccagauaucuagcggaaugaguuccaaaaucgaagauaaugcuaacaauauucaacggaacuaucugagcucuaucggcaaguugucagaguaccgcaauagucucgaauccaaacuggaccaggccuauacuccuaacuuucuacauuguaaggauagccagcagcaaauugugugcaucgcagagcagucuaagcacucggagacauguucacccgguaauaccgcuagcgaagagucccagaugccaaacaauugcuucgugacaagucugagaucuccuauaaaacagauugccugggaacaaaagcagaggggguuuauccuugacaugagcaacuucaaacccgagcggguaaagccacgaucccucucagaagcaaucagucagacuaaagcccugucucaguguaagaauagaaacgucagcaccccguccgcuuuuggcgagggacaaucaggcuuggcggugcugaaggaguuacuccagaaacgccagcaaaaggcccagaaugcaaacacgacacaggauccucugagcaauaaacaccagcccaacaagaacauuucugggucccuugaacauaauaaagcuaacaagaggacccguaguguuacuagcccacggaagcccagaaccccuaggucgacaaaacaaaaggagaaaaucccaaagcuguugaaaguggacucccucaaucugcagaacucuucacagcuagauaauagcgucagugacgauucccccauuuucuuuucugacccuggauucgaaagcugcuacucacuggaggauucccuuaguccggagcacaacuauaauuuugacauaaacacuaucggccagaccgguuucuguagcuuuuacucugggucacaauucgugccagccgaccagaaucucccccagaaguuccuguccgaugccguucaggacuuguuuccuggacaagcuauugagaagaacgaguucuuaagccaugauaaucagaagugcgacgaagauaagcaccauacaacggacucugcaaguuggauccgcucgggcacccugucccccgagauuuuugaaaagucaacuaucgauucaaacgagaaucgaagacacaaccaguggaaaaauucuuuccacccacucacaacccggagcaacuccauaauggacaguuuuugcgugcaacaggccgaggauugucugucagaaaaaucuaggcuuaaccgcagcuccguaaguaaggaggucuuccugagcuugccucagcccaauaacuccgacuggauccagggucauacucguaaagaaaugggccaaucucuagauucagcgaauacuucauuuaccgcuauucugucguccccagacggggagcucguggauguggccugcgaagaccuggagcuuuaugucaguagaaacaaugacauguuaacgccuacuccggauucuagcccccggucaaccuccucuccaagucagagcaagaacggauccuucacaccuaggaccgcaaauauccugaagccccucaugucaccaccuagccgcgaggaaauuauggccacuuugcuggaccacgaucucucugagacaaucuaccaggaacccuuuuguaguaacccguccgacguuccagagaaaccucgagaaauaggcgggagacugcuuaugguggagacccggcuggcuaaugauuuggcagaguucgaaggagacuuuagccuagagggccugaggcucuggaagacagccuucucagcgaugacucagaacccccgcccagguucucccuuaagauccgggcaaggaguagugaauaaaggcucgagcaacaguccuaagauggucgaagauaaaaagauugugaucaugccgugcaagugugcucccucuaggcagcugguucagguguggcuucaggccaaagaggaguacgaacgguccaagaaacugccaaagaccaaaccuacgggugucguaaagagcgcagagaauuuuucaaguuccguuaaccccgacgauaagccuguggucccacccaaaauggacguaagcccuugcauccucccaacaaccgcccauacuaaggaagauguggacaauucucaaauugcuuugcaggcccccaccacaggcuguucacagacugcaagcgagucccagaugcugccgccuguugcuucugccagugauccagaaaaagacgaggacgaugacgauaacuauuacauaucguauagcucccccgacucaccugugaucccacccuggcaacagccgauuucuccugauagcaaggcgcucaacggggacgaucgucccaguuccccagucgaggaacugccuucacuugccuucgagaauuuccuaaaacccaucaaggacgggauucagaaaucuccaugcagcgaaccccaagagccucuggugaucuccccaauaaacacccgcgcacgaacgggcaagugugaaaguuugugcuuucacagcacaccgaucauucagagaaaguuacuggagaggcuccccgaggcuccugggcugucuccacuuucaaccgaacccaaaacucagaagcuguccaauaaaaagggaagcaacacagauacccuccggcgcguauugcugacucaggccaaaaaucaauucgcugcagugaacacaccucagaaggagaccagucagaucgacggcccaucucuaaauaacacguacgguuuuaaggucuccauucagaaucugcaagaagccaaagcccuccacgagauccagaaccuuacucugauaucgguugaauuacaugcuagaaccaggcgggauuuggagcccgacccugaguucgacccgauuugugcgcuguuuuauugcaucagcucagauacaccacuccccgacaccgaaaagacagagcugacuggggugaucgugauugauaaagacaagaccgucuucucccaggauauccgauaccagacgccucuucugauaagaucuggaauuacaggccucgaagugacuuaugcagccgacgagaaggcuuuguuucacgagaucgccaauauuaucaagcgcuacgaucccgacauacuguuagguuacgaaauucaaaugcauaguuggggcuaucuacugcagagggcagccgcucucagcaucgaucuuugccggaugaucucacguguuccagacgauaagauugagaacagauucgcggccgaaagggacgaguacggguccuauaccaugagcgaaaucaauauuguaggacgcauaacacugaacuuguggcggaucaugcgaaaugagguggcacugaccaacuacacuuuugagaacgucucuuuccacgugcuccaucagagauuuccucuguucaccuuuaggguucuuagugauugguucgacaauaaaacagaccucuaucgcuggaagaugguggaucacuacgucucccgggugagaggcaaccugcaaauguuggaacagcuggacuuaauugggaaaacgagcgagauggcucgucuauucggaauccaguuucugcacguacucacuaggggcucacaguaucgggucgaaucuaugaugcuucgcaucgccaagcccaugaauuacauuccagugaccccgucgguucaacagcgaagccagaugagagcaccucagugugugccccugauaauggagccagaauccagguucuacaguaacucugucuuggugcuggauuuucaaucacucuaucccagcaucguuauugccuacaauuauugcuucuccacaugucugggucauguggagaaccuugggaaauacgacgaguuuaaguucggaugcaccaguuuacgggucccuccagaucugcucuaucaggugcgccacgacaucacuguaucucccaauggcguggcuuuuguuaagccuagcgucagaaaaggcguguugccgaggaugcuggaagagauucuaaagacacgauucauggugaaacaguccaugaaggccuacaaacaggaucgggcgcugucacguaugcucgacgcaagacaacuugggcugaaguugaucgccaacgucaccuuuggauauacgagcgcuaauuucucuggucgcaugccauguauagaaguaggcgauuccaucgugcauaaggccagggagacucuggaacgggcuauuaaacucguuaacgacacaaagaaauggggagcaagaguggucuacggagauaccgacaguauguuugugcuguuaaagggcgccaccaaagagcagucauucaagaucggucaggagauugcugaagccguuacugcaacaaaucccaaaccugugaaacuuaaguuugagaaagucuaccugccaugcgugcuccaaaccaagaaacgcuauguaggguacauguaugaaacacuagaccagaaggaucccguguucgacgcgaaaggaaucgagacuguuaggcgagauagcuguccugccgucucgaagauacuggagcgguccuugaagcuacucuucgaaacgagagacauuucucuuaucaaacaguacgugcagaggcaaugcaugaagcuguuggagggcaaagcuaguauucaggauuuuaucuucgccaaggaauaucgcggcagcuuuucauacaaacccggggcaugugugccagcucuggagcucacccguaagauguuaacauaugaccggagauccgaaccgcaggucggagagaggguuccuuacgugauaaucuacgguacucccggcguaccacugauucagcuugugcgccgaccugucgaggugcugcaagaucccacccuacggcucaacgccacauauuacaucaccaagcagauucugccaccuuuggcaagaaucuucucucugauagggauugacguuuuuagcugguaucacgaacuccccaggauccacaaagccacaaguuccagccgcucugagccggaaggaagaaagggcacgaucucacaguacuucaccacacuucauugcccagugugugaugaccugacucagcacgguauuugcuccaaaugccggagccaaccucagcaugucgcuguaaucuuaaaucaggagauaagggaacuggagcgucagcaagagcaguuggugaagauuuguaaaaacugcaccggguguuuugaucgacacauccccugcguuagucucaauuguccagugcuguucaagcuaucucgcgucaacagagaacuuucaaaggcgcccuaucugcggcagcuccuggaccaauuuuga

SEQ ID NO: 61736 - RNA, 3666 nt, Artificial Sequence
  derived and/or modified sequence opt3 from REXO1__Homo_sapiens__NP_065746
augcugagaagcaccggcuucuuuagggccaucgacugccccuacugguccggggcuccuggagguccaugucggcgcccguauugccacuuccgacaucguggcgcaagagggucuggagcccccggcgaugguggggaggcgccuccagcugccggacucggcuacgaccccuauaacccugaacuuccaaagcccccugcacagagggagaauggcacacugggguugggagaggagccacggccggauguguuagaacuggagcuagucaaccaagccauugaggcuguucgcucagaaguggagcucgaacagagaagguaccgggagcugcuugagacuacgcgcgaacaccgaagugcagaggcccccgcucuggccccuagagguccaaaugcgagccccaccguaggcccugacgaagaugcauuuccauuggccuucgacuauucccccgggucucauggacuccugucgccggaugcuggcuaccagccuacaccccuggccgcaccagcugagccugguucaaaauauagccucgccaguuuagacagggggcagggacggggcggcgggggagguggcgcgcuggaauacgugcccaaggccgucucccaaccacgucgccacucuagacccgugccuagcgggaaauacguuguggauaacuccaggccaccgacugaccuugaguaugaucccuugucaaauuacagugcacggcaucugagccgagcuucuucccgcgacgagagagccgcuaagaggccucggggaucacgcggcagcgaaccauauacccccgccccuaaaaagcuaugugauccauuugguaguugcgacgcaagauucucugacuccgaggaugaagccgcuacaguccccgggaacgagccgaccacugcgagcacaccuaaggcaagggccgacccagaaauaaaagcuaccggccagcccccuucgaaggagggacucgaggccgaaggcgggggacugcgugagacgaaagaaacugcagugcagugugauguaggugaccuucagcccccaccagccaagcccgcuucuccagcccaaguucaguccucacaggauggcgggugcccgaaagagggaaagccuaagaaaaagaaaaccggcgcacccccagcgcccaguuguaaggacggugcucaggggaaagauaagacaaaagacaagggccggggacgaccuguggaaaagccaagagccgauaaaaagggcccccaagcaagcuccccuaggcgcaaagccgagcggccggaggggacuaagaaaaagccaucuagcgcuacccccgucgccacaucaggaaaggguagaccugacaggccagcacgccgacccaguccuaccuccggcgauagccggccggcugccgggcguggacccccaagaccucugcaguugcccgacaggaaaucuacgaaggcgccaucaggcaaacucguggaacgcaaggcccggagucuggacgagggugcuagccaggaugcaccuaaauuaaagaagagagcccugucccacgcugaccucuuuggggaugaaucugaggacgaggccgcaggccccggagugccaucggucuggccgagcgcgcuuccuucccugucaagugauucugacagcgauuccgacagcagcuugggcuuccccgaagcccaagggccacccaaaaggcuaaaggcuucuccuccacccuccccugccccgaguucaucuuccucaaguagcucguccacuucuagcgcaggagcugauguugacuacucagcccuggagaaagaaguggauuuugacagugauccaauggaggaaugccuccgaaucuucaaugaguccacaucuguaaagaccgaggaccgcggccggcuggcaagacagcccccuaaagaagaaaagagcgaagagaagggucuuuccgggcugacuacauuguuucccggacagaaaaggcguauuucacaccucagcaagcagggccaagaaguggagccaccucgccggggucccgccgucccuccugcuagaccgcccaccgcgcaggagguguguuaucugagggcccagcaggcacaacgagcuagugccucuuuacugcaggccccagcucggcuagcagaaaaauccccuagcguucauaucucggcccccggcgagaagcgcagaauugcgcacaucccaaacccuaggcucgcugccgcacccacgggggccaaacggacccuggcugcaucaggaucucagaguuccaauggcccggaaccagggggacagcaacuuaagacacgaacuuugagcggcauggccucuaaaaccacaacuaccauaaucccuaagagaauugcgcauagccccucccugcagucacucaagaaaccaaucauucccaaggaguucggugggaaagugccuacagucauccgccagagguaccugaaccuuuuuauagaagagugccugaaguucuguaccaguaaucaggaggcuauugaaaaagccuugaacgaggaaaagguggcauaugaccguagcccgucuaagaauaucuaccucaacguagccguuaauacucugaaaaaguuacggggacuggcucccuccgccgugccaggccuaucaaaaacgagugguagaagggucgugagccacgaggucgugcucggcgggcgccuggcagcuaagacauccuucucucuuucgcgaccuagcucacccagaguugaggauuugaaaggagccgcgcuguacucccggcucagggaauaucuguuaacccaagaccagcugaaggagaacggcuacccuuuuccacaccccgaacgcccugggggagccauuaucuucacugcagaggaaaagcguccaaaagauaguucuugcagaaccugcugucggugcggcacagaguaucuugugagcuccucagguagguguauccgcgacgaggaaugcuacuaucauugggggcgauugagacggaacaggguagcuggaggcugggagacccaguacauguguugcucugccgcugcagguagcgucggcugucaaguggccaagcagcacguucaggaugggcgcaaagaaagacucgagggauuugugaagacuuucgaaaaagagcugaguggcgacacacaucccgggauuuaugcccuagauugcgagauguccuacacgaccuacggacuggaacucacuagggucacagugguagacaccgaugugcacguugucuaugacacauuugugaagccggauaaugagauaguggacuacaacacucgguucagcggcgucaccgaagcugaucuggcggacacgucuguuacccuucgugacgugcaggcaguguugcugucaauguuuuccgccgauacaaucuuaauuggucauagucucgagagcgaccugcuugcucugaagguaauccacucgacugucguggauaccucuguuuuguucccucaccgccucgggcugccauauaaacgaucccuaagaaaucugauggccgacuaccucaggcaaauaauucaggauaacguggacggacauagcucaagugaagaugcaggcgccuguaugcaccuggucaucuggaaggugcgggaggacgcuaaaacaaagcgcuga

SEQ ID NO: 61737 - RNA, 714 nt, Artificial Sequence
  derived and/or modified sequence opt3 from REXO2__Homo_sapiens__NP_056338
augcugggcgggagccucggauccagacuucugaggggugugggcgggucucacggacgguucggcgcccgcgguguccgagaagggggagcugcaauggccgcgggcgagucaauggcucagcguaugguuuggguggacuuggagaugaccggcuuagauaucgaaaaggaccaaauuauagagauggccugccugaucacagauagugaccuaaacauucucgcagaagggcccaaucugaucauuaaacagccugaugagcuucuggacagcauguccgauugguguaaggagcaucacggaaaaucugguuugacuaaggccguaaaagaaucgacgaucacccuccagcaggcugaguacgaauuucugucauucgugagacaacagacaccaccgggccugugcccccucgcagggaacagcguccaugaggacaagaaguuuuuagauaaauauaugccucaguucaugaagcaucugcacuacaggauaaucgacgugaguacuguuaaagagcuuugucggcgcugguauccagaagaguacgaauuugcccccaagaaagcugccucccacagagcguuggaugacauuucugagagcaucaaggaacugcaguucuauaggaauaacauuuuuaagaaaaagaucgaugagaaaaagcggaaaauaauugagaauggagaaaacgagaagaccguguccuga

SEQ ID NO: 61738 - RNA, 753 nt, Artificial Sequence
  derived and/or modified sequence opt3 from REXO4__Homo_sapiens__NP_001266278
augggcaaggccaaagugcccgcuagcaagagagcaccuuccucuccagucgccaaaccggggcccguuaagacccugacaaggaaaaagaacaagaaaaagaaacgguucuggaagucaaaagcgcgcgaggugaguaagaagccugcuagcggaccaggugccguagugcgacccccuaaagcaccagaagacuuuucccagaauuggaaggcccuccaagaggucccccguuggacuggcgggagacaguaccuugcuccuaggccaguggaacagucuacgauccggaaagagccgcgcaagggacagaugguuauucuguuccaaaacgaaggcaccucgucaauaagaagcgguaaauugaggcggcagccccagccucacccaccccgcgaggaguuagaagugguccagaaggagguggcagaaaugcugaaagggcgaauccuaguaggacaugcccuccacaaugaucugaagguucuuuuucuggaccauccuaagaaaaagauuagagauacacaaaaauauaagccauucaaaagucaggugaaguccggcaggcccucuuugcggcuccugagcgagaagauccugggccuccagguccagcaagcugagcacugcuccauucaggacgcccaggcggcaaugcguuuauacgugauggugaaaaaggaaugggagucaauggcccgcgauagaaggccgcugcuuacugcuccugaccauuguagugaugacgccuga

SEQ ID NO: 61739 - RNA, 3447 nt, Artificial Sequence
  derived and/or modified sequence opt3 from RFC1__Homo_sapiens__NP_001191676
auggacaucagaaaguucuuuggcgugauucccagcgggaaaaagcuggucuccgagaccguuaaaaagaacgaaaagacaaagucugaugaggaaacucucaaggccaaaaagggaauaaaagagaucaagguaaauucaaguaggaaagaagacgauuucaagcagaagcaaccuagcaaaaagaaacggauuaucuacgacuccgauucugagucggaggaaacgcuucaggugaagaacgcuaaaaagccaccggagaaacugcccgugucaagcaagccugguaagauuagucgccaggacccagucaccuauaucuccgaaacagaugaggaggacgauuuuaugugcaaaaaggcagccucuaaaagcaaggaaaauggccgauccacuaacucacacuuggggaccaguaauaugaaaaagaacgaggaaaauacaaagaccaaaaacaagcccuuaagcccuauaaaacugacuccaacaucugugcuagacuacuucggaaccggcuccguucagcguucaaauaagaaaaugguggcgagcaagagaaaggagcucagucaaaacacggaugaaucuggucugaaugacgaggcuaucgccaaacagcuucagcuggaugaggacgcagaauuggagaggcagcuccaugaagacgaggaauuugcccggacucuggcuaugcuggaugaggagcccaagaccaaaaaggcacgcaaagacacagaagccggggagacuuucuccagcguccaagcuaaccucucgaaggccgaaaagcacaaauauccucauaaggugaaaaccgcgcagguaucugaugagagaaaguccuacucaccaaggaaacagaguaaguaugaaagcuccaaagagucucagcaacacagcaagucaagugcagacaagauuggagagguuuccagcccgaaagccucuucaaaguuagcuaucaugaaacggaaggaagagaguagcuacaaagaaauugagcccguggccuccaagcgcaaggagaaugcaaucaaacugaagggcgaaacaaaaaccccuaagaaaacgaagucuucgccagcuaagaaagagagcgucucccccgaagauucagagaagaaacgaacuaacuaucaggccuacagaaguuaccuuaauagggaaggcccuaaggcguuggggucuaaagagauaccaaagggagccgagaacugucuggaaggucuaauuuuugugaucacaggcgugcucgagagcauugaacgggacgaggcaaagucccugaucgaacguuaugggggaaaagucaccggcaacguuucaaagaaaacuaauuaccuugugaugggucgcgauagcgggcagucuaaguccgacaaagcugccgcucugggaacaaagaucauugaugaggacggcuugcucaaccugauaagaaccaugcccggcaaaaagaguaaguaugagaucgccguagaaacggagaugaaaaaggaaagcaaauuagagaggaccccgcaaaagaaugugcaggggaaacggaagauuucuccuuccaagaaagaaucagagaguaagaaaagccgacccacaucgaagcgcgauucccuggcaaaaacuaucaagaaggagaccgacgucuucuggaaaucucucgacuuuaaggaacagguggccgaggaaacaagcggagauucaaaagcuagaaaccuugcggacgauaguuccgagaauaagguugagaaccuguuguggguggacaaauacaagccaacuucucuaaagaccauaauuggucagcaaggcgaucagagcugcgcaaauaaacugcucagguggcugcggaacuggcagaaguccucaagcgaagacaaaaagcaugccgcuaaauucgggaaguuuaguggaaaggaugacgggucuuccuucaaagccgcacuucugagcgguccucccggggucggcaagacaaccacugccucguuggugugucaggagcucggauauucauacguagaacugaaugcuucugauacgcgcaguaaauccagcuuaaaggccaucguugcagagucucugaacaauacaagcaucaaaggcuuuuauuccaacggggcggcuucaagugugagcaccaagcacgcccuaauuauggacgaagucgauggaauggcagguaaugaggacagaggcgggauccaagagcucauuggacugauaaaacacacuaagaucccaauuaucugcauguguaacgauaggaaucaucccaagauccguucucuugugcacuacugcuucgacuugcgguuccagcgaccuagagucgaacagauuaaaggcgccaugauguccauagcuuuuaaggagggucugaaaaucccaccgcccgccaugaacgaaauuauccucggggcaaaccaggacauuaggcaagugcugcauaaucuuucaauguggugugcucgcaguaaggcccugaccuacgaucaggcgaaagccgacagccaccgggcuaagaaggauaucaaaaugggcccuuucgacguugcaagaaagguguuugccgcuggagaggaaacagcccacauguccuugguagauaaaucugaccucuucuuucaugauuauucgauagcaccacuguucguccaggagaacuacauccacgugaagcccguugcggccggcggggacaugaaaaagcauuuaaugcugcuaagcagggcugccgauucaauuugcgacggagaucucguggacucccagauccgcaguaagcaaaauuggucucugcuuccugcacaggcuauuuaugccagcgucuugccaggugagcugaugcgaggcuacaugacccaguuucccacuuucccguccuggcucgggaaacacucaucuacaggaaagcaugaucggaucgugcaagaccuggcauuacacaugagccugcguacguauaguuccaaaagaaccguaaacauggacuaccuuagcuugcucagggaugcccuggugcagccucuaacuucucagggcguugacgguguccaggaugugguggcucugauggacacauauuaccucaugaaggaagauuuugagaauauaauggaaauuucauccuggggcggcaaaccaagucccuucagcaagcuggacccuaaggucaaagcggccuuuacccgcgcauacaacaaggaggcucaccuuacacccuauucguugcaagccaucaaagccucucggcauuccacuagcccaucacuggauagugaauacaaugaggaguuaaacgaagacgauucucaguccgacgagaaggaucaggacgcuauugaaaccgacgcaaugaucaaaaagaaaacgaaaagcucaaagccuaguaaacccgagaaggauaaagagccaagaaagggaaaaggcaagagcuccaagaaauga

SEQ ID NO: 61740 - RNA, 963 nt, Artificial Sequence
  derived and/or modified sequence opt3 from RFC2__Homo_sapiens__NP_002905
auggagguggaagccgucugcggcggggcuggagagguugaagcacaggacagcgaucccgccccugcguucuccaaggcuccagguucugccggccacuacgagcugccguggguggaaaaauauagacccguaaagcucaacgagaucguggggaaugaggacaccgucucaaggcuugaaguguuugcacgggagggaaacguuccuaauauuauaaucgccggcccacccgguacagggaaaacuacgaguauucuguguuuggcucgcgcauuacugggaccugcccuaaaggaugcuaugcucgaacugaacgccagcaaugacuccaugaccgauggcgcgcaacaggcacuucgacguacaauggagaucuacucuaaaacuaccagauucgcccuggcuugcaacgccucggacaagauuaucgagccaauacagucaaggugugcaguguugcgguauacaaagcucaccgaugcucagauccugacucgccugaugaaugucauugaaaaagagagagugcccuacacagacgauggccucgaagccaucauuuuuaccgcgcaaggggacaugaggcaggccuuaaacaaucugcagagcacguucaguggauuugguuucaucaacuccgagaauguauuuaagguuugcgaugaaccucauccacuuuuggugaaagagaugauacagcacugugucaacgcaaauauugacgaggcuuauaagauccuggcccaucuauggcaccucggcuacucuccggaagauauuaucgggaacaucuuccgggugugcaaaacuuuucaaauggcugaguaucugaaacuugaguucauuaaggaaauaggauacacccauaugaagaucgccgaaggcgugaauagccuguugcagauggcaggucuccuggcccgcuuaugucagaagacaauggcucccgucgcguccuga

SEQ ID NO: 61741 - RNA, 1071 nt, Artificial Sequence
  derived and/or modified sequence opt3 from RFC3__Homo_sapiens__NP_002906
augagccuguggguggacaaguacagacccugcucccucggcaggcuugauuaucacaaagagcaggccgcucaacugcggaacuugguccaguguggggacuucccucauuuacugguuuacggaccaucuggugcaggcaagaaaacccgcaucaugugcauucuacgagaacucuauggggugggaguagagaagcugcguauagaacaccagacaaucacuacgccgaguaaaaagaagauugagaucucaaccauugccagcaauuaccaucuugaagugaaccccuccgaugcgggcaauucugacagagucgugauccaggagaugcugaaaacaguugcucaaucgcagcaguuggagacuaacucacagagggauuuuaaggugguccuccugaccgaaguggacaaacugacaaaggaugcccaacacgcacuccggcgcaccauggagaaauauaugagcacuuguagauuaauacugugcuguaauaguacauccaagguaaucccuccaauuaggucucggugccuugccguucgcgugcccgcuccuagcaucgaagacauuugucaugucuuguccaccgugugcaagaaagagggucugaaccuaccaucacagcucgcacaccgacuggccgagaagaguuguagaaaucuuaggaaagcucuguugaugugcgaagccugucgggugcagcaguaccccuucacggcggaucaagagaucccugaaacugacugggaggucuaucuccgugaaaccgcaaacgccauaguuagccagcagacaccacaacgccuguuagaggugagagggaggcuguacgagcuccuuacucacugcauuccgcccgaaaucauuaugaagggacuguugucugagcuacugcauaauugcgauggccagcucaaaggcgaaguagcucagauggccgcauacuaugagcaccggcugcagcuuggguccaaggcuaucuaccaucuggaagccuuuguggcgaaauucauggccuuguauaagaaguuuauggaggacggacucgaggguaugauguucuga

SEQ ID NO: 61742 - RNA, 1092 nt, Artificial Sequence
  derived and/or modified sequence opt3 from RFC4__Homo_sapiens__NP_853551
augcaggccuuccugaagggcaccagcaucuccacaaaacccccucucacuaaggacagagggguggcugcaucugccggaucaaguggugagaacaaaaaggcgaaaccagucccguggguugaaaaguacaggcccaagugcguggaugagguagcuuuucaagaagagguggucgccgugcuuaaaaagagccuggaaggcgcagacuugccuaauuuacuguucuaugggccacccggaacgggcaaaaccuccacaauucuagccgcugcacgggagcucuuugguccugagcuguuccgccuucgaguucuggaauugaacgccucugaugagcgugggauacagguggucagagaaaaggugaaaaauuuugcucagcucacuguaucgggaucaaggagcgacggcaagccaugucccccuuucaagaucguuauucuggaugaggccgacaguaugaccuccgcggcacaggccgcucugcggcgcacaauggagaaagaaucuaagaccacuagauuuugccucaucuguaacuacgugagcaggauuaucgagccauuaacaucccggugcucaaaauuccgcuuuaagccgcugagugauaaaauacaacagcagcgacuuuuggacaucgccaagaaagaaaaugucaagauuagcgaugagggcaucgcauaucuggugaaggugucugaaggggaccuaagaaaagcuauuaccuuccuccaguccgccacgaggcugacuggagguaaggagaucaccgagaaagucauaacagauauugcgggcguuauccccgccgaaaagauugacgggguguuugcagcuugucaaucaggcagcuucgauaaacuugaggccguagugaaggaccugaucgacgaaggacacgcugccacucaguuggucaaccagcuccaugaugugguuguggagaauaaccugagugacaagcagaaaucuaucauuaccgaaaaguuagcagaggucgauaaaugccuggccgacggugcugaugagcaccuccaacuuauaucccugugugcgacagugaugcagcaguugagccaaaauugcuga

SEQ ID NO: 61743 - RNA, 768 nt, Artificial Sequence
  derived and/or modified sequence opt3 from RFC5__Homo_sapiens__NP_001123584
auggugcuggaacucaacgccagcgacgauagaggcaucgacauuauaagggggcccauccuuuccuucgcuucuacccggacaauuuuuaagaaaggauucaagcuggucaucuuggaugaagcagacgccaugacucaggaugcgcaaaaugcuuuacgccgaguuauugagaaauuuacggaaaacacccguuucugccugaucuguaauuaccuaucaaagauaaucccugcccuccagaguagaugcacaagguuucgguucgguccacugacuccggagcuuauggugccccgccuggaacacguaguggaggaggaaaaagucgacauuagcgaggauggcaugaaggcauuggugacccucuccucuggggacaugagaagggcccugaacauccugcagucgacaaauauggcuuuuggaaagguuaccgaagagacuguguauacauguaccggccauccucucaaaucagauauugcaaacaucuuagacuggaugcugaaucaggauuucacgacugccuaccggaacauaaccgagcuuaagacauugaaaggucuggcucuacacgacauucucacugaaauccaucuguuuguccaccgcguggauuucccaagcaguguacgaauccaucuucugaccaagauggccgacauugaguauagauuguccguugggacaaaugagaaaauccaacucucuagccugauugcggcauuucaggugaccagggacuuaauagucgccgaggcuuga

SEQ ID NO: 61744 - RNA, 1092 nt, Artificial Sequence
  derived and/or modified sequence opt3 from RFFL__Homo_sapiens__NP_001017368
augugggcuaccugcuguaacugguucugccuggacggccagcccgaggaagugccuccaccgcaaggggccagaaugcaggcauacagcaaucccggauauuccucuuuuccuucaccaacaggucucgagcccaguuguaagagcugcggcgcccacuucgcgaacacugcuaggaaacagacgugucuugauugcaagaaaaauuuuuguaugaccugcuccucucaggucgggaacggaccucggcuguguuuguuaugccaacgcuuccgagccacagcauuucagcgugaggaacugaugaagaugaaaguuaaggaccuaagagauuaccucucgcugcaugacaucucaacugaaauguguagggagaaggaggaacuugugcuguugguacucggccagcagccagugauuagccaagaggaucggacccgcgccaguacacugucccccgacuucccugaacagcaggcuuuucugacccagccacacucuagcauggucccgcccacuuccccuaaucucccaucaaguagcgcacaagccacaucugugcccccugcucagguucaggagaaccaacaggccaauggucaugugucccaggaucaggaggaaccagucuauuuagagucaguggcgagaguacccgcagaagacgagacccaaagcauagauagugaagacucuuucguuccggggaggcgggccucccugagcgaucuuacggacuuggaggauaucgagggacugacugugcgccagcuaaaagaaauucucgcucgaaacuuugucaauuacaagggcugcugcgagaaaugggaacugauggagagagugaccaggcuuuauaaggaccagaaaggccugcagcacuuggugucgggggccgaagaccaaaacggaggugcagucccuucuggccucgaggagaaucuguguaagaucugcauggauucccccauugacuguguuuuacuggaaugcgggcauauggugacauguacuaagugcggaaaacggaugaacgaguguccaaucugccgucaguacguaauacgcgcugugcacgucuucagaucauga

SEQ ID NO: 61745 - RNA, 468 nt, Artificial Sequence
  derived and/or modified sequence opt3 from RFK__Homo_sapiens__NP_060809
augagacaucugcccuacuucugcaggggccaggugguccggggguuuggacgcgguagcaagcaacucggcaucccuaccgccaacuucccagagcagguuguggacaaucuuccggcugauauuuccacagggauauauuacggaugggcaucuguaggcucaggugacgugcacaaaauggucgugaguaucggguggaaccccuauuacaagaauacuaaaaagagcauggaaacgcacauuaugcauaccuuuaaagaggauuucuauggagaaauccugaacguugccauugugggcuacuugcgaccugagaagaauuuugacuccuuagaaucucugaucucggcgauacagggcgauaucgaggaggcuaagaaacgucuagaacucccagagcaccugaagauuaaagaagacaacuucuuucaggucucaaagagcaaaaucaugaaugggcauuga

SEQ ID NO: 61746 - RNA, 954 nt, Artificial Sequence
  derived and/or modified sequence opt3 from RFPL1__Homo_sapiens__NP_066306
augaagagacugagccucgugaccacaaacaggcuuuccccucacggcaauuuccugcccuugugcacuuuuccauuagccgucgacauggcugcacuguuccaggaggccucuucauguccgguuugcagugauuaccuagaaaaacccaugagccucgagugugggugcgcgguguguuuuaagugcaucaacucccugcaaaaagaaccucauggagaggaccuucuguguugcuguugcucuaugguaucgcagaagaauaaaauucggccaucauggcaguuggaacgccucgcuagccacauaaaggagcuggagcccaagcugaaaaagauccuccagaugaacccucgaaugcguaaauuccaaguggauaugacguuagacgccgauaccgcaaauaacuuucugcuuauuagugacgauuugagauccgucaggucugguuguaucacacagaaucggcaggaccuggccgaacgcuucgaugugagcauuugcauccuaggcuccccaagauuuacuugcgggaggcauuauugggagguugacgugggaaccucaacagaaugggaucucggcgucugucgggagagugugcaccgcaagggucgaauacaucugaccacugagagaggguucuggacaguaagccuuagggacggaucucggcuguccgcuucaaccguucccuugacguuucucuucguggaucguaaacugcagcgcgucggcaucuuuuuagacaugggcaugcaaaacgugagcuucuuugacgcagaagggggaagucacguguacacuuucagaucugucuccgccgaggaaccucugcaccucuucuuugcuccaccgucgcccccuaauggugauaagagcguucuuucuauuugcccagugaucaaccccggcaccacagacgccccuguacauccaggggaggcgaaguga

SEQ ID NO: 61747 - RNA, 1626 nt, Artificial Sequence
  derived and/or modified sequence opt3 from RFT1__Homo_sapiens__NP_443091
augggcagccaggaggugcuggggcacgccgcuagacucgcauccucuggacuucuguugcaagucuuauucaggcugaucaccuuuguucuaaacgccuucauucuccgguuucugucaaaggaaauaguggguguagugaauguccgccuuacacuguuguacaguacuacccucuuccuggcgcgagaggcuuuucguagagccugccugagcggcgggacgcagagggacuggucccagacacucaacuuacuguggcuuacugugcccuugggaguuuucuggucucuguuucuaggcuggaucuggcuccagcugcuugaagugccugauccaaaugucgugccgcauuaugcaaccgguguaguucuguucggguugucggccguggucgagcuccugggagaacccuuuuggguguuagcucaagcacacauguucgugaaacugaaggucauugccgagucacucagcguuauccuuaaaagugugcugacagcuuuucuuguacuauggcugccucauuggggccucuacauuuucucccuggcccaguuguuuuauaccacugugcuggucuuguguuacgugaucuauuucacaaagcuccugggcucuccagagagcaccaaauuacagacgcugcccguuucccggauaacugaccuacucccuaacaucacccgcaauggggcguucauuaacuggaaggaagcaaagcugacauggucauuuuucaaacagaguuuucuuaagcaaaucuugacugagggagaaagauacgugaugaccuuccugaauguccucaacuuuggugaucagggcguguaugacauuguaaauaaccuggggagccuuguugccaggcugaucuuccagccaauagaggagucuuuuuacauuuucuuugcuaaaguguuggaacggggaaaggaugccacacuccagaaacaagaggacgucgcaguggcugccgcgguccuggaauccuuacugaagcuagcccuccuggcaggccuuaccaucacgguguucgguuuugcuuacucacaguuggcccuggauauuuaugggggaacuaugcucagcaguggcucuggccccguucuguuacgcuccuacugccuguaugugcuuuugcucgcuaucaaugggguaacagaguguuucaccuuugccgcaaugagcaaggaagaggucgaccgauacaacuucgugaugcuggcccuaucgucuuccuuccugguucucucauaucugcuuacuagauggugcggaaguguggguuuuaucuuggcuaauuguuucaacaugggcauuaggauaacacagagccugugcuuuauccaccgguacuaucgucgcuccccucauagaccauuagcggggcuccaccugucuccgguccuucugggaaccuucgcauugagcggcggugugacggccguaucagagguguuucucuguugcgaacaaggguggcccgcuaggcuggcccacauugcaguuggcgccuucugucuaggagcuacccugggcacagccuuucucacugagaccaaacugauccauuuccuucggacacaguugggggucccucgacgcacugauaagaugaccuga

SEQ ID NO: 61748 - RNA, 1737 nt, Artificial Sequence
  derived and/or modified sequence opt3 from RFTN1__Homo_sapiens__NP_055965
augggcugcgggcugaacaagcucgagaaaagagacgaaaagaggcccggaaauaucuacagcacccuuaaacggccucagguggagacaaagauugaugucuccuaugaauaccgcuuccuggaguuuacuacguugucugccgcugaauuaccagguucaagugcaguucgacuggccagccuacgugaccucccggcgcaacugcuugagcuguaucagcagggcuucuccuuggcugcccuccaccccuuugugcagccuacccaugagagagagaaaacaccacuggagcacauauucagggcaauccugauuaagaagacugaucggucucagaaaaccgaccuccauaacgaaggguacaucuuagagcuggauuguugcucgucacuugaccaccccacagaucaaaaguugauuccugaguuuaucaaaaagauacaggaagccgcuagccagggacugaaauucguaggcgugaucccacaauaucauaguuccgucaauucugcagguagcuccgcccccgugucaaccgcuaacaguacugaggacgcccgcgaugcgaagaaugcaagaggggaccacgccagccuagaaaacgagaagccuggaacaggcgauguuuguucugcuccagccggcaggaaucaguccccggaacccucaagcgggccucggggagaggugccacucgcaaaacagcccaguucuccuuccggugagggcgacgggggagaacugagcccacagggcgucucgaagacccuugauggucccgagucuaacccgcuggaagugcacgaggaaccuuuguccgggaaaauggagauuuuuacguuguucaauaagcccaaaucacaucaaaagugccgccaguacuauccaguaacuaucccucugcacguuaguaaaaacggacagaccgugagcggcuuagacgcuaauuggcuggagcauauguccgaccacuuucgaaagggcgggaugcucgucaacgccguguucuaccuuggaauugugaaugauucucugcacgguuugacagacggcgucuuuaucuucgaagcgguuagcacugaggauucaaagaccauacaaggguacgacgccauugugguagaacaguggacagugcuagagggagucgaagugcagaccgauuauguuccccugcucaacagucuggcagcuuacggcuggcagcuuacgugugugcugccaacucccgucgugaaaacaaccuccgaggguagcguaucuacuaagcaaaucguuuuucuccagagaccuugccucccacagaaaauuaagaaaaaggagucaaaguuccaguggagguucagucgggaagagaugcauaaucgucaaaugcgcaaaagcaaggggaaacuguccgccagagacaagcagcaggcugaagagaacgagaaaaacuuagaagaucagucuucgaaggccggcgacaugggaaauugugugagcggccaacagcaggaagggggagucuccgaagagaugaaggguccggugcaggaagauaaaggcgagcaacugucacccgggggacuacucugcggcgucgguguggagggggaagcaguucagaacggcccugccagucacucuagggcucuggugggaaucuguacaggccauagcaauccaggggaggacgcgcgggauggagacgcagaagagguacgagaacuugguaccgucgaggagaacuga

SEQ ID NO: 61749 - RNA, 1506 nt, Artificial Sequence
  derived and/or modified sequence opt3 from RFTN2__Homo_sapiens__NP_653230
augggcugcgggcugagaaagcucgaggaccccgaugacagcuccccuggaaaaaucuucucuacccuuaagaggccacagguggaaacaaaaacugaguuugccuacgaauauguccuguuggauuucacguuacaggcuucaaguaacccggagguuauuaagauaaauagcauccuggacauugugaccaaaguagaaaacuacuaucuaaaggguuacaucgugggcgcaauucaccccgucauccagccuguggggcagcggaagcaucucccagccuccuaucuguaccgcguugugcuucugcgauugaaacucucucccaagaauagcgcggcuccuucaggacagcguagaccaaggcuggucauagaggaguguccccugacaagcgaagcccaaacuaacgaugcagccaaagagcucaucgaaaagauuaauguggcugcaaaacggggcaugaaguuuguagguuucaucagucagcacuauuccccuucuaaguuuugcaacgggaccaaucaugacggagauauugagagcauguuacacguucgccauggcuccgacgagaacuguagaucauggaaugaaggcacacugagugggcagagcucugaguccggaaucgaagaggaacuucaccacgagucaggucaguaccaaauggagcagaacggcagcccaaccaguucuaaauccaggaagggggaagccagcgauaauaaauuguacacuguguucaacgcuuuugacgaugacucgacaucuugggccuaucaggagggaauacuguccaugaaggucacccggaaaggcucagugauuaguacgcuagaugcggacuggcucgaacugacuaccuucuacuauaagcagggucuuagccugaucgacuccuuuguguucugggagacaucuaaaggggaacauuugccgaagucgcucgagggauuuuucauuuacgaggaagagggcucaggcguccccgggaguucccgcaagggaaaugaugcaaucguuguggaacaauggacuguaaucgaggguugcgaaauuaaaaccgacuauggcccucuguuacacacacuggccgaguuuggguggcuccuuaccagcgugcugccaacgcccgucuugcgacaugauucugagggaaaccuagcuacuaagcagauaguguuccugcagagaccuguuauguggaacucagccgcacaaacaccagacaaaaaggcuaguaggcacaucaaaggcgaagauaagaauaaggccaccagccgguccauuggucucgacacuacaucuucgcagcccgcggagagccgucaucugccggaagagugucgccuuuccccuucaagagagugcuggaccaaagaagggaggcuggcccagcacaacaguuucucuggcuuuagcuccucagauaauguguugcgggagcucgacgauggacaguucgaccaagaagauggcgucacgcaagugaccuguauguga

SEQ ID NO: 61750 - RNA, 2124 nt, Artificial Sequence
  derived and/or modified sequence opt3 from RFWD2__Homo_sapiens__NP_001001740
augagcggcuccagacaggccgggucuggaucagcugguaccagucccggcagcuccgcagccucuucggugacaucagcgagcaguucccugucuagcuccccuucaccaccgagugucgcuguuagcgccgcagcccucgugucugggggaguagcucaagcagccggcuccggugggcuuggaggccccgugaggccuguccugguggcuccagccguuucaggcagcgggggaggugcggugaguacuggcuugucucggcacuccugcgcagcccgccccagcgcuggggucggaggcucgucuuccucauuagguagugggagccgaaagcguccucugcuagccccacucuguaacggacugaucaauuccuacgaggacaaaucuaacgauuucgugugccccauuuguuuugacaugauagaagaggcauauaugacgaagugcggccauagcuucuguuacaaaugcauccaccagucacuugaagauaauaacagauguccuaagugcaauuauguaguugacaacauugaucaucuguacccaaauuuucuugugaacgagcucauccugaaacagaagcagagguucgaagagaagcgguuuaaacuggaccacaguaauggccaucgcuggcaaauuuuccaggauuggcucgggaccgaccaggauaacuuagaccuggcuaaugucaaccuuauguuggagcugcuagugcagaagaaaaagcaacucgaagccgagucccacgcggcccagcugcagauccuuauggaauuucugaaaguggcaagaaggaauaagcgggaggagaugagcggauuguauucuccggucucagaagauaguacaguuccccaguucgaggcuccuagcccaucccacucuucgauaaucgacagcacugaauacucccaacccccugguuuuucaggcaguucucagaccaagaaacagccaugguauaacagcacacucgccucccgccgaaagagacugaccgcucauuucgaggauuuagaacaauguuacuuuucaacuaggaugagccggauuucugacgacucccguacagccagucagcuggaugaguuccaggagugccucagcaaauuuacccgcuacaauucugugagaccccuugcaacgcuguccuaugccucagacuuguacaacgggaguagcaucguaucguccauugaguucgauagggacugugauuauuucgcuaucgcgggagugacuaagaaaauaaaggucuacgaauaugacaccgugauucaggaugcaguugacauccacuacccggaaaacgagaugacaugcaauucuaaaauuagcugcaucucauggaguuccuaucauaagaaccuacuggccucuagcgauuacgaaggcacugugauccucugggacgguuuuaccgggcaacgguccaaggucuaccaggagcacgagaaacgauguuggucaguggauuucaaucugauggacccuaaguugcuggcuagcggcagugacgaugccaaaguaaaguuguggucuacaaaccucgacaauuccguugcaagcauugaagccaaagcuaacgugugcugugucaaguuuucgcccucaucucgcuaucaccuggccuucggaugcgcagaucauugugugcacuacuaugacuuaagaaauaccaagcagccaauaauggucuuuaaaggccauaggaaggcggugaguuacgcuaaauucguuuccggggaggaaaucgugagcgccucuacggauagccagcugaagcuauggaacguaggaaaaccuuauugccuccgguccuuuaagggucacauuaaugagaagaacuucgucggccuggcaucaaauggggacuacaucgccuguggaagugaaaacaauagccuuuauuuguacuacaaaggccugucuaagacucuccugacauuuaaauucgauaccgugaaguccguucuugacaaagaucgcaaggaggacgauacuaacgaguuugugucagcugucugcuggagagcccugcccgacggugaaaguaauguguugauagcagcuaacagccaagggacaauuaagguacucgagcugguguga

SEQ ID NO: 61751 - RNA, 2325 nt, Artificial Sequence
  derived and/or modified sequence opt3 from RFWD3__Homo_sapiens__NP_060594
auggcccacgaggcuauggaauacgacgugcagguccaacugaaccaugcagagcagcagcccgccccugcgggcauggcuagcucccaagggggaccagcccuccuucagccgguucccgcagaugugguaucuucacagggugugccuaguauccugcagccagcccccgcugaagucauuagcucccaggcaaccccuccauuguuacaacccgccccucagcugucuguggaccuaacagagguugaagugcucggcgaggauacugucgagaauauaaacccaagaacgucggaacagcacaggcaggggucagacggaaaucauaccaucccggcuagcagucugcacuccaugacaaacuucauuucuggccuucaacggcugcaugguauguuggaguuucuccgccccagcuccucaaaucacaguguggggccuaugcgaacucguagaaggguaagcgccucucggcgcgcgagagcaggaggcucccagaggaccgauucagcccggcugcgcgcuccacuggacgccuauuuccagguuagccgaacacaacccgaucucccugcaaccacuuacgacagugaaacaagaaacccagugucugaggaguuacaggucuccagcucgucugauuccgacucagauaguagcgcugaauauggcggggugguggaccaggccgaggaauccggagcggucauccuggaggaacagcuugccgguguuucugcagagcaagaggugaccugcauugauggcgggaagacguugcccaaacagccgagcccucagaagucagaaccccugcuaccaagugcuuccauggacgaggaagagggagacacuuguaccaucugccucgaacaguggacaaaugccggcgaucacaggcugagcgcccuucgguguggucaucuguuuggguaccguugcauaucuacuugguugaaaggacaaguacgcaaguguccucagugcaacaaaaaggcuagacacucagacaucgugguccucuaugcaaggacccugcgggccuuagauacaagugagcaggagcgaaugaaaagcucccugcucaaagaacagaugcuucgcaagcaagcugagcuggaaucugcgcaguguagauugcagcuacaggugcugaccgacaaaugcacgaggcuccaacggcgcguucaggaucugcagaaacuuacuucgcaucaaagccagaaucugcagcagcccagaggcucccaagcauggguguugucauguaguccaucuagccagggccagcacaagcacaaguaccauuuccagaagacauuuaccgucucccaagccgggaacugcaggauuauggcuuauugugacgcccucucaugccuggugaucagccagcccucuccucaggcauccuucuuaccaggauuugguguaaaaaugcugaguacugccaauaugaaaagcucucaguacauuccgaugcacggcaagcaaauccgugggcuagcuuucuccucauaccuccggggacugcuuuugagugccagccuggauaacacaauaaagcucaccucgcuggagacgaauaccguugugcagacauauaacgcaggccgacccgucugguccugcuguuggugccuugacgaagcgaauuacauuuaugcuggucuggccaacgggucuaucuugguguacgaugucagaaacacuagcucacaugugcaggagcucguugcacaaaaagccagguguccucuggugaguuuauccuauaugccacgcgcugccucugcagcuuuucccuacggcggaguacuggccggcacccuagaggacgcgagcuucugggaacagaagauggauuuuucccacuggccucauguccucccacuggagcccgggggaugcauugacuuccagacagaaaauucaagccggcacugucuugugacuuauagaccggacaaaaaccacaccacaaucaggaguguuuugauggagaugucuuaccgccuggaugacaccgguaauccuaucugcuccugucagccagugcauacguuuuucggcgggcccacuugcaagcuccugacaaagaacgccauuuuccaaagcccugagaaugauggaaacauauuagucuguaccggcgacgaagcugcaaauucggcccugcuuugggaugcugccucagguucuuugcuccaggaccugcagacugaucagcccgugcuagacaucugcccauuugagguaaaccgaaauaguuaccuggcaacccucacagaaaagauggugcacauuuauaagugggaguga

SEQ ID NO: 61752 - RNA, 2940 nt, Artificial Sequence
  derived and/or modified sequence opt3 from RFX1__Homo_sapiens__NP_002909
auggccacccaggcuuacacagagcugcaagcagcacccccuccaagccagccgccccaggcgccuccacaggcucaaccccagccuccacccccuccaccgcccgccgcaccucagccaccccagccuccaacugccgcugcaacgccccaaccgcaguaugugaccgaacuccaguccccucagccccaagcccagccaccuggcgggcagaagcaauacgucacagagcuucccgcuguuccagcccccucucagccuacuggagcgccaaccccgucacccgcaccucagcaguauaucgugguaacagugagugaaggugccaugagagcuagcgagaccgucuccgaagccucuccaggcucgacugcaucacaaacaggggugcccacccagguugugcagcagguccaaggaacgcagcagaggcuguuggugcagacuagcguacaagcuaaaccuggccacguuaguccauuacagcugaccaacauucaggugccccagcaagcccuaccgacacagcggcucgucgugcaguccgcggccccugguucuaaagggggacaagugagccugacuguccauggcacccagcagguucacuccccacccgagcagucaccugugcaagcaaauaguucuagcuccaagacagcuggcgcccccaccgggacgguaccacagcagcuucaggugcauggaguccaacagucagugccuguuacucaggagcgcagcgugguccaggcuacaccccaagccccaaagccggguccugugcagccccugaccguacagggcuugcaaccaguucacguggcacaggaaguccagcagcuccaacaggugcccgucccucauguguacaguucucagguucaguauguggaagggggagacgccuccuacacugcuagcgcgauacgaucgucuacauauuccuacccagagacaccccuguacacgcaaaccgcaucaacaaguuauuacgaggccgcuggcacugccacccagguaagcaccccugcaacuucccaggccgucgcuucuagcgguucaaugccgauguaugugagugggucccagguuguggccagcucuaccucaacaggagcaggcgcgaguaacagcuccggcgggggagguucuggcgggggaggcggugggggcggaggcgggggagguggcgggucgggaagcaccggcggugggggcuccggagcuggcacuuacgucauccaagggggauauaugcuggguucagccagucagucuuacagccacacgacacgugcauccccagccaccgugcaguggcucuuagauaauuaugagacugcugaaggcguaucacugcccagaagcacccuuuacugccacuacuugcugcauugucaggagcaaaaacuagaaccugugaacgccgcaucuuucgggaagcucauuagguccguuuuuaugggacugcggacacgcagacuuggcaccagggguaauaguaaguaucacuacuaugggcugcggaucaaagcuagcucuccauugcuccgccugauggaggaccagcagcauauggccaugcgaggccaacccuucucccagaagcagagauuaaaaccuauucagaagauggaaggaaugacuaacggcgucgcgguggggcaacagccgucaacaggacugagugauaucagcgcccaggugcagcaauaccagcaguuucucgacgcuucgaggucccuucccgauuucacggagcuggacuugcagggcaaaguccuaccagaggguguugggccuggagauauaaaggcauuucaagugcuguaucgggaacacugcgaggccaucguggacguaauggucaaucuccaguucacccugguggaaacucuuuggaagacauuuuggcguuacaaccugucucagcccagcgaggcuccaccuuuggccguucacgaugaagcagagaaacgccuccccaaggcgauucugguguuacugucaaaauucgagccaguccuacaauggaccaagcauugugacaaugugcucuaucagggccugguugaaauccuuauuccggauguguugagaccuauccccagugcccugacacaggcuauaaggaacuuugccaaaucccucgagucuuggcugacucacgcaaugguaaauauuccagaagagaugcuucgggucaagguggcugccgccggugccuucgcucagacccugcgacgcuacacgagcuugaaccaucucgcgcaagccgcaagagcugugcugcagaauaccgcccagaucaaccagauguuauccgaccugaauagggucgauuuugccaacguucaagaacaggcuucaugggugugccggugugaggaccgcguagugcagagacuagagcaggacuucaaagucacacuccaacagcagaacagccuggaacagugggcagccuggcuugauggcgugguuagucaaguguugaagcccuaccaggggucugcgggauuuccuaaggcugccaaacuguuccuccugaagugguccuucuauagcucgauggucauuagggacuuaacucugcguucagcagccucuuuuggcaguuuccaccuuauccgguugcucuacgaugaguauauguacuaucugaucgaacaucgaguggcucaggcaaaaggggagaccccaauugccguuaugggagaguuugcgaaucuagcuacaucccugaacccccucgacccugauaaggacgaagaggaagaggaagaggaggaaagcgaggaugaacugccgcaagacauaucucuugccgcaggcggugagagcccagccuuggggcccgaaacucuggagccucccgcuaaauuagccagaaccgaugcaaggggacucuucgugcaggcucugccauccucauga

SEQ ID NO: 61753 - RNA, 2172 nt, Artificial Sequence
  derived and/or modified sequence opt3 from RFX2__Homo_sapiens__NP_000626
augcagaacagcgagggcggggccgacucccccgcuucuguggcacugagaccuucagccgcggcuccaccgguccccgccaguccucaaaggguucucgugcaggcagccagcuccaauccaaagggagcucagaugcagcccaucucucuuccucggguacaacaggugccacagcagguccaacccgugcagcacguuuacccugcacaggugcaguaugucgaagguggcgaugccguguacaccaacggggcuauucgcacagccuauacuuacaauccagagccgcaaauguaugcgcccucgucaacggcaagcuacuucgaagccccuggaggcgcucagguaaccguugccgcaaguuccccacccgcugugccuucucauagcauggucgguauaacaauggacgucgggggauccccaaucgugucaagugccggcgcguaucugauucacggcgggauggauagcacucgacauucuuuggcccacaccucccguucaagccccgcaacauuagagauggcuaucgaaaaccugcagaaaagugagggaauuaccucucauaaguccggucuacucaauagccaucugcaauggcuucuggacaacuacgagacugccgaaggcgugucguugccgagaucuucccucuacaaucacuaucugaggcacugccaggagcacaaacuggauccuguuaacgcugccucauuugggaagcucauccggaguguguucaugggauuacgcacaagaaggcugggcacccgggguaauagcaaauaccauuauuacgggauacgccuuaagcccgacuccccauugaaccgacugcaggaagauacgcaguauauggcaaugagacaacagccuaugcaccagaagcccagguaccggccagcccagaaaacugacucucuaggagauagcggcucacacaguggccuccauuccacccccgagcaaacaauggcuguacagagccagcaccaucagcaauauaucgacgugucucacgucuuuccugaguucccagcgccggaucuggggucauuucuucugcaggacggagugacuuugcaugauguuaaggcacuccagcugguguaccgucgccacugugaagccaccgucgacgugguaaugaauuuacaguuccacuacauugagaaacuguggcucaguuuuuggaacagcaaggcuuccucuucggacggucccacaagccuuccugccuccgaugaagacccagagggcgcaguucugcccaaagauaaguugaucucacuaugccaaugugacccuauucugagauggaugaggaguugcgaucauauccucuaucaggcccugguggaaauacuuauuccagacguccugcggcccgugccgucuaccuugacgcaggcuauccgaaauuucgccaagagccucgagggguggcugacuaacgcaauguccgauuuuccucaacaggucauucagacaaaagugggaguugugucagcguucgcucagaccuuacgcagauacacuagccugaaucaccuagcccaagcagccagggcuguacuccagaacacaucucagaucaaccagaugcuguccgaccuuaaucgggucgauuuugccaacgugcaagagcaggcaaguuggguuugucagugcgaagagagcgugguccagcgcuuggaacaagacuucaagcugacccuccagcagcaaucuucccuggaucagugggcuucauggcuugacagugugguaacccaggugcugaaacagcaugccggcagcccaucguuucccaaggcggccagacaauucuugcucaaaugguccuucuauucuagcaugguuaucagggaccugacguuacguucagcugcaaguuuugguuccuuccaccugauucggcuacucuacgaugaguauauguuuuaccuggucgaacaccgaguggccgaggcuacaggggagacuccuauagccgugaugggcgaguucaaugaccuugcaucuuugagccugacccuccuggauaaggacgauaugggagacgaacagagaggcuccgaagcggggcccgaugccaggucauuaggagagccacuggucaaacgcgaacggagcgacccuaaccauagucuucaggguaucuga

SEQ ID NO: 61754 - RNA, 1242 nt, Artificial Sequence
  derived and/or modified sequence opt3 from RFX3__Homo_sapiens__NP_001269046
augcagaccagcgagacaggcuccgacacugggucuacggugacccugcaaacaucagucgccagucaggcugcaguucccacucaggugguacagcaagugccuguccagcaacaggugcagcagguucagaccgugcagcaaguccagcacguguacccagcccagguacaauauguugaaggaagcgauacaguguacaccaacggugcgaucagaacuacaaccuauccguacacggagacucagauguauucccagaauaccggcgggaacuacuucgacacacagggaucuucggcucaagucacuaccguggugucaagccauaguauggucggcacaggugggauucagaugggaguuaccggcggccagcucauauccucuagcgggggaacguaucuuaucgguaauuccauggaaaacucaggccacagugugacucauacaaccagggccagccccgcaacuauugagauggccaucgaaacacugcagaagucugauggguuguccacccaccggaguagcuuacugaauagucaucuacaauggcuccuggacaacuacgagacggcugagggaguaucucuuccucgcuccacccuguacaaucacuauuugcgacacugccaggaacauaaacucgauccagugaacgcagccagcuuuggcaagcugauucguucgaucuucaugggucugagaacaaggcggcucgggacucgcggaaauucuaaauaccacuauuacggcauaagagucaagcccgacuccccuuuaaacaggcugcaggaggauaugcaguauauggcuaugcggcaacagccaaugcagcagaaacaacgcuacaagcccaugcagaagguggacggcguugccgauggguuuaccggaucaggucagcaaacaggcacuucaguggaacagaccgucaucgcgcagagccagcaucaccaacaguuccuugacgcaucccgagccuugccugaguuuggggagguggaaauuucuagccugccagauggaacaaccuucgaggacaucaaaucacuacagagucucuauagagaacacugugaggcuauucuggauguaguugugaaucuucaguuuucccugaucgaaaaguuguggcaaacuuucuggagguacagcccgucuacgcccacagacggcaccacuauaaccgagucacggagugagagcacauccuuuccuauucauuuccacgguuga

SEQ ID NO: 61755 - RNA, 2235 nt, Artificial Sequence
  derived and/or modified sequence opt3 from RFX4__Homo_sapiens__NP_001193620
augaucaagagaagggcccaccccggcgcugggggagaccggacccgcccucgacguagaaggagcacagaguccuggauugaacggugccugaacgagucugaaaauaaacgcuacucaagucauacuagccucgguaacguguccaaugaugagaacgaagagaaggagaauaacagagcaucuaaaccacacucgacgccggccacccuucaguggcuggaagagaauuaugaaauagcggagggcgucuguauccccaggucagcuuuguacaugcauuauuuagacuucugcgagaagaacgauacacaaccuguuaaugccgccagcuuugggaaaauuauccggcagcaguucccacagcugacuacccgccgacuaggaacaagaggccaaaguaaguaccacuauuacgguauugcagugaaggaauccucucaguauuacgacguaauguacagcaaaaagggggcugcauggguguccgagaccggcaaaaaggaagucucaaaacagacuguggccuauagucccaggagcaagcucggaacacugcuuccugaguuuccaaacguuaaggaucugaauuugcccgcuucucucccugaagagaaaguguccaccuucaucaugauguaccggacgcauugucagcguauacuggacacugucauccgcgccaacuuugaugaggugcaaucauuccugcuccacuuuuggcagggcaugccaccgcacauguuacccguacuggggagcaguaccguugugaauauugucggagugugcgacucuauccuuuauaaggcgauuuccgguguguugaugccuacaguccugcaggcacuaccagauagccucacucagguuaucagaaaauucgccaagcaacuggacgaauggcuuaaaguggcucugcaugauuugcccgagaaccucaggaauauaaaguuugaacugucgcggcgauucucucagauuuuacgcagacagaccucccugaaccaccucugucaagccucaaggacaguaauccauagugcagacauuaccuuucagaugcuugaggauuggcggaacguggaccugaauagcaucacgaaacagacuuuguacacaauggaagacucccgcgaugagcacagaaagcuaaucacccagcuguaucaagaguucgaccaccuccuggaggaacagucuccuauugaaagcuacauagaguggcuugauacuauggucgacaggugcgugguuaagguggcugccaaacgucagggcucacugaagaaagucgcgcagcaauuuuugcucauguggaguuguuucgggacacgggugauccgagauaugacccugcauuccgcccccagcuucggaucuuuucacuuaauucaucugauguucgacgauuauguacuauaccuccuggaaucacuucacugccaggagagagcaaacgaguugaugagggcuaugaagggcgaagguaguacggccgagguucgcgaagagaucauacugaccgaggcugccgcaccaacaccgagcccugugcccuccuuuucuccagccaaaucggcuacuagcgucgaagugccucccccauccucacccgucaguaauccuucuccagaguacaccgggcucagcacaacuggagcgaugcaguccuauaccuggucacugacauacaccgugacuacggcagccggcagcccggcugaaaacucucagcaacuucccuguaugcggaauacacauguuccuuccaguagcgugacccacaggauuccaguauauccccacagagaggaacauggcuacacugggucuuauaacuacggauccuaugguaaucagcacccucauccaaugcagucacaguaccccgcccugccgcacgacaccgcaaucaguggcccuuugcacuacgccccauaucaucgcagcucggcucaauaccccuucaacuccccuacaucucgaauggagcccugccucaugagcucaaccccacggcugcacccuacucccgucacaccacguuggccggaggugccuagugccaauacguguuauaccucccccucuguucauagcgcaagauacgggaacuccucagauauguauacuccauuaacaaccaggcgcaauagcgaauacgagcacaugcagcauuuucccggauucgcguauaucaacggcgaagcuaguacagguugggccaaguga

SEQ ID NO: 61756 - RNA, 1851 nt, Artificial Sequence
  derived and/or modified sequence opt3 from RFX5__Homo_sapiens__NP_001020774
auggccgaggacgaacccgaugcuaagagcccuaaaaccggcgggagagcaccaccgggaggugccgaggcgggcgaacccacaacucugcuccagaggcuucgggggacgaucuccaaggcugugcaaaacaaagucgagggcauucugcaggacguucagaaguucucugauaaugacaaauuguacuuauaucugcagcuaccuucaggaccaaccacaggugauaagaguagcgaacccuccacucucucuaacgaggaguacauguaugccuaccgcuggauacgaaaucaccuggaggaacauaccgacacaugccuuccuaagcaaucgguguaugaugcauaccguaaauauugugaaucacuggccugcuguagaccauugagcaccgcuaacuuugggaagaucauuagggagaucuuccccgacauuaaagcacggcgccucggaggcagaggccagaguaaguacugcuacuccgggaucaggcggaaaacucugguaucuaugccuccacugccgggacucgauuuaaaggguagcgagucccccgaaaugggcccugaggugacaccagccccacgcgacgaacuggucgaggcugccugugcgcuuaccugcgauugggcagaacgaauauugaagagaucauuuaguagcaucguggagguugccagguuccugcuacagcagcaccucauuucugcucgguccgcccaugcacacgugcugaaagcuauggggcuugccgaggaagacgagcaugcgccucgugaacgcucaagcaagcccaaaaauggacuggagaaccccgaaggcggugcccacaagaaaccggagagauuggcacaaccucccaaggaucucgaggcuaggacgggggccggaccacuggcucggggcgaacgcaaaaagagugucguggagucuuccgccccuggcgcaaauaacuuacagguaaaugcccugguugcucgacucccccuucuguugccaagagcgcccaggagccuaaucccuccaauuccggugucgcccccuauccuggcaccacggcucucuuccggggcccugaaggucgcuacucuuccccugucaagucgcgccggagcaccuccagccgcugugcccauaauuaacaugaucuugccgaccgugccugcccucccaggucccggcccugggcccggcagagcaccaccuggaggucugacacagcccagggggacugaaaaucgugaggucggcauuggaggcgaccaggggccacacgacaaaggaguuaagcggaccgcggaagugccgguaagcgaggcuuccggucaagccccucccgcaaaagccgcuaagcaggauaucgaggacacagccucugaugcaaaacgaaagagaggcaggccacgcaagaaaagcgggggaucaggcgaacggaacaguacccccuuaaaguccgcugccgcgauggagagcgcccagucuucaagacugccuugggaaacgugggguagugggggcgagggaaauagcgcuggcggggcagagaggccaggacccaugggugaagccgagaaaggcgcugugcuagcccaagggcagggagacggcacugucuccaagggugggcgcggcccuggaucucagcauacaaaagaagcagaggauaagaucccgcucgugccaucgaagguuagcgugauuaaaggcucccgaucacagaaggaagcguuuccccuggccaaaggggaggucgacaccgcuccucaaggaaacaaggaucuuaaagagcacguguugcagaguucucugagccaggaacauaaggacccaaaggccacucccccuuga

SEQ ID NO: 61757 - RNA, 2787 nt, Artificial Sequence
  derived and/or modified sequence opt3 from RFX6__Homo_sapiens__NP_775831
auggccaaggugcccgagcuggaagacaccuuccuccaggcucaaccugcaccacagcuuagcccgggcauccaggaggauugcuguguccagcuguuggggaaaggauuacugguuuaccccgaagagacaguguaucuagccgcggaaggucaaccuggcggggagcagggaggcggugagaagggggaagacccagagcuccccggagcuguaaaauccgaaaugcaccugaacaauggcaacuuuucuucagaggaggaagaugccgacaaucaugauaguaagacuaaagcagccgaccaguaccuuagccagaagaagacgauuacccaaauagugaaagauaagaaaaagcagacacagcugacuuugcaguggcucgaggaaaacuauaucgucugcgagggcgugugucugccuagaugcauucuguacgcucacuaucucgacuucuguaggaaagaaaaguuagagccagcaugcgccgcuaccuuugggaagacaauccggcaaaaauucccccugcuuaccacucgccgauugggaacacguggucauuccaaguaccacuauuacggcauugggaucaaagagucuucggccuacuaucauucaguuuacagcggaaagggccugaccagauuuagugguuccaaacuaaagaaugaagggggauucacgaggaaauauucucucagcuccaagacuggcacccugcuuccugaguuuccaucagcgcagcaccugguguaccagggcuguauaaguaaggauaaagucgacacauugaucaugauguauaagacucacugccaauguauucucgauaacgcaaucaaugggaacuucgaagagauucagcauuuucuguuacacuucuggcagggaaugccggaccaucugcucccccuucuggaaaauccugugaucauagauaucuuuugcguaugugacagcauuuuguacaaaguucuaaccgacgugcugauuccagccacaaugcaggagaugcccgagucucuccuggcugauauccggaacuucgccaagaauugggaacaaugggucguguccucacuugagaaccugccugaagcauugaccgacaaaaagaucccaauugugcgcagauuugucagcagucucaagaggcagacgucuuuccugcacuuagcucagauagcccggcccgcgcuguucgaucagcacguugugaauagcaugguaagcgacaucgagcgcguggaucuaaacucgauugguucucaagcccuccugacuaucuccggcucaacagacaccgaaagugggauauauacugagcaugauagcauuacagucuuucaggagcuuaaagacuugcugaagaaaaaugcaaccguggaggcuuucaucgaauggcucgauacgguuguggaacagcgagucaucaagaccuccaaacagaacggaagaucucugaagaagagggcccaagacuuucuucugaaauggagcuucuuuggcgcucgggugaugcacaacuugacacucaauaacgccucaaguuucgguuccuuucaucugauucguauguuacuggaugaguacauccuacucgcaauggagacucaguucaauaacgacaaggaacaggagcugcagaaucuuuuggacaaauacaugaagaacagcgaugccucuaaagcugcguuuaccgcaucaccgaguagcugcuuccuggccaaucgcaacaagggguccaugguaucuucggacgcuguuaagaaugaaagccacguggagacaacuuaucucccucugcccuccucacaaccaggcggauuaggcccugcccugcaucaguuucccgcagggaacaccgauaauaugccacuuacaggacagauggaauugagucaaauugccggucaccucaugacucccccuauaucuccagcuauggccagcagaggcuccgucaucaaccaggggccgauggcaggaaggcccccuucagugggcccaguccugagcgcgcccucucacugcuccaccuacccugagccaauuuaucccacgcuaccgcaggcuaaucaugacuucuacaguacaagcucuaacuaucagaccguguuucgggcccaaccucacuccacuucaggucuguacccacaucacaccgagcacgggcgauguauggcauggacagaacagcagcucagucgcgauuucuucagcggcucgugcgccggaucccccuauaauucuagaccucccagcucauacggcccaagucugcaggcucaagacucccauaacaugcaguuucuuaacaccgggucuuucaacuuuuugagcaauacuggagccgcauccugucagggugcuacacugccucccaauucaccaaacggcuacuaugggagcaauaucaacuacccggagagucacagguuaggaucuaugguuaaucagcauguguccguaaucagcucgauucggucacucccucccuauucugauauacacgacccacugaacauccuugaugacaguggccgcaaacaaacguccagcuucuacaccgauacuucuagccccgucgccugcagaacaccugugcuggcguccucauugcagaccccaauucccaguuccucuucccaguguauguaugguacaucaaaucaauacccugcccaggaaacucucgacagucaugggaccagcuccagggagaugguuucuucgcugccgccaaucaacacgguguuuaugggcaccgcugcaggaggcacauga

SEQ ID NO: 61758 - RNA, 1422 nt, Artificial Sequence
  derived and/or modified sequence opt3 from RFX8__Homo_sapiens__NP_001139136
auguacgagaucuauguggaaaccugcggccagaacacagagaaucaagucaaccccgccacuuucgggaagugugaagaccacagcccuaugaaaacggauccaguuggauccccgcugucugaguuuagaaggugccccuuccucgaacaggagcuugcuaagaaauacucauguaauaugauggcauuucuggccgacgaguauugcaacuacugucgggauauuuugcgcaauguggaagacuuacugaccaguuucuggaaaagccuacagcaggauacaguaaugcucaugucccugccugacgugugccaacuuuuuaaauguuaugauguccagcuguacaaggguauagaggacguguugcuccaugauuuccuggaagacguuucuauccaguaucugaagucggugcagcucuuuucaaagaaguucaaauuauggcugcuuaacgcguuggagggcgucccagcucugcuacaaauuagcaagcucaaagaggugacucuguuuguaaagcgacuucguagaaagaccuaccugaguaauauggccaaaacaaugaggaugguuuugaaguccaaacggcgcgugucuguccucaagagcgaucugcaggcaaucauuaaccaggggaccuuagccacuuccaaaaaggcucuggcaucagacagaaguggagccgaugaacucgagaauaaccccgaaaugaaaugccuuaggaaucugaucagcuugcuaggcacaucuaccgaccugcggguguuccucuccugucugucaagccaccuucaggcuuuuguguuccaaacgagucgcucuaaggaggaauuuacuaagcuggccgcguccuuccaguugcgauggaaccuccuguuaaccgcagucagcaaagccaugacacugugccauagagacucguucgguucuuggcaccuauuucaucuccugcuuuuggaguacaugauacacauccugcaguccugucucgaggaagaggaagaggaagaggauauggggacuguuaaggagaugcugccugacgauccaacccuuggacaacccgaccaggcucuguuccacucauugaauaguagccucucccaggccugcgcaucuccuagcauggaaccacugggcgugaugccgacacauaugggccaggggagguaucccguaggagugucaaacauggucuuacggauucuggguuuucuaguggauaccgcuaugggcaauaaacucauccaaguucugcuugaggacgaaacgacugagagugccgugaaguugucccugccuauggggcaggaagcgcucauuacacugaaagauggacagcaguucgucauccaaauaagcgacgugccacagucuucagaggauauuuacuuucgugagaacaacgccaauguauga

SEQ ID NO: 61759 - RNA, 717 nt, Artificial Sequence
  derived and/or modified sequence opt3 from RFXANK__Homo_sapiens__NP_001265656
auggagcugacccagcccgccgaagaccucauccagacacagcagacuccugcuagcgagcuuggcgauccagaagacccgggggaggaagcagccgauggauccgacacggugguccugucuuuguuccccugcaccccugagccaguuaaccccgagccugaugcgucagugaguagcccacaggcugguuccucuuuaaagcacucgacaacucugaccaauagacaaaggggcaacgaaguaucagcccuacccgcaacacucgacugugauaaucuggugaacaaaccugacgagcggggguuuaccccacuuauuugggccagcgcuuucggagaaauagagacuguccgcuuucuguuggaguggggcgcagauccgcauauccucgccaaggaacgagagagugcucugucccuggccucuacagguggguacaccgacauugugggacucuuacuggaacgugauguugacaucaauauuuaugauuggaacggcggcacgccccuuuuguacgcggugagagggaaucacgucaaaugcguggaggcacugcuagccaggggagcugaccucacuaccgaagccgacagcgguuauacaccuauggaucuggcaguagcucuuggcuaccggaagguucaacaggugaucgagaaccauauacugaaauuguuccaguccaaucucgucccagccgaccccgaguga

SEQ ID NO: 61760 - RNA, 819 nt, Artificial Sequence
  derived and/or modified sequence opt3 from RFXAP__Homo_sapiens__NP_000529
auggaggcccagggcguggcugaaggggcaggacccggugccgcgagcggcgucccucacccagcugcccuggcaccggccgcugcacccacccucgccccugcuuccguugccgcggcagccucucaauucacacuucuggugaugcagccaugcgcugggcaggacgaggccgcagcucccggaggcucaguaggugccgggaagccugugagauacuugugugaaggagcgggcgauggcgaggaagaggccggggaggacgaagcagauuuacuggacacgagugauccacccggagguggcgagagcgcugccucccuagaagaccucgaggaugaggaaacucauucugggggagagggcucgucagguggggcuaggcggcgcggaagcggcggcgggaguauguccaaaaccugcacauaugaaggauguucugagacuaccagccaggucgccaagcaacgaaaaccuuggaugugcaagaaacaccguaacaagauguacaaggacaaauauaagaaaaagaaauccgaucaggcacugaauugugguggcacagccucaaccgggagugcuggaaacgugaaacuugaagagagcgcggacaauauccugucuauuguuaagcagagaacuggcuccuuuggugauaggccagcacggccgacauugcucgaacaggugcugaaccaaaagcgccugucacucuuaagaagccccgaggucgugcaguuccugcagaagcagcaacagcuuuugaaucagcaaguacuggagcagaggcagcagcaauuuccugggaccaguauguga

SEQ ID NO: 61761 - RNA, 414 nt, Artificial Sequence
  derived and/or modified sequence opt3 from RGCC__Homo_sapiens__NP_054778
augaagcccccugccgcucagggcagcccagcagccgcggcugccgcagccccggcucuggacuccgcagccgcugaggaucucucugacgcccuuugcgaguucgaugcggugcuggcagacuuugccucacccuuccacgagagacauuuucacuacgaagaacauuuggaaaggaugaaacggcgcaguagcgcuuccgucucugauucgucaggguucagcgacagugaguccgccgauucuuuauaucgaaacagcuuuuccuucucagacgagaagcugaauaguccuaccgauagcacaccagcacuacucucugcuacuguuacgccccaaaaagccaagcugggagacaccaaagaacuugaggcguuuaucgccgaucuggacaagacauuggcauccauguga

SEQ ID NO: 61762 - RNA, 2301 nt, Artificial Sequence
  derived and/or modified sequence opt3 from RGL1__Homo_sapiens__NP_001284598
auggaggugaagcccgucggcgaaccuacccaggagguuagcaaauucaagcuguccacaaaaguggaaucuacugggcacuggcucguagaggaccaugugagaaucugggaaguccuuaagacggaggagguggaaggagaucaacugccaccgggucacaccguuucacaguacgagacaugcaaaauuaggacuauaaaggccggcaccuuggaaaaguuaguggagaaccugcuaacagcuuuuggggacaaugauuucaccuauaucaguauuuuucucagcacuuaccggggauucgcauccacaaaagagguccuggaacuucuguuggaccgcuauggcaaccucaccucucccaauugugaggaagaugguucgcagucaagcagugaguccaagauggugauccgaaacgccauugcgucuauccugcgugcuuggcuggaccagugcgccgaagauuuuagagagccuccacauuuccccugucuccaaaaauuacuggacuaccuuacgaggaugaugccugggagcgauccagagcggcgcgcacagaauuugcuggaacaguuucagaagcaagagguagaaacugacaacggacuacccaauaccauauccuucucacucgaggaagaggaggaacuggagggcggcgaaagugccgaguuuacaugcuucagcgaagaucuuguugcugagcagcugacuuauauggacgcacaguuguuuaaaaagguggucccucaccauugucucgggugcaucuggucuagaagggauaagaaagagaacaagcaccuggccccaaccauucgggcuacaaucucccaguucaauaccuuaacgaaauguguggugucaacuauucugggagguaaggaacucaaaacacaacagcgcgccaagaucauagagaaauggauuaacaucgcgcacgaaugccgacuucugaagaauuuuagcaguuugagagcaauugucucugcccuacaguccaacagcaucuacaggcugaagaaaaccugggcugccguuccgcgggaccguaugcucauguucgaggagcugucggacaucuucucugaucauaauaaccaccuuacuucccgcgaacuguugaugaaggagggcacaucaaaauuugcaaaucucgacaguagcgugaaggaaaaccaaaaacggacccagaggcggcugcaguuacagaaggauauggggguaaugcaaggaacggugcccuaucugggcaccuuccuaacagaccucacuaugcuggauaccgcccuucaggacuacauugaggguggguugauaaacuuugaaaagcgacgcagagaguucgaggucaucgcucagauuaaacugcuccaguccgcguguaauucuuacugcaugacaccugaucaaaaguuuauccagugguuccagaggcagcaacugcuuacugaagaggaaagcuaugcccugucaugugagauagaagcagcugccgacgcuaguaccacauccccaaaacccagaaagagcauggugaaacgcuugucucuccuguuuuuaggaucagauaugauuaccaguccuacuccaacgaaggagcagcccaagagcacagccuccgggucuucgggcgagagcauggacuccguuucagugaguucuugcgaaagcaaccauuccgaggcagaagagggcucaaucaccccgauggauacuccugacgaaccccagaaaaagcugagcgagucuuccaguagcuguucuuccauccacucaauggacaccaauaguagcggaaugucgucccuaauuaacccacucucuagcccucccucaugcaauaacaauccaaaaauccacaagagaagugucuccgugacaucuauuaccagcacuguacugcccccuguuuacaaccagcaaaaugaggauacaugcauaaucaggauuuccguggaagacaacaaugguaacauguauaaaucaaucaugcuuacgagccaggauaagaccccagccgucauccagcgugcuauguugaagcauaaucuggacagugauccggcggaggaauacgagcucgugcaagucauuucugaggacaaagaacuggugauacccgauuccgcaaacguuuucuaugccaugaauagccaggugaacuuugacuucaucuuacggaagaaaaacucgauggaggaacagguaaagcugcgaucaagaacuucucuuacauugccuaggaccgcuaaacgcggcuguuggaguaaucggcacuccaagauuacacucuga

SEQ ID NO: 61763 - RNA, 2334 nt, Artificial Sequence
  derived and/or modified sequence opt3 from RGL2__Homo_sapiens__NP_004752
augcugcccagaccucucaggcuucuguuggacaccagcccaccgggcgggguggucuuauccucuuuccggucacgcgaucccgaggagggagguggcccugggggacugguugugggcggugggcaggaggaagaggaagaggaggaagaggaagccccaguaagugugugggacgaggaggaagauggagcugucuuuacagugacuagccgacaauaccguccccuagacccucucguuccaaugcccccuccaagauccucuaggcggcugcgcgcaggcacgcuugaggcccuggugagacacuugcucgauaccaggacaucgggcacugacgucucauucaugagcgcguuucuggcuacccaucgggccuucacaaguaccccggcacugcucggguuaauggccgaucgccuggaagcucuugagucccaccccacugacgaauuggagcgaacaaccgagguggcaaucucuguacugagcacguggcuagccucccauccugaagauuuuggaucagaggcuaagggucagcucgacagacuggaaaguuuccuucugcagacuggcuaugccgcggggaaaggaguuggcggugggagcgcagauuugauuaggaaccuccggucucguguggacccacaggcccccgaucugccuaagccauuagcucugcccggagacccgccugccgaccccaccgauguccucguguuucuugcagaccaccuggcugagcaauugacacuacuggaugccgaacucuuccugaaucuuauaccaucccagugccugggcggcuugugggggcaucgcgacagaccuggacacucacaccucugucccagcgugagggcgacugucacccaguuuaacaaaguugccggugcagugguaaguucugugcugggcgcuacauccaccggggagggaccaggcgaggucacgauccggcccuuacgaccuccacagcgcgccagacugcuagaaaaguggauuaggguggcugaggaaugccggcuccugcgcaauuucagcucgguuuacgccguggucucugcacuucaauccucaccgauccauagauugagggccgcuuggggugaggcgacucgugauagucugcggguguuuagcucccucugucagauuuucucugaagaggacaacuauagccagucacgagagcugcuuguacaggaaguuaaacugcaaagucccuuggagccucacuccaagaaggcaccaagaagcgggucuaggggcggaggcgugguccccuaccucgggacauuucugaaagauuuagugaugcuggacgccgcuucaaaggaugaacuagagaauggauauaucaacuucgacaaacgccggaaggaguucgccguccucagugaacugagaaggcuucagaaugagugccgcgguuacaacuugcagccugaucaugacauacaacgauggcugcagggccuccggccacugaccgaagcacagagccaccguguguccugugagguugaacccccggggucuucggacccuccagcccccagaguguuaaggccuacucugguaaucagccaguggacagagguccuuggauccgugggcguucccaccccauuggugucaugcgaucgcccuaguacggguggggacgaggcucccaccacaccagccccgcuccugacucggcuagcacaacacaugaaauggccuucugucagcucccuggauucagcgcucgaaagcucucccucccugcauaguccagcugaccccagccaccuuucuccuccagccuccucacccagaccuaguaggggccaucgacgcagcgcaucguguggauccccguugucuggcggggccgaggaagcuagcggagguaccggcuaugggggagagggcucagguccaggggccagugauugccggauuaucagagugcagauggaacugggcgaggacggauccguauacaagucuauuuuagugacaagccaggauaaggcacccuccguuaucucaaggguccucaaaaagaauaaccgugacagcgcuguggccagugaguacgaacuggugcagcuucugccuggcgagcgcgaauugacuauaccagcgucugccaaugucuuuuaugcuauggauggggcaucccacgacuuccuccugcggcaaagaaggcgaagcucgaccgccacacccggaguuaccucaggcccuucugcuagugguacuccgcccuccgaagggggaggcgguagcuuuccacggauuaaagccacgggccgcaagaucgcaagagcgcuauucuga

SEQ ID NO: 61764 - RNA, 1422 nt, Artificial Sequence
  derived and/or modified sequence opt3 from RGL4__Homo_sapiens__NP_705843
augagaaagcugcucaccaaccuucccgccgcugcagugcugagcgcccaggucuacuccgcgguuuugcaaggcuuaugggaggaaaaugugugcgggacaccuggaaggacucggguauguacggcucugcuauauggucaggugugcccauuccaggacucuaccgauggccuccgcacaaucacuucaauucuguuuaacuggccgcccgagaauaccagugucuacuaucagccuccacaacgaagcuccuuccguauaaaacuugccuuuagaaaccugucuuggcccggguugggacucgaagaccaccaggagaucgugcugggccagcugguucucccugaaccaaaugaggcaaagcccgaugacccugccccaaggccgggucagcaugcuuuaacaaugcccgcacuggagccugccccaccccuuuuggcugaucuggggccugcccuagaaccagagucgcccgcggcacucggaccgccuggcuaccugcacucagcccccggcccagcuccugcccccggggaaggaccacccccugguaccgugcuugagccacaaagcgcaccggagaguuccugucccugccggggcucugucaaaaaccagccuagcgaggaacugccagacaugacuacauuucccccucgcuugcucgcugaacagcugaccuuaauggaugccgagcuguucaagaaagugguacuccaugaaugucuugggugcauuuggggacagggccaccugaaggguaaugagcauauggcgccaacgguuagagccacuaucgcacacuucaacagguugaccaauuguauuacaacuuccugccuaggggaccacucaaugcgggcucgcgaucgagccagaguggucgagcauuggaucaagguggcuagggaaugucugagucucaacaauuuuagcucugugcacgucauaguuuccgcccugugcucaaaccccaucggacaacuucauaaaaccugggcaggcgugagcaguaagucuaugaaagagcugaaggaauuguguaaaaaggacacagccguaaagcgggaucuccugauuaaagcuggcuccuucaagguggcgacccaggagcguaauccgcagcgcguccaaaugagauuaaggcggcagaaaaagggggugguuccuuuucugggagacuuccuaacggaacuccagcgacuggauagcgcaaucccagacgaccuugaugguaacacuaauaaacgcucgaaggaggugagagucuugcaggagaugcaacugcuccagguggccgcuaugaacuauaggcugcggccccuugaaaaauuuguaacauacuucacccgcauggagcagcugucugacaaggaauccuauaaguugucaugccagcucgagccugaaaaccccuga

SEQ ID NO: 61765 - RNA, 1377 nt, Artificial Sequence
  derived and/or modified sequence opt3 from RGMA__Homo_sapiens__NP_001159755
augggcgggcugggacccagaagggccgguaccagccgggagcgccucguugucacaggccgagcuggguggaugggaaugggccguggugcagggagauccgcccuuggauucuggccuacucuggcguuuuuguuaugcucuuucccagcugccacgucaccguguaagauccugaaaugcaacagugaauuuuggagcgcaaccuccggcucucacgcccccgcuucggacgauacaccugaguucugugcagcccuaaggucauacgcucucugcacucggcgcaccgccagaacauguaggggcgaccuggcguaucauagcgcaguucacgggauugaagaucuuaugagucagcauaauugcuccaaggacggaccaaccucucaaccccggcugcgcacuuugccuccagccggugauagccaggagcgauccgacucacccgaaauaugucacuacgagaaaaguuuucauaagcacagcgcuacaccuaacuauacccacugcggccucuucggggauccacaucugagaacguuuacugacagguuccagaccuguaaagugcagggagccuggccgcugaucgauaauaacuaccucaauguacaagugacaaacacucccgucuuaccuggcucugcagcuaccgccacauccaagcugaccauuaucuuuaagaauuuccaggagugcguggaccagaaaguuuaucaggcggaaauggaugagcuuccagccgcauuuguggacgguucaaagaacgggggagauaaacacggcgcuaauagcuugaagauuacggaaaaagucaguggccaacauguggagauccaggccaaguacauagggacuacaaucguaguucggcaagugggacguuaucugaccuucgcuguccgcaugcccgaggaaguggugaacgccgucgaggacugggacucucagggucuauaccucugucugagaggcugcccucuuaaucaacagauugauuuucaggcauuccacacuaacgccgaagggacaggagcuaggcggcuggcggcagccuccccagcucccaccgccccggagacguucccuuacgaaaccgcaguugccaagugcaaagagaaguugcccguggaggaccucuauuaccaggcuuguguauuugaucuguuaacaacuggcgacgugaauuucacccuggccgcauauuacgcgcucgaagaugucaaaaugcuucacagcaacaaggacaaacugcauuuguaugagcgaacacgcgaucuaccagguagagcugccgcagggcugccucucgcccccaggccacugcuuggcgcucuggugcccuugcucgcccuguuaccuguguuuugcuga

SEQ ID NO: 61766 - RNA, 1437 nt, Artificial Sequence
  derived and/or modified sequence opt3 from RGMB__Homo_sapiens__NP_001012779
augaucagaaagaaaaggaagcggagcgcacccccuggcccaugccgcucccacgggccgcgacccgcuaccgccccugccccacccccuucuccagagcccacacguccugcguggacuggaaugggucugagagcugccccaucaagugcagccgcugcagccgcugaaguggagcagaggcggagcccgggccucugucccccuccacuugaacuguuguuacugcuacucuucucccuggggcuucugcaugccggagacugccaacagcccgcgcagugucgcauucagaaaugcacgaccgauuuugucucuuugacaucgcaccucaacucagcaguugacggcuucgauagcgaguuuuguaaggcccugagagcuuacgccgguugcacucaaaggaccaguaaagcaugucgggggaaucugguguaucauuccgcuguacucggaauaucugacuuaaugagccagcgcaacugcuccaaggauggcccuacaucaaguaccaauccagaagugacucacgaccccuguaacuaccauagccacgccggcgcgcgagagcacagaaggggagaucagaauccgccuucuuaucuguucugcgggcuuuuuggugacccccauuugcggacauucaaggauaacuuucagaccuguaaagucgagggcgccuggccacugaucgacaauaacuaccuauccgugcaaguuacgaaugugccugucgugcccgggucaagcgcaacugcuaccaacaagauuacaaucauuuucaaagcccaccaugaaugcacugaucagaagguauaucaggcuguuaccgacgaucucccagccgcauuuguggacggaacaaccaguggcggugacucugaugccaaaucccugcguaucgucgagcgcgaaagcgggcacuacguggagaugcacgcuagauauauaggaacgacuguguucgucaggcagguuggccgguaccuuacacuggcgauccgaaugcccgaggacuuggcaaugucguacgaagagucucaagaucuccagcugugcgugaauggcuguccuuuauccgaacgcauugacgaugggcagggacaaguaucagccauccugggucauagucucccaagaaccagccuugugcaggcuuggccgggcuauacucuggagacagccaacacccagugccacgaaaagaugcccgucaaggacauuuacuuucaguccuguguguucgauuugcuaacgaccggggacgcaaauuuuacagccgcugcccauucugcacuggaggauguugaggcgcuccacccuaggaaagaacgguggcauaucuucccaagcucaggaaacggcacuccccgcggugggagugaccuguccgugagccuuggccugaccugcuugauacucauugucuuccuguga

SEQ ID NO: 61767 - RNA, 900 nt, Artificial Sequence
  derived and/or modified sequence opt3 from RGN__Homo_sapiens__NP_004674
augagcuccaucaagauugagugcgugcugcccgaaaacuguagaugcggcgagucuccugucugggaagagguuucaaauagucuccuuuucguggacauaccagccaaaaagguauguaggugggauagcuuuaccaaacaggugcaacgggucacaauggacgcuccgguguccucuguugcacugcgccagucagggggauacguggccacuaucgguacgaaguucugcgcguugaacuggaaagaacagucggcugucguguuagccaccguagauaaugacaagaagaacaaucgauuuaacgauggcaaaguugaccccgcagggcguuauuucgccggaacaauggcugaggagacugccccugcagugcuggaaagacaccagggcgcucuauacagccucuuuccagaucaucacgucaagaaauauuucgaccaaguggauauuaguaauggucuggacuggucccuugaucauaagaucuuuuacuauauugacucucugagcuacuccguggaugccuucgacuaugacuugcagaccgggcagaucucaaacaggcggagugucuacaaacucgagaaggaggaacagauacccgauggaauguguaucgacgcggagggcaagcuguggguugcaugcuacaauggcgggcgcgugauuagacuggauccuguaacaggaaaaaggcuccaaaccgugaaguuaccagucgacaaaacuacaagcuguugcuuugguggcaagaacuauucugaaauguacgugaccugugcccgggaugggauggaccccgagggacugcuucgccagccugaagcuggcgguaucuucaaaauuacgggguugggaguuaagggcaucgccccauauuccuacgcaggcuga

SEQ ID NO: 61768 - RNA, 5271 nt, Artificial Sequence
  derived and/or modified sequence opt3 from RGPD2__Homo_sapiens__NP_001071638
augagaaggucaaaggccuacggcgagcgguaucuggcuuccgugcaggggucugcaccaucaccuggcaagaagcuccgcgguuucuacuuugccaaacuuuauuacgaagcgaaggaguaugaccuggcuaaaaaguacguaugcaccuauuugaguguucaagaacgagauccacgugcccacagauucuuaggccugcuauacgagcucgaagagaacacagagaaggcaguggaauguuacaggcggagccuggagcuuaauccgccccagaaagaccugguauugaagaucgccgaacuccugugcaaaaacgaugugacugacgggcgcgcuaaguauugggucgagagagcagccaaacuguuuccuggauccccagcuauuuacaagcucaaggagcauuuacuggauugugaaggcgaggacgguuggaauaaacuuuucgauuggauacagucugaauuguaugugaggcccgacgauguucacaugaacauccggcugguggagcuguaccgcucgaauaagcgacucaaagacgccgucgcgagaugccaugaagcagagaggaacauugcccugcggucaagccuugaguggaauaguugugugguacagacgcugaaggaauauuuggagucccuccaaugccuggaaucugauaaaagcgacuggcgugcuaccaacacagauuuacugcucgccuacgcaaaucuuaugcuguugacucuauccacccgcgacguucaggagucaagagaacugcucgagaguuuugacagcgcucugcagucugccaaguccucacuugggggaaacgaugagcugagcgcgacauucuuggaaaugaaaggccacuuuuauaugcaugccggcagucuccuguuaaagauggggcagcacggaaauaacgugcaauggcaggcacugucugagcuagcugcccucuguuacgucaucgcuuuccaggugccuaggccaaagauuaaacugaucaagggugaagccggccagaaucuuuuggagaugauggcaugcgaccggcugucccaaagcgggcacaugcuccugaaccuuucgcgaggaaaacaggauuuucugaaggaaguggucgagaccuucgccaauaaaucuggccaguccguuuuguacaacgcucucuuuucaagucaaagcuccaaggacacuucuuuccuggguagcgaugacauagggaacaucgaugugcaggagcccgaauuagaggaccuggcgcgcuaugauguaggagcaauucaggcccauaauggcucacuacagcaccucacauggcugggccuucaauggaacaguuugccugcucugccagggaucagaaaguggcucaaacagcuguuucaucacuuaccgcaggaaaccuccaggcuggagacgaaugcccccgagagcauuuguauccuugacuuggaaguguuccuccugggagucguguacacuucucaccuacagcugaaggagaaaugcaacucacaucacaguagcuaucaaccucucugucugccacuucccguuugcaagcgguugugcaccgaacgccagaaauccuggugggaugcaguguguacacugauacauagaaaggccgucccugguaauucugcugaguuaaggcucgugguacagcacgaaauuaacacucugcgugcccaggagaagcauggccuucaaccagcacuguugguucacugggcgaaaugccuccagaagauggggcggggacuaaauucgagcuacgaccagcaggaguauaucggccgauccgugcacuacuggaaaaagguccuaccccugcucaaaauuaucaagaagaacucaaucccggaaccuauugacccccuguucaaacauuuucacaguguggauauacaggcuucugagaucgucgaauaugaggaagacgcccauauuaccuucgcaauccuugaugccgugcacgguaauauagaggacgcuguuacagccuuugagagcauuaaguccgugguaucauacuggaacuuggcacugaucuuccacagaaaagcugaagauaucgagaaugacgccgucuuuccagaagaacaagaagaguguaagaacuacuuaaggaaaacccgcgauuaucucauuaagaucauugacgauagcgacucuaaucuguccgugguuaagaaacuuccugugccccuggagagugucaaagaaaugcuaaaaagcgugaugcaggagcucgaagauuacucugaagggggaccacuguauaagaacggauccuugcggaaugcggacucagagauaaaacauaguacgcccagcccuacuaaguacucgcuguccccaucuaaaagcuauaaguacucaccgaagacacccccuagaugggccgaagaucaaaacaguuuaaggaaaaugaucugccaggagguaaaggcuauuaccaaacucaacuccucuaagagcgcaucccgccaccgauggccaacugaaaauuauggccccgacucagugccugacggguaccagggaagccagacauuccauggugccccacugaccguugcuacgaccggccccagugucuacuauucucaauccccggccuacaacagccaguaucuucugcggccugcagcgaaugugacaccaacuaaagggucgucaaacaccgaguuuaagucuacaaaggaaggauucaguaucgccguguccgcugauggcuuuaaauucgguaucagcgagcccgggaaucaggagaagaaaucugaaaagccuuuggagaacgacacuggcuuucaggcccaagauauuagcggacagaaaaauggccguggggucauauucggacagaccuccucaacauuuaccuucgcagacguugcuaagaguacuagcggugaaggcuuccaguuugggaagaaagaucccaacuucaagggauuuucuggcgccggugagaaacucuucuccucacaaugugggaagauggcaaauaaagccaacacgaguggcgacuuugaaaaggaugacgaugcuugcaaaacagaggacagcgaugacauccacuucgagccaguggugcagaugccugaaaagguagagcuggucaccggagaagagggcgaaaaggugcuauacucccaggggguuaaacuguuuagauucgaugcggagauuucucaauggaaggagaggggacuuggcaaucucaaaauccugaagaacgaagugaaugguaaaccccgcauguugaugcggagagaccagguccugaaggugugugccaaccauuggauuacuaccacaaugaauuuaaagccacucucggggagcgacagggcauggauguggcuggcuucagauuuuuccgacggagaugccaaacuugagcgacuggccgcucaguucaagaccccggaauuggcagaggaguuuaaacagaaguucgaagagugccaacgccuccugcuagacaucccucugcagacuccccacaaacuuguugauacaggccgggccgcgaagcucauacagagagcugaagagaugaagaguggucugaaagacuuuaagacguucuugaccaacgaucagacuaaagugacagaagaggagaacaagggcucugggaccggagccgcaggcgccagcgacacaacuaucaaaccaaaucccgaaaacaccgggccuacguuagagugggauaauuaugaccugagggaagaugcucucgacgacaacguauccucaucuagcguccacgauaguccacuggcauccagccccgugcguaagaauauuuuccgcuuugacgagucuaccacaggauucaacuuuucauucaaguccgcccuuagucugagcaaaucgccugcgaaguugaaucaaucuggcacuuccguggguaccgaugaagagagcgacgucacacaggaggaggagcgggaugggcaguacuuugaaccgguugugccacuacccgaccugguagaggugucaaguggagaagagaacgagcaggucguguucucucauauggcugaacucuauagauacgauaaagacguuggccaauggaaggagagggguaucggcgauauuaaaauccugcagaauuacgacaacaaacaggugcgaauagucaugcggcgcgaucaggugcuuaaguuaugugccaaucacagaauuacuccugacaugucccugcaaaacaugaaagggaccgaaaggguuuggguguggacggcaugcgauuuugccgacggagagcggaaggucgagcaucucgcuguacgauucaaauugcaggacguggccgauagcuuuaagaaaaucuucgacgaagcaaagacagcucaggagaaagauucacugauuaccccacacguuaguagaagcuccacuccccgcgaaucuccuuguggcaagaucgccguggcgguccucgaggaaacaaccagggagcguacugacgugauacaaggggaugacguagccgaugcagcuagcgagguggaagucuccucaaccucugagacaacgaccaaggccguugugaguccgcccaaauuuguguucggaucggaaagcgucaagcggaucuucuccucugagaaaucaaauccauuugcuuucggcaacagcuccgcaacugguagucuguuuggguucucuuuuaaugccccucuuaagagcaacgacucagaaacauccaguguggcccagagcggaucugaguccaaaguugagcccaagaagugcgaacugagcaagaacagcgauauugagcagucgucugacaguaaggucaaaaauuuguccgcuagcuucccaauggaagagucauccaucaacuauaccuuuaagacaccugaaaaagagcccccacuauggcaugcggaguucacuaaggaggagcuggugcagaagcucucuagcaccacgaaaagugcagaucaauuaaauggccugcuuagagaaacagaggccaccuccgcuguccugauggagcagauuaagcucuugaaaagcgaaaucaggcgccuggagcgaaaccaggaagagucugccgcaaauguggaacaccucaagaacguucugcuucaguuuauauuccuaaaaccggguucagagagagagagucuguugccugugauuaauacuauguuacaacugucccccgaagagaagggcaagcucgccgcugucgcgcaggggcugcaggaaaccagcauccccaaaaagaaauga

SEQ ID NO: 61769 - RNA, 876 nt, Artificial Sequence
  derived and/or modified sequence opt3 from RGR__Homo_sapiens__NP_001012738
auggccgagaccagcgcucugcccacaggcuucggggaacucgaggugcuugcagucggaaugguucuguugguggaagccuuauccggucugucucuaaacacucucacgaucuuuucauucugcaagaccccugagcugagaacaccaugucaccuucugguauugagucucgcgcuggcugacagcggcauuucccugaaugcccucguggcagccacuucuucguuacugaggcgguggccguacgggucagauggaugccaggcucauggcuuucaagguuucgucaccgcacuugccagcauauguaguuccgcugccaucgcgugggggcgcuaucaccauuacugcacacgaucucaguuggcauggaacagcgccgugucccugguucuauuuguguggcucucaagugcuuucugggccgcacugccccuucugggauggggccacuaugacuacgaaccuuugggcaccuguugcacucucgauuauagcaaaggggaccguaauuuuacaucuuuccuguuuaccauguccuucuuuaacuucgcuaugccauuauuuauuacgaucacuucauacagccugauggagcagaagcucggaaaaaguggucaucuucaggucaauaccacacugcccgccagaacuuugcuacugggcugggggccuuaugcgauucucuaccuguacgccgugaucgcagauguaaccucuauauccccaaaacuucaaaugguucccgcucugaucgccaagauggugccuacaauuaacgcuaucaauuaugccuugggaaacgagauggucuguaggggcauuuggcagugccucagcccacagaagcgggaaaaggaccgcaccaaauga

SEQ ID NO: 61770 - RNA, 546 nt, Artificial Sequence
  derived and/or modified sequence opt3 from RGS10__Homo_sapiens__NP_001005339
auguucaacagagccgugagcaggcugucccggaagcgacccccuucugacauccacgauucagacggcaguagcuccucuucgcaucagucacucaaaagcaccgcuaagugggcagccagucuugagaaucuguuggaagauccagagggggucaaacgcuuucgugaguucuuaaagaaagaauuuuccgaagagaacguucuguucuggcuagcgugcgaggacuuuaagaagaugcaagauaaaacacagaugcaggaaaaggcuaaagagauuuacaugacuuuccucucuagcaaggccuccucacaggugaauguagaaggacaaaguagacugaacgagaaaauacuugaggaaccgcacccccugauguuucagaaguugcaggaccagaucuucaaucucaugaaguaugauagcuacucuagguuucugaaauccgaccuguuccucaagcauaaacggacggaggaagaggaagaggauuuaccugacgcacaaaccgccgcuaagcgcgcaucaagaauuuauaacacauga

SEQ ID NO: 61771 - RNA, 1341 nt, Artificial Sequence
  derived and/or modified sequence opt3 from RGS11__Homo_sapiens__NP_003825
auggagagaguggucguuagcaugcaggaccccgaucaaggcgugaagaugaggucccagcggcugcucguaaccgugaucccucacgccgucacagggucugacgugguucaguggcuugcucagaaauucugcgugucagaagaggaagcacugcauuugggagccgucuuagugcaacacgguuacauuuauccacugcgcgauccgcgaagucuaaugcuccgucccgacgagacuccuuacagauuucagacgccauauuucuggaccagcacacugaggcccgcggcugaacuugauuacgccauauaucuggcaaagaaaaacauccggaagcgcggcacuuugguagacuacgagaaagauuguuaugacagacuccauaagaagauuaaucacgccugggaucugguucugaugcaggcuagggagcagcuccgggcagccaaacaacgcuccaagggggaccgauuagugaucgcuugccaggaacagaccuacuggcuggucaacagaccuccacccggagccccugaugugcuugagcagggcccagguagggggucuugugcggcaucgcggguguugaugacaaaaucagccgacuuucauaagcgugaaauugaguacuuccgcaaagcucugggaagaaccagggucaagagcaguguuugccuagaggccuaucucuccuuuuguggccaacggggcccgcacgauccccuggugucugggugccuuccuagcaauccauggaucuccgacaacgacgcauacuggguaaugaaugcucccacuguggccgcgccuacaaagcugcgagucgaacgcuggggauucucauuuagagaguugcucgaagauccaguggguagggcccacuucauggacuuucugggcaaagaguucaguggggaaaaccugagcuuuugggaggcaugugaggaauuacgguauggagcucaggcccagguucccacccucguggaugcugucuacgagcaauuccuugccccgggcgcagcccauugggugaauauagacucucgcacgauggaacagacucuggaggguuugagacagccucacagguauguacuagaugacgcucagcugcauaucuacaugcucaugaagaaagauuccuauccccguuuucugaagucagacauguacaaagcgcuucuggcagaagccgggauuccauuggagaugaagcggcgaguuuucccuuucaccuggagacccaggcacagcaguccaucucccgcucuccugccuacaccaguggagccgacugccgcaugcggacccggcggcggggauggagucgccuga

SEQ ID NO: 61772 - RNA, 2400 nt, Artificial Sequence
  derived and/or modified sequence opt3 from RGS12__Homo_sapiens__NP_937870
augaaccugggcaaggagcucagcaaugaaacccacguguccaacgaccagcaaucugccacagucucagauggggagcuuacuggagcugaccugaaagauugcguuaguaauaacagcuuguccucuaaugcaucguuacccucagugcagagcuguagaaggcugcgggaacgccgaguagccaguugggcgguguccuucgagcgucuacuccaggacccugucggugugagauacuuuucugauuuccugaggaaggaauuuagcgaggagaacauccuuuucuggcaggcuugcgaauauuuuaaucauguuccagcccacgacaaaaaggagcuguccuaccgggcacgcgaaauuuucucaaaauuuuuguguaguaaggccacgaccccggugaacauagauagccaagcucagcucgcagacgauguccugagagcuccccauccugacauguucaaggagcagcagcugcaaaucuuuaaucucaugaaauucgauucuuauacaagguuuuuaaaguccccacuguaccaggagugcauucuugcugaaguggagggccgggccuugcccgacucacagcagguaccuagcaguccagcgucuaaacacucccuggggagcgaucauucgucuguuuccacucccaagaaacuaucaggaaagaguaagagcggccgcucccucaacgaagaacugggugacgaagacucugagaaaaagcgaaaaggggcauucuuuagcuggucaagaaccaggaguacaggacggucccaaaagaaacgugagcacggcgaucacgccgacgaugcccuucaugccaauggcgggcugugucgcagagaaagccagggaucugugucaagugcagguagcuuggaccucuccgaggcuugcaggacccuggccccugaaaaggauaaagcgacuaagcacuguugcauccauuuaccagacggcacaucuugugucguggccgugaaggcaggguucucgauuaaagauauccugagcggacucugcgagcggcacggcauaaacggugcugccgcugaccuuuuccuggucgggggagauaagccguugguucuacaccaggacuccucaauccuggaaagucgagaucuccgccuggagaaaagaacccuuuuuaggcuggacuuggugcccauuaaucggucuguaggccucaaggccaaaccuacgaagccagugacugagguccugcgccccgugguugcaagauauggcuuagaccugagcgggcuacucgugaggcuguccggagaaaaggagccucuugauuugggugccccaaucucaagccuggacggccaacgugucgugcucgaagagaaagaucccucucgggggaaggcuuccgcggacaaacagaagggaguaccgguuaaacagaacaccgcagugaauaguagcucucgaaaccauuccgccacaggcgaagagagaacucuggguaagucaaacaguauuaagaucaaaggggagaauggcaagaacgcuagggauccucgccuuagcaaacgggaagagucgauagccaagauuggcaaaaagaaguaccagaaaaucaaucuggacgaagcagaggaguucuuugaauugauuuccaaggcccaaucuaacagagcugaugaccagaggggacuccugcgcaaagaggauuuaguccugcccgaguuccuacgacucccaccugggagcaccgagcugacacuucccaccccagccgcaguggcgaagggauuuucaaaacggagugcuacggguaauggccgugaauccgccucucagcccggggagcagugggagccuguccaagaaagcuccgacucaccaagcacuagcccgggaucugcauccagucccccuggcccacccgguacaaccccuccagggcagaagucgcccucaggcccguucuguacuccucagucuccagugaguuuggcccaggagggaacagcucaaaucuggaaaagacagucccaggaaguugaggccggcgggauccagaccguggaagaugagcacguagcagagcugacgcucaugggagaaggugacauuagcucucccaacagcacccuguuaccucccccauccacaccucaagagguccccggcccaucaaggccggggaguggaacucauggcagccgcgaucugccugugaaucggauaaucgacguugaccuugugaccgguucugcucccgggagagauggcggaauugccggcgcgcaggccgggccaggaaggucccaggcuucaggcggucccccuacaagugacuugccagggcucggacccgucccuggcgaaccggcaaagccaaagacuagcgcccaccaugcuaccuuuguguga

SEQ ID NO: 61773 - RNA, 480 nt, Artificial Sequence
  derived and/or modified sequence opt3 from RGS13__Homo_sapiens__NP_002918
augagcagaaggaacugcuggaucuguaagaugugccgggacgaguccaaacgacccccuucuaaucugacccucgaagaggugcuucagugggcccaaucauucgaaaaccugauggcuacaaaguacggcccagucguuuaugcagccuacuugaaaauggagcacagugaugaaaauauucaguuuuggauggcgugugagacuuauaagaaaauagcuagccgcuggucccguaucucuagagccaagaaguuauacaaaauuuauauccagccgcagucgcccagggagauuaacaucgacucaagcacgcgggaaaccauaauccgcaauauucaagagccuacagaaacuugcuucgaggaggcacagaagaucguguacaugcauauggaaagagauaguuauccaagguuucugaaauccgagauguaccagaagcuacucaaaaccaugcagucuaacaauagcuucuga

SEQ ID NO: 61774 - RNA, 1701 nt, Artificial Sequence
  derived and/or modified sequence opt3 from RGS14__Homo_sapiens__NP_006471
augcccggcaagccuaaacaccugggggugccaaacggaagaaugguccucgccguuagcgacggugagcuuuccucuaccacaggcccgcaggggcaaggagaaggcagggguucaagucugagcauccauuccuugcccucugggccuucgucaccauuccccacugaggaacagccuguggcuagcugggcauuaaguuuugagcggcugcuacaggauccacucggacuggccuacuucacggaauuucuuaagaaagaguucuccgcggagaauguaaccuuuuggaaggcuugcgaacgcuuccagcaaauucccgccucugacacacagcagcuggcacaggaggcccgaaacauauaucaagaauuuuugagcucccaggcucucucaccugugaauaucgaucgucaggcauggcugggcgaggagguccuggccgaaccaagaccggacauguucagggcucagcaacuccagauuuuuaacuuaaugaaauucgauaguuacgcccgguuuguuaagagcccccuguaucgcgagugucuuuuggcggaagcagagggcagaccucugagggaaccagggucuucccggcuaggaucacccgacgccacucgcaagaaaccuaagcucaaaccagguaagagccugccccuuggcguggaggagcuggggcaguugccgccuguggaaggacccggcggucgaccacucagaaaaaguuucaggcgggaguuagggggaaccgcuaaugccgcacugcgucgcgaaucucaaggcucccugaacagcucggcuucucucgaucuuggcuuucuggccuucgucuccucaaagagugagagccacagaaaguccuuggggucuacagaaggagagagcgagucaaggccugguaaauacugcuguguguaucuacccgacggcaccgcgagucuggcccucgcacggccagggcugacuauccgagauaugcuugcuggaauuugcgaaaagcgcggccuguccuugcccgacaucaaaguauaccucguugguaaugagcaggcccugguguuagaucaggacuguacaguccuggcugaucaggaagugagacuagagaacaggauaaccuucgaacucgagcugacggcccuugagcgggugguccgcaucagcgcaaagccuacuaaaagauugcaagaagcccugcagccaauucucgagaagcaugggcugucuccgcuugaaguugugcugcacaggcccggcgagaaacagccuuuggaccucggaaagcugguaucaaguguggcugcgcagcguuuaguccuggacacccuaccaggcgugaagaucagcaaagcacgggauaagucccccugccgaucucaaggguguccuccaagaacacaggacaaagccacucaucccccgccugcuucgccaagcucccucguuaaggugcccucaagugccaccggaaaaaggcagacaugcgauauugagggucuggucgaacuuuugaaucgcgugcagucuagcggcgcacacgaccaacgggggcugcucagaaaggaggaucugguauuaccugaauuucugcagcuucccgcccagggaccauccucagaggaaaccccuccccagacuaagagcgcugcccaaccaaucggcgguucuuugaacuccacgacagacagugcacucuga

SEQ ID NO: 61775 - RNA, 609 nt, Artificial Sequence
  derived and/or modified sequence opt3 from RGS16__Homo_sapiens__NP_002919
augugcagaacccuggccgcuuuccccacaacuugucucgagagggcaaaggaauuuaaaacgcggcuuggcaucuuccugcacaagagcgaguuggggugcgacaccggauccacagguaaauuugaauggggcucuaagcauucaaaagagaaccgcaauuucagugaagauguguuaggguggcgagagagcuuugaccugcuacucuccucuaagaacggagucgccgcguuccacgcuuuucugaagacugaguucucggaagagaaucuugaauuuuggcuggccugugaggaguucaaaaagauucguucagcaaccaaauuggccagcagagcucaucagauauuugaagaguucaucugcagugaagcaccuaaggagguuaacauugaucacgaaacacaugagcucaccaggaugaaucugcaaacugccacagcuaccuguuuugacgccgcgcagggcaaaacgcggacucugauggagaaggauuccuacccacgcuuccucaagucuccggcauauagagacuuagccgcucaggccagcgcagcuuccgccacccugucaaguugcagccuugaugaacccucucacacauga

SEQ ID NO: 61776 - RNA, 666 nt, Artificial Sequence
  derived and/or modified sequence opt3 from RGS17__Homo_sapiens__XP_011534055
augagcucccagcugggccccgagguggccgaaaugagaaagaggcaacagucucagaacgaggggaccccugcugucucacaggcaccaggaaaucaacggccgaacaauacaugcuguuucugcugguguugcuguugcaguuguagcugccucacuguucgcaacgaggaacgaggugaaaaugccggccgucccacgcacaccacaaaaauggaguccauccaggugcuugaggaaugucagaacccuacugcggaggaaguacugucuuggucgcagaauuuugacaagaugaugaaagcuccagccgggagaaacuuguucagggaguuuuuacggaccgaguacucagaagagaaucugcuauucuggcucgcaugcgaagaucugaagaaagagcaaaacaagaaggugauugaagagaaagcccgcaugauauaugaggacuacaucagcauucuuagucccaaggaagucucccuggauucuagagugagggagguuaucaaucggaacuugcucgacccuaauccacauauguaugaagaugcucagcugcagauuuacacacugaugcaccgcgacagcuuuccccgauuccucaacucccagaucuauaaaucauuuguggagaguaccgcaggaucuagcuccgaaucauga

SEQ ID NO: 61777 - RNA, 708 nt, Artificial Sequence
  derived and/or modified sequence opt3 from RGS18__Homo_sapiens__NP_570138
auggagaccacccuucucuucuuuagccagaucaacaugugcgaauccaaggagaaaacuuucuuuaagcugauucacggcucugggaaagaagagacgucaaaggaagccaaaauaagagcuaaggagaagaggaaucggcugaguuuguuagugcaaaaacccgaguuccaugaagacacccgcagcucccgaucuggacaccuggcaaaggagacacgugucucgccugaagaggccguuaaauggggugagucauuugauaagcuacucagccauagagacggccuggaagcguucacuagguuucuuaaaaccgaguucagugaagagaacaucgaauuuuggauugcuugugaggauuucaagaaguccaaagggccacagcagauccaccugaaggccaaagcaauuuacgagaaguuuauccagacagacgccccgaaagaagugaauuuggauuuccauaccaaggagguaauaacuaacucuaucacacaacccacccuccacagcuuugacgcugcacagucccggguguaucagcugauggaacaggauucauacacgcgcuuccugaaaagugacauuuaucucgauuuaauggagggaagaccucaaaggccaacuaaucugcggcgccgaagcagaucuuucacaugcaacgaauuucaggacguccaguccgauguggccaucuggcuuuga

SEQ ID NO: 61778 - RNA, 654 nt, Artificial Sequence
  derived and/or modified sequence opt3 from RGS19__Homo_sapiens__XP_011526788
augcccaccccucacgaggccgaaaagcagaucacaggcccagaggaagcugacagaccgcccagcauguccucucaugauacugcaaguccugccgcgccaucaaggaaccccugcugucugugcugguguugcuguugcagcuguuccuggaaucaagagcggcgccgagcuuggcaggccucucgugaaucgaaacuccagccucuuccaucaugcgaggugugugcaacgcccagcccugaggaaguccagaguugggcccaauccuucgacaagcugaugcacucuccagcugggagaagcguuuuuagggcauucuugcggaccgaguacuccgaagagaacauguuauuuuggcuggccugcgaggaacuaaaagcugaggccaaucagcaugugguagaugaaaaggcgcgccucauuuaugaggacuacgugucaauacugaguccgaaagaagucagccuugauucuagagugagggagggaaucaacaagaagaugcaggagcccuccgcacacacauucgacgaugcccagcugcaaauuuauacuuugaugcaucgggacucauacccucgcuuucucagcaguccaaccuaucgagcucugcugcuccagggucccucucaguccagcucggaagccuga

SEQ ID NO: 61779 - RNA, 630 nt, Artificial Sequence
  derived and/or modified sequence opt3 from RGS1__Homo_sapiens__NP_002913
augagagccgcugcaaucagcacccccaagcuggacaaaaugccuggcauguucuuuuccgccaacccaaaggagcucaaagggacaacucacucucuucuggaugacaagaugcagaaaaggcggccgaagacguucggaauggauaugaaggcguacuugcgcucaaugauuccccauuuagaaagugguaugaaaagcuccaagucuaaagacgugcugucggcugccgaggucaugcaauggucacagagccuagaaaagcuccuggcaaaucagaccggccagaacguuuuugggaguuuccuuaaauccgaguuuucugaagagaauauagaguucuggcuggccugcgaagauuauaagaagacagagagcgacuugcucccuuguaaagcugaagagaucuacaaggcauuugugcacuccgaugccgcuaaacaaauuaacaucgacuuccgaacucgugagucaaccgccaagaaaauuaaggcgccaacaccuaccugcuuugaugaagcacagaaaguaaucuauacucugauggagaaggacaguuaccccagauuccucaagagcgauauauaucugaauuuacugaacgaccuucaggccaauucuuugaaauga

SEQ ID NO: 61780 - RNA, 726 nt, Artificial Sequence
  derived and/or modified sequence opt3 from RGS20__Homo_sapiens__NP_003693
augagaaccgccgacggcggggagcccgcuggagcaagcuccccugccgguaggguggauggcgggcugcagaugggaucugaacggauggagaugcgcaagcgacaaaugccagcggcucaggacacaccgggcgccgcacccggucagccuggggccggaucacguggcaguaacgcuugcuguuucugcugguguugcuguugcagcuguuccugccucacugucagaaaucaggaagaucaaaggccaacgaucgcaucucacgagcuucgggccgaccugcccaccugggaagagucgccugcuccaacauuggaggaaguuaacgccugggcgcagucauuugauaaauuaauggugacucccgcaggccgcaaugccuucagagaguuucugaggaccgaguucagcgaggagaacaugcuauuuuggauggcuugugaagaacucaagaaagaagccaauaagaacauuauagaggaaaaagcacggaucauuuacgaggacuauaucaguauucuguccccuaaggagguaucucuugauagccgcgugcgagaagucaucaauagaaacaugguggagccaucccagcauauauucgacgaugcucagcugcaaaucuacacauugaugcacagggacucauauccgcgguuuaugaauagugccguuuacaaggaucuccugcagagccugucugaaaaauccauugaggcguga

SEQ ID NO: 61781 - RNA, 459 nt, Artificial Sequence
  derived and/or modified sequence opt3 from RGS21__Homo_sapiens__NP_001034241
augcccgugaagugcuguuucuacagaagcccuaccgccgagacaaugacuugguccgaaaacauggacacgcugcucgcuaaucaggcaggccuugaugccuuuaggaucuuccugaaaucugaguuuucagaagagaacgucgaguucugguuggcgugcgaagacuuuaagaaaaccaagaaugcugauaaaauugccaguaaggcaaagaugauauauagcgaguucaucgaagccgacgcuccaaaagagauuaacaucgauuuugggacacgggacuuaauuuccaagaauaucgcagaaccgacucugaaauguuucgaugaggcccagaagcuaauauacugccucauggcuaaagacucuuuuccccgcuuccugaagucggagaucuauaagaaacuuguuaacucacaacaggugccuaaucacaagaaauggcugccauuuuuguga

SEQ ID NO: 61782 - RNA, 3759 nt, Artificial Sequence
  derived and/or modified sequence opt3 from RGS22__Homo_sapiens__NP_001273621
augcccgagaagagacugaccgccgaaccuccaacaaucacugaggaagaguucgaagacagccucgcuacggaugacuuucuuguggauuacuucaacgaguuucuguccuugccgaccuucucugaggcaauuagguuuaaugccgacuauggcgucuucgaaguugcgaacgaugcuccccaguuuuuagagaaacaacugaagaaaauacuacagaaucagcagccucggaacccaaucuacgacgugguacgcaaggggaaaaaugaagugaagcccguccaaaugaacgccccugaugaggacgagacaauuaaugugaacuauaauaucaugugccucucacgagaagagggaauuaaguggaucaaaaaggaacgucugccagcauuccuugagagugauuguuacuuugaauauagacuggccaaauugguuagccaggugaggugguccaagucugguaugaacuucacugucggcucgaauuuuucacccuggauagugaaaaagccuccaagccucccgcccccugcuaccgaggaggacaaccuggcaaguuacacacagaccaaggauugguucgcccuggcuaaacagucccaacagacuguaucuacauuuagccucccaugcuguguucccuauaauaaguuaaaauccccugccaucucaagugugagcgaaaacuucauuuucgacgaugggguccacccacggaccaagaaagaccccucuaagacgaauaaacugaucuccgaguuugaagaggaagagggagaggaagaggaagugucagugagccuucaggacacuccgagucaggcguugcugcgcgucuaccuagagaagaagcaagauguugacgaaucucucaccaugcauuucuccacaugcgaggaguuucugagcucguacauuuauuucauccuuagaggcgcaauacagcagauuguggguaaaccuguaggggaaacucccgauuacaucaacuuuaacaauauuaccaaggugucuuucgacgauuguuuugaguccauccacggaaagaacuuccugucagaauugguccaaacaaccaaggagaggagugaggaaaucgagcagacgagccucuccucuaaaaaugaaagcgccggcccagagucacgggcugacuggugcauuagucaucgcacuuaugauauaggcaaccgaaaggaauuugagagauucaagaaauuuaucaaggggacacugggagagagguacuggugguuauggauggacauugaacggcugaaagugcucaaggauccuggucgucaccagcgccaucuugagaaaaugaagaaguguuaucugguuuccaauggcgacuacuauuugagcgccgaaauccuaucuaaauucaagcugcucgaugggucacaguggaacgaggaacaccugagaaauauacaaagugaggugcuuaaaccccuguugcucuacugggcaccaagguuuugcgucacccacagcgcuuccacuaaguacgccucugcggagcugaaauucuggcauuuacggcaggccaagccccgaaaggacauugacccuuucccacagauggcaacacugcuaccgcuccgccccaaaucguguaucccucagaucccagaaauucaaaaggaggaauuuagccugucccagcccccuaaaucaccaaacaagagucccgaggugaaaaccgcuacgcagaagccguggaaaagagaacuuuuguauccuggaucuagcaaggaugacguaaucgagaagggcuccaaauacaugucagagagcucuaagguuauucaccugaccuccuucacagauauaagugaaugccucaaaccacagcuggacaggcgguaugccuacacugaggaaccccgcgugaagaccgucagcgaugugggugcucuugggggaucugacauggagaaucuguugcaaucccucuaugucgagaacagagccggcuuuuucuuuacaaaauucugugaacauucaggcaauaagcuguggaagaacaguguguacuuuugguucgauuuacaggcauaucaccagcuguuuuaccaggagacucuacaaccuuucaaaguuugcaagcaggcccaguaccucuuugcuaccuauguggcgcccagcgcaacacuggacaucgggcuucaacaggagaaaaagaaagaaauuuacaugaagauccagccaccuuucgaagauuuguuugacaccgccgaggaguauauccugcuccuguuacuggaacccuggacuaagaugguaaaaucggaucagauugcuuacaagaaagucgagcuuguggaagagacgaggcaauuggacuccacauauuuccguaagcuccaggcccugcacaaagaaaccuucucuaagaaggcagaggauacuaccugcgagauaggaacagguauccuaagccugucaaauguuaguaaacggaccgaauacugggacaacgugccagccgaguauaagcauuuuaaauucuccgaccuccugaauaacaaacuugaauuugagcacuuccgacaguuuuuggaaacucauucuagcuccauggaucugauguguuggacagacauugagcaguucagaaggaucacguaccgcgaucggaaccaaagaaaagcuaagucaauuuacaucaaaaauaaguauuuaaacaagaaauacuuuuucggcccgaauagcccugccagucucuaucagcagaaccaggucaugcaccugucugggggauggggcaagauacuucaugagcaacuggacgcacccguguugguagaaauccagaaacacgugcagaauaggcucgagaacguuuggcugccacuauuucuggcguccgaacaauucgcugcccgccagaagauuaaaguccagaugaaggauaucgcagaggagcuccugcuucagaaggccgagaaaaagauugguguguggaaacccguggaaagcaaguggaucucgucaucuugcaaaauaauugcuuuucgaaaggccuugcugaauccugucaccagucggcaauuccagcguuucguugcauuaaagggggaccuccuggaaaacggccuucuguuuuggcaggaggugcagaaauacaaggaucuaugucacucccauugcgacgaaagcgugauccagaaaaagauuacuacaaucauaaauuguuucaucaacucuagcauuccacccgcucuccaaaucgauauuccuguagagcaggcccagaaaaucauagagcacagaaaggaacugggaccguaugucuuuagggaggcgcaaaugaccauuuucggcguguuguuuaaguucuggccacaguuuugcgaguuccgcaaaaaucugacagacgaaaacaucauguccguuuuagaacggagacaggaguacaauaagcagaaaaagaaacucgccgugcuggaggaugaaaagucagggaaggacggaaucaaacaauaugcuaacaccaguguccccgcaauuaagacugcccuucugagcgauuccuuuuugggucuccagccuuacggcaggcagccaacgugguguuacucuaaauauaucgaggcucuggaacaagagcgaauacuacugaagauucaggaggaacuugagaaaaagcuguucgccgggcuccagcccuugaccaauuuuaaagcaucaaguagcacaaugucccugaagaagaacaugucugcgcauucgagccagaaauga

SEQ ID NO: 61783 - RNA, 636 nt, Artificial Sequence
  derived and/or modified sequence opt3 from RGS2__Homo_sapiens__NP_002914
augcagagcgccauguuccuggcugugcaacacgacugcagacccauggauaaguccgcaggcucugggcauaaaucagaggaaaagagggagaaaaugaagcggacccuccuuaaagacuggaagacacgccugaguuacuuuuugcagaacagcuccacuccuggaaagccaaaaacggguaagaaaucuaagcagcaggccuucaucaaaccgucgcccgaagaggcgcaauuauggucagaggcuuuugaugaacugcuagccagcaaguauggccucgcagccuuccgagcuuuucugaagagugaguucugugaagagaauauugaauuuuggcuugcaugcgaggacuucaaaaagaccaaauccccucagaagcugucuagcaaagcccguaagauauacacagauuuuaucgagaaagaagcuccaaaggagauuaacaucgacuuccagacuaagaccuugauugcccagaauauccaagaagcgacauccggguguuuuaccacugcacagaaaagagucuauucacucauggagaacaauaguuaccccagguuccuggaaagcgaguuuuaucaggaucugugcaagaaaccucagauaacaaccgagccacacgccacguga

SEQ ID NO: 61784 - RNA, 1776 nt, Artificial Sequence
  derived and/or modified sequence opt3 from RGS3__Homo_sapiens__NP_001263190
augaacagauucaauggccugugcaagguguguagcgagaggcgguaccgccagaucaccauuccccgagggaaagacggauuugguuucacaauaugcugugauuccccuguccguguucaagccguggacucuggcgggccagcugaaagagcaggacuccagcagcuugauacuguacugcaguugaacgagaggccgguggaacacuggaagugcgucgaguuagcccaugaaauccggucaugucccagugagauuauccugcuaguguggcgcaugguuccucaagugaaaccaggccccgacggugggguccucagaagggcgagcugcaaguccacgcacgaucugcagucuccuccaaauaaacgggagaagaacuguacccauggagugcaggcucgccccgaacagcgacacucgugccaucuuguaugugacucaagcgauggccuguugcucggcgggugggagagauauacagaaguugccaagaggggaggucaacacacucugccugcacugagucgggccaccgcuccaacagacccgaauuacauuauccucgcacccuuaaacccuggcucccagcugcuucguccaguguaucaggaggauaccauacccgaggaaucugggagcccuuccaaaggaaagucauacacuggcuuggguaaaaagagucgccugaugaaaacaguccagaccaugaaggggcacggaaauuaucaaaacugcccaguggugagaccccaugccacgcacagcucuuacggcacuuaugucacccuagcuccgaagguucucguguuuccuguauucgugcagccccuggaccuuuguaauccagccaggacacuguugcucuccgaggaacuguuacuguacgagggccggaacaaagcggcagaagucacucucuuugccuacucagaucuucuguuguucaccaaggaggacgagccugggcgaugcgaugugcuacgcaauccccuguaucuccagagcguuaaacugcaagaaggaaguucugaggaccuuaaguuuugcgugcuguacuuggcugaaaaagccgagugucucuucacacuggaagcacauucccaggagcagaagaaaagagucugcugguguuuaagcgagaacaucgcuaagcagcaacagcuggccgcgucgccacccgacucuaagauguccggugccgauaccgugggcgacgaugacgaagcaucaaggaaacggaagaguaaaaaucuagcuaaggauaugaaaaacaagcucgggauuuuucgcagaaggaaugagagcccuggagccccaccggcuggcaaggccgacaaaaugaugaaguccuucaaacccacgucugaagaggcacugaaguggggugaaagccuugagaaauugcugguacacaaguaugggcucgccguuuuucaggcuuuccugcguacugaguuuucagaagagaaccuugaguucuggcuggcgugcgaagauuucaagaaagugaagagucaguccaaaauggcaagcaaggccaaaaagaucuuugcugaguacauugccauccaagcauguaaggaagucaacuuggacucuuauacacgggagcacaccaaagauaaucuccagucagugacucgaggcugcuucgaccuggcccagaagagaauauuuggauuaauggaaaaagauaguuacccuagguuccugcgcagcgaccuauaucucgaccugauuaaccagaagaaaauguccccaccccuuuga

SEQ ID NO: 61785 - RNA, 909 nt, Artificial Sequence
  derived and/or modified sequence opt3 from RGS4__Homo_sapiens__NP_001095915
auguacaacaugaugcugcucauccagaagagaaaaggcauugggagccaacuucugagggccggagaggcugaaggugaccggggcgcagggaccgccgagcgcuccucugauugguuggacggacgaucaugggcgauaaaggaaacacccacuggcuuagcuggucguagaagugaggauagcgacaauaucuucacgggggaagaggccaaauaugcacaguccaggucucacucgucaagcugccggauuaguuuucugcuagccaacuccaagcuccugaauaaaauguguaagggacuugcuggccugccugcaucuugcuugcgcagcgccaaggauaugaaacauagacucggcuuccugcugcagaaguccgacucaugugagcacaacaguagccauaauaaaaaggauaaaguggucaucugccagaggguuucucaagaagaggugaagaagugggcugaaucccucgagaacuuaauuucacacgagugugggcuggccgcguuuaaagcauuccuuaagagcgaauacagugaggaaaauaucgacuuuuggauaucuugcgaggaauauaaaaagaucaaauccccaagcaaguugucgccgaaagccaagaagauuuacaacgaguucaucucuguacaggcuaccaaagaggugaaucuggauuccuguacacgggaagagacuucacgcaacaugcuagaacccaccauuacaugcuuugacgaggcccagaagaaaaucuucaaucucauggaaaaggauaguuaucgaagauuucugaaaagcagguucuaccuugaccuggucaacccuuccucuuguggagcagagaagcagaagggugcuaaaagcucagccgauugcgcgaguuuggugccacaaugugccuga

SEQ ID NO: 61786 - RNA, 222 nt, Artificial Sequence
  derived and/or modified sequence opt3 from RGS5__Homo_sapiens__NP_001241677
auggccgagaaggcuaaacagaucuacgaagaguucauucaaaccgaagcacccaaggaggugaacauagaccacuuuacaaaagauaucacuaugaagaaucuggucgaaccuagccucuccucuuucgacauggcccagaaaaggauucaugcgcuuauggagaaggauucacugccaagauuuguucggagugaguucuaucaggaauugaucaaguga

SEQ ID NO: 61787 - RNA, 1458 nt, Artificial Sequence
  derived and/or modified sequence opt3 from RGS6__Homo_sapiens__NP_001191346
auggcccagggcagcggggaccaaagagcugugggagucgcagaucccgaggaauccucuccuaacaugaucguuuacugcaagauugaggacauaaucaccaaaaugcaggaugacaagacagguggcgugccaauuaggacuguaaaaucauuccugaguaagaucccgagcguggucacggggaccgauauugugcaguggcucaugaaaaaucuuuccaucgaagaccccguugaggccauacaccugggaucuuugaucgcggcucagggcuauauuuuuccuaucucggaucauguguuaacaaugaaggacgaugguacuuucuaccgguuucaagccccauauuucuggcccucaaacuguugggaaccugagaauaccgacuacgcaauuuaucugugcaagcgcacaaugcagaacaaagcccgacuagagcucgcugauuacgaagcagagaaucuggcccgucuucagagagcuuuugccaggaagugggaguucaucuuuaugcaggcggaagcacaagucaaaauagaccggaagaaagauaagaccgagcgcaagauucuggacagccaggaaagagccuucugggacgugcacaggccaguacccggguguguuaacacuacagagauggauauccggaaaugccgccgauugaagaauccucagaaagugaagaaaagugucuauggagugaccgaagagucccaggcucaaucuccagugcauguccucagccagccgauuagaaagacgacuaaagaagacaucaggaagcagaucaccuuucugaacgcccaaauugaucggcacugucugaagauguccaaaguugcagagucacucauagcuuacacagagcaguacguggaauaugaccccuuaaucacuccugccgagccaaguaaucccuggauuagcgaugacguagcgcugugggauaucgaaaugucuaaggagccuucccagcagcgugugaaacgcuggggcuucucauuugacgaaauacuuaaggaucaagucggcagagaccaguucuugagguuucuggagagcgaguucaguucugaaaaccuacgguucuggcucgccgugcaggaucugaaaaagcagccacuucaagacguugcaaagcgaguggaggaaauuuggcaggaguuucuggcucccggggccccguccgcuaucaauuuggacagccauucguacgaaaucaccucucagaacgucaaagauggaggucgcuauacauucgaggacgcccaggagcacauuuacaagcucaugaaauccgauucauaugcaagauuucugaggaguaaugccuaccaagacuuacugcucgcuaagaaaaagccugaaagcgagcagggccggcgcaccucccuugaaaaguucacgagaucugugcuguauagcaacacucccuuggcgaaaaggccauga

SEQ ID NO: 61788 - RNA, 774 nt, Artificial Sequence
  derived and/or modified sequence opt3 from RGS7BP__Homo_sapiens__NP_001025046
augagcuccgcccccaacggcagaaagaaaaggccuucucggucaacccgcaguagcaucuuccagauuuccaagccaccgcugcaaucuggggacugggagcgacguggaucggguucagaaagcgcucacaaaacacagagagcacucgaugacugcaagaugcuugugcaggaguuuaauacucaggucgcccuguacagggaauugguuauaaguaucggcgauguguccguaucuugucccagcuuacgggcggagaugcauaaaacgcgcaccaaggggugcgaaauggcuagacaagcccaccagaagcuggcagccauuuccggaccugaggacggcgagauccauccagaaauuuguaggcuauauauccagcuccagugcugucuggagauguacacaacugaaaugcuuaaaucaauaugccuguuggguagucuccaauuccaccggaaggggaaagagcccggaggcggcaccaagagccuggauuguaaaaucgaggaaucugcugagaccccugcacuggaagacuccucaagcaguccaguggauucucagcagcauuccuggcaggucagcacagacauugagaacacugaacgcgauaugcgagagaugaagaaucucuuaucgaagcugagagagacaaugccccuuccuuugaaaaaccaagacgauucuucccugcuaaaucucaccccauauccgcuggugaggcggcguaagcgcagauuuuucgggcuuugcugucugaucucaaguuga

SEQ ID NO: 61789 - RNA, 1275 nt, Artificial Sequence
  derived and/or modified sequence opt3 from RGS7__Homo_sapiens__NP_001269702
auggcccagggcaacaauuacgggcaaaccagcaacggaguggcugacgagucccccaauaugcuggucuauagaaagauggaagauguuaucgcaaggaugcaggacgagaaaaacgguauuccuauacggacagugaagucuuuccucucaaaaaucccaaguguauuuagcggcuccgauauugugcaguggcuuaucaagaaucugacuauugaagacccggccgucuacuugugcaaacgcacgaugcagaacaaggcgcgauuagagcuggcugauuaugaagccgagucucuagcacgucuccaaagagccuucgcuaggaagugggaguuuaucuucaugcaggcagaagcccaggcuaaaguggacaagaaacgggauaagauagagcgcaaaauccuggacucgcaggaaagagccuuuugggauguucacaggcccgugccugggugugucaauaccacagagguggacauuaagaagucaagccggaugcgcaacccacauaaaacucgaaagaguguauacggacuucaaaaugauaucagaucccacucucccacccauacaccuaccccagagacuaaacccccuacagaagacgagcugcagcagcagauuaaguauuggcaaauccaguuggauaggcaccggcucaaaaugagcaagguugcggacucccugcugucauacaccgaacaguaucucgaguacgacccauucuuacugccgcccgauccuaguaacccauggcuuagcgacgauacgacuuuuugggaauuggaggcaucuaaagagcccucccaacagcgugugaagcgcuggggcuucgguauggacgaagcccugaaggauccugucgggagagagcaguuucuaaaauuccucgaaucagaguuuagcagugaaaaucugagguucuggcuugcuguggaggaccugaagaaacggccaauaaaggaggugcccucucgaguccaggaaauuuggcaagaguuuuuggccccgggagcaccuuccgcuaucaaccucgauagcaaaucguacgacaagaccacacagaauguuaaggaacccggccgcuauacuuucgaggaugcccaggaacauauuuacaaacugaugaagucugacuccuauccaagauucaucaggucaagugcguaccaggaguuacugcaagccaaaaagaaaggccggaacaucccuauuuuucccugccacaagaauuguaccccaacacuccgcgcaagcaccaaccuucuguga

SEQ ID NO: 61790 - RNA, 543 nt, Artificial Sequence
  derived and/or modified sequence opt3 from RGS8__Homo_sapiens__XP_005245612
auggccgcucugcucaugcccagaaggaacaagggcaugcggacccgccuugggugccugagccacaaauccgacucuuguucagauuucacagcaaucuugccugacaagccaaaucgagccuuaaaacgucugaguacugaggaagcgacgagaugggcugauagcuuugacgugcuacucucccauaaguacggagucgccgcauucagggccuuucugaaaaccgaguucucugaagagaaccuugaauuuuggcuggcuugcgaggaguucaagaagacacggucgacugcaaaauugguuucaaaggcccaccgcauuuuugaagaguucguggauguacaggcuccgagagaagugaauauagacuuucaaaccagggaggccacacggaaaaaccuccaggagcccagccugaccuguuucgaucaggcgcaggguaagguccauagucugauggaaaaagacuccuauccucgcuuucuccgaucuaagauguacuuagaucugcuuagccaaucccagagaagguugucauga

SEQ ID NO: 61791 - RNA, 708 nt, Artificial Sequence
  derived and/or modified sequence opt3 from RGS9BP__Homo_sapiens__NP_997274
auggccagagaggaaugcaaggcucugcucgacggccuuaacaagaccacagcauguuaccaccaucugguguugacugucgggggaagcgccgauucccagaauuuaaggcaagagcugcagaagacgcggcagaaagcgcaggaacuagcuguuucuaccugcgcccgccucacagcagugcugcgagaccguggucuugccgcugaugagagagcagaguucgaaaggcuguggguagccuuuucaggcuguuuggaccuccuggaggcugauaugcggcgcgcccuggaacucggggcggcauuccccuuacacgccccuagaaggccacuggugcggacuggagucgcuggcgccaguagcgguguggcagcucgcgcccuuuccacccgaucuuugagacuggaggcggaaggggacuuugauguugccgaccuaagggagcucgagcgggaagugcugcaagucggagagaugaucgauaacauggaaaugaaggugaauguaccgcguuggacaguucaggcacgccaggcugccggcgcugagcuucugucgaccgugucagccggccccagcagugucguguccuugcaggaaagagggggagguugcgacccuaggaaagcacucgccgcuauucuguucggcgcgguguuacuggcagccgucgcucucgccguuuguguggcaaaacuuucuuga

SEQ ID NO: 61792 - RNA, 2016 nt, Artificial Sequence
  derived and/or modified sequence opt3 from RGS9__Homo_sapiens__NP_001075424
augaccaucagacaccagggccaacaguacaggccccggauggccuuccugcagaagauugaggcucucgugaaagacaugcagaacccugaaacagggguccgcaugcaaaaucagcgaguucuugugacuagcguaccacaugcaaugacgggauccgaugugcugcaguggauaguccagcguuuguggaucucuucauuagaggcccaaaaccuggguaauuuuauugugagauauggcuacaucuauccgcuacaggaccccaagaaccucauucugaaaccugaugggagucuuuacagguuccagaccccauauuuuuggcccacacagcaauggccugcggaagacacugauuacgcuaucuaucuggccaagcggaauaucaaaaagaagggaauauuggaggaauacgagaaagagaacuacaauuuccucaaccagaagaugaauuauaaaugggacuuuguuauuaugcaggcaaaggaacaauaccgcgccggcaaagagagaaacaaggcugauagguaugcacuggacugccaggaaaaggccuacuggcuggugcaccgguguccacccgguauggauaauguccucgacuauggguuagaucgcgugaccaacccuaaugagguuaaaaagcagacaguaguggcugucaaaaaggagaucauguacuaucagcaagcccugaugcgaagcaccgugaaauccucugugucgcuuggaggcauugucaaguacucagaacaguucagcaguaacgacgcgaucauguccggcugcuugccaucuaauccguggauaacugaugacacacaguuuugggaccugaacgcaaagcuaguugagauucccaccaaaaugagaguggaaaggugggccuucaacuuuagcgagcucauccgggauccuaaggggcgucaguccuuccaauacuuucugaaaaaggaguucucaggagaaaaucuugguuuuugggaggcuugugaagaccugaaauauggcgaucagaguaagguaaaagagaaggccgaagagauuuacaaguuguuccucgcaccaggggcucgcagauggaucaacaucgacggaaaaacgauggauauuacugugaagggccugaaacauccccacagguaugucuuagacgccgcgcagacccauauauacaugcugaugaagaaagauagcuaugcccgguaccucaagucuccuaucuauaaggacaugcuugcaaaagcuauugaaccacaggagacaacuaagaaauccucaacccugcccuucaugcgacgccacuugagaagcaguccgucuccugugauccuaaggcaacuggaggaagaggccaaggcucgggaagccgcaaauacaguugauauaacccagcccggucagcacauggccccauccccucaucucacgguguacacugggacaugcaugcccccaagccccucgucuccuuuuuccucaaguugucgcagcccaagaaaaccguucgcuucccccucuagguuuauucgucggccuagcaccacuaucugcccaucacccauccgagucgcgcuggagaguuccagcggacuugaacagaagggcgaguguucuggcucaauggcaccuagagggccaagugugacagagagcuccgaagccucucuggacaccucguggcccaggagccgcccgcgggcuccuccaaaggccagaauggcauuguccuucucaagguuucuccgccgaggaugccuggccagucccguauucgcucgguuaucuccuaaaugucccgccguuagccacggucgugugcaaccacugggcgaugucgggcagcagcuaccuagacucaaguccaaaaggguggcaaacuuuuuccaaauuaagauggacguccccacgggaucagguaccugccugauggacagcgaggaugcgggcacaggggaaucuggcgaccgcgcuacugagaaagaggugaucuguccaugggaaucccuuuga

SEQ ID NO: 61793 - RNA, 3231 nt, Artificial Sequence
  derived and/or modified sequence opt3 from RGSL1__Homo_sapiens__NP_001131141
augagcuccgccgagaucauuggcucuaccaaccugauaauccuccuugaagacgagguguucgcugauuucuucaauacauuucugucauugcccgucuucgggcagacuccuuuuuacacgguugaaaacagucaauggagcuuauggccagagauuccgugcaaucugaucgcaaaguauaaaggacuacucaccuggcuggaaaaguguagacuucccuucuuuugcaaaacaaaccuguguuuccacuacauuuugugccaggaguuuaucuccuucauaaagucuccugaggguggcgaggaacucguggacuuuuggauccuggccgaaaauauucugucgaucgaugagauggaccucgagguaagggauuauuacuuaucacugcuuuugaugcugcgggcgacucaucuacaggaagggagccgcguggucacccucuguaacaugaauauuaaaagucugcuuaaccuguccaucuggcacccaaaucagucuacaacccgacgugagauauugagccauaugcaaaagguggcucucuucaagcugcaguccuauugguuacccaacuuuuacacucacacaaaaaugaccauggccaaggaagaggcaugccauggacugaugcaggaauaugagacgagacucuacucaguuuguuacacucacauuggcggucuuccucugaauaugaguaucaaaaagugccaccauuuccagaaaagguauagcucucggaaggccaagcgcaaaauguggcaauugguggacccagauuccuggucacuagagauggaccugaagcccgaugcuauugggaugccucuccaggaaaccuguccacaggagaaagucgugauccagaugccgagccugaagauggcaaguucuaaagaaacaagaaucuccagccuugagaaggacaugcacuacgccaaaauuucgucuauggaaaacaaggcuaagucccaucugcacauggaggcccccuucgagacuaaaguaucaacccacuugaggacaguuauaccuaucgugaaucauaguagcaagaugaccauucaaaaagcgaucaagcaguccuuuucucucggauauauacaccuggcauuaugcgccgaugcuugugccggcaacccauuccgggaccaucugaaaaagcuaaaucucaaggucgaaauucagcugcuugauuuguggcaagaccugcagcacuuucucagcgugcugcuuaacaacaaaaagaauggcaacgcaaucuuccgccaucuguugggggaccgaaucugcgagcucuaccugaaugaacagauuggacccugcuuaccucugaaaucacagacgauccaaggucuaaaggagcuccugccaaguggcgaugugauucccuggauaccgaaagcucagaaggaaaucuguaagaugcuuuccccuugguaugacgaguuuuuggaugaggaagacuacugguuccugcucuuuacuacacagaacagauucauuagcucuaggcagcacaaacgggaguuuaucgggaaggaagagaauauccuguuauauaaacguauucaacagucacuggagcuuagucaggccuuggcggauaugaaggaaauggacuaccgccaguggagaaaaauagccaccgaggaucucaagcaaggaggcagccugcaggucgaacuaacuucccccguuuuccugacagacaucaccaagaugucuuuugaggaacucugcuacaaaaacccaaagauggcaauucagaaaaucucggaugacuauaagauuuacugugagaaagcuccuaagaucgauuucaaaauggagauaaucaaggaaacgaagaccgugagcagguccaaucggaaaaugucacugcuuaagcgaacauugguacgcaaacccaguaugagaccaaggaaccugacugagguguuacucaauacccagcaccuggaauuuuuccgggaguuccuuaaggaacgcaaagccaagauuccccugcaauuuuugacagcuguccagaagaucucuauugagacuaacgagaaaaucugcaagagccucauagaaaaugugauuaaaaccuucuuucagggucaacuguccccugaggaaaugcuacagugugacgccccaaucauuaaggagaucgcaucaaugagacauguuacaaccagcacucugcucacgcugcaggggcacgugaugaaaucuauagaagagaagugguucaaggacuaucaggaucuuuuuccgccccaucaccaagaggucgaagugcaguccgagguacagaucaguagcaggaaaccuucuaagauuguuuccacauacuugcaggaaucacagaaaaagggauggaugcguaugaucaguuucauucggagcuuuugcaaauaucgaagauucaugcugaacccaucgaagaggcaggaguuugaggacuacuuacaccaggaaaugcaaaauuccaaggagaacuucaccacugcccauaauaccucuggccgcagcgcucccccuucaacaaacgugcggagugcggaucaagaaaacggcgagaucacccucgucaaaagaaggauauuugggcaccgcauuaucacugugaauuucgcaaucaacgaccuguacuuuuucuccgaaauggagaaguucaaugaucuugucucuagcgcccauaugcuacaggugaaccgagcuuauaaugagaacgacguuauucugaugcgguccaaaaugaauaucauucagaagcucuuucugaacucagauauaccacccaaauugcgugugaauguaccggaauuucaaaaggacgccauccuggcagccauuacagagggauacuuagauagaagcgucuuucacggugcuaucaugaguguguucccuguugugauguauuuuuggaaaagguucuguuuuuggaaggccacgcgcucuuaccuccaguaucggggcaagaaauucaaggacagaaaauccccacccaagagcaccgauaaauacccuuuuucgucagggggagacaacgcaauucugagguucacucuucugcgaggcaucgaaugguugcagccccagcgcgaggcgauaucuaguguccaaaauuccagcucuagcaagcucacacagccacggcuggugguauccgcuaugcagcuacauccugugcagggucaaaagcugucauauaucaaaaaggaaaaauga

SEQ ID NO: 61794 - RNA, 1230 nt, Artificial Sequence
  derived and/or modified sequence opt3 from RHAG__Homo_sapiens__NP_000315
augagauucaccuuuccccugauggccaucgugcucgagauugcuaugauaguccuuuucggccuguuuguugaauacgagacagaccagacuguguuggaacaauuaaacaucacgaagccuaccgauauggggauuuucuuugagcuguauccacuauuccaggacguacacgugaugaucuuugucggauucgguuuucucaugacauuccugaaaaaguacggcuuuagcuccguggggauuaaucuucugguugcagccuugggacuccaguggggcacuaucgugcaggguauacugcaaucucaggggcagaaauucaacaucggaauuaagaauaugaucaacgcggauuuuucagcugccaccguccugauuaguuucggcgcagugcucggcaaaacaagcccgacccagauguuaaucaugacuauacuggaaauuguauucuuugcccauaaugaguaucuuguuuccgagaucuucaaggcuucugacauuggggcaucgaugacaauccacgccuuuggagcuuacuucgguuuggccguggcgggcauccuguauaggucagggcuacggaagggacaugaaaacgaggaaagcgcauacuauagugaucucuuugccaugauuggcacccuguuccuuuggauguuuuggcccuccuucaauucugcuauagccgagccuggugacaaacaaugccgcgcaaucgucaacacguacuuuagccuggcugccuguguguugacugcguucgccuuuuccucacucguggagcaccgagggaagcugaauaugguccauauucagaacgcaaccuuagcuggaggcguugccgugggcacaugcgcugauauggccauccacccauucgggaguaugauaauuggaagcaucgcagguaugguaucugugcugggcuacaaauuucucacuccccuuuucaccacaaagcugcguauccacgacaccugugggguccauaauuugcacggacuaccuggcgugguuggugggcuggccggcauuguggcugucgcgaugggagcauccaacacgucaauggccaugcaggcugccgcacucggcagcaguaucgggacugccgugguaggaggucugaugacaggccuuauucugaaauugccacucugggggcagcccucugaucaaaauugcuaugacgauuccguuuacuggaaggugccuaagaccagauga

SEQ ID NO: 61795 - RNA, 1095 nt, Artificial Sequence
  derived and/or modified sequence opt3 from RHBDD2__Homo_sapiens__NP_001035546
auggccgcuagcggccccgggugcagauccuggugucugugcccugaggugccaucugcaaccuucuuuacagcccuccuuucacuguuggucaguggaccgagguuauuccugcuacagcaaccccucgcgccuagcggucugacucuuaaguccgaagcucugcggaacuggcagguuuaccgcuuggugacguauaucuuuguauacgagaauccaauuucucuccuguguggcgccauaaucauuuggcgauucgcagggaacuuugaacguaccgugggaacagucagacacugcuucuuuacugugaucuucgccaucuuuucggcuauuauauuccugucauuugaggcaguuagcagucucuccaaauuaggcgaaguggaggacgccagggguuucacccccgucgcuuuugccaugcugggggugacaaccguacggucucgcaugagaagggcgcuuguuuucggaaugguggucccuagcguguuggugccauggcugcuacucggcgcauccuggcugaucccccagacuucauuccuuaguaaugucuguggccugagcauuggguuggccuauggacucacauacugcuauucuaucgaucuguccgagcggguugcuuuaaagcuggaccagaccuuuccuuucucacucaugcgccgaauuagcguguuuaaauacguaagugguucuuccgccgaaagaagggcagcucaaagccggaaacuuaacccagugccgggcucguaucccacgcagucuugucauccucaccuguccccaucacaucccgucagucagacucagcacgccagcgggcaaaaguuggcguccuggccuucuugcaccccaggacauaugcccacacuaccgccuuaccagcccgccagcggccuguguuacgugcagaaucacuucgguccaaacccuacuucaaguuccguuuaucccgcaagcgcugggaccucucucggaauccagccacccacaccugucaauucaccaggcaccguguacaguggcgcccuggggacgccgggagcugccgguagcaaggaguccucucgugugcccaugccuuga

SEQ ID NO: 61796 - RNA, 1161 nt, Artificial Sequence
  derived and/or modified sequence opt3 from RHBDD3__Homo_sapiens__NP_036397
augcacgccagaggcccccaugggcagcugagcccugcucucccacuugcauccucugugcugauguuguuaaugucaacccuguggcuagucggagccgguccgggccucguucuggcgcccgagcuucuguuggacccuuggcaagugcacaggcuccugacacaugcucuggggcacacugcccucccaggauuacugcuuaguuugcugcuacuccccacgguaggcuggcagcaggaaugccaucuggguacccuucgguuccugcacgcaagcgccuugcucgcucuggcauccggguuacuggccgugcuccuugcuggacugggcuugucuucggccgcgggcucauguggguacaugccuguccaccuagcaaugcuggccggagagggucaucgcccacgacgucccagaggcgcucucccuccauggcugagcccguggcuucuguuggcccucacaccccuguuaaguuccgaaccuccauuucugcagcuacucugcgggcugcuugcaggauuggcuuaugccgcgggcgccuucagguggcuggagcccucugaacggcgccuccaagugcugcaggaggguguucuuuguagaacucuggcagggugcuggccuuugaggcuccuggcuaccccaggaagccucgccgagcugcccgugacacacccggcuggcguccggccucccaucccaggcccucccuacguggccuccccagaucuauggucacauugggaagacagugcauuacccccuccaagccugcgcccgguacagcccaccugggaggggucuuccgaagccggacuugauugggcuggugcgucauuuagcccuggcacuccaaugugggcagccuuggacgagcagaugcugcaagaggggauucaggcuagucuccuggauggacccgcccaggaaccucagucugcaccaugguuauccaagagcucgguuucuucccugcgacuucaacaguuggagagaaugggcuuccccacagaacaggccguggucgcucucgccgcaaccgguaggguggagggggcggugucacugcuagucggcggacaaguuggcacggaaacucuggugacccacgggaaaggagguccggcucacagugagggcccugggccacccuga

SEQ ID NO: 61797 - RNA, 2568 nt, Artificial Sequence
  derived and/or modified sequence opt3 from RHBDF1__Homo_sapiens__NP_071895
augagcgaggccagaagggacuccaccucuucacugcagcggaagaaacccccuuggcucaaguuggauaucccaagugcugugccgcugacagcagaggaacccagcuucuugcaaccuuuacgccgacaggccuuucugcguuccgucucuaugccagcggaaacugcucacauuucgucaccccaucacgagcuaagaaggccuguucuccagcggcagacgagcauaacccaaacaauccgcagaggcacugccgacugguucggggugaguaaagauuccgacucuacccagaaguggcagaggaaaagcauucggcauugcucccagcgcuacggaaagcugaagccacaaguacuucgagaacuggauuugcccucacaggacaacgugagucucacaagcaccgagacuccuccaccgcuguaugucggucccugucagcugggcaugcagaaaaucauugauccucucgcaagagggagggccuuucggguggcugacgauacagcagagggauuaucugccccacacacccccguuacgccuggcgcugccucccugugcucauucagcaguucucguuccgguuuucaucgccuuccaagaaggcggaagcgagaaagcguggcgaaaaugucguuccgcgcagccgcugccuugaugaaggggagaucugucagggacggaacuuuucggcgcgcacaaagaagguccuucacccccgcuucauuucuggaggaagauacaacugacuucccggaugagcuagacaccaguuucuucgcccgugagggcauccuccacgaggaacugagcacauacccugacgaaguguuugagucccccucugaagcggcccuuaaagauugggagaaggcaccagagcaggcugaccugaccggcggggccuuggaucggagcgaacucgagcgaucacaccugauguuaccucuggaaagaggauggaggaagcagaaagagggugcugccgcaccccaaccaaagguacgccuccggcaggaaguugugaguacggccggccccagaagggggcagcgcauagcugucccugugcgaaaacuuuucgcgcgggagaagcguccauauggacugggcaugguggguagauugacuaauaggacauaccgcaaacggaucgacuccuucgucaagagacagauugaggauauggacgaucauaggccguuuuucaccuauuggcuaacuuuuguucacagccuggugacaauccucgcaguauguauuuacgggaucgcccccgugggauucucucaacaugaaaccgucgacucagugcugcgaaaccgcggcguuuaugagaaugugaaauacguccagcaggaaaacuuuuggauaggcccuaguagcgaggcucuuauucaccugggggccaaguucuccccaugcaugcggcaggauccccaagugcacucuuuuaucagaucggcaagggaacgugagaagcauagcgccuguugcguacgcaaugaccgguccggauguguucagacgucagaggaagagugcaguucuaccuuggcugugugggucaaauggccuauucacccaagcgcccccgaacucgcaggucauaagagacaguucggcuccgugugucaccaggauccgagggucugcgacgagccuucaagcgaggacccacaugaauggcccgaggauaucacaaaauggccuaucuguacuaagaacucugcggggaaucacaccaaccacccccauauggacugcgugauuacaggacgaccaugcuguauaggcacuaaaggucggugcgaaaucaccucccgcgaguacugugauuuuaugagaggguauuuccacgaagaggcuacacugugcagucaaguucauuguauggacgaugugugcggcuuacugccuuuucuaaaucccgagguaccagaccaguucuacaggcucuggcugagccuuuuucuucacgccggcauucugcacugucucgucucuaucugcuuccagaugaccgugcugcgggaucuugaaaagcuggcaggauggcaucgaauagccauuaucuauuugcucuccgggguuacuggaaaccuggcuucagccaucuucuuaccguacagagcagagguggguccugcuggcagucaguuugggauucuggccugucuauucgucgaacucuuucaaagcuggcagauccuggcgcgccccuggagggccuucuuuaaacuuuuggcugugguacuguuccucuuuacguucggacuguuaccauggauugacaauuuugcacacauaucgggcuucaucuccggucuguuucuuucuuucgccuuuuugcccuauauuagcuucgggaaguucgaucucuaccguaagcggugccagaucaucauuuuucaagugguuuuccugggccuacuggcuggacucgucgugcuguuuuauguguacccugucagaugugaguggugcgaauuucuuacaugcauaccauuuaccgacaaauucugugagaaguacgaguuggaugcccagcugcauuga

SEQ ID NO: 61798 - RNA, 2484 nt, Artificial Sequence
  derived and/or modified sequence opt3 from RHBDF2__Homo_sapiens__NP_001005498
auggccagcgcugacaagaacggcggguccgugucuucagucaguagcuccagacugcagucuaggaaacccccuaaucucucgaucaccauuccaccgcccgagaaggaaacacaagcaccuggagagcaggauucaaugcuuccagaacggaaaaaccccgccuaccugaaaagcguuaguuugcaggagccucgcucccgauggcaggaaucuagcgagaagcguccagguuucagaaggcaagcguccuuaucacagaguauacggaagggcgcugcccagugguuuggggugagcggagacugggagggccagcgccaacaguggcagagaaggucucugcaccauugcuccaugcgguauggucgccuaaaggcaucaugucagcgagaucucgaacugcccagccaagaggccccuaguuuccaggggacugaaucuccaaaaccgugcaagaugcccaaaaucguagacccucuugcuagaggaagggcauuucggcacccagaggagauggaucguccccaugccccucacccaccccugacgccgggcguguugucccucaccagcuucacaucgguccgcucuggcuacucccaucugccuagaaggaagcggaugucaguggcucacaugagucugcaggccgcggcagcccucuuaaaagggcgaagcguucuggacgcuacuggacaacgcuguagaguggucaagagguccuuugccuuccccucuuuucuugaagaggaugugguagacggugcagauaccuucgacagcucauuuuucaguaaggaagagauguccagcaugccagaugacguuuuugaaucuccucccuugucagcuaguuauuuccggggcauuccacacagcgccucccccgugucuccugaugggguccagaucccacugaaagaguacggacgcgcgccggugcccggcccuagaagggguaagcguauugccucgaaagugaagcauuuugcauucgaccggaaaaagcgacacuaugggcuaggagucguuggcaauuggcucaacagaagcuacaggcgcuccaucucaaguacagugcagcggcagcuggagucuuucgacagccauagaccauauuuuaccuacuggcuuacuuucguacacgugauaaucacacuguuggucauuugcaccuacggcaucgcucccgugggguuugcccaacacguuacgacucagcucgugcugaggaauaaaggagucuaugaauccgugaaguacauucagcaggagaacuucuggguagguccuucaagcaucgauuuaauacaucugggcgcuaaguuuucuccauguauucgcaaagacgggcaaaucgaacagcucguucuucgagagcgggaucuggaacgugacuccggaugcugugugcagaaugaucacaguggcugcauucagacccaaagaaaggacuguagcgagacauuggccacuuucgucaaauggcaggaugacaccggucccccgauggauaagucugaccuagggcagaaaaggacauccggcgcagugugccaucaggauccucgcaccugugaggaaccagccucaaguggagcucacaucuggcccgacgacaucacgaaguggccuauuugcacugagcaagcgcggagcaaccauacaggcuuucugcacauggauugcgaaauaaaggggagacccuguugcaucggaaccaaagguucgugugagauuacuacaagggaauauugcgaguucaugcacggcuacuuucaugaggaagcaacccucuguucccagguccacugccuggacaaggugugugggcuucugccauucuugaauccugagguucccgaucaguuuuaucgacucuggcugucuuuauuccugcaugccggagugguacacugccuagucagcgugguuuuucaaaugacgauccuccgcgaccuggaaaaacuugcuggcuggcaccggauagccauuaucuucaucuugucagguauuaccgggaaccuggcaagugccaucuuccucccauacagagcugaggugggcccggccggaucccaguuuggccugcuugcaugucuguucgucgaguuguuucagucuuggccucuccuggaaaggcccuggaaggcguucuuaaaucugagcgcuauugugcuauuucucuucauaugcgggcugcuuccauggaucgauaacauugcccauaucuuuggauucuuguccggucugcuccuggcauuugccuucuuacccuauaucacauuuggcacuucagacaaauaccguaagcgcgcucugauucuugugagcuugcucgccuucgcagggcuguuugcugcccuaguacuguggcucuacauauauccuaucaauuggccauggauugagcaccugaccuguuuccccuucacaagucgguuuugcgaaaaguacgagcuugaucagguuuugcauuga

SEQ ID NO: 61799 - RNA, 1122 nt, Artificial Sequence
  derived and/or modified sequence opt3 from RHBDL1__Homo_sapiens__NP_001265649
auggacagaagcucccugcuccagcuuauccaagagcagcagcuggaucccgaaaacaccggcuucauuggggccgacacauuuacuggauuggugcacucucaugaguuaccucuggauccagcuaagcuagacaugcucgucgcacuggcccagucaaaugaacaaggucagguuugcuaccaggagcuuguggaucugauaaguagcaaaagguccucuucguucaagcgggcgaucgcuaacggccagcgcgccuugccgcgagacgggccccucgaugaaccuggacugggcguauauaaacguuuugugagauacgucgcauaugagauucugccaugugagguggacaggcggugguacuucuaucgccacagaucaugucccccuccaguuuuuauggccagcgugacgcucgcucaaaucauugucuucuuaugcuacggugcaaggcugaauaagugggugcuucagaccuaucaucccgaauacaugaaaaguccuuugguauaccacccagggcaucgggcccgcgcuuggcgauuucugacauauauguucaugcacguuggacuagagcagcucggcuuuaacgcccugcuucagcugaugaucggcgugccguuggaaaugguccacgggcuccugagaauauccuuacuguaccucgcgggagugcuugcagguucucugacugugagcaucaccgauaugagggcccccgucguuggcggguccggaggcguguaugcuuugugcucagcccaucuagcaaauguagugaugaacugggcugguaugcgguguccuuacaagcugcuccguaugguccuggcccuugugugcaugaguagcgagguugggcgcgcgguguggcugagauucucuccacccuugccugccuccggaccacaacccucauuuauggcacaccucgcuggcgccgucgugggcguaagcauggggcugacaauuuuaaggaguuaugaggaacggcugcgagaccaguguggaugguggguugugcuacucgcuuacgguaccuuccugcuuuuugccgucuucuggaauguguucgcauaugauuugcugggcgcccauaucccgccucccccauga

SEQ ID NO: 61800 - RNA, 1152 nt, Artificial Sequence
  derived and/or modified sequence opt3 from RHBDL2__Homo_sapiens__NP_001291675
augcagcugggcaagagacacaaacucaccacaaagagcgugugccaugggaaaggagucguuaucagggugcuugcccugcccgguccuuccuggguacggcgccgacgugagggcaaggcuuuggaaucuucaagaugugcaaggcaaccacgggaggaacgccagccggaggacuuagggcccccugccgugccaugggauaguugccccagcggagaagagggcgguccuagaacuauggcggcuguccacgaccuggagauggaauccaugaaccuaaauauggggagggagaugaaagaggaacucgaggaagaggaaaagaugcgggaggauggaggcggcaaggaccgcgccaaaucuaagaaagugcaucgaauuguuucgaaguggaugcugccagaaaaaucaagagggacguaccuugagagggcaaacuguuuucccccuccaguguucauaaucagcauuagucuggccgaguuggcugucuucaucuauuacgcaguguggaagccgcagaagcaguggauuacccucgauacaggaauccuggaaucccccuuuauauauucuccugagaaacgggaagaggccuggcguuucaucagcuacaugcugguacacgcugguguucaacauauucucggcaauuuaugcaugcagcuggugcuugggaucccauuggaaaugguccacaagggacugcgcgugggccuaguguaucucgccggugucauugcggggucccuggcaucaaguaucuuugacccccuuagauaccugguuggagccagcggcggcguguaugcuuugaugggaggguacuucaugaacguacucgugaauuuucaggagaugauaccugccuucgguauuuuuaggcuguuaaucauuauccugaucauuguccucgauaugggcuucgcacuuuaccggcgauuuuucgugccagaggacgggucucccguuuccuuugcugcccacauagcgggaggcuucgccgguaugucaaucggguauacuguguucagcuguuuugauaaagcacuguugaaggacccgcgcuucuggauugcuaucgccgcuuaccuagccugcguccuguuugcaguguucuuuaacauauuccucaguccugccaauuga

SEQ ID NO: 61801 - RNA, 1125 nt, Artificial Sequence
  derived and/or modified sequence opt3 from RHCE__Homo_sapiens__XP_011540191
augcccggcaccgugcuggucgggcaggaccucacaguuauggccgcucuuggacuggguuucuugacuagcaacuuuagaaggcacuccuggucuucaguggcauucaauuuauuuaugcuggcccuaggcguacaaugggcgauccuccuggauggguuccuuagucaguuuccuccaggaaagguggucauuacgcuguucagcauacgguuggcuaccauguccgccaugucugugcucaucucggcaggcgccguucuggguaaagugaaccuggcucagcucgucgugaugguauuaguugaggugacagcacuggggacucuucgcauggucauuucaaauaucuuuaacaccgacuaccauaugaauuugcgacacuucuauguguuugccgcuuacuucggacugacaguggccuggugccuaccgaagccccucccuaaaggcaccgaagauaacgaccagcgugcgacuauuccaagccugagugcaaugcuuggcgcccuguuuuuguggauguucuggcccuccgucaauucugcucuccugagaagcccuauccaaaggaagaacgccauguuuaauacauauuacgcauuagcuguuuccgugguaaccgccauaucagggaguagccuggcgcauccacagcggaaaaucucuaugacguaugugcacuccgccguccucgcaggagguguggcuguuggcacuucaugucaucuuauucccagcccuuggcuggccaugguguuggggcuagucgcuggacugaucaguauuggcggugccaagugccucccaguguguugcaaccgcguacuggggauccaccacauaucuguuaugcauuccauuuucagccuucugggauugcucggcgagaucaccuacauugugcuguuaguccugcacacaguguggaauggcaacgggaugaucggauuccagguccuacucucgaucggugaacugucucuugcaauugugauagccuugacuuccggccugcucaccgggcugcuucugaauuugaagaucuggaaagcuccgcauguugcgaaguauuuugaugaccagguguucuggaaauuuccccaccucgcaguaggauucuga

SEQ ID NO: 61802 - RNA, 1440 nt, Artificial Sequence
  derived and/or modified sequence opt3 from RHCG__Homo_sapiens__XP_011519965
auggccuggaacaccaaucugagauggaggcucccccuuacaugccuguuguuacaggugaucauggucauucuguucggcguuuuugugcgguacgacuucgaggcugaugcacacugguggagcgaacgcacucauaagaaccuauccgacauggagaaugaauuuuauuaccgauauccuucuuuccaagauguacacgugauggucuuugugggguucggauuucucaugacguuccugcagcguuacgguuuuucagccguuggcuucaacuuucuucuggcggcuuucgggauacagugggccuugcucaugcagggaugguuucauuuccugcaagacagauauaucguggucggcguggagaaucugauuaacgcagauuucuguguagccaguguuugcguggcuuuuggugcaguccucgggaaagugagcccaauccaguuacugauuaugaccuucuuucaggugacacuuuucgccgucaaugaauuuaucuugcugaaccuacucaagguuaaagacgcuggaggcuccaugacuauacacaccuucggcgccuacuuugggcugacagugaccaggauccuuuaucggcgcaaucuggagcagucuaaggagagacaaaacucgguauaccagucagauuuguucgcgaugauuggaacucucuuucuguggauguacuggccgagcuucaauagugcaaucuccuaucauggugacucucagcacagggccgcuauuaacacauacuguagcuuagccgcaugcgugcugaccuccgucgcuaucucaagugcccuccacaaaaagggcaaacuugauauggugcauauacagaaugcgacgcuggccgggggaguugcagugggcacugcugccgaaaugauguugaugcccuauggugcucuaauuaucggguuugucuguggaauuaucagcacccugggcuucguguaccucacaccuuuucuggagucucggcuucacauccaagacacuugcggcauuaacaaucugcaugggauaccaggaaucauugguggcaucguaggggccguuaccgcagccuccgcuucauuggaaguguauggaaaggagggccucguccacagcuucgauuuccaggguuuuaacggggacuggacagcgcgcacccagggcaaguuccaaauauacggacuguuagugacgcuggcaauggcccuaaugggcgggauuaucgucggacucauccugcgacuucccuuuuggggucagccuagugaugagaacuguuucgaagacgcuguguauugggagaugccagaaggcaauucuacuguuuacauucccgaggacccuacauuuaaaccauccgggccgagcgugcccucgguaccuauggucucuccauugcccauggccuccucagugccucugguuccauga

SEQ ID NO: 61803 - RNA, 555 nt, Artificial Sequence
  derived and/or modified sequence opt3 from RHEB__Homo_sapiens__NP_005605
augccccagagcaaguccagaaaaaucgccauucugggcuacaggucuguggggaagucaagucucaccauacaauucgucgagggacaguuuguugacagcuaugauccuacaaucgaaaacacuuucacgaaacuuauuaccgugaauggucaggaguaccaucugcaguugguagacacagcuggccaagaugaauauuccaucuuuccacagacuuacucuauugacaucaacggguauauauuaguguacucggucaccucaaucaagagcuucgaggugauuaaaguuauccacggaaagcugcuagauauggugggcaagguccagauuccgaucaugcucguggguaauaaaaaggaccugcacauggaacggguaauaaguuaugaggaggggaaagcacuugccgaauccuggaacgcggcuuuucuggagucuagcgccaaggaaaaucagacagcaguugauguguuccgccgaauuaucuuggaggccgagaaaauggacggagcugcaucccaaggcaagucaaguugcagcgucauguga

SEQ ID NO: 61804 - RNA, 552 nt, Artificial Sequence
  derived and/or modified sequence opt3 from RHEBL1__Homo_sapiens__NP_653194
augccccuggugagauacaggaaggucguuauccucggcuaucggugcguggggaaaaccagccuugcccaccaguucguagagggagaauuuuccgaggguuacgacccuacaguggaaaacacuuauucuaagauugucacgcugggcaaagaugaguuccauuugcacuuaguggacaccgcugggcaagaugaauacucaauacugccauauaguuuuaucauuggaguucauggcuacgugcuagucuauagcgugacaucccuccacucuuuccagguaaucgagucgcuguaccagaaacuucaugagggucacgggaagacucgcguuccggugguccuggugggaaauaaggcagacuugucacccgaacgagaggugcaggccgucgaaggcaagaaacucgcggagagcuggggcgcuaccuuuauggagaguuccgcccgugaaaaccaacugacacaggggauuuucaccaagguuauccaggagauagcaagaguggaaaauucuuacggacaggagaggcggugucaccugauguga

SEQ ID NO: 61805 - RNA, 717 nt, Artificial Sequence
  derived and/or modified sequence opt3 from RHNO1__Homo_sapiens__NP_001239428
augcccccuagaaagaaaaggcggcagccaagccaaaaggccccgcuccuguuccaccagcagccccuugagggcccuaaacauuccugcgcuucuacccagcugccaaucacacacacucgccaagugcccucaaagccuauugaccauaguacgauaaccagcugggucuccccagauuuugacacagcagccgggucuuuguuccccgcguaccagaaacaccagaaccgagcucgucauucgucaagaaagccuacuaccagcaaguuuccacacuuaacauucgaaaguccgcaguccucuagcuccgagacccugggaaucccccuaauuagggaauguccuucagagagugaaaaagauguuagccggcgcccacucgugcccguacugucuccucaauccugcgguaauaugucagugcaggcccuucagagccugccauaugucuuuauucccccggacauccagacuccugagaguucuuccgugaaggaggaauugaucccccaagaucagaaagagaacagccuccugucguguacacugcacaccggcacgccaaauucuccugaacccgggccaguucucgugaaggacacucccgaggauaaauacggaauaaaggucaccuggagaaggcggcagcauuuacuggcauaucuucgcgagcgaggcaaguuguccagaucacaauuccuggugaaaaguuga

SEQ ID NO: 61806 - RNA, 591 nt, Artificial Sequence
  derived and/or modified sequence opt3 from RHOB__Homo_sapiens__NP_004031
auggccgcuaucagaaagaaacugguggucguuggcgacggggcaugcggaaagaccugucuccuuauuguguucagcaaagaugaguuucccgaaguauacgugccuacagucuucgagaacuauguggccgacauagaaguugaugguaaacagguggagcuggcguugugggacacugcuggccaagaagauuacgacagguuacggccacuguccuauccggauacggacgucauccuaaugugcuuuucuguggauucacccgacagucucgagaauauuccugagaaguggguaccagaaguuaagcacuucugucccaacgugccuaucauucuggucgccaauaagaaagaucuucgcagcgacgagcaugugcgaaccgaacuggcacguaugaagcaggagccagugagaacagaugacgggagggccauggcuguccggauccaggcauacgacuauuuggagugcuccgccaaaacuaaggaaggaguucgcgagguguuugaaaccgcuacaagagccgcgcuccagaaaagguacggcucucaaaacgguuguauaaauugcuguaagguacuguga

SEQ ID NO: 61807 - RNA, 2091 nt, Artificial Sequence
  derived and/or modified sequence opt3 from RHOBTB1__Homo_sapiens__XP_011538726
auggacgccgauauggacuacgagagacccaacguggaaaccaucaagugcgucguugugggcgauaaugcuguagggaaaacaaggcugauuugugcacgggccugcaacacuacgcucacccaguaucaacuucuggcgacacacgugccuacugucugggcuauagaccaguaccgcgugugucaggagguuuuggaacgaagccgugauguggucgacgagguguccguaucuuuaagacugugggauaccuucggagaccaucacaaggauaggcgguuugccuauggucgcucagacguugugguccuaugcuucaguaucgcaaauccaaacagccucaaucaugugaaauccaugugguacccggaaauuaagcacuuuugucccagaacaccugugauccuggucggcugccagcuugaucugagguaugccgacuuggaggcuguuaaccgggcacgccgaccacucgccagacccauuaaaagaggggauauccugccuccagagaagggacgggaaguggcuaaggagcugggccuccccuacuaugaaaccucuguauucgaccaauuugguauaaaagacguguucgauaaugccauccgugcggcauuaauuucgcgcagacaucugcaguuuuggaagucacaccuuaaaaagguccagaaaccuuugcugcaggccccauuccuaccgcccaaggcuccuccacccgugaucaagauuccugaguguccaagcauggggacuaacgaggccgcaugccuccuggacaauccccuuugugcugauguucuguuuaucuugcaagaccaggaacacauauucgcccauaggauuuaccucgcgacaaguuccucuaaauuuuacgaucuguucuuaauggagugcgaagagagcccgaacggauccgaaggcgccugugagaaggagaaacagucacgggacuuucagggccgaauccugaguguggauccugaagaggaacgcgaggaagggcccccaaggauuccucaagcagaccaguggaaaagcucuaauaagucccucgucgaggcucuuggacuggaggccgaaggugcugugcccgagacccagacguugacuggcuggucaaagggguucaucggaaugcacagggaaaugcaaguaaacccaaucagcaaacggaugggccccaugaccguugugcgcauggaugccaguguccagccugguccauucagaacacuacugcaguuucucuauacugggcagcuggacgagaaggaaaaggaucuugugggacuggcacaaauugccgaggucuuggagauguucgaccucaggaugaugguggaaaauauaaugaacaaagaggcuuuuaugaaucaggaaaucaccaaggcguuccauguucguaaagcaaaccggauuaaggagugccugucuaaaggcacauuuuccgacgugaccuucaaguuagaugacggcgccaucagcgcucacaagccgcugcuaauaugcucgugugaguggauggccgcaauguuugggggaucuuucguagaauccgccaacucagaggucuaccuccccaauauuaacaaaaucaguaugcaggcugugcuggauuaucuuuacacgaagcaguugagcccuaaucuggaccucgauccacuggaacuuaucgcccuggcaaaccgauuuugcuugccccaccucguugcgcuggcugagcaacaugccgugcaggaauuaacuaaagcagccacauccggugucggcauugacggggaggugcugucuuaucuagagcucgcucaguuccacaaugcccaucagcuggcagcuuggugucuucaccauaucugcaccaacuacaauagcguauguucaaaguuuagaaaagaaauuaagaguaaguccgccgauaaccaagaguauuucgaaaggcaccgcuggccuccagugugguacuugaaagaggaagaccacuaccagcggguuaagagagagagggagaaagaagauauagcgcugaauaagcaucgcagccgacggaaauggugcuuuuggaacucuucacccgccgucgcuuga

SEQ ID NO: 61808 - RNA, 2250 nt, Artificial Sequence
  derived and/or modified sequence opt3 from RHOBTB2__Homo_sapiens__NP_001153508
augcaggccuggagaaagggccccgacgggccucagaaaaccagcuccgauucuaugucaaggcugauggacagugauauggacuacgagcggccaaacguggaaacaaucaagugcgucguugugggagauaaugcuguagguaaaacucgccucauuugugcacgagccugcaacgcgacgcuuacccaauaucagcuguuggcuacacacgugccgacugucugggccauagaccaguaccgugugugucaagagguuuuagaaagaagcagggauguggucgacgauguguccguaucucugcggcuaugggacaccuucggcgaucaucacaaggaccgcagauuugcauaugggaggucggauguugugguccucugcuucucaaucgccaaucccaacagccugcaucacgugaaaacaaugugguacccugagauuaagcauuuuuguccacgggcucccgugauccuugucggaugccagcuggacuugcgcuaugcagaccucgaagccguuaaucgagcuagaaggccucuggcccggccaauuaagcccaacgagauccugccuccagagaaaggccgugaaguggcgaaggagcucgguauaccguacuaugaaaccaguguaguggcacaguucgggaucaaagaugucuuugacaaugccauucgcgcugccuuaaucuccagaaggcaucugcaguucuggaagucucaccuucggaacgugcaacgacccuugcugcaggcaccuuuucuaccacccaaaccuccacccccgauuaucguugugccugaucccccaagcuccucagaggaguguccugcucaccuccuggaagacccccuuugcgccgaugucauacugguguugcaggagcgcguaagaauuuucgcgcacaagaucuaccucaguacuagcaguuccaaguuuuacgaccuguucuuaauggaucugucagaaggagagcucggcggcccaagcgaacccgggggaacacauccugaggaccaccagggucacagugaucaacaucaccaucaccaucaccaccaucacggcagggacuuucuucugcgggccgcaucuuucgauguuugugaguccguggacgaagcugggggaagcggcccagccgguuugcgcgcuucgaccucugacgggauucuaagaggaaauggcacgggcuaucugccggggaggggacguguccucuccucauggagucgggccuuugugagcauccaggaggaaauggcagaggauccccugacuuacaaaucccgacuuauggucgugguuaagauggacucuagcauccagccugguccauucagagccgugcugaaauauuuguacaccggcgaacucgaugagaacgagagggaccugaugcauauugcucacauagcggaauuacuggagguauucgaucuacgcaugauggucgcaaauauccucaacaaugaagccuuuaugaaccaagagauuacaaaggcuuuccacgugcggagaacuaauaggguuaaagaaugccuggccaaggggaccuuuucagacgugacauucauccuugaugacggaaccauaagugcacauaaacccuugcugauuuccagcugugauuggauggccgcuauguuuggcgguccuuucgucgagucuucaacgcgcgaggugguauuuccauauacuucuaagagcugcaugcgagccgugcucgaauaccuguauacagggauguucaccuccucucccgaccuugaugacaugaagcugaucaucuuggcaaaccggcucugccugccgcacuuaguugcgcugacugagcaguacacagucaccggccuaauggaagcuacgcagaugaugguggauauugacggagacgugcucgucuuucuggagcuugcccaguuccauugugcauaccaauuggccgauuggugccugcaccauaucuguaccaacuauaauaacguuugccguaaauuuccuagagacaugaaggcuaugucgccagagaaucaggaauacuucgagaaacacagguggcccccugugugguaucucaaggaagaggaucacuaccagcgcgcccggaaagaaagagagaaggaggacuaucugcauuuaaagaggcagcccaaacgacgcuggcuguuuuggaacagcccauccucaccuaguucuagcgcagcuuccucaagcucucccuccaguagcucugccgugguauga

SEQ ID NO: 61809 - RNA, 1836 nt, Artificial Sequence
  derived and/or modified sequence opt3 from RHOBTB3__Homo_sapiens__NP_055714
augagcauccacauuguggcccugggcaacgagggggacaccuuccaucaggauaauagacccuccggacucauaaggacauaccuuggucggucuccucuggucucaggcgacgaaaguagcuuguuacugaacgcugcauccacuguugcccgcccaguguuuacggaguaucaagcgucugcuuucgggaauguaaagcuagugguccacgauugcccggugugggacaucuuugauucggacugguacaccucacgaaaccucauuggaggcgccgauaucauuguuaucaaauauaaugugaacgacaaguucagcuuucaugaagucaaagauaauuacauacccgugaucaagcgugcacugaacaguguaccuguuauuaucgccgcuguggguacaagacagaaugaggaacuuccauguacuugcccccuguguaccuccgacagggggucuugcgucagcacaaccgagggcauucaguuggcaaaagagcucggagccacuuaucuggaacugcacucccucgaugacuucuacaucggcaaguauuuugggggaguguuagaguacuucaugauacaggcucugaaccaaaagacaucagagaaaaugaagaaacggaagaugaguaauagcuuucaugguauucgcccuccacagcuugaacagcccgagaaaaugccuguguugaaggccgaagcgucucacuacaacuccgaucugaauaaccuacucuucuguugccagugugucgacguuguguuuuauaauccaaaccugaagaaaguaguggaggcacacaagaucguccuuugcgccgugucacauguuuucaugcuguuguuuaacgugaaaagcccgaccgacauucaagauaguucuaucaucagaacgacucaggaccucuucgcuauuaauagggauaccgccuuccccggcgcaucccacgaaagcucggggaacccuccacugcgggucauagugaaggacgcuuuauuuuguucuugccuguccgauauccuccgcuucauuuacucaggagccuuucagugggaggaacuugaggaggacauccgaaagaaacugaaagauaguggcgacguaagcaauguuauagaaaaggugaaguguauuuugaaaacacccgguaagaucaacugccuaagaaauugcaaaacuuaucaggcgaggaagccucugugguucuacaacaccucccucaaauuuuuccugaauaagccaaugcuugccgaugucguguuugagauccaagggacaaccguccccgcacaucgggcuauucugguggcccguugugaaguuauggcugccauguucaacggaaauuauauggaggcaaagucuguguugaucccgguauacggcgucagcaaagaaacguuucucucauuccuggaguauuuauacacugacaguugcuguccugccggcauuuuucaggcuaugugccugcuaauaugugcggagauguaccaggugucccgccuccaacacaucugcgaacuguucauuaucacacagcuucagagcaugcccucuagagaguuggcaucaaugaaccuggauaucguugaccuccugaagaaagccaaguuucaccauagugacugucuuagcaccuggcuguugcacuucauugcuacuaauuaucucauauucucccagaaaccagaauuucaagaucugucuguggaggaaaggucguucgucgagaagcaucgguggccuagcaacauguacuuaaagcagcuggccgaguaucgaaaauacauccacucccgcaagugcagaugucuagugauguga

SEQ ID NO: 61810 - RNA, 633 nt, Artificial Sequence
  derived and/or modified sequence opt3 from RHOD__Homo_sapiens__NP_055393
augaccgccgcucaggcagccggcgaggaagcgcccccuggggugagaagcgucaagguugugcugguaggagacgguggcugcgggaaaacaucccuccuuaugguguucgcugauggagccuuuccagagucuuacacuccgacggucuucgaaagguauauggugaaccugcaaguuaagggcaaacccgugcacuugcauaucugggacaccgcaggucaggaugacuacgaucgguuacgcccucuguuuuauccagacgccucaguccuacuccuguguuucgaugugacaagucccaauagcuuugacaacauuuucaaucgaugguacccugagguaaaccacuuuugcaagaaaguuccaauaaucguggucggguguaagacugaucuucguaaggacaaaucccuggugaauaaguugagaaggaacggacucgaacccgugaccuaucaucggggccaggagauggcucgcucugucggcgcaguugccuaccuggagugcucggcuagacugcacgauaaugugcaugccguauuccaggaagcggcagagguggcccucucaagcagggggcggaacuuuuggcgccgaauuacacaaggauucugugucgugaccuga

SEQ ID NO: 61811 - RNA, 636 nt, Artificial Sequence
  derived and/or modified sequence opt3 from RHOF__Homo_sapiens__NP_061907
auggacgcccccggcgcucuggcacagaccgccgcgccugggccaggaagaaaggagcucaaaaucgugauugucggugauggcgggugcggaaagacaagccuucugaugguuuacucccaaggcucuuucccggaacacuaugcucccucaguguuugagaaauacacugccaguguaacgguggguagcaaggaagucaccuugaacuuauaugacacagcagggcaggaggauuacgacaggcugcggccucuauccuaucagaauacucaucucgugcugauauguuacgauguuaugaacccaaccucuuaugacaaugugcuuaucaaaugguuccccgaagucacacacuuuugccgcggcauuccuauggugcugaucggauguaagaccgauuugcgaaaggacaaagagcagcuccguaagcugagagccgcucaacuggagccaauuacuuacaugcagggccucucggcaugcgaacagaucagggccgcuuuauaccuggaguguucagccaaauuccgggaaaacguagaggauguuuuucgcgaggcggcaaagguggcccuuagcgcuuugaaaaaggcccagagacaaaagaaaaggcggcugugccuacuccuguga

SEQ ID NO: 61812 - RNA, 576 nt, Artificial Sequence
  derived and/or modified sequence opt3 from RHOG__Homo_sapiens__XP_005252973
augcagagcaucaagugcguggucguuggcgacggggccgugggaaaaaccugucugcucauuugcuacacaacuaacgcuuuccccaaggaguauauaccuacgguauuugauaauuacuccgcacaaucugccguggacgguagaaccgucaaccuuaaucugugggauacagcgggccaggaagaguaugacagguugcggacuuuaucauacccacagaccaacguguucguuaucuguuuuaguauugcuagcccgcccuccuaugaaaaugugcgccacaaauggcauccugaggucugccaccauuguccagaugugcccauccugcuaguagggacaaagaaagaccuccgagcccagccugauacccugcguagacuuaaggaacaaggacaggcaccaauuacuccccagcagggccaagcccuggcuaagcagauccacgcaguuagguacuuggagugcucugcccuccagcaggacggugugaaagaggucuucgcugaagccgugcgggcggugcugaacccuacaccaauaaagcgcgggagaucguguauccugcucuga

SEQ ID NO: 61813 - RNA, 576 nt, Artificial Sequence
  derived and/or modified sequence opt3 from RHOH__Homo_sapiens__NP_001265298
augcugagcuccaucaagugcgugcucgucggcgacucugccguugggaaaaccucacuucuggugagauucacaagugagacuuuucccgaggcuuacaagccuacgguauaugaaaacaccggaguggaugucuucauggacgguauucagaucagcuugggcuuaugggauacagcagggaaugacgccuuuagguccauacggccacugucuuaccagcaggcggaugugguucuaauguguuauucgguggcuaaccacaauucauuccucaaccugaaaaauaaguggauuggagaaauccgcagcaaccuuccgugcacucccguccuggugguagccacccagacagaccagcgagagaugggcccucaucgugcaaguuguguuaaugccauggaagguaaaaaguuggcucaagaugugagagcaaagggguaccucgagugcuccgcccugucuaacaggggaguccaacagguguuugagugugcugugcggaccgccgucaaucaggcgcgcagaaggaaccggcgccgacuguucagcauuaaugaaugcaaaaucuuuuga

SEQ ID NO: 61814 - RNA, 1047 nt, Artificial Sequence
  derived and/or modified sequence opt3 from RHO__Homo_sapiens__NP_000530
augaacggcaccgaggggcccaauuucuacgugccuuuuagcaacgccacaggagucguuagauccccauucgaauauccgcaguacuaucuggcugagcccuggcaauuuucuaugcucgcagccuacauguuccuucugaucguguuggguuuuccuauuaauuucuuaacucuguauguaacggugcagcacaagaaacuaaggaccccacucaacuacauacugcuuaaucuggcggucgcugacuuguuuauggugcucggcggguucacaucaacucuguauaccagucugcauggauacuuuguuuucggccccacagguugcaaccucgaaggguuuuucgccaccuuaggaggcgagaucgcacuguggagccuuguggucuuggccauugaacgguacgugguaguuuguaagccuauguccaauuuucgcuucggcgagaaccacgcuaucauggggguggcauucacuugggucauggcccuggcuugcgccgcgccaccccuagcaggauggucucgauauauuccugagggucuccaguguucgugcggcaucgauuacuauacacugaaaccagaagugaauaacgagucauuugugauauacauguucgucguucauuuuaccaucccgaugauuaucauuuucuuuuguuaugggcagcuuguguucacgguaaaggaagccgcugcccaacagcaggagagcgcaacuacccagaaagcugagaaggaagugacacguauggucaucauaauggugauugccuuucugaucugcuggguucccuacgcgaguguggccuucuauauuuuuacucaccaaggauccaauuucggcccuaucuuuaugaccaucccagcauucuuugcuaagucugccgcuauuuacaaccccgucauauacaucaugaugaauaaacaguucagaaacuguauguugacaaccauuugcugugguaagaauccucucggggacgaugaggccagcgcaacgguguccaaaacugaaacaucacagguagccccagcuuga

SEQ ID NO: 61815 - RNA, 645 nt, Artificial Sequence
  derived and/or modified sequence opt3 from RHOJ__Homo_sapiens__NP_065714
augaacugcaaggagggcaccgacagcuccugugggugcagaggaaaugaugagaaaaagaugcugaaauguguggucguuggugacggcgccguggggaagacaugccuccuuaugucuuacgcuaacgaugcauuccccgaagaauauguaccuacuguguuugaccacuacgccgucacggugaccguuggaggcaaacagcaucuguuggguuuauaugauacagcggggcaagaggacuacaaucagcugaggccacuaucauauccgaacacugauguguuccucaucuguuuuagugucgugaaucccgcuagcuaccacaacguacaggaagaguggguuccugagcugaaggacugcaugccacaugugcccuauguccuuauuggaacccagauagaucugcgggacgauccuaagacauuggcccgccuccuguacaugaaagaaaagccacugaccuacgagcacggcgugaaacucgcaaaggccaucggcgcucaauguuauuuagaaugcuccgcacugacucagaaagggcuuaaggccguguucgacgaggcuauuuugacaaucuuucaucccaagaaaaagaaaaagcgauguucugagggacacucgugcuguucaauuaucuga

SEQ ID NO: 61816 - RNA, 618 nt, Artificial Sequence
  derived and/or modified sequence opt3 from RHOQ__Homo_sapiens__NP_036381
auggcccacggccccggggcucugaugcucaagugcguggucguuggagacggugcagugggcaaaaccugucuucugaugagcuacgccaacgaugcguucccugaggaauauguaccaacaguguuugaccauuacgcugucuccgugacuguugggggaaagcaguauuuguuaggccuguacgauacggccggucaagaggacuaugauagacuaaggccgcucucuuaccccaugaccgacguguuccugaucugcuuuucagucgugaauccugcaaguuuccagaacguaaaagaagaguggguuccagaacuuaaggaguaugcccccaaugugccuuuucuguugauugggacacagauagaucuccgggacgauccaaaaacucuggcucgccugaacgacaugaaggagaagcccaucugugucgaacagggacaaaaacucgcaaaggagauuggcgccugcuguuacguggaaugcagcgcuuuaacccagaaaggccugaagacaguguucgaugaggccaucauugcgauccuuaccccuaaaaagcacacugucaagaaacgaauagggucccguuguaucaauugcuguuugauuacauga

SEQ ID NO: 61817 - RNA, 1980 nt, Artificial Sequence
  derived and/or modified sequence opt3 from RHOT1__Homo_sapiens__NP_001028738
augaagaaagacgugagaauccugcucgucggcgagcccaggguugggaagaccagccuuauuaugucccuggugucugaagaguucccugaagagguaccaccgcgggccgaagagauaacaauccccgcugaugugacuccugagcgcgucccaacgcacauuguggacuacucagaagcagagcagagugaugaacaauugcaucaggagaucagccaggccaacguuauuugcaucguguaugcggucaauaacaaacacuccauagacaaggugaccucucgauggauccccuuaauuaaugagcguacagauaaagacucgagacugccucuaauccucguaggaaacaagucagaucugguugaauacagcaguauggagacuauucuuccaaucaugaaucaguauaccgaaauagagacauguguggaaugcuccgcuaagaaccugaaaaauauuucugaguuguuuuacuaugcccaaaaggcaguccuccaucccaccgguccucuguacuguccagaggaaaaagagaugaagccggccugcaucaaagcucugacuaggauuuucaagaucagcgaccaggauaacgacggcacacucaaugaugcagaauuaaacuuuuuccagcggaucuguuuuaauacccccuuggccccucaggcucuugaggacgugaagaacgugguccgcaaacacauuuccgaugggguugccgacucaggauugacgcugaagggcuuccuauuucuccauacucuguucauacaaagagguaggcacgaaaccacauggacugugcuucggcgcuuuggguaugacgaugaccuggauuugaccccagaguaccucuucccccuguuaaaaaucccuccagacugcacaaccgagcugaaucaccaugcguaccucuuucuucagaguacguucgauaagcacgaccuggaucgagacugugcauugagccccgaugaacuaaaagaccuguuuaagguauucccguauauuccuuggggacccgaugugaacaauacugucugcacaaacgagagaggcuggaucaccuaccagggcuuccucucucaguggacucugacaaccuaucuugacgugcaaaggugucuggaauacuugggguaucucggauacuccauacugacggagcaggaaucacaggccagcgcuguuaccgugacacgggacaaaaagauugauuuacaaaagaaacagacucagcguaacgucuuucgcugcaaugugaucgguguaaagaacuguggcaaaagugggguucugcaggcccuacucggaagaaaucugaugaggcaaaagaaaauccgggaggaccauaagucuuauuacgcaauuaacaccguguacgucuauggccaggagaaguaccuuuugcugcacgauaucuccgaaagcgaguuccucacagaagcugagauuauaugcgacguggucugccugguguaugauguuucgaauccaaaaucuuuugaguacugugcccgaaucuucaagcagcacuuuauggacucccgcauuccuugccuuaucguggcggccaaaucagaucugcaugaaguaaagcaggaguauaguaucagccccacugacuucuguagaaaacacaagaugccacccccucaagcauuuaccugcaacacagcugaugccccauccaaggacauuuucgucaaauugaccacuauggcuauguacccgcaugccaggcuccgguguaugugcacguguaaucgcugcacauuuuguauaugccagaacuucuuaaauucugaucugcugcagagcgugaagaacaaaaucuuuaccgcaguucuaaauagacacgugacucaggccgaccucaagucaaguaccuucuggcugagggcuuccuuuggugcgacagucuucgcagugcuuggguucgccauguauaaagcucugcugaagcaacguuga

SEQ ID NO: 61818 - RNA, 777 nt, Artificial Sequence
  derived and/or modified sequence opt3 from RHOU__Homo_sapiens__NP_067028
augcccccucagcaaggcgacccagccuucccggauagaugcgaggcucccccugugccacccaggcgggaacgcgggggacgagguggccgugggccuggagagccaggcgguagagggagggcaggaggcgccgaaggccgcggggucaaguguguucuggugggagacggugcgguaggcaaaaccagccucguggucuccuacacaacuaacggguaucccacggaguacaucccuaccgcuuuugauaauuucucugccgugguuucaguggacggacggccagucagacuucagcugugcgauacagcaggccaggacgaauuugauaaguugaggccguuauguuauacuaacaccgacauuuuccugcuaugcuuuagugugguaagccccuccucuuuccagaauguuucggagaaaugggugccugagauacggugucacugcccaaaggcccccaucauucucgucgguacacaaucagaucugcgcgaagacgugaaagugcuuaucgagcuggauaaguguaaggaaaaaccugucccagaggaggcugcaaaguugugcgccgaagagauuaaagcugccagcuacaucgaauguagugcgcucacccagaagaaccugaaagagguuuuugacgcagccauaguggcugggauccaguauuccgauacucagcaacagcccaagaagucuaaaagccgaacaccggacaagaugaaaaaucuguccaagucaugguggaaaaaguacugcuguuucguauga

SEQ ID NO: 61819 - RNA, 711 nt, Artificial Sequence
  derived and/or modified sequence opt3 from RHOV__Homo_sapiens__NP_598378
augcccccuagagagcugagcgaagccgagccaccgccccucagggcuccuaccccacccccucggcgccgauccgcaccacccgaacuuggcaucaagugcgugcuggucggggacggagccguugguaaaucuucauugauugugaguuacacauguaacggcuauccugcgcguuacagaccaacugcuuuagauacguucagcguacaggugcuggucgacggggccccggugaggauagagcuaugggauaccgcaggacaagaagacuuugaucggcuccgcucccugugcuaucccgacacagauguuuuccuugccuguuuuucugugguccagccuucgucauuccagaauaucacugagaaguggcugccagagauuagaacccacaacccccaggcuccuguguugcucguaggcacacaagcagaccugagggaugacguuaaugugcugauccagcucgaucagggugggcgggaaggaccagucccccagccgcaagcccagggcuuagcugagaaaauucgcgccugcuguuaccuggaaugcagcgcgcuuacccagaagaacuugaaagagguguuugacagugcaauccuguccgccauagagcauaaggcucgacuagaaaagaaacucaaugccaagggcgugagaacucugucuaggugucgguggaaaaaguucuuuugcuucgucuga

SEQ ID NO: 61820 - RNA, 555 nt, Artificial Sequence
  derived and/or modified sequence opt3 from RHOXF1__Homo_sapiens__NP_644811
auggccagaagccuggugcacgacaccgucuucuacugccucuccguuuaucaggugaagaucucucccacaccucaacuuggcgcugcaucaagugccgaggggcauguaggacagggugcgccaggccugauggggaacaugaauccggaaggaggcgugaaccacgagaaugguaugaacagggaugggggaaugauucccgaaggcggcgggggaaaucaggagccucggcagcaaccacagcccccuccagaggaacccgcucaggccgcaauggaggguccucagccagaaaacaugcaaccgcgcacucgacguacgaaauuuaccuuguuacaggucgaggaacuggagagcguguucagacauacacaguaccccgacguuccuacuaggcgggagcuagccgaaaaucucggcgugaccgaggauaagguccgcgugugguuuaaaaacaagagagcuaggugucggcgccaccagcgagaacugaugcuugcaaaugagcugagagccgacccagaugacugcguauauauaguuguggauuga

SEQ ID NO: 61821 - RNA, 867 nt, Artificial Sequence
  derived and/or modified sequence opt3 from RHOXF2__Homo_sapiens__NP_115887
auggaacccccugaccagugcagccaauacaugaccucccuccucucuccagccguggaugacgaaaaggagcuucaggauaugaacgcuaugguccugucauugacagaagagguuaaagaagaggaggaagacgcacagccggagcccgaacagggcacugccgcgggggagaaguuaaaaagugcuggagcccaagguggcgaggaaaaggaugggggaggcgaggaaaaagacggugggggagcaggcgugccuggccaccugugggagggggaucuagaaggaacgagcgguuccgacggcaauguagaggauucugaccagucggagaaggaaccagggcagcaguauucaagaccccaaggagccgugggcggucucgagccugggaacgcucagcagccaaauguccaugcauucacaccccugcagcuucaagaacuggagaggaucuuucagcgggaacaguucccuagcgaguuuuugcgccgacgucucgccagaaguaugaacgugaccgagcuggcuguucaaauuugguucgaaaauaggcgggccaaguggcgcagacaccagagggcgcugauggcacggaacaugcucccauuuauggccgugggacagccggucauggugacugcugccgaggcaauaaccgcucccuuauucaucuccggcaugcgcgaugacuacuuuugggaucauucucacagcuccucacuguguuucccuaugccacccuuuccuccacccagucuuccguugccucugaugcuacugcccccaaugccucccgccggccaggcggaguucgggccauuucccuucguaauuguuccuagcuuuacauucccaaauguguga

SEQ ID NO: 61822 - RNA, 2013 nt, Artificial Sequence
  derived and/or modified sequence opt3 from RHPN1__Homo_sapiens__NP_443156
augauccuggaggaaagacccgacggcgccggggcuggagaggaaagcccuaggcuccaggguugcgauucccuuacccaaauucaguguggccagcugcagucucggcgcgcacaaauacaccagcagaucgacaaggaguugcagaugcgaacaggggccgaaaacuuauaccgugcgacuucaaauaacagagugagggagacggucgcucuggagcuaaguuauguuaauagcaaccuccaacugcuuaaagaggaacuggaagaguuguccggaggcguggauccaggucggcaugggucugaggccguaaccgugccgaugauuccccucggacugaaggaaacaaaagagcuggacuggucgacuccucucaaggaauuaaucucaguccacuucggcgaggauggcgcaagcuacgaagccgagauucgcgagcuggaagcucuuagacaggcaaugaggaccccaagucggaaugaguccggguuggaacugcuaacagccuauuacaaccagcucugcuuucuggacgcucgcuuccuuacccccgcccgaucucugggauuguuuuuccauugguaugauagccucacuggugugccugcgcagcaaagagcacuggccuuugagaaaggcuccguuuuauucaauaucggggcucugcacacacagauaggagccaggcaggaccggucauguaccgaaggcgcacgucgcgcuauggaggccuuucaaagagcggccggugcauucagucuccuuagggagaacuuuagccaugcuccaucucccgauauguccgccgcuucacugugcgccuuggaacagcuaaugauggcacaggcccaggaguguguguucgaagggcugagcccuccagcuaguauggcgccgcaagacugccucgcacagcugcggcuugcccaggaggcugcccaggucgcagccgaauaccgacuggugcaccgcacgauggcucaacccccuguacacgauuauguuccagugucuuggacugccuugguccaugugaaggcagaguacuuuagaucccucgcgcacuaccauguggcuauggcccugugugacggaagccccgcaaccgagggcgaauuaccuacacacgagcaggucuuccugcagccacccacuucgucuaagccgaggggcccuguucuaccccaggaacucgaggagcggcgccaacuggggaaagcccaccuuaagagagcuaucuugggacaggaagaggcccugaggcuccaugcacugugccgugugcuucgggaaguagaucuguugcgagcugugauuucccagacccuccagagaucacuggccaaauaugcggaguuagacagggaagacgauuuuugugaggccgcugaggcaccagacauccaaccuaagacacaccagaaacccgaagcccgcaugccacggcugagucaggguaagggccccgauauuuuccauagacuagggccucucagcgucuucuccgcuaagaauagguggcgccuggugggaccaguucaccuuacccgaggcgaggguggguuuggcuugacgcugcggggagacucuccggugcucaucgccgcagucauacccggcagccaagcggccgcugccgggcugaaagaaggagauuacauugugucaguaaacggucagccuugccguugguggagacaugcagagguugugacugaauuaaaggcugccggcgaggcaggggccagucugcaggucgugucccuuuugccaagcucuaggcuccccucacugggagaccgccggccuguccuacugggcccaagaggucuccugaggagucagcgagagcacggguguaaaacacccgcuagcaccugggcguccccgcgcccucuuuugaauuggucucggaaggcccaacagggcaaaacuggaggcugcccacagcccugcgcaccugugaagcccgcuccaccuucgagccugaaacaccccggguggccauga

SEQ ID NO: 61823 - RNA, 2061 nt, Artificial Sequence
  derived and/or modified sequence opt3 from RHPN2__Homo_sapiens__NP_149094
augaccgacgcccugcuccccgcugcaccucagccacuugagaaggaaaacgauggcuacuucagaaaagggugcaauccgcuggcccaaacaggaaggagcaaguugcagaaccagcgggcggcuuuaaaucagcaaauccugaaagccgugcgcaugcgaacuggugcagagaaccuacucaaggucgccacgaauagcaaaguucgugaacaggugagacuggagcuuucuuuuguaaacucagaccugcagauguugaaggaagaacucgagggccugaauauuagugugggggucuaucagaacaccgaagaggcuuucacaauaccccugaucccucucggauuaaaggaaacuaaagauguggacuuugcaguugugcugaaggauuucauucuugagcacuacagcgaggacggcuauuuguacgaagaugagaucgccgaccugauggaucuaaggcaggcuugucggaccccaucccgcgacgaagccggugucgagcuccugaugacauauuuuauucaacuuggguucguggaaucuagauuuuucccucccaccaggcagaugggacuguuguuuacuugguacgauucgcucacaggcguaccaguuucacagcaaaaucuguuacuggagaaagcgagcgugcuuuucaacaccggcgcacuuuauacgcagaucgggacucggugcgaccgccagacccaagccggacuggagagugcuauagaugccuuucagcgagcagcuggugucuugaauuaccuaaaggacacauucacucauacccccuccuacgacaugucuccugccaugcugagcgugcucgugaaaaugaugcuggcgcaggcccaggaauccgucuuugagaagaucucacuuccaggcauuagaaacgaguucuucaugcugguuaagguggcacaagaggcugccaaaguaggggaaguguaucagcaguugcacgcugccaugagucaggcaccggucaaggagaauauccccuacagcugggccucucucgcuugugugaaagcgcaucacuaugcagcccuggcucauuacuuuacagccauuuuacugaucgaucaccaaguuaagccuggaaccgaccuagaucaccaggagaaaugccucucccagcuguaugaccauaugccagaaggccuuacgcccuuggcaacucugaagaacgaucagcaaaggcggcagcucgguaaaucacaucugcgucgcgccauggcucaccacgaggaaagcgugagagaggccagucuuuguaagaagcugaggucuauagaagucuugcagaaagugcucugcgcagcgcaggagcggucccgacugacauacgcucaacaccaggaggaagacgauuuacugaaucuaauugacgccccuagcguaguugcaaagaccgagcaggaaguggauaucauucucccacaauucucgaaacugacugucacagacuuuuuccagaagcucgggcccuugucuguguuuuccgccaacaaacgcuggaccccgccuagaucaaucagguucacggcugaggagggagaucugggcuuuacccuccggggcaacgcccccguccaggugcauuuccuggacccauauuguagugcaagcguugcuggggcccgcgaaggagacuacaucguguccauucaguuaguagauugcaaguggcugacacuuucugaggucaugaaguugcucaaauccuuuggugaagacgagauagaaaugaaggugguuucacugcuagauaguacuuccagcaugcacaauaaaucugcgaccuacucagugggcaugcaaaagacauauaguaugaucugucuggccauugacgaugacgauaaaacugacaagaccaagaaaaucagcaagaaacucuccuuccugucuugggggacaaacaagaauagacagaaaucggcuagcacccuuugcuugccuuccgucggagcagccaggccccaggugaagaagaaacugccaucacccuuuaguuuacucaacucugauagcuccugguacuga

SEQ ID NO: 61824 - RNA, 1149 nt, Artificial Sequence
  derived and/or modified sequence opt3 from RIBC2__Homo_sapiens__NP_056468
augggcagccagaccauggccguggcucugcccagagaccucaggcaagaugcaaaccuugccaagcggcgccacgcggagcugugccgacagaaacgugucuucaaugcuagaaacaggaucauugggggagacacagaagccugggauguucaggugcaugaccagaagauaaaagaggcaacugaaaaggcccggcacgagacguuugcugcagaaaugcgccaaaaugauaaaaucauguguauuuuggagaacagaaagaagagggaccggaaaaauuuaugccgcgccaucaacgauuuccagcaguccuuucagaagccugagacccgaagagaguucgaccugucugauccacuagcucucaaaaaggaccugccggccaggcaaucagauaaugacguacggaacacaauuagugguaugcagaaauuuaugggcgaagaucuuaauuuccaugaacguaagaaguuucaggaggagcagaaccgcgaauggagccugcaacagcagagagaguggaaaaaugcgagggcagaacaaaagugugccgaggcuuuguacacugaaacccggcuccaguucgacgagacagccaaacaucugcagaagcuggaguccaccacucgaaaagcagugugcgcuucugucaaggacuuuaacaaaucgcaggccaucgaaucaguggagcgcaagaagcaagagaaaaagcaggaacaggaagauaaucucgcggagauaacaaacuuacugagaggggaccuuuugagcgagaauccccagcaagccgcaaguuccuucggaccucacaggguugugccagaucgguggaaaggcaugacccaggaacagcuggagcagauccgccuaguccaaaagcagcagauucaggaaaaacucagacugcaagaggaaaagaggcagcgugaccuugauugggaccggcgaagaauccagggugcuagggccacgcuguuguuugagcgccaacaguggcggagacagagggaucuccgccgagcucuggacucuagcaacuuaucccuggccaaggagcagcaccuccagaaaaaguauaugaacgaaguguacacuaaucaacccaccggggauuauuucacacaguuuaacacuggaucacgguga

SEQ ID NO: 61825 - RNA, 3498 nt, Artificial Sequence
  derived and/or modified sequence opt3 from RIC1__Homo_sapiens__NP_001129392
auguacuuccugagcggcuggcccaagagacuccuuugcccucugggguccccagccgaggcuccguuucacgugcagucugacccccaaagggcauucuuugccgucuuggcggcugcccgguuaucaaucugguauagucgcccuagcguucugauugugaccuacaaagaaccagcaaaguccucuacacaguucggaucguauaaacaggccgaguggcgacccgauucaacuaugauagcuguaagcacggcaaacgguuacauccuauuuuuccauauuaccaguacacguggcgacaaguaucucuacgaaccuguguauccaaaagggucuccccagaugaagggaacuccucacuuuaaggaggaacaaugugccccagcucugaaucuugagaugagaaaaauccuggauuugcaggccccgauuaugucccuccagagcguccuggaggaccugcucguggcgaccuccgauggcuuacugcaucuuauccacugggaagguaugacaaacgggaggaaggcaauaaauuugugcaccguucccuucucaguggaccugcagaguagccgggucggaucuuuucuaggcuucacugaugugcauauccgcgacauggaguacugugccacacucgauggcuuugcuguaguuuucaacgacgggaaagugggauuuauuaccccugucuccucaagauucacggccgaacaacugcacgguguguggccacaggauguggucgacggcacuugcguugcagugaauaacaaguacaggcuuauggcuuucggguguguaagcggaagugugcaggucuauaccaucgauaauucuacaggcgccaugcuguugucccacaaacucgagcugacugcgaagcaguaccccgacauuuggaacaagaccggugccgugaaauuaaugcgguggagcccugacaauucgguugugaucgucacaugggaguaugggggacugucucucugguccguguuuggcgcacaacuuauaugcacccugggcggggauuucgcuuaccgcucagacggaacgaagaaagauccauugaagauuaacaguaugagcuggggugccgaaggcuaucaucuauggguaaucuccggguuuggaucucagaauacugagauugaaagcgaccugcgaucaguugugaaacagcccaguauccuccuguuccaauuuaucaaguccguccuuacagugaacccguguaugagcaaucaggagcagguccuguugcagggcgaagauagacucuaccugaacugcggugaggcuucucaaacccagaauccuaggucaaguagcacucacuccgagcauaaacccucucgggaaaagucgccauucgccgacgggggcuuagagagccagggacuguccacacuacucggccaccgucacuggcaugugguucagauuucaaguaccuaucuggaaucuaacuggccuauacgcuuuagcgcaaucgauaaacuugggcaaaacauugccgugguaggaaaguucgguuuugcucacuacuccuugcugacgaagaaauggaaacucuucggcaauaucacccaggagcagaacaugauagucacagggggacuggcgugguggaaugacuuuauggugcuugcauguuacaacauuaaugauagacaggaggaacugaggguuuauuugcggacuucaaaccucgacaaugccuucgcucaugugaccaaggcccaagcagagacacuguuacugagcgucuuucaggauauggugaucguauuccgagccgacugcucuaucugucuauacuccauugaacgcaagagugacggccccaacacuaccgcugguauccaggugcuccaggagguuagcaugucuagauauauuccacaccccuuccuggucguguccgugacacuuaccucagucaguacugaaaaugggauaacguugaagaugccucaacaggccaggggcgcagagagcaucaugcugaaccucgcgggacagcugauuaugaugcaacgggaucgcucgggcccacagaucagagaaaaagacuccaauccgaacaaucagaggaaguuacugcccuuuugcccuccaguugugcuugcucagucuguggagaacguauggacaaccugccgugccaauaaacaaaagcggcauuugcucgaggcacuguggcuaagcugugggggagccgguaugaaagucuggcugccccucuucccucgagaucacagaaagccacacucauuucugagucagaggaucaugcuucccuuccauauuaacauauacccguuggcugugcuguuugaagacgccuuaguucucggcgcagugaacgauacucugcuuuaugacucccuguacacccgcaauaacgcucgggagcaguuggaaguccucuucccuuuuugcgugguugagagaacaucucagaucuaucugcaccauauucuaaggcaacugcucgugcgcaaucugggggagcaggcccuuuugcuggcgcagagcugugccaccuuaccauacuucccccacguacucgaacugaugcuucacgagguccuggaagaggaagcuacuucccgagagccuauccccgauccacuacucccuacaguggcaaaguuuauuacggaguucccccuguuuuugcagaccgugguccauugcgcccggaaaacugaauacgcucuguggaacuauuuauucgccgcaguuggaaauccaaaggaccucuuugaggaaugucugauggcgcaagaucuugacacagccgcuucauaccugaucauauugcagaacauggaggugccggccguaagccgucagcacgcaacccuccuguucaauacagcucuagaacaaggcaaaugggaucugugcagacauaugaucagguuccuuaaggccauugguaguggggagucugagacuccucccuccaccccaacggcacaggaacccagcucgucaggcggauuugaguucuuucgcaaccggucuaucagucucucccagagcgccgaaaaugugccugcuucuaaauucagccugcagaagaccuuguccaugccaucaggccccagugggaagagauggagcaaagacucugauugugcggagaacauguauauugacaugaugcuguggaggcacgcccgacgcuuacucgaagacguccggcugaaggaucuuggaugcuuugcagcucaacugggcuucgaguugaucuccuggcucuguaaagagagaacaagggccgcccguguggacaauuuuguuauagcucugaagcgccuacauaaagauuuccuguggccucuuccgauuaucccagcaucaaguauuagcucccccuuuaagaacgguaaauaccggacugggaauguggacuucaugucucucguccagggagaacuguauuuuaccccuugcaucuacacauucuguuauuga

SEQ ID NO: 61826 - RNA, 564 nt, Artificial Sequence
  derived and/or modified sequence opt3 from RIC3__Homo_sapiens__NP_001128581
auggccuacagcaccgugcagagagucgcucuggcauccggccucguucuugcccugucuuuguuacugcccaaggcguuccuaucaagggggaaacggcaagagccuccaccgacacccgaaggauauccugaggaaacuuacccaaucuaugaccucagugauugcauuaagcgccgacaggagacgauacugguggacuaccccgauccuaaagaacuuagcgcugaggagaucgccgaacguauggguaugauugaggaagaggaguccgaccaccugggcugggaaucuuugccaaccgaucccagagcacaggaggacaacucgguaacaucaugugauccuaagccagaaacuugcagcuguugcuuucaugaggacgaagauccggccgugcucgcugagaaugcaggguucagugccgacuccuaucccgagcaggaagagaccacaaaagaagaguggucucaagauuuuaaggacgaaggacugggcaucagcaccgauaaggcuuacacugguuccaugcugaggaaacggaacccucaggggcucgaguga

SEQ ID NO: 61827 - RNA, 5199 nt, Artificial Sequence
  derived and/or modified sequence opt3 from RICTOR__Homo_sapiens__NP_001272368
auggccgcuaucggcagagggaggagccugaagaaccuccgggugcgcggacgaaaugacuccggugaggaaaacgucccccuugaucugacccgugagccuucugacaauuugagagaaauuuuacagaacguugcaaggcugcaaggcgugucaaauaugcggaaacuagggcaccucaacaauuucacaaagcugcuuugcgauauaggacauagugaggaaaaacugggcuuucacuacgaggacaucauuaucuguuugcgccucgcccugcugaacgaggcgaaggaaguaagagcugccggucucagggcauuacgguaucugauucaggauagcuccauccuucagaaaguguugaagcugaaggucgacuaccuaauagcccgcugcaucgauauucagcaaucuaaugagguggaacgaacucaggcucucagacugguuaggaaaaugaucacggugaacgcaucgcuuuucccaucaagcgucaccaauagucugauugccguggggaacgacggauugcaggagcgggaucguaugguacgcgcuuguaucgccauaauuugcgagcucgcgcugcagaauccggaaguuguggcauuaagaggcggccugaacacaauccucaagaaugucauugacugucaacuuuccaggaucaacgaggcccugaucacuaccauuuugcaucuacugaaccaccccaaaacacggcaguaugugcgagcugauguggaacucgagcgcauacuggccccuuacaccgacuuucauuauagacacucuccagauacugcagaagggcagcuuaaggaggacagggaggcucgguuccuggccagcaaaaugggaaucauugcgacauuucgcuccugggccgguaucauaaauuugugcaagcccggcaacucagggauucagagucucaucggaguccuguguaucccuaauauggaaauuagaaggggcuuacuggagguucuauacgacaucuuccgucucccacugcccgugguaaccgaagaguuuauugaagcacuuuugagcguggauccuggucgguuccaagacucuuggcgacuguccgauggguuugucgcugccgaggcuaagacgauacucccacacagagccaggucacgcccggaccugauggauaacuaucuugcacugaucuugagcgccuucauucggaauggacuccuggagggcuuaguggaaguuaucacuaacagugacgaucauaucucugugagagcuaccauucugcuaggcgagcuccugcacauggcgaauacaauacuuccccauucccacagccaccauuugcacugccugccuacucucaugaacauggcagccucguuugacaucccaaaagaaaagaggcugcgcgcuucugccgcauuaaauugucugaaacgauuccaugagaugaagaaacgggggcccaagccuuacucccuucacuuggaucauauuauccagaaagccauugcuacccaccagaagcgugaccaauaccucagaguccagaaggauaucuuuauacugaaagacacagaagaggcccuacugaucaaccucagggacucacaggugcugcagcacaaggagaaucuugaauggaacuggaauuugauuggaaccauccugaaauggccaaacguaaauuuacgcaacuauaaggaugagcaacuccaucgguucguuagaaggcugcuuuacuucuauaaacccaguagcaagcuguacgcaaacuuggaccucgauuuugcgaaggcuaaacagcugacgguggucgguugccaguucacugaauuucuacuggaguccgaggaagacggccagggguaucucgaggaucuggugaaggacauuguccaauggcuuaaugccucuagcggaaugaaaccggaacgaucauugcagaacaauggccuguuaacaacccucagucagcacuacuuccuguuuaucgguacucuuuccugucauccucacggggugaagaugcuggagaaaugcagcguuuuccagugccuacucaaccuguguucuuugaagaaucaagaucaccuguuaaagcucacagugucaagucuggacuauagccgcgauggccuugcacggguaauacuguccaaaauuuugaccgccgcuacggacgccugcagacucuacgcaaccaagcaucugaggguccuacugcgugcuaacguggaauuuuucaauaacuggggaaucgagcuucucguuacacagcugcacgauaaaaauaagacuauuucuucggaggccuuggacauccuggaugaagcgugugaggacaaagccaacuuacaugcucucauacagaugaagcccgcacugagccaccuuggcgacaaggggcuguugcuccugcuacgcuuucuguccaucccaaaaggauucucauaccuuaaugaacgggguuauguggccaagcagcucgagaaauggcauagagaauacaacaguaaguaugucgaucugauugaggagcaauugaaugaagcuuuaaccacauacaggaaaccuguggacggcgauaacuauguacgacggucuaaucagcgccugcagagaccccacguguaccucccaauccaccuguaugggcaacuuguucaucacaagacuggaugccaucuguuggagguccagaacauuaucaccgaacuauguaggaacgugcggacacccgaccuggauaaaugggaggaaauaaagaagcucaaagccagccugugggcacuuggcaauauugguuccucaaacuggggguuaaaucugcuccaggaggagaacgugaucccugacaucuugaagcuggcgaaacagugcgaaguccucagcauucgaggcaccuguguuuacgugcugggacuuaucgccaagacuaaacaaggcugcgauauucugaagugucacaauugggacgcugugagacauucucgcaagcacuuguggccaguagucccggaugacguggagcagcuaugcaacgaacuguccaguauacccagcacgcucucuuuaaauuccgagucaacaaguagcaggcacaacucggaguccgaaucuguuccuagcucaauguuuauccuggaggaugaccguuucgggaguuccucuaccagcacuuuuuuccuugauauuaaugaagacaccgagccaacauucuacgaccgguccggacccaucaaagauaagaacucauuuccuuucuuugccagcaguaaacuggugaagaauagaauucucaacucuuugacccugccaaauaaaaagcauagguccagcucggaccccaaggguggcaaacucucaucugaaaguaagacuuccaaccgccgaaucagaacacugacggagccgagcgucgauuucaaucacucugacgauuuuaccccuauaagcacugugcagaaaacacuucagcuagagaccuccuucauggggaacaagcauaucgaagacacaggaucaacuccaaguauuggcgagaacgaucugaaauuuaccaagaauuucgguacggaaaaccaccgggagaauaccagcagggaacgcuugguuguggagucuuccacaucaagucacaugaagauccguagccaauccuuuaacacugacaccacaacuucugggauuucgagcaugucauccagucccucuagagagaccguaggcgucgaugcaacgacaauggacaccgauuguggaagcauguccacuguggugucaacaaaaaccaucaagacuucucauuauuuaaccccucagagcaaucaccugagucucuccaaaagcaacucugucucacugguucccccaggcuccagucauacacuuccucggagggcucagagccugaaggcccccucgauagcaacgauuaaaucucucgccgacugcaauuucuccuacaccagcucacgcgacgcuuuuggguaugcgacuuugaagcgacugcagcaacagagaaugcacccaagucuaucucauuccgaagcccuggcaagcccggcuaaagaugugcucuucacagacaccaucacaaugaaggccaacucauuugagagucggcuuacuccuagcaggaucgauuucaagaaaaagcacguaggaggcauucgcucccugagacccaccauaacgaauaacuuauucagguuuaugaaagccuugucuuacgcuagccuggacaaggaagaucuccuguccccaaucaaucagaacacacuucaacggucaucuagugugcguucgauggucagcuccgcaaccuauggugggucugacgauuacauuggacuggcccuccccguggacaucaaugauauuuuccagguuaaagacaucccuuauuuucagacuaagaacauaccaccccacgaugaccgcggcgcgcgagcuuucgcccaugaugcagguggcuugccuucagggaccggaggccuggugaagaauagcuuucacuuacuaagacagcaaaugucccugacagagaucaugaacaguauucauucugacgccagccucuuccuugaaucaacugaggacaccgggcugcaggagcacacagaugacaauugcuuguacugugucugcaucgaaauucugggauuucagccguccaaccagcucagugcuaucuguagccacucugauuuccaagacauaccauacuccgauuggugcgagcagacgauucauaacccccuggaagugguuccuucaaaauuuagcggcaucucggguuguucugacggggugagucaggagggauccgcaagcucaaccaaguccacugagcuucuccugggcgucaaaacaaucccagaugacacccccaugugcaggauuuugcugcggaaggaaguauuacgccuagugaucaaucugucuagcaguguuuccacuaaaugucacgagacaggucuccuuaccauaaaggaaaaguauccucagacguucgaugacauuugccuguacagcgaggugucucauuugcugucacacuguacuuuuagacucccgugcaggcgguucauccaagaacuguuccaggauguccaguuucuucagaugcaugaggaggccgaagcgguguuagcuacccccccaaaacaaccuauuguagacacaagugccgaguccuga

SEQ ID NO: 61828 - RNA, 7341 nt, Artificial Sequence
  derived and/or modified sequence opt3 from RIF1__Homo_sapiens__NP_001171134
augaccgccagaggccagagcccccuggcuccucuccuugagacccuggaagacccauccgcaucucacgggggacaaacugaugccuacuugacguuaaccucaaggaugacaggugaagaaggcaaggaggugaucacugaaauugagaaaaagcugccgcggcuguauaaaguccucaagacccauaucaguagccagaacuccgagcugucuucggcggcccuucaagcucugggguucugcuuguacaaucccaaaaucacaucagaacucagcgaggcaaacgcccuggaacugcucaguaaguuaaaugacaccauuaagaacuccgauaaaaauguucgcacucgagcucugugggugaucucuaagcagacauuuccuagcgagguggugggaaaaauggucuccucaauuaucgacagucuugagauauuguucaacaagggcgaaacccacagcgcagugguugauuuugaggcccugaaugugaucguccgucuaauugaacaagcuccaauccagaugggugaggaagccgugagaugggcgaaacucguaauuccccugguugugcauucugcacagaagguccaccuuagaggggccacggcucuggagaugggaaugccuuugcuccugcagaagcaacaggagaucgccuccauaacugaacaguuaaugaccacaaaacugauuucagagcuccagaaacuuuucaugagcaaaaacgaaacuuaugugcugaaguuguggccacuauuugugaaacugcucggccggacccugcaucgcaguggcucuuucaucaauucccuucugcaauuggaggaacucggguuuagaagcggagcacccaugauuaagaaaaucgcuuucaucgccuggaagucgcugauugacaacuuugcguuaaauccugauauucuguguucugccaagaggcuaaaacuccugaugcagccacuuuccucaauccacguccggacagagaccuuggcacugacgaagcucgagguuuggugguaccugcuuaugcgccuggguccgcacuugcccgcuaacuucgaacaggugugcguaccucucauucaaaguacuaucagcauagacuccaaugccucuccacagggcaacagcugucauguggcuacaucacccgggcugaauccuaugaccccaguccacaaaggagccaguucccccuauggcgcaccggguacuccucgaaugaacuuaagcucuaaccuagggggaauggccacaauucccucaauccagcuacucggccuggagaugcuuuugcauuuucugcucggcccagaagcucugaguuucgcgaagcagaauaaauuagugcugagccuugagccuuuggaacacccccucaucuccucuccaucguuuuucagcaagcacgcaaacacccugauuacggccguucaugauuccuucguggcugucgggaaggacgcccccgaugugguaguuucagcaaucuggaaagagcuaauuagucuggugaagucugucaccgagagcggaaauaaaaaggaaaaaccugguuccgaggugcucacacugcuuuugaagucacuggaaagcauagucaagucugagguguuuccaguuuccaaaacuuuagugcucauggagaucaccauuaagggccugccgcaaaaaguacuugggagucccgccuaccaggucgcuaacauggacauccugaauggaacuccugccuuguuccucauccagcugauuuuuaacaauuuccuagaaugcggcgugagcgaugagagauuuuuccugucucucgaaucccugguugguugugugcuuucagggccaacaagucccuuggcauuuagcgacucgguccugaacgugauaaaucagaacgcgaagcaauuagagaauaaagaacaccucuggaagaugugguccguaaucgugaccccucugacagagcuuauuaaccagaccaaugagguuaaccagggcgacgcucuggaacauaauuucucugccaucuauggagcacuaacucucccagucaaccacauuuuuagcgagcagagguuccccguggccacgaugaagacacuguugcggaccuggucagaacuguaccgugcuuuugcccgcugcgcagcuuuaguggccacugcggaggaaaaccucuguugcgaggagcugaguuccaaaaucaugucuagccuugaagaugagggcuucuccaaucuguuguuugucgacagaauaaucuacauuaucaccguuaugguggauuguauugacuucucaccguauaacaucaaguaccaaccuaaaguaaagagcccacagaggcccagugauuggucuaaaaagaaaaaugaaccucucgggaagcugacaucccuauucaagcugauaguaaaagucauuuauagcuuucauacccuuucguucaaggaggcccacucagacacucucuuuacaaucggaaacucuauuacggguaucauaaguuccgugcugggccacaucagcuugcccucuaugauucggaaaaucuucgcuacccugacucgaccauuagcacucuuuuacgaaaauagcaagcuggaugagguuccuaaaguguauuccugccuuaacaauaagcuggagaaguugcucggggaaauuaucgccugucugcaguucucauacacaggaaccuaugacagugagcuacuggaacagcuuagcccccuccugugcauaauauuuuugcauaaaaacaagcaaauccgcaaacagucugcucaguucuggaaugccacauuugcaaaggucaugauguuaguguacccagaggagcugaaaccgguucucacucaagcgaagcagaaguuccugcuucuguugccuggccuagaaaccguggagaugauggaagaguccucaggucccuacagugaugggacggaaaacagccagcugaauguaaaaaucuccggcauggagagaaagucuaacggaaaaagggacucguuucucgcccagaccaagaauaaaaaggagaacaugaagccagcugccaaacugaaacuugaaagcucauccuuaaaagucaagggcgagauucugcucgaagaggagaagaguacagauuucguguuuauacccccugaggggaaggacgcaaaagagcggauuuugacugaccaccaaaaggaagugcugaagaccaaacgcugcgauauaccagcuauguauaauaaccucgacgucucucaggauacacuguucacucaguacagccaggaggaacccauggagaucccuacccuuacgagaaagccgaaagaagacuccaagaugaugauuacagaggagcaaauggauucagacaucguuauuccacaggaugugaccgaagacuguggaauggccgagcaucuggaaaaaucuagcuugaguaacaaugagugcgguucccuagauaagacuagccccgagaugucuaacucaaauaacgacgaaaggaagaaagcacugaucuccagucguaagacaagcaccgagugugccucgucuacugaaaauuccuucguagugagcucaaguucugucuccaacaccacaguggcuggcacgccuccauaucccaccagccggcgacagacuuuuauaacacucgagaaauucgaugggucagaaaauagaccuuuuaguccgagccccuuaaacaauaucuccucuaccguuacagugaagaacaaucaggagacuaugauuaaaaccgacuuccugccaaaggcgaagcaaagggagggaacguuuagcaaauccgauucagaaaagaucgucaacggcacaaaacgcucuagucggagagccgguaaggcagagcagaccgggaauaaaaggucgaagccucuuaugcgcagcgaacccgagaagaacacugaagaguccguggagggcauuguugugcuggaaaauaacccaccuggacucuugaaccagaccgagugcgucucugacaaucaaguacaccugucagaaagcacaauggagcacgacaacacuaaacucaaggcugccaccguggaaaaugccguucugcuugagacaaacacgguggaggagaagaaugucgagaucaaccuagaauccaaggagaauacacccccagugguaauaagugcugaucagauggugaacgaggacucucagguccagauuacuccgaaucagaaaacacugcgacggagcucacguagaagguccgaaguuguggagaguaccacugaaagccaggauaaggagaacucucaucagaagaaagaacgccggaaggaggaggaaaaaccuuugcagaagucccccuuacacaucaaagacgaugugcugccaaagcaaaaacucaucgcagagcagacacugcaggaaaaucuuauugagaagggcucaaaccugcaugaaaagacccucggggagacgagcgccaaugcggagacugaacagaacaaaaagaaagcugaccccgagaauauaaagucggaaggagauggcacccaagacaucgucgauaaaucuagugagaaguuggugagagguaggacacgauaccagacccgccgggccucccaggggcugcuaagcucaauugaaaacuccgagucugacagcagugaggcaaaggaagagggauccaggaaaaagaggagcggcaaauggaagaauaaaucuaacgaaucaguugauauccaggaccaagaggagaagguagugaagcaggaauguauuaaagccgagaaccagagucacgauuauaaggcuacuuccgaagaggacgucagcaucaaaucuccuauaugcgaaaagcaagacgagucgaauacagugaucugucaggauucaaccguuacaagcgaccugcuccaggugccagaugaccuucccaacgucugcgaggagaaaaaugagacuuccaaguacgcagaauauaguuucaccucucugccugugccggagagcaacuuacguacgcgcaaugccauuaagcgguugcauaaaagagauuccuuugacaacuguucacugggugaaaguucuaagaucggcauuagcgauaucuccucacucagcgagaaaacauuccagacccuggagugccaacacaagaggucucgacggguacgcagauccaaagggugugacugcugcggagaaaagagucagccacaggagaaaagccuuauaggccugaagaauacugaaaacaaugaugucgagauuucggaaaccaagaaagcggacgugcaggcucccguuuccccuucugagacaucacaagccaaccccuacagcgaggggcaguuucucgaugaacaccauagugugaauuuccacuugggacugaaggaggacaacgacacuaucaaugauuccuuaaucgucucugaaaccaaaagcaaggagaacacgaugcaggagucacuaccauccggcauugugaauuuuagggaagagaucugugacauggauaguagcgaagcaaugucucuggagucacaggaauccccuaacgagaacuucaaaacaguuggucccugccucggggacagcaagaaugugucucaagagagucuugaaaccaaggaggaaaaaccagaggaaacuccuaagauggagcugucguuggagaacgucacaguggaaggaaaugccuguaaaguaaccgaguccaaccuggaaaaggcuaaaacuauggagcucaaugugggcaacgaagccagcuuccauggucaggagcggacaaagaccggcauaucagaggaagcagcuauugaggaaaauaagcgaaacgaugacucugaggccgauacggcgaaacugaaugccaaggagguugcaacugaagaguuuaacagcgacaucucccuuagugauaauaccacaccggucaaacucaacgcucagaccgaaauuucagagcaaacagccgcuggggaacuggacggaggcaaugaugugucugacuugcacagcuccgaggagacuaacaccaagaugaaaaauaacgaagagaugaugaucggggaagcaauggccgagacgggacaugauggcgaaacagagaacgaggguauaacuaccaagacaaguaagcccgacgaagccgagaccaauaugcugacugcugaaauggacaacuucgugugcgauaccgucgagaugagcacagaagaggggauuaucgacgcgaauaaaacggagacuaacaccgaauacuccaagucugaggaaaaauuagauaauaaccagaugguaauggagucagacauccuacaggaggaucaccacacaagccagaagguggaagaaccaucgcaaugucuggcauccggaaccgccauuagugaacucaucauugaggacaauaacgcuucuccucagaaacuuagagaacuggaucccagcuugguuucagccaaugacuccccaucuggcaugcagacucgcugcguguggaguccucuggcaagccccuccacaucaauacucaagaggggucugaaacguagccaggaggaugagaucucuaguccggucaacaaggugcggagaguuuccuuugccgacccaauuuaucaagcuggccuugcggaugacaucgauaggcgcuguagcaucgugcgaucacauucuuccaauucgagcccuauugggaagagugucaaaaccucucccacgacucaguccaagauaagcgaaauggccaaagagucaaucccaugccccacagaaaguguguacccuccguuaguaaacuguguggcacccguugacauuauccugccacagauuaccuccaauaugugggcuagaggacucggccaguugauccgggccaagaacauaaaaaccaucggggaccugagcacucuaacagcaucugagauuaagacccugccuaucaggucacccaaggucagcaaugugaaaaaggcccuccgcauuuaucacgaacaacaggugaaaacacguggacuugaggagaucccugucuucgauauauccgaaaagacuguuaacggcauugagaacaaaucucugaguccagacgaagagagauuggugucggauaucauugaccccguagcucuggaaaucccucucagcaagaaucuguuagcccagauauccgcgcuugcacugcagcucgauucagaggaccuacauaacuacucugguagccaacuguuugagaugcacgaaaaguugaguugcauggccaauuccgugaucaaaaaccugcagucacgguggaggucuccaagccacgaaaauuccauuuga

SEQ ID NO: 61829 - RNA, 1206 nt, Artificial Sequence
  derived and/or modified sequence opt3 from RILP__Homo_sapiens__NP_113618
auggagcccagaagggccgcuccuggcgugccaggguggggaagccgggaagcagccgguuccgcgucugcugccgagcuggucuaccaccucgcaggcgcccuugggaccgaacugcaggacuuggcucgccgauucggaccggaggcagccgcuggcuuaguuccccuggugguacgugcccuagaacuccuggagcaagcggcaguggguccugccccagauucacuucaggucagugcucagcccgccgagcaggaacugagaagguugcgggaggaaaacgagcgccucagaagggagcugcgggcagggccucaagaggaacgcgcucugcuccgacaguuaaaggaagugacagacagacagagggaugagcugcgggcccauaaucgugaccuucgccagagaggacaagaaacugaggcguugcaggagcagcugcagaggcuacuccugguuaacgccgaacuucggcacaaacuggcagcuaugcaaacgcaguugcgagccgcucaggaucgcgagagagaaaggcaacagccaggcgaggccgcaacaccccaggccaaggaacgggcucgcggccaggcggggagaccuggacaucaacacggucaggagccagagugggcaaccgccggcgcuggggccccgggaaaucccgaagacccugcagaggccgcucagcagcucggcaggccaagcgaagccggucaaugccguuuuucccgggaggaauuugagcagauccugcaggagcgaaacgaauuaaaagcaaagguguuucugcucaaagaggaacuugcguauuuccagagagagcuguugacugaucauaggguccccgggcuacugcucgaggcuaugaagguggccguacgcaagcaacggaaaaagauuaaagcaaagaugcugggaaccccugaagaggccgaaucuucggaggacgaagcuggcccauggauacuucugucagaugacaaaggcgaucaucccccgccucccgagagcaagauccagaguuucuucggguugugguacagaggaaaggccgaguccucugaagacgagacaagcuccccagcaccuucaaaacucgguggcgaagaggaagcucagccccagaguccagcccccgauccuccauguagcgcgcugcacgagcacuuaugccugggggccucugcugcaccggaggccuga

SEQ ID NO: 61830 - RNA, 1212 nt, Artificial Sequence
  derived and/or modified sequence opt3 from RILPL1__Homo_sapiens__NP_847884
auggaggaagagagaggcagcgcccuggcugcagaauccgcccucgagaagaacguggcggaacuuaccgucauggacguuuacgauaucgcuucucugguggggcacgaguucgagaggguaauugaccagcauggaugcgaagccauagcacgguugaugcccaaagugguccgcguguuagagauccuggaaguucuagugucacgacaccaugucgccccugagcucgaugagcugcgucuugaacuggacagauugaggcucgagcggauggaucgcauugaaaaggagagaaaacaccaaaaggaacuggagcugguggaggacguauggaggggugaagcucaggaucucuuaagucagaucgcacagcugcaagaggaaaauaaacagcuuaugacaaacuugagccauaaggacguuaauuuuuccgaggaagaguuccagaagcacgagggcaugucugaacgggagcgccaggugaugaaaaagcugaaagaagucguggauaagcaacgagacgagauuagagccaaagauagggaacuagggcucaagaacgaggacguggaggcucugcagcagcagcaaacucggcuuaugaagaucaaucacgaucugcgucaucgcgucacgguuguggaagcccagggaaaagcguugauagagcagaagguagaacucgaggcagaccugcaaaccaaagagcaggaaaugggcucguuaagagccgagcuggguaagcucagggaacggcuucagggggagcacucacagaacggagaagaggagccagaaacagagccggugggcgaagagagcaucagugacgcugaaaaagucgccauggaucugaaggaccccaaucgaccucgcuuuacuuugcaagagcuaagagaugugcugcaugagaggaacgaacucaaauccaagguuuuccugcuucaggaggaacuggcauauuacaagucugaggaaauggaggaggaaaaucggauuccacagcccccuccaaucgcucacccccgcaccagcccucagccagaguccggcauuaaaagauuguuuucauucuuuaguagggacaagaaacgucucgccaacacacaacggaaugugcacauccaggagagcuucgggcagugggcgaacacccaucgagaugacggauauacugaacagggucaagaggcccugcagcacuuauga

SEQ ID NO: 61831 - RNA, 3159 nt, Artificial Sequence
  derived and/or modified sequence opt3 from RIMBP2__Homo_sapiens__NP_056162
augagagaggccgcugaaaggcggcagcaacugcagcucgagcacgaccaggcacuugccgugcugagcgcgaagcagcaagaaaucgauuuguuacagaaauccaagguccgcgagcuggaagagaaaugccgaacccagucugagcaguucaaccuacucucacgugaccuggaaaaguuuagacaacaugcuggcaaaauugaucuucugggagggagugccguugcacccuuggacauaagcacagccccuuccaagccauucccgcaguuuaugaauggucucgcuacuucucugggcaaggggcaggagucggcaaucggaggcucaagcgccauuggugaauacaucaggccccugccucagccaggggaucggcccgagccucucagugcuaaaccaacguucuuaucccgcucuggaagcgccagauguagguccgagucagacauggaaaacgagcggaauaguaacaccagcaagcaacgcuauucuggcaaagugcaccugugcguagcgcgauacuccuauaaucccuuugauggcccuaacgaaaauccagaggcagaacuuccguugacagccgggaaguaccuguauguguacggagacauggaugaggacgguuucuaugagggcgaacuacucgaugggcagagaggacugguccccucaaacuuuguggacuucguucaggauaaugagagcaggcuugcuaguacucugggcaacgaacaagaccagaauuuuauuaaccauucugguaucggguuggagggagaacacauacucgaccugcauuccccuacccacaucgaugccggcauuacagacaauagcgcaggcaccuuagaugugaacaucgacgauauuggggaggacaucgucccauacccccggaaaauaacucugauuaagcagcucgcuaagucggugaucguaggaugggagccuccagccguucccccggguuggggcacagugucuuccuacaauguccuuguggauaaagaaacccguaugaaccugacguuggggucacgcacuaaggcgcuaauugagaaacugaacauggccgcauguaccuauagaaucagugugcagugcgucacaagcaggggauccucugacgaacuccaauguacucugcuuguuggcaaggaugugguaguggcuccuagccaucugcgggucgacaauaucacccagauuucagcccaguugaguuggcuccccacaaacuccaauuacagccacgugauauuccugaacgaggaagaguuugauaucguuaaagcugcccgauauaaguaccaguucuuuaauuuacgcccaaacauggcauauaaagugaagguccuggccaagccucaccaaaugcccuggcagcuaccacucgagcagagagagaaaaaggaggcuuucguggaguucucuacccugcccgcggguccuccagcaccgccccaggacguaacgguucaagccggggugacuccugcuacaauuagggucucauggcggccacccgugcuuaccccuacuggcuugaguaauggagccaacgucacaggcuacgggguguaugcaaaaggacagcgcguugccgaagugaucuuuccaaccgcugacagcacggccguagagcuggucagacucaggucccuggaagcaaagggugugaccguucguacacuuucugcgcagggcgagucgguggauagcgcugucgccgcagugcccccggaacuguugguaccuccaacuccccauccucggcccgccccacaguccaaaccucucgcuucaaguggggugcccgagaccaaggacgaacaccugggaccacacgcccgaauggaugaggcaugggagcaaucuagagcuccgggcccuguucauggucacauguuagaacccccagucgggcccggcaggcgcagcccuuccccaucacggauacugccccagccucagggaacaccggugagcacuaccguggccaaggcgauggccagagaggcugcacaaagggucgccgaaucuucccgccuagagaaacgaaguguuuuccucgaacggagcucugcuggccaguacgccgcauccgacgaggaggaugcguacgacucaccagauuuuaagcguagaggggccaguguggacgauuuccugaaaggaagcgaacuugguaagcagccccauugcugucacggcgacgaguaucauacagaaucguccagggggucugauuugagcgacauuauggaggaagaugaggaggaacuguacucagagaugcagcucgaagacggaggccgccggagaccuagugguaccucccacaaugcucugaaaaucuuagggaacccagccucugcaggcaggguggaccacaugggacgacgcuuuccccggggcagcgcugggccucaaagauccaggccgguaacuguccccucaaucgaugacuauggacgugaucgccugagcccagacuucuacgaggagagugaaacggauccuggcgccgaggaacuucccgcacggauuuuuguggccuuguucgacuaugauccacucacaaugucuccuaaucccgacgcugcggaggaagaacugccauuuaaggagggucagaucauuaagguuuacggggauaaagacgccgauggauucuauagaggcgaaaccugcgcaaggcuaggucugauaccguguaacaugguguccgagauccaggcugacgaugaagagaugauggaccagcuccugcgacaaggcuuucuuccuuugaauacucccgucgaaaagauugagcggagccgcagaucggggaggcggcauucagugucuacccgaagaaugguugcccuguacgacuacgauccacgcgagaguucccccaacguggacguagaagccgaguuaacauucugcaccggagauaucaucacugucuuuggcgaaauugacgaggauggguucuauuacggagaacucaauggccagaaaggucuggugccuagcaacuuccuugaggaggugccagacgaugucgaaguuuaucugucugacgcucccagccacuacucccaggauacaccuaugaggucaaaggcaaaacguaagaagagugugcauuuuacgccguga

SEQ ID NO: 61832 - RNA, 4920 nt, Artificial Sequence
  derived and/or modified sequence opt3 from RIMBP3C__Homo_sapiens__NP_001122105
auggccaaggacagccccuccccucugggcgcuucuccgaaaaagccagggugcucaagucccgcagccgcggugcucgagaaccagagaagggaacuugagaaacugcgggcugaauuggaggccgaacgcgcaggauggcgagccgagcguagaagguucgcugcacgggagcgccaauuaagagaagaggccgaaagggagcggcgccagcuggcugaucgacuaagaagcaagugggaggcccagaggucccgggaacuccgucagcugcaagaggaaaugcagcgcgagagagaagcggagaucaggcagcuucugcgguggaaagaggcagaacagcgacaauugcagcagcuccugcaccgcgagagagacggugucguuaggcaggcccgggaacugcaacgccagcucgcugaggaauuagugaauagaggccauuguucuaggccuggggccucggagguaucagcagcucagugccguugucggcugcaagaggugcuugcccaguugcgauggcagaccgauggagaacaggcggccagaauuagguaccugcaagcagcucuagaggucgaacgccagcucuuucugaaguauauacuugcccacuuccggggccauccagcucugagcgguagucccgacccucaggccgugcacuccuuggaggaaccacucccccagacaucuagcggguccugccaugcaccuaagccagccugucaacugggaucauuagauagucugagcgcugagguuggcgugagaucuaggucccucggccuugucucaagcgcgugcaguucuuccccggacgggcuguugagcacucacgcaucgucucuagauuguuuugcccccgcuugcucccgcucacuggacaguacgcgaagccucccuaaagccuccaagucugaggaacggccaagcucacccgauaccaguacaccuggaucccguagacugagcccacccccgucuccucuucccccaccucccccacccucagcacacaggaaacugaguaacccucgcgguggcgaggggagcgaaucccagccaugugagguguugacuccgucucccccuggacucggccaucacgagcugaucaaguuaaauuggcugcuagccaaagcucucuggguacuggcccggagaugcuacacccuucaggaagagaacaagcaguugaggcgagcagguuguccauaucaagcggacgaaaagguuaaacgccugaaggugaaacgggcugagcucacagggcuggccagaaggcuugcagaucgugcccgcgaacugcaggagaccaauuugcgggcugucucggcccccauuccuggagagagcugcgcaggccucgaacugugccagguguucgcuagacagagggcccgagacuuauccgagcaagcgucagccccacuggcuaaggauaaacagaucgaagaacuacggcaggaaugucaucuccugcaagcacgcguggccaguggccccugcucugaccuucacacugggagaggagguccguguacacagugguugaacgucagggaccuggaucggcuccagcgagagagccagagagagguucugcgcuuacaaaggcagcugaugcuucagcagggcaaugggggagcuuggccugaagccggcggucaauccgcaaccugcgaggaagugcgucggcagauguuggcgcucgagagagaacuggaccagaggcgccgagagugucaggagcuagggacgcaagccgcuccagccagacggaggggcgaagaggcagaaacucagcugcaggcugcccuccugaagaacgcauggcuugccgaggagaauggacgcuugcaagcuaaaaccgauuggguacguaagguggaagcggagaacucagaagucagaggccaccuggggcgggccugccaggagagggacgcaagcggauuaauugcugaacagcuccugcagcaagccgcccgcggucaggaucgacagcagcaacuucagagagacccccagaaggcucugugugauuugcauccuucuuggaaagagauccaggcacuccaaugccggcccggccacccaccugagcagcccugggaaacaucccagaugccagagagucaggugaaggggagcaggcgcccgaaauuucaugccagaccugaagacuacgcgguuucucaacccaauagggauauacaggagaagcgggaggcuucccuggaggagucaccaguggcccuaggagaaagugcaagcgucccccaggugucggagacuguaccugccucccaaccacugucuaaaaagaccagcucacagaguaacuccucuagcgaaggcuccaugugggcuacaguucccucaagcccuacccucgaccgugauacggcaagugagguggacgaccuggaaccggauucugucucccuugccuuggagaugggugggagcgcggcuccagccgcacccaagcugaaaaucuucauggcccaguauaauuacaacccuuuugagggcccaaaugaccaccccgaaggagaguuaccucucacugcuggcgauuauauuuacaucuucggggacauggaugaagacggauuuuacgagggugagcuggaugacggccgccgagggcuugugccgucgaacuucgucgaacagauucccgauucauauaucccaggaugucugccugccaagucucccgaccuaggcccaagucaacucccugcaggucaggaugaggcucuggaagaggacuccuugcugagcgggaaagcccagggcaugguggauagaggauuaugccagaugguuagggugggcucuaagacagaaguagcgaccgagauacucgacacuaaaacagaggccugucaacuggggcuucugcagagcaugggaaagcagggcuugucccggccccuccuggguaccaaggggguccuacgcauggcaccaaugcagcugcaucuucaaaacgugacggcuaccucagccaauauuacauggguuuacaguagccacagacacccgcauguggucuaucucgacgauagggaacacgcucugacuccugcaggagugucuugcuacaccuuucagggcuugugccccgguacacauuaucggguacgaguggagguuagacugccaugggacuuacuccaggucuacuggggcacuauguccucaaccgugacauucgauacccugcuugccgggcccccuuauccaccccuggacguguuggucgaacgccacgccaguccuggaguucucguggugagcuggcugccgguaacuaucgauuccgcugggucuucgaacggcguccaagugacgggauacgcgguuuacgcagacggccuaaaagugugugaggucgccgaugcuacagccgguagcaccgugcuggaauuuucacagcuucagguuccacucacuuggcagaagguguccguaaggaccaugagucugugcggggagucuuuggacagcguccccgcacaaauuccugaggauuucuucaugugucaccgguggcccgaaacaccaccuuuuuccuauaccugcggagaccccucaacuuaccgugugacauucccaguguguccucagaaauuaucucuggccccgcccagcgcuaaggcgaguccacauaauccuggcuccugcggugagccccaggccaaauuucucgaagcauucuuugaggaaccaccuagaaggcagagccccgucucuaaccugggcucagagggggaguguccguccaguggagcuggcagccaagcccaggaacuugcagaggccugggaagggugccgcaaggaucuguuguuccagaagucgccacagaaucaccggccucccucuguuuccgaccaaccaggagagaaagagaacuguuaucagcauaugggcacgagcaagucacccgcuccugguuuuauccaccuacgaaccgaaugcgggccgagaaaagagcccugucaggaaaaggccgcgcuggagagggugcuccgccagaaacaagaugcacagggauucacuccaccucagcugggcgccagucaacaguacgcuucugacuuucauaauguacuuaaggaagaacaggaggccuuaugccuggaccuccgggguacagaaagacgugaggaaaggcgggagcccgaaccucacucccgccagggccaggcuuugggggugaaacgaggaugccaacugcacgagccaagcucagcacucugucccgccccuagugcuaaggucaucaagaugccaagaggcgggccccagcagcugggaaccggcgccaacacaccggcaaggguguucguugcgcuuagcgauuauaauccucuggugauguccgccaacuugaaagcugccgaggaggagcuagucuuucaaaagcggcagcugcuccgcgugugggguucucaggacacucaugauuucuacuuaagcgaaugcaauagacagguugggaacauuccaggaaggcugguggcagagauggaagucggcaccgagcaaacggaccgacgguggcguucccccgcucagggccaccuuccuucaguagcccaucuggaggauuuucaggggcucauaaucccacaaggaucuaguuuggugcugcaggguaauucgaaaagacucccccuguggaccccgaagauuaugaucgcagcccuugacuaugauccuggcgacgggcagaugggaggccaggguaaagggcgccuagcucugagggcgggagauguugugauggucuacggccccauggacgaucaaggcuucuacuauggggaauugggaggucaccggggcuuagugccagcccaucugcucgaccacaugagccugcacgggcauuga

SEQ ID NO: 61833 - RNA, 3039 nt, Artificial Sequence
  derived and/or modified sequence opt3 from RIMS1__Homo_sapiens__NP_001161879
augugcgcccccggcauccacgugagcuccgaggggugggaagaggucagaucuguugacucagaagagggaaccauugaagcuaggcgggcaguggccggugaucuggacuacuauuggcucgauccugcgacauggcauagucgcgagacuagcccaauauccucucacccgguaacguggcagcccucgaaggagggcgaccgacuuaucgggcgugugauucugaacaaaagaaccacaaugccuaaggauucaggagcuuuguuaggccugaaagucgugggugggaagaugacugaccuaggaaggcucggcgccuucaucaccaaaguuaagaagggcagccuggcagauguggucgggcaucuucgggccggagacgaagugcuggaguggaaugguaaaccauugcccggcgcuacaaacgaagagguauacaauauuauccucgagaguaaguccgaaccucaaguugagauaaucgugucucgcccaauuggggauauccccaggauuccugaaagcucccacccaccgcuggagucaaguucuagcuccuuugaaucacagaaaauggagagacccagcaucagugucauaucuccuaccuccccaggagcacugaaggacgccccucaggugcucccuggccaguuaagcgugaaacugugguaugauaaggucggucaucaacuuauuguuaacguguugcaggcuacugaccugccagcccggguagaugggcgcccccgaaauccguacgugaagauguauuuccuaccugacagaucggacaaaucuaagaggcggacaaaaaccgucaagaaaauccucgagcccaaguggaaccagacguuuguguacucccacguucaccgucgcgauuucagagaaaggaugcuggagauuacugugugggaccagccacggguccaagaagaggaaucagaguuucuuggagagauccugaucgaauuggagaccgcgcuccuggaugacgaaccucauugguauaaauuacagacacacgaugagaguagccugccccucccacagcccuccccuuucaugccacgacgccauauucacggcgaaucuagcucaaagaaacuucagagaagucaaaggauauccgacagcgauaucucugacuacgagguggaugacggcauugggguaguuccgcccggauaccggucaagugcacgcgagagcaaguccacuacccugacagugccugaacagcagagaaccacgcaccauaggucucguucggucagcccacaccgggguaaugaucaaggcaagccccgauccagauugccuaacgugccacuacagaggucacuggacgagauccaucccacucgccggaguagaucuccgacaaggcaccaugacgccagccgcuccccugucgaucaccgaacccgggacguggauucacaguaucucagcgaacaggacucugagcugcuuaugcugccacgugcuaaaagagggagguccgccgaguguuugcacacuacaagugaacuccaacccuuucuggaucgcgcacggagcgcuucuaccaauugcuuaagaccugacacgucccugcauucacccgagagggaacgacacagucgcaagagcgagcggucguccauacagaaacagaccagaaagggaacagccucugaugcggaaaggaugcaucgucagcgcagcccaacucaaucaccucccgccgacaccaguuucuccucucggagaggcaggcagcuaccacagguuccggugcgaagcgguuccauugagcaggcaucacucguagucgaggaacggacacgccaaaugaagaugaaagugcacagauuuaagcagacuaccgggagcggcaguucucaggagcuggauagggaacaguacuccaaauauaacauccacaaggaccaauaccggagcugugauaauguuucggcuaaaucaucugacagugauguguccgacgucagcgccaucucucgaacaagcuccgcuucaagacuuaguagcaccucuuucauguccgagcagucagaacgcccuaggggacguauuaguagcuuuacucccaagaugcagggccggagaauggggacguccggaaggucuaucaugaagucgacaagcgugucaggugagauguauaccuuggagcauaacgacggcucccaaagugauacugccguagggaccgugggagcaggcgguaaaaagcgccgaucuagccuguccgccaaaguugucgcuauugugucaagacggucuaggagcacaagucagcucucccagaccgaaagcgggcacaagaaacugaagucuacuauacagcgcucaacagagacgggcauggcggcagaaaugcguaagauggugagacaaccaucccgggagaguaccgacggaagcaucaauucguacucuuccgaaggcaaccuuauuuuccccggggucaggcugggagccgauagccaguuuucagacuucuuggauggucucggcccugcucagcugguugggcgccagacuuuagccacaccagcaaugggagacauccaaaucggcauggaggauaaaaagggucagcuggagguggaagugauucgagccagaagucuaacccagaaacccgggucuaaguccacacccgcuccguauguaaaagucuaccuccuggagaauggcgccugcauagcaaagaaaaagacucggaucgcgaggaagacccuugacccauuguaccagcaaagccugguguucgaugaaucaccccagggaaaaguucuccaggugauugucuggggcgacuaugggcgcauggaucauaaguguuuuaugggaguggcucaaauccuguuagaggagcuggaccuuaguagcaugguuauuggcugguacaaauuguucccuccauccucucucguggaucccacgcugaccccucuaacaagaagggccagccaguccucacuggaaucuaguacugguccgcccugcauccggucguga

SEQ ID NO: 61834 - RNA, 4050 nt, Artificial Sequence
  derived and/or modified sequence opt3 from RIMS2__Homo_sapiens__NP_001093587
augagcgcccccgugggcccuagagggaggcuggcuccaaucccggcagccucccagcccccucuccaaccagagaugcccgaccuuucucaccugaccgaagaggaacggaagauuauauuggcggucauggaucgccagaaaaaggaggaagagaaagagcagucaguuuuaaagaaacugcaucagcaauucgaaauguacaaggaacaggugaagaaaaugggagaagagagucagcagcaacaggagcagaagggugacgcuccuacaugcggcaucugucacaaaacuaaguuugccgaugggugcggacauaacuguagcuauugccagacgaaauucugugcacgaugcggcggucguguaucccuaagaucuaauaaggugaugugggucuguaaccucugcaggaagcaacaggaaauucugaccaaaucgggggccugguuuuacaauucaggaagcaacacaccacagcaacccgaccagaaggugcuucggggccugcgcaaugaggaagcuccucaggagaaaaagccaaaauugcacgaacagacucaauuccagggcccgaguggggaucucuccguucccgcaguggagaagucuagaagccauggacugaccaggcagcacuccaucaaaaacgguucaggcgucaagcaccauauugccagugacaucgcuagcgaucggaagcgcucuccuuccgugucacgagaccagaauagaagguaugaucaacgggaggaacgugaggaauacagccaguaugccacaagugacaccgcgaugccacgcucucccuccgauuacgcagacagaaggagccagcacgagccucaguuuuaugaagauucggaccaucugucuuaccgggacuccaaccgacgcucacacagacacaguaaagaguacauaguagaugacgaggauguugaaagcagggacgaguaugaacggcaacgcagagaggaagaguaccaguccagguaucguucugauccaaaucucgcccgguaccccgugaagccgcagccuuaugaggaacagaugcgaauccaugcugaggucagcagagccaggcacgaacgccggcauucagacgugaguuuagcaaacgcugaucuggaggacuccagaauuagcaugcuuaggauggaucgccccucucgacaacggucaaucagugagcguagagccgcgauggaaaaucagaggagcuacuccauggagcgcacucgggaagcccaggggccaucuucguaugcacaaagaacaaccaaccacagcccucccacgccaaggcgaucccccuugccuauugaccgcccagaucugcggagaacugacucacuaaggaaacagcaucaccucgacccgaguucugcugugcguaagaccaaacgcgagaagauggaaacaaugcugcggaaugauagccuuuccucagaccagagcgagucugucagacccccuccacccaagccucacaaauccaagaaaggaggcaagaugaggcagaucagucugucuucuuccgaggaagaguuggccucaacuccagaauacaccaguugugaugacguugagauagaaagcgagucgguguccgagaaaggugauauggacuacaacuggcucgaucauacaucuuggcacagcucagaagcuagucccaugucccugcauccgguaaccuggcaaccuucuaaggacggggaucgauuaauuggacggauccugcucaauaagcgccuuaaagacggcagcgugccaagagauuccggcgccaugcugggguugaaggucgugggagguaaaaugacggagucaggcaggcuaugcgcauucauuacuaagguuaaaaaggggagccuggccgacacagugggacaccuccggcccggcgaugaaguccuggaguggaacggucgacuucugcagggggcuaccuuugaagagguguauaacaucaucuuggagaguaagccugaaccccagguagagcucguugugucuagaccaauuggcgacauaccucgcauccccgacuccacucacgcgcagcuggaaagcucgucaucuaguuucgagucccagaaaauggauaggccaagcauuucugucacaagcccgauguccccuggaauguuacgugacgugccccaauuucugucaggccagcuaaguagccagucucucucccggagaaccacgccauucguccccagggugcaaaucaagcugugguuugauaaaguugggcaucagcuuauagugaccauuuugggagcaaaggaccugccuucacgcgaggauggucgaccaagaaaucccuacguaaaaaucuauuuccucccugaccggagugauaagaacaaaaggcgcacaaagacugucaagaaaacccuggaaccgaaguggaaucagacauuuaucuacagcccagugcaccguagagaguuccgggaaaggaugcuugagauuacucugugggaccaagcccgcguucgagaagaggaguccgaguucuugggcgagauccucauugaacuggagaccgcuuuacuggaugacgaaccccauugguauaaacuacagacacacgaugugucuucgcucccucugccacaucccagcccuuacaugccgagacggcagcuucacggggagucacccaccaggcgcuugcagagauccaagaggauaagugacucugaggucagcgauuaugacugugacgauggaaucggcgugguauccgacuaccggcacgauggucgugaccugcaaucaucuacucucagcgugccagaacagguuaugaguuccaaccauugcagcccuucugggucaccccaccgcgucgaugugauuggccgaacgagauccuggaguccaagcgugccucccccacagucgaggaaugucgagcagggacugcggggcacacgcaccaugacugggcauuacaacaccaucucuagaauggacaggcaccggguuauggaugaccauuauuccccggaucgagacagagauugcgaagccgcagaccgccaaccuuaccacaggagccggucaacagagcagcgucccuuacuggaaagaaccacuacaaggagucgcucuacggagcggccagacaccaaucuuaugcgauccaugcccagcuugaugacuggaagaucagccccuccaagucccgcucucagcaggucccacccucgcacagguucugugcagaccagcccguccucaacaccaguggccggccggagagggcgucagcugccccaacuaccucccaaaggaacucuggauaggaaggcaggcgguaagaaacuccggucuaccguacagcgcaguacggagaccgggcuggcggucgaaaugcgaaacuggaugacaagacaggcuucgagggagagcacugacggcuccaugaauagcuauucaagcgaaggaaaccuuaucuuuccaggcgugcgguuggccuccgauagucaguucucugacuuucuggauggguuaggaccugcacaacucguuggccgccagacccuggccacacccgcuaugggugacauucagguggggaugauggauaagaaaggacaacuugaggucgagauaaucagagccaggggccuggugguuaagccagguagcaaaacuuugccugcaccguacgugaagguauaucuccuggacaauggcgucuguauugcuaagaaaaagaccaaaguggcccgaaagacgcuagaaccccuguaccagcagcuccugucauucgaggaauccccacaggggaaagugcuucaaaucauugucuggggagauuauggccggauggaccauaagaguuuuauggggguugcgcagaucuugcuggaugaguuagaacucagcaacauggugauaggaugguucaagcuguuuccucccucuucccuuguagacccaacacuggccccucuaacccguagagcuucacagagcucgcucgagucuaguacuggccccuccuacagccgcucauga

SEQ ID NO: 61835 - RNA, 813 nt, Artificial Sequence
  derived and/or modified sequence opt3 from RIMS4__Homo_sapiens__NP_001192246
auggagagaagccaguccaggcugucucucucagccaguuucgaagcucuugcaaucuacuuucccugcaugaacagcuucgacgaugaggacgccgaaggcgauucccggcgccugaagggggcgauucaacgaucuaccgagacaggauuggcuguggaaaugccuucgcguacuuuaagacaggccucacacgagagcauagaggacaguaugaacuccuaugguucugaaggcaaucugaauuacgggggagucugucuagcaagcgaugcccaguuuuccgacuuccucggcucaauggguccagcucaguuuguugggaggcaaacgcuggcaaccacaccgaugggagauguggagaucggccuucaggaacggaacggccagcuggagguagacauuauccaggcccgcggguugacugcuaaacccggaaguaagacccucccugccgcguauauuaaagcauaccugcuggagaaugguaucugcauagccaagaaaaagacaaagguggcuagaaaaagccucgauccauuauauaaccaaguccugcuuuuccccgaaucuccucagggcaagguguugcagguuaucgugugggggaauuacggaaggauggagcggaaacaguuuaugggcgucgcccgcgugcugcuagaggaacucgaccugaccacucuugcaguagguugguauaagcuguucccaacauccucaaugguugaucccgcuaccgggccuuugcuccgacaagccagccagcugaguuuagaaucuacggugggaccauguggcgagagauccuga

SEQ ID NO: 61836 - RNA, 2352 nt, Artificial Sequence
  derived and/or modified sequence opt3 from RIN1__Homo_sapiens__NP_004283
auggagagccccggcgaauccggggccggaucuccuggugcuccaucaccgaguagcuucaccacaggccaccuggcaagagagaagcccgcccaggacccucucuacgaugugccaaacgcguccgggggacaagcuggcgguccccagaggccugggcgggucguuucucuucgcgaacgacuguuguuaacucguccaguguggcugcagcuacaggccaaugcagccgcugcacuccauaugcugagaacggagcccccuggaaccuuucuuguaaggaaaucgaacacacggcaaugccaggcccuguguaugcgcuugccagaggcuucaggcccgagcuucgugaguucccacuauauccucgagucucccggcggggucagccuggagggauccgaacugauguuuccugaccucgugcaguuaauuugcgccuacugucauacuagagauauacugcuuuugccacugcagcuacccagggcgauccaccaugcagccacccacaaggagcucgaagcuauuucacaccuggguaucgaguucuggaguagcucucuuaauauuaaagcccaacggggcccugcagggggaccaguucugccccaguugaaggcucgcuccccgcaggagcucgaccagggcacaggugccgcgcugugcuuuuucaacccuuuauuucccggggaucugggaccaaccaaacgagaaaaguucaagagaucauuuaaagugagggucagcacugagacaaguucuccucucuccccacccgccgugcccccuccaccgguacccguucuuccuggcgcagugccaagccaaaccgaacggcugcccccuugucaguugcuacgucgcgagucgucugucggcuauagagugccagcuggguccggacccucacugccgccuaugccaagucuccaggaaguggacugcgguagccccuccucuagcgaggaggaaggcgucccugggucaaggggaagucccgccacguccccacaucugggccggcgacgcccucuucugagaagcaugucugcugccuucuguucauugcucgcacccgagaggcaaguuggucgggccgcugcggcacugaugcaggaucgccacacugccgcugggcaguuagugcaggaccugcuaacccaaguaagagccggcccagaaccgcaggagcuccagggaaucaggcaggcacugagucgugcccgggcuaugcuuagcgccgaauugggcccugagaagcugcucucccccaaacgacuggagcaugugcuugaaaagucucugcacugcucggucuugaaaccacucagacccauacuggcagcgagguuacgccggagacuggcugccgaugggagccuaggaaggcucgcagagggucugcgccuugcccgagcucaaggcccuggggccuuuggaucccacuugucacugccaagucccguggaacucgagcagguucggcagaagcuguuacagcugcuucguacauacucuccuagcgcacaagugaagagauugcuccaggcuuguaaacugcuauauauggcccugaggacucaggaaggcgagggugcgggggccgacgaguuccucccgcugcuuuccuugguccuggcucauugcgauuuaccagaacuccugcuugaggcagaauacaugucagagcuguuggagcccagccuccugaccggcgaaggaggcuauuaccuaacaucucuguccgccagucucgcucugcuuagcggguugggacaggcccacacccugccuuuaucuccagugcaagagcuccgccggucccugucacuuugggaacagagaaggcugcccgcaacgcauuguuuucagcaccuacuccgaguagcguaccaagacccuaguagcgguugcacuucgaagacacuggccguuccgcccgaggcuuccaucgccaccuugaaucagcugugcgcaacuaaauuccgcgugacacagccaaacaccuucggcuuauuucucuauaaggaacagggguaccaucggcugccucccggagcucuugcccacagacugccaacgaccggcuauuuggucuacaggcgugcagaguggccugagacacaaggugccgugacugaagaggaagggucuggccagagcgaggcucgcucacggggagaagaacagggcugucagggggauggagacgcgggcgucaaagccagucccagagacauuagggagcaauccgaaaccacagcagagggugggcagggacaggcucaggaaggcccagcccaaccgggugagccugaagccgagggcucucgagcugcagaggaauga

SEQ ID NO: 61837 - RNA, 2835 nt, Artificial Sequence
  derived and/or modified sequence opt3 from RIN2__Homo_sapiens__NP_001229510
augcuggacagcuucucccaggagucuacccuccccuuuagagaagccaggaagcggacaucauuccaaccugugcaggucuggcgcaacuuuacugcuagucagacgaccgagagcccagcaugcuccggcgccucucuuggggaaaugacagcguggacuaugggagcucgaggucuggauaaacguggcucguucuuuaaguugaucgacaccauugccucagagauaggggaauuaaaacaggagaugguuagaacagaugugaaucuggagaacggacuagaaccggcagagacccacagcaugguaaggcauaaggacggcgguuacagugaagaggaggaugugaaaacuugugcccgggacuccggguaugauucucucagcaaucgccuguccauccuugacagacuguugcacacacaucccauuuggcuccaacugucacugagugaagaggaagcugcagagguccuccaggcccagccuccaggaaucuucuuagugcacaagagcaccaagaugcagaaaaagguucugucucuuagguugcccugcgaauuuggcgcuccucugaaagaguucgccauuaaggaguccacguacacuuuuucacuagaaggcagcgggaucaguuucgcggaucucuuucggcugauagcauucuauuguaucucucgcgacgugcuuccauuuacccugaaauugcccuacgccauuuccacagcuaagagcgaggcccaacucgaagaacuggcacagaugggauuaaacuucuggucgucuccugcugauuccaagccaccgaaucugcccccuccacaucgaccccucucaagugacggugucugcccugccagccuuagacagcuguguuugaucaacggcgugcacuccauuaaaacuaggaccccaucugaacuagagugcagccagacaaauggggcgcuguguuucaucaacccccucuuucugaagguacacucacaagaucuuaguggaggccugaaacggccguccacccguacgccuaaugccaacgguacugagcgcacaagaucucccccaccuaggcccccacccccugcaauaaauagcuugcauaccucaccacggcucgcucgaacugaaacacagaccaguaugccggagacgguuaaccacaauaagcaugggaacguggcccugcccggaaccaaaccuacaccaauucccccuccacgcuuaaagaaacaggcuagcuuccuggaagccgagggcggcgcaaagacucuauccgggggaagacccggugccggcccggaacucgagcuggggaccgcuggaucuccuggcggugcgccacccgaggcagccccuggggacugcacaagggcucccccaccuucgagcgaaucccggcccccaugucacggcggacgccaaagacuuucagacaugaguaucucuacuagcuccucagauagcuuggaguuugacaggucuaugccgcuguucggcuaugaagccgauaccaauuccagucucgaggacuacgagggggaaagcgaucaggagacaauggcaccucccauuaagucuaaaaagaaacguuccucaaguuuuguccugccaaaacuugugaaaagccagcugcagaaggugucgggagucuucuccucuuuuaugacccccgaaaagcggaugguucgaagaaucgccgaguugagcagggacaaaugcacuuauuucgguugucucgugcaagauuacguaucauuucugcaggaaaacaaggagugccacgugaguuccacggacauguuacagacaauccgccaguucaugacccaagucaaaaacuaccugucucagagcuccgagcuagauccuccaauugaaucacucauacccgaggaccagaucgaugugguucuggaaaaggcuaugcauaaaugcauucuuaagccuuugaagggccacguggaggccaugcugaaagacuuucauauggcagacgggagcuggaagcagcucaaagaaaaucugcaauuaguccggcagagaaacccgcaggagcugggaguguucgcgccaacucccgauuuuguagacguugagaagaucaaagugaaguucaugaccaugcagaagauguauaguccugaaaagaaggucaugcuuuugcucaggguguguaaacugauauacacagucauggagaauaacucuggccgcauguauggugcugaugacuuccuaccagugcugaccuacguuauugcccaaugcgauaugcucgaacuggacacugagaucgaauauaugauggagcuuuuggaucccucccuguuacacggggagggcggauacuaucucacaagcgcauacggcgcccugucgcuuaucaagaauuuucaggaggagcaggcugcccgacuguugucaucugaaacgcgggacacccuccgucaauggcauaaaagaaggacuacaaaccgcaccauuccuaguguggaugacuuccagaauuaccugcggguagcauuucaggaggucaacuccggguguacaggaaagacucuacuggugagaccguauaucaccacggaggauguuugccagauuugugcugaaaaauucaaggugggugaccccgaggaauacagccucuuucuguucgucgaugagaccuggcaacagcuugccgaagacacauauccacagaagauaaaagcggaguugcacucuaggccucagccccacaucuuucauuucguguacaagcgaauuaaaaaugacccauauggcaucaucuuucaaaacggggaggaagaucugacuaccagcuga

SEQ ID NO: 61838 - RNA, 2958 nt, Artificial Sequence
  derived and/or modified sequence opt3 from RIN3__Homo_sapiens__NP_079108
augaucagacacgccggcgcucccgcaaggggcgacccuaccggaccagugccggucguugguaagggcgaggaagaggaagaggaagaugggaugcggcugugccuccccgccaacccuaaaaauugucuuccacaucgccgaggaauuagcauacuggagaaguugaucaaaacaugccccgugugguuacagcugucccuaggccaagcggagguagcucguauucuccacagaguggucgccgguauguuccuggugaggcgggacucuucaaguaagcagcuuguucugugugugcauuuuccuagcuugaacgaauccucugcagagguccucgaauacacuaucaaagaggagaagucgauucuguaucuggaagggucagcccucguguucgaggauaucuuucgcuuaauagcuuucuacugcguaagcagagaccugcuuccauuuacguugaggcugccccaggcaauccuagaagccaguuccuucaccgaucucgagacaauugcuaaucugggacuuggcuuuugggacucuagccugaacccuccacaggaacggggcaagccggccgagcccccucgcgaucgagcgccaggguuccccuugguuuccucacucagaccuacugcacacgacgccaauugugcuugcgagaucgaacugagugugggaaacgauagguuaugguuugucaauccaauuuucaucgaggacuguagcucugcccugcccaccgaucaaccgccucucgguaacugccccgcacggccacuuccucccacauccgacgcuaccucaccaacuagccguugggcuccccgcagaccuccaccgcccccuccagugcugcccuugcagccuuguaguccagcgcagcccccggugcuaccugcccuggcaccagcucccgccugcccucuccccacaucuccaccuguccccgcuccacauguuaccccgcacgccccugggcccccagaucaccccaaucagccuccaaugaugacgugugaaaggcugcccugcccuacugcagggcuuggaccgcugcgggaggaagccaugaaaccaggcgcugcguccagccccuugcaacaggugccugcaccaccccucccugccaagaaaaaccugccgaccgcucccccacgacgcagaguaucggagagggugucuuuagaggaccaguccccugguauggccgcagaaggggaccagcugucacuacccccacaaggaacaagugauggcccugaggacacuccccgggaaagcaccgagcagggccaggauacagaagucaaggccuccgacccacauucuaugccggagcucccucgcaccgcuaaacaacccccagugcccccuccaagaaagaagaggauaagccgucagcuggccucaacgcuucccgcaccuuuggagaaugcggaacugugcacucaggcuauggcccucgagacaccgaccccagggcccccucgggaaggacagagucccgcaucccaagccgguacucagcacccuccagcucaggccacagcacauagccagucuucacccgaguuuaaaggcagucuggcuagccuuuccgauucucuggggguuucggugauggccaccgaccaagauagcuauuccacgucaaguaccgaggaagaguuggaacaguucucuagcccauccgucaagaaaaagccuucaaugauucucggaaaagcgcgacacagacugagcuuugccucuuucuccaguauguuccacgcuuuucuuagcaacaauaggaagcuguacaaaaaggugguagagcuagcacaggacaagggcucuuauuucgguucccucguucaggauuacaaaguguauucacuggaaaugauggcccgccaaacaaguagcacugagaugcuucaggagauccggaccaugaugacacaguugaagucguaccugcuccaguccacugaacugaaagccuuagucgacccggcccugcauucugaggaagaguuagaagcaauuguggagagcgcguuguacaaguguguccucaaaccccugaaggaggccaucaacucaugccuacaccaaauccauaguaaggaugggucccugcagcagcucaaagaaaaucaacuggugauucuugcuaccacaaccacugacuugggcguuacgacaucugugccagagguaccuaugauggaaaagauacugcagaaauuuaccagcaugcacaaggccuauucccccgagaaaaagaucucaauuuuacucaagacuuguaaacugaucuacgacagcauggcacuuggaaacccaggcaagccuuauggggcugaugacuuccugcccgucuugauguacgugcucgccagaaguaaccugaccgaaaugcuacugaauguugaguauaugauggagcucauggauccggcacugcagcuuggagaagguucuuacuauuugacaaccacuuacggcgcccuggagcauauaaaauccuacgacaagauuacagugacgaggcaguuaagcgucgaagugcaagauucgauccaccgcugggagcgacggcguacccucaacaaagcuagagcgucaaggucuaguguacaggacuuuaucugcguguccuaucuggagccagaacagcaggcccgcacucuugcaagccgggcugauacacaagcccaggcccugugugcucagugcgcagagaaguucgccguugaaagaccucaggcgcacaggcuauuuguccucguggacgggcgauguuuccaacuggcugaugacgccuugccccauugcauuaagggauaccuguuacgcucugagccaaaacgggauuuucacuucguguauagaccccucgacggcggugggggcggaggcgggggaagcccuccgugucuggucguuagggaacccaauuuucuuuga

SEQ ID NO: 61839 - RNA, 1221 nt, Artificial Sequence
  derived and/or modified sequence opt3 from RING1__Homo_sapiens__NP_002922
augaccacacccgccaacgcucagaaugcaagcaagacuugggagcugucccucuacgaacuucacagaacgccucaagaggccaucauggacggcaccgaaauugcggugucuccaaggucacugcauagugaguugaugugcccgauauguuuagauaugcugaaaaacacaaugacuaccaaggaaugccuacaccgguucuguagcgacugcaucgucacagcucuccgcuccgggaauaaagaguguccuaccugccgaaagaaacugguuucuaagcguucgcuuagacccgauccaaacuuugacgcccugauuucaaagaucuaucccagcagggaggaauacgaggcacaucaggaucggguguugauucgccucaguagacugcacaaucagcaggcccuguccucuagcaucgaagagggacucaggaugcaagcuaugcaucgggcacagcgcguacgaagaccuauaccagguuccgaccagacuacaaccaugucaggcggggagggagaacccggcgagggugaaggggauggagaggacgugaguagcgauucugccccugacuccgcuccaggcccggcccccaaaaggccucggggcgggggagcggguggcucaagcgucgggacgggaggcggugggacuggaggcgugggcgggggagcagguagugaagauucuggcgaccgugggggaaccuuaggcggugggacacugggcccacccuccccuccaggagcccccagcccgccugagcccggcggggagaucgaacuuguuuuccgcccacacccuuugcugguggagaagggagaauauugucagacuagauacgucaaaaccacagguaacgcuaccguggaucaccuaucgaaguaucucgcccugaggauugcacuugagcggcgacaacagcaggaagcuggcgagcccgggggaccaggcgguggggccucugacacgggcggacccgacggcugcgggggagaggguggcggggcgggaggcggugaugggccugaggaaccagcccugccguccuuggaaggcguaucagagaaacaguacacuaucuauauugcacccggaggcggggcuuuuacaacccucaauggaagucugacuuuagaacugguuaacgagaaguucuggaaggugagccgcccucucgagcuuuguuacgccccaacaaaagaccccaaguga

SEQ ID NO: 61840 - RNA, 2379 nt, Artificial Sequence
  derived and/or modified sequence opt3 from RINT1__Homo_sapiens__NP_068749
augcugcccgccggcgagaucggggcuagcccugcagccccaugcuguuccgaaucuggagacgagagaaagaaccucgaagagaaaucagauauuaaugugaccguccuuauagguaguaagcagguuagcgaaggcacagacaacggggaucugccguccuacgugucugcguucaucgagaaagagguaggaaaugacuugaagucgcucaaaaagcuggauaagcuaauugaacaaaggacugugucaaaaaugcagcucgaggaacagguccugacgaucagcagugagauucccaagcggauccgcuccgcucuuaaaaacgccgaggaaucuaagcaguuucugaaucaauucuuggagcaggaaacccaccucuuuagcgcaauaaacucccaucugcugacagcccagccuuggauggacgaucucggcacuaugaucucacagauugaggaaaucgagcgacacuuagcuuaucugaaauggauuagucaaaucgaggaacuuagcgacaauauacagcaguacuugaugaccaacaaugugccagaggcagccucuacacugguuuccauggcugaacuagauauuaagcuccaggagucaagcugcacccaucugcuugguuucaugcgugccacugugaaguuuuggcacaaaauccugaaggacaaauugacaagugauuucgaagagauucucgcgcaacugcauuggcccuuuaucgcaccuccacagucucagaccgucggguuauccagacccgccagcgcuccugagaucuauucguaccuggaaacguuauucugucaacuucugaaguugcagacuucugacgagcuacugaccgaaccaaaacagcucccggagaaguauucccugcccgccucaccuagugugauucuuccaauacagguaaugcugacacccuugcagaaaagguuucgguaccacuuccgcggaaacagacaaacuaauguucucagcaagccugaaugguaucuggcacagguguuaauguggaucggcaaccacaccgaguuucuggaugagaagauucagccaauccuagacaaagucggcucccucgugaaugcuaggcuggaauuuucucgggggcuuaugauguuggugcuggagaagcucgccacagacauacccugccugcuuuacgaugacaaccuguuuugucauuuggucgaugaaguucuccuguucgagcgcgaguuacacagcgugcauggauacccggguaccuucgcgucaugcaugcacauucugagugaagagacguguuuucaacgauggcuaacuguagaaagaaaauucgcccuccagaagauggacuccaugcugagcucugaggcagcuugggugucacaguauaaagauaucacagacgucgaugaaaugaaggugccugacugcgccgagaccuuuaugacucuuuugcugguuaucacagauagguacaagaaucuccccaccgcuagucggaaacugcaguucuuagagcugcaaaaggaccuuguggaugacuuucguauucgcuugacgcaggucaugaaagaagagaccagagccagccucggcuucagguauugugcaauccugaacgccgugaacuacauuuccacaguacuagcugacugggcggauaauguuuucuuccugcagcuccagcaagcagcccuggaaguguuugcugagaacaauacucuuucuaaguugcagcuggggcaguuagccucgauggaaagcuccgucuucgacgauaugauaaaccuccuggagcggcuuaaacacgacaugcugacccgacaaguggaucaugucuuucgcgaggugaaggacgcagccaaguuguauaaaaaggaaagauggcucucacugccaagucagucugagcaggcuguuaugagccuauccucaagcgccugcccucugcuccugacacuuagggaucacuugcugcaguuagaacaacagcucuguuucucucuguuuaaaaucuucuggcagaugcuuguggagaagcuggacguauacauuuaucaggaaaucauccuagcaaaucauuucaacgagggaggcgcggcucaacuccaguuugauaugacucggaaucuguuccccuuguuuucccacuacugcaaacgcccagagaacuacuucaagcauauuaaggaagccugcauaguccugaauuuaaacguggguagugcacuccugcuuaaagacguucugcagagcgccucugggcaguugcccgcuaccgccgcacucaaugaggugggaaucuauaagcuggcucaacaggaugucgaaauucuacugaaccuuagaacaaauuggccuaacaccggcaaauga

SEQ ID NO: 61841 - RNA, 1707 nt, Artificial Sequence
  derived and/or modified sequence opt3 from RIOK1__Homo_sapiens__NP_113668
auggacuacagaaggcugcucaugagccgggugguccccggccaguucgaugacgccgauuccucugacucagagaaccgcgaucuuaagacaguuaaagaaaaggacgauauccuguuugaggacuugcaagauaaugugaacgaaaauggggagggagaaauugaggacgaggaagaggaagguuaugaugacgaugacgacgauugggacugggaugagggcguagggaaauuagcuaagggauacguguggaacggcgguaguaauccucaggcaaaccgacagacaagcgacuccucuucggccaaaaugucaacuccagcggauaagguccugcguaaguucgagaauaaaauaaaccuagacaagcucaaugugacggauagcguuaucaacaaagugaccgaaaagaguagacagaaagaggcugacauguauaggauuaaggauaaggccgaccgggcaacagucgaacaagugcuggauccgcgcacuagaaugauccuuuuuaaaaugcugaccagggggauuaucacagagauaaauggaugcaucuccaccggcaaggaagccaacguauaccacgcuucuacugcaaauggcgagagccgggccauuaaaaucuauaagacauccauuuugguuuucaaagaccgcgacaaguacgugucaggggaguuucgauucagacauggauauuguaaagguaaccccaggaagauggucaagaccugggcugaaaaagagaugcggaaucucauccgucugaacacggccgaaauaccuugcccagagcccauuaugcugcgcagucacgugcucgugaugagcuuuaucggcaaggaugacaugccugcgccauuacugaaaaacguccagcuuucugaauccaaggcaagagaguuguaccugcagguuauucaguacaugaggcggauguaucaagaugcccgacucgugcaugcugaccuaucagaguucaauaugcuguaccacgggggaggcguauauaucaucgaugugagccagagugucgaacaugaccacccccacgcccuugaguuucugcgcaaagauugugcaaacgugaaugacuucuuuaugagacauucuguugcugugaugacugucagggaauuguucgaguuugugaccgauccuuccauuacacacgaaaacauggacgccuaccucagcaaggcgauggagauagccucgcagcggacuaaggaggaaagaucuucccaggaucauguagacgaggaaguuuucaaaagagcauauaucccaaggacccugaaugaggugaagaacuacgagcgugauauggacauuaucaugaaauuaaaggaagaggacauggcuaugaaugcccaacaggauaacauacuguaucagacagucaccggucucaaaaaggaccuuucaggggugcaaaaggucccggcucuguuggaaaaucagguggaggaacggacgugcagugauagcgaggacauuggauccucugaguguagcgauacugacucagaggaacagggcgaucacgcccgacccaaaaagcacacaaccgacccugauaucgacaaaaaggaacgcaaaaagaugguuaaggaggcacagagggaaaaacgcaagaacaaaaucccaaagcaugugaaaaagcggaaagagaagacugccaagaccaaaaagggcaaauga

SEQ ID NO: 61842 - RNA, 1425 nt, Artificial Sequence
  derived and/or modified sequence opt3 from RIOK2__Homo_sapiens__NP_001153221
augggcaaggugaacgucgccaaacugagauacaugagcagggacgauuuccggguucucaccgcuguggagauggggaugaagaaucacgaaaucguacccggaucccuuauugcaucuauagccucacugaaacaugguggcugcaacaagguguugcgcgaguuagucaaacacaagcugaucgcgugggaacgaacaaagacugugcagggguaucgucuaacgaaugcuggauacgacuaucucgcccugaaaacccuuaguagcagacaaguuguggaguccgucggcaaccagauggguguggggaaggaaucugauauuuacaucguagcaaaugaggagggacagcaguuugcccugaaauugcauaggcucggccggacaucguuccgcaaccugaagaauaaaagagacuaucacaagcauaggcacaacguuucauggcuguaccucagccgguuaagugcuaugaaggaauuugcauauaugaaagcccuguacgagcgcaaguucccugugccaaaaccgauugauuacaaucgacacgcugucgugauggaacuuaucaacggcuaucccuugugucaaauacaucacguggaggacccugccuccgucuacgaugaggcgauggaacugaucguuaagcuagcaaaucaugggcucauucacggagacuuuaacgaguucaaucugauccuugaugaaucugaccacauuacuaugaucgauuuuccacagauggugagcaccucccaucccaacgccgagugguauuucgacagagauguaaaaugcauaaaggacuuuuucaugaaaagguuuucauacgaaagugagcuguucccuacauuuaaggacauucggcgugaggauaccuuggacguggaagucagcgcuucugguuauacuaaggagaugcaggccgaugacgaacuccugcacccauuaggccccgaugacaaaaauaucgagacaaaggaaggguccgaguucucauucagcgauggagagguggcagaaaaagcugagguuuacggcagugaaaacgagucugaacgcaacugucuggaggaguccgaagguugcuauuguagaagcucgggggacccugagcagauuaaggaagauucucucuccgaggagucagccgacgcgaggaguuuugaaaugaccgaguucaaucaagcccuugaagagaucaaaggacagguggucgaaaacaauagcgugacggaguuuuccgaggaaaagaaccggacugagaauuacaaccgacaggauggccagcgcguacaaggcgggguuccagcaggaucugacgaauacgaggacgaaugcccgcaucugaucgcuuugagcucacuaaauagagaguucaggcccuuucgguaucgccugcucaguauugccuucuga

SEQ ID NO: 61843 - RNA, 1560 nt, Artificial Sequence
  derived and/or modified sequence opt3 from RIOK3__Homo_sapiens__NP_003822
auggaccuggugggcgucgccagccccgagccugggaccgcugcagccuggggaccauccaagugcccgugggcgaucccccaaaacacaauuucuuguucacucgcugauguuaugagugaacaacuugccaaagagcugcaguuggaagaggaagcagccguguucccugagguagcuguggcagaggguccauuuauaacuggcgaaaauaucgacacgagcuccgauuuaaugcuggcccagaugcuacagauggaguacgacagagaauaugaugcucaacucaggcgggaggagaagaaauucaacggggacucuaaggucucgauuucauuugaaaauuaccgcaaagugcaccccuaugaggauagcgacaguuccgaagaugagguugacuggcaggauacccgagacgauccuuaccguccagccaagcccgugccuacaccaaagaaaggauucaucggcaaggguaaagacauuacuaccaagcaugacgaagucgugugcgggagaaagaacacagcgaggauggagaauuuugcaccggaguuccagguaggagauggcaucggcauggaccugaaacuuucuaaccacguuuuuaaugcccugaagcagcaugcuuauagcgaggaacggcgcuccgccagauugcacgagaaaaaggaacauucaaccgcagaaaaagcuguggaucccaagacuaggcuccugauguacaaaauggucaacagugggaugcuggagacaauaaccggauguaucagcacggguaaggagucugugguguuccacgccuauggcggguccauggaagacgagaaagaagauucaaaggucauuccuacugagugcgcgaucaagguuuuuaaaaccacacucaaugaguucaagaaccgggacaaauacauuaaggaugacuuucgcuucaaagaucgauuuagcaaguuaaauccaagaaagaucauaaggaugugggccgaaaaagagaugcacaaccuggcacggaugcaacgugcuggcauucccuguccuacugugguacuuuugaagaaacauauccuggugaugaguuucauuggacacgaccaggucccagcccccaagcuaaaagaagugaagcucaauucugaggaaaugaaggaggcuuacuaucagacccugcaucuuaugcgccagcuguaccacgagugcacauugguucacgccgaucucuccgaauauaacaugcuguggcaugcagguaaagugugguuaaucgacgucagccaaucgguggagccgacccacccucaugggcuggaguuccucuuuagagacuguaggaauguaucucaguucuuucagaagggaggcguuaaagaagcccuuuccgaacgggagcuguucaacgcugugucaggcuugaacaucacggcggauaaugaggcagacuuucuagccgaaauugaggcucuggaaaagaugaacgaggaucacguccagaaaaaugggcgaaaggccgcaaguuuccucaaggacgauggagaucccccacugcuuuacgacgaauga

SEQ ID NO: 61844 - RNA, 2016 nt, Artificial Sequence
  derived and/or modified sequence opt3 from RIPK1__Homo_sapiens__NP_003795
augcagcccgacaugagccugaacgugaucaagaugaaauccucugauuuccucgagucagccgaacuugacaguggcggguuuggaaaggucagccugugcuuccacagaacccaagguuugaugauuaugaaaacaguuuacaagggcccuaauuguauagagcauaacgaggcuuuacuggaagaagcaaaaaugaugaauaggcuacggcacucccgcgugguaaagcuccugggggugaucauugaggagggaaaguauucucuugucauggaauacauggagaaaggcaaccugaugcauguguugaaggccgaaaugucgacuccacucucaguuaaaggucgaaucauucuggagaucauagaggggaugugcuaucugcacggaaagggcgugauccauaaagaucucaagccggaaaauauuuuagucgacaacgauuuucacaucaagauugcggaccugggccuugcuagcuucaaaauguggaguaaguugaauaacgaggaacacaaugagcugcgugaaguggaugggacggccaaaaagaacggagguacccuauacuauauggcacccgagcaucucaaugacguaaacgccaaaccuacagagaaguccgauguuuacucuuuugcugugguccugugggcaaucuucgccaauaaagaaccauaugagaacgcuauaugugaacagcagcuuauuaugugcaucaagagcggcaauagacccgacguggaugacauuacugaguacuguccuagggaaaucaucucccugaugaaguugugcugggaggccaacccagaggcgcggcccaccuuuccugggauugaagagaaauuccgcccauuuuaccucucacagcuggaagagaguguggaagaggaugucaagagccugaaaaaggaguauucuaacgaaaaugcaguugugaaaagaaugcaauccuuacagcucgacuguguagccgugccgucaagcaggaguaacucugcuacagagcagcccggaucccuucacagcucgcagggccuggguauggggccugucgaagagucuugguucgccccauccuuggagcauccccaagaagagaaugaaccuucacuacagaguaagcugcaggacgaggcaaacuaccaccucuauggaagccggauggaucgccagaccaagcaacagccacgacagaauguggcuuacaacagagaagaggagaggcggcgucgcguuucccacgaccccuuugcccaacagagaccguaugaaaauuuccagaacacugagggcaaaggcacagcguacucuagcgccgcaucacaugggaaugcugugcaccagccuaguggacugaccucccaaccccagguccuuuaucagaacaauggucuguacagcucucauggcuuugggacgaggccauuggauccuggaacugccggcccccgggugugguaccgaccaauacccucacacaugccuagucuccauaacaucccaguaccggaaaccaauuaucuggguaacacacccacuaugccuuucagcuccuuaccacccaccgacgagucuauuaaguacacaaucuauaauucgaccgggauacagauuggcgcuuacaacuauauggaaaucggaggcacgagcuccucacugcuagauaguacuaacacaaauuucaaagaggagccugccgcaaaguaccaagccaucuuugacaacaccacuucucucacagauaaacaccuggacccaauucgcgaaaaucuugggaagcacuggaagaacugcgcuagaaaauugggauucacccagagccagaucgaugagauugaccaugauuaugaaagggacggucugaaggagaaaguuuaccagaugcuccaaaagugggugaugcgggaaggcauaaaaggggcgacggucggaaagcuggcacaggcccuucaccaguguucccgcaucgaccuguugucaagccucauuuacgugucucagaauuga

SEQ ID NO: 61845 - RNA, 1623 nt, Artificial Sequence
  derived and/or modified sequence opt3 from RIPK2__Homo_sapiens__NP_003812
augaacggcgaggccaucugcagcgcucugccaaccauuccuuaccacaagcucgcagaccuuagauaucuguccaggggagccucugggacagugucaagugcgcggcaugcugauuggcgcguccagguugccgugaaacacuugcauauacacacuccauuacuggacagcgaacgaaaggauguacuacgugaggcagaaauccuccauaaagccagauucuccuacauucugccgauccuugguauuuguaaugagcccgaauuucugggcaucgugacggaguauaugccuaacgggucuuugaaugagcuccugcacaggaagaccgaauacccagacgucgcuuggccccugcgguuccgcauacuccacgagaucgcauuaggagugaacuaucugcauaauaugacaccuccacuuuugcaccaugaucugaaaacucaaaacauucuacucgacaaugaauuucacguuaagaucgccgauuucggccugucgaaguggagaaugaugucacuuagccagaguagguccucuaaaagcgcucccgagggugggaccauuaucuacaugccuccagagaacuaugaaccgggacagaagucccgggccucaauaaaacacgacauuuacaguuacgcggugaucacaugggagguccugagccgcaagcagcccuuugaagaugugaccaauccuuugcaaauuauguauucuguaucccagggccaucgaccaguuaucaacgaggaaucacuccccuacgacaucccucacagagcaaggaugauuagccugauagagaguggcugggcccagaauccagaugagcggcccucuuucuuaaaaugccugaucgaacucgagccggugcuucguacuuuugaagagauuacauuccuggaagcugucauccaguugaagaagaccaaacuacaauccgugagcucggccauacaucugugugacaagaaaaagauggagcucucucugaacauuccugugaaucacgggccccaggaggaauccugcggaucaagucagcuucaugagaacagcgguuccccagaaacgucucgcagccugccugcaccccaggauaaugacuuuuugucaagaaaagcucaagacuguuauuucaugaagcuccaccacugcccaggcaaccauaguugggauuccacuaucagcgggucucagagggccgcguuuugugaccacaaaaccacacccugcucaagugccaucauuaacccucugagcacugcaggaaauuccgagcgguuacagccaggcaucgcucaacaguggauucagucuaagcgagaagauauagucaaccagaugaccgaggccugucugaaucaaucgcuagacgcucuccugagccgcgaucuuaucaugaaggaggacuacgaauugguuuccacaaaaccgaccagaacgucaaaggugaggcagcugcucgauacuacagacauucagggugaggaguucgccaaaguaaucgugcagaagcugaaagauaacaagcaaauggggcuucagcccuauccugaaauccuggucgugagucggucucccagcuugaaucuccugcagaacaaguccauguga

SEQ ID NO: 61846 - RNA, 1557 nt, Artificial Sequence
  derived and/or modified sequence opt3 from RIPK3__Homo_sapiens__NP_006862
augagcugcgugaagcuguggcccuccggcgccccugcuccacucgucucuaucgaggaacuugagaaccaggaacugguugggaaaggagguuucggcaccguguuuagagcacaacacaggaaguggggguacgacguagccgugaaaauugucaauucaaaggcgauaagucgggaggugaaagcuauggccagcuuggauaacgaguucguuuuacgccuggagggagugaucgagaaggucaauugggaccaggauccgaagcccgcccuagugacaaaauuuauggaaaacggcucccucucuggucugcuucagucgcaguguccucgaccauggccccuguugugccgucuccugaaggagguaguucuggggauguucuaucuccaugaccaaaauccuguguuacugcacagagaucuuaaaccaucaaacgucuugcuggaccccgaacuacaugugaagcucgcagauuuuggacugagcacuuuccagggcggcagucaguccgggacgggaucuggugagccuggcgggacccuuggauaccuggcuccagaguuguuugugaaugucaacaggaaagcaagcacagccuccgacguuuauucauucggcauucucaugugggcugugcuggccggucgggaaguagaguuaccgacugaacccagucugguguacgaggcggucuguaaucgccagaacagaccuagccucgcagaacuuccacaagccgggcccgagaccccuggacuggagggcuugaaggaacuaaugcagcugugcuggucuuccgagccaaaggauaggcccucauuucaggaaugucucccgaaaacagacgagguguuccagaugguugaaaauaacaugaaugcugccgugagcaccgucaaggauuuucugagucaacuucggucuuccaaccgccgauucagcaucccugagucgggccaagggggaacugagauggacgguuuuagaaggacaauugaaaaucagcacucucggaacgaugugaugguauccgaguggcugaacaaauugaaucucgaggaacccccaucaaguguuccuaagaaaugccccagccugaccaagcguucccgcgcacaggaagaacaggugccacaggcuuggacggccggcacuucuagcgacucaauggcgcagcccccucaaaccccagagacaaguacuuucagaaaccagaugccgucccccaccagcacagggaccccuucuccaggacccaggggcaaucagggugccgaacggcaggggaugaacuggucaugucgaacgccugagccaaaucccgucacuggccgcccguuagugaacaucuauaauugcaguggaguccaagugggcgacaacaauuaccugacaaugcagcagaccacugcacuaccuacaugggggcucgcuccaagcggaaaagguagaggccugcagcaucccccucccguugggucccaagaaggaccaaaggauccugaggccuggucuaggccccagggcugguauaaccacucggguaaguga

SEQ ID NO: 61847 - RNA, 2355 nt, Artificial Sequence
  derived and/or modified sequence opt3 from RIPK4__Homo_sapiens__NP_065690
auggagggcgacgggggaacccccugggcccuggcucuccuuagaacauucgaugcaggggaauuuacuggcugggagaagguggggagcggaggcuucggucaggucuacaaaguuaggcacgugcauuggaagacguggcuggccaucaaaugcuccccuucuuugcacguagacgaucgggaacgcauggaguuacuggaagaggcgaagaaaauggagauggcuaaguuucgauauauucuaccaguguacgggauaugucgugaaccggucggacucgugauggaguauauggaaaccggcucacuggagaaacuucuggccagugagcccuugccuugggaccucagauucaggaucauucaugaaacagcaguuggcaugaacuuucugcacugcauggccccaccccugcuccauuuagaucugaagccugcuaauauccuuuuggacgcacacuaccacgugaagauuagcgauuucgggcuggccaaauguaacggacuaucccauucucacgaccucucgauggauggucuguuuggcacuaucgcuuaucuuccacccgagcggauacgcgaaaagucaagacuguucgacaccaaacaugaugucuacagcuuugccaucgugauuugggguguauugacacaaaagaagccuuucgcggacgagaaaaauauccuccacauuaugguuaagguggucaaaggacacaggccagaacugccgcccgugugccgggcacgcccucgagccuguagucauuuaaucagacugaugcagaggugcuggcagggcgauccacgggugcgucccaccuuucaggagauaacuuccgagacagaagaccucugugagaagccugacgaugaagucaaagagaccgcucacgaccuugauguuaagucuccacccgaaccgcgcagcgaggugguaccugccagacugaaaagggcauccgcucccacguucgacaacgauuauucauugagugagcuacugagccaacucgacucuggugugucccaggccgucgaagggccagaggaacugucacggagcaguucugaguccaaacuuccuagcucgggaucuggcaagcgacuguccggcgugucaaguguugauagcgcguuuuccucucgcgggagcuugucacucaguuucgaaagagagcccuccacuagcgaccugggaaccacagaugugcagaagaagaaauuagucgacgccauugugucuggugauacuucaaagcugaugaaaauccuacagccacaagacguagaccucgcacuggauaguggcgcuagccuuuugcaucuggccguugaggcugggcaggaagagugcgccaaguggcuccugcuuaauaacgcaaaucccaaccuguccaauaggcggggaucuaccccuuugcacauggccguggaacgcagagucaggggcguggucgagcuccuguuagcucguaagauuucggugaacgcgaaagacgaggaucaguggacagcacugcauuucgccgcucagaauggugacgaaagcuccacccggcuacuccuggagaagaacgccucaguuaaugaaguggauuuugaggggcgaacgccaaugcacguagcaugucaacacggccaggaaaacaucgucagaauccuuuugaggcgcggaguggacguuagucugcagggcaaagaugccuggcucccgcugcauuacgcugccuggcaagggcacuuacccauugugaagcugcuugcaaaacagccuggagucucugugaaugcgcagacuuuggacggucggacaccacuccaucuggcugcccagagaggccacuacaggguagcacgcauacuaaucgaucugugcagcgacgugaacguuuguucccuccuggcccaaacuccccuucacgucgcugccgagaccgggcauacaucaaccgcacgauugcuguuacaccggggagcuggcaaggaggccaugacgagcgaugguuauaccgcgcuccaucuggccgcucguaacgggcaccuugcaacagugaagcuguugguggaagagaaagccgacguccucgcuagaggcccucugaaucagacugcccuacaucuggcagcggcccacggacacucugaaguuguggaggaacucguguccgcugauguaauugaccuguucgacgagcagggccuuagugccuugcaucuggcagcucaggggaggcacgcccaaaccgucgagacauuacuccgccauggagcacacaucaaccugcagagccuuaaguuucaggguggccaugggccagccgcuacucugcuacggagaucuaaaaccuga

SEQ ID NO: 61848 - RNA, 387 nt, Artificial Sequence
  derived and/or modified sequence opt3 from RIPPLY2__Homo_sapiens__NP_001009994
auggagaacgccggcggggcugaaggaaccgagagcggugcagccgcgugcgcugccacagacggccccacuagaagggcaggggccgauuccggauacgcuggcuucuggcggccuuggguggacgccggugggaagaaagaagaggaaacgccaaaucacgcagcugaggccaugccggauggacccggcaugaccgcggcaucuggcaagcuguaucaguuucgccauccuguccgacucuucuggccaaaaucaaaguguuacgacuaucuuuaccaagaggccgaagcucuguugaaaaacuuucccauccaggccacaauuaguuucuaugaggauagcgacuccgaagaugagauagaggacuuaacuugcgaaaauuga

SEQ ID NO: 61849 - RNA, 552 nt, Artificial Sequence
  derived and/or modified sequence opt3 from RIT1__Homo_sapiens__NP_001243749
augaccaugcaguucaucagccacagauuucccgaggaccaugauccuacaauugaagacgccuacaagauaaggauccggauugaugacgagccagcuaaccuggauauccucgacacugcaggccaagccgaguucacggcgaugcgcgaucaguauaugcgagcuggggaaggauuuauuaucugcuacuccauaaccgaccguagaucuuuccacgaagugagggaguuuaaacagcuuaucuaucggguccgcagaacagaugacacuccgguugugcugguagguaauaagucagauuugaaacaguuaaggcaagugaccaaggaggaaggccuggcccuagcacgggaguucaguugucccuuuuucgaaacaagcgccgcuuaccgcuauuacauugacgaugucuuucaugcacucgugcgagagaucagaaggaaagagaaggaagccguucuggcuauggagaagaaauccaagccuaaaaacucuguguggaagcggcuuaaaucgccauuccguaagaagaaagacucagucaccuga

SEQ ID NO: 61850 - RNA, 462 nt, Artificial Sequence
  derived and/or modified sequence opt3 from RIT2__Homo_sapiens__NP_001259006
auggagguggaaaacgaggccagcugcucccccggcucugcuucagggggaaguagagaauacaaggucguuaugcugggugcaggcggggugggaaaaagcgccaugaccaugcaguucaucucccaccaauuuccugacuaucaugauccaacaauugaggacgcguacaagacucagguaaggauagauaaugaaccggcuuaucucgacauccuugauacggccggccaggcagaguucaccgccaugcgggagcaguacaugcgcgguggggaaggauuuauuaucuguuauucugugacagaccgacaaucguuccaggaggcugcaaaauuuaaggaacugauuuuccagguccgucacacuuacgagauccccuugguguuaguuggcaacaaaauagaucuggagcaguuuagacaaccuacccuaaaggaguucggcagggaagaauuuuga

SEQ ID NO: 61851 - RNA, 882 nt, Artificial Sequence
  derived and/or modified sequence opt3 from RITA1__Homo_sapiens__NP_001273144
augcugagagagcccaggaagcagggccucgccgggcgggcucaccuucugagcccuggaaccacagguuccaugaaaacuccaguggaauuggcagucucuggcaugcaaacguuagggcugcagcaucgcugccgaggaggcuaccguguuaaggccagaaccucauauguggacgagacacuauucgguaguccggcggggacuaggcccaccccuccagauuuugaucccccuuggguagaaaaagcuaaccggacacgcggagugggcaaggaggccagcaaagcacucggcgccaagggguccugugaaaccacuccaucuagaggaucgacacccacccugacgccuaggaagaaaaauaaguaccggccaaucucacacacuccgagcuauugcgacgagagucuuuucgguucccgcucugagggcgcuagcuuuggggcaccccgaauggccaaaggagacgcugccaagcugagagcguugcucuggaccccuccacccacaccuaggggcucccauucaccacggccccgugaagcaccgcugcgcgccauucacccugcuggucccaguaaaacugagccagggccugccgcagauagccagaagcugucuaugggaggccuccauuccucaagacccuuaaagaggggccugagccacagucuuacccacuugaacgucccaucuacagggcaucccgcuaccuccgccccucacacgaauggaccacaggaccugcggccgagcacuucgggugugacauuccgaucuccccuaguuaccucccgcgcgagaucagugaguauaagcgucccuuccacuccaaggcggggcggggccacacaaaaacccaagccuccauggaaauga

SEQ ID NO: 61852 - RNA, 954 nt, Artificial Sequence
  derived and/or modified sequence opt3 from RLBP1__Homo_sapiens__XP_011520172
augagcgagggcguggggaccuucagaaugguccccgaagaggaacaggagcugagggcccaacucgaacagcuuacaacuaaggaccacggaccuguuuuugguccaugcucccagcugccgcggcauacguugcagaaagcuaaggaugaguuaaacgagcgcgaagagacccgagaagaggcagugcgugagcugcaagaaaugguacaggcccaggcggcuucuggcgaggaacuagccguggcagucgccgagagagugcaggaaaaagacucaggguucuuucucagguucauccgggcucgcaaguuuaauguuggcagagcauacgagcugcuuaggggauaugugaacuuccggcugcaauaccccgaguuguuugauagucucagcccugaagccguccgcuguacaauugaggcugguuauccaggggugcuguccucucgagacaaauacggaagaguaguuaugcuguucaauauagaaaacuggcagucgcaggagaucacuuuugaugaaauucuccaggccuauugcuucaucuuagagaagcugcuugagaaugaagagacccaaauuaacggcuuuuguaucauagaaaauuucaagggcuuuacaaugcagcaggcggcaucauugaggaccagcgaccugcggaaaaugguggauaugcuacaagacaguuuccccgcccguuucaaggcuauccacuuuauucaucagccuugguacuucacuacaaccuauaacgucgugaaaccauuucucaaguccaaacugcuugagcgcguguucguccacggggaugaccugucuggauuuuaccaggaaaucgaugagaauauuuugcccagcgacuucgguggcacgcucccuaaguacgaugggaaggccguugcagagcagcuguuuggaccacaagcucaggccgaaaacacugcguucuga

SEQ ID NO: 61853 - RNA, 4578 nt, Artificial Sequence
  derived and/or modified sequence opt3 from RLF__Homo_sapiens__XP_011540196
augaaggccagcgugugcaaaaccaucgcuugucugcuccccgaggaccuugaagucagaagggcaugccagcugacagaguucuugauugaaccuuccuuagauggcuuuaacaugcuggaggaacuauaccuccaaccagaccagaaguucgaugaggagaaugccccgguucccaacucucugcggugugaacuucuguuggcgcucaaagcucacuggccuuuugacccagaguucugggauuggaagacucugaaacgccauugccaccagcugcucgggcaggaagccucagacagugaugacgauuuaagcggauaugagauguccauaaaugacacggaugugcuggagucuuuucuuucggacuacgaugaagguaaggaggacaagcaauaucgacguagagacuugaccgaucagcauaaagaaaagagggacaaaaagcccaucggcucaagcgagcgguaccagcgcuggcugcaguauaaauucuuuugucuacucugcaagagagaauguauugaggcaaggauccugcaccauaguaagaugcacauggaggaugggauuuacacaugcccuguauguaucaaaaaguucaaacggaaggaaauguuugugccacacgucauggagcaugugaaaaugcccccuucccgccgagacagaucuaagaaaaagcugcuguugaagggaagccaaaaaggcauaugcccaaaguccccgucagccauccccgaacagaaccacagucucaaugaucaggcuaaaggugagagccaugaauauguuacuuucucuaagcuggaggacugucacuuacaggauagggaccuguacccuugcccagggaccgauugcucccggguguuuaaacaauucaaguaccucucaguccaccuuaaggcagagcaucagaacaaugacgaaaacgccaaacacuaucuggauaugaagaaucgucgcgagaaauguacauacugcagaaggcauuuuaugagcgcuuuccacuugcgggaacaugaacaggugcacuguggaccccaaccuuauaugugcguaaguauugacuguuacgcccgauucggcucuguuaacgaacuacugaaucacaagcagaaacaugacgaucuccgcuauaagugcgagcugaacggcuguaauaucguguuuuccgaccuugggcagcuguaccaccaugaggcgcagcacuucagagaugcaagcuauaccugcaacuuuuugggauguaagaaauucuacuacucgaagauugaauaucaaaaucaccucucuaugcauaacgucgagaacuccaauggugacaucaaaaagucagugaaacuggaagagagugccacuggcgagaagcaggauugcauaaaccagccacacuuacugaaucagacagacaagagccaucuacccgaagaucucuuuugugcugaguccgccaacucucaaauugacaccgaaacggcagagaaucugaaagaaaacagcgauucaaauaguuccgaccagcuuagccacucuucaagugcuagcaugaacgaggaguugaucgauacucuggaccauuccgaaaccaugcaggaugugcuccugucuaaugagaaggucuucgggccgucgagccuuaaagaaaagugcuccucaauggccguuugcuuugacggaacaaaauucacuuguggcuuugacgguugcgggaguaccuacaagaacgcgaggggaaugcagaaacaccuucggaaggugcacccuuaucauuucaagcccaaaaagauuaaaacaaaggauuuguuuccaucucucggcaaugagcacaaccaaaccacggaaaaacuggacgccgagccuaagcccuguagcgauacuaauuccgacucaccagaugagggcuuagaccauaacauccacaucaagugcaaacgcgaacaucagggguacagcucugaguccaguauuugugcaagcaagagacccugcacagaagauaccaugcuggagcuacuccugaggcuuaaacacuugucucugaaaaauuccauaacucacggaucauucagugguagccuccagggcuauccuucguccggggcuaaaucucugcagagcguaucaaguaucuccgacuuaaacuuucaaaaccaggaugaaaauaugccaucucaguaccuggcccaacuugcugccaagccguucuucugugaguugcagggaugcaaguaugaguuugugacacgugaagcacuccugaugcauuaccuaaagaagcacaacuacagcaaagagaagguccugcagcucaccauguuccagcaucgguauucccccuuucaaugucacauuugccagcgaucauucacgagaaaaacccaccugaggauccauuacaagaauaagcaccagauaggcagcgaccgcgccacacauaaacuuuuggauaacgaaaagugugaccacgaggguccuugcaguguggaucggcugaaaggggacugcucugcugaguuaggcggagacccauccagcaauucggaaaagccccauugucacccuaaaaaggaugagugcucaucugaaacugaccucgagaguuccugugaagagaccgagagcaaaacaucugauauuagcuccccaaucggcucacacagagaggagcaggaagggagggagggacgcgguagucgacggacuguugcgaagggcaaccugugcuauauccuuaauaaguaccauaaacccuuucacuguauucauaagaccugcaacagcucuuucacaaaucugaaaggguugauccgucacuauagaaccgugcaccaauacaacaaggaacagcucugucuggagaaagacaaggcaaggacuaagcgcgagcuagucaaaugcaagaaaauuuuugccuguaaguauaaagaaugcaauaagcgguuccuguguuccaaggcucucgccaaacauugcucagauagucacaaccuggaccauauagaggaaccgaaggugcuuagcgaggcaggauccgccgcuagauuuucuugcaaucagccucaguguccagccguauucuacacguuuaacaaauugaagcaccaucugauggaacaacacaauaucgagggcgagauucacucggauuacgaaauccauugcgacuuaaacgguugugggcagaucuucacacacaggagcaacuauucacagcauguuuacuaucgacacaaagauuacuaugacgaucucuuucgcucccaaaagguggcaaaugagcggcugcuuagaagugaaaaggucugccagaccgcggacacucagggccacgagcaucagaccacaaggcguucuuucaacgcuaaaagcaagaaauguggacugauuaaggagaaaaaggcccccauauccuucaagacccgcgcagaagcccuacacaugugcguggagcauucagaacacacucaauacccuuguaugguccagggcugccucucugugguuaaacuggagagcaguaucgugcggcauuauaagagaacacaccagauguccagcgcuuacuuggaacagcaaauggagaaucugguagucugugugaaauacgggacgaagauuaaagaggaacccccaucugaggccgacccuugcaucaagaaagaagagaacaggucaugugaauccgagcgaaccgagcacagucauagccccggagauucgucugcaccaauucagaauacugacugcugccacuccagcgaacgggaugguggccagaagggguguaucgagucaaguucuguuuuugacgcugauacauuacucuaucgcggaacccugaagugcaaccauuccagcaaaacaacuucacuugaacaguguaauauagugcaaccgccucccccaugcaagaucgagaacaguauucccaauccuaacggcaccgaaagcgguacguacuucaccuccuuucagcugccauugcccagaaucaaagagucugagacaaggcagcacagcuccgggcaggaaaauacugucaagaacccuacccaugugccgaaagagaauuuccggaagcacucacaaccacgaucuuuugaccucaagacauauaaacccaugggcuucgaaaguucguuucugaaguucauucaggagagcgaggaaaaagaggaugacuuugaugacugggaaccuuccgagcaccuaacucugucuaacucaagccaguccaguaaugaucuuaccggaaacguaguggccaacaauaugguuaacgacucugaaccagaggucgauaucccccauagcucauccgacaguacgauacacgagaaucucacagcgauuccuccgcugaucguggccgaaaccacuacagugcccagcuuggagaaccugagagucguuuuagacaaggcucucaccgauuguggcgaacuggcacuuaaacaacugcauuacuugcgcccaguggugguacucgagaggucuaaguucuccacuccuauucuggaccuauuucccaccaagaaaacagaugaacugugcgucgggucaagcuga

SEQ ID NO: 61854 - RNA, 1875 nt, Artificial Sequence
  derived and/or modified sequence opt3 from RLIM__Homo_sapiens__NP_899196
auggagaacagcgacuccaaugauaagggcucuggggaccagucagccgcucaaagaaggagucagauggaucggcuggaccgcgaagaggcauucuaccaguuugugaacaaucucagcgaagaggauuaucgacuuaugcgugacaacaaucuguugggaacccccggugaauccacagaggaggaauuacugagaaggcuacagcaaaucaaagagggcccuccaccgcagaacucugaugaaaauagagggggagacucgucagaugacgucagcaacggcgauaguauuauagacuggcucaauuccguucgccagacugguaacacgaccagaucugggcagaggggaaaucaaagcuggcgggccgugucccgcacaaaccccaauucaggcgauuuccgauuuagucuggagaucaacguaaauagaaacaacggcagccagaauagcgagaacgaaaaugagccuuccgcgaggcggucaagcggggaaaacguggagaauaacagucagcgucaggucgaaaauccacgcucugaguccacuagcgcuagacccucgaggucugagcggaacuccaccgaagcccuuacagaggugccuccaacccgaggacaacgcagagcaaggucacggagucccgaccaccgcagaacuagggcccgugcugaacggagccgauccccucugcauccaaugucugagauuccgagaaggagccaccauucaaucaguucccagacauucgaacaccccuugguuaaugagaccgaggguagcucucgcacgcggcaucacgugacucucagacagcaaauuucaggcccugaacugcugaguagggggcucuuugcagccagcggaacccgcaacgcuucccagggcgccgguucuucggacacagcggcaagcggggaguccacuggaucaggccagcgaccacccaccaucgucuuagaucuucaggugcggcguguaagaccuggcgaauacaggcaacgcgacaguauagccucucggacaagaagcaggucccagaccccaaauaacacgguuacuuaugagucagaacgagggggauuccgccggacauuuagcagaucugagagggcuggugugcguaccuacgucuccacuauccgcauucccauccggcggauucugaauacaggcuugagugagaccacgagcguggccauccagaccaugcugaggcagauaaugacaggguucggagaacuaucuuauuuuauguacuccgauucagacagugagccgacuggcagcgugucgaaccgaaauauggaacgggcagagucccgcucugguagagggggcagcggaggcgggucaaguuccggaucuagcuccucaagcaguucuuccagcucgucaucuaguuccagcucuagcuccucaaguccuucuucuuccucagguggcgagaguagcgaaaccuccucugaucucuucgaggggucgaacgaaggaagcucauccaguggcucuagcggugcuaggcgggaggggcgacacagagcccccgucacauuugacgaauccggcucacugccauuccuuucucuggcgcaauuuuucuugcucaacgaggaugacgaugaccagccucgcggacugacuaaggagcagauugauaauuuagccaugaggagcuucggcgaaaacgacgcacugaaaaccugcaguguuuguaucacagaguauaccgaagggaauaagcuccguaaacuucccugcucccaugaguaccacgugcauuguauugaccgguggcugagcgaaaacucuacuugcccaaucuguagaagggcuguauuggccucaggaaaucgcgaguccguggucuga

SEQ ID NO: 61855 - RNA, 558 nt, Artificial Sequence
  derived and/or modified sequence opt3 from RLN1__Homo_sapiens__NP_008842
augcccagacuguuccucuuucaccuucuggaguucugcuuguuacugaaccaguuuagcagggccguggcugcaaaguggaaagacgaugucaucaagcuauguggccgggaacucguucgcgcccaaauugcgauaugcgggauguccaccuggucuaaacgaucacugagucaggaggacgcuccucagacaccacguccgguggccgaaaucguacccagcuucauuaauaaggauacugagacgaucauuaucaugcuugaauuuauagcaaaccugccuccagaguugaaagccgcucucuccgagagacagcccucucugccugaacugcaacaguacgugccagcacucaaggacucgaauuuaucauucgaggaauuuaagaaacugaucaggaaccggcagagcgaggccgcugauaguaaucccuccgagcuuaaguauuugggacuggacacccauucucagaaaaagcgcagaccuuacgucgcccuauucgaaaaauguugccucauugguuguacaaagaggagccuggcgaaguauugcuga

SEQ ID NO: 61856 - RNA, 354 nt, Artificial Sequence
  derived and/or modified sequence opt3 from RLN2__Homo_sapiens__NP_005050
augcccagacuguucuuuuuccaccuccuuggcgugugccuguuguuaaaccaguuuagcagggccgucgcugacuccuggauggaggaaguuaucaagcugugugggcgggagcuagugcgcgcacaaauugccauaugcggaaugucuaccuggucaaaacgaagucucagccaggaagaugcgccucagacaccacguccgguagcuggugacuucauccagacugugucccugggcauuucucccgaugggggaaaggcccuuagaacgggcucguguuuuaccagggaguuccugggugcauugucaaaacucugccauccuagcaguacaaagauccaaaaaccauga

SEQ ID NO: 61857 - RNA, 429 nt, Artificial Sequence
  derived and/or modified sequence opt3 from RLN3__Homo_sapiens__NP_543140
auggccagauacaugcugcuccuucuguuggcugugugggucuuaaccggcgagcuguggcccggggcagaagccagggcggcuccuuauggaguucggcuaugcggucgcgaguucauccgagccgugauuuuuacauguggcgggagccguuggagaagguccgacauacucgcacacgaagccaugggagauacuuucccagacgcugaugcagacgaggauucucuggccggcgaacuugacgaggcuauggguucaagugaguggcuggccuugaccaagagcccgcaggcguuuuaccgggggcgccccuccuggcaaggaacgccuggcguacucagaggcucuagggaugugcuggcagggcugucgucaagcugcuguaaauggggaugcaguaaguccgaaaucucuagccucuguuga

SEQ ID NO: 61858 - RNA, 855 nt, Artificial Sequence
  derived and/or modified sequence opt3 from RMDN1__Homo_sapiens__NP_001273648
auggcccuggcugcaagacucuggaggcuucugcccuuccggcgcggcgccgcgccugggagccgauugccagcuggaaccuccgguucucguggccacugcgggccguguagauuuaggggauucgaggugaugggcaaccccgguacauuuaagcggggguuacugcuaucagcccucaguuaccugggauucgaaacuuaucaggucaucagccaagcagccguugugcaugcuacggcaaaaguagaggaaauucuugagcaggccgacuaccuguaugaauccggcgagaccgagaaguuguaccagcuccugacacaguauaaagaaucugaggaugcugaacugcucuggcgcuuagccagagcgucgagggacguggcacaacugucacggacuagcgaggaggaaaagaaacuuuuggucuacgaggcccuggaauaugcuaagcgcgcccuagagaagaaugaaaguuccuuugcaucucacaaaaaggcuauagagcucaacccuaaagaugccaccagcauccaucugaugggcauuuggugcuacacauucgcggagaugccaugguaccagcgaagaaucgccaagaugcuuuuugcaacucccccuuccucaaccuaugaaaaagcucugggguacuuccacagggccgaacagguggacccaaauuuuuauaguaagaacuugcuccuguuaggaaagacauaccugaaacuccauaauaagaaacuugcugccuucuggcugaugaaggcaaaagauuaucccgcccacaccgaggaggacaagcagauucaaacggaagcugcgcaguugcuaacuagcuuuucugagaaaaacuga

SEQ ID NO: 61859 - RNA, 1233 nt, Artificial Sequence
  derived and/or modified sequence opt3 from RMDN2__Homo_sapiens__NP_001164263
augcccuacagcaccaacaaggagcugauccucggcauuaugguggggacagccggaauaucccuucuguuguuaugguaucacaaagucagaaagccugguaucgcuaugaaacugccagaguuccuaucucucggcaauacuuuuaacucaauuacgcugcaggacgagauccaugaugaccaagggaccacaguuauuuuccaggaaaggcagcuucagauccuggagaaguugaaugaacuccugacuaacauggaggagcugaaagaagagauacgguuucucaaggaagcaaucccgaaguuagaggaguacauucaagaugaacugggaggcaaaaucaccgugcacaagauuaguccccagcaucgcgcccgaaaacguagacuuccuacaauccagagcuccgcgaccucuaauucgucagaggaagcugagagcgaagguggguauauaacugccaacacagacaccgaggagcagaguuucccaguacccaaggcauuuaauacgaggguggaagaguugaaccuggauguccuacuccaaaaaguggaccaucugcggauguccgaaucuggaaagagcgaguccuucgaacuucugcgcgaucacaaggagaaauuuagagacgagauugaguucauguggagguuugcccgggcuuacggcgauauguaugaauugucaacuaauacccaggaaaagaaacacuacgcaaacaucggcaagacacucagugagcgcgccauuaaucgagcuccuaugaacgggcacugccaucugugguaugccguuuuauguggauacgugagcgaguucgaaggucugcagaauaaaaucaacuacggccaccucuuuaaggagcaucuugacaucgcgauuaaacuguugccagaagaacccuuccuauauuaccugaaggggagauauugcuacacugucucuaagcucuccuggauagagaaaaagauggcagccacccuguuuggaaaaaucccuucaagcacagugcaggaagcccuucacaauuuccugaaggcugaggaauuguguccaggcuauaguaacccgaacuacauguaucucgcaaaaugcuacaccgaucuggaggaaaaucaaaacgcuuuaaaguucuguaaucuggcccuacuccugcccacgguaacuaaggaggacaaagaagcgcagaaggagaugcagaaaauuaugacaucucuuaagagguga

SEQ ID NO: 61860 - RNA, 1413 nt, Artificial Sequence
  derived and/or modified sequence opt3 from RMDN3__Homo_sapiens__NP_001291731
augagcagacugggcgcccucgggggagcuagggcaggucuuggccuguuguuagggaccgccgcgggacugggcuuccuaugccuccuguacucccagcgguggaagcgcacacaacgacacggucguucucagucacuucccaauagucuggacuauacucagacgagcgauccugggagacaugugauguugcucagggcugucccaggaggcgccggcgacgcauccguucugccgucucugccccgggaggggcaggaaaaagugcucgaucgcuuagacuuuguacugaccucgcuuguggccuugagaagggaggucgaagaacugcggucaagccuacgcggacucgcuggugaaaucgugggcgagguucgaugucacauggaggaaaaucaaagaguggcaaggcggcgucgcuucccuuuugucagagagaggagugauuccacagggucuagcuccguguacuucacugccucaaguggagcuaccuuuacagacgccgaaagcgagggcgguuauaccacugcgaacgcagagucugauaaugaacgggacuccgauaaggagucagaagacggggaggaugaaguaagcugcgagacaguuaaaaugggacgaaaggacagucuggaucuugaggaagaggccgcuucuggcgccuccagcgcacuggaagcuggcgggucgucuggauuggaggacgugcucccacuguuacagcaggccgacgaacugcaucgcggugaugagcagggcaaaagagagggguuccaacuccuucugaacaauaaguuggucuacggauccaggcaggacuuucuauggcggcuggcgcgcgccuauucagauaugugugaacucaccgaggaagugagugagaagaaaagcuacgcacuggacggcaaggaagaggcugaggccgcucuugaaaaaggugaugaguccgccgacugccaccugugguaugcaguguugugugggcagcucgccgaacaugagucuauucagagaaggauacaaagcggcuucucauuuaaggagcacgucgauaaagcuaucgcgcugcagcccgaaaacccuauggcacacuucuuacugggacguuggugcuaccagguuagucaucuauccuggcucgagaagaagacggccacugcucugcuugaaagcccauugucugccaccguggaggacgcacugcaaucauuucucaaagccgaggagcugcagcccggcuucaguaaggcugggcggguauacauuagcaaauguuaucgagagcuuggaaagaacuccgaagccagaugguggaugaaacuggcauuggagcucccugaugugacaaaggaagaccuggcgauccagaaagauuuagaggaacuggaggucauucuaagggacuga

SEQ ID NO: 61861 - RNA, 1878 nt, Artificial Sequence
  derived and/or modified sequence opt3 from RMI1__Homo_sapiens__XP_011517336
augaacgugaccagcaucgcccugagagcugagacauggcuccuugcagccuggcacgucaagguucccccuauguggcuggaagcgugcauuaauuggauacaggaggaaaacaauaacgugaauuugucccaagcucagaugaacaaacagguauucgagcagugguuacugacugaccuaagggaucucgaacauccacugcuuccggacggcauccuggagauucccaagggggaguugaauggauuuuacgcccuccaaaucaacucucugguggaugucucacagccugcauauagucagauucagaaacugcgggguaagaauacgaccaacgaccucgugacagccgaagcucaaguuacuccaaaacccugggaggcaaagccuagccgcauguuaaugcugcagcuuaccgauggcaucgugcagauacaggggauggaauaccaaccaauccccauuuugcacuccgaccugccuccaggaacaaagauccuaauuuauggcaauaucucuuuccgacucgguguccugcuucugaaaccggagaacgugaagguacucgggggagagguugaugccuugcuggaagaguacgcucaggaaaaaguguuagcccgucugauaggcgagcccgaccucgucgugucggugauuccuaauaacucaaaugaaaacaucccaagagucaccgauguucuugaccccgcgcugggcccuagcgaugaggaguugcuagcaagucuggacgaaaacgaugagcucacugccaauaacgacacauccucugaaagguguuuuaccacggggagcuccucaaauacuauuccaacccggcagaguagcuucgagcccgaauuugugaucucuccgcgcccuaaggaggagcccuccaaccugucaauccauguaauggacggagaacuugaugacuucagccuggaggaggcuuugcuccuggaagaaacagugcaaaaagagcagauggagacuaaggaauuacagccacugaccuuuaauagaaacgccgauaggaguauugagcgguucucucacaauccuaacacaaccaauaacuuuucccuaacgugcaagaaugguaacaauaacuggagcgagaaaaaugucucggaacagaugacuaacgaggacaagucuuucggcugucccuccgugcgcgaucaaaaccgaucaauauuuaguguucauugcaaugugccacucgcacacgacuucacaaacaaagaaaagaaucuggagaccgauaacaaaaucaagcagacuagcuccucugacagccacucacuuaauaacaaaauuuugaauagagaagucgugaacuauguacagaagaggaauagucagaucuccaacgagaaugauuguaaccugcaaagcugcucucuccggucaagugaaaauagcauaaaccuguccauugcuauggaccuuuacucucccccuuuuguuuaucugucgguguugauggccagcaagccaaaagaggucacaaccgugaaggucaaagcguucaucgugacgcucaccgggaaucuguccucaaguggaggcaucuggucuauuacagccaagguuagcgaugguacugcauacuuagacguggacuucguagaugagauccugaccucccuaauuggguuuucagucccggaaaugaaacagagcaagaaggacccccuccaguaccagaaauuccuggagggacuucaaaagugucagcgugauuugauagaccugugcugucucaugacaaucucuuuuaacccuucccugaguaaagcuaugguguuagcccugcaggauguuaacauggaacaucuugagaauuugaagaaacgccucaacaaguga

SEQ ID NO: 61862 - RNA, 444 nt, Artificial Sequence
  derived and/or modified sequence opt3 from RMI2__Homo_sapiens__NP_689521
auggccgcugcagccgacagcuucuccggcgggcccgcgggagugagacugccuaggucuccaccgcucaagguccuugcugagcagcugcggcgcgaugccgaagguggccccggggcauggcgauugucacgugccgcugcaggaagaggcccuuuagaccuggccgcuguuuggaugcaagguagggugguaauggccgaucgcggggaggcgcggcuaagagacccaaguggagauuuuagcgugaggggccucgaacgggucccccgcggccgaccuugccuggugccagggaaauacguuauggugaugggagucgugcaggcauguucccccgagccuugccuucaggccguaaagaugaccgaccugucugauaacccaauccacgaaucgaugugggaguuggagguugaagaccuccauagaaauauuccguga

SEQ ID NO: 61863 - RNA, 840 nt, Artificial Sequence
  derived and/or modified sequence opt3 from RMND1__Homo_sapiens__NP_001258866
augcacugcaccgccuucgcuacagcagacgaguaccaucugggcaaccucagccaggaucuugccucccacggguauguggaagucacuucucugcccagagacgcggcuaauaucuugguuaugggaguggagaacucagccaaggaaggugauccuggcacgauauuuuucuuuagggagggggcagccguauucuggaaugugaaagacaagaccaugaaacaugucaugaagguguuagaaaaacacgagauucaaccauacgagaucgcucugguucauugggaaaacgaggaacuaaauuauauuaagaucgagggacagaguaagcuccaccggggcgagauuaaacugaacagcgaacuugaucuggacgaugcaaucuuggagaaguuugccuucuccaaugcucucugucugucugugaaacuggccauaugggaagcgucgcucgacaaguuuaucgagucaauucagagcaucccggaagcauuaaaagccgguaagaaggucaaacugagucacgaggaggugaugcagaagauuggggaacuuuucgcuuugcgccaucgaaucaaccuguccucugauuuucuaauaacacccgacuucuacugggaucgugagaaucucgaaggacuguaugacaaaacuugccaauuucuuagcauuggcagaaggguaaagguuaugaacgagaaacugcagcacuguauggaauugaccgaucucaugcggaaucaucugaacgagaagcgcgccuuaagacuggaguggaugaucgugauucucaucacaaucgaagucauguucgagcuuggcaggguguuuuucuga

SEQ ID NO: 61864 - RNA, 600 nt, Artificial Sequence
  derived and/or modified sequence opt3 from RNASE11__Homo_sapiens__NP_660293
auggaaaccuucccccugcuccuucugagcuugggcuuagugcuggccgaggcuuccgaaucuacaaugaagaucauuaaagaagaguuuacugacgaagagaugcaguacgauauggcaaagucagggcaagagaaacagacgauagaaauccuaaugaacccuauucuccuggucaagaauaccagucuuagcauguccaaagacgauaugucuucgacacuguugacuuucagaucacuccacuauaacgacccaaagggaaauagcagugguaacgauaaggagugcuguaaugacaugaccguuuggaggaaaguguccgaagccaacggcucuugcaaguggagcaauaacuuuauccgguccucaacagagguaaugcgccgagugcaucgugcgccgaguuguaaauucguccagaaucccgggauuagcugcugugagucucuggaacuggagaacaccgugugccaguuuacuacaggaaagcaauucccuagaugucaguaccacuccguuaccucacucgagaaaaucuuaacggugcugacuggccauagccuuaugaguugguuggucugcgguucuaagcuguga

SEQ ID NO: 61865 - RNA, 444 nt, Artificial Sequence
  derived and/or modified sequence opt3 from RNASE12__Homo_sapiens__NP_001019993
augaucauuauggugauaaucuuccugguccuccuguuuugggagaacgaaguuaaugacgaggccgugaugagcacccuugaacacuugcauguagauuacccccagaacgacgugccugucccagcuagauauugcaaucacaugauuauccaaagggugauucgggagccggaucauacauguaagaaagaacacguuuucauccaugagcgcccccgaaagauaaacggcaucugcauuuccccuaaaaagguggcaugucagaauuuaucugccaucuuuugcuuccagucagagacuaaauuuaagaugacggucugucagcugauugaagggacccguuacccagcgugcagauaucacuacagucccacagagggauucgugcuaguaacuugugacgaucucaggccugacagcuuucuggguuauguuaaguga

SEQ ID NO: 61866 - RNA, 471 nt, Artificial Sequence
  derived and/or modified sequence opt3 from RNASE13__Homo_sapiens__NP_001012264
auggcccccgcugugaccagacuccuguuccuucagcuggucuugggcccuacauuaguuauggacaucaagaugcaaauugggagcaggaacuuuuacacucuguccauagauuauccacgggugaauuacccgaaaggauuccgcgguuauugcaacggccuaaugucuuacaugcgagggaagaugcaaaauucagacugucccaaaauccacuauguaauucaugcaccuuggaaggccauccagaaauuuugcaaguacagugauagcuucugugagaacuauaaugaauacugcacgcucacccaggacucccugccaauuacaguguguucucuuucgcaccagcagcccccuacuucaugcuacuauaacagcacccugacaaaucagaaguuguaccuccuguguagucguaaauaugaggcggauccaaucggaauagcuggccuguacuccgguaucuga

SEQ ID NO: 61867 - RNA, 471 nt, Artificial Sequence
  derived and/or modified sequence opt3 from RNASE1__Homo_sapiens__NP_937875
auggcccuggaaaagagccucgugagacuucuguuguuaguccugauccuacucguucugggcugggugcagcccucccuugggaaagagucuagggcuaagaaauuccaacggcagcacauggacucagauaguagcccuuccucuucgucaaccuacugcaaccagaugaugcgccgacguaauaugacacagggaagauguaagccaguaaacacuuuugugcaugagccgcuggucgacgugcaaaauguuugcuuccaggaaaaagugacguguaagaacggucagggcaauugcuauaagagcaacaguuccaugcacauuaccgauuguagguugacaaaugggucucgguaccccaacugcgcauaucgcacuagcccuaaagagagacauauaaucgucgccugugaaggauccccauacgugcccguacacuuugacgcgucaguugaggauaguaccuga

SEQ ID NO: 61868 - RNA, 486 nt, Artificial Sequence
  derived and/or modified sequence opt3 from RNASE2__Homo_sapiens__NP_002925
auggugcccaagcuguucaccagccagaucugccuccuucuguuguuaggccugcuagccgucgaggggucccuccacguuaaaccuccacaauuuacaugggcucagugguucgaaacucagcauauuaacaugacgucucagcaauguaccaaugcaaugcaagugauaaacaauuaccagagaaggugcaagaaccagaauacauuucugcuuacuaccuucgccaacguagugaaugucuguggaaacccgaauaugacaugccccucaaacaaaacccggaagaauugucaccauagugguagccaggugccucugauccacugcaacuugacuacaccaucuccccagaauauuuccaacugucgcuaugcgcagaccccugcuaauauguuuuacaucguugccugcgacaaccgagaucagcguagagacccaccccaauauccuguggucccagugcaucucgauaggauuaucuga

SEQ ID NO: 61869 - RNA, 483 nt, Artificial Sequence
  derived and/or modified sequence opt3 from RNASE3__Homo_sapiens__NP_002926
auggugcccaagcuguucaccucccagaucugccuccuucuguuguuaggccugaugggggucgagggaucccuacacgccagaccuccacaauuuacaagggcucagugguucgcaauucagcauauaucucucaacccgccccgguguacuaucgccaugcgcgcgauuaauaacuaccgauggcguugcaaaaaucagaacacguuucugagaaccacauucgcuaauguugugaacguaugugguaaucaaucaaucaggugcccucacaaccggacucuuaauaacugucaucgcaguagauuuagggugccacuguugcacugcgaccucauuaaucccggcgcccagaacaucagcaauuguaccuaugcagaucggccugggcgccgauucuacgucguggccugcgacaacagagauccaagggacagcccccgguauccuguugugccaguccaucuggauacaaccauauga

SEQ ID NO: 61870 - RNA, 444 nt, Artificial Sequence
  derived and/or modified sequence opt3 from RNASE4__Homo_sapiens__NP_002928
auggcccugcagagaacccacagccuccuucuguuguuacugcuaacacuccugggccuugggcuggugcaacccuccuacggacaggacgguauguaucagagguucuugcggcagcauguccacccugaggaaacuggcgggucugaucgcuacugcaaccucaugaugcaacgacguaagaugacgcuguaucauuguaaaagauuuaauaccuucauccacgaggacauuuggaacauaaggucaaucugcaguacaacuaauauucaguguaagaacggaaaaaugaauugccaugaaggcguugugaagguaaccgauugucgggacacagguagcucccgcgcuccaaacugcagauacagggcaaucgccucuacccggcgcguggucauugcgugugaggggaauccccaggugccgguucacuuugauggauga

SEQ ID NO: 61871 - RNA, 453 nt, Artificial Sequence
  derived and/or modified sequence opt3 from RNASE6__Homo_sapiens__NP_005606
auggugcugugcuucccccuccuucuguuguuacugguccuauggggcccuguuuguccacuccacgccuggccgaagagacugaccaaagcucauugguuugagauccagcacauucaacccagcccucuucagugcaacagggcaauguccgggauaaauaacuacacacagcauuguaagcaccagaauacuuuccugcaugacucuuuucaaaacguggccgcgguaugcgauuugcucucaaucguguguaaaaaucggcgccacaacugccaccagaguagcaagccagucaauaugacggacugucgacugaccuccggaaaauauccccagugccguuacucugcugccgcacaguauaaguucuuuauuguggccugugauccuccacaaaagucggaucccccuuacaaacugguuccagugcaucucgacucaaucuuauga

SEQ ID NO: 61872 - RNA, 471 nt, Artificial Sequence
  derived and/or modified sequence opt3 from RNASE7__Homo_sapiens__NP_115961
auggcccccgcuagagcaggcuucugcccucugcuccuucuguuguuacuggggcuauggguggccgagaucccagucagcgcgaagccgaaaggaaugaccuccucucagugguuuaagauucaacacaugcagcccucaccucaggcuuguaacagugccaugaaaaauauaaacaagcauacaaaaaggugcaaggaccucaauacuuuccugcacgaaccauuuagcuccguugcagccacgugucagacccccaagaucgcuugcaaaaacggugauaagaauugucaucaaucucacggcgcagugucgcuuacaaugugcaaacugacuucagggaaguacccuaacugucgguauaaagagaagcgccagaauaagagcuacguaguggccugcaaaccaccccagaagaaagacagucagcaauuccauuuggucccugugcaccucgaucgaguucuguga

SEQ ID NO: 61873 - RNA, 465 nt, Artificial Sequence
  derived and/or modified sequence opt3 from RNASE8__Homo_sapiens__NP_612204
auggcccccgcuagagcaggcugcuguccucugcuccuucuguuguuagggcuguggguggccgagguccuaguuagggcgaagccaaaagacaugaccagcucccagugguucaagacacaacacgugcagccgucuccccaggcuugcaacucagccaugaguaucauuaauaaauacacugaacgguguaaggaucucaacacguuucugcaugagccuuucagcuccguagcaauaaccugccagacaccaaauaucgccuguaaaaacucuugcaagaauugucaccaaucgcauggacccaugucacuuacuaugggugaacugaccagcggcaaguauccuaacugccgcuacaaagagaagcacuugaauacaccauauauuguggcuugugaucccccucagcagggggacccaggauacccgcucguccccgugcaucuggacaaaguuguguga

SEQ ID NO: 61874 - RNA, 618 nt, Artificial Sequence
  derived and/or modified sequence opt3 from RNASE9__Homo_sapiens__NP_001103826
augaugagaacccugaucacaacucacccccucccucuucuguuguuaccacagcaacugcuacagcucgugcaguuccaggaggucgacacggauuuugacuucccggaagaggauaagaaagaagaguuugaagagugccuggagaaguucuuuagcaccggccccgccaggccuccaacaaaagaaaagguuaaacggcgcgugcuuauugagcccgggaugccucugaaccauauagaauacuguaaucacgagaucaugggaaagaacguauauuacaagcaucgauggguggcugagcacuauuucuugcucaugcaauacgacgaacugcagaaaauuugcuauaaucguuuugucccauguaagaacgguaucagaaaaugcaauagguccaagggccugguggaggggguuuacuguaaccucacugaagcauucgagauucccgccugcaaauaugaaucuuuauaccggaagggauacgugcugaucaccuguucauggcagaaugagaugcagaagcgcauaccucauacaaucaacgaucuugucgagccaccggaacacagaaguuucuugagcgaggacggcguguuuguaauuucccccuga

SEQ ID NO: 61875 - RNA, 861 nt, Artificial Sequence
  derived and/or modified sequence opt3 from RNASEH1__Homo_sapiens__NP_002927
augagcugguuacucuuccuugcccacagaguggcucuggcagccuugcccugcaggcggggcucccgcggguuuggaauguucuacgcgguccgacgugguagaaagaccggcguuuuucugacauggaacgaguguagggcucagguggaccgguucccugccgcacgcuuuaaaaaguucgccacugaagaugaggcuugggcauuuguaagaaaaucugccucaccagaagugagugaggggcaugaaaaucaacacggacaggagagcgaggcuaaggccuccaaaaggcugcgggaaccgcuagacggcgauggucaugagucugcggaacccuaugcaaagcacaugaagccuucggucgagccagcucccccugugucacgcgacacguucagcuacaugggggauuuuguuguggucuauaccgacggaugcuguaguuccaacggccgaagaaggccacgggccggcaucgggguguacuggggacccggucauccucucaauguaggcauucgucugccagggcgccagacaaaccagagagccgagauacacgcagcuugcaaagccaucgaacaagcgaagacucagaauauuaacaaacuuguucuguauaccgauucuauguucacaaucaauggaauuaccaacugggugcagggcuggaagaaaaaugguuggaagacuagcgccgggaaggaggucaucaacaaagaagacuuuguggcauuggagaggcucacacagggaauggauauacaauggaugcacgugccgggccauuccggcuucaucgggaaugaagaggcugaccggcuggcccgagagggagcuaagcagucagaagauuga

SEQ ID NO: 61876 - RNA, 900 nt, Artificial Sequence
  derived and/or modified sequence opt3 from RNASEH2A__Homo_sapiens__NP_006388
auggaccugagcgagcucgaaagagauaacaccgggaggugccggcuuuccucucccgugccugccgucugucgcaaggagccaugcguucugggcguggacgaagcuggacgagguccgguauugggccccaugguguacgcaaucuguuauugcccuuuaccacgucuggccgaucuagaggcgcucaaagucgcugacucaaagacacugcuugaaagugagagagagaggcuguucgccaaaauggaagauacugacuuuguggggugggcauuggauguucucagccccaaucugauuuccacgucuaugcugggacgggugaaguacaaccucaauucguuaucacacgacaccgccacaggccugauacaguaugcucuugaucaaggugucaacgugacucagguauucguugacaccguggggaugccugagacauaccaggcacgcuugcagcaaaguuuuccaggaaucgaagucaccgugaaagccaaggcugaugcccuguaucccguggucagugcggcauccauuugugccaagguugcuagagaccaggccgugaaaaaguggcaguucguagagaaacuacaggaucucgacacugacuacggcucuggcuauccuaaugauccaaagacaaaagcauggcugaaggagcauguggaaccggucuuuggguucccccaauuugugagguucagcuggcggaccgcucagacgauccuugagaaggaagccgaggacguuauuugggaagauuccgcgucagagaaccaggagggacugcgcaaaaucacuagcuacuuuuugaaugaagguagccaggcccgaccuagaucuucccacagguacuuccucgagcggggccuggaaucagcaaccagcuuauga

SEQ ID NO: 61877 - RNA, 774 nt, Artificial Sequence
  derived and/or modified sequence opt3 from RNASEH2B__Homo_sapiens__NP_001135751
auggccgcuggcguggacugcggggauggagucggugcaagacagcacguuuuccuggugagcgaguaccucaaggacgccuccaaaaagaugaaaaacggccuuauguuuguaaagcuggugaaucccuguucuggggaaggagcgaucuauuuguucaacaugugcuuacaacagcuguuugaggucaaaguguucaaggaaaagcaucacucaugguuuauuaaucagaguguucagagcggcggucuacuccauuucgcuaccccuguggauccacuguuucuucuguugcacuaccucauaaaagccgacaaggaggggaaauuccaaccgcuggaucaggucgugguagacaacguuuuucccaauuguauccugcucuuaaagcugccuggacuugaaaaauugcugcaucacgugacagaggagaagggcaacccagaaauugauaauaagaaauauuacaaguauuccaaagagaagacucuaaaauggcucgaaaagaaagucaaccagacgguggcagcccugaagaccaauaacgugaaugucucuucgaggguucagucaacagcuuucuuuagcggcgaccaagcaaguacugauaaggaggaggacuacauccgguaugcccacgggcuuauuuccgauuacauccccaaagaacugucugacgauuugagcaaguaccucaaacugccugagccauccgcuucauuacccaacccuccaaguaagauggccgcgcagcgccagaaacgaggaaaguga

SEQ ID NO: 61878 - RNA, 495 nt, Artificial Sequence
  derived and/or modified sequence opt3 from RNASEH2C__Homo_sapiens__NP_115569
auggagagcggcgacgaagccgcuaucgagagacacagggugcaucugcgguccgcaacccuccgcgaugccguccccgcgacacuucaccuguugccuugcgaaguugcuguggacgggccagccccgguaggacgauucuuuacucccgcaauucgucaggguccugagggcuuagaagugucuuucagagggaggugucugcggggagaggaggucgccgugccacccggccuaguugguuacgugauggucacggaagagaagaaagugucaauggggaagccugauccacuccgcgacaguggaaccgaugaccaagaagaggagccccuggaaagagauuuugacagguucauaggcgcuacagcaaacuuuagccgguucacucuuuggggccuggagaccaucccugggccagaugccaaaguacgcggagcuuugacauggccgucccucgccgcggcaauucaugcccagguucccgaagacuga

SEQ ID NO: 61879 - RNA, 414 nt, Artificial Sequence
  derived and/or modified sequence opt3 from RNASEK__Homo_sapiens__NP_001004333
augggcuggcugagacccgggccuaggccacucugcccgcccgcccgggcuagcugggcauucucccaccgcuuuccuucuccacuugcgccccgacguucaccuaccccauucuuuauggccagucuguuguguugcggacccaaguuagcugccugugguaucgugcugagcgcauggggcgucauuaugcuaauaaugcucgggaucuucuuuaacguucauuccgccgugcugauugaggacguaccuuucacagaaaaagauuuugagaauggaccacagaacaucuacaaucuuuaugaacaagugucuuacaacugcuucauugcugcaggccuguauuugcuccuggguggguuuucguucugucaggucagacugaauaagaggaaagaguacauggugcgguga

SEQ ID NO: 61880 - RNA, 2226 nt, Artificial Sequence
  derived and/or modified sequence opt3 from RNASEL__Homo_sapiens__NP_066956
auggagagcagagaccacaacaauccccaggaaggcccuaccuccucuucagggaggcgggccgcuguggaggauaaccaucugcucaucaaggcaguccaaaaugaagacguugaucuugugcagcagcuguuggagggaggugccaacguaaauuuccaggaagaggagggcggguggacaccauuacacaacgcggugcaaaugagucgcgaagacauugucgagcugcuacuccgacauggagcugauccggugcugcguaaaaagaauggcgccacucccuuuauacuugcagccaucgcugguagcguuaaacuguugaaacucuuccuguccaaaggggcagacgugaacgaaugcgauuuuuacggauucacggccuuuauggaggcugccgucuauggcaaggugaaggcgcugaaauuccucuacaagagaggcgcaaauguaaacuuaaggcggaaaaccaaggaggaccaggaacgccugagaaaagggggagccacagcucuuauggaugccgcagagaagggucacguugaaguguugaagauucugcuagacgagaugggcgcugaugucaaugccugugacaacauggggaggaaugcgcucauccaugcccugcuuucuucggaugacucagacguggaagcaauuacucaccuguugcucgaucacggagcugacgugaacguccggggcgagcgcgguaaaaccccucugaucuuagccguugagaagaaacaucuggggcucgugcagcgacuucuggaacaggagcacauagaaaucaaugauacagacagcgauggaaagaccgcuuugcuacuggccguagagcucaaacugaagaaaauugcagaacuucugugcaagagaggcgccaguacugacuguggcgauuuggugaugacagcuaggcggaacuaugaccauucccucgucaaggugcuguuaucucacggggcgaaagaggauuuucacccacccgcagaggacuggaagccucaaagcucccauuggggagccgcucugaaagaucuacaccguaucuaccgcccaaugauugguaagcucaaauucuuuaucgacgaaaaguauaagauagccgacaccucagagggcgggauuuaccugggauucuaugaaaaacaggagguugcagugaagacguuuugcgaaggcagucccagagcccagagggaggucagcugucuucagucuucccgggagaacucacauuuggugacuuucuacgguagcgaaagucaccgagggcaucuguuuguaugcguuacccucugugagcaaacacuggaggcuugccuugaugugcaccgcggcgaagacgucgagaaugaagaggaugaguucgccagaaacgugcugucuuccaucuucaaagcaguccaggaauugcaccucagcuguggauacacucaucaggaccugcaaccucagaauauuuuaaucgauucgaagaaagcggcucaccuggccgacuuugauaagucuaucaagugggcaggcgacccacaggaagugaaaagggaucuagaggaccucgggcggcugguucuuuaugugguaaagaaaggauccauuucauucgaggauuugaaggcccagaguaacgaagaggucgugcaacugagcccggacgaagagaccaaagaucucauacaucgccuguuucaccccggugaacacguuagagacugcuuauccgaccugcuuggccauccuuucuuuuggacaugggagucuagguaccguaccuugcggaauguggggaacgagagcgauaucaagacgcgaaagucagaaagugagauucucagacugcuacagccaggacccuccgaacacagcaaaucuuucgacaaguggacuacaaaaaucaaugagugugucaugaagaaaaugaacaaguuuuaugaaaagaggggcaauuucuaccagaacaccgugggugaucugcucaaguuuauacgcaaucugggggagcauauugacgaggaaaagcacaaaaagaugaaacuuaagaucggcgauccuucauuguauuuccagaaaacuuuuccagaccugguaaucuacguguauacaaaguuacaaaacaccgaguaccggaagcauuucccccagacgcacaguccgaauaaaccucagugcgauggagcuggcggggccagcggacucgcaucccccgguugcuga

SEQ ID NO: 61881 - RNA, 771 nt, Artificial Sequence
  derived and/or modified sequence opt3 from RNASET2__Homo_sapiens__NP_003721
augagacccgccgcucugaggggcgcacuccuugggugccuguguuuggccuuacugugccuaggaggugcggacaagcggcuccgcgauaaccacgaguggaaaaagcugaucauggugcagcauuggccugaaaccgucugugagaaaauucaaaaugacugccgagauccaccggacuacuggacaauacacggccuuuggcccgauaagagcgaaggguguaaccguuccuggccuuucaaucuggaggaaaucaaagacuugcucccagagaugagagcuuauuggcccgauguuauucauucuuuuccuaacaggucacgguucuggaagcacgagugggaaaagcauggaacuugcgccgcacagguggacgcccugaauagucagaaaaaguacuuuggccgcagccuggagcucuauagagaauuagaucugaacuccguacuuuugaaacuggguaucaagccaucuauuaauuacuaucagguggcugacuucaaagaugcacuagccagggucuacggggugauccccaagauacaaugucucccuccaucgcaggacgaggagguucagacgaucggacagauugaacugugccuuaccaagcaagaucagcagcugcagaacuguacagagccgggcgaacaacccucaccuaaacaggaggugugguuggcuaauggcgccgcggaaagccgggggcuccgcgucugcgaggacggaccaguguuuuaucccccuccaaagaaaacuaagcacuga

SEQ ID NO: 61882 - RNA, 699 nt, Artificial Sequence
  derived and/or modified sequence opt3 from RND1__Homo_sapiens__NP_055285
augaaggagagaagggcuccccagccuguggucgcccggugcaaacugguucucgugggcgacguacaaugugggaagaccgcaaugcuucaggugcuggccaaagauugcuacccagaaacauaugucccgacuguguucgagaacuacacggcguguuuggaaaccgaggaacagcgcguugaguuaagccugugggacacauccggaucucccuauuacgauaaugugcgaccucuaugcuauucagacagugaugcuguccuccuguguuuugacaucagccguccagagacuguggauuccgcccuuaagaaauggagaaccgaaauucuggacuacugccccucuacaaggguauugcucauagguuguaagaccgaucugcggacugaccugucgacacucauggaguuaucacaccagaagcaagcaccuaucagcuaugaacagggcugcgccauugcuaaacagcugggggcagagaucuaccuugagggaagugccuucaccuccgaaaagucuauucacagcaucuuucgcacggcuuccauguugugucugaacaaaccaucaccccuaccucagaagaguccaguuagaagccucucuaaaaggcugcuucaucugccgucccggucagaguugauaagcaguacuuucaagaaggaaaaagccaagucuugcuccaucauguga

SEQ ID NO: 61883 - RNA, 735 nt, Artificial Sequence
  derived and/or modified sequence opt3 from RND3__Homo_sapiens__NP_005159
augaaggagagaagggccagccagaaacuguccucuaagucaaucauggaccccaaccaaaaugugaaaugcaagauugucguugugggcgauagucagugugggaaaaccgcucuccuucacguauucgcaaaggacugcuuuccugaaaacuacgugccaacagucuucgagaauuauacugccagcuuugaaauagauacgcagcggaucgagcuguccuugugggacaccucuggaucgccguacuaugauaacgugcgccccuuaucauacccugacagcgaugcgguucugauuuguuucgacaucagucgaccagaaacacuagauuccgugcucaagaaauggaagggugagauucaggaguuuugccccaauacuaaaaugcugcuugucggcuguaagucugaccugcguaccgaugugagcacauugguagaacucuccaaccauagacaaaccccuguuucauaugaccagggggcuaauauggccaaacagaucggagcagccacuuacauagagugcagugcucugcagagcgaaaacucugugagggauaucuuccacgucgcaacacuggccugugugaauaagaccaacaagaaugugaaacggaacaagucccaacgcgcuacgaaaagaauuucacauaugccaagcaggcccgagcucagugccgucgcgacugacuuacggaaggacaaagcaaagucuugcaccguuauguga

SEQ ID NO: 61884 - RNA, 756 nt, Artificial Sequence
  derived and/or modified sequence opt3 from RNF103-CHMP3__Homo_sapiens__NP_001185883
auggagggcgaacuguacagcgcccucaaggaggaagaggcuuccgaaucugugucaaguaccaacuucagcggggagaugcacuuuuaugagcuugucgaagacacaaaagauggaaucuggcugguucaggugaaugagugguccuugaagauuagaaaagaaaugaggguaguggaccggcaaauacgcgauauccagcgagaggaggaaaaggucaaacguucugugaaggacgcagccaagaaaggucagaaggauguuugcauuguguuagcgaaagagaugaucagaucgaggaaggcugucucaaaacuguacgccagcaaggcacauaugaacagugugcuaaugggcaugaagaaucagcucgccguacugcggguugcugggucccuucaaaaaucuacugaagugaugaaggcaaugcagagccuggucaaaauucccgagauccaggccacgaugcgcgaauuguccaaggagaugaugaaagcuggaauaaucgaggaaaugcucgaggacaccuucgaaucaauggaugaccaggaggaaauggaggaggaagccgagauggaaauugauagaauccuguuugagauuacagcgggcgcacuggguaaggccccuaguaaagugacugacgcucucccagaaccggagcccccuggggccauggcagcuagcgaggaugaagaggaagaggaggaagccuuagaggcgaugcaaucuaggcuggccacccuucgguccuga

SEQ ID NO: 61885 - RNA, 2046 nt, Artificial Sequence
  derived and/or modified sequence opt3 from RNF103__Homo_sapiens__NP_001185880
augagcagacugaggccccggccuccacucauccacggcugcgggggauucuuugaggccauugugugguacgaaaccgguauauucgcuacacagcuugucgacccgguugcacuguccuuuaagaaauugaagacuaucuuagagugucgcggccugggguauucuggacuacccgagaaaaaggaugugcgagaacucguagaaaaaucaggcgaccugauggagggugagcuuuacagugcccugaaggaagaggaagcgagcgaguccgugucuucgacgaacuucucaggggagaugcauuuuuaugaauuggucgaggauaccaaggacggaauuuggcucgugcaaguuaucgcuaaugaucguagcccucuggugggcaaaauucacugggaaaagauggucaaaaaggugaguagauucggcaucaggacagggacuuuuaacugcuccucugacccacgguacugucgcagaaggggauggguacggagcacccugauaauguccguuccccagacaucaaccaguaaagguaaggugaugcucaaggaguauagcggccgcaaaaucgaagucgagcauauuuucaaguggaucacugcccacgcagccucucgaauuaaaacaaucuacaaugcugagcauuuaaaggaagaguggaacaaauccgaucaguauuggcugaagauauaccuuuuugcaaauuuggaccagccuccagccuucuuuucagcucugagcauuaaauucaccgggagaguggaauuuaucuucgugaacgucgagaauugggauaacaagaguuacaugacggacauuggaaucuauaauaugcccucuuacauccuaaggacuccugaaggcauuuaucgguacgguaaccacaccggggaguucauaucccuccaagccauggauagcuuucugcguucgcuucagccagagguuaaugaccuguucguguugucucucguacuggugaacuuaauggcguggauggaucuguuuaucacacagggagcaacuauuaagcgcuucgucgugcucaucuccacccuuggcacauauaauucacuguugauaauuaguuggcuaccgguucugggcuuucuccagcugcccuaccuugacagcuucuaugaauacucccugaaauugcucagauacucuaacaccacgacucuggccagcugggugagggcugacuggauguuuuauucaagucacccugccuuauuccuguccacauaccuagggcauggacuccugaucgauuauuuugagaagaaacggcgacgcaauaacaacaaugacgaagucaacgcaaauaaccuugagugguugagcucucugugggauugguacaccucauaucucuuccacccaaucgcuaguuuucaaaauuuccccguggaaagcgacugggaugaggacccugaucuguuucuugagagacuggccuucccagacuuguggcuccauccccugauuccgacugauuacaucaagaacuuaccuauguggagguucaaaugccuggguguacaguccgaagaggaaaugucugagggcucgcaggacacagagaaugauagcgaauccgagaacaccgacacgcuaucaagugaaaaggagguuuuugaagacaagcagucugugcuccacaauagccccgggaccgcgucccacugugaugccgaggcaugcucaugugcuaacaaauauugccaaacaagcccaugugagcggaagggacgcucuuacggcuccuacaauacuaacgaagacauggagccugauuggcugaccuggcccgccgacaugcuucauugcacagaaugugucgugugcuuggagaauuucgaaaacgguugccugcucauggggcugccauguggccacgucuuucaucagaauugcauugugaugugguuagcuggaggcagacacuguugccccguuuguagguggccuaguuauaaaaagaaacagccauacgcccaacaucagccgcugagcaacgaugugcccucuuga

SEQ ID NO: 61886 - RNA, 3081 nt, Artificial Sequence
  derived and/or modified sequence opt3 from RNF111__Homo_sapiens__XP_006720638
augcacguguucagccugaucgacggcuccucugggcucgccguccuuagacugucauugaaguuucccaugagucaguggaccccugaguacaacgaauuauauacacugaaaguugauaugaaaagcgagauuccauccgacgcuccgaagacucaagaaucucuaaagggaauacuccugcaucccgagccuaucggugcagccaaaucguucccagcgggcguggaaaugauuaauucaaagguagggaacgaguuuagccaccuuugcgaugacagucagaagcaggagaaagaaaugaauggaaaccagcaagagcaggaaaagucccugguggucaggaaaaagcggaaaucucagcaggcuggccccagcuacgugcaaaauuguguuaaggagaaccaggguaucuuggggcuccgccagcaucugggaacgccuuccgaugaggacaaugauucaaguuucagcgacugccugucuuccccaucaagcagucuccacuuuggcgauucugacaccgugacauccgaugaagacaaggaggucagcgugcgacauucgcagacuauuuuaaacgccaaaucucguucccacucagcaagaagucacaaguggcccaggaccgaaacagagagcguauccggccugcuuaugaaacggccuuguuugcaugggucuagccugcgcagacuaccaugcaggaagcgguucguuaaaaauaacucaagucaacgcacccagaagcagaaagaacgaauccucaugcaaagaaagaagagggaggugcuggcccggcguaaauaugcacuucugccguccuccucuucaaguagcgagaaugauuuguccucugaaucgagcuccucaaguucuacugagggagaagaggaccucuuugucagcgcuuccgaaaaccaccagaauaaccccgccgugccuucagguagcauagacgaggauguggucguuaucgaggcuucuuccacaccacaggugaccgccaaugaagagauuaacguaacgaguacugacagcgaaguggagaucgucaccgugggcgaaucuuaccgcuccagaucaacacuggggcauaguaggagccacuggucgcagggauccucuagccacgcgucacggccccaagagccucgaaaccgcaguagaauuuccacuguuauccagccauuaaggcagaaugcagccgagguggucgaucugaccguggacgaagaugagcccacaguaguuccgaccacgucugcucggauggaaagccaggccacuuccgcaucaauaaacaauagcaacccuaguacaucugagcaagcuagcgacaccgccagcgcggugacuucgucacagcccucuacagucagugagaccuccgccacgcucaccagcaauucuacaacuggcaccagcauuggugaugacucccgcagaacaacuucaagugcagugaccgaaacagggccuccagcuaugcccaggcuuccaagcuguugcccccagcauucuccuuguggaggcuccucacagaaccaccaugcccugggccacccacauaccaguugcuuccaacagcacgggcaccauuuucagcaccaucaccaccaucaccauacuccgcaccccgcugucccugugagcccauccuucucugaucccgccuguccuguugagcguccaccccaggugcaagcaccgugcggagccaauucgagcucagguacguccuaucaugaacagcaggcuuugccuguagaccuaaguaacucuggcauccggagccacggguccggaucauuucacggcgcgucugcauucgauccauguugccccgucagcaguucccgagccgcuauuuuuggucaucaagccgcagccgcugccccuagccagccccugucuucaaucgacggguacggcuccaguaugguggcacagccacagccucaacccccaccgcagccuagccucucgucuugcagacacuauaugcccccacccuacgcgucccugacaaggccucuucaucaccaggcuagcgccuguccacauucacacggaaaucccccuccgcagacccaaccacccccucagguugacuacgugaucccacaccccguccaugcauuccacagucagauuucuucccaugccacuagccacccuguggcuccgcccccaccuacccaccuggccucaacagcagcucccauaccacagcauuugccucccacccaccaaccaaucagucaucacauuccggccacugcgccucccgcccagcgccuccauccacacgagguaaugcagcggauggaagugcaaagaaggcgcaugaugcagcaccccacaggccuguucgucuuuugcguuagccgacgggcucaugagcguccuccaccccacccucauagaaugcacccgaacuaugggcacggacaucacauccaugugccacagacgauguccucucaccccaggcaggcaccugagcgcagcgccugggaauuagguauagaggcuggcgugaccgccgcaacuuacacacccggggcgcugcauccacaccuagcccacuaucaugcuccuccccggcuccaccaucugcaacuuggagccuugccacugauggucccugauauggcaggcuacccgcacauuagauauaucuccucaggucucgacgggaccucuuucaggggccccuuucgaggaaauuucgaggaacugauccaccuugaggaacgccugggcaacguuaauagaggggcuagucagggaacaauugagcgguguacuuacccacauaaguauaaaaaggugaccacggauugguuuucgcagaggaaauugcacugcaagcaggacggugaagagggcaccgaagaggauacagaagagaaguguacuaucugccucagcauucuggaggaaggggaggacgugcgucgcuuaccuuguaugcaucuguuccaccaaguaugcgucgaucaguggcuaauaaccaacaaaaagugucccaucugccggguggacauugaagcccagcucccauccgagucuuga

SEQ ID NO: 61887 - RNA, 1896 nt, Artificial Sequence
  derived and/or modified sequence opt3 from RNF112__Homo_sapiens__NP_009079
augcccagaccugcccugagcgugaccuccuucugccacaggcucggcaagcgggagcgcaaacagucuuuuauggggaacucaggaaauaguuggagccauacaccauucccgaaacuugaacuggguuugggcccccaaccuauggcuccacgagaguuacccacuuguuccaucugccuggaacgucuaagagacccuauuucucucgauugugggcacgacuuuugcauaagguguuucucgacgcaucggcugccaggaugcgagcccccuuguugcccagaaugucgcaaaaucugcaagcagaaaagaggccuuaggucacugggugagaagaugaaguugcucccgcagcggccccugccuccagcacugcaggagaccugucccguccgcgccgaaccucucuuacugguucgaauuaacgcgagcgggggacuuaucuugagaaugggcgcuauuaauaggugccugaaacacccacuagcccgggauacacccgugugccuccuggcaguacuuggcgagcaacauagugggaaguccuuucuguugaaccaccuccugcagggauuaccgggucuggaaucuggcgaagggggacguccucgcggcggugaggccagccuccagggguguagauggggagcuaauggccuugcaaggggcaucuggauguggucccaccccuuccuguuggggaaagaaggaaagaaaguggccgucuuucuaguggacacuggugaugcuaugucaccagagcugagucgggaaacccgaauaaagcucugcgcccugacaaccaugcuuagcucuuaccagauccuguccacuucacaagaguugaaggacacagaucucgacuaucuggaaauguucguucauguggcggaggucaugggcaaacacuacgggauggugccuauucagcauuuagaucugcuaguacgcgacagcagucaccccaacaaggcaggacagggccacguugguaauaucuuucagagacucucugggagguauccaaaagugcaagagcugcuucagggcaagcgggcccgcuguugcuugcugcccgcuccuggaagaaggcguaugaaccagggccaugccuccccaggggauaccgacgaugacuuccggcaccuccugggagcauacgucagcgacgugcuuucggcugccccgcaacaugcgaaaucucgaugucaggguuauuggaaugaaggcagagccguggcacgcggggauaggcggcuguugacgggacagcagcucgcucaagagauuaagaaccuguccggcuggauggguagaacugggcccggcuuuaccucaccugacgaaauggccgcucaguuacacgaucugaggaaagucgaggccgcaaagcgcgaguucgaggaguacguucgacagcaggacguggccacaaagcggaucuuuagugcucuacguguacucccagauacuaugagaaaucugcuuagcacccaaaaagacgcgauauuggcaaggcauggaguggcccugcucugcaagggccgcgaucagacacuggaggcuuuagaagccgaacugcaggcaaccgccaaggcuuucauggacuccuauacgaugcgguucugugggcaccuugccgcagucggaggugcggugggcgcuggguugaugggacucgccggcgguguugugggggcaggcauggccgcugccgcacuggcugccgaggcgggaauggucgccgcuggcgcagccgugggggcuacuggagccgcaguaguuggcgguggggugggagcgggccuagccgcuacagucgguugcauggaaaaggaggaggaugaaagacugcucgagggcgacagggaaccccugcuucaggaggaguga

SEQ ID NO: 61888 - RNA, 687 nt, Artificial Sequence
  derived and/or modified sequence opt3 from RNF114__Homo_sapiens__NP_061153
auggccgcucagcaaagagacugcggcggggcagcccagcuggcgggacccgcugccgaggcagauccucucgguagguucaccuguccagugugccuugaagucuacgagaagccgguucaggugcccuguggccacguauuuugcagcgccugucugcaggaaugcuugaaaccuaagaaaccaguguguggggucugccgguccgcuuuagcacccggagugcgcgccguugagcuggaacgacaaaucgagucuacagagacuucaugucauggcugccguaagaacuucuuucuaaguaaaauuagaagccacguggcuacguguuccaaguaucagaauuacauaauggaaggugucaaggccaccaucaaagacgcgucucuccagccuaggaacgugccaaaucgguauacauuccccugcccuuacugcccagagaagaacuuugaucaggaagggcugguagagcauuguaaacuuuuccacucgacugacaccaagucaguugugugcccgauuugugcaagcaugcccuggggagauccuaauuaucgcagugccaacuuuagagagcauauccaaaggcggcaccgcuucuccuacgacacauuugucgauuaugacguggaugaagaggacaugaugaaucaggugcugcagcgaucuauuaucgaucaguga

SEQ ID NO: 61889 - RNA, 3945 nt, Artificial Sequence
  derived and/or modified sequence opt3 from RNF123__Homo_sapiens__NP_071347
auggccagcaagggcgcugggauguccuucucuagaaaaucauacaggcugaccagugacgcagaaaagagccgggugacaggaaucguccaggaaaaacuccuuaacgauuaucugaaucgcauuuuuaguucuucggagcacgcgcccccugccgcuacuucacgaaagccauugaacuuccaaaauuuaccggaacaucuggaccagcuacuccagguugauaacgaggaagaggagagccagggucaaguggaaggccgucuggggcccaguacgguagugcuugaccacaccggaggcuuugagggucuguugcucgucgaugacgaucugcugggggugauaggacauuccaauuucggcacaaucagaucuacuaccugcguuuacaaaggcaaguggcucuaugaaguguuaauuagcucccaggggcugaugcagaucggaugguguacaauuucaugcagguuuaaccaggaggagggugucggcgacacccacaauaguuacgccuaugaugggaaccgggugcgcaaguggaauguaacuacaaccaacuacggaaaagcaugggccgcuggcgacaucguuagcugucuuauagauuuggacgaugguacgcugucuuucugccuaaauggggugucccucggaacugcauuugaaaaccugucaagaggccuuggcauggccuauuucccugcuaucagccugaguuuuaaggagucugucgccuucaauuuuggguccaggccauugcgguaccccguggcgggauaccgcccucuccaagacccacccagcgcagaccuggugcgagcccagagauuacuggguuguuucagggcuguccucucgguugaacuugauccuguggagggccggcuguuggacaaagaaucuuccaaguggcgucuacgcgggcagccaaccguacugcucacacuggcccauauuuuucaccacuucgcaccgcuucugagaaaaguguauuuggucgaggcugugcucaugucauuccuguuaggaaucguugagaagggcacucccacccaggcccaaagugugguccaucaggugcuggaucuacucuggcuguuuauggaagacuacgagguacaggauugccuuaagcaauugaugaugagccugcucaggcuguaucgguucuccccuauuguuccagaccuuggucugcagauccacuacuugcgacucacaauagcgauucugcgccaugaaaaaucuagaaaguuuuuacugagcaacgugcuauucgauguccucaggucaguggucuuuuucuauaucaaaaguccccugcggguggaggaagccgggcuucaggaguugauuccuaccacgugguggccacacuguuccagccgcgagggcaaggaaucuacugagaugaaagaagagacagcagaagagagacugaggcgucgggcuuacgagcgaggaugccagagacucaggaagcgcaucgaaguuguggaggaacugcaaguacagaucuuaaaacugcuuuuggacaauaaggaugacaacggcggggaggccucacgguauauuuuucucaccaaguucagaaaauuucugcaggagaacgcuaguggaagggguaauaugcccaugcuauguccgccugaauacauggucugcuuccugcaccgccucauaagcgcccugcgauacuauugggaugaguacaaggcauccaacccccaugccucuuuuucggaagaggcuuauaucccaccucagguguucuacaauggcaaaguugacuauuuugaccuucaacgguugggagggcuguuaagccaccuccguaagacucugaaagaugaccuugcguccaaggcaaacauugugaucgauccccuggaauugcagucaacagccauggacgaucucgacgaggaugaggaaccagcucccgccauggcacagagaccuaugcaggcccuggcugucggcgguccacuaccgcugcccaggccuggguggcucaguucuccaacccugggccgcgccaaucgguuccuuagcacggcagcgguguccuugaugacccccagaaggccucugucaacaagcgagaagguaaaagugcgaacuuuaucuguugaacaacgcacccgggaggacauagaaggaucccauuggaacgagggccuccugcuugggagaccacccgaggaaccggagcagccucugacagaaaauagucuacucgagguccuggauggagcugugaugauguacaacuugagcgugcaccagcagcuggguaagauggucggcguuucugacgaugugaaugaauaugccauggcauuaagggacacugaggauaaacuccgucgcuguccaaagcggagaaaagacauucuggccgagcuuaccaagucccaaaagguguucucagaaaaacuggaccauuugaguaggcgacucgcuuggguacacgccacagucuacagccaggagaagaugcuggauaucuacuggcuacugcgggugugccuucgcaccaucgaacacggggacagaacuggaucgcucuuugcauucaugcccgaguuuuaucuguccguugcuauuaacucuuacagcgccuugaaaaauuauuucggcccugugcauucaauggaggaacugcccgguuacgaggaaacguuaacaaggcucgcggccauccuggcuaagcacuuugcagaugcccggauugucgggaccgacauacgagauagucuuaugcaggcucuggccuccuaugugugcuacccacauucuuugagagcaguugagcgcaucccugaggagcaaaggauugcgauggugcguaaccuccuggcccccuaugagcagcggccaugggcucagacuaauuggauccuaguaagacuguggaggggcuguggauucggcuaccgcuacacccgacuuccgcaccuccugaaaacaaaguuggaagacgccaacuuaccuagccugcagaagcccugcccauccacccuccugcaacagcacauggcagaucuucugcagcaggggcccgacgucgcuccuucauuuuugaauagcgugcuaaaccaacugaacugggccuucagugaguuuaucggaaugauucaggaaauacagcaggcagccgagagacucgaacggaauuucguggauucuaggcaacugaaagucugugcuacuugcuuugaccuuuccguuagcuuacugcgcgugcucgagaugacaaucacguugguaccagagauuuuccuggauuggacccgucccacuucggaaaugcuccugagacggcuugcgcagcuguugaaccaggugcuaaauagggucacagccgagcgcaaccuguuugaccgagugguuacccucagauuaccuggccuggaaucaguggaucauuauccgauccuugucgcagugacagguauucugguucaacucuuggugcgggggccagcuucugagagggaacaggccacuuccguccugcucgccgaccccuguuuccagcugcgcuccaucugcuaccuucuaggacagccugagccacccgcuccuggcaccgcacugccggcccccgacagaaagagguucagcuugcaaucuuaugcggauuacauaagcgcugacgaguuagcccagguagaacagaugcuggcacaccucacguccgccucagcucaggcagccgcggcuagucugccaaccagcgaggaagaucuuuguccuaucugcuaugcccaucccauuucugcaguguuucaaccauguggucacaaauccugcaaggccuguaucaaucagcaucugaugaacaauaaagacugcuucuuuugcaagacaacuauuguuucaguggaggauugggagaaaggcgcuaacaccaguacaacuagcuccgccgcauga

SEQ ID NO: 61890 - RNA, 699 nt, Artificial Sequence
  derived and/or modified sequence opt3 from RNF125__Homo_sapiens__NP_060301
augggcagcgugcuguccaccgacucugggaagucagcccccgcuagugcaacagccagagcgcucgagaggcggcgcgauccugaacuuccagucacuagcuucgacugcgcuguuugucuggagguguugcaccagccgguacgaacgcguugcggacauguguuuuguagauccugcaucgccaccucucugaaaaacaauaaguggacaugucccuacugcagggcauauuuaccuucggaaggugucccagccacugauguggcuaaacggaugaagucagaguacaaaaacugugcagaaugcgacacccuaguuugucucagcgagaugcgcgcccacauuagaacaugccaaaaguauauagauaaguacggcccccugcaggagcuugaagagaccgcugccaggugugugugcccuuucugccagcgggaacuguaugaggacaguuugcucgaucauuguaucacucaccaucgcuccgagcgaagaccagucuuuugcccccuguguaggcugauuccugacgaaaauccaucuagcuucuccgggucacucauccggcacuuacaggugagucacacacuguuuuacgaugacuucauugauuuuaacaucauagaggaagcgcuuauccgucgcguauuggacagaagccugcuagaguauguuaaucauucuaacaccacguga

SEQ ID NO: 61891 - RNA, 1209 nt, Artificial Sequence
  derived and/or modified sequence opt3 from RNF128__Homo_sapiens__NP_078815
augaaccaggagaauagaagcuccuucuuuuggcugcucgugaucuucaccuuucuucugaagauuacagccucuuucucaaugagugcuuacgucacuguuacguauuacaacgaaaccagcaauuauacagcaauagagacuugcgaauguggcguguacggguuggccucccccguagcgaacgcuaugggaguggucgguaucccuaaaaauaacaauuaucaagccugcgaccacaacaccgaguuuucuaauacaaagaaaccauggauugcauuaaucgaaaggggcaacuguaccuucucggagaagauucagacugccgggcggcgcaaugcugaugcagugguuaucuacaacgccccggagacaggaaaucagaccauacagauggcuaacuuuggcgccguggacaucgucgcgauuaugaucgguaaucugaaagggacgaagauucuacaaucaauccagcgaggaauacaggugacuaugguaauugaaguuggcaagaaacauggccccugggugaaccacuauagcaucuucuuugucaguguguccuucuuuauuaucaccgcagccacagugggguacuucaucuuuuacucugcucguagacucaggaacgcccgggcacagagccgcaagcaaagacagcugaaagcugaugccaagaaagcgauuggaaggcuucagcugcggacuuugaagcagggugacaaggagauaggcccugauggggacuccugcgccgucuguaucgaacucuauaaaccaaaugaucugguucgcauucugaccugcaaccauaucuuccacaagacauguguggaccccuggcucuuagagcaucgaaccugcccuauguguaaaugcgauauacugaaggcacuuggaauugagguagacguggaagauggcucagucaguuugcaagugccaguuagcaaugagaucucuaacuccgcuucaagccacgaagaggacaauagaagugaaacggccucuuccgguuacgcuagcgugcaggggacugaugagcccccucuggaggaacacguccagucgacaaacgagucucuacaacucgugaaucaugaagccaacuccguagcaguugacgugaucccacacgucgacaauccgaccuucgaggaagaugagacucccaaccaggagacagccgugagggaaauuaaaucauga

SEQ ID NO: 61892 - RNA, 1260 nt, Artificial Sequence
  derived and/or modified sequence opt3 from RNF130__Homo_sapiens__NP_060904
augagcugcgccggcagagcugggcccgcaaggcuggccgcgcucgcacuucugaccuguuccuuguggccugcccgggcagacaacgccucucaggaguacuauacagcuuuaaucaaugugacuguccaagaaccaggacgcggugcaccgcugacguuccgaauugaucguggcagauacgggcuagacucacccaaggccgagguuaggggacaggugcucgcuccucugccacuucacggcguagccgaucaucuggguugcgacccccagacccgguuuuucgugccuccaaacauaaaacaguggaucgcguugcuccaacgcgggaauuguacauuuaaggagaaaauuaguagagcagccuuccacaacgcugucgccgugguuaucuauaauaacaagagcaaagaagaacccgugacuaugacccauccuggaacaggcgauauuaucgcagucaugauaaccgagcugaggggcaaggacauccuguccuaccucgagaagaauauuucugugcagaugacuaucgcuguagggacacggaugccaccgaaaaacuuuucgcgcggaucauuaguuuucgugagcauuaguuuuaucguccugaugauaauuuccucugccuggcuuaucuucuauuuuauucagaagauccgauacaccaaugcgagagauaggaaccagcggcguuugggugacgccgcuaaaaaggcuaucagcaaacugacgacucgcaccgugaagaagggcgauaaagaaacagaccccgauuucgaccacugcgccguguguauugaguccuauaagcaaaaugaugucguuagaauacuaccuugcaaacauguguuucacaagucauguguagacccauggcucagugaacacugcacuugucccaugugcaaacugaacauccuuaaggcucuggggauugugccuaauuugccauguaccgacaacgucgccuucgauauggagaggcucacacggacccaggcagugaaucgacgcagcgcccugggagacuuagcuggcgauaacucucugggucucgagccccuuagaacguccgggaucucaccgcugccucaggacggagaauugacucccaggacaggcgagauaaacauugcgguuaccaaagaaugguuuaucaucgccagcuucggccuacugagugcacucacucugugcuacaugauuauccgggcuacagccucucuuaaugcaaacgagguggaaugguucuga

SEQ ID NO: 61893 - RNA, 861 nt, Artificial Sequence
  derived and/or modified sequence opt3 from RNF135__Homo_sapiens__NP_001171921
auggccggccuggggcucggaagcgcugugcccgucuggcuugcagaggacgaucuggguugcaucauuugucagggcuuguuagacuggccugccacccugccaugcgggcacuccuucuguagacauugccuagaagcgcucuggggagcuagggaugcccggcgcugggcauguccgacaugccgacaaggcgccgcucagcagccccaucugcguaagaacacucuucugcaggacuuggcagauaaauacagaagggccgcucgggagauacaagccgguucugacccugcgcacuguccaugccccgggucaaguagccucuccucugcagccgcucgcccuagaaggcggccagaacugcagcgcguugccguggagaagucgaucacggaaguagcacaggagcugaccgagcucguggaacacuuagucgauauugugcgaucacugcagaaucaaagaccccuuagcgagaguggaccugacaacgaauuguccauccugggcaaggcuuuuucuagcggcguugaucuauccauggccucaccaaaacucgugacaagugacacugcggccgggaaaauuagggauauccugcaugaccuugaggagauacaggaaaagcugcaggagagcgucaccuggaaggaagcaccggaggcucagaugcaaggaucuuugcucccccggcuggaauguuccgguacaaucaccgccgcuucaauuagccaggcccaggagaauaguuggaaaccucguuuaccaccccacgcacacugccugacucgcgccacacuccauucuggcgagcuucugggguugcuauccggaccuagcauccaaccacugaccuga

SEQ ID NO: 61894 - RNA, 738 nt, Artificial Sequence
  derived and/or modified sequence opt3 from RNF138__Homo_sapiens__NP_057355
auggccgaggaccugagcgcugcaaccuccuacacagaagaugacuucuauugccccgugugucaggagguccucaagacuccuguuagaacgaccgccugccaacacguguuuuguaggaaaugcuuccuuacagcgaugcgggaaucuggcgcucauuguccacugugccgcgggaacguaacucgacgugagagagccuguccggaaagggcauuggauuuagagaauaucaugcggaaguuuucaggaaguugccgcuguugcgccaaacagauuaaguucuacagaaugaggcaccauuauaaaagcuguaagaaguaccaggacgaguaugguguguccucuauaauccccaacuuucagauuucgcaagauucagucggcaauagcaaccggagugaaaccuccacaucugacaauaccgagacuuaccaggaaaacacaagcuccucagggcacccuaccuucaaaugcccacugugccaggagaguaauuuuacgcgccagcgacuacucgaucauuguaacagcaaucaccuguuccaaaucgugcccguuacuugcccuauuugugugucucuuccauggggagaccccucccagaucaccagaaacuuugucucacaccugaaucagaggcaucaguucgauuauggcgaguuugugaacuugcaacucgacgaagagacacaguaccagacugcuguagaagagagcuuccaaguuaauauauga

SEQ ID NO: 61895 - RNA, 1995 nt, Artificial Sequence
  derived and/or modified sequence opt3 from RNF139__Homo_sapiens__NP_009149
auggccgcuguggggcccccucagcaacaggucagaauggcacaccagcagguuugggccgcgcuggagguggcucucaggguaccaugccuuuacaucauugacgccauauucaacagcuauccggauuccucucaaucacgguuuuguaucgugcugcagauuuucuugcgcuuauuuggcgucuucgcaaguagcaucgugcugauucuaucccagcgaucucucuuuaaguucuacaccuauucgucagccuuucugcuugcugcaacaagcguucuggugaauuacuaugccaguuugcauaucgacuucuacggagcuuauaacacuuccgccuuugguauagaacuccugccccguaaaggcccuucucuguggauggcgcucaucgucuuacagcugacguucgggauuggauacgugacccuuuugcaaauccacagcauuuacucccagcugaucauacuagaucuccugguaccaguuauuggccuuaucacagagcugcccuugcauauuagagaaacucuccuguuuaccucaaguuuaauccugacacucaauaccguguucguccuugcagugaagcugaaaugguuuuauuacagcacuagguauguguacuugcuaguccggcacauguaucgcaucuacggucugcagcuccugauggaggacacauggaagagaauuagguucccugauauacuucggguuuucuggcugacccgcgugacggcccaggcuacuguauugauguauauccuccgaauggccaacgaaaccgacuccuuuuucauuucuugggaugacuuuugggaucugaucugcaauuuaauaauuucagggugugacagcacacugacugugcuaggaaugagugcagucaucucuuccguggcucauuaccucggccugggcauccuugccuucauugggagcaccgaggaggaugacagaagguugggauuuguugcgccagugcuguucuuuauccucgcccugcaaacaggucuuucgggccugcggcccgaggaacguuugauucgccucucuagaaacaugugccuguuacugaccgcaguccuacacuucauacacgggaugacggauccugugcucaugucccugucagcuagucauguaagcuccuuuaggcggcacuucccaguucuuuuugugucugccuguuuguucauccugccgguccuccugagcuacguguuauggcaucacuaugcucugaauacuuggcuuuuugccgucacagcauucugcguggaauugugucucaaaguuauugugucacugaccguauacacucuauucaugaucgacggauauuacaacguccugugggagaagcucgacgauuauguguacuauguucgaaguacaggcuccaucauugaguuuauauucgguguggucauguuugggaauggagccuacaccaugauguucgaaagcggcucuaagauccgcgcuuuuaugaugugccugcacgcguacuucaacauuuaucuucaggccaaaaauggcuggaagacguuuaugaacagaaggaccgcagugaaaaagaucaauucauugcccgagauuaaagggagucggcugcaggaaaucaacgacguaugugcuauaugcuaccaugaguucacaacuagcgcccgcaucaccccuuguaaucacuauuuucaugcauuaugccucagaaaguggcuguacauucaagauacaugcccaaugugucaccagaagguguauaucgaagacgauauuaaagacaacuccaacguuucuaauaacaauggauucauacccccuaacgagacuccagaggaagccgucagggaggcugccgcagaaucggaucgugagcuuaaugaagacgauagcaccgacugcgaugacgacgugcagcgggagcgaaacggugugauccagcauacaggcgcggcugccgaggaauuuaaugaugacaccgauuga

SEQ ID NO: 61896 - RNA, 879 nt, Artificial Sequence
  derived and/or modified sequence opt3 from RNF144A__Homo_sapiens__XP_005246259
augaccacaacuagauacaggcccacgugggaccuggcccucgauccucuugugagcugcaagcuguguuugggcgaguauccagucgaacagaugaccacaaucgcucaaugccaguguauuuucugcacuuuaugucugaaacaguacguugagcuacucauaaaggaagggcuggagaccgcaaucuccugcccggacgccgcgugucccaaacagggacaccuucaagaaaacgagauugagugcaugguggcugccgaaaucaugcagcgguauaagaaacugcaguuugagcgcgaaguauuguucgauccuugucgaacauggugcccagcaucuaccugucaggccgugugccaacuccaggacgucggucugcagacuccccagccugugcaaugcaaggcuugucguauggaguuuugcucaacauguaaggcaaguuggcauccaggccaggggugccccgagaccaugccuauuacguuccugccaggagaaacuagcgccgcuuuuaaaauggaggaagaugacgccccgaucaagagaugucccaaaugcaagguuuacauagagagggaugaaggcugugcgcagaugaugugcaaaaauuguaagcacgcauucugcugguauugucucgaguccuuagacgaugacuuucugcuuauccauuacgauaaggguccuugccggaacaaauuggggcacucucgcgccucggugauuuggcauagaacccaagucgugggaaucuucgcuggcuuuggccugcuacuccugguagccucaccauuccuucuguuggcaacacccuuuguucucugcuguaagugcaaauguagcaagggggacgaugacccucugccaacuuga

SEQ ID NO: 61897 - RNA, 912 nt, Artificial Sequence
  derived and/or modified sequence opt3 from RNF144B__Homo_sapiens__XP_005249041
augggaagcgccgggagacugcacuaccucgcuaugaccgcagagaaccccacaccuggagaccuugccccagcgccgcugaucacuugcaaguuguguuuaugcgaacagucccuggauaaaaugacgacccuacaagagugucagugcauuuucuguacagcuugccucaagcaguauaugcagcuggccauaagggaagguuguggcucucccaucacuugcccugacauggugugucuuaaucaugggacccugcaagaggcagaaauugccugcuuggucccaguugaucaguuucagcucuaccagcggcugaaauucgagcgcgaggugcaccuggaccccuaucgaacaugguguccuguagcugauugccaaaccgugugcccagucgcaucaagugaccccggacagccugugcucguugaauguccaagcugccauuuaaaguuuuguuccugcuguaaagaugccuggcacgcugaggugucuugccgugacucgcagccgaucguccugcccacugaacauagagcccuuuucggcacagaugcggaggcaccuauuaagcaguguccagugugcaggguauacaucgagcggaacgaagguugugcccaaaugaugugcaagaauuguaaacacaccuuuugcugguauugcuugcagaaccuggacaaugauauauuccuacgccacuacgacaaggggcccuguagaaacaaacucggacauucaagggcuagcguuauguggaaucggacucagguggucggcauccuggugggccuugggauuaucgcccuggugacgaguccuuugcuccuguuagcauccccaugcauuaucuguugcgucuguaagucuugccgcggcaaaaagaagaaacacgaucccagcaccacauga

SEQ ID NO: 61898 - RNA, 1080 nt, Artificial Sequence
  derived and/or modified sequence opt3 from RNF146__Homo_sapiens__NP_001229778
augauggccggcugcggggagaucgaccacagcauuaacaugcugcccaccaauagaaaggcuaacgaauccuguucuaauacagcaccuucacucacugugccagagugcgccauaugucuucagacgugcguccauccgguuagucugcccuguaaacacguguucugcuacuuguguguaaagggagcgagcugguuagguaaaaggugcgcucugugucggcaagaaaucccugaggauuuucuagacaagccaacccuccugucccccgaggaacuuaaagccgcaucucgcggcaacggggaguaugccugguacuaugaaggacgaaauggcugguggcaguacgaugagcguacaucgagagaacuggaggacgcuuucucaaaggguaagaaaaacacugagauguugauugcaggguuucucuauguggccgaucuggaaaauaugguccaguacaggcggaacgagcauggacgcagaaggaagaucaaacgggacauuaucgauauaccuaagaaaggcguggcuggccugcgccucgacugcgaugccaauaccguuaacuuagcgcgagaaagcagugcagacggggccgauuccgugucugcucagagcggagccuccguccaaccacuggugucaaguguaagaccccuuacaagcguugacggucaguugaccucuccugcaacuccauccccggaugcuucaacaagccuggaggacaguuucgcccaccuacagcucucuggcgacaauaccgcggaaaggucccaucguggggagggagaggaagaucacgagagccccucgucuggccgggugccugccccagacacguccaucgaagagacugaaucagaugcaaguagcgacuccgaggaugucucugcugugguggcccagcacagccugacccaacagcgccuucuggucucaaacgcuaaucagacaguucccgacagaagugauagguccgguacugaccggagcguggccgggggaggcaccguaucugugucaguccgaagucgcagaccugauggccaguguacagugaccgagguuuga

SEQ ID NO: 61899 - RNA, 1203 nt, Artificial Sequence
  derived and/or modified sequence opt3 from RNF149__Homo_sapiens__NP_775918
auggccuggagaaggcgggaggcuagcgugggcgcacgcgggguccuggcccucgcgcuucuggcuuuggccuuaugcguucccggagcacgaggucgugcccuggaaugguucuccgcugugguaaacaucgaguacguggacccucagaccaaucuaacagucuggucugugucagaaaguggcagauuuggggauagcuccccaaaggagggagcacacggccucguuggugugccgugggcccccgggggagaccuggaaggcugugcuccugauacuagguucuuugucccagagcccggcgggcggggagccgcgccuuggguggcacuuguagcccgcgguggcugcacguucaaagacaagguucugguggcugccagaaggaacgcaucugcugucguguuguauaaugaggaacgguacgggaacauuacccucccaaugucgcaugccggaacaggcaauauaguggucaucaugauuucauaucccaaaggucgcgagauccuggaacugguucaaaaggggauuccugugacuaugaccaucggaguaggcacacgacacgugcaggaguuuauaagcggccagagugucguguucguugcgaucgccuuuauuaccaugaugaucauuucccucgcaugguuaaucuucuacuauauacagagauuucuguacacugggucucaaauuggaagccagucccauaggaaagagacaaagaaggugaucggucagcuuuugcugcacaccgucaaacauggcgaaaaggggauugauguggacgcugagaacugugccguaugcaucgaaaauuucaaaguuaaggauaucauucggauacuaccauguaaacacaucuuucaccguauuugcaucgacccguggcuccuggaucaucgcacgugucccaugugcaaacuugacgugauaaaggcucugggauauuggggcgagccuggugauguccaggaaaugccagcccccgagucaccuccagggagagaccccgcagccaacuugagucucgcucugccggaugacgacggcagcgaugacucuuccccucccucagcgagcccagcagagagugaaccucaaugugaucccucuuucaagggagacgccggcgagaauacugcuuuacuggaagccgggagguccgauagccggcacggagguccaauuucguga

SEQ ID NO: 61900 - RNA, 1047 nt, Artificial Sequence
  derived and/or modified sequence opt3 from RNF14__Homo_sapiens__XP_005268598
augcaguuccugaaggaggaaacccucgccuaccuuaacaucgugagccccuuugagcugaaaauuggcucccaaaagaaaguccagagaaggacagcucaggcaucuccuaauacugaauuggacuucgggggagccgcggguucagauguugaccaggaggaaauaguggaugagcgggcuguacaagacguggagaguuuaagcaaccugauccaggaaauucuagauuuugaccaggcccagcaaaucaagugcuucaauuccaaacucuuucuguguucuauuugcuucugugagaaacuuggcucggaaugcauguauuuucuggagugucgccacgucuacugcaaggcauguuugaaggauuauuucgagauccagauacgagacggacaggugcagugccucaacuguccagaaccgaagugccccucaguugccacgccugggcaagugaaagagcuggucgaagcugagcuguuugcacguuacgauagacucuuacugcagagcagucuugacuugauggccgaugugguauauuguccaaggcccugcugccagcugccuguuaugcaagaaccaggcuguaccauggguaucugcuccucuuguaauuucgcuuuuugcacacuaugucggcucacuuaccauggggugagccccugcaaggucaccgccgagaaacugauggaccuucgcaacgaguaucugcaggcggaugaagcaaauaagagauugcucgaccagagguacggaaagcgggugauucagaaagcccuggaggaaauggaguccaaggaaugguuagagaaaaacucaaagaguuguccuugcuguggcacaccaaucgagaaacuggacggcugcaauaagaugaccuguacugggugcaugcaauacuucugcuggauuuguaugggaagccucucucgcgcuaacccguauaaacacuuuaaugaucccgguuccccuugcuucaaccgacuuuucuacgccguggacgucgaugacgauaucugggaagacgagguugaagauuga

SEQ ID NO: 61901 - RNA, 1317 nt, Artificial Sequence
  derived and/or modified sequence opt3 from RNF150__Homo_sapiens__NP_065775
auggccaugagccugauccaggcuugcuguucccucgcacuuucuaccuggcuguugucauucugcuuugugcacuuacugugucuagacuucacagucgccgagaaggaagagugguacacugcguuuguuaacauuacguaugcugaacccgccccugauccaggcgcaggggccgcuggagguggcggggcagagcuccauaccgagaaaacagaaugcggaagauacggcgagcacaguccgaagcaagacgccaggggugaagugguaauggcuagcuccgcccaugaucggcuggcgugugaccccaauacuaaauucgcagccccuacccgcgggaagaacuggauagcucuuaucccaaaaggaaauugcacauaucgagauaagauucguaacgccuuucugcagaaugcaucugcuguggucaucuucaacgugggcucgaauaccaacgagacuauuacaaugccccacgccggcguugaagacaucguggcgauaaugaucccugagccaaaggggaaagagauugucucauugcucgaaagaaauaucaccgugacgauguacauuacuaucggaaccaggaaccugcagaaguauguaagccggacaaguguuguguuugucuccauaucuuucauugugcugaugaucauuagccucgccugguuaguguuuuacuauauccagcgcuucagauacgcaaaugcuagggaucggaaccaacgccgacugggugacgccgcuaaaaaggccaucuccaaacuucagauuagaacuauaaagaagggcgauaaagagaccgaaucagacuuugauaauugugcagucugcaucgagggguacaagcccaacgacguugugaggauuuugccuugucggcaucuguuccacaaaaguugcguagauccauggcuacucgaccaccguacauguccgaugugcaagaugaauauccugaaagcccuuggaauacccccuaacgcugacugcauggaugaccugccaaccgauuuugaaggcagcuugggugggcccccuacgaaccagauuacuggagcgucugacacaaccgugaaugaguccucagucacucucgauccagcagugcgcacaguuggcgccuuacaggugguccaagacaccgaucccaucccgcaggagggcgacgugaucuucacgaccaacagcgaacaggagccugcuguaaguucugauuccgacauuagccugaucauggccauggaaguugggcugucggauguggagcucucuacagaccaggacugugaagaggucaaguccuga

SEQ ID NO: 61902 - RNA, 612 nt, Artificial Sequence
  derived and/or modified sequence opt3 from RNF152__Homo_sapiens__NP_775828
auggagacccugagccaggacucccuccuugaaugccaaaucuguuucaacuacuauucucccagaaggcggccuaagcuguuggauugcaaacacacauguugcucaguguguuuacagcagaugcgcacgagucagaaggacguccgaugcccauggugucguggcguuacuaaacugccgcccggguuuagcgugucccaacuaccugaugacccagagguacucgccgugauugcuauaccccauaccucugaacacacaccugucuucaucaagcugccaucgaauggaugcuacaugcuuccccugccuauuucaaaagagagagcauugcucccaggugauaugggcuguaggcugcugccggggagccagcagaagagugugacuguugugaccauccccgccgaacagcaaccucuccagggaggcgcgccacaggaggcugucgaggaggaacaggaccggcgcggugugguaaaguccucuacauggagcgggguuugcaccgugauuuuagucgccugugugcugguguuucuuuugggaaucguccugcauaacauguccugcauaucaaaaagauucacuguuaucaguugcggcuga

SEQ ID NO: 61903 - RNA, 2040 nt, Artificial Sequence
  derived and/or modified sequence opt3 from RNF157__Homo_sapiens__NP_443148
augggcgcccugaccagcagacagcacgcugggguggaggaagucgacauccccuccaacucuguuuacagguauccuccaaagucaggaaguuacuucgcaagccauuuuauuauggguggcgagaaguucgauuccacacacccggaaggguaucucuuuggagaaaauucugaccuuaacuuccugggcaaucggcccgugguauuuccuuacgccgcgccacccccucaagaaccagugaagacuuugcgcucguuagucaacauacgaaaagauacgcugcgucuagugaagugcgcugaggagguuaaaucacccggugaagaggccagcaaggcaaaggugcauuauaaugucgaguucaccuuugacacagaugccagaguggcuaucacuauuuacuaucaggcaaccgaggaguuccagaacgggaucgccaguuacauuccuaaagacaauucccuccagucugaaacaguacaauacaagaggggaguuugucagcaguuuugccugccaagccacaccguggauccguccgagugggcugaagaggaacuuggcuucgaccuggaucgggaggucuaucccuugguggugcaugccgucguugacgagggcgaugaauacuuugggcacugucacgugcuccugggaacuuucgagaaacauacagacgguaccuuuugcguaaagccucugaaacagaagcaaguggucgauggcgugucauaucucuuacaggaaaucuacgggauagagaacaaguauaauacgcaggacaguaaaguugcggaagacgaggugagcgauaacucugcagagugugucgugugccuguccgacguacgcgauacucuuaucuugccauguagacaccugugccuauguaauaccugcgccgacacacucagguaccaggcuaacaauugucccauuugccggcugccuuuccgcgcccuucugcaaauccgagcaaugagaaagaaauugggaccacucucacccacuagcuucaacccgauuaucaguucucagaccuccgauagcgaggaacauccuucgucugaaaauauacccccaggcuaugagguugugucccuguuagaagcucugaacgguccucucacacccucaccagccgugcccccucuucacguccugggggacggacacuugaguggcaugcuaccaagcuacggcuccgaugggcaucugccgcccgucaggaccauuucuccucucgaccggcugagcgauucaaguucccagggacuuaagcugaaaaagagcuugucuaaaucaacgagucaaaacagcuccgugcuccacgaggaggaagacgagcauucuugcucggaaagcgagacucagcugucccagcguccaucaguucagcacuuaggugaggaauguggcgugacacccgagagugaaaaucugacccuaucuagcuccggggcgaucgaucaaucaagcugcacuggaacaccucucucuuccaccauuaguagcccagagggccccgccucuuccucacuggcacagaguguaaugagcauggcuucgucccagaucucuacggacaccgucagcucaaugagugguuccuacaucgccccggggacagaagaggagggcgaagcucuuucuagcccucagccagccucccgcgcacccucagaggaaggagagggcuugccugccgaaagccccgacaguaacuuugcugggcugccagcgggagagcaagaugcagaggguaaugacgugauugaagaggaagauggcucuccuacucaggaggggcagagaaccugugccuuccucggaauggaaugcgacaacaauaacgauuuugacauagcuuccguuaaggcccuggauaauaaacuuuguagcgaggugugccugcccggcgcauggcaggccgacgauaacgcugucucgaggaaugcccaacggcgacgcuugucaucuaguucccucgaggacagcgaaacaagaccaugugugugggguccgcuggcaguauga

SEQ ID NO: 61904 - RNA, 1053 nt, Artificial Sequence
  derived and/or modified sequence opt3 from RNF167__Homo_sapiens__NP_056343
augcaccccgccgccuucccucugccaguggucguugcagccgugcucuggggcgcggcuccgaccagagggcuuauaagggccacaagcgaccauaacgcauccauggauuuugccgaccugcccgcuuuguucggagcaacuuuaucucaggagggucugcaaggcuuucuaguagaagcccacccugauaaugcuugcucaccaauugcgcccccuccacccgccccugugaacgggagugucuucauagcacuccugcggcgcuuugacuguaauuucgaucuuaaggugcugaacgcccagaaagcuggauacggcgccgcaguugugcauaaugucaacagcaaugaguugcucaacaugguguggaacuccgaagagauccagcagcaaauuuggaucccaucuguauuuauuggugaacgaucgucagaguaucugcgugcucuguucguuuacgagaagggggccagagugcucuuagucccggacaauacguuuccccugggauauuaccuuaucccuuucaccggcauagugggcuugcuggugcuagcgaugggggccgucaugaucgcaaggugcauucagcaccggaaacgccuccagagaaauaggcugacaaaggaacagcuuaaacaaaucccaacucaugauuaucagaagggagaccaguacgauguuugugcuauuugccuggacgaguaugaagauggugacaaguugcgggugcuccccugugcccacgcuuaccacagccgcugcguagauccuuggcugacccagacacgaaaaaccuguccaaucugcaagcaacccgugcauagaggcccgggggacgaggaccaggaggaagagacucagggacaagaagagggcgaugaaggugagccuagggaccaccccgccagugagcggacaccauuacugggguccucuccuacccuccccacgagcuuuggaucccuugcaccagcuccccuggucuucccuggcccaucaacugauccgcccuugaguccuccaagcucucccgugauccuaguuuga

SEQ ID NO: 61905 - RNA, 1716 nt, Artificial Sequence
  derived and/or modified sequence opt3 from RNF168__Homo_sapiens__NP_689830
auggcccugcccaaggacgcuaucccuagccucuccgagugccaguguggcauuugcauggaaauacuuguggagccagucacccugccguguaaccacacauugugcaaacccuguuuccaaucuacuguugaaaaggcaucauuaugcuguccuuuuugcagaaggcgggugaguagcuggacgcgcuaccauacccgacguaauucccugguaaacguggagcuauggacaaucauucagaaacacuauccaagagaauguaagcucagggccucugggcaggagucggaggaagucgcggaugacuaccagcccgugcggcugcuuucaaaaccuggagagcugcgcagagaauaugaggaggaaaucagcaagguugcugccgagaggcgggcaagugaagaggaagagaauaaggccuccgaggaauacauucaacgcuugcucgcugaggaagaggaagaggagaaacgacaggcagaaaagagaaggcgggccauggaggaacagcugaaaucugaugaggaacuggcucguaagcucagcaucgacauaaacaauuucugcgaggguuccaucucagccaguccauuaaacagccgcaaaucugaucccgugacuccuaaguccgagaagaaaucaaagaauaaacagagaaacaccggcgacauucaaaaguaucugacaccaaaaagccaguuugggagugcgucucauuccgaagcaguccaggaggugaggaaggauagcguaucgaaagacaucgauucuuccgaccggaagucaccgaccggacaggauacugaaauugaggacaugcccacacuuaguccucaaaucagcuugggcguuggugagcagggggccgauuccucuauagaaagcccaaugcccuggcugugugcuugcggagccgagugguaccacgaaggcaaugugaagacccgaccuucaaaccauggcaaagagcuaugcguccucagucacgaacgcccaaagacgagagugcccuauuccaaagagacugcagugaugccgugugggaggaccgagagcggaugcgcuccuacaucuggugucacucagaccaauggcaacaauacaggggaaaccgagaacgaagagucaugucugcuuauuaguaaggaaaucagcaaacggaagaaucaagaguccucuuucgaggccguuaaggaccccugcuuuucggcgaaacgcagaaaggugagcccagaauccucaccugaccaggaggaaacggagauuaacuucacucagaaacugaucgauuuggaacaccuccuguuugagaggcauaagcaggaggaacaagaccguuuacuggcccuccagcuucagaaagagguagauaaggaacagauggugcccaaccggcaaaagggaaguccagacgaguaccaucugcgagcaacaucuagcccucccgauaaagucuugaauggccagagaaagaacccaaaagacgguaauuucaagaggcagacccacacuaaacacccgacacccgagcgcgggucccgggauaagaacagacaggugucacuaaagaugcaacugaaacagagcguuaauaggcgcaagaugccuaacucuacccgagaccacuguaaaguguccaagagugcucauagccuccagccaucuaucucccagaaaucagucuuucaaauguuccagcggugcacgaaguga

SEQ ID NO: 61906 - RNA, 777 nt, Artificial Sequence
  derived and/or modified sequence opt3 from RNF170__Homo_sapiens__NP_001153695
auggccaaguaccagggcgaggugcaaagccugaaacucgacgaugacuccgucaucgaagggguuucugaucaggugcuuguagcuguggucgugucauucgcacugauugccaccuugguuuaugcguuauuuagaaacgugcaccagaauauacaucccgagaaccaggaacuggucagggugcuacgggagcaacuccagacagaacaggacgcuccugccgcaacucgccagcaauucuacacggauauguauugcccaaucugucugcaccaggccaguuuuccgguagagaccaauugcggacaucuuuucuguggugcuugcauuaucgcauacuggcgauauggcagcuggcugggggccauuuccugucccaucugccgucagacaguuacuuugcuccugaccguguuuggagaggacgaucagucucaagacguccugagacuccaccaggauauaaacgacuacaauaggcgguucucgggccagccucgcucaaucauggaaagaauuauggauuuaccaacacugcuuaggcaugcuuuucgggagauguucagcguggguggguuguuuuggauguuccgcauccgaauuauccugugucuaaugggagccuuuuucuaucucauaaguccccuggacuuugugccugaagcgcuuuucggcauucugggcuucuuggaugacuuuuucgucaucuuucuccuguuaauuuacaucuccaucauguacagagagguuauuacccaaaggcugacucgguga

SEQ ID NO: 61907 - RNA, 1779 nt, Artificial Sequence
  derived and/or modified sequence opt3 from RNF180__Homo_sapiens__NP_001107033
augaagagaagcaaagagcugaucaccaagaaccacucccaggaagagacaucuauucucaggugcuggaaaugucggaagugcauagccucaaguggcuguuucauggaauaccuugagaaucaagugaucaaagacaaggaugacagcgucgaugcucagaacauuugccauguuuggcacaugaauguggaagcacugcccgaguggaucuccuguuugauucagaaggcccaguggacuguagggaaauuaaacugcccuuuuuguggagcgcgccuggguggcuucaauuuugugucuacgccaaagugcucgugugggcaacuagcugccguccaucucucaaaaagccgaaccgacuaucagccgacacaggcaggacgucugaugagacccagugugaaguaccuuucccacccuaggguucagucuggcugcgauaaagaggcccuguugacuggugggggaagcgaaaaccggaaucaucgccuccugaacauggcuagaaauaacaaugacccaggcaggcugaccgaggcacucuguuuagaagugcggcccacauauuucgagaugaagaacgagaagcugcuuuccaaagccucagaaccuaaguaccaauuguuugucccacagcuggugaccggccgcugcgcuacucgagccuuccacagaaaaagucacagccuagaucucaauaucucugagaagcugacacuucugcccaccuuguaugaaauacauuccaaaacgacugcguacucaaggcucaacgagacccagccuaucgaccugagcggguuaccacugcagaguucuaagaauagcuauagcuuucaaaacccgucgucuuucgaucccuccaugcuccuucagcgguuuucaguagcaccucacgaaacacagacucaacguggaggugaguuccagugcggccuggaggccgcuaguguuuacagcgaccauaccaacacaaauaacuugaccuuucuaauggaucugccauccgccgggcgcucuaugcccgaagcaagcgaccaggaggaacaccucucaccucuggauuuccuucacagugcuaauuuuucccugggaagcauuaaccagagauugaauaaaagggagcggucuaagcucaagaaccugcgacgcaaacaaagaaggcgggaacgcugguuacagaagcagggcaaauacucagguguggggcugcuagaccauaugacgcucaauaacgagaugaguacugacgaggauaaugaauaugccgaggaaaaggacagcuacaucugugcggucugccuggauguguauuucaacccauacauguguuaucccugccaccauauuuucugugagccgugccuuagaacauuggccaaagacaauccuuccucuacccccuguccacugugcaggacuaucauaucgcguguguuuuuccagacagaacucaacaaugcaaccaagacguuuuucaccaaggaguaccugaaaauuaagcaauccuuucagaaauccaacucagcuaaguggccucuucccaguugucggaaagccuuccaccuguuuggaggcuuccgaagacaugcugccccagucacaaggcgccaguuuccccacggcgcacaccggauggauuauuugcauuucgaggacgauucuagaggguggugguuugacauggauaugguuaucauuuacaucuacagcgugaauuggguaaucggauucauuguguuuugcuuccucuguuauuucuuuuucccuuuuuga

SEQ ID NO: 61908 - RNA, 744 nt, Artificial Sequence
  derived and/or modified sequence opt3 from RNF182__Homo_sapiens__NP_001158506
auggccagccagcccccugaggacaccgcugaaucccaagcaucugaugagcuggaaugcaagaucuguuacaacagauauaaucucaaacagaggaagccaaaagugcuugagugcugucaccgggucugcgccaagugucuguacaaaauuauagacuucggcgauucaccgcaggggguuaucgugugccccuuuugucgcuucgaaacaugcuugccugacgaugagguaaguagcuuaccagacgauaacaauauucuggugaaccuaacuuguggagguaagggcaagaaaugccuccccgagaauccuacggaacugcuucugaccccaaagcgauuggcgucccucgucucucccucgcauacaucaagcaacugucuggugaucacuauuauggagguucagcgugaaaguuccccuucucugagcuccaccccaguggucgaguuuuauagaccggcuucauucgacagugugacaaccguaagccacaauuggacuguuuggaacugcacaucucucuuauuucaaaccuccaucagggugcuggucuggcuuuuggggcugcuauacuucucaagccucccccugggaauauaucuucuggugaguaaaaaggugacguugggcgucguuuuugugucucucguaccuuccagccuggugaucuuaauggucuacgguuucugccagugugugugccaugaguuucuggauuguauggccccacccucguga

SEQ ID NO: 61909 - RNA, 2517 nt, Artificial Sequence
  derived and/or modified sequence opt3 from RNF19A__Homo_sapiens__XP_005250910
augcaggagcaagaaaucggcuucauuagcaaguacaacgaggggcugugcgugaauaccgaccccgucuccauacucacaucuauccuugauaugucacugcacagacagaugggaagugacagggauuugcagagcuccgccucuucgguuucauuaccuagcgugaaaaaggcuccaaagaagcggcgcauuaguaucgguucccuguuucgacguaaaaaggacaacaagagaaaaucuagggaacuaaauggcgggguagauggaauugcaagcaucgaguccauacauucagaaauguguacugacaagaacaguaucuucagcacgaauaccucuuccgauaacggccucacaucaauuagcaaacagaucggugacuuuauugagugcccgcugugucuucugcggcacaguaaggaucgcuuccccgacaucaugacuugccaucacagaucuuguguggauugcuugaggcaauaucuccggauagagauuuccgaaagccgcgucaauaucucguguccugagugcaccgaacgauuuaacccacaugacauuagacugauccugucugaugacgugcucauggagaaauacgaggaguucauguuaaggcgguggcugguugccgaccccgauugucguuggugcccugcgccagacuguggguaugcugugaucgccuuuggaugcgcauccugccccaaacuuacauguggccgcgaaggcugcgggaccgaguucuguuaccacugcaagcagauuuggcacccuaaucagacuugugaugccgcuagacaggaaagggcacaaucauugcggcugcgaacaauacgcaguagcuccaucucuuauagccaggaaucaggagccgcugccgacgauauuaaaccaugcccgagaugugcggcauacaucauaaagaugaacgacgguaguugcaaucauaugaccugugccgucugcggcugugaguuuugcuggcuaugcaugaaagagauuuccgaucuccacuaucugagccccucuggguguacguucuggggaaagaaaccuuggucaaggaagaaaaagauccuuuggcagcugggcacuuuggugggugcuccaguagggaucgcccucauugcaggaaucgcuauucccgccaugauaaucggcauuccuguuuacgugggccggaagauccauaaccgcuacgaagggaaagacgucaguaagcacaaaagaaaucuggcgaucgccggaggugugaccuuaagcgugauugucuccccaguuguggcagcuguaacagugggcauagggguccccaucaugcuggccuauguguacggaguugugccgauuucucucugcaggucgggcgguuguggggucagcgcuggcaacggaaagggcgugcguaucgaguuugaugacgaaaaugauauuaacguagggggaacuaacaccgccguugacacaaccuccguggcagaggcccggcacaauccuucaaucggugaaggcagugucgggggacuuacgggcucucugagcgcuuccgguucacauauggaccgaauaggggcgaucagagauaacuugagcgagacugcaucuacaauggcccuagcuggcgccuccauuaccggaagucugagcggcucugcaauggugaauugcuucaacaggcucgagguccaggccgacgugcaaaaagaacgcuauucccugucaggggagaguggaacuguuagccuugguacagugucggauaaugcuuccaccaaggccauggcaggcucuauccugaacagcuacauucccuuggacaaggaaggaaauucaauggagguacaggucgauaucgaaaguaaaccauccaaguuucggcacaacucugggagcuccucaguggacgauggcagcgcgacgagaagucaugcuggugggucuuccagcggccucccugagggaaaaucgucagccaccaaguggucuaaagaggcaacagccggcaagaagaguaaauccgggaagcugaggaaaaagggaaauaugaaaauaaacgaaacucgcgaggacauggaugcucaguuacuggaacaacagagcaccaauucuagcgaguucgaggcccccucccuaucagacaguaugccaagcguugcagauucucacuccucacauuucagugaauuuagcuguuccgaccucgagucuaugaagacaucgugcagccacggcucauccgauuaucacacucgauucgcuaccgugaacauucugcccgaagucgagaaugaccggcuugaaaacaguccucaucaguguucuaucagcgugguaacacagaccgccuccugcucagaggugucucaauugaaucacauugcggaggaacaugguaacaacgggaucaagccaaauguugaccuguacuuuggagaugcccucaaagagacuaacaauaaccacagccaccagacgauggaacugaaggucgcuauacagacagagaucuga

SEQ ID NO: 61910 - RNA, 2049 nt, Artificial Sequence
  derived and/or modified sequence opt3 from RNF207__Homo_sapiens__XP_011539741
augcccgaggaagccagcccugcuggccacccagaggacaccagaagggggaucccgcgggugggaguccgccgaggucguagaggccaugggaggggacggccccgcgcagaaugggagccuuccccaggcgccggucugaacuuccaggggagacuccuucugggaagggcgacagcucggugcuugcgcgcccgacccggcgcagccuuaagagcucuggauggcgggagggaagcacggcguacuggaucuucacaacagagugguccugccgacguuggcagcuaccuacgcgcuccagggggacccgagcucccuggcuguccagagcacccgcccgccggugugccugcgguaccaagagcagugagggcccccgucuccucugggcuguuuccucggcuucugugccgauugccagcuuggccccgcgauagaaggccgccucaucuccccgccgugccagacguugaaacgaccuauuucuguaauacaugcggacagccucugugugcacggugccgcgaugagacucacagagcuaggauguuugcccgucaugacauuguggcgcugggccagcggucgcgagaugucccccaaaaguguacccuccacgccgaaccauacuuacuguucucaacagacaaaaaguugcuucugugcauaagauguuuuagggauaugcagaaagagagccgcgcacacugcguggaccuagagagugcuuauguacagggcugugaacggcucgagcaggccguucuggcugugaaggcccuucaaaccgcaacuagagaagccaucgcucuguugcaggcgauggucgaggaagugaggcauuccgcagccgaggaggaagaugcuauucacgcccucuucgggucuaugcaggaccgccuggcagagcgaaaagccuuacugcuccaggcugugcaaagccaguacgaagagaaggauaaggccuuuaaagaacagcuuucccaucuggcaacauugcuacccacccugcaaguccaccucguuaucugcucaaguuuccugagccuugcgaacaaggcugaguuucuggacuugggauaugagcucauggaacggcugcaggguauugugacgcguccucaccauuuaagaccaauccagucuuccaaaauagccucagaccacagggcagaguucgcccgcugccuggaaccgcuacuccugcuuggcccccggagaguagcugccgcagcuagcggggccaauacuuuggcgggaggccuggguccuaaggcccucaccgggccacauugucccaguccugugggcaaaaugucuggauccccaguccagaagcccacacugcacaggagcaucucgacuaaggugcuucuggcugagggcgaaaacaccccguuugcagagcauugccgacacuacgaggauucuuaucgccacuugcaagccgaaaugcagucccucaaagaccagguucaggagcugcaucgggauuuaacaaagcaccauucacugauuaaagcugaaaucaugggggacgugcuacacaagagucuccaacuggauguccagauugccagcgagcacgcaucccuugagggaaugagagugguauuccaggaaaucugggaggaagcguaccagaggguugccaaugagcaagaaauauacgaggcucaguugcaugaccugcuccagcugcgucaggagaacgccuauuuaaccacgauuacuaaacaaaucacaccuuacgugcgcucuauugcaaaggucaaagaacggcuggagccaagauuucaggcucccguggaugaacagagcgagucacuucaaaauacccacgacgauaguaggaacaaugccgcauccgcccgaaacaauccugguagcguccccgaaaagcgggagaagacuucugagccaaaaggcaacucaugggcuccuaauggguugagugaggaaccccuccugaagaacauggaccaucaccgcagcaaacagaagaauggaggcgaugugccaacauggagagaacauccgaccuga

SEQ ID NO: 61911 - RNA, 2928 nt, Artificial Sequence
  derived and/or modified sequence opt3 from RNF20__Homo_sapiens__NP_062538
augagcggcaucgggaacaagagagccgcuggagagcccgguaccuccaugccuccagaaaagaaggcagccguggaggacucuggcacaacugucgaaacgauuaaacuugggggaguuucaaguaccgaggaacucgauauaaggacacuucagacuaagaaucggaaacuggcggagauguuggaccaacgccaggcuaucgaggaugaauuacgagagcacauugaaaagcuggagcguagacaggccaccgacgaugcaagccuacucaucgugaacagguacuggucccaguucgacgagaauauucggaucauacugaagcgcuaugaucuugaacaaggccugggugacuugcucacagagagaaaagcccugguagugccggaacccgagccugauucugacucgaaccaggaaaggaaggaugaccgggagcgcggggagggacaggaaccagcuuuuucauuccuggcaacccucgccagcaguuccucugaggaaauggagagccaguuacaagaacgagucgaguccucaagaagggcugugagucagaucguuacuguguacgauaaacugcaggagaaggucgaacuuuugagccggaaacuuaauucuggcgacaaccuaauuguggaggaagccguacaggagcucaauuccuuucuggcgcaagaaaacaugcgucuucaggagcugacagacuugcuccaggagaagcaucgcaccaugucacaagaguucagcaagcugcagaguaaaguugaaacggcagaaucuagaguguccgucuuagagagcaugaucgaugaccugcagugggauauugacaagaucaggaaacgggagcagcgacucaaucgccaccuugccgaagugcuggagagagugaacucgaagggcuauaaagucuacggggcuggaucuuccuuguaugguggcacuauaaccauuaaugccaggaaguuugaagagaugaacgcagaacuagaggagaauaaagaacuggcucaaaaccggcucugcgagcuggaaaagcugcgccaggauuucgaggaaguuacaacucagaaugagaagcugaaaguggaguugagaucagccguagaacagguggucaaggagacccccgaauacagguguaugcaaagucaguuuagcgugcucuauaacgagucccugcaguuaaaagcgcaucuggacgaagcccguacacuacuccacgggacccggggaacgcaucagcaccaaguugagcugaucgagcgagaugaagugucucuucacaagaaauugagaacugaggucauucagcuggaagacacacucgcacaggugaggaaggaguacgagaugcugcgcaucgaguucgaacagacccuugcugccaacgaacaagcuggcccuaucaaucgggagaugagacaucugauuagcucauugcagaaccacaaucaucagcucaagggugaaguacugagguacaaacgcaaguuacgagaggcccaaagugaucugaacaaaacucggcuacguuccgggagcgcacuccugcagucucagucaaguacagaggacccaaaggaugaacccgccgagcuuaaaccugacagcgaagacuuguccucucagucgagcgcuuccaaggcgucacaagaggaugcaaaugaaauaaagaguaaaagagacgaggaggaaagggagcgcgaacggagagagaaggaaagggagcgagagcgcgaacgggagaaagaaaaggagagagagagggaaaaacagaagcugaaggagucugaaaaagagcgugauagcgccaaggacaaagaaaagggaaaacacgaugacggccgcaagaaagaggcugagaucauuaagcagcucaagaucgaacugaaaaaggcccaggagucccaaaaagaaaugaaguuacugcuugauauguaucggucagcaccaaaagagcagagagacaagguucaguugauggccgcugaaaagaaaagcaaggccgagcucgaggaucugaggcagcgacuaaaagaccuggaagauaaggagaaaaaggaaaacaagaaaauggcagacgaggaugcgcuccggaagauacgcgcuguggaggaacaaauugaguaccugcagaaaaagcuggccauggcaaaacaggaagaggaagccuugcugucugagauggacgucaccggccaggcuuuugaggacaugcaagaacagaauaucagauuaaugcagcaacucagggagaaggaugacgccaacuucaagcugauguccgaacggaucaaaaguaaucagauucacaaacuucugaaagaggaaaaggaggaguuggcagaucaggugcucacgcugaaaacccaggucgacgcucaacuacaggugguucgaaagcuggaagagaaagaacaucuccugcagagcaacaucgggacaggagagaaggaacuugguuugagaacucaggcccuggagaugaauaagcgcaaagcgauggaggccgcucaauuagcagaugaccucaaggcccagcuggaacuugcucagaaaaagcugcacgauuuucaggacgagauuguggaaaacucuguaaccaaagagaaggauauguucaauuuuaagagggcccaagaagacauaucccgucuacggagaaaacucgagacaacuaagaaaccggauaacguccccaagugcgacgagauccugauggaagagauuaaagauuauaaggcaagguugaccuguccuugcuguaauaugcgcaagaaagacgcggugcugacaaagugcuuccauguuuucuguuuugaaugcgugaaaacccgauacgacacuagacagcggaaguguccaaaaugcaacgccgcuuucggcgccaacgauuuucacaggaucuauaucggguga

SEQ ID NO: 61912 - RNA, 15624 nt, Artificial Sequence
  derived and/or modified sequence opt3 from RNF213__Homo_sapiens__NP_001243000
auggagugccccagcugucagcacguguccaaggaagagaccccuaaauucugcucucaauguggcgaaagacugccaccggccgcucccaucgcagacucagagaacaauaacaguacaauggccagcgcguccgaaggggagauggagugcggacaggaacucaaggaggaagguggcccuugucuuuuuccagggucugauucguggcaggagaaucccgaggaaccuugcucaaaagcuagcuggacuguccaggagaguaagaaaaagaagaggaaaaagaaaaagaaaggaaacaaguccgccucuagcgaacuggcauccuugccauuaucacccgccaguccuugucaucugacgcuacucagcaauccauggccgcaagacaccgcucugccccacucucaggcacagcaguccggcccuacaggucaaccaucacagcccccugggacugccaccacaccacuugagggagauggccugagcgcucccaccgaaguuggcgacaguccguugcaggcccaggcgcucggggaggcaggaguggccacugguucugaggcucaauccagcccucaguuccaggaucauacagaaggcgaggaccaagaugccucgauucccucugggggacggggccugucccaggaagguaccgggccaccuacgucagcaggagagggccacagucgcacugaagacgcugcccaggagcugcucuuacccgagagcaagggcggguccucugaaccaggaaccgagcugcagacaacugaacaacaggcgggugccagcgcaucaauggcuguagaugccguggcugagcccgccaacgcagucaaaggcgccgggaaggaaaugaaagagaagacccagcgaaugaaacagccuccagcuacaaccccgcccuuuaagacgcauugccaagaggcggaaacuaaaacaaaggacgagauggcagccgcugaagagaaggugggaaaaaaugagcagggcgaaccugaggaucuuaagaaaccagaagguaagaaccguagugccgcagccguuaaaaaugagaaggaacagaagaaccaggaggcugacgugcaagaggucaaagccuccaccuugagccccgggggcggagugacuguauucuuucacgcaauaaucucucugcacuucccuuuuaauccagaucuacauaagguuuucauuagaggcggggaagaguuuggagaaucaaaaugggacaguaacaucugugagcuccacuacacaagggaccugggucaugaucgggugcuugucgaaggcauugugugcaucagcaagaaacaccuggacaaguauauacccuacaaguaugugaucuacaauggggaguccuucgaguaugaauuuauuuacaaacaccagcagaagaaaggagaguaugucaaccgcuguuuguucaucaagucuucgcuccugggcagcggugauuggcaucaguacuacgacauuguuuauaugaaaccgcacgggagauuacaaaaggugaugaaucauaucaccgauggcccuaggaaggaccugguaaaaggaaagcagauagcggcugcccucaugcuugauuccacguuuucaauucugcagaccugggacacaaucaacuugaacaguuucuucacucaauuugaacaguucugcuuugugcuacagcagccaaugauuuacgagggccaagcacagcuguggaccgaucuccaguaucgggaaaaagaggucaagcgcuaccuguggcagcaccuuaaaaagcaugugguuccccugccugacgggaaaucuacagauuucuugcccguggacugcccaguccgaagcaagcucaagacuggacugaucguguuauuuguaguugagaaaaucgaacugcuacucgaggguucccuggacuggcuuugucacuugcugaccucagaugccagcucuccugacgaauuccacagagaucucucccauauucugggcauaccccaaaguuggaggcuuuaucuggugaauuugugccagcgguguauggacacacguaccuacacuuggcucggggcucugccagucuuacacugcuguauggagcuggccccgcgccauaaggaugcauggagacagccugaggacacgugggcugcccuagaaggacucagcuuuucucccuucagggagcagaugcuggauacauccucacuuuugcaauuuaugcgggaaaaacagcaccugcucaguaucgacgagccacuguuccgaagcugguuuucguuacugccccuuucccacuuggugauguauauggaaaacuucauugagcaucucggccgcuuuccugcgcacauccuggauugccuaucugguauauacuacagacugccagggcucgagcagguccugaauacccaagacgugcaggauguucagaacgugcagaauauucuugaaauguugcugagguuacucgacacuuaucgggauaagauccccgaggaagcccugagcccuucauaccuuaccguaugucugaaauugcaugaggcuaucugcaguuccacaaagcuccugaaguucuaugaacuaccggcacugucugccgagauugucugucgcaugaucagacuccugagccuuguggacuccgcuggccaaagggacgagaccggaaacaauucaguucagacuguguuccagggcacauuggccgcaacgaaacguuggcugcgggaagucuuuaccaagaacauguuaacuagcaguggggcgucuuucacauacgugaaagagauugaaguauggcgaagacucguggagauacaguuuccagccgaacacggauggaaggagucccugcuuggcgauauggaguggaggcugaccaaagaagagccccuaagccaaaucacagcuuauugcaauucguguugggacacuaagggucucgaagauucaguugccaagaccuucgagaaaugcauuaucgaggcagucucuagugcuugccagucccagacgagcauccugcagggguuuucuuacagcgacuugcgcaaguucggaauugugcuguccgccgugauaaccaaaucauggccucggacagcagauaacuuugacgauaucuuaaagcaucuccugacucuugccgacgucaaacacguuuucagacuguguggcaccgaugaaaagauuuuggcuaaugugacagaggacgcgaagaggcucaucgccguggcagauaguguacugacuaaagucgugggugaccuacugagcggcaccauucuuguugggcaacucgaacugaucauaaagcacaaaaaccaguuuuuggauaucuggcagcugcgcgagaagucuuuauccccacaggacgaacaaugcgcuguggaggaggcccucgacuggcgacgggaagagcugcuucuguugaaaaaggaaaaacguugugucgauucacuccugaagaugugcggaaaugugaagcaucuaauucagguugacuucggcgugcuggccguaagacacagucaggaucuuagcuccaaaaggcucaacgacacggucacagugcgccugucuaccucgagcaauucacaacgggcuacucauuaucacuuguccagucaggugcaggagauggcagggaagaucgauuuacugagagacucucauauuuuucagcucuucuggagggaagccgcggagccccugagcgagccuaaagaagaucaagaggcugccgaacuucuguccgagccggaagaggagucagaacgacacaucuuggagcuagaagaggucuacgacuaccuguaucagcccucuuaccgcaaguuuauaaaacuccaccaggaucugaagagcggagagguuacacuugcagaaauugacgugaucuucaaggauuucguaaacaaauauaccgacuuagacagugagcugaagauuauguguacuguggaucaucaggaccaacgggauuggaucaaagacagagucgaacagauaaaggaguaccaccaucuccaccaggccgugcacgcugcaaaaguuaucuugcaggugaaggaaucccugggccucaacggugauuuuagcguccugaauacccuucugaacuucacagacaauuuugaugacuucaggcgugagacguuggaucaaauuaaccaggagcuaauccaggccaagaaacugcuccaagacauuucugaagcgcgcugcaagggguuacaggcucugucacuucggaaagaguuuaucuguugggugagagaagcccugggaggcauaaaugagcucaagguuuucguggauuuggcauccauuagugccggugaaaacgacaucgaugucgacaggguagcuugcuuucaugacgccgugcagggcuaugcaagccugcucuucaaacuggauccaucgguugacuuuucugcuuucaugaagcaccuuaagaaacuauggaaggcccuggauaaagaccaguacuugccucgaaaguuaugugauuccgcgcggaaucuggaguggcucaaaaccgugaacgagagccaugggucagucgaacgcaguucucugacucuugccacagcaaucaaucaaagaggaauuuaugugauccaggcucccaagggcgggcagaagauuuccccagacaccguacugcaccucauauugccugagagccccggaucacaugaagagaguagggaauacagccuggaggaggugaaagaacuacugaacaagcucaugcuuauguccggcaaaaaggaucggaauaacacagaggucgaacgauuuucugagguuuucugcagcgugcagagacugucccaagccuucaucgacuuacacucagcugguaauauguuguuucgcacuuggauugcaauggccuacuguucuccaaaacagggggugagucugcagauggauuucggacucgaccuggucaccgagcuuaaggaaggcggugaugugacggagcugcucgccgcuuugugcaggcagauggaacacuuucuggacucguggaaacguuucguuacacaaaagcggauggagcauuuuuauuuaaacuucuacaccgcggaacagcuaguauaucugagcacugagcucagaaagcagccgccuuccgaugcagcccuuaccaugcugucuuuuaucaaaucaaauugcacauugagggacgugcugcgcgcuagcgucggcuguggguccgaggccgcacgauacagaaugcggagggugauggaagagcucccccugaugcuucucagugaauucucucugguugacaaguugcgcauuaucauggagcagagcaugcguugccugccagccuuuuuacccgauugucuagaccuggaaacucucggacacugccuugcucaucuggcgggcauggggggaucaccuguggagagauguuugccacggggccugcaagucggucagcccaaccucgugguaugcgggcacuccgagguccugccugccgcacuugcuguguauaugcagaccccgagucaaccauuacccacauacgaugaaguucugcucuguacgccugccaccacuuucgaggaaguggcauugcugcuaaggcgcugccugacacucggaagccuuggccacaaagucuauucucuguuguuugccgaccagcuguccuacgagguggcucgacaggccgaagagcucuuccauaaccuguguacccagcaacacagagaggauuaccaguuaguuauggugugcgacggcgauugggaacauuguuaucuucccucagcguuuagccagcacaaggucuucgugacuccacaggcaccucuggaggccauacaagcuuaccucgccgggcauuaucggguacccaaacagacacuaucggcugcagccguguucaaugacaggcugugcguuggaaucgucgcuucugaacgcgccggugugggcaagaguuuguacgugaagagacugcacgauaaaaugaagaugcagcucaacgucaaaaauguaccacuuaagaccauuaggcugaucgacccucagguggaugagucccggguuuugggggcacugcucccguuuuuagacgcgcaauaucagaaagugcccguccuguuccaccuugacgugacgagcucaguucagacuggaauuuggguguuucuguucaagcuacucauccugcaauacuugauggauauaaacggcaagauguggcugcguaauccaugccaucucuauauugucgagauccuugaacgccgaaccuccgugccuucuagaagcaguuccgcccugaggacacggguaccccaguuuagcuucuuagacaucuuuccaaaagugaccugucgcccucccaaggagguuauugauauggaacugucugcuuugagaucagacacugagccggguauggaucucugggaauucugcagugagacauuucagaggccauaccaguaccugcggcgauucaaccaaaaucaggaccuagauaccuuucaguaucaggagggguccgucgaaggaacaccugaggaaugucuucaacacuuccuguuucauugcggcgugauaaaccccagcuggucugagcucagaaauuucgcccgcuuccugaacuaccaguugagggacugugaagcaucgcuguuuugcaauccaucauucaucggcgauacucuccggggguuuaaaaaguucguggucaccuuuaugauuuucauggcucgugacuuugccacgcccagccuucacacauccgaucagaguccuggaaaacacaugguuaccauggacggugugagagaggaggaucuggcaccguucucuuuaaggaagcgcugggaaagcgagccccauccauauguauuuuucaacgacgaccacacuaccaugacauuuaucggcuuccaucugcagccuaauauuaacggguccguggaugccaucucacacuugacuggaaaggucauaaaacgggacgugaugacccgagaucucuaccaaggccugcuacuucagagaguucccuuuaauguggacuucgauaagcugccuaggcauaaaaagcucgaacgccuguguuugacguuagguaucccacaggcuacagaccccgauaaaaccuaugagcugacuacagacaacaugcucaagauucuugcgaucgaaaugcgguucagaugcgggauuccugucaucauaaugggagagaccggcuguggcaaaacucgucugauuaaguuucuaagugaucugaggcgggggggaacaaacgccgacaccaucaagcucguaaaagugcacgguggcacgacugcagauaugaucuacucucgcguucgagaggcugaaaauguggccuucgccaacaaggaccaacaccaguuggacaccauucuguuuuucgaugaggcaaauacaaccgaagcuaucagcugcauaaaagagguccuuugugaccauaugguggaugggcagccacuggccgaggacuccggacuccacauuaucgcggcuugcaaccccuauagaaagcauucagaagagaugauuugcagguuagaaagcgccggccuggguuaccgggucucuauggaggaaacagcagaucgcuugggguccaucccgcugagacagcucguguacaggguucacgcccuuccuccaagucugauaccccuagugugggacuuuggacaacugagcgauguagcugagaaacucuauauucagcagaucgugcagcgauuggucgagucgaucucccuggacgaaaauggcacucggguuauuaccgaggugcuuugugcaucucaaggcuucaugcguaagacggaagaugagugcucauuugucagccugagagacguggaacgcuguguaaagguguucaggugguuucaugagcacagugccauguuacucgcgcagcugaacgcuuucuuguccaaaucuagcguuucaaagaaucacacagagcgggauccugugcuguggucccucaugcuugccaucggggucugcuaccaugcaagucuggaaaaaaaggacagcuauagaaaagccauugcucgcuuuuucccaaagcccuacgaugacucuaggcuacugcucgacgagauaacucgagcccaggauuuguuucuggacggagugccguuacggaagaccaucgcaaaaaaccuugcucugaaggaaaaugucuucaugauggugguuuguauugagcucaaaaucccucuguucuugguagguaagcccggcucauccaaaagccuggccaagacaaucguggcggaugccaugcaggggccagcagcuuauucugaccucuuuagaagucuuaagcaaguccaccuggugucguuccagugcuccccucauagcaccccccagggaauuauaucaacuuuuaggcagugugcccgcuuccaacagggcaaagaucuacagcaauacguuucuguggucgugcuggacgaaguagguuuagcagaggauagcccaaagaugccccucaaaacccugcacccuuugcuugaggacgggugcaucgaagaugacccagcuccgcacaagaaagugggauuuguuggcauuuccaacugggcccuggaucccgccaagaugaaucguggcaucuucgucagucgggggucaccuaacgagacagaacucauugagucugcgaaaggaaucuguagcuccgacauacuggugcaggauagagugcaggguuauuuugcuaguuucgcaaaggccuacgagacggucugcaagaggcaggacaaagaauuuuucggcuugcgcgacuacuauagccugaucaagaugguuuuugcugccgcaaaagccuccaaucgaaagccaucuccccaagauauugcucaggcggugcuacggaacuucucagggaaagacgauauccaggcccucgacauuuuucuugcaaaucugccugaggcuaaguguagcgaagagguaucgccaaugcaguuaaucaagcaaaacauauucggacccucccagaaagugccuggcggugaacaggaggaugccgagaguagauaccugcucguccugacuaagaauuauguggcauugcagauucuucaacagaccuucuuugaaggggaccagcaaccggagaucauuuucggcucuggauuuccaaaagaucaggaauacacacagcugugcaggaacaucaaccgcguuaagauaugcauggagaccggcaaaauggugcuccugcuaaauuugcagaaccuguaugaaagccucuacgacgcccuuaaucaauauuacguccaucuggggggacagaaguacguggauuuaggucugggcacucacagaguaaagugucggguucaucccaacuucaggcucaucgugauugaggagaaagacgucguguauaagcacuuuccuaucccccugauuaaucguuuggaaaaacauuaccuugauaucaacacagugcuggagaaguggcagaaaucaauagucgaagagcucugcgcuuggguugaaaaguucauuaaugugaaggcccaccacuuucagaaacgacauaaguauuccccaucugacguauucaucggguaccacagugacgcgugugcaagcgugguccugcaagugaucgagcgccagggaccuagagcccuaaccgaggaauuacaucagaaaguuuccgaggaagcuaagucaauucuguugaacugcgccacgcccgaugcagugguccggcucagcgcuuauucucugggcgguuuugccgcugaguggcuuagucaggaguacuuccacaggcaacgccacaauuccuuugccgacuuccugcaggcacaucuccacacugcggaucuggaaagacaugccaucuuuacagagauaaccaccuucagccgguugcuuacuucacacgacugugaaauucuggagucugaagugacagggagggcuccaaaaccgacccuacucuggcugcagcaguucgauacagaguauuccuuuuuaaaggagguacgaaacugccugacuaauacggccaaguguaaaaucuugauuuuccaaaccgacuuugaagauggcauccguucggcacagcucauagcuagcgccaaguacaguguuaucaacgagauuaauaaaaucagagaaaacgaggaccgcauuuucguguacuuuaucacaaagcugucucgggucggaaggggcacugcauaugugggguuccauggaggucuuuggcaguccguucacauugaugaccugagacgcagcacccucauggugucagaugucacacgguugcaacacgugaccaucagucagcuguuugccccuggcgaccuucccgaacugggguuagagcauagggcggaggauggacacgaagaggcuauggaaacugaggccuccacgagcggcgaaguagcagagguggccgaggaagcuauggagaccgaaucuucagagaaagucgguaaggagacaagcgaacuagggggcuccgacguuucuauacucgacacuacccgacugcugagaaguugcgugcagucggccgucggaauguugcgggaucagaaugagagcuguacaaggaacaugcgccgugugguacuccugcuuggccuguuaaacgaagacgaugcaugccaugcuuccuuccucagagugucaaaaaugcgacugucuguuuuuuugaagaagcaagaggaaagccaguuccacccacuugaguggcuggccagggaggcguguaaucaggacgcucuacaggaagccgggaccuuucggcauacucucuggaaacgcgugcaaggagcagucacaccccugcuggccaguaugauuuccuucaucgauagagacggcaacuuggagcuccugacgaggccugauaccccacccugggcucgggaccuuuggauguucaucuuuucagauacuaugcuguuaaauauuccucucgugaugaacaaugaacgccacaagggugagauggcauacauaguuguccagaaccacaugaaucugucugaaaacgccagcaauaacgugccguucuccuggaaaaucaaggacuaucuagaggaguugugggugcaggcgcaguacauuacagaugccgaagggcugccaaaaaaguuuguagacaucuuccaacagaccccccuuggaagauuucucgcucagcugcauggcgagccucaacaggaacuguugcagugcuaucuuaaggauuucauucuccugaccaugcgagucaguacagaggaagaguuaaaauuucugcagauggcacuauggagcuguacuaggaagcucaaagccgcuucugaggccccagaagaggaagugucacugcccuggguucacuuggcauaccaacgguuccguucccgccugcagaauuuuagcagaauccuuacgauauauccucaggugcuccauagucugauggaggcuagguggaaccacgaguuagccgguugcgaaaugacccuggacgcguucgccgcaauggcuugcacagagauguugacucggaauacccucaagcccucuccacaggccuggcugcaacuugucaaaaaccuguccaugccgcuagaacucaucuguucggacgagcacaugcagggcagcgggucacuggcacaggccgugauuagagaaguucgcgcucaguggucccgaaucuuuucuacagccuuguucguggagcauguacugcuuggaaccgagaguagggucccugaacuccaaggccuggugacugagcacguguuuuuacuggauaagugcuugcgggaaaauagcgacguuaagacgcaugggcccuucgaggcggucaugagaacacucugugaaugcaaagagaccgcuucaaagacucugucccguuucggaauucagccauguagcaucugccuuggcgaugcaaaagacccugugugucugcccugcgaucacguacauugucuacgcugccucagggccugguuugcuucugagcagaugauauguccauacugccugaccgccuugccugacgaauucagucccgcagugucccaagcccaccgggaggcuauugaaaagcacgcgagauuucgacagaugugcaacagcuucuuugucgaucuggugucaacaaucuguuucaaagacaacgccccgccagagaaggaaguuaucgagucucuuuuaucgcugcucuuugugcagaaggguaggcugcgcgaugcagcccagcggcauugcgagcacacuaaaagccuauccccuuucaaugacgucguggauaagacccccguuauuagaagugugauauugaaacugcuccuuaaguacucuuuucaugacguaaaagacuauauccaagaauaccugacacuccugaagaaaaaggcuuucauuacggaggauaagaccgaauuauauauguuguuuaucaacugucuggaggacucaauucuugagaaaacuagcgcauacuccaggaaugaugaacugaaccaccucgaggaagaggggcgcuuccugaaggccuauaguccagcuucucguggacgggaacccgccaaugaggcgagcgucgaguaccuacaggaaguggcaagaauccgacuuugccuggacagggccgcugauuuucucuccgagccugaaggcgguccggagauggccaaagaaaagcaguguuauuugcagcaaguuaaacaguucugcauacgcguggagaacgacuggcaccgggucuaccuggugagaaaguuaucaagccagaggggcauggaguucguacaggggcugucuaagccaggacgcccccaucaauggguguuuccuaaagaugucguuaagcagcagggccucagacaggaccaccccgggcaaauggaucgguaccuuguguauggagacgaauacaaagcacugcgagaugcuguggccaaggcggucuuggaguguaaaccacugggcaucaagacagcccucaaggcuugcaaaaccccucagucccagcaaagugcauauuuccuacugacucuuuuuagggaaguggccauucuguaccguucacauaaugcuagccuccaccccacaccagagcagugugaagcaguuucgaaguucaucggugagugcaaaauuuuguccccuccggacaucucuagauuugccaccagucugguagauaacagcgugcccuuacugcgggcugggccaucagacuccaaucucgacggaacggucaccgagauggccauucaugcagccgcggugcuucuguguggccagaacgaauugcuggagccucucaagaaucuagcuuucucucccgccacaauggcacacgccuuucugccaacuaugccugaagauuuacuggcucaggcccgcagguggaaaggccucgagcgaguucacugguauaccugccccaacgggcauccgugcagcgugggagagugugguagaccaauggaacaaaguauaugcaucgacugucacgcaccuauuggcgggaucgaucauaagccccgggacggauuccaccuugucaaggauaaagcugaccgcacacagacuggccacguguuggguaauccacagaggagagauguagugaccugcgaccgggggcugcccccugucguuuuucugcucauccgucuucugacacauuuggcccugcuccuaggagcgucccagagcucucaagcacugauuaacauaaucaagcccccagugcgcgauccuaaaggcuucuuacagcagcacauucuuaaggaccuggagcagcucgccaaaauguugggccauucagcugaugaaaccaucggggucgugcaccugguucugaggcgacuccuucaagagcagcaucagcuguccagcagacgguugcuaaauuuugacacugaacugaguacgaaggagaugaggaacaacugggagaaagaaauugccgcugugaucucuccggagcucgaacacuuagauaagacacugcccaccaugaauaaccuuauaucacaagacaagcgcaucuccagcaauccaguagcaaaaauuaucuacggagacccugugacuuuccugccccaccucccaagaaagucggucgugcauuguucuaaaauuuggaguugccggaagaggaucaccguugaguauuugcagcacauagucgaacagaaaaacgguaaggagcgcgugccuauucuguggcauuuucugcagaaggaggccgaacuccgacuagugaaauuccugcccgagauccuugcguugcaaagagaucugguaaagcaguuccagaauguccagcaaguggaauacuccagcauucguggcuuucucucaaaacacucuagcgacggguuacggcagcugcuucauaacaggaucacaguuuuccuguccacguggaauaagcuccgcagaaguuuggagaccaacggagaaauaaaucugccgaaagauuacuguucaacugaccuagaucuggacacagaguuugagauccucuuaccucggaggcgaggccugggucuuugcgccaccgcucuggugagcuauuugauuagacuccacaacgaaaucgucuacgcaguggagaagcuguccaaggaaaauaacucuuauaguguugaugccgcugaggugacugagcuucacgucauuagcuacgaaguggagcgcgaccugacaccacucaucuuguccaauugucaguaucagguagaagaggggcgggaaaccgugcaagaguucgaucuggagaaaauacagaggcagauuguuucacguuuuuuacagggaaagcccagacugucucucaaaggcaucccuacacuagucuaccgccaugacuggaacuaugaacaccuguucauggauaucaagaauaaaauggcccaagacucgcuuccaagcuccgugauuagugcaaucucuggccaguugcagagcuacucagacgccugcgaggugcuguccgucguugaagugacucucggguuucugagcaccgcuggaggugaucccaacaugcaacuuaacguauacacgcaggacauacugcagaugggcgaucagaccauucaugugcucaaggcguugaauaggugucaacugaagcacacaaucgccuuauggcaguuccuaucugcacacaaaagugagcagcugcuccggcugcauaaggaaccuuuuggggagauuuccucacgauauaaagcugaccuuagcccagagaacgccaaguugcugucuacuuuccucaaucagaccggacuggaugcauuuuuacuggaacuucacgagaugaucauacucaaacugaagaacccccaaacacagacugaagagagauuccgcccgcaguggucguugagggacacccuagucuccuacaugcagacgaaggaaagugagauccugccugagauggccagccaauuucccgaagagauucuccuggcuucaugcgugucuguuuggaaaacagcggccgugcuuaaguggaaucgggaaaugagauga

SEQ ID NO: 61913 - RNA, 2112 nt, Artificial Sequence
  derived and/or modified sequence opt3 from RNF214__Homo_sapiens__NP_997226
auggccgcuagcgagguggcaggcgucguugccaacgcgcccuccccuccagaaucuucaagucugugcgcuagcaaguccgacgaggggcucccggauggacuuucuaccaaagacucggcccagaagcagaaaaauucaccccuguugagcgugaguucccaaacaaucacuaaggaaaacaauagaaacguacacuuagagcauucugaacagaauccugguagcuccgcaggcgauacgucagccgcucaccaggugguccugggggagaaccuaauugcaaccgcccucugucugaguggaagcggcucucaauccgaccuuaaagauguggcuucaacagccggugaggaaggggacacuagccugagggagaguuugcauccaguuacccggucucucaaggcgggaugccacacaaagcagcuggcaucccgcaauuguagcgaagagaaaucgccccagaccucuauacugaaggagggcaaccgagauacuucccucgacuuccguccuguggucucaccagccaauggcguggaagggguaagaguugaucaggacgaugaccaagauaguagcuccuuaaaacugucucagaacaucgcugugcagacagacuuuaagaccgccgacagcgaggucaauacggaucaggacauugagaaaaaccuugauaagaugaugacugaaaggaccuugcugaaggaacgguaccaagaggugcuagacaaacagcgccagguggagaaucaacuccagguccagcugaagcagcuucaacagagaagggaagaggaaaugaaaaaccaucaggagauccugaaggcaauucaggauguuacaaucaaacgggaagagacuaagaaaaagauagagaaggaaaagaaagaguucuugcaaaaagaacaggaccucaaggcugagaucgaaaaacugugcgagaagggacgccgagaggugugggaaauggaguuagauagacugaagaaucaggacggugaaauuaacaggaacaucauggaggagaccgaacgggccuggaaagcggagauucucucacuugaaagucguaaggagcuguugguacuaaaacuggaagaggccgagaaggaagcagagcuccaccugacauaucuuaaauccacgcccccuacccuggaaacugugcgcagcaagcaggagugggaaacaagauugaauggcgucaggaucaugaagaaaaacgugcgggaucaauuuaauucucacauacagcucguucgaaacggggcuaagcugucaaguuuaccacagauuccgacccccacucugccuccacccccuagcgagacagacuucaugcuacagguguuucaaccaucccccucucucgccccgcgcaugccuuucucgaucggacaggucaccaugcccauggugaugccaagcgcugauccuagaucccugucauuucccauucuuaauccagccuugagucagcccucucaaccuagcuccccacugccgggcucacaugguaggaacagccccgggcucggaucucugguauccccucacggcccacauaugcccccugcagccaguaucccacccccgccuggccuugggggaguuaaagcuagcgcggagacgccacggccccagccuguggacaagcuggagaaaaucuuggaaaagcuccugacccgcuucccccaguguaauaaggcacagaugacaaacauuuuacaacagauaaaaacugccagaaccacaauggcuggucugacuauggaggaacuaauccagcucgucgccgcaaggcuggccgaacacgagcguguggcugccucuacccagccacuuggccggauucgagcauuguuuccugcgccccuggcucaaaucuccacaccaauguuccucccgucagcccaggucaguuacccugggagaagcucgcacgcacccgcuaccugcaagcuguguuuaaugugccagaaacuggugcagccauccgagcuucaucccauggccuguacucacguuuugcauaaggaaugcauaaaauuuugggcccaaacgaauacaaacgacaccuguccuuucugcccaacucucaaguga

SEQ ID NO: 61914 - RNA, 2601 nt, Artificial Sequence
  derived and/or modified sequence opt3 from RNF216__Homo_sapiens__NP_996999
auggaggaaggcaacaauaacgaggaagugauccaccugaauaacuuccauugccacagagggcaggaguggauuaaucucagggacggacccauaaccaucagcgauuccucugacgaagaacggauuccuaugcuugucacaccagccccgcaacagcaugaggaagaggaucuggacgaugacguuaucuugacugaagaugacucagaggaugacuacggugaguuuuuagaucuggggcccccuggcauuagugaguucacgaagccaagcggacagaccgagcgcgaacccaaaccuggcccaucccacaaccaggcugcaaaugacaucgugaacccccgaucugagcaaaagguaauaauccuagaagaggguucgcuccuguauacagagucagauccucuugaaacucagaaucagagcagugaggacuccgaaaccgagcuguugucuaaccucggggaaagcgccgcgcuggcugacgaucaggccauugaggaggacuguuggcuggaucauccauacuuucaaucccucaaucagcagccgcgugaaaucacaaaccagguggucccccaagagagacagccugaagcagaguuaggaaggcugcuuuuccagcacgaauuuccaggccccgccuucccucggccagagccccaacagggcgggauuucaggaccgaguagcccucagcccgcucacccauugggugaguuugaagaccagcaacuggcaucugaugacgaggaaccuggccccgccuucccaaugcaggagucccaggagcccaaucuagaaaacaucugggggcaggaggcugccgaaguggaucaagagcucguugaacugcuugugaaagagaccgaggcgcgcuuuccugacgucgcaaauggauucauagaagagauuauccauuuuaagaacuauuacgaucugaacguguugugcaauuuccuccuggaaaacccagacuauccgaaaagagaggauaggauuaucaucaaucccucaagcaguuuacuggccucucaggacgaaacuaagcucccuaagauugacuuuuucgauuacuccaaacuuacaccacuggaccagcgguguuucauacaggcugccgauuugcuaauggcagacuuuaagguacugagcucgcaagauaucaaaugggcucuccacgagcugaagggccauuaugccauuacccgcaaagcgcuuucugacgccaucaagaaguggcaggagcugucccccgaaacgucagguaaacgaaagaaaagaaagcagaugaaccaguacaguuacauagauuucaaauuugagcaaggggacauuaagaucgagaaaaggauguucuuuuuggagaauaagcggcgucacugccgcagcuaugauagaagggcacuccugccugcuguucagcaggaacaagaguucuacgagcagaagaucaaagaaauggccgagcacgaagacuuuuuacuggcucuacagaugaacgaggagcaguaucaaaaggauggacagcucauugaaugucggugcuguuacggcgaguucccauuugaagaacugacucagugcgccgacgcacaucuuuucuguaaagaaugcuugauccgauaugcccaggaggcuguguuuggcuccgggaagcuggagcucucuuguauggaaggaagcuguaccugcucauuccccacaagugagcuggaaaaaguccuuccgcaaacuauucuguacaaguauuacgagcgcaaggcggaagaggagguggcagccgcuuacgccgaugaauuggugagaugcccuuccugcagcuuuccagcacuccuggacucugacgucaaaagguucucaugucccaauccucacugccggaaggagaccugucgcaaaugccaggguuuauggaaggaacauaacggccugacaugugaggaacuagccgagaaagaugacauaaaguauagaaccaguaucgaggaaaagaugacggcugccaggauucguaaaugccacaagugugggacuggacucaucaaaagcgagggcugcaaucggauguccugucgaugcggugcacagaugugcuaccuguguagaguuucuaucaacggguaugaucauuucugccagcaccccaggucgccaggcgcgccuugucaagaaugcagccgcuguucccuuuggacagaccccaccgaggaugacgagaaguugauugaagagauacagaaagaagcugaggaggaacagaagcggaagaauggagagaacacuuuuaaaagaaucggcccaccgcuggaaaagccuguggagaaaguacaaaggguggaagcccucccccgcccagucccccagaaucugccucagccacagaugcccccuuacgcauucgcccacccgccauuucccuuaccuccagugcgacccguuuucaacaauuuuccucugaacauggggccgauucccgcuccauaugugccuccccuuccaaacguccgggugaauuacgauuucggaccuauccauaugcccuuggagcacaaccucccaaugcauuuugguccgcaaccucgucacagauucuga

SEQ ID NO: 61915 - RNA, 447 nt, Artificial Sequence
  derived and/or modified sequence opt3 from RNF24__Homo_sapiens__NP_001127809
augagcuccgacuucccccacuacaacuuuagaaugccuaauaucggcuuccagaaccugccacucaauauuuauauaguggucuuugggaccgccaucuucguuuuuauucuuucucuguuguucugcuguuacuuaaucaggcugcggcaucaagcucacaaggaguuuuaugcauacaaacaggugauucuaaaggaaaaaguaaaggagcucaaccugcaugaacuuugcgccgugugucuggaggauuucaaaccgcgcgacgaauugggaaucugccccuguaagcacgcguuucaucgaaagugccucauaaaauggcuggagguccguaagguguguccucugugcaauaugccaguucuccaguuagcucagcugcacucaaaacaagauagaggucccccucagggcccacuucccggggccgagaacaucguguga

SEQ ID NO: 61916 - RNA, 864 nt, Artificial Sequence
  derived and/or modified sequence opt3 from RNF2__Homo_sapiens__XP_005245470
augugccccaucugucuggacaugcucaagaacaccaugacaacuaaagagugccuucacagauucugugccgauugcauuauaacggcucugaggagcggcaauaaggaauguccuaccugccggaaaaaguugguguccaaacgcucuuuacgaccagacccgaacuuugaugcacugaucucaaagauuuaccccagucgugacgaguaugaagcccaucaggagagaguccuagcgaggaucaauaagcacaacaaucaacaggcucucagccauuccauugaagaggggcugaaaauccaggccaugaaccggcuucagcgcggaaagaaacaacagauagagaaugguucuggcgcagaagauaacggggacucgucacacuguagcaaugccaguacacauuccaaccaggaggcuggaccuucuaauaagagaacuaaaaccagcgaugacuccggccuggaauuggauaacaauaacgcagccauggcuaucgacccaguuauggauggugccucagagauugagcucguguucaggccccacccuacacugauggaaaaggacgauagugcgcagacccgguacaucaagacuagcgggaaugcaacaguagaccaccugucuaaauaucucgccgugcgcuuagcucuggaggaacuucgauccaagggagagucaaaccaaaugaacuuggacaccgccagcgaaaaacaguacacgauuuauaucgcaacugcuaguggccaguuuaccguccugaauggcucuuucucccuagagcucgugagcgagaaguacuggaaaguuaacaagccaauggaacuguauuacgcccccacaaaagagcauaaguga

SEQ ID NO: 61917 - RNA, 3219 nt, Artificial Sequence
  derived and/or modified sequence opt3 from RNF31__Homo_sapiens__NP_060469
augcccggcgaggaagaggaaagagccuuccugguggcuagggaggaacucgcaagcgcccuucggcgcgacuccgggcaggcguuuucucuggagcaauugcgaccuuuacuggcuucaagucuaccacucgccgcacguuaccugcagcuugaugccgcuagacuggucaggugcaacgcacacggagagccgcggaauuauuugaacacccucagcacagcccugaauauccuggaaaaguacggucgcaaccucuuaucuccccagagaccuagguauuggcggggcguuaaauucaauaacccaguguuucgcuccacuguagacgcugugcaagggggacgagauguccugagacuuuacggcuauacggaggaacagcccgacgguuugucguucccugaggggcaggaggaaccagaugagcaucagguggccaccguuacacuggaagugcuacuccugaggacugagcuuucacuguugcuccagaauacccacccccggcaacaggcgcuggaacaguuacuggaggacaaggucgaggaugacaugcuccagcuuagcgaauuugauccucuguugcgugagauugcaccaggaccgcuaacaacccccagugugccuggcuccacuccaggccccuguuuccugugcgggucugccccuggaacacuccauuguccaagcugcaaacaagcucugugucccgccugcgaccaccuuuuucauggucacccgucccgcgcacaccaucugagacagaccuugccuggcguacuccaggggacgcaccugucacccaguuuaccagcuagcgcccaaccuaggccccagucuacuucccugcuagcgcucggagauucaagccugaguucuccaaaccccgccuccgcacaucuuccuuggcacugugcugccugcgcuauguugaaugaaccaugggccguucuguguguggcaugcgaccggccgcgaggcuguaagggucucgggcugggaaccgagggcccccagggcacagggggacuugaaccugaucuggcccgcgguagaugggcuugccagagcugcacuuucgagaacgaggcggcagccgucuuguguucgauaugcgaaaggccacggcucgcucaacccccuucucuggugguggacucccgcgacgccggcaucuguuuacagccacugcagcagggggaugcacuacucgccucagcucaaagucaggucugguacugcauucacuguaccuuuugcaauagcucccccggauggguuugugugaugugcaacagaacaucuagcccgaucccugcccagcaugcaccaaggcccuaugcgucaagucuggagaaaggcccucccaagccagguccuccccgucggcuuuccgcuccauugccgagcucuuguggggacccugaaaagcagcgacaagauaaaaugagagaggaaggccugcagcucguaucaaugauuagggagggagaggccgcaggcgccugccccgaagagaucuucagugcucugcaguacagcgggaccgaagugccauuacaguggcugcgcuccgagcuucccuacgucuuggagaugguggccgaacucgcaggacaacaggacccuggucugggcgcuuuuucuugucaggaggcccggagagcguggcuagauaggcacgggaaucuggacgaagccguugaggaaugcgugcgcacgcgacggcguaagguccaagagcuccagucgcugggauucggcccagaggaagguagccuucaggcuuuguuucagcaugggggcgauguguccagagcacugacugaguuacaaaggcagcgccucgaacccuuccggcagagacugugggacucaggaccugagccgacaccaaguugggauggccccgacaaacagucucuuguaaggcgacuguuggccguuuaugcucucccuagcugggggcgcgccgaacuggcacuaucccugcuccaagagaccccacggaacuacgagcugggagauguggucgaagcggugagacacucacaggacagggccuuccuucgucgcuugcuggcucaggagugcgccgucugugguugggcauuaccccauaaucggaugcaggcucucacuagcugcgaauguacaauaugcccugacuguuuuagacaacacuucaccaucgcccugaaggagaaacacauuacggauauggugugcccggcauguggcaggcccgaccuuaccgaugacacacagcugcuaucuuauuuuuccacucucgauauccagcugcgagaaaguuuggagccagacgccuacgcucuguuccauaagaaguuaaccgaggggguucucaugcgggauccuaaauuucuguggugcgcgcaauguagcuucggauuuauuuaugaacgcgagcagcuugaagccacaugcccccagugucaccagacuuucugcgugagaugcaagaggcaaugggaggagcagcaucggggccgaucuugugaagacuuucagaacuggaaaagaaugaacgauccagaguaccaggcacaaggucuggcuauguauuugcaggaaaaugggaucgacugcccuaaguguaaauucuccuacgcccucgcccgcggcggaugcaugcacuuucacuguacccagugcaggcaucaguucuguucaggcugcuacaacgcuuuuuaugcaaagaauaaaugucccgagccaaacugccguguaaagaagagucugcacgggcaucacccgcgggauugucuauucuaccugagagacuggacagcccuuaggcuccaaaaacuguugcaggauaauaacgucauguucaauaccgaaccucccgcgggagcucgcgccgugccaggcggugggugccgaguuauagagcagaaggaggugcccaacggacugagagacgaagcaugcggcaaagagacuccugccgguuaugcuggcuuaugucaggcacauuacaaggaauaucucgucagccugauuaaugcccacucgcuugacccagcgacgcuguacgagguggaagaguuggagacagcuaccgaacgguaucuccacguaaggccccaaccucuggccggggaggauccgccagcauaccaggcccgccuacugcagaaacuuacugaagaggugccccucggacaauccaucccucguagacggaaguga

SEQ ID NO: 61918 - RNA, 1119 nt, Artificial Sequence
  derived and/or modified sequence opt3 from RNF34__Homo_sapiens__NP_079402
augaaggccggcgcuaccagcaugugggcauccugcugugggcugcucaacgaggugaugggaacaggugccgucagaggccagcaaucugcguucgcuggggccacuggacccuuuagguucacgccuaauccagaauuuucaaccuacccgcccgcagccacagagggcccuaacaucguuugcaaagcauguggucuuaguuucagcguguuucggaagaaacacguaugcugugacugcaagaaagauuucuguuccgugugcucuguccugcaggaaaauuugcgccgauguucgacuugccauuuacugcaggagaccgcuuuucagcguccacaacuaaugagacucaaggugaaggaccugaggcaguaucuuauucugcggaacauacccaucgauacaugucgcgaaaaagaggacuugguugaucucgugcugugccaccaugggcugggaucagaggacgauauggacaccagcagucucaauuccucuagaagccagacuuccucauucuuuacaaggaguuucuuuagcaacuacaccgccccuucugcuacgauguccucauuccagggcgaauuaauggauggcgaccaaacuagccggaguggggucccagcccaggugcagucugagauuaccuccgcgaauacagaagaugacgaugacgacgaugacgaggaugacgaugacgaggaagagaacgcagaagaucgcaaucccggacugagcaaggagcgaguaagagccucgcuuucugacuuguccucacuggaugacguugaagguaugagugugaggcagcuaaaagagauccucgcucggaacuuugucaauuauagcggcugcugugagaagugggaacugguggagaaagugaaccgucuuuacaaggaaaaugaggaaaaccaaaaguccuauggggagcgccugcaguugcaggaugaggaagacgacucucucugcagaauuuguauggaugccgucaucgacugcguucuguuagaguguggacacauggugacuugcaccaaauguggcaagaggaugagcgaaugcccuauaugucggcaauacguagugcgagcaguccauguguucaaaucauga

SEQ ID NO: 61919 - RNA, 1263 nt, Artificial Sequence
  derived and/or modified sequence opt3 from RNF39__Homo_sapiens__NP_079512
augugguggagagaccugaccaggcuccggcuuuggcugaagcgcgaggccauccccggcgaagggcgaaaagcugcaaaggugaacgccggagucggugagaaaggcauuuacacagcgagcucccgugggggaccuccaucugcuagaucaaaggccguuacugugguagcagaaggcgccgcuaguaggagcugguuguccauggaugcaccggaguuaggucccgggcugguggaacggcuagagcagcucgccacgugcccucuguguggaggcucuuucgaggacccaguccuucuggcuugcgaacacucguuuugucgcgccugcuuggcgagaagguggggcacacccccugcaaccgggacugaggccucaccaaccgcuugucccugcuguggacucccuugcccacggcgcagccugcgaaguaaugugagacuggccguugaagugaggauaucccgggagcuccgugagaaauuagcagaaccgggugcucgcgccggcagaaggcgagggggacggauccccacaaugggcugucuggaucuuccuggugaggacaugcgcaagaccuggagaagguucgaagucccaacuucuaagagcuccaacucagaggaugacuugcccgaagauuauccugugguuaaaaagaugcugcaucggcuaacagcggaccucacccuggauccagggacggcccaccgcagacuucugauuagugcagacaggcguagcguacaauuggcucccccgggaacuccugcacccccagauggcccuaaacgguuugaccagcuccccgcugugcugggcgcccagggguucggagcaggucgacauugcugggaggucgagaccgccgaugcugcgucuuguagagacuccucaggcgaagacgcagaugacgaggaaagccacuacgccgugggggcugccggagagagugugcagaggaagggcugcguccgcuuaugcccagccggugccguuugggcuguggaagggcggggcggaagacugugggcccucacagcacccgagccuacucuucugggcgggguagagccaccgcccaggcgcauccgaguggauuuggacugggaacggggacgugucgcguuuuaugaugguagaucucuagaccugcucuacgcuuuccaagccccuggcccacugggggagaggauuuuuccccuuuucuguaccugcgauccucgcgcaccacugcggaucgugcccgccgaauccuga

SEQ ID NO: 61920 - RNA, 2706 nt, Artificial Sequence
  derived and/or modified sequence opt3 from RNF40__Homo_sapiens__NP_001193963
augagcggccccgggaacaagagagccgcuggagacgguggcuccgggccuccagagaaaaagcugucuagggaagagaaaaccacaacuacgcucaucgaaccgauucggcuuggaggcauaucaaguaccgaggaaauggaucugaagguguugcaguucaaaaauaagaaguuagcagagcgccuggagcaacgacaggccugcgaagacgagcuacgugaaagaaucgagaaacucgagaagaggcaggcgacagaugacgcuacucugcuuauugucaaccgguacugggcccagcuggaugaaaccguugaggcauugcuccgcugucacgaaagccaaggugagcuguccucugcccccgaagcuccugggacacaggagggaccaaccugcgacggcacuccccugccugagccaggcacaucggaacucagagaucccuuacugaugcagcuuaggccuccauugucagagccggcacuggccuuugugguagcucuaggggccagcaguuccgaagagguggaacucgagcugcagggacggauggaguucucuaaagcggcagucagccgcgugguugaagccuccgaccgacuucaaagaaggguggaggaacugugucagcgggucuauucacguggugauagugagcccuugagcgaagcugcccaggcacauacccgcgagcucggcagagagaauaggcggcugcaggacuuagcuacgcaacugcaggaaaagcaccaucgaaucucucucgaguacuccgaacuucaggauaaagugacuucagccgagaccaagguacuggagauggaaacaacuguugaggacuugcaaugggauauugaaaagcuacgcaaaagagagcagaagcugaacaaacaccucgcggaagcccuggagcagcuuaauagcggguauuacgugaguggaucuuccagcggcuuucagggugggcaaaucacccugucgaugcagaagucugacgaguugggacuccagaaaaagcugaggacagaagucauacaguuagaggacacccuggcacaagugcggaaagaauaugagaugcuacgcaucgaguucgagcagaaccucgcugccaaugagcaggcuggcccuauuaacagagaaaugaggcaucugaucuccucacuucagaaucacaaccaccaauugaagggcgaugcccagcguuacaagcggaaacugcgagaggugcaggcagaaauugggaagcucagagcccaggcuaguggaagcgcgcauuccacgccaaaucugggucaccccgaggacucuggcgucagcgccccugcaccagggaaagaagagggaggccccgguccgguuucaacuccugauaacaggaaggagauggcucccgugccagggacaaccacuacaaccacgagugugaaaaaggaagaacuuguaccuuccgaagaggacuuucaaggcaucacccccggagcccagggcccaagcucucgcgggcgggagcccgaagcaagaccuaagagggagcugcgcgaacgagagggaccaucauuggguccgcccccugucgccagugcucucagccgggccgaucgugaaaaagcaaagguggaggagacaaaaagaaaggaauccgagcuguuaaaaggccugagggcggaacuaaagaaggcucaggagucucaaaaagaaaugaagcuccugcuugacauguauaaaucggccccaaaggagcagcgcgauaaaguucaguugauggcagccgagcggaaggcuaaggccgaaguggacgagcugagaagcaggauacgagaacucgaggaacgcgaucggagagaguccaaaaagauugcagacgaggaugcucugaggcguauccgccaggccgaggaacaaauugaacauuuacagcggaaacugggggcgacuaagcaggaggaggaagcccuuuugucagagauggacgucaccggacaggcuuucgaagacaugcaagagcagaauggcagacuccugcagcagcuaagggaaaaagaugacgcaaacuuuaagcugaugagugagcgaaucaaagccaaucaaauccacaagcuccugcgggaggaaaaggaugagcuuggugaacagguguuggggcugaaaucucagguagacgcucaauuacucacaguucagaagcuggaggaaaaagagcgcgcccuucagggcagccugggaggcguggagaaggaauugacucucagaucccaggcacuggagcuaaacaaaaggaaggcggucgaagccgcucaacuggccgaggaucucaaggugcagcuggaacacguccagacccggcuucgagagauucagcccugcuuggcagagucaagagcugcccgcgaaaaagagagcuucaaccugaagagggcacaagaagacauaucucguuuacggagaaaacucgagaagcagaggaaaguggagguuuacgccgaugcugacgaaauccugcaggaggaaauuaaggaguacaaggcgcgccuuacauguccuugcuguaauacccgaaagaaagaugccgugcugacuaaaugcuuucauguauucuguuuugaaugcgucagagggcgguaugaggcaaggcagcgcaaguguccaaaaugcaacgcugccuucggagcccacgacuuucaucguaucuacauauccuga

SEQ ID NO: 61921 - RNA, 954 nt, Artificial Sequence
  derived and/or modified sequence opt3 from RNF41__Homo_sapiens__NP_001229755
augggcuacgacgugaccagauuccagggggaugucgacgaggaucugaucugccccauuuguagcggaguucucgaggaaccugugcaagccccacacugcgaacaugcuuuuuguaacgcaugcauaacacagugguucucccagcagcaaacuuguccgguagacaggucuguggucacgguggcccaccuucggcccguuccucgcaucaugcgaaauaugcugucaaaguugcagauugcgugcgauaacgcuguguuugguuguagugccgucgugcguuuagacaaucugaugagccaucuauccgauugcgagcacaacccaaaaagacccguaaccugugaacagggcugcgggcucgagaugccuaaggacgagcugccaaaucauaacuguaucaaacaccuuaggucuguugugcagcaacagcagacacggauugcagaacuggagaagacuucggccgaacacaaacaucaguuggcugagcaaaagcgcgauauccagcuccugaaggcauauaugagagccauaaggucagucaaucccaaccugcagaaucucgaggaaaccaucgaguacaacgaaauuuuagagugggugaauagccugcaaccugcucgggugacacgcuggggaggcaugaucaguaccccagacgccguccuucaggcgguuauuaaacgauccuugguggaaucugguugcccggcaagcaucguaaacgagcugauagagaaugcccacgaaagauccuggccccaggggcuagcuacucucgagacaaggcagaugaaccggcguuauuacgaaaauuauguggccaagcgcauuccuggaaaacaagcagucgugguuauggcuugcgagaaccagcauaugggcgaugacauggugcaggaaccaggccuggucaugaucuucgcccacgggguggaggagauuuga

SEQ ID NO: 61922 - RNA, 2352 nt, Artificial Sequence
  derived and/or modified sequence opt3 from RNF43__Homo_sapiens__NP_060233
augagcggcgggcaccagcugcaacucgccgcucuuuggcccuggcuguugauggcaaccuuacaggccggauucgguagaacaggccuggugcuagcggcugccgucgaguccgaaaggucugcagagcagaaggccaucauucggguuauaccucucaaaauggacccaacugggaagcugaaccuuacgcuggaaggaguguuugcuggcguagcagagaucaccccggccgaagguaaauugaugcagucacauccccucuaccugugcaaugcuagugaugacgauaaccuggagccuggguucauuagcaucgugaagcucgaguccccacgccgagcaccccguccuuguuuaucucuggcgucgaaagcaagaauggccggagaaaggggcgcuucagccguccuuuuugacauuacagaggaucgggcagcugccgaacaauugcagcagccacugggccuaacuuggcccgugguucucaucugggggaaugacgcggagaagcugauggaguucguguauaagaaccagaaagcccacguccgcauagaacuuaaggagccuccagcauggccggauuacgacguguggauccugaugaccguaguuggaacaauuuuugugaucauuuuggcuagcguccucagaaucaggugccggccccgccauagucgaccugauccacugcaacagagaaccgccugggcuauaucccaguuagccacuaggcgguaucaggcaucuugucgucaagcccgcggugaauggcccgacagcggcuccucaugcaguagcgcuccugugugugcgauuugccuggaggaguucucugaggggcaggagcucagagugaucuccugucuucacgaauuucauaggaauugcgucgauccauggcugcaccagcaccggacaugucccuugugcauguucaacauuaccgagggagacucauuuagccaaagucuaggcccgucucgauccuaccaggaaccuggucgcagacugcaucucaucaggcagcaccccgggcaugcacacuaucaucugccagccgcuuaccuucugggaccuagccggucggccguugcaaggcccccaagacccggcccuuucuugccaucucaggagccgggcauggggcccaggcaccaccguuuuccucgggccgcucauccacgagcccccggagaacaacagagacucgccggugcgcagcacccuuaugcucagggcugggggcugucccauuuacaaucaacgagucagcacccagccgcaugucccgugccgcugaggcgcgcccggccuccagauagcuccggaucuggcgagagcuacugcacugagagaucagguuaccuagcugacgggcccgccagugacuccagcucuggcccuugccacggaucaaguagcgauuccguagugaauuguaccgacaucucucuccagggcguccaugggucgagcuccacauucugcucaagucugucuagcgauuuugacccccuuguguauuguuccccaaaaggagauccucagaggguugacaugcaacccucagugacuagccgcccacgaucuuuggauuccgucgugccgaccggugaaacacagguaaguagccacguucauuaccaccggcaccgucaucaccauuauaagaaaagauuccaguggcacggcaggaagccugggcccgagaccggagugccacagucucggcccccuauuccacgcacgcaaccccagccugaaccgccaucccccgaccagcaagucacuagaucaaacagugcagcuccuagcggcaggcugucgaauccacagugcccccgagcccucccugagccggcgcccgguccaguggaugccuccucuauauguccuagcacaucaagucuguucaaccuucagaaguccucucugagcgcucgccauccccagcggaaaagacgcgggggcccauccgaaccuacccccggaucacguccacaagacgcaacuguccacccggccugccagaucuuuccucacuacacacccagcguggcuuauccauggagucccgaggcccauccuuugauuuguggcccacccgggcucgauaagcgccuguuaccugagaccccgggaccaugcuacucuaauucccagcccguuuggcugugucuaacgccucggcagccccucgaaccacacccucccggugagggcccaagcgaauggucgucagacaccgcagaggggagaccuugcccguauccccauugucaagugcugucugcgcagccaggaagugaggaagaacuugaagaguugugcgaacaggccguauga

SEQ ID NO: 61923 - RNA, 1056 nt, Artificial Sequence
  derived and/or modified sequence opt3 from RNF44__Homo_sapiens__XP_005265902
augcugcaccccgccacccagcaaagcccuuucaugguggaccuccaugagcagguccaccagggcccaguuccgcuuuccuacacagugacuacgguaaccacacagggguuuccccugccuacuggacaacauaucccagguugcucugcucagcaguugcccgcauguucagugauguucaguggccagcacuauccuuuaugcugucugccacccccucuaauucaagccugcaccaugcagcagcucccagucccguaccaggcguauccccaucugauaagcuccgaucacuacauccuucacccuccacccccugcuccacccccgcaaccuacacauauggcaccccuggggcaguuugugucuuugcagacccaacacccaagaaugccucuccagaggcuggacaacgauguugaccugcggggagaucagcccucgcucggcucauucacuuauagcacaagugccccaggucccgccuuauccccuucugugccacugcauuaccuuccgcacgaccccuugcaccaggaacugagcuuuggggucccuuauucccauaugaugccacgccgacuaucaacccaacguuacagacuccagcagccccugccuccacccccgccuccacccccucccccaccuuacuaucccaguuuccuuccauacuuucugagcauguugccgaugucuccuacggcuaugggacccacuauuucccucgaucuggacguggaugacguagagauggaaaauuaugaggcauuacugaaccucgccgaaaggcuuggcgaugcuaagccacggggccugaccaaagccgacaucgagcaguugcccucauaccgcuucaauccugauagccaccaaagugagcagacacuauguguugugugcuuuucugacuucgaagcgagacagcugcucaggguccugccauguaaccaugaguuucacacuaagugcguggacaaauggcuuaaggcaaaucggaccugucccauuugccgcgccgaugcuuccgaagugccucgagaggccgaguga

SEQ ID NO: 61924 - RNA, 342 nt, Artificial Sequence
  derived and/or modified sequence opt3 from RNF4__Homo_sapiens__NP_001171939
augagcaccagaaagaggcggggcggggccaucaacucccgccaggcucaaaaacgaacacgugaggcaacuucuacgcccgaaauuucacuggaggccgaaccuauagagcucguggaaaccgcgggagacgagaucgucgaucuuacaugcgagagucuggaaccaguugugguagacuugacucacaaugauagcguggucauuguggacgguccgcagguuuuauccgugguccccucugcuuggaccgauacacagagaucguguaggauggacgugagcucauucccucagaacgccgcaaugaguuccguagccucugcuagcguuaucccauga

SEQ ID NO: 61925 - RNA, 543 nt, Artificial Sequence
  derived and/or modified sequence opt3 from RNF5__Homo_sapiens__NP_008844
auggccgcugcagaggaagaggacggcgggcccgaaggaccuaacagagagagggguggcgccggggcgaccuucgaaugcaauaucugucuggagacagcucgggaggccguggucagcguuugcggacaccucuacuguuggccaugccuucaucaguggcuggaaacucgcccggagcgacaagaaugucccgugugcaaggcaggcauuucccgugagaaaguagugccuuuguaugguagagggucucagaagccacaggaucccagguuaaaaacgccuccacggccccagggacaacgcccugccccagagucaagaggcggcuuucagccguucggggacaccggagguuuucacuucaguuuuggcgucggggcuuuccccuuuggauucuuuacaacuguguucaacgcacaugaaccuuuuaggcggggcaccgguguugaucuggggcagggacacccagccagcuccuggcaggacucucuauuccucuuucuggcuauauucuucuuuuucuggcuucugucgaucuga

SEQ ID NO: 61926 - RNA, 2058 nt, Artificial Sequence
  derived and/or modified sequence opt3 from RNF6__Homo_sapiens__NP_005968
augaaccagagcagauccaggucugacggcgggucagaggaaacccugccccaagaucacaaucaucacgagaacgaacggcgcuggcagcaggagcgacuccaucgugaagaggccuacuaucaguucaucaaugagcuuaacgacgaagauuacagacugaugagggaccacaauuuguuaggaacaccuggugagauuacgagugaagaacugcaacagcggcuagauggcgugaaggagcagcucgcuagccagccagaccugcgcgaugggacuaacuauagagacuccgaagucccgagggagucuucgcaugaagauucacuucuggagugguugaauaccuuucggcgcacaggaaacgcaacucgaagcggccaaaaugguaaccagaccuggagagccguuaguaggacaaaucccaacaauggggaguuccgguuuucccucgagauacacgugaaccacgagaaucguggauucgaaauccauggcgaggacuacaccgauauuccucugucugacagcaaccgcgaucacacugcgaacagacagcagagguccacaucaccaguagcucggcgaacccgcagucaaacgagcgugaauuuuaacgggucuuccucaaauauccccagaacuaggcuggccagccgggggcagaacccugcagaaggaaguuucucuacccucggucgcuuaagaaauggcauugggggagccgcuggcaucccaagggcaaacgccucccguacaaauuuuagcucgcauacuaaccagucugguggguccgagcugcggcaacgagaaggacagagauucggcgcugcccacgucugggagaauggcgcgaggucaaacgugaccguucgcaauacaaaccagcggcuugagcccauaagauugaggaguaccagcaauucccgcucucgaagcccuauccagcggcaaucagggacgguguaucacaacagucagcgugaauccagaccaguccagcagacuacaaggcgcagcgugcggagaaggggacgaacccgcguauuucuggagcaagaccgggaaagagagaggcgugguacugcauacacaccguucucuaauucacgccuaguuagucggauuaccguggaagagggcgaggaaagcuccagaucuucgacggccgucaggcgacaucccaccaucacacucgaccuucaggugcggcgcauuagaccuggggagaacagggaucgggacagcaucgcuaaccgaacuagaucccgcgugggacuggccgaaaauaccgucacaauagagucaaacaguggcgguuuuaggcguacuauuucucggcuggagagaagcgggaucaggaccuauguuuccacaauuaccgugccauugcgccgaaucucagaaaaugagcucguagaacccagcucuguggcacugagauccaucuuacggcagauuaugacuggcuucggagagcugaguagccucauggaagcugauucugaguccgagcuucagaggaacggccaacaucugccugacaugcacucagaauugaguaaucuagggacggauaacaaucgcagccagcaccgugagggaucgucccaggacagacaggcccaaggugauucuacagaaaugcauggcgagaacgaaaccacucagccacacacccggaauagcgacucaaggggcggacgccagcugcgaaaccccaauaaccucgucgagacaggcacccugccgauacuuagacuggcgcacuuuuucuugcucaaugagagugaugacgaugaccggaucaggggucugacuaaagaacaaauugacaacuuauccacacgccauuacgagcacaauucuaucgauagcgaacuggggaagauaugcuccguguguauuucagacuacguuacgggcaacaaacuaagacagcucccuugcaugcaugaguuccacauccacuguaucgauagguggcugagcgaaaacugcaccugucccauuugccggcagccagugcuuggaaguaauaucgccaacaauggcuga

SEQ ID NO: 61927 - RNA, 294 nt, Artificial Sequence
  derived and/or modified sequence opt3 from RNF7__Homo_sapiens__NP_001188299
auggccgacguggaggauggcgaagagaccugcgcucuggcaagccacuccgggucuucaggaaguaagagcgguggcgacaaaauguucucccucaagaaauggaacgccgucgcgauguggucuugggauguugaaugugacacaugcgcuaucuguagagugcagguaaugguggucuggggagagugcaaucauucguuucacaacuguugcaugucacuuugggugaagcaaaauaacagguguccccugugccagcaggauuggguugugcagcggauugggaaauga

SEQ ID NO: 61928 - RNA, 1458 nt, Artificial Sequence
  derived and/or modified sequence opt3 from RNF8__Homo_sapiens__NP_003949
augggcgagcccggguucuuugugaccggagacagagccgguggcaggagcuggugccugcggcgcgucgggauguccgcuggauggcuccuucuggaagauggcugugagguuacagugggucgaggguucggaguaacuuaccaguuggugucuaagaucugcccuuuaaugauuucacguaaccacuguguccugaaacaaaauccagaaggccaguggacgauaauggacaacaagagucuaaauggcguguggcucaacagagcaaggcuggagccgcuucggguuuauagcauccaucagggggauuacauucagcugggagugcccuuggaaaauaaagagaacgccgaguaugaauacgaggucaccgaagaggacugggagacaaucuauccuugccucuccccaaagaaugaucaaaugauugagaaaaacaaggaacugcgcacuaagagaaaauuuucucuggacgaacucgcgggucccggcgcugaggggccuucgaauuuaaagucaaaaaucaacaaggugagcugugaaaguggacagccaguaaaaucccagggcaagggugagguugccucuacccccagcgauaaucuggacccuaaacuuacagcauuggagccauccaaaaccacuggggccccgauauaccccggauucccuaaggugacagaaguccaccaugagcagaaggcuucaaacaguagcgcaucucaaaggucccugcagauguuuaaggugaccaugucacggauccuacgccucaaaauucagaugcaggaaaagcacgaggccgugaugaaugucaaaaagcaaacgcagaagggcaacagcaaaaagguugugcagauggaacaagagcugcaggaucuucagagucagcugugcgcugagcaagcccagcagcaggcgcgaguagaacaauuggagaaaacuuuccaggaagaggaacagcaucuccagggccuggagaucgcacaaggggagaaggacuuaaaacagcagcuggcccaggcucuccaagaacacugggcccuuauggaggaacugaauagaucuaagaaggauuuugaggcaauuauccaggcuaaaaacaaggaguuggaacagaccaaagaggaaaaggagaaaaugcaagcccagaaggaagaggugcuaucccacaugaacgacguccuggagaaugaacuccaguguauaauuugcagcgaguauuucaucgaagcggugacacugaacugugcccauucguuuugcucuuacuguauuaaugaguggaugaagaggaaaaucgaaugcccaaucugccggaaggauauuaaauccaagacuuacucacuuguucuggacaacuguauaaauaaaauggugaacaauuugaguagcgaggucaaggagcgucgcaucgugcucauuagagaaaggaaggcaaaacggcuguucuga

SEQ ID NO: 61929 - RNA, 1725 nt, Artificial Sequence
  derived and/or modified sequence opt3 from RNGTT__Homo_sapiens__NP_001273355
auggcccacaacaagauucccccuagauggcugaauugcccaaggcggggccagccgguggcugggcgcuuccucccccuuaaaaccaugcugggaccucgauacgacagccaagucgcagaggaaaaccguuuucauccauccauguugucuaauuauuuaaagucacugaaaguuaagaugggucuacucguggaucugacaaacacgaguagauucuacgacaggaaugauaucgagaaagaaggcauaaaguauaucaagcuccaguguaaagggcacggagagugccccacuaccgaaaacacagagacuuuuauucggcugugugagcgcuucaaugaaagaaacccuccagaguugaucggcguacauugcacccacgguuuuaauaggacaggguuccucauuugugccuuucugguggaaaagauggacuggagcaucgaggcggcugucgccaccuucgcacaggcccggcccccuggaauauacaaaggcgauuaucugaaggagcucuuucgccgauacggcgacaucgaagaggcuccaccgcccccuuuacugccagauuggugcuucgaagacgaugaggacgaagaugaggacgaggaugggaaaaaggaauccgagcccggaucuucggcaucauuugguaagagaaggaaagaacggcuuaaguugggcgccauuuuccuggagggggugacuguuaaaggagugacacaggucaccacgcaaccuaagcuaggcgaagugcagcagaaaugucaucaguuuugcgguugggaggggagcggauucccaggcgcucaacccguaaguauggacaagcagaacaucaaacuccuggaccuuaagccguauaagguuuccuggaaagccgauggcacucguuacaugaugcugauugacgggaccaaugagguguucaugaucgaucgcgacaacucugucuuucacgugagcaauuuggaguucccuuuuagaaaggaucucaggaugcaccuguccaacacauuacuggacggagaaaugauaauugaucgggugaauggucaggcggucccccgauaccucaucuaugacauuaucaaauucaacucacagccaguuggcgauugugacuuuaacgugcgccuucaaugcaucgaaagagagauuauaaguccuaggcaugaaaagaugaaaacugggcugaucgauaagacccaggagcccuucagcguacggaauaagccauuuuucgacauuuguacaucucgcaaaaaguacaaacccggaagaugcgacgauaucuugaaguggaaaccuccaucccuaaacucaguggacuuuaggcugaagauaacccguaugggcggugaggggcuccugccgcagaaugucggccuucuguaugugggaggcuacgaacggcccuucgcacaaauuaagguuacgaaagaguugaagcaguaugauaacaaaaucaucgaaugcaaguuugagaauaacagcuggguguucaugcgacagagaacugacaaaaguuuuccuaaugccuacaacacagcuauggccgucuguaauucuauuuccaacccagugaccaaggagaugcuuuucgaguucaucgauaggugcacugcagcuagccaggggcaaaagcgcaaacaccaucuggaccccgauacagaauuaaugccuccacccccgccuaagcggccaagaccccugaccuga

SEQ ID NO: 61930 - RNA, 1386 nt, Artificial Sequence
  derived and/or modified sequence opt3 from RNH1__Homo_sapiens__XP_011518565
augagccuggacauccagucccucgauauucaaugcgaggaacuuucugacgccagaugggcugagcuguugcccuuacugcagcagugucagguggucaggcuagaugacugcggccucaccgaagcacgguguaaggauauaucaagugcccugcgcguuaacccugcgcuugcugagcugaauuugcgaagcaacgaacucggggacgugggaguacacugcgugcugcaaggucugcagacaccauccuguaaaauccagaagcucucuuuacagaauugcugucugacuggcgccgggugcggaguccuuucgucaacguugcguacccugccgacacuacaagagcuccaucugagcgauaaccuucugggcgacgcagguuugcagcuccugugugagggguuacuggauccccagugcagacucgaaaaacuucagcuggaguacuguaguuuguccgccgcuucuugcgaaccucuagcaagcgugcugagggccaagccagacuucaaagagcucacuguuuccaauaacgauauuaaugaggcuggagugcggguccugugccaaggccuuaaggacucacccugucagcuggaagccuugaagcucgagaguugcggcgugaccagcgauaacugucgcgaccugugcgggaucguagcgucuaaagcauccuuaagagaacuggcccuaggaucaaauaagcucggugacguuggcauggcugagcuguguccugggcuuuugcacccaagcaguaggcugcggacacucuggauuugggaaugcggaaucaccgccaaaggcuguggugaucugugccgcgugcuucgagcaaaggagucucugaaagaguugucccucgcugggaacgaacugggagacgagggcgccagauuacugugugaaacucuacucgagcccggcugccagcuggaaagccuuugggucaagucguguucuuuuacagcggccugcugcucccauuucucaaguguguuggcacaaaauagguuucugcucgagcugcagauaagcaacaaucgguuagaggaugcuggggugcgugaacugugucagggacuuggucagccuggcuccgucuugcgcguucucuggcuggccgacugcgaugugucugacagcucauguaguucccuagcugccacccugcucgcaaaccacagccugagagagcuugauuugucuaauaacugccugggggacgccggaaucuuacaacucguagaaucagugaggcagccaggcugucugcuugagcagcuggucuuguaugauauuuacuggagugaagagauggaggaccggcuccaggcucuggaaaaggauaaaccgagccuacgagugaucuccuga

SEQ ID NO: 61931 - RNA, 1029 nt, Artificial Sequence
  derived and/or modified sequence opt3 from RNLS__Homo_sapiens__NP_001026879
auggcccaggugcugaucgucggcgcugggaugaccggaagccucugcgcagcccuucugagaaggcaaacauccggucccuuguacuuagcgguuugggacaaggcugaggauucuggcgggcggaugacuacggccuguucaccucacaacccacagugcaccgcagaccugggagcccaguauauuacauguacuccgcauuacgcuaaaaagcaccagcgcuucuaugaugaacuacucgcauacggcgugcugcgaccccuuaguagcccuauagaggguaugguaaugaaagaaggggacugcaauuuuguggccccacaaggaaucuccucuauuaucaagcauuaucugaaagagucgggcgcugaagucuacuuccgucacagagugacccagauuaacuugagggaugacaagugggagguuucaaagcagacaggcagccccgagcaguuugaucucaucgugcugaccaugccugucccagaaauacugcaacuccagggggacaucacuacauuaauuagugagugucagcggcagcaacuggaagccguguccuauucuagccgcuacgcgcuuggauuguucuacgaggcagguaccaaaaucgauguacccugggccggccaguauauuacguccaauccuugcaucagauuuguuucaauagacaacaagaaaaggaauauugagaguagcgaaaucgggccaucucuggugauucauacuaccgucccguucggagugacauaccuagagcacuccaucgaagaugugcaggagcucgucuuucaacagcuggaaaacauccuucccggccugccucagccaauugcuacuaagugucagaaauggcggcacucacaaguuaccaaugccgcagcuaacugccccggucagaugacauugcaucacaagccuuuccucgccugugggggagacggcuuuacccagagcaauuucgauggcugcauaacgagugcgcuguguguguuagaggcccugaagaacuauaucuga

SEQ ID NO: 61932 - RNA, 1431 nt, Artificial Sequence
  derived and/or modified sequence opt3 from RNMT__Homo_sapiens__NP_003790
auggccaacagcgcuaaggcagaggaauacgagaaaaugucccuggaacaggccaaggcgucugugaauagcgagaccgaaaguagcuucaacaucaaugagaacacaacugcuuccggcacggggcucucugagaaaaccucggucugcagacaaguugacauugccaggaagcggaaagaauuugaggaugaccuugugaaggaaucaagcaguuguggaaaggauacacccuccaaaaagcgcaaacuggacccugagauaguaccagaggaaaaggauugcggugacgcagagggcaauucuaaaaagcgaaagcgugaaacugaggaugugccgaaagacaagagcuccaccggggauggaacacagaacaaaagaaagaucgccuuggaagacguccccgagaaacagaagaauuuagaggaaggccacucaaguaccguggcugcacauuauaacgagcugcaggaaguuggucuagagaaaaggagccaaucucggauuuucuaccuccgcaauuuuaacaauuggaugaaguccgugcugaucggggaguuccuugaaaaggucagacagaaaaagaaaagggauauuacugugcuggacuugggauguggcaagggcggggaucuccugaaauggaagaagggacggaucaacaaacugguaugcacagacauagccgacguuucagugaagcagugucagcaacgcuaugaggauaugaaaaaucgaagagacagcgaauacaucuuuagugcugaguucauuaccgccgauucuuccaaggaacucuuaaucgacaaauuuagggauccucagaugugcuucgacauuuguagcugccaguuugucugucacuauucguucgagucuuacgaacaggcggauaugaugcugcggaacgcaugcgagcgucuuuccccagguggcuauuuuaucgggacgacucccaauucauucgaguugauacgcagacuggaagccagugagaccgaaucauuuggaaacgagauuuacacagugaaguuccaaaagaaaggcgacuacccucuauucgguuguaaguaugauuuuaaccucgaggggguggucgacguuccagaguuccugguguacuuuccccuucugaaugaaauggcuaaaaaguauaacaugaaauugguauacaagaagacuuuccucgaauuuuaugaggaaaagaucaagaauaacgagaauaaaaugcuguuaaagaggaugcaggcccuggagccuuacccagcaaacgaauccucuaaacucgugagcgagaaggucgaugacuaugaacaugcugccaaauacaugaaaaauucacaggugcggcuuccgcugggaaccuugaguaaguccgagugggaagcgacaagcauuuaccuaguuuucgccuuugagaaacaacaguga

SEQ ID NO: 61933 - RNA, 1953 nt, Artificial Sequence
  derived and/or modified sequence opt3 from RNPEP__Homo_sapiens__NP_064601
auggccagcggcgagcacucccccgggucuggagcugcaagaaggccucugcauucagcccaggcgguggacgucgcuagugccagcaacuuccgggcauuugaacuccuucaucugcacuuggauuuacgcgccgaguucgguccaccgggccccggggcuggaucccgaggccugucugguaccgcaguucuagaccuccguugccuggaaccugagggggccgcugaacuuagacuggauucgcacccauguuuggaggugacagccgcggcacucaggcgggagcgccccggaucagaagaaccuccagccgaacccgugagcuuuuacacucaaccuuucagucauuauggccaggcucugugcguauccuuuccacagccguguagagccgcagagaggcugcagguccucuuaacguaccgggugggcgaggggcccggaguuugcuggcuggcuccugaacaaaccgccgguaagaaaaagccauucguguauacacagggccaggcgguccuuaaucgcgccuuuuuccccuguuuugacacuccugcagugaaauacaaguauucugcuuugaucgagguaccagauggguucaccgccguuaugagcgcuuccacaugggaaaaacgaggacccaacaaguuuuucuuucagaugugccaaccgauuccuucauaccugauagcccuagcaaucggcgaccucgugagugccgaggucggucccagaagcagggugugggcugaaccaugucugauugaugcggcaaaggaggaguauaauggggugaucgaagaguuccuugccaccggagaaaaacuguucggcccuuacgucuggggccgguacgacuugcucuuuaugcccccaucuuuccccuuugggggaauggagaacccuugccugacuuucguuacaccauguuuacuggcuggugaucguucccucgccgacgugauuauccacgaaauaucacacagcugguuuggcaaucuuguaaccaacgcaaauuggggagaguucuggcugaacgagggguuuacgauguaugcccagcgcagaaucaguacuauuuuguucggcgcugccuauaccugccuagaagcagcgacagguagggcucugcuccggcagcauauggauaucacuggggaggaaaauccgcugaacaaacuucgagugaaaauugagcccggcgucgacccugaugacaccuacaaugaaacaccauacgagaagggauuuuguuucgugucuuaucuggcccacuugguuggcgaccaggaucaauuugacuccuuccucaaagcauacgugcaugaguuuaaguuccgcagcauccuggccgaugacuucuuagauuuuuaucuggaauacuuccccgagcuaaagaaaaagagagucgacauaauuccuggguuugaguucgauagguggcucaacaccccaggauggcccccguaccugccugaccuuucgccaggugauucuuugaugaaacccgcugaggagcuggcccagcucugggcagcugaggaacuggacaugaaggccaucgaagcgguggccauuuccccuuggaaaacguaucagcuuguauacuuucuggauaagaucuugcaaaaaucaccccucccaccuggcaauguuaagaagcugggggacacuuaucccaguaucagcaacgcucggaaugcagaguuacgccugagauggggacagauugugcuaaagaacgaccaccaggaagauuucuggaaggucaaagaguuucuccacaaccagggcaagcaaaaauacacacugccacuuuaucaugccaugauggguggguccgagguggcucagaccuuggccaaggaaacuuucgcaucuacagcgagccagcugcacucaaaugucgugaacuacguucagcaaauaguggccccgaagggcaguuga

SEQ ID NO: 61934 - RNA, 2178 nt, Artificial Sequence
  derived and/or modified sequence opt3 from RNPEPL1__Homo_sapiens__NP_060696
auggccgcucagugcuguugcagacaagcacccggcgccgaggcggcuccugugaggccaccgcccgaaccuccacccgcccuggacgucgcaagcgccuccucugcucagcucuuucggcuucgccacuuacaguugggguuagagcugcgaccugaagcacgugagcuagccggaugucucguucuggaacuuugcgcucugagaccagcccccagggcguuggugcucgaugcacauccugcccugcggcugcacucagcugccuuucgcagagcaccagcugccgcggccgagaccccgugugcauucgcuuuuagugcccccgguccuggcccagcucccccuccaccccucccggccuucccugaggcacccgggagcgaaccagccugcuguccuuuagcuuuuaggguagaccccuucacagauuacggauccucucugacugugacgcuuccacccgaguugcaggcgcaucaaccuuuucaggucauccugcgguauaccucgacagacgcaccagccauuugguggcuagauccggaacucacuuacggcugcgcuaagcccuucguguuuacccagggucacucaguuuguaaccgcagcuucuuuccuugcuucgacacaccagccgugaaauguaccuauagugcagucgugaaggcccccuccgggguacagguucugaugucugcuacucgaagcgccuacauggaggaggaaggaguguuucauuuccacauggagcacccugucccagcauaucuuguggcgcugguggcuggcgauuugaaacccgccgacauaggcccgagauccagggucugggcagaaccuugccuccugccaacagccaccucaaaguuaaguggggcuguugagcaauggcugagcgccgcagaacggcucuacggacccuauauguggggucguuacgauaucguguuccuuccucccucuuuuccaauuguagcuauggagaauccuugccugacguucaucauuuccucaaucuuggagagcgacgaauuucuagugauagaugucauccaugagguggcccacaguugguucggcaacgcgguuacuaaugccaccugggaagagauguggcugucugaagggcucgcuacauacgcacagcgcagaauuacuaccgagacauauggagccgcuuuuaccugucuggagacggccuucaggcuugacgcacugcaucggcagaugaaauugcucggcgaagauucccccgugagcaagcugcaggucaaguuagagccaggugugaacccgucgcaccugaugaaucuauuuacuuacgaaaaaggguauugcuucguauacuaucucucucaacuguguggagacccucagcgauuugacgauuuccuucgcgcguacguugagaaguauaaauuuacauccguggucgcccaggacuugcuggauucauuccucaguuucuuccccgaacugaaggagcaaagcguggacugcagagcuggccuugaguucgaaagguggcugaacgccaccggcccacccuuggcagagccugaucucucccaggggucuagccugacucggccagucgaagcucuguuucagcuguggacagccgagccccuagaccaggcagccgcuucagcgagugccaucgauauuuccaaauggcgcaccuuccaaacggcacucuuucuggacagacuuuuggauggaagcccucugccgcaggaggugguuaugucucucucaaaguguuacaguagccuguuagacuccaugaaugcugaaaucaggauacguuggcugcagauugugguacggaacgauuacuauccagaccuucaccgagucagaagguucuuggagucucagaugucgcgcauguacaccaucccccucuaugaagaccugugcacaggugcccuaaagagcuuugcccuggagguguucuaccaaacucagggccggcuccauccuaaucugagaagggcuauucagcagauccuuucccaaggguugggaucaaguaccgaaccagcaucugagcccagcacagagcugggcaaagccgaagcggauacugacuccgaugcucaggccuuacuccugggugacgaggcaccuucaagcgccaucucucuucgcgauguuaacguguccgcuuga

SEQ ID NO: 61935 - RNA, 849 nt, Artificial Sequence
  derived and/or modified sequence opt3 from RNPS1__Homo_sapiens__NP_001273555
auggcccccagcccuaccaagagaaaagacagguccgaugagaagucuaaagaccggucaaaggauaaaggcgcuacaaaggaaaguagcgagaaggaccgcgggcgagauaaaacucguaagagaagguccgcaucuucgggaucaagcaguacgcggucccgcucuagcuccaccucaaguagcgguucuuccacaucaacuggcagcaguucuggguccagcucgucuuccgccucaaguagaagcggauccucuagcaccucaaggaguuccucgucuucaaguagcuccggcucuccaucgccgagccggcgccgacacgacaacagaaggcggucccguucaaaaaguaagcccccuaaacgcgaugaaaaggagagaaagaggcggucuccaagccccaaaccuacaaaggugcauaucggucgacugacccgcaaugucacuaaagaccacauuauggaaauauucuccacauacgggaagaucaaaaugauugauaugccaguugagagaaugcauccccaccucucaaagggauaugcguacguggaguuugaaaacccugacgaggcugaaaaagcccuuaagcauauggauggcggccagaucgacgggcaagagauuaccgcaacggccguacuggcuccauggccgaggcccccuccacggcgcuucagcccucccagaaggauguugccacccccgccuauguggcgucggucucccccacgaaugagaaggcgcucccggaguccuagaaggcgcagccccgugcgacggcguucuagauccccaggaaggcgccggcacagaucaaggaguagcagcaauuccucucgauga

SEQ ID NO: 61936 - RNA, 4656 nt, Artificial Sequence
  derived and/or modified sequence opt3 from ROBO1__Homo_sapiens__NP_001139317
augaucgccgagcccgcucacuucuaccuguuuggccucauuugccuuuguagcggguccagacugaggcaggaagacuucccuccacggauaguggagcauccgucugauuugaucgucucaaagggagaacccgcaaccuuaaacugcaaagccgagggucgcccuacaccaacuauugaaugguauaagggcggggagcgaguugagacggacaaagaugacccccguagucacagaaugcugcuaccuagcggaucccucuuuuuccugaggaucgugcauggccggaagucucgcccagaugaagguguauacgugugugucgcgagaaauuaucuuggggaggcugugucgcacaacgccucacuggaaguugcaauuuugagggacgauuuucggcaaaaucccagcgacgugauggucgccgugggagagccugcuguaauggagugccagccaccgcgcggccaucccgaaccuaccaucaguuggaaaaaggauggcuccccacucgacgauaaggacgagcgaauaacaaucagagggggaaaacugaugauuacuuacaccaggaagucugaugcagguaaauauguuugugugggcacaaacauggucggggaacgggagagcgaaguggccgagcugaccgugcucgagcgucccuccuucgucaagcgcccuucaaauuuagcuguuacuguggacgacagugccgaauuuaaaugcgaggcgagaggagauccaguacccacagugagguggcggaaggacgauggcgaacugccgaagagucgauacgagauccgcgacgaucacacccuuaaaauuagaaaggucacggccggugacauggggucuuauacuuguguggcagaaaacaugguuggaaaagcugaggccuccgcaaccuugacagugcaggucggcucagagccuccccacuucgugguaaagccaagggaucagguuguggcucugggccggacugucaccuuucaaugcgaagccacagggaauccucagcccgcgaucuucuggcgcagagagggaagccagaaccuacucuuuaguuaccagccaccccaaucuuccagcagguucucggugucucagaccggugaccugacgauaacuaauguccagcguuccgaugugggcuacuauauuugucagacacuuaacguugccgggucaaucauuaccaaagcauaccuggaagugacugacguaaucgcugaucggccuccaccggucauccgacaaggacccgugaaucagacaguugccguggacggcaccuuugucuugaguugcguggcuacggguagcccuguaccaaccauucucuggagaaaggacggggugcugguuuccacacaggauucuaggauaaaacaauuagagaacggcguccugcagauccgcuaugccaagcucggagacacuggccgguacaccuguauugcaagcacacccucaggggaagccacuuggagugcuuauaucgaggugcaggaguucggagugccuguccagccacccagaccgaccgauccuaaucuuauaccauccgcgcccagcaagccugaaguuacagacgugucuaggaacaccgugacucugucauggcaacccaauuugaacaguggugcaacgccaacaagcuacauuaucgaggccuucucccaugcuucuggcucgagcuggcagaccguagccgaaaacgucaaaacugagaccuccgcaaucaaggggcuaaaaccuaaugccauuuaucuguuucucgugcgcgcugccaacgcauacggaaucucagaucccagucagauuucugacccaguuaagacacaggaugugcugccgaccagccaaggcgucgaccacaaacaggugcagcgagagcuugguaaugcgguucugcauuugcacaacccuacugugcucuccucaagcucuauagaaguacacuggacagucgaucagcaaucccaguacauccagggguauaagauucuguaccggcccaguggcgcuaaucauggagagagcgacugguuaguguucgaagugcguacgccagccaagaacucugucguuauccccgaucugagaaaaggcgugaauuaugagaucaaggcaaggcccuuuuucaacgaauuucagggggccgacuccgagauuaaauucgcuaagacccuagaggaagccccaucagcacccccucaaggaguaacugugaguaaaaaugaugguaacggcacagcuauacucgucagcuggcagccgccacccgaggacacccagaaugggauggugcaagaauacaagguuuggugccugggaaacgagacacgcuaucacaucaauaagacuguggacggcucgaccuuuuccgucgugauuccuuuccuuguuccagguauccgguacucuguggaagucgccgcgagcacgggggccggcucaggaguaaaaagugagccccaguuuauucaguuggaugcucauggcaacccuguguccccggaggaccagguuucucuggcacaacagaucagcgauguggucaagcagcccgccuucauagcugggaucggagccgcaugcuggauuauccucaugguguuuuccauuuggcuguauagacacaggaaaaagcgaaauggccuuaccucaacauacgcggguauccgcaaaguaacuuaccagagagggggagaagccgugagcaguggcggucggccaggccuguugaacauaucugagccugcugcccaacccuggcucgcagacaccuggccaaacacagggaauaaccauaaugauuguuccauuagcugcuguacugcuggaaacggcaauucggacucaaaccugaccacguauucuaggccugggcagcccacaccauacgccaccacucaguuaauccagaguaaucuguccaacaauaugaacaauggaagcggcgauucuggugaaaagcacuggaagccgcuagggcaacagaaacaggaggucgcaccuguucaauauaacauuguggaacagaauaagcucaacaaagacuaccgugccaaugauacagugcccccaaccauccccuauaaccagagcuacgaccagaacacuggaggcuccuauaauucaagugaucgcgguagcucuaccuccggcucacaagggcacaagaaaggagcucggacaccuaaggucccaaaacagggcgggaugaacugggcggaccugcuucccccuccgccagcccaucccccuccccacaguaauagcgaggaguacaacauauccguggaugaaucuuacgaccaggagaugccaugcccuguucccccagcaagaauguauuugcagcaagacgaacuggaggaggaagaggaugaaaggggaccuacgccgcccguacgaggcgcugccucgagcccagccgcugugucauacucccaucagaguaccgcaacucucacaccuucuccccaggaggaacugcagccaauguuacaagacuguccugaggagaccggucacaugcagcaccagcccgaucggcgcagacagccggucagcccaccucccccacccaggccuaucuccccgccccauacauauggguacauuucaggaccacuggugucugacauggauacugacgccccugaagaggaagaggaugaagcggacauggagguugcuaagaugcaaacccggcgacuuuugcucagaggccuggagcagacgcccgccagcagugugggugaucuagaauccagcgucacaggcucuaugaucaauggguggggaucagcauccgaggaagacaacauuaguagcggccgcucgucuguguccagcucagaugggaguuucuuuaccgacgccgacuucgcucaggcaguagccgcggcugccgaguaugcaggacugaaggucgccaggcgucaaaugcaggaugcugccggccggagacacuuccaugcaucucagugcccuaggccaacuucccccgugagcaccgacucaaauaugagugcugccguuaugcagaaaacacgcccugcgaagaaacucaagcaccaaccaggucaucugcgaagagaaacuuacaccgaugaccuucccccgccuccagugcccccuccagccaucaaaagccccacagcacaguccaagacgcaguuggagguccggccggugguugugccuaagcugcccucuauggaugcuaggaccgaccgcagcuccgaucguaaagggucaucuuauaagggaagagaggucuuagacggccggcaagugguagauaugaggacuaacccaggcgacccucgcgaagcccaggagcagcagaaugaugggaaaggacgagguaacaaggcugcaaaaagagaccucccuccagccaagacacaccugauacaggaagauauucuucccuacugucggccuaccuuuccaacuagcaauaacccgagggaccccucgagcuccucuucaaugagcucccgcggcagugggucuagacaaagggagcaggccaaugugggacggcguaacaucgcugagaugcagguucugggcgguuacgaacgcggggaggacaauaacgaagaguuggaagagacagagagcuga

SEQ ID NO: 61937 - RNA, 4185 nt, Artificial Sequence
  derived and/or modified sequence opt3 from ROBO2__Homo_sapiens__NP_001122401
auggccagaaggcacgagcgggugacccgccgaauguggacaugggcucccggccugcucaugaugacugucguuuucugggggcaucagggaaacggucaaggccaggggagccgucuuagacaggaagacuuuccuccaaggaucguggagcacccguccgauguaauugugucuaagggagaacccacgacccugaauugcaaagcagagggccggccuacaccaacuauagaaugguacaaggacggugagcgcgucgagaccgauaaagacgaucccagaucacauaggauguuguuaccuagugggagccuguucuuucuacggaucgugcacggacgccgauccaagccagacgaaggcucuuauguuuguguggccagaaacuaccucggcgaggcggucucgaggaaugcuucacuggaaguggcccuucugcgggaugacuuccgucagaaccccacagauguaguuguggcagccggggagccugcuauuuuggagugccaaccaccgcgcggacaucccgaaccuaccaucuauuggaaaaaggacaaggucagaauugaugacaaagaggaaaggaucagcauacgggguggcaagcucaugaucaguaauacucgaaaauccgaugcagggauguacacaugugugggaaccaacauggugggcgagcgcgacucugacccagccgaacugacggucuuugagagacccacuuuccugaggcggccuauuaaucagguugugcucgaggaagaggcuguagaauuucgcugccaggugcagggugauccacaacccaccgucagauggaagaaagacgaugccgacuuaccgagggggcguuaugauaucaaggacgauuacacacugcggauuaagaaaacuaugagcaccgacgagggaacauauauguguaucgcggaaaaccgagugggcaagauggaggcauccgccacccuuacgguuagagcuccuccccaguucguggucaggccacgcgaucagauaguggcccagggccggacuguaacauuuccuugcgagaccaaagggaauccccaaccagcaguuuucuggcagaaggaaggaucacagaacuugcuguuucccaaucaaccucagcagccaaacaguagauguagcgugucuccgacuggugaccuaacaauuaccaauauccagagguccgaugcuggcuacuacauuugccaagcccucacggucgcggggucaauccuggccaaagcacagcuugaggugaccgacguccugacagaccgacccccuccaaucauuuugcagggacccgcuaaccagacucucgccguggauggcaccgcucuguuaaaguguaaagccacaggugacccucugccaguuauaagcuggcucaaggaaggguucacuuuucccggccgcgauccgcgggcaaccauccaagagcagggaacacuucagauuaagaaucugcguaucagugacaccggcacuuauacgugcguggccacaucuuccagcggggaaaccucguggucugcuguauuggaugucacugaguccggagcgaccauaucaaagaacuacgaccuaagugaucugccugguccacccagcaagccucaggugacagacguuaccaaaaacuccgugacucucucuuggcaacccggcacaccagggacgcugccugcaagcgccuauauuaucgaggcuuucucacagagugucuccaauagcuggcagaccguggccaaccacguaaagacuacacuuuacaccgugagaggacugaggcccaauacaaucuauuuguucaugguucgcgcaauuaacccacagggccucucugauccgucaccuaugagugaccccguccggacucaagauaucagcccacccgcccaggguguggaccacagacaggugcaaaaagaacugggggaugucuuaguuaggcugcauaauccuguggugcuaaccccaacgaccguacaggucacauggacuguggaccgacagccccaguuuauucaaggcuaccgcguuauguaucggcagaccuccggacuccaggcuacaucuucguggcagaaccuggacgccaaggugccuacugagagaagcgcaguccuugugaauuugaagaaaggcguuaccuacgaaauaaaggugaggccguacuucaacgaguuucaagggauggauuccgagucaaaaacgguacguacaaccgaagaggcgccaagugcucccccucagucugucacugugcugacagugggaagcuauaauuccaccucaaucagcgucucuugggacccacccccuccggaucaccagaacgguauuauccaggaauacaagaucuggugucucggcaaugagacucgcuuccauauuaacaaaaccguugacgccgcaauacgguccgugaucauugggggacuguuucccggcauccaauauagaguagaaguggccgcuaguacaagcgccggugucggggugaagucugagccacagccuauuaucauaggcaggcgaaaugagguugugaucacggaaaacaauaacuccauuaccgagcagaucacugaugucgugaagcaacccgcauucauugcuggaaucggcggggccugcuggguuauacuuaugggauuuucaauuuggcuguacuggcggcgcaaaaagagaaaaggcuugaguaacuaugcggugacauuccagaggggugacgggggacucaugagcaauggcucgcggccaggucuguuaaacgccggcgauccuuccuaccccuggcuggcugacucuuggccagcaaccagccuaccggucaauaacucaaauagugggccuaacgaaaucggaaauuuuggccgaggggauguacugcccccagugcccggacagggcgacaagacagccacuaugcucuccgauggugcuauuuauucuagcaucgacuucaccacgaaaacauccuacaacucaagcagucagauaacccaagccacuccuuacgcaaccacacagauccuucacucuaauuccauucacgaguuggcgguugaucugccagacccccaguggaaaagcucgauccagcaaaagacugaccucaugggguuuggauauucacugccugaucagaacaaaggcaauaacgguggcaaagggggaaagaagaaaaagaauaaaaacucuaguaagccgcagaagaauaacggcuccaccugggccaacgugccauuacccccucccccaguccagccucugcccgggacagaacuugagcauuacgcuguggagcaacaggaaaauggauaugacagcgauucuuggugcccaccuuugccgguacagacguaccuccaccagggccuggaggacgaacuagaggaagaugacgauagagugcccaccccaccuguccgcgguguugccagcucccccgcaauuucauucgggcaacagaguacugcuacacugaccccaagcccuagggaggagaugcagcccaugcuccaagcccaucuggacgaacuuacucgugcauaucaguuugauaucgccaaacagacauggcacauacagucuaacaaucaaccgccacagccucccgugccacccuugggauacguguccggcgcucugauuucagacuuagagaccgaugucgcggacgacgaugccgacgaugaagaggaggcacucgaaaucccucggccgcugagagcucuugaccagacgcccgguaguagcauggauaaccuggacuccucugugacuggcaaggccuucaccucgagccagaggccacgcccuacaucacccuucuccaccgauaguaauacuucugccgcuuugagccaaucccagcgaccuagaccaaccaaaaagcauaaagggggacggauggaccagcagcccgcacucccucacaggcgcgagggcaugacagaugaagaggcccugguuccauauucaaagcccucuuuuccgagcccugggggacacaguuccagcggcacagcgucuucaaaggguuccacugggccacguaaaaccgaaguacuaagagcuggacaucaacggaacgccagugaccugcucgauaucggcuacaugggcagcaauucgcaggggcaguucacgggagagcuguga

SEQ ID NO: 61938 - RNA, 4161 nt, Artificial Sequence
  derived and/or modified sequence opt3 from ROBO3__Homo_sapiens__NP_071765
augcugagauaccuccuuaagacccuguugcagaugaacuuauucgccgacagccuggcuggcgauaucuccaauucuucagagcuacuccugggguuuaacaguagccuugcagcccugaaucacacauugcugcccccuggagacccaucccucaacgguucuagggugggcccggaagaugcgaugccccggauugucgagcaaccuccagaccugcucguuucgcgcggggaacccgcuacuuuaccuugccgagccgagggacguccaagacccaauauagaaugguauaaaaacggcgcaaggguggccacgguacgggaggauccucgcgcucauagacugcuuuugccaucaggugcacuguucuuuccgaggaucgugcacgggcggcgcgcccgacccgacgagggagucuacaccuguguggcuagaaauuaucuaggcgccgcggcaagcaggaacgccagucucgaaguugcugugcugcgggaugacuuccgucaguccccuggcaaugucgugguagccguuggggagccagcagugcuugaaugcgugcccccucgcggacauccagagcccucugucagcuggagaaaggauggugcuaggcugaaagaggaagagggccggauuacaauccgagggggaaaguugaugaugucccacacucucaaaucagacgccggcauguacgugugugucgcgaguaacauggccggugaacgcgagagcgcagcugccgaaguuauggugcuggagagaccgucauuuuuaaggcggccuguaaaucaggugguccuggcugaugcccccgugaccuuccucugcgagguuaagggggacccaccuccccgccuuagauggaggaaggaagauggagagcugccaacaggccguuaugaaauucgguccgaccauucauuguggaucggccacgugagcgcagaggacgaagggaccuacacuugugucgccgagaacagugugggacgagcugaggcgucugguucccuaagcguacacguucccccucagcuggugacacaaccacaggaucagauggcagccccgggcgaaucggucgcuuuucagugcgagaccaaagggaaucccccuccagccauauucuggcaaaaggaaggaucucaggugcuccuguuucccucccagucacuucagccuacgggcagauucagugucagcccaaggggucaacugaacaucacugcagugcagcgcggggacgccggcuauuacguuugucaggcuguguccguagccggaucuauuuuggcaaaagcgcuccuggagaucaagggcgcuagcuuagaugggcugcccccggucauucuacaaggaccugccaaucagacccucgugcuggguucaaguguuuggcuuccaugccgggugacaggcaacccccagccuuccgucagauggaaaaaggacgggcagugguugcaaggagaugaccugcaguuuaagacuauggcaaacggcacccucuacaucgccaaugugcaggaaauggauauggguuucuauagcuguguagcuaaaucuucaacaggggaggccaccuggaguggcuggcugaagaugagggaggacuggggagugagccccgauccaccuacggaacccuccucuccaccgggcgcaccuucgcagcccguugucacugagauaaccaaaaacagcauuacccuuacuuggaagccaaauccccaaacaggggcugccgugaccuccuacgugaucgaagcguuuucuccugccgcuggaaacacguggcgcaccgucgcagacgguguucagcuggagacacauacugugaguggcuugcagccaaauaccauuuaucucuuccuggugcgagccguaggggcuuggggauuaucugagcccagcccugucuccgaaccggugcggacacaggauucaagcccaucucgucccguugaggacccuuggagaggccaacagggucuggccgaaguggcagucaggcuacaggagccaaucgugcucgggccccgcacucugcagguuuccuggaccguggacggcccuguacaacuuguccagggauuccgggugaguuggagaguggcgggcccggaagggggaagcuggacaauguuggaucugcagucucccucccaacagucaaccguccucaggggccugccaccugguacucagauccagauuaaaguucaagcccaggggcaggagggauuaggcgcugagagucugagcgugacgcgaucgauacccgaagaggccccauccgguccuccccagggcguagcaguggcucuugggggagacggcaacucuagcaucacagucucaugggaaccaccguugccuagucaacagaauggggugauuaccgaguaccagaucuggugccucggaaacgaaucccgcuuucaccugaaucggucugccgcaggcugggccagaagcgcuaugcuaaggggucugguucccgggcuccuguaucguacucuuguggcggccgcaaccuccgcuggagucggcgugccaucagcccccguuuuggugcagcugccuagcccacccgauuuagagccuggucucgaggucggcgccgggcuggcuguacgccuugcacgggugcugagagaaccggccuucuuggcgggaaguggcgcugccuguggggcacuccugcuaggacugugcgccgcucucuacuggaggcgaaagcaacggaaagagcugucucauuauacagcauccuuugccuacaccccagcgguuagcuucccccacucggaaggccuuucaggugcuucuagucgcccucccaugggguugggaccagccccuuacuccuggcuggcagacagcuggccccacccaucuagaagcccuuccgcccaggagccgaggggcucaugcugucccaguaacccagauccugacgaucgguauuacaaugaagcugguauuagcuuauaucucgcccagacugcacgaggcacagcugcccccggggagggaccaguguacucuacgauagacccugcgggcgaggaacugcaaaccuuucaugggggauucccccagcacccguccggcgaucuugguccauggucacaguaugccccucccgaguggagucagggggacagcggagcaaagggcggcaaggucaaacugcuagggaagccagugcaaaugcccucccucaacuggccugaagcucugccgcccccaccucccucuugcgaguugucgugucuggagggaccugaagaggaauuagaggguagcucagaaccagaggaguggugucccccuaugccagaaagaucccaucucacugagcccaguucuagcggcgggugccugguaacaccgucccgcagggaaaccccuucaccaacacccucuuacggacagcagagcacugccacccuuacgccuaguccacccgauccgccucagcccccaaccgacaugccucaucugcaccaaaugccccgucgggugccauugggccccuccagcccucucucugucucacagccaaugcuggguaucagagaggcuaggccggcagggcuaggagccggccccgccgcuuccccucaccugaguccaagccccgcgccuucgacagcaucuuccgccccaggccgcacuuggcaggggaauggagaaaugacacccccucuucaggguccgcgagcuagauuucggaaaaagccaaaagcccuccccuauaggcgcgagaacagcccuggcgaucugcccccaccucccuugccaccgccugaggaagaggcaucaugggcccuggaauuacgugcugcggggaguaugucuucccucgagagagaacggagcggagagaggaaggccguucaagcagugccccuggcugcccagcgcgugcuucacccagacgaggaagcauggcugcccuacucacgaccuaguuucuugagcagaggccaggguacauccacuugcucuaccgccgggagcaauuccucacggggaucuaguucgagcaggggcucccgcggcccagggagaucuaggucacggagccagucccguagucaaucucagcgccccggacagaagcgaagagaggaaccuagguga

SEQ ID NO: 61939 - RNA, 2589 nt, Artificial Sequence
  derived and/or modified sequence opt3 from ROBO4__Homo_sapiens__NP_001288017
augguggccgucguuggcgagcaguucacccuggaaugcgggcccccuuggggacacccagagccgacagugagcugguggaaggacgguaaaccccucgcacuucaaccuggcagacauacuguauccgggggaucucuguugauggcuagggccgaaaagucagaugagggcacguacauguguguggcgaccaacagugcuggucaccgggaaagccgcgccgcacgagucuccauccaggagccacaggacuauacagagcccguggaauuacuggccguucguauucagcuagagaaugugacucuccugaacccugauccagcugaagggcccaaaccuagaccagcagucuggcuuucuuggaaggugucgggaccggccgcucccgcccaaucauacaccgcgcuguuuaggacacagaccgcaccuggcggccagggggccccaugggcugaggaguugcucgccggauggcagagcgcagaacuggguggccugcauugggggcaagacuaugaguucaaaguacggcccaguuccggacgcgcuagaggcccugauucuaauguucucuuacugaggcuuccagaaaaggugcccagcgccccgccucaggaggucacuuugaagcccgguaacgggacaguguuuguguccugggucccaccucccgcggaaaaucacaacggaauaauccggggcuaccagguuuggucacugggcaauaccagucuaccacccgccaacuggacggugguaggggagcagacucaacucgagauugcaacccauaugccuggaagcuauugcgugcaggucgcugccgugacaggugcuggcgccggggaaccaucucgcccgguuugucugcuucuggagcaggcaauggaacgagccacucaagagcccuccgaacacggaccuuggaccuuggagcagcucagagcuacacugaaaaggccagaggugaucgcgaccugcggcgucgcauuauggcugcuccuucuggguacggccguguguauucaccggcgucgcagagcuaggguacauuuggggcccggccuauaccgguauacuucagaagacgccauccugaagcaccgaauggaucauagcgacagucaguggcucgcagauacauggcgcucuaccuccggaagcagagaccugucgucuuccucaagucuuagcuccaggcugggcgccgaugcucgggacccuuuggauugccgcagaucucuccugagcugggacucaaggaguccagggguucccuuacugccggacacuuccacauucuacggaagccuaauagccgagcucccuucuucaaccccagcacgucccaguccucaggugcccgcgguccggcgacugccaccucaacuugcucaguugagcucccccuguucuucgagcgauucccugugcucaagaaggggucucaguucuccacgccugagccuugccccggcagaagccuggaaagcuaagaaaaagcaggagcugcagcacgccaauuccucaccuuugcuccggggcagccacucucuggaauuaagagcaugugagcuggggaacaggggauccaagaaucuaagucaaagccccggcgcugugccacaggcccucgucgcguggcgcgcccugggucccaaacuuuugucuuccucaaacgagcuggugacgcgacaucucccuccagcuccccuguuuccucacgaaaccccgccaacacagagucagcaaacucagcccccuguugcaccacaggcccccagcucgaucuuacugccugcugccccgauucccauccuuuccccaugcucuccucccagcccacaggcaucaaguuuguccgggccuucucccgcgagcucccggcucucaagcaguucucuguccagccuaggcgaggaccaagauucggugcugaccccagaagagguagcccucugucuggagcuuucagaaggagaggaaacaccgcguaauucugucaguccuaugcccagagcuccauccccucccacuaccuacggcuauauuagcgugccaacagccucugaguucaccgacauggggaggacuggagguggcguugggcccaagggaggcguguugcugugcccuccgcgcccaugcuuaacgcccacaccuagcgaagguucccucgcaaacggguggggcucagcuagugaggauaaugccgcaagcgcccgggcuucucuggucuccucaagugacggcagcuuucuugcggaugcccauuucgcaagagcucuggccguggccguagacuccuuuggauucggguuggagcccagggaagcugauuguguguuuaucgacgcaucuucgccaccuagcccccgagaugagauauuccucaccccaaaccugucacuaccucugugggaauggcgcccggacuggcucgaggacauggaaguuucccacacucagcggcugggaagaggcaugcccccauggccucccgauagucagauuucuagccaaaggucccagcuucauugccguaugccaaaagccggugcgucaccugucgacuacucuuga

SEQ ID NO: 61940 - RNA, 4065 nt, Artificial Sequence
  derived and/or modified sequence opt3 from ROCK1__Homo_sapiens__NP_005397
augagcaccggcgacuccuucgagacaagauuugaaaagauggauaaccugcucagggaccccaaaucugaggucaauucagauugccuucuggacggguuggaugccuuaguguacgaccuggauuucccugcucuacggaagaacaaaaauaucgacaacuuucucagucgcuauaaggauacuauuaauaaaauacgagaccugcguaugaaggcagaagauuacgagguugugaagguaaucggaagaggugccuucggcgaagugcagcuugucaggcacaaaagcacgcggaagguguaugcgaugaaacuguuguccaaguuugagaugauuaaacgcucugacucggcuuucuuuugggaggaaagagauaucauggccuucgcaaacucaccauggguugugcaacucuuuuacgccuuccaggacgacagguaucuguacauggucauggaguauaugccagggggagaucuggugaaucucaugagcaacuacgacguacccgaaaagugggcucgguuuuacaccgcagagguuguguuagcccuggaugcuauucauaguaugggcuucauccaccgcgacgucaagccugauaauaugcuuuuggacaaauccggucaucugaagcuagccgauuuugggacauguaugaaaaugaacaaggagggaauggugcgaugcgacacugcggugggcaccccagauuauauaucucccgaaguccucaaaagccagggcggggacggauacuaugguagagagugugauuggugguccguuggcguguuccuguacgaaaugcuuguaggggacacaccuuucuaugcagacucacuggugggaaccuacaguaagaucaugaaucacaaaaacagcuugacuuuuccagaugacaaugauauuucuaaggaggccaagaaccucaucugcgcuuuccugacagacagggaaguccgguuaggccguaaugguguggaggagauuaaacgccaucuguuuuucaagaacgaucagugggccugggaaacccucagagacacgguugcacccguggucccugaucuuuccucagacaucgauacuagcaacuuugacgaucuggaggaagacaaaggggaggaagagaccuucccaauaccgaaggcuuuugugggaaaucaauugcccuucguaggcuuuacauauuacaguaacaggcgguaccuaucuuccgccaauccuaacgauaaucgaacuagcucgaacgcggacaaaucucugcaggagucccuccagaagaccauuuauaagcuggaagaacagcuucacaaugaaaugcaacugaaagacgagauggaacagaagugucgcacaucaaacaucaaauuggauaagauuaugaaagagcucgacgaggaaggcaaucagagaaggaaccuggagaguaccguuagccagaucgaaaaggagaagauguuacugcaacaccggaucaaugaguaccagcgcaaagccgaacaggagaacgaaaagagaaggaauguggagaacgaagucuccacgcuaaaagaucaacucgaggaccugaagaaagugucucagaauagccagcuugcaaacgagaaguugucacagcugcaaaagcagcucgaagaggcuaacgaucugcuucguacugaaagugacacagccguccggcugcgaaaaucccauaccgagaugagcaagucuauuucacaguuggaaagucucaauagagagcugcaggagaggaaccgcauauuagaaaauagcaaaucccaaacugauaaggacuauuaccagcugcaggcuauccuagaggccgaacggagagauagggggcacgacucugagaugauuggagaucuccaggcacgcaucacaucgcugcaagaagaggugaaacaucuuaagcacaacuuggagaaaguugaaggugagcgaaaggaagcccaggacaugcugaaucacagcgagaaggagaaaaacaaucucgaaauagaucugaacuauaaguuaaaaucccugcagcagcggcuugagcaagaagugaaugagcauaagguaaccaaagcucguuugacggacaagcaccagucaauugaagaggcgaagagugucgcaaugugcgagauggaaaagaagcucaaagaggaaagagaggccagggaaaaggcugagaaccgcgugguucagaucgagaaacaauguucuaugcuggacguggaucuaaagcagagccagcagaagcuggaacaucucaccggcaauaaagagcggauggaagacgaggucaagaaccugacacuucaauuggaacaggaguccaauaaaagacuguuacuccagaacgagcugaagacucaggccuucgaagcagauaaucuuaaagggcuggagaagcaaaugaagcaggaaaucaacaccuugcucgaggccaaaaggcugcuagaguuugaacuggcucagcucacaaagcaguaccgaggaaacgagggccaaaugcgcgaacugcaggaccagcuugaggccgaacaauauuucucaacuuuguacaaaacccaggugaaggagcugaaagaggaaauugaggaaaagaaucgggagaaccucaaaaagauccaggaauuacagaaugagaaggagacacuggcaacccaacuugaucuggcggaaacuaaagcugagagcgaacagcuagccagaggucuccuggaggaacaguacuuugaguugacgcaggagucuaagaaagcagccuccaggaaccgucaagaaauuacagacaaggaucacaccguaagucgccuggaggaagcuaauagcauguuaacuaaagacauagagauccuccggagagagaacgaggagcugaccgaaaagaugaagaaagccgaggaagaguauaaacuugagaaagaagaggaaauuucuaaucugaaggcagcuuucgagaaaaacaucaauacagaaaggaccuugaagacucaggccgugaacaagcucgcggagaucaugaaucgaaaagauuucaagauugaccggaaaaaggccaacacacaggaucugcgcaaaaaggagaaggaaaauagaaaacuacagcuggagcuuaaccaagaaagggagaaguuuaaucagaugguugucaaacaucagaaggaacucaacgacaugcaggcucaacugguggaggagugcgcacaccggaacgaauugcagaugcagcuggccuccaaagagucagacauagaacaauuacgagcuaagcuccuggaucuuagugacagcacgucgguggccuccuucccaucugcagaugagaccgacgggaaucugcccgagagcagaaucgaaggcugguugucagucccuaaccgcggaaauauuaagagguacggcuggaaaaagcaguauguuguggugaguuccaaaaagauccucuuuuacaacgaugagcaggacaaagaacagucuaauccaagcaugguacuggauauugacaagcuauuccacguccgucccgugacucaaggggauguuuaucgggcggagacagaagagaucccgaaaauauuucagauccuguacgccaacgagggagaauguagaaaggacguggagauggaaccuguccagcaggcugagaagaccaauuuccaaaaccauaaaggucacgaauuuauucccacacuuuaucauuucccagccaauugcgaugcaugugcuaagccucucuggcacguguuuaaacccccacccgcccuggagugcaggcgcugccacguuaagugucaucgagaccacuuggauaaaaaggaggacuuaaucugcccuuguaagguguccuacgacguaacuucagcaagagauaugcugcuccuggccugcagccaggacgaacagaaaaagugggucacccaucuugugaaaaagauuccgaaaaacccgcccaguggcuucgugcgggcuucuccuaggacgcuguccacccgcagcacagcgaaucagucguuucguaaggucguuaagaacacuucagggaaaaccucuuga

SEQ ID NO: 61941 - RNA, 4167 nt, Artificial Sequence
  derived and/or modified sequence opt3 from ROCK2__Homo_sapiens__NP_004841
augagcagacccccuccaaccggcaagaugccgggggcccccgagacagcuccuggagacggugcaggcgccuccaggcagcggaaacuggaagcgcucauccgcgauccacgaucucccauuaacguggagucacuucuggacggguugaauaguuuaguccuggaucuagacuucccugcucuccguaagaacaaaaauauagauaacuuucugaauagauacgaaaagaucguuaaaaagauuaggggacuucaaaugaaggccgaggacuaugaugugguaaaagugaucggccggggugcauucggggaaguccagcuggugcgccacaaggccagccagaaaguuuacgcuaugaaguugcucuccaaauuugagaugauuaagagaucugacucggcauucuuuugggaggaaagggauaucauggccuucgcuaacucaccaugggugguccagcuguuuuaugccuuccaagacgaucgguaccuguauauggugauggaguacaugcccggaggcgaccucguaaauuuaaugagcaacuaugauguuccugaaaagugggcgaaauuuuacacugcagaggugguccuggcccuugacgcuauacauaguaugggcuugauccaccgcgacgugaagccagauaauaugcugcuagacaaacaugggcaccucaagcuggccgauuucggaacgugcaugaaaauggacgagaccgguauggugcauugugauacagcagucggcacuccggacuacauuucccccgaaguucuuaagucucaagggggagauggcuuuuauggucgagagugcgacugguggagcguggggguauuccuguacgaaauguuggugggagauaccccuuuuuaugcugacucccucgucggcacauacucaaaaaucauggaucacaagaacagucuguguuucccagaggacgccgaaauuagcaagcacgcgaaaaauuuaaucugcgccuuccugaccgacagagaggugaggcucggccggaacgggguugaggaaauacgucagcaucccuuuuucaagaaugaucaguggcacugggacaacauucgcgagacugcagcuccuguggucccagaacuuucuuccgauaucgacucaagcaauuuugaugacauugaggaugacaaaggagauguggaaacauuccccaucccgaaggccuuuguagguaaccaacugccuuucaucggcuuuaccuauuacagagagaacuugcuacugagugacucucccuccuguagggagacggauagcauucagucgcggaaaaaugaagagucucaggaaauacagaagaagcucuauacucuggaggaacaucuuuccaacgagaugcaagcuaaagaggaacuggagcagaagugcaaaucaguuaauacccgauuggaaaagacagccaaagagcucgaggaagagaucacucugcgcaagaguguggaaagcgcauuaagacagcuggagagggaaaaggcccuacuccaacacaaaaacgcugaguaccagcggaaggcggaccacgaggcagauaaaaagcgcaaucuggaaaacgacgucaauucccuuaaagaccaguuggaggaucugaagaagagaaaccaaaauucucagauuagcaccgaaaaagugaaccagcuccagaggcagcuggacgagacaaaugcccuucugcguaccgaaucagauacggcugcccgguugcgaaagacucaagcagagaguuccaaacagauccagcagcucgagagcaacaauagagaccugcaagauaagaacuguuuacuggaaacagccaaacuaaagcucgagaaagaguucauaaaucugcagucugcucuugagucagaaaggcgcgaccggacccaugggagugagauuaucaacgauuugcagggaagaaucugcggccuggaggaagaccucaagaacgguaagauucuguuagccaaagucgagcuggaaaagaggcagcuucaagagcgcuuuacugauuuggagaaagaaaagagcaauauggagaucgacaugacauaccagcucaaagugauucagcaaucccuggaacaggaggaagcagagcacaaggcgaccaaggcucgacuagccgauaaaaacaagauauaugagucuaucgaagaggcaaaaucggaagccaugaaggagauggaaaagaaacugcucgaggagcggacgcugaagcagaaaguugaaaaucuuuugcuggaggcugaaaagcguuguagcuuacucgacugcgaucugaaacagucccaacagaagauuaacgagcuucugaaacagaaggacguguugaaugaagacguaagaaaccucacccugaagaucgagcaggagacacagaaaaggugucuaacucagaaugaucugaagaugcagacccagcaagucaacacacucaaaaugucagaaaagcagcugaaacaggagaauaaccaucuuauggaaaugaagaugaauuuggagaaacaaaacgccgagcugcgcaaggaacggcaggacgcagaugggcagaugaaggaguuacaggaccaacucgaagcugagcaguacuucaguacucuguauaaaacccaggugagagaacuuaaggaggagugcgaagagaaaacaaagcugggcaaagaacuacagcaaaagaagcaggagcuccaggaugaaagggacucucuggccgcgcaguuggagaucacccugacuaaagccgauagcgagcaauuagcucgauccauugcagaagaacaguacucagaccucgaaaaggagaaaauaaugaaggaacuggagaucaaagagaugauggcccgccacaagcaggaacuuacggagaaggaugcuacaauugccagccuggaagagaccaaucggacuuugaccucugacguugcaaaccucgcgaaugagaaagaggaacugaacaacaagcuaaaagaugugcaggaacaacuguccagacuuaaggacgaggaaaucagugccgcugccauuaaagcacaguuugagaagcagcuccugacagagaggaccuugaagacucaagcugucaauaaacuggccgaaaucaugaaccguaaggagccagugaaacgcggaaaugacacagauguacggagaaaggaaaaagagaacaggaaguuacauauggaacucaagagcgagcgagagaaacugacgcagcagaugauaaaguaucagaaagaacuuaaugagaugcaagcacagaucgccgaagagucucagauucggaucgaacugcagaugaccuuggacuccaaggauucagacauugagcaacuccgcagucagcugcaggcucuacacaucggccuggauagcucguccauagggucuggaccuggugacgcggaggccgaugacggcuuccccgaaagcagacuugagggguggcucucacugccagugaggaacaauacuaaaaaguuuggauggguuaaaaaguacgucauugugaguuccaagaaaaucuuguucuaugauucugaacaggacaaggagcaaagcaaccccuacaugguguuagauauugacaaacuguuccacguccggccuguuacacagaccgauguguaccgagcagacgcuaaggagaucccaagaauauuucagauccucuaugccaaugaaggcgaguccaaaaaggaacaagaguucccgguggaacccguaggugagaagucaaacuacauuugccauaaagggcacgaguuuaucccuacacuguaucauuucccaacuaauugugaagccugcaugaagccccuuuggcacauguuuaaaccuccacccgcucuggaguguaggcgcugccacauuaagugucauaaagaccacauggauaagaaggaagagaucauagcaccgugcaaagucuacuaugacauuagcaccgccaagaacuugcuacugcucgcgaauaguacggaggaacagcagaaaugggugucucgucugguuaagaaaaucccuaagaagccacccgcuccugaucccuucgcccgguccagcccaagaaccucgaugaaaauccagcaaaaccagucaauuaggcgcccuucucgacagcuugcacccaauaagccaaguuga

SEQ ID NO: 61942 - RNA, 864 nt, Artificial Sequence
  derived and/or modified sequence opt3 from ROGDI__Homo_sapiens__NP_078865
auggccaccgugauggcugcaacagccgcggagagagcuguccuggaagaggaguucagguggcuccuucacgacgaaguucaugccgugcugaagcaguugcaagauaucuuaaaagaagcaagccugcgguuuacucuacccggcuccgggacggagggaccugccaagcaggagaacuucauucucgguucuugcggcaccgaccagguaaaaggggugcugacacuucagggagaugcucugucacaagcagacgucaauuugaagaugccacgcaacaaucagcuccugcacuuugccuuccgagaagauaaacaguggaagcugcagcaaauacaggacgcucguaaccaugugagucaggccaucuaccucuuaacuagcagagaucaguccuaucaauuuaagaccggcgcggagguucugaaacuuauggacgcagugauguugcagcugacaagggcccggaaucgccuaaccacuccggcuacacucacccugcccgaaauugccgcaucuggucuuacgagaauguucgcuccugcccugccaucggauuugcucgucaacguguacaucaaucugaacaaguuaugucugacuguauaucagcuccacgcgcuucaacccaauucaaccaaaaacuuuaggccugccgggggagcaguucugcauagcccaggcgcuauguucgaguggggcagucagcgguuggaggugucccacguccacaagguggaaugcgugauucccuggcuaaaugacgcccuggucuacuuuacaguuucucuccagcugugucagcaacuuaaagauaagaucagcguguucuccucauauuggaguuaccgcccuuuuuga

SEQ ID NO: 61943 - RNA, 1056 nt, Artificial Sequence
  derived and/or modified sequence opt3 from ROM1__Homo_sapiens__NP_000318
auggcccccgugcugccucucguccuuccacugcagccgagaaucagguuggcucaaggcuuauggcugcuaagcuggcuccuggcacuugccgggggaguuauucuguugugcuccggucaccuccuggugcagcugcggcaccucggcaccuucuuagcgcccucuugucaguuuccuguacugccacaggcugcccuugcagccggggcuguggcauugggaacaggccuggucggugugggggccucacgcgcuagucuaaacgccgcgcucuaucccccuuggcgaggaguucugggcccacuucugguggcaggcacugccgggggagguggcuugcucgucguggcucugggguuagcccuggcacuccccggaagccuugacgaggcucuggaagagggcuugguaacggcccuagcgcacuacaaggauaccgaaguuccuggucauugccaagccaaacgucugguggacgagcuccagcugagauaccacuguugcgggaggcauggauauaaggauugguucggcguccaguggguguccucucgguaccuugacccaggcgaucgcgacguggcagauagaauacagucgaaugucgaagggcuguauuugacagacggaguuccguuuucauguugcaacccccacagcccuaggccaugucuccaaaaucggcugagugauuccuacgcucaccccuuauucgacccucgccagccaaaccagaaucugugggcccaggguugccaugaggugcuacucgagcaucugcaagaucuugcuggcacuuuggggucuaugcuggccguaaccuuucuccugcaggcacuugugcuguugggacuccgauaucugcagacagccuuagaaggccuggguggggucaucgacgcuggcggagagacccaaggcuaccuauuccccagcgggcucaaagauaugcugaagacugcguggcuucagggagguguggcauguagaccggccccugaagaggcucccccaggcgaggccccucccaaagaagacuuguccgaggcauga

SEQ ID NO: 61944 - RNA, 363 nt, Artificial Sequence
  derived and/or modified sequence opt3 from ROPN1B__Homo_sapiens__XP_005247195
auguggaagguggucaaccugcccaccgaccucuucaauagcguuaugaacgugggcagauuuacagaggaaaucgaguggcuuaaauuccuggccuuggcuugcuccgcauuagggguaacuauuacgaagacccugaaaauagugugugaaguccuaucuugcgaucacaauggaggucucccuaggaucccauuuucaacauuccaguuucuguacacuuauauugccgagguggacggcgaaaucugugcgagucauguuagccggaugcuuaacuacauugagcaagaggugaucgggccggauggacugauaaccgucaaugacuucacacagaacccccgcgugugguuggaauga

SEQ ID NO: 61945 - RNA, 441 nt, Artificial Sequence
  derived and/or modified sequence opt3 from ROPN1__Homo_sapiens__XP_011511238
auggcccagaccgacaagcccacaugcaucccuccagagcugccgaaaaugcucaaggaguucgcuaaagcagccauuagagugcaaccccaggaucuuauacagugggcggcugacuacuuugaggcccugagcaggggcgaaacuccuccaguccgggagcgcuccgaacgaguugcauuguguaaccgugccgaguuaacgcccgagcugcuaaagauccuccacucucagguggcugggagacugauuaucagggcagaagaacuugcccaaauguggaaaguagugaaucugccuaccgauuuguucaacucagucaugaaugugggacgguuuacagaagagauugaguggcucaaguuccuggcucuggccugcagugcgcucgguguucgccagccaagagcagacuguaggaagcgguuacccgauacuuga

SEQ ID NO: 61946 - RNA, 693 nt, Artificial Sequence
  derived and/or modified sequence opt3 from ROPN1L__Homo_sapiens__NP_114122
augccccugccugacaccauguucugcgcccagcaaauccacauuccaccggagcuccccgauauacuuaagcaguuuacaaaagcugcaaucagaacucagccugccgacgugcugagguggagcgcgggcuacuucuccgcuuugucucgcggggauccauuacccgucaaggaccggauggaaaugccuacggccacccagaaaacagauacuggacugacccaaggucuacucaagguucugcauaaacagugucaccauaagcgauauguggagcuuacagaccuggaacagaaguggaaaaacuugugccucccaaaggagaaauuuaaggcacugcugcagcucgaucccugugaaaauaaaauuaaguggaucaacuucuuagcccugggcugcucaaugcuugggggaaguuugaauaccgcucugaagcaccuaugugagauucucacugacgauccugagggcgguccagcacguaucccguuuaaaacauucagcuacguauauagauaccuggccaggcuugacuccgaugugucuccccuggaaaccgagucguauuuggcuucacucaaggaaaacauagacgcccggaaaaaugggaugaucggacugagcgacuuuuucuuuccuaagcgcaaauuacuggagaguauugagaacuccgaagaugucggccauuga

SEQ ID NO: 61947 - RNA, 2625 nt, Artificial Sequence
  derived and/or modified sequence opt3 from ROR1__Homo_sapiens__XP_011539828
augaacaauaucaccacaagccugggccagacugccgagcuccacugcaagguguccgggaaucccccuccaacgauuagaugguucaaaaacgacgcuccggucguucaagaacccaggcggcuuucuuuucgcucaaccauauacggaagucgacugcguaucagaaacuuggauacaacugacaccgguuauuuccaguguguggcaacaaauggcaaggagguagugagcuccaccggggucuuauuugugaaauucggaccuccacccacugccucuccuggcuacucggaugaauaugaggaagacgguuuuugccagccauacagggggauugcgugugcucgguucaucggaaaccgcacaguuuauauggagucacugcauaugcagggcgagauugaaaaucaaaucaccgccgcauuuacgaugauaggcacuagcagucaccuauccgauaagugcucucaguucgccauccccagccucugucauuacgcuuuuccuuauugcgacgagaccuccucagugccaaaaccgagagaucuguguagggacgaaugcgagauucuugagaacguccugugucagacagaauacaucuucgcacggaguaaucccaugauuuugaugcgccucaagcugccuaacugcgaggaucugccacagcccgaaagcccugaggccgcuaauuguauccgaauagggauuccaauggccgaccccaucaacaagaaucacaaaugcuacaacucuacuggaguggauuauagagguaccguauccguuacaaagucaggcaggcaaugccagccguggaauagccaguacccucauacccacacguuuacugcgcuccgguuccccgaauuaaacgggggacacaguuauugucguaacccaggcaaucagaaagaggcaccuuggugcuuuacacuggacgagaacuucaagucugaucuuugugacauucccgccugcgacuccaaagauagcaaggaaaagaauaaaauggagaucuuguacauccuggugccaucggucgcuauuccccuagccauagcacuccuguucuuuuucaucugugugugccgcaacaaucaaaagucuuccucagcuccugugcagagacagccaaaacaugucaggggucaaaacguugaaaugaguaugcuuaaugccuauaagccgaaaagcaaggcgaaagagcugcccuuguccgccgugcgguuuauggaggaacucggggagugugcauucggaaagauuuacaagggccaccuguauuuaccuggcauggaccaugcucagcugguagccaucaaaacccucaaggauuacaacaauccacagcaguggacugaauuucaacaggaggcuucucuuauggccgaacugcaccaccccaacauagugugcuugcuaggggcagucacacaggagcagccuguguguaugcuguucgaauacauuaaucaaggagaccuccaugaguuucugaucaugcgaagcccacacucagauguugguugcaguuccgacgaggauggcaccgugaaaagcucucuugaccauggggauuuccugcacaucgccauucagaucgcugcgggaauggaauauuugucaagucacuuuuucguccauaaggaccucgcagcccgcaacauucugauaggcgagcaguuacacgugaaaaucagcgaucugggucuauccagagaaauuuacucugcugacuauuacaggguacagagcaagucgcuccugcccauccgguggaugccgccugaggccaucauguaugggaaguuuuccucagacagugauauuuggucuuucggcguugugcuuugggagauauuuagcuucggauugcaaccauacuauggcuucuccaaucaggaagucaucgagauggugcgcaaaagacagcugcuccccuguucagaagacugcccucccaggauguacagccugaugacggagugcuggaacgaaauuccaucucgucggccucgauuuaaggauauccaugucagacuuagguccugggaggggcugaguagccacaccucuuccacaacucccucaggagguaaugcaaccacacagacuaccaguuugagcgccucgccaguguccaaccucucuaacccgcgcuacccuaauuauauguuccccagccaaggcauuacaccacaggggcagaucgcuggauuuauaggucccccuaucccacaaaaccagcgguucauucccaucaauggcuacccuauuccgccaggguaugccgcauuucccgcggcucauuaccagccuaccggcccacccagaguuauccagcacuguccuccgcccaaaucaaggaguccauccucugccagcggauccacuucaacgggccacgugacaagccugccuaguucuggguccaaccaagaggcaaauauacccuuacugccacauaugagcauuccuaaccaccccggagguaugggcaucaccguauucgggaauaagucgcagaaaccauauaagauugacucaaagcaggccucucuacucggagaugcuaacauccauggccacacugaaaguaugauauccgccgagcuguga

SEQ ID NO: 61948 - RNA, 2832 nt, Artificial Sequence
  derived and/or modified sequence opt3 from ROR2__Homo_sapiens__NP_004551
auggccagaggcagcgcucugcccaggcggccucuccuuugcaucccagcagugugggccgcggcugcccuguuguuauccgucucucgcaccucaggggagguugaagugcuggacccgaacgauccccuaggaccucucgacggucaggauggcccaauucccacacugaagggguacuuccuuaauuuucuggagccuguaaacaauauaacuaucgugcaaggacagacggcaauuuugcacuguaaagucgccggcaacccacccccuaaugugcgauggcucaagaacgacgcuccaguugugcaggaaccgcguagaaucauuaucaggaaaaccgaguaugguagucggcugcgcauacaggaucuggacacaacugauaccggguacuaucaaugcgucgcaacaaauggaaugaagaccaucacugccacaggcguucucuucguaagauuaggccccacccauagcccuaaccacaauuuucaggacgauuaccaugaagacggguucugucagccauauaggggaauugcuugcgcccgguuuaucgguaaccgcacgauuuacguugauucccugcagaugcaaggcgagaucgagaaucgaauaacugcggcauucaccaugauugggacaucuacucaccuuucggaccaguguucacaguuugccauccccagcuucugccauuuuguguucccuuugugugaugcuagaaguaggaccccaaaaccccgggaacugugccgugacgagugugaaguccuagaguccgaccucugccgccaggaguauacaauugccagaucuaacccgcugauccuuaugaggcugcaauugccuaagugugaagcacuccccaugccagagagcccugaugcugccaauugcaugcggaucggcauucccgcggaacgacugggacgcuaccaccagugcuacaacgguuccgggauggacuauagaggaaccgccucaacgacuaagaguggccaccagugucaaccaugggcauuacagcauccccacagccaucaccugucuuccacagauuuuccugagcucggcgggggacacgcuuacugcaggaauccagguggccagauggaagggccgugguguuucacccagaacaaaaacgugcggauggagcuuugcgacgugcccucauguagcccucgcgauaguucuaagaugggaauacuguauaucuuggucccauccauugccaucccccuaguuauagcuugccuguuuuuccucguguguaugugcagaaauaaacaaaaggccagcgcaucgacuccucagaggcgucagcugauggccucuccaucccaggacauggagaugccccuuauuaaccaacauaaacaggcuaagcugaaggaaaucucauugagugcgguacgguucauggaggaacucggcgaggaucgauuugguaaaguguacaaggggcaccuguucggcccggcaccuggagaacagacacaggccgucgcuaucaaaaccuuaaaggacaaagccgagggcccacugagagaggaauuuaggcaugaggcaaugcuacgcgcccggcuccaacaccccaaugugguuugucugcuugggguggucacgaaggaucagccuuugagcaugauuuucuccuauugcucucauggagaccugcacgaauuucucgugaugagaagcccccacucagauguagguaguaccgacgacgauaggacaguuaaauccgcucuggagccaccugacuucgugcaucuugucgcccagaucgcagcgggcauggaauaccugagcucucaccaugugguccacaaggauuuggcuacucgcaacgugcucguuuaugacaagcugaaugugaaaauuucagauuuagggcuguuucgagagguauacgccgcagacuacuauaagcuacucggaaacagucugcuucccauacgguggauggccccagaggcuaucauguacggcaaauucagcauugauuccgacaucuggucuuauggugucguguugugggaaguguuuucguacgggcugcagccguauuguggcuacagcaaucaagauguggucgagaugauccguaacagacaggugcucccuugccccgacgauugcccagccuggguauaugcacugaugauugaauguuggaaugaguuccccuccaggcgcccucgguuuaaggacauacacucaagauuaagggcuuggggaaaccugaguaauuacaacucuagcgcccagaccuccggcgcgucaaauacaacucaaaccagcucucuuuccacaaguccagugagcaacguuucuaaugcccgauacgucgggcccaaacagaaggcuccuccguucccacagccccaguuuaucccuaugaagggacaaauucgcccaauggugcccccuccgcaguuguaugugcccgucaacgguuaccagccaguuccugcauauggcgccuaccuccccaacuucuauccagugcagaucccuaugcaaauggcuccccaacaggugccaccgcagaugguaccuaaacccuccucacaucacagugggagcggaucgaccuccacuggcuacgucacgacagccccaucuaauaccagcauggcagaucgggcggcccugcuaucagagggugcugacgacacucagaacgcccccgaagauggggcacagaguaccgugcaggaggcugaagaggaagaggagggcuccguuccugaaacagagcugcucggagacugcgauacccugcaaguggacgaagcccagguccagcuugaggcauga

SEQ ID NO: 61949 - RNA, 1647 nt, Artificial Sequence
  derived and/or modified sequence opt3 from RORA__Homo_sapiens__NP_002934
augaacgagggcgcccccggggacagcgaucuggaaaccgaggcuagagugccuugguccaucaugggacacugccucaggacaggucaggcacggaugucugccacuccaacgccggcgggcgaaggggcucgcucaaguagcaccuguuccucucuuucgcgacuguucuggucacaauuggagcauauuaauugggacggagccacagcaaagaacuuuauaaauuuacgugaguucuuuagcuuccugcuacccgcccucagaaaagcucagaucgaaauuaucccuugcaagauuuguggcgauaaaaguuccgguauccacuacggggucauaacuugcgagggauguaagggcuuuuucaggcggucucagcagagcaacgcaaccuauuccugcccacgccagaaaaauugucugaucgacagaacaucaaggaaccggugccaacauugucgccuucagaagugccuggccguuggcaugagucgagaugcugugaaguuugggagaaugagcaaaaagcagagggacucuuuguacgccgaaguacaaaaacaccggaugcagcagcagcaacgugaucaucagcagcaacccggagaggcggaaccucucaccccaacuuauaauauuuccgcaaacggucugacagagcugcacgacgaucucucaaauuacaucgacggccacacccccgaggggagcaaggccgauagugcugugucuuccuucuauuuagacauucagccuagcccagaucagucgggacuggacaucaacggcauaaaaccggaacccauuugugacuacacgccugccucuggguuuuucccauauugcuccuuuacuaauggugagaccucacccacagucaguauggcagaacuugagcauuuggcucagaacaucagcaagucccaccuggaaacuugccaauaccuacgcgaggagcuccagcagauuaccuggcagacauuccugcaagaagagaucgaaaauuaccagaacaagcagagagaggugauguggcagcuuugugccaucaaaauuaccgaagcgauacaauauguuguggaguuugccaagaggaucgauggauucauggagcugugccagaaugaccagauugucuugcucaaagcaggcucucuggaagugguauucauccggaugugucgagcuuuugauagccagaacaacacgguuuacuucgacggcaaguaugccucaccugauguguuuaaaaguuuagggugcgaggacuucauauccuuugucuucgaauuuggaaagagccuguguucuaugcaucucacugaggaugaaauugcucuuuucucagccuuugugcugaugagugcagaccgcagcugguugcaagagaaagugaagaucgagaagcuacagcagaaaauccaacuggcccuccagcacguccugcagaagaaucacagagaagaugguauucuuacaaaacugaucugcaagguuuccaccuugagggcucucuguggccggcauacugagaaacugauggcguucaaggcaauuuacccagacauagugcgcuuacacuuucccccgcuguauaaggaacuauucacaucugaguuugagccugccaugcagaucgauggguga

SEQ ID NO: 61950 - RNA, 1380 nt, Artificial Sequence
  derived and/or modified sequence opt3 from RORB__Homo_sapiens__NP_008845
augagagcccagaucgaggugauucccugcaagauauguggcgacaaaagcuccgggauccacuacggagucauuaccugcgaagguuguaagggcuucuuuaggcggucucaacagaacaaugcuucauauaguugcccucgccagcgaaacugucugaucgaucguacaaauagaaacaggugccagcauugucggcuccaaaaaugccuugcacuggggaugagccgcgacgccguuaaguucggaagaauguccaaaaagcagagggauucuuuguacgcggaggugcagaagcaccagcaacgguuacaggaacagcgccagcaacagucgggcgaggcugaagcccuggcacgaguauauucaagcaguauuuccaauggucuaucuaaccucaauaacgagacuagcgggacguacgccaauggacaugugaucgaccugccaaaauccgagggcuauuacaacgucgauucaggccagccgagucccgaccaaagcgggcuugauaugaccggaauaaagcagaucaaacaggaaccuauuuaugaccugacaucugugccaaauuuguuuacuuacuccucauucaacaauggucagcucgcucccggcaucaccaugacagagauugauagaaucgcacaaaacauaauuaagagccaccuggaaaccugucaguacacuauggaggagcugcaucagcucgccuggcagacacacaccuaugaagagaucaaggcuuaccaaaguaagucuagggaagccuuauggcagcagugcgcgauucagaucacgcacgcaauccaauauguuguggaguuugccaagcggauuacuggguucauggaacugugucagaaugaccagauacuuuugcugaaauccggaugccuagaggucgugcucguacguaugugccgcgcuuuuaacccucugaacaauaccguucuuuucgagggcaaguacggugggaugcagauguuuaaagcccugggaagcgaugacuuggugaacgaagcauucgauuuugcuaagaaucucuguucgcugcaauuaacagaggaagagaucgcccuguucucuuccgcgguccucauuucaccagacagagccuggcuuaucgaacccaggaaagugcagaagcugcaggagaaaauauauuuugcauugcaacaugugauucagaagaaccaccuagacgaugagacucuggcuaagcucaucgccaaaaucccuaccauuacagcugucugcaaucugcauggcgaaaaacuucagguuuucaaacagagucacccagagaucgugaacacccuguucccgcccuuguacaaggaacucuuuaauccugacugugccacgggcugcaaauga

SEQ ID NO: 61951 - RNA, 1494 nt, Artificial Sequence
  derived and/or modified sequence opt3 from RORC__Homo_sapiens__NP_001001523
augagaacccagaucgaggugauucccugcaagauauguggcgacaaaagcuccgggauccacuacggagucauuacaugcgaagguuguaagggcuucuuuaggcggucucaacgcugcaacgccgcuuauucauguacucgacagcagaauugcccuaucgaucguacgaguagaaacaggugucagcauugccggcugcaaaaaugucucgcacuugggaugagccgcgacgccguuaaguucggaagaauguccaaaaagcagagggauucucugcacgcggaggugcagaagcaguugcaacagcggcagcagcaacagcaggaaccaguagugaaaaccccgcccgcuggcgcccaaggugcagacacauuaacuuacacccuggggcuaccugauggacagcucccacugggcucgucacccgaccuuccugaggccagcgcuugcccacccggccuguugaaggcaaguggguccggaccuucuuauagcaauaaccucgccaaagcuggucugaauggcgccuccugucaucuggaauacucaccagagcgcgggaaggcggagggacgagaaaguuuuuauagcacaggcucucagcucaccccggauagaugcgguuuaagguucgaggaacaccggcaucccgggcugggagagcuuggccagggcccugacuccuacgggucacccagcuuucguaguacucccgaggcaccuuaugccucuuugacagaaauugagcaccugguccaauccgugugcaaaagcuaccgcgaaaccugucagcuaagacucgaggaucugcuuaggcagcggucgaacaucuucucucgagaagagguuacgggauaccagcgcaaguccaugugggagaugugggaaagaugcgcucaccaucugacugaggccauacaauauguggucgaauuugcaaagagguugucagguuucauggagcucugucagaaugaccagaucgugcuguuaaaagcuggcgccauggaaguaguucuggugcggaugugccgcgcguacaacgccgauaauagaaccgucuuuuucgaggggaaguauggaggcauggagcucuuuagggcacuugguuguagugaacugauuagcuccaucuucgacuuuucucacagcuugucagcucuacauuucagugaggaugaaauugcccuguacacagcucucgugcugaucaacgcccaccguccagggcuucaggagaaacggaagguggaacaacugcaguauaauuuggagcucgcauuccaccaucaccugugcaaaacucaucgacaguccauauuagccaagcugcccccgaaaggcaagcuaagaagccucuguucucagcacgucgagaggcugcaaauuuuucagcaucuucacccuaucguugugcaggcugcguucccaccauuguacaaggaacuguuuucaaccgagacagaaaguccuguaggacucagcaaauga

SEQ ID NO: 61952 - RNA, 7044 nt, Artificial Sequence
  derived and/or modified sequence opt3 from ROS1__Homo_sapiens__NP_002935
augaagaacaucuacugccugauucccaagcucgugaauuucgccacccuuggaugucuguggauuagcgucguucagugcacuguguugaacuccuguuuaaagucuugcguaacuaaucuggggcagcagcuagaccucggaacgccucacaaccugucagaaccauguauccaggguugccauuuuuggaauaguguggaucagaaaaacugugcucuuaagugcagagaaagcugugaagucggcugcuccucugccgaaggggccuaugaagaagaagugcuggagaaugcggacuugccgaccgcucccuucgccucgucaauuggaagccacaacaugacacucagauggaaaagugccaauuuuuccggcguuaaguacaucauucaauggaaguaugcccagcugcuggguucuuggacuuacaccaaaacagugagccggccuuccuaugucgugaagccacuccaucccuucaccgaauacaucuuucgcguaguuuggauauucacugcucaguuacagcuguauucaccuccaagucccagcuaccgaacacacccucauggggugccagagaccgcaccgcuuauccguaacauugaaucuuccucacccgauacggucgaggugagcugggacccuccacaauuucccggaggcccuaucuugggcuacaaucugagacuaauuaguaaaaaccagaagcucgaugccgggacucagaggaccucuuuccaguuuuauuccacacugccaaauacuaucuaccgguucagcauagcugccgugaacgaggucggagaaggucccgaggcggaaucgucuauuaccacauccucaagugcaguucaacaggaggaacaguggcuuuuucugagccgcaaaaccuccuugagaaagaggucucucaagcaccugguggacgaggcccacuguuuacggcuggaugcuaucuaucauaauauuacgggcaucagcguagacgugcaccaacagaucgucuacuucucagaggggacucucauuugggccaaaaaggcagcuaacaugagugauguguccgaccuucgcauauuuuaucgaggaagcggccugaucucuucaauuaguaucgauugguuguaccagagaauguauuucauaauggacgagcuaguuugcgugugcgaucuggagaacuguagcaauauugaagagaucacaccgccuuccaucucugcaccccagaaaauugucgcggacucguacaacgguuacguguucuaucuccugagggacgggaucuaccgggccgaucuuccaguaccuagcggacguugcgcagaagcuguucgcauuguggaguccuguacccugaaggacuuugccauaaaaccccaagcuaagagaaucauuuauuucaaugauacugcccaggucuuuaugucaacauucuuggacggcagugcaucucaucucauccugccaaggauccccuuugccgaugugaagaguuucgcuugcgagaacaaugacuuuuuagucaccgauggcaaggugauuuuccagcaggacgcgcuguccuuuaacgaguucauaguugggugugaucuaucacacaucgaggaauuuggauucgguaaucucgugauuuuuggcaguucuucccaacugcacccucuuccagggcggccgcaggaguugaguguacuguucggaagccaucaggcacucguccaguggaagcccccugcccuggcuaucggcgccaacgugauucuuaucucugacauaaucgaacuguucgaguuggguccauccgcauggcaaaauuggacguacgagguuaaagugucaacccaggaucccccugaagucacacacauuuuucucaacaucagugggacuaugcugaaugugccagaguuacagagcgccaugaaguauaaaguaucggugcgagcuuccucucccaagcgcccgggcccuuggagcgaaccaucaguuggaaccacacugguccccgccagugagccucccuucauuauggcagugaaagaggacggccuaugguccaagccacucaacucuuuugggccuggagaguuccugagcuccgacaucgguaaugugucagauauggacugguacaacaauagccuuuauuacagugauacuaagggcgacgucuuuguuugguugcugaacgggaccgauauaucugagaacuaccaucuccccuccauugcgggagcuggcgcccuggcauucgaaugguuaggucacuuucuguauugggccgggaaaacauacgugauccagagacaaagcgugcuuaccggccauacugacauuguaacgcacgucaaguugcucgugaaugauaugguuguggacucggucggaggcuaucuguacuggacaacccuauauucaguggagucuacuaggcugaacggggaaaguucccucguucugcagacccagccaugguucagcggcaagaaagugaucgcucuuacauuggaucugucugacgguuuacucuacuggcugguacaagauagccagugcauacaccuuuauaccgccguccugcggggccaguccacuggggacacaacgaucaccgaguuugcagcuuggucaacaagcgagauuagccagaaugccuugauguacuacucuggacgccucuucuggaucaacggcuuuagaauuaucacaacccaagaaauaggucagaaaacauccgugucagugcuggagccggcgagguucaaucaguuuacuauuauccagaccagucuaaagccucugcccgggaacuucagcuucacgccaaaggucauccccgauuccguucaagaaucuucguuucguauugagggcaaugccagcucauuccagauccucuggaacggaccuccagcuguggacuggggcguaguguuuuauuccgucgaguucagugcacauucuaaauuucuggccagcgagcagcacucccuucccguguucaccguugagggguuggaaccuuacgcucuguuuaauuuaucagugacaccguauacuuacuggggaaagggcccaaaaaccucucucagccugcgggcccccgagacagucccuagugcaccagaaaacccccgaauuuucauacuuccuuccgguaaguguugcaauaaaaacgaggugguuguggaauuuagauggaauaagccgaagcaugagaacgggguccugacuaaauucgagaucuuuuauaauauuagcaaccagucuaucaccaacaagacgugugaagacuggauugcgguaaaugugacacccucaguuauguccuuccaacuagagggaaugaguccaaggugcuucaucgccuuucaggugcgcgcuuucaccagcaaaggcccuggucccuacgccgaugucgugaagucgacuacaucugaaauaaacccauuuccucaccucaucacccuguugggcaauaaaauuguauuccuggacauggaucagaaccaaguggucuggacuuuuuccgcagagcggguuaucagcgcuguguguuauaccgccgacaaugagaugggguacuacgcagaaggagauucauuauuccuccugcaccuucauaacagaaguucuuccgagcuguuucaggacagcuugguguucgauauuacagucaucacgauagacuggauuucaaggcaccucuauuuugcccugaaggaaagucagaauggcaugcaaguguucgauguugaccuagagcauaaaguaaaguacccccgcgaagugaagauccacaaccgaaauagcaccaucauuuccuuuucugucuauccacugcuuagccggcucuacuggacugagguguccaacuucggguaucaaauguuuuacuauucaauaaucucucauacacugcaccguauuuugcagccgaccgcuacaaaucagcagaacaaaagaaaucaaugcaguugcaacguuacugaguucgaacugucgggagcgauggccaucgauaccagcaauuuagagaagccucucauuuacuucgcaaaagcucaggaaaucugggccauggaccuggagggcugucagugcuggagggugauaacgguccccgccaugcuugcugguaagacacugguguccuugaccguagauggggaccucaucuacuggauuaucacugcaaaagacucuacccagauuuaucaagccaagaagggaaacggcgcgaucgucucacaggugaaagcucugcgcagccggcacauacuagccuacuccaguguuaugcagccauuucccgauaaggcauuccugucucuugccagcgacacaguggaaccuacuauucucaacgcuaccaauacaucacugacgaucagauugccauuagcaaaaaccaaccugacuugguaugguaucacaucccccaccccuacuuaccucgucuauuacgccgaggugaaugauaggaagaacaguagcgaccugaaauaucgaauacuugaguuucaggauucuaucgcgcugauagaagacuugcaaccguucuccacauacaugauucagaucgcuguuaagaauuacuauucagauccacuagagcaucugcccccuggcaaggaaauuugggggaaaaccaagaacggagugcccgaggccguccagcucaucaauacgacugugcgcagcgacaccucgcugauaauuucuuggcgggaaagucacaaaccaaacggcccuaaggaguccguaagauaccaacuugcaaucagccauuuagcccugauccccgagacaccacucaggcagucagaauuuccuaaugggcguuugacccugcucgugacucgccuguccggaggcaacauuuauguucuuaaaguccuggcuugucacucugaggaaauguggugcacagagagccauccggugaccguggagauguucaauacacccgaaaagccauacaguuuggucccugagaacacuucccuacaguuuaauuggaaggcaccccugaacguaaaucucauccgguucuggguggaauuacagaaauggaaguauaacgaguuuuaccacguuaaaaccagcuguucucaagguccagcauaugugugcaauauuacgaaccugcagccuuacacaucauacaacgucagagugguuguggucuauaagaccggggaaaauaguacuucccuucccgagagcuucaaaaccaaggcuggagugccgaacaaaccaggcauaccuaagcugcucgaggguucuaaaaauucgauccagugggaaaaagccgaggauaacggcuguaggauuacauacuauaucuuggaaauccgaaagucaacuagcaauaaccugcagaaucaaaaccuccgguggaaaaugaccuuuaauggguccugcaguucuguauguacguggaaaagcaaaaaccugaagggaauuuuccaguuucgcgugguugcggccaauaaccuuggcuucggggaguacuccggaauaucagaaaauaucauucuagucggcgacgauuucuggauccccgagacaaguuuuauucugaccaucauaguggguaucuucuugguggucacuauuccauuaacauuuguuuggcacagaaggcugaagaaccagaaaucugcaaaggagggggugaccguacucaucaaugaagacaaagagcuggcugaacuucggggacuggccgcuggcgugggccucgcaaacgccugcuaugccauucauacuuugcccacacaggaggaaaucgagaaccugccugcuuucccgcgagagaagcuaacccugagacuccuucuggggagcggagcguuuggugaagucuacgagggcacggcaguggacauauuagggguuggauccggcgaaauuaaaguggccgucaagacuuugaagaaagguucaaccgaucaagagaagaucgaguuccugaaagaagcucaccucaugagcaaguuuaaucaucccaacauucugaaacagcuugggguaugucugcucaaugagccacaguauaucauauuggaacugauggagggaggcgacuuacuaacauaccugcgcaaggccaggauggcaaccuucuacggcccucuccuuacacugguggauuugguugaccugugcguggauaucucuaaggggugcgucuaucucgaacguaugcacuuuauucaccgggaccuggccgcuagaaacugucuuguguccgucaaagauuacacuagccccaggaucgugaagauuggagacuucggucucgcgcgcgauaucuauaaaaaugacuacuaucgaaagagaggcgaggggcuguugccuguucgguggauggccccagagagccugauggauggaauauuuaccacgcaaucggacgugugguccuucggcauuuuaaucugggaaauccuaacacugggucaucagcccuacccugcacacucuaaccucgauguacuuaauuaugugcagacugggggaaggcuggagccaccccgcaacugcccggacgacuuguggaaucugaugacccaguguugggcucaagaaccugaucagcguccaacauuucauaggauucaggaccagcuccaacuguuccggaacuucuuucuuaauucaaucuacaaaagcagggaugaggccaacaauaguggcgucauaaacgaauccuucgagggcgaggacggggauguuauuugcuuaaauucugacgauaucaugcccguggcacugauggaaaccaagaaccgcgagggacucaacuacauggucuuggccacugaauguggucagggcgaggaaaagagcgaggggccucugggaucacaggaguccgaaaguugcggccuacgaaaagaggaaaaggagccacacgcugacaaagauuuuugucaggagaagcaaguggccuauugccccagcgguaaaccggaagggcugaauuacgcgugucucacccauucuggauauggcgacggcucagauuga

SEQ ID NO: 61953 - RNA, 6471 nt, Artificial Sequence
  derived and/or modified sequence opt3 from RP1__Homo_sapiens__NP_006260
augagcgacacccccuccacuggauucucuaucauucacccuacuucaagugaggggcaagugccaccgccccgccaucugagccucacgcacccugucguugccaagaggauauccuuuuacaaaucuggagauccacaguucgguggcgugcggguaguggucaacccccgcucguuuaagucauucgacgcacuucuggauaauuugagccgaaaagugccuuuaccauuugggguucguaauaucaguacaccccggggaaggcauuccauuacccggcuggaagaacuagaagacggcgagucuuaucucugcagccacggucgcaaggugcagccugucgaucuggacaaagcuagaaggcggccacgcccguggcuuuccucacgagccaucagugcgcauagucccccucacccaguggcuguagccgcacccgggaugccuagaccacccaggucucugguuguguuccggaauggagauccgaagacucgucgcgccgucuugcucuccagaagggugacccagucauuugaggcuuuccugcagcaccugacagaggugaugcaacggccugucguuaagcucuacgcaaccgacggccgacgcgugcccagcuuacaggccguaauucugaguucuggcgcuguggucgccgcggggagagagccauuuaaaccuggaaacuaugauauccagaaguaccuuuugcccgcaaggcugccagguauaucccagcggguguaucccaaaggcaaugccaagagcgaaucgcgcaaaaucucuacucauauguccucaaguagcagaucccaaauuuacucuguuagcucagagaagacacacaacaaugacuguuaucuagauuacaguuucgugccugaaaaguaccucgcucuggagaaaaacgacucccagaaucuuccaaucuauccgagcgaggaugacauugaaaagucuaucauauuuaaccaggacgggaccaugacggucgagaugaaagugagguuccguauuaaggaagaggaaacuaucaaauggaccacaacuguaucaaagaccggacccaguaauaacgaugagaaaagcgagauguccuuuccuggccggacagaaucucgaucgagcggucugaaguuggccgcaugcuccuucucagcugacguuaguccaauggagagaucuagcaaucaggaagggucccucgccgaggaaauuaacauccaaaugaccgaucagguggcggagacguguucaagcgccucuugggagaaugcaacugucgacacagauaucauucagggaacccaagaccaggcuaagcauagguucuacagacccccuacuccaggccugcggagagugaggcagaaaaaguccgucauaggcagugugacauuaguuagcgaaaccgaggugcaggagaaaaugaucgggcaauuuucuuauuccgaggaacgcgagucaggagagaacaagagugaauaccacauguucacgcacagcugcucgaaaauguccucuguaagcaacaagcccguccuggugcagauuaauaacaaugaucagauggaggaaucaagucucgagcgaaagaaagagaacucccuucugaagucuagcgccaucuccgcugguguuauagaaauuaccucacagaaaauguuggagaugagccauaauaacggccuaccgaguacaaucucuaauaacuccaucguggaagaggacgucguggauuguguagugcuggacaauaagacugggauuaaaaacuuuaagaccuauggaaauacaaacgaucgguucagcccuaucucggccgacgcaacucacuuuucaucuaauaacaguggcaccgacaagaauauuuccgaagccccagcuagcgaggcgucuagcacaguuaccgcacguauagauagacucaucaacgaguucgcccaaugcggucugacuaaacuucccaagaacgagaaaaagauucuguccucagucgcuaguaaaaagaagaaaaagagcaggcagcaggccaucaauucucgcuaccaggacgggcaauuggcaacgaaaggcauccucaacaagaaugagcggauuaacacaaaaggaagaauaaccaaggaaaugaucgugcaggauuccgacucaccucugaaaggcgggauuuuaugugaggaagaucugcagaagagugacacugugaucgagagcaauaccuuuugcuccaagucuaaccuaaauucgacaauuagcaaaaacuuccauaggaauaagcucaacaccacucaaaauucaaaaguccaaggacugcuuacaaagcgaaaaucccgcaguuugaacaagaucucucugggugcccccaagaaacgggagauaggccagagagauaagguuuuuccacacaaugaaagcaaauauuguaaguccacguucgagaacaaaucacucuuucauguguucaauauccuggaacagaagccuaaggacuuuuacgcuccccaaucucaggccgagguggcaagcggguaccuuaggggaauggcgaaaaagagucugguauccaaagucaccgauagccacauuacuuugaagucucagaaaaagcguaagggcgacaaagugaaggcuucagccauccucuccaaacagcacgcaacaacccgcgccaacagucuggcuagcuuaaagaaaccagauuucccggaagccauugcacaucacucgauccaaaacuauauacagucuuggcugcagaauauuaacccuuaccccacacuaaagccaaucaaauccgcucccguuugccggaaugagacuagcguggucaacuguucaaauaacaguuucucugguaaugacccucauaccaacuccgggaagauuagcaauuuugugauggagucaaacaagcacaucacgaaaauagccggccucaccggagauaaucugugcaaggaaggcgacaaaaguuucaucgcgaacgacacaggggaggaagaucuucacgagacucagguuggcagcuugaaugacgccuaucuggugccacuccaugagcacugcacccugucccaaucugcuauuaacgaucauaauacaaagagccacaucgcagccgaaaaauccggucccgagaagaaguuaguauaccaggaaauuaaccuggcuagaaaaaggcagucagucgaggccgcaauccagguggacccuauagaagaggagacuccgaaggaucuuuugccagugcucaugcugcaucaacuacaggcgucuguccccggcauucacaaaacccagaacgggguugugcaaaugccuggaagucuggccggcguaccauuucacucggcuaucuguaauagcuccacgaaccuccugcuugccugguugcugguguuaaaucucaaggguucuaugaacucauucugccaggucgacgcacauaaagcuacaaauaagagcuccgaaacccuggcccuucuggagaucuugaagcacauugcaaucacugaagaggccgaugaccucaaagcugcgguggccaaccugguugaaaguacaaccucucauuuugggcuaagcgagaaggagcaggauauggugcccauugaccugucagcaaauuguuccacugucaacauacagagugugccuaaaugcagcgaaaaugagcgaacccaaggcaucucuucccucgauggaggcuguucagcuagcgaagccugcgccccggagguuugugugcuggaagucacaugcucgcccugugagaugugcacgguaaacaaggcuuauucuccaaaagagaccuguaauccuagugacacuuucuuucccuccgauggguacggaguggaccagacaagcaugaacaaggcaugcuuccuuggcgaaguuugcucauugaccgacacaguguuuuccgauaaggccugugcgcagaaagagaaucacacuuaugaaggugcuugcccaauugacgagaccuacgucccugugaacguauguaauacgaucgauuuccugaacucuaaggagaauacauacaccgacaacuuagauagcacugaagaacucgaaagaggggacgauauucagaaagaccugaacauccuuaccgaucccgaguauaagaauggauuuaacacacuggugagucaucaaaaugucuccaaccuaagcucuugcggccucugucugucagaaaaagaggccgaguuggacaagaagcacaguucccuggaugacuucgaaaauugcagcuuacgcaaauuucaggacgagaacgcauacacuucuuucgauauggaagaaccaagaaccucggaagaaccggguucaauaacaaauagcaugacguccagugagaggaacaucucugaacucgagagcuucgaggaacuggaaaaucacgacaccgauauuuuuaacacuguugugaauggcggggagcaggccacagaggaacuuauccaggaggaaguggaggcuuccaagacccuggaguugauugacaucucaaguaaaaacauaauggaagagaagcggaugaauggaauuaucuaugaaaucauuucuaaacgacucgcaacuccucccagccuggauuucuguuacgacuccaagcaaaacucagagaaagaaacaaaugagggcgagaccaagauggucaagaugauggugaaaacgauggaaacugggagcuauucugaguccaguccagaucuaaagaaaugcauaaagagccccguuaccucggacugguccgauuacagaccugacucugauucagaacagccauauaaaacaagcagugacgaucccaacgacuccggagagcugacccaggaaaaggaguacaacaucggcuuuguaaagcgcgccauugagaaacuuuacgguaaggcggacaucauuaaaccuucuuucuuuccggggagcacuaggaagucacagguguguccauauaauuccgucgaguuccaaugcagucguaaagcuagccucuacgauucugagggacagucauuuggcuccagcgaacaggugucuaguucguccagcaugcugcaagaguuccaggaggaacggcaggacaagugugauguuucagccgugagagacaacuauugcaggggugauaucgucgagcccggcacaaagcagaaugacgauucucgcauauugaccgacaucgaagagggggugcugauugauaaaggaaagugguuacucaaagaaaaccaucugcuucgaaugagcuccgagaauccuggcaugugcgggaacgcagacacaacaagcguagauacccuguuggacaauaacucaucugagguccccuacagccacuuuggaaaucucgccccaggcccuacgauggaugaacuguccaguagcgagcuagaggaacugacacaaccccuugaacucaaguguaacuauuucaauaugccacaugguuccgacucugagccuuuucacgaggaccuguuggaugugagaaacgaaaccugcgcuaaagagcggaucgccaaucaccauacugaagagaaggggucacaccagagcgaaaggguuuguaccucggugacacauuccuucauuagugcaggaaacaaggucuacccggugucugacgaugcuaucaaaaaucagcccuuaccaggcagcaacaugauacacgguacucugcaggaggccgacucacucgauaagcuguaugcgcuuugcggccaacauuguccuauucugaccguuaucauccagcccaugaacgaggaagaccgcggguucgccuaccguaaagaguccgauauugaaaacuuuuugggauucuaccuauggaugaagauccacccauaucugcuccagacggacaaaaacguguuuagagaggaaaauaacaaggcaucuaugcggcagaaucugauagauaacgcuauuggcgacaucuucgaucaauuuuacuucaguaauacauuugaccuuauggggaaaaggcgcaagcagaagcgaauuaacuucuuaggacuggaggaggaaggcaaucucaaaaaguuucagccugacuugaaagagagauucugcaugaacuuucugcacaccagccuccuggucguggguaauguagauuccaacacucaagaccuuucagggcagacaaaugaaaucuucaaggccguggaugagaacaauaaccuguugaacaaucgguuucagggaagcaggaccaaccuaaaucagguuguccgcgagaacauaaauugucauuauuucuucgaaaugcugggccaggcuugccucuuagacauuugucagguggagacuucucugaacaucaguaauagaaacauccuugaacugugcauguuugagggcgaaaaucucuucauuugggaggaggaagauaucuugaaccugacagaccucgaguccagcagggaacaggaggaucuguga

SEQ ID NO: 61954 - RNA, 7203 nt, Artificial Sequence
  derived and/or modified sequence opt3 from RP1L1__Homo_sapiens__NP_849188
augaacagcacccccagaaaugcccaggcuccuucccacagggagugcuuccugccaucuguggcacggacaccgucagucacuaagguuacgcccgccaaaaagaucaccuuucucaaacgcggcgacccucgauucgcgggggugcgucuugcuguacaucaaagagccuuuaagacauucagugcacugauggaugaauugagccagagggugccauuauccuuuggaguccggucugugacuaccccccgcggucugcacucgcuaucagcccucgagcagcuggaagacggcggguguuaccuuugcagcgauaaaaagccuccaaagacacccaguggaccuggcagaccacaggagaggaacccgaccgcucaacagcugcgggacguugaaggucagcgcgaggcacccgggacuuccucuagccgaaaauccuugaagacaccuagaaggauucuccugauaaaaaauauggauccacggcugcagcaaaccgugguccucucacaucguaacacgcgcaauuuagccgcuuuccugggaaaggccagugaccuuuugagauuucccgugaaacagcuguauacuaccagcggcaagaagguagauucucuacaggcgcuccugcacuccccuucaguucuugugugugcaggccaugaggccuucaggacaccagcuaugaaaaacgcccggcgaagcgaagcagagacucugaguggguugaccucucgcaauaagaacggauccuggggucccaaaacaaagccgagcgucauccacucgagaucuccucccggcuccaccccaaggcucccugaacggcccgggccaucaaaucccccugugggaccagcuccgggccgccacccccaggacacgccugcccaaagugguccacugguggcgggggaugacaugaaaaagaaagucagaaugaacgaggauggaagcuuauccguugagaugaaggugagguuucaucugguaggcgaagacacucuccuuuggucucgucggaugggccgagccagcgcacugacagcugccucaggggaggaucccguguugggagaagucgacccucuaugcugugugugggaggguuacccauggggcuucagugaacccgggguuuggggaccgagaccuugcagggugggcugucgcgaggucuuuggucgggggggccagccaggacccaaguaugagauuuggaccaauccucugcacgcuucccagggcgaaagaguggccgcaaggaaacgcugggggcucgcccaacauguacgaugcagcggacuguggggucacggcacugcugggcgggagcguuguucucaggacucagcgagucccgcaagcuccacaggacuuccagaaggcucugagccugaaucgagcugcugucccagaaccccagaggaugguguugacuccgccucaccgagugcucagaucggggccgagaggaaggcaggcggaucucugggcgaagauccuggguugugcauugacggagccggucucggcgggcccgagcagggaggccgccugacgccacgggcuagaagcgaagagggugccuccucagauagcucugcauccaccgggagucacgaaggcagcucugaguggggaggcaggccccaagggugcccuggaaaagcgcgagcugagacaucccagcaggaagccucagagggcggugacccagcaagucccgccuuaagccugucgucccuacgcucugaugaccuccaggcugaaacucaagggcagggaaccgagcaggccacaggcgcagcugugacucgggagccucugguccuugguuugagcuguucaugggauagugaaggcgccuccucuaccccgagcacaugcaccuccucacagcaagggcagagaaggcaucguagccgcgcgagugccaugucuuccccaagcucgcccggacugggccggguggcuccuagagggcacccaaggcauucacacuaccgaaaggacacucauucuccccucgauaguuccgucacgaaacaggugccucggccgcccgagcgcagaagggcaugucaggacggaagcguuccacgguauucuggcagcuccucaaguacacgaacccaagccagcgguaaccugagaccucccucuuccgggucacuuccaagucaggaccuguugggaacuagcuccgcuaccgugacaccugccguacacucugauuucgucucgggcgugagcccccacaaugcaccaucagcggguugggccggcgacgcugggucccgcaccugcaguccggccccuauccccccacauacuucugauagcuguuccaagucaggagcagcuucucucggcgaagaggccagggacacaccccagccuagcaguccacugguuuuacaaguggggcgucccgaacagggagcagucggcccucaccggucccauugcuguagccagccggguacgcagccagcccaagaggcucagagagggcccucuccugaggcgucauggcugugcggaagguacugucccaccccaccucgcggccgacccugcccacagagacgguccaguagcugugguucgacuggcucuucccaccagagcacagccagggggccuggaggcucaccgcaagaagggacccgccagcccggaccaacaccuagucccggcccaaacucuggugcaucccguagaagcucagcuagucagggggccggaagccggggccuauccgaggaaaagacucucaggucuggcgggggaccucagggucaagaggaagccagcggcgugucccccucaucucugccgcgcaguucgccagaggcuguagugcgagaguggcuugauaauauaccugaagagcccaucuugaugaccuaugaacuggcagacgagacgaccggggccgcgggaggcggucucagagggccagaaguugaucccggagacgaucacagccuggagggcuuaggcgagccugcucaggccgggcagcaaucccuggaaggagacccgggucaggaucccgagccagaaggcgcacuuuuggggucuucagacacaggaccucagagcggcgagggugucccccagggggccgcuccugagggaguguccgaagcaccagccgaggcgggcgcugaucgggaagcccccgcaggcugcagggugagucuccgcgcccugccugggagagucucugcuagcacucaaauuaugagggcccuaaugggaucaaaacagggucggccauccaguguucccgaggugagccguccgauggcacgccgacugucuugcuccgcuggcgcccucaucaccugucuggcgucacuucaguuguuugaagaggaccuggggagcccugccucgaaggugagauucaaagacucuccaagguaccaggaguuacucaguauuuccaaggaucuguggcccggaugcgacguaggcgaagaucaacuugacagcggucugugggaguugacauggucacaggcacucccugaucuggggucccaugcuaugacugaaaacuucaccccaacgucuagcaguggagucgacaucuccagcggcucuggcgggucaggagagaguuccgugcccugugccauggaugguacacuaguuacccagggcacugaacugccgcucaaaacaagcaaccagcggccugacucucgcaccuacgagucgcccggggaucuggagaaucaacagcagugcuguuuuccaacuuuccuuaacgcuagagcaugcgccugugccaccaaugaagacgaggcugaaagggauucagaggaacagcgggcgagcuccaacuuggagcaacuggcagagaauacagugcaggaagagguccaguuagaagagacgaaggagggaaccgaaggcgagggucuccaagaagaggccgugcagcuggaagagacuaagacagaggaagggcuucaggaggaaggaguucagcuggaggaaaccaaagagacagagggcgaaggccaacaggaggaagaggcucagcuagaagagauagaggaaacugggggagagggucuccaggaagagggcgugcaacuggaggaaguaaaggaggggccugaaggaggcuugcagggugaggcccuggaagagggguuaaaagaggaaggccuccccgaggaaggaaguguccacggccaggagcugucugaagcaagcuccccagacgggaagggaucacaggaggaugaccccgugcaagaggaagaggccggucgagcuagugcgucugccgaaccuugcccagcagagggcaccgaagagccgacggagcccccuagccaucuuuccgaaacagacccaucagcuagcgagagacagucugggucccagcuggaacccggauuggagaaaccuccaggcgccaccaugaugggucaagagcacacucaggcacagcccacccagggggccgcugaacgcaguagcucgguggccuguuccgcggcacucgauugcgacccuauuugggucucuguucugcuaaagaagacagagaaagccuuucuggcucaucuugccucagcuguggcagaacucagggcccgguggggccugcaagauaacgacuugcuggaucagauggcugccgaguuacagcaggacguagcacaacgucuccaggauagcacuaagagagaacugcagaaacuucagggaagggcgggccgcauggugcuggagccgccacgggaggccuugaccggggaacuccugcuacaaacacagcagcgaagacacaggcugcgcggacuucggaaucucagugcuuucuccgagagaacgcuggguuugggccccuuaucuuuuacccuggaagacgagccugcccucagcacugcacuggggucacagcuuggagaagaggcugagggcgaagaguucugucccugcgaagccugcguccguaagaaaguguccccaaugaguccuaaggcaacaaugggugccaccagggggcccaucaaagaggcuuuugaucugcaacagauuuugcagcggaagcgcggcgaacacacugacggagaggcggccgagguugcaccaggcaagacacauaccgauccgacgagcacucgaaccgugcaaggggcugaaggaggccuagguccugggcugucucagggacccggcgucgacgagggugaagacggcgaggggucacagagacucaacagggauaaagacccaaagcugggagaggccgaaggcgaugccauggcacaggagcgggaagggaaaacacacaauuccgagaccagcgcuggaucugaacuuggcgaggccgagcaagaaggugaggggaucagugaacgcggagagacuggcggucagggcucggggcaugaagacaacuuacagggagaggcggcugccggcggggaucaggaccccggacaauccgauggcgcagaggguaucgaagccccugaggcugaaggggaggcacagccagaaagcgagggaguggaggcccccgaagcggagggcgacgcucaggaagccgagggcgaggcacagccugaaucagaggauguugaagccccggaggcugaaggggaggcccaaccagagucugaagacguggagacacccgaagcagagugggaaguccagccugagagcgagggagcugaagccccagaggcggaaaaggaggcccagcccgaaaccgaguccguagaggcacuggaaacagagggugaagaugagccugagagugaaggcgcugaggcccaagaagcagaggaagcugcccaggaggccgaggggcagacucagcccgaaucagaggugauugaaucucaagaggcggaagaggaggcucagccagaaagcgaggacguugaagcacucgagguggaagucgagacccaggaggccgaaggagaggcucagccggaauccgaggauguggaggccccugaagcagagggcgaaaugcaagaggccgaagaggaggcucagcccgaaagugacgguguagaggcgcagccaaaaagcgaaggggaggaagcccaggagguggagggagaaacgcaaaagacagagggcgacgcacagccugaauccgauggcgucgaggcucccgaagccgaggaggaagcacaggaggccgaaggggagguucaagaggcugaaggagaggcccacccagaaucugaggacguggaugcgcaggaagcagagggugaggcccagccugaaucagagggcguggaagcucccgaggccgaaggggaggcacagaaggcugagggaauagaagccccggagaccgaaggcgaggcucaaccagaaagcgaggguaucgaggccccugaagcagagggggaagcgcagcccgagucggagggagucgaagcccaggacgcugagggcgaagcccagccagaguccgaaggcauugaggcacaagaggcugaagaggaagcccagcccgaguuggaagggguggaggcaccugaggccgaaggagaggcgcagccggaaagugaggguaucgaagcuccagaggccgagggcgaagcacagcccgagcuggaagggguugaggccccugaggcugaagaggaagcccaacccgagccagaaggaguagagacuccugaggcagaaggcgaggcucagcccgaaucugagggugaaacccagggggagaaaaagggaagcccacaggugucacucggcgauggccaauccgaggaagccucugagaguagcuccccugucccggaagacagacccacaccaccucccucaccagggggagauacuccucaucagaggcccgguagccagaccggcccgucuaguucccgagcgagcucaugggggaauuguuggcaaaaagacucugagaacgaucacgugcugggagacacgcgguccccagaugcuaagucgacaggcaccccucacgccgaacguaaagcaacuagaauguaucccgagagcaguacaucugagcaggaagaggccccacuugguucccgcacccccgaacagggggcuagcgagggauacgaccugcaggaggaucaagcauugggcucacuagccccuacugaagcgguuggcagggccgacggguucggacaggacgaucuggacuuuuga

SEQ ID NO: 61955 - RNA, 1053 nt, Artificial Sequence
  derived and/or modified sequence opt3 from RP2__Homo_sapiens__NP_008846
augggcugcuucuuuagcaagagaaggaaagccgacaaggagucccggcccgaaaacgaggaggaacgcccuaaacaguacucuugggaucaacgagaaaagguggacccaaaagauuauauguucucagggcugaaggacgagaccgucggacgucucccggguacaguugcuggccagcaguuucuuauccaggauugugagaauugcaacauuuacauauucgaccacagugcaacugugacgaucgaugacuguaccaauugcauuaucuuucuggggcccguaaagggaagcguguucuuuagaaacuguagggauugcaaauguacauuggccugccaacaguuccggguccgcgacuguagaaaguuagaaguguuucugugcugugcgacucagccuauuaucgaguccucuucgaauauaaaauucggcugcuuucagugguauuacccagaacuagcuuuccaauuuaaggaugccggucucucaaucuucaacaauaccuggagcaacauucaugacuucacacccguuaguggggagcugaauuggucccuucugccugaggaugcagugguccaggacuaugugccaauccccaccacugaagaguugaaagccguaaggguuucuacagaagcuaaccggagcauugugccuaucucccgcggacagcgacagaagucaagugacgagagcugccucgucgugcuguuugcaggcgauuacaccauagccaaugcuagaaagcugauugacgaaauggugggcaaaggguucuuucucguccaaacgaaggagguuucuaugaaagccgaggaugcgcagaggguguuccgggaaaaggcaccagacuuuuuaccgcugcuuaacaaaggacccguaaucgccuuggaguucaauggugauggcgcuguggaagucugucagcugauugugaacgagaucuuuaaugggacuaagauguucguuuccgaaucaaaagagaccgccagcggagacguggauaguuuuuauaacuucgcagacauccaaaugggcauuuga

SEQ ID NO: 61956 - RNA, 666 nt, Artificial Sequence
  derived and/or modified sequence opt3 from RP9__Homo_sapiens__NP_976033
augagcuccagacccggcagggaggacgugggggccgcuggagcacggcgcccucgagaaccaccggagcaggaacugcaacguagaagggagcagaagcggcgcagacacgaugcccagcagcuccaacagcuuaaacaucuggaaucuuucuacgagaagcccccuccagguuugaucaaagaggacgaaaccaagcccgaggauugcauuccugacgucccaggcaacgaacacgcgagggaguuuuuagcucaugcccccacaaaagggcuguggaugccucuaggaaaggagguuaaggugaugcaguguuggcggugcaaacgcuauggccaccgaacuggugauaaggaauguccauucuuuauaaaagggaaucagaagcucgagcaauucagaguagcacaugaagacccgauguacgauaucauuagggacaacaaacggcacgagaaggaugugcguauccagcagcugaagcagcuucuggaagacucaacgagugaugaggaccgcagcuccucuucgucaagcgagggaaaagaaaagcacaaaaagaaaaagaaaaaggagaagcauaaaaagaggaaaaaggagaaaaagaagaaaaagaaaagaaagcacaaaaguuccaagucuaaugaaggcagcgauuccgaauga

SEQ ID NO: 61957 - RNA, 1851 nt, Artificial Sequence
  derived and/or modified sequence opt3 from RPA1__Homo_sapiens__NP_002936
auggugggccagcugagcgagggggccaucgcugcaauuaugcaaaagggagacaccaacauaaaacccauccuccaggucauuaauaucagaccuauuacaacugguaacuccccaccgagguaccggcuucugaugucugauggcuugaauacguuaucaaguuucaugcuggccacccagcuaaacccccucguugaagaggaacagcugagcuccaauugcgugugucaaauccaccgcuuuauaguaaacacacuuaaggacgggcgacguguggucauccugauggaguuggaagugcucaaaucugcggaggcuguuggagugaagauuggcaauccugucccauauaacgagggucuggggcagccccagguggccccuccagcacccgccgcuucgccugcagccucaagcagaccacagccgcaaaauggaaguuccggcaugggcucuacuguaagcaaggcuuacggggccuccaaaaccuucggaaaggcggcaggucccucacugagucauacaagcggcgggacccagucuaaaguugugccuaucgccucccucacuccauaucagucaaaguggacaauuugcgcuagggucaccaacaaaagccagauccggacguggaguaauucucgcggagaaggcaaguuauuuucccuggagcuuguggaugaaagcggugagauaagagccacugcauucaacgagcaaguggacaaauuuuuccccuugauugaagucaauaagguuuacuauuuuucgaaggggacccugaaaaucgcuaacaagcaguucacagccgugaaaaaugauuacgagaugacuuuuaacaacgaaaccucuguaaugccuugugaggacgaucaccaucuaccaacagugcaguucgacuuuaccggaauugaugaccucgaaaauaaguccaaagauucacuggucgacaucaucggcauuugcaagaguuaugaggaugcgacgaaaauaacugugaggagcaacaaucgggagguugccaagcgcaacaucuaccuuauggacacauccggcaagguggucaccgcaacucuguggggagaagacgcugauaaauucgacgggucucgacaacccguguuggccauuaagggugcuagaguaagcgauuuuggcgggaggucacucaguguucuguccagcucuacaaucauagccaauccggacauuccugaggcauacaaauuacggggaugguucgaugccgaaggccaggcucuggacggugugucaaucagugaucucaagagcgggggcgucggaggcuccaacaccaauuggaaaacgcuuuaugaggugaagucugaaaaccuggggcagggagacaagcccgauuacuucucgagcgucgcgaccgugguuuauuugcguaaagagaauuguauguaccaggcaugcccaacacaagacuguaacaagaaagugaucgaucagcagaauggucuauaucgcugcgagaagugugacacugaauuuccuaacuucaaauacagaaugauucuguccguaaauaucgccgacuuucaggagaaccaaugggugaccugcuuccaggaaucagcugaggccauucucggccagaaugcagccuaucugggggaacuuaaggauaagaacgagcaggcuuuugaggaagucuuccaaaacgccaauuuuaggaguuucauauuucggguucgagugaaagucgagacauacaacgacgaaucucgcaucaaggcaacugugauggauguaaaacccguggacuacagagaguauggaaggcggcugguuaugagcauucgcagauccgcguugauguga

SEQ ID NO: 61958 - RNA, 837 nt, Artificial Sequence
  derived and/or modified sequence opt3 from RPA2__Homo_sapiens__NP_001284487
augggcagaggggacaggaacaagcggagcauccgcggauucgaguccuacgguucuucaaguuauggcggggccggaggcuacacccagagccccgguggguuuggauccccugcuccaucucaagcagagaaaaagucgcgagcccgugcgcagcacauugugccgugcacaauaucacagcugcucagcgcuacucuugucgaugaaguuuucagaaucggcaauguggaaauuagucagguaacgaucgugggcauuaucaggcaugccgagaaagcacccaccaacauagucuauaagaucgacgauaugacagccgcuccuauggacgugcggcaauggguugauacugacgauaccuccucugaaaauacaguggucccacccgagaccuacgugaaaguagcagggcaucugcgcagcuuucagaacaagaaguccuugguugccuucaaaauuaugccuuuagaggacaugaaugaauuuacuacacacauccuggaggugauuaacgcucacaugguccuaucaaaggccaauagucagccaagcgcggguagagcacccaucucuaacccuggaauguccgaagccggcaauuucgggggaaacucauuuaugccagcuaauggccucaccguggcccagaaccaagugcugaaucuuauaaaagcauguccgaggcccgagggucugaacuuccaggauuugaagaaucagcucaaacauaugagcgucaguucuauuaagcaggcuguugacuuucuguccaacgaggggcacaucuauagcacgguggaugacgaucacuucaagucgacugacgccgaauga

SEQ ID NO: 61959 - RNA, 366 nt, Artificial Sequence
  derived and/or modified sequence opt3 from RPA3__Homo_sapiens__NP_002938
augguggacaugauggaucugcccagaagcaggaucaacgccggcaugcucgcucaguucauugacaagccugucugcuuuguugggcggcuugagaaaauacacccaaccggaaagauguucauccuguccgauggugaaggcaaaaaugggacaauugaguugauggaaccguuagacgaggaaaucucuggaauuguggagguagugggccgcgucacugcaaaggccacgauccuguguaccucauacgugcaauuuaaagaggauagucaucccuucgaccuaggucucuauaacgaagcgguuaagauaauccacgauuuuccucaguucuacccacuggggauugugcagcaugacuga

SEQ ID NO: 61960 - RNA, 786 nt, Artificial Sequence
  derived and/or modified sequence opt3 from RPA4__Homo_sapiens__NP_037479
augagcaaguccggcuucgggucuuacggaucaaucagugccgcugacggugcaagcggcggguccgaucagcugugcgagagagacgccacccccgcgauuaaaacacaaaggccuaaggugcggauacaggaugucguuccauguaacgugaaucagcuccuuucuucgacuguauuugacccgguguucaaaguccgcggaaucauugugucacagguuagcaucgugggcgucauucgaggugcugaaaaggccaguaaccacaucugcuauaaaauagaugacaugacggcaaagcccaucgaggcccgucaaugguuugggagagaaaaggugaaacagguaaccccucuguccguuggaguguacgucaagguguucggcauuuugaaauguccaacaggcacuaagucuuuagaggugcugaaaauccauguccuagaagauaugaaugaguuuaccguucacauucucgagacagugaacgcucauaugaugcuggacaaggcaaggcgggauaccacuguagaaagcgugcccgucuccccuucagaggugaaugacgccggggauaacgacgaaagucaccgcaauuucauccaggaugagguucuuagacugauacaugagugcccacaccaggaaggaaagagcauucacgaguugagggcucaacucugugaccugucugugaaagccaucaaggaagcgauugacuaucugacagucgagggucauaucuaccccaccguggaucgggaacacuuuaaauccgcagacuga

SEQ ID NO: 61961 - RNA, 660 nt, Artificial Sequence
  derived and/or modified sequence opt3 from RPAIN__Homo_sapiens__NP_001028174
auggccgagagccugagaucccccaggcggucucucuacaaacuugugggcucaccuccauggaaggaggcuuuccgccagcgaugccuggagcguaugagaaacaguagggaccgguuguuaaaucgcuauagacaagcagggagcuccggaccggguaacucucaaaauucguuucugguccaggaaguuauggaggaagaguggaacgcccuacagucaguggagaauugucccgaagaucucgcgcagcuggaggaacuuaucgacauggcuguacuggaggagauucagcaggaauugauaaaccaggagcaaagcaucauuagugaauacgagaagucccuccaguucgaugaaaaaugccugucuaucaugcuggccgagugggaggcaaauccucucauuuguccagugugcaccaaguauaacuuaaggaucacaagcggcgucgugguuugucagugcgggcuguccauacccucacacaguagcgaacuuacugagcagaaauugcgggccugucuggaaggaucuaucaaugagcauuccgcucacugcccucauacgccagaauuuucagugaccggcgguacagaggaaaagagcagucuacucaugucuugucuggcaugcgacacuugggccgucauucuuuga

SEQ ID NO: 61962 - RNA, 4182 nt, Artificial Sequence
  derived and/or modified sequence opt3 from RPAP1__Homo_sapiens__NP_056355
augcugagcagacccaagccuggcgaguccgaaguggaccuccuucacuuccagucucaauuucuggccgcuggggcagccccagcgguccaguugguuaaaaagggaaacagggguggcggggaugcuaauucagaccggccgcccuuacaggaucaucgcgacgugguaaugcuggauaaccuaccugaccucccacccgcccuggugccuaguccacccaaacgagcacguccuagcccaggacacugccuuccggaggaugaagaccccgaggaaagacugaggcggcaugaucagcacaucaccgccgucuugacaaagauuauagagcgcgacacuuccucuguggcuguuaaucucccugugccaucgggcgucgcauuccccgccguguuucugagaucaagggauacgcaagguaaaagcgcuaccagugggaagcgguccaucuucgcccaggagauugcggcacgccgaaucgccgaagcuaagggaccuucuguaggcgagguugugccaaacgucggcccgccggaaggggccgugacaugugagacuccuacccccagaaaucagggaugccagcugccagguagcucccauucauuucaaggcccuaaccucgugacagggaaaggauuaagggaccaggaggcagaacaggaggcucagaccauucacgaagagaauaucgcccggcugcaagcgauggcccccgaagagauacuucaggagcagcaacguuugcuggcacagcuagauccaagucucgucgcuuuccugcgcagccacucucauacucaggaacagacaggcgagaccgccuccgaagaacaaagacccggugggccuucagcuaacguuacgaaggaggagccacuuaugagcgccuuugcaagugagccgaggaaacgggacaagcuggaacccgaggccccugcuuuggcgcucccagugacuccccagaaagaauggcugcacauggacaccguagaguuagaaaagcugcauuggacacaggaucucccuccagugcgacgccagcaaacucaggagagaaugcaggcaagguucucucuucagggagagcuguuggcccccgacgucgaucuaccgacccaccugggccuccaccaucacggcgaagaggcugaacgggccggguacucccugcaagagcuuuuucaucugacacgcagccaggugucgcagcagagagcauuggcccuccacguucuggcucaagugaucucuagggcccaggcaggagaguucggugaccguuuagcgggcuccguccugucacuacuccuggaugcuggguuucuuuucuugcugcgguuuagucucgacgaucgaguggacggaguaauugccaccgcaaucagagcccugagggcccuucugguugccccuggcgaugaagaguugcucgacagcacguucuccugguaucauggugcacugacuuucccauuaaugcccucucaggaagauaaggaggacgaagacgaggaugaggaauguccugcugggaaagccaagcgcaaaagccccgaggaagagucacggccaccucccgaccuggcgagacacgaugugauuaagggccuacucgccacaagucugcuuccaagguugcgcuacguccuggaagugaccuauccgggaccugcugucgugcucgacauccuggcaguuuuaauacgacuggcccggcacucccuugagagcgcuacucguguguuggagugccccagacucauugaaacaaucguaagggaguuucugccaaccucuuggucacccgucggcgccgggccuacgccaagucuauacaaagugcccugugcaaccgcgaugaagcugcuccgcguucuggccagcgcuggacggaauauugccgcaagacuuuuguccucuuucgaucugaggucgcgauuaugccgcaucaucgcugaagccccucaagagcucgcacugccgccagaagaggccgagaugcuuagcacagaagcucugcgguugugggcgguggccgcauccuauggucagggcggguaccucuauagagagcuguaccccguccuaaugagggcucuccaggugguaccucgugaacugucaacucauccaccccagccucugaguaugcaacgcauugccucucuuuugacccuguuaacacagcucacucuggccgcuggaagcaccccggcagagacaauauccgacucagccgaggcgagccuuucugcuacccccucccuggugacuuggacgcagguuaguggccuacagccacucgucgaaccuugucugcggcaaacauugaaacuguuaagcagacccgagauguggagggccguggguccagugccugucgcaugccuccuguuucuuggggccuacuaucaggcuuggucucagcagcccuccucauguccagaagauuggcugcaagacaugcagcgauugagugaggaacuccugcuaccgcugcuuagccagccuacccucggcucgcugugggauuccuugcggcacugcucucuguuauguaacccccucagcugcguuccagcacuggaggcucccccuucacuugugagucugggaugcuccggcggguguccacgcuugucucucgcgggaagcgcuucccccuucccuuuucugacugcccuacugucacuucucaauacccuggcacaaauccauaaggguuugugcggccaguuagccgcuauucuggccgcaccggggcuccagaacuacuuccugcaguguguggcuccaggagccgcgccccaccuuacaccuuuuagcgccugggcacugagacacgaguaucauuugcaauaccuagcucuggcccucgcucagaaggcagccgcccugcagccccuuccagcuacccacgcggcauuauaucauggcauggcccuggcucucuugaguaggcugcucccugguucugaauaccugacucacgagcuucuguuguccugcguauuccggcuagaauuucugcccgagcgaacaagcgggggcccagaagccgcagacuucucggaucagcucucauuaggaucuaguagagucccucgcuguggccaagggacgcugcuugcccaggcuugccaggaccugccguccaucaggaauuguuaucucacccauugcagccccgcgcgugccucuuugcuggcaagccaggcucuccaccggggagagcugcaaagagugccaacucuucuacugccuaugcccacagagccauuguuaccuaccgauuggcccuuucugccgcucauaaggcuguaccaccgcgccuccgacacaccaucaggccuuaguccuacugacaccauggguacggcaaugcgaguucugcagugggugcucgucuuggaaagcuggagaccccaggcccugugggcugugccacccgccgcgcggcuagcaaggcugauguguguuuuccucguggauucugagcuuuuucgcgaauccccuguacagcaucuggucgccgcuuuauuggcccaacugugccagccccaggugcuccccaaccugaaucuugacugucgucugccagggcucaccucauucccugauuuguacgcuaacuuccuggaccacuuugaggcagugaguuucggagaucauuuauuuggcgcccuaguccugcucccccuucaaagacgguucagcguuacacugagguuggcucuguuuggugaacacgugggcgcccuccgcgcacugucccuuccucucacucagcugccaguaucuuuggagugcuauaccgugcccccugaggacaaccuggcguuacuacagcuguacuuccgaacacucgucacuggggcccuuagaccacgguggugccccgugcuguaugcuguugccguggcacaugucaauucguuuauuuucagccaggauccgcaaucauccgacgaagugaaagcugccaggcgcaguauguugcagaagaccuggcugcucgcagaugagggacugagacagcaccuuuuacacuacaaacugccuaacucuacgcucccagaaggcuuugaguuguauagccagcugcccccucuaaggcaacauuaccugcagcggcucacauccaccguucuucagaauggggugucagagacuuga

SEQ ID NO: 61963 - RNA, 600 nt, Artificial Sequence
  derived and/or modified sequence opt3 from RPE__Homo_sapiens__NP_001265214
auggccagcggcugcaagaucgggcccuccauucugaacucugaccucgcuaaucuuggagcagagugucugagaauguuggauucaggugccgacuacuuacaccuggaugugauggacggccauuucgucccuaacauaaccuuugggcacccaguuguggaaagucuaaggaaacagcucggacaagauccguucuuugacaugcauaugaugguaagcaagcccgagcagugggugaaaccuauggcggucgcuggcgccaaucaguauacauuccaccuggaagcaacugagaacccaggugcccuuaucaaggauauucgggaaaaugggaugaaagugggacuggcuaucaagcccggcacguccguugaguacuuggcaccuugggccaaccagauugacauggcucucgugaugaccgucgagccaggcuuugggggacaaaaguucauggaagauaugaugcccaaagccggugcgaauaugaucgugucuggcucggcaauaaugcgcucagaggacccucgaagcguaaucaaccugcugcguaauguuugcagugaagccgcucagaagagaucccucgauagguga

SEQ ID NO: 61964 - RNA, 2448 nt, Artificial Sequence
  derived and/or modified sequence opt3 from RPGR__Homo_sapiens__NP_000319
augagagagcccgaagaacugaugccugacagcggcgccguguucaccuuugggaaguccaaauucgcugaaaacaauccaggaaaguuuugguucaaaaacgaugucccgguucaccucucuugcggugacgagcauucagcagugguaacaggcaauaacaagcucuacauguuugggaguaauaacuggggacagcugggcuuggguagcaaauccgccaucucuaagcccacuugugugaaggcguuaaaaccugaaaaggucaaacuggcugccugcgggaggaaucacacgcuagugucgaccgagggaggcaacguuuaugcaacaggcgggaauaacgagggacaacucggucugggcgauacugaagaacggaauaccuuccaugugauuucauuuuucacaagcgaacacaagauaaaacagcuuagugccggguccaacaccucugcugcacugacugaggacggacgcuuguuuauguggggcgauaauagcgagggucagaucgggcucaagaacgucuccaauguguguguaccacagcaaguuacaauuggaaagcccgugucauggaucaguugcggcuacuaucauagcgccuucgucaccacggacggcgaacuguacguguuuggggagccugaaaacggaaaacugggucucccaaaccaguuacugggcaaucaccgaacuccccagcuugugucugagauuccugaaaaggucauccagguugcuugugggggagagcacaccgugguauugacagagaacgccguguauacuuucggccugggucaauuugggcagcuaggccucggaaccuuccuguucgaaacauccgagccaaaagucauagaaaauauccgugaucagaccauuucauacaucagcugcggcgagaaccauacggcgcuuauuacugacaucgggcugauguauacauuuggagaugguagacacggcaaguuggggcucggacuggaaaauuucaccaaccauuuuauaccgacuuuauguaguaauuuccugagguuuauugugaaacucguugcaugcggcgguugucacaugguggucuucgccgcuccccaccgcgggguggccaaggagaucgaguuugacgaaauuaacgauacaugccuuucuguagcaaccuuccugccuuacuccagcuugacgucgggcaauguucuacagcggacccugucugcuagaaugaggcggcgcgagcgagaaagauccccagacucauuuaguaugaggcggacacuucccccuaucgagggaacucugggccuuagcgccuguuuccugccaaacuccguguuuccccguugcucugaacgcaauuugcaagagagcguccucucagagcaggaucugaugcagccggaggagccugacuacuuacuggacgaaaugaccaaagaggcggagaucgauaacaguuccacaguggaaagccuaggggagacuaccgacauucucaauaugacacauauaaugucucugaacucaaaugaaaagagucuuaaguugagccccguccaaaaacagaagaaacagcagaccaucggagagcugacucaagauacggcccucacagaaaacgacgauuccgacgaguaugaggaaaugucugagaugaaggaagguaaagcaugcaagcagcacgugucgcagggcauuuucaugacccagccagcuacuaccaucgaggccuuuagcgaugaagagguugagauaccugaagagaaggaaggggcugaggacuccaaaggaaacggcauugaggagcaagagguggaagccaaugaggaaaacguaaagguccauggugggagaaaagagaagacagagauccugucagaugaccuuaccgauaaagcagaagaccacgaguucaguaagacugaggaacugaaguuggaagacguggaugaggagaucaaugccgaaaacguugagucuaaaaagaaaacagugggcgacgaugaaagcguccccacgggauaccauuccaagaccgagggcgcugaaaggacuaaugacgauucaagcgcggagacaauugagaaaaaggaaaaggcaaaccucgaggaacgggccaucugugaguauaaugaaaacccaaaaggguacaugcuggacgaugcugacucuuccaguuuagagauucuggagaauagcgaaaccacacccucuaaggauaugaaaaagacuaaaaagauauuccuauuuaaacgagugccuuccaucaaccagaagauuguaaagaauaacaaugagccacucccggaaaucaaaucaaucggagaccagauuauacugaagagugauaacaaagacgccgaucagaaucacaugagccaaaaccaccagaacauucccccuaccaauacggagcgcagaucgaaguccugcaccauccuuuga

SEQ ID NO: 61965 - RNA, 3861 nt, Artificial Sequence
  derived and/or modified sequence opt3 from RPGRIP1__Homo_sapiens__NP_065099
augagccaccugguggaccccaccuccggcgaucucccugucagagacaucgaugccauuccacuuguucugccggcuucuaaggggaaaaacaugaagacacagcccccuuugucaaggaugaaucgggaggaauuagaggacaguuucuuucgccugcgagaagaucauaugcuagugaaagagcucagcuggaagcaacaggacgaaauaaaacgucugagaacuacgcuucugagguugaccgcagccggacgggaucuccgcguagcggaggaggcugccccacuguccgaaacagcaagaaggggucagaaggccggcuggcggcagcgccugucuaugcaccaacgaccccagaugcauagacuccaggggcacuuccauugcgugggaccugcuucgccaaggcgggcacagccccguguccaagugggccaccgccaguuacacacugccggugcuccuguuccagagaagccgaaaagagggcccagggaccggcugucauacaccgccccucccagcuuuaaggaacaugcgacaaacgagaaucgaggagagguggcaaguaaacccuccgaacuugucucuggcagcaacuccaucauuucauucaguagcgugaucucuauggccaagccuauuggcuuguguaugccaaauuccgcucacaucauggccucaaacaccaugcagguagaggaacccccgaaaagcccugagaagauguggcccaaggaugaaaauuuugagcagcgcaguucucuggagugcgcacaaaaagcugccgaacuaagagcguccauaaaggagaaaguugaacucaucaggcugaagaaacuucugcaugagcggaacgccagcuuggugaugacuaaggcacagcucacagaaguccaggaggcuuaugagacccuguuacagaaaaaucaggggauucugucggccgcucacgaagcccuccuuaaacaggugaacgagcugcgcgcagaauugaaggaggaaucuaaaaaggccgugucccuaaaaucacagcuggaggacgucaguauccuccaaaugacgcugaaggaguuccaggaaagaguugaggaucuugaaaaagagaggaagcuguugaaugacaacuacgauaagcuccuggagagcauguuagacuccucugacagcucaagucagccacacugguccaaugaacugauugcugagcagcuacaacaacaggugagccagcuccaagaucagcuggacgcggaacuugaggauaaacguaagguauugcuggaacucucucgggagaaagcacagaacgaggaccugaaacuugaagugacuaauauccugcagaagcauaagcaagaggucgaauugcuccagaacgccgcuaccauaucacagccucccgaucgacaaagugagccagccacacaccccgcagugcugcaggaaaacacucagauugagccuagcgagccaaagaaucaggaagagaaaaaguuaucccaaguucugaacgaacuacaggugucucaugccgagaccacacucgaacuggagaaaaccagagacaugcuuaucuugcagaggaagauuaaugucuguuaucaggaggaacuggaggcuaugaugacgaaagccgauaacgacaaucgcgaucacaaggaaaagcucgagcggcugacuagauuacuggaccuuaaaaacaauaggaucaagcaauuggagggaauccuccgcucgcaugaucugccgacaagcgaacagcuaaaagacguggcauacgguacccgaccccugucccucugccuggagacucuuccugcgcacggcgacgaagauaagguagacauuucauugcugcaccagggggagaacuuauuugaacuccauauacaccaggcuuuccugacaagugccgcacuugcccaagcuggagauacccagccaacgaccuuuuguacauauucuuucuacgacuuugagacucauugcaccccacugagcguuggcccucagccauuguaugauuucacaucccaauacgugauggagacugacucacucuuucugcacuaccuacaggaagccagcgcacggcuggauauccaccaggcuauggccucugagcauuccacccucgcggccgguuggauuuguuucgaccguguccuggaaacaguggagaaaguccacgggcuugcuaccuugaucggagcaggcggcgaagaguucggggugcuggaguauuggaugagauuaagguuucccauaaagccgagucuccaggccugcaauaaacgcaagaaggcucaaguuuaccugagcacugaugugcuuggaggucggaaagcccaggaagaggaguucagaucugaauccugggaaccucagaacgagcuguggauugagaucacgaaguguugcggccuaaggucacgauggcucgggacacagccaagucccuaugcaguauaccgcuuuuucaccuuuagcgaccaugauacugcgaucauuccugccucgaauaaccccuauuuccgggaccaagcuagauuuccaguccuggugaccuccgauuuggaccacuaccugaggcgugaagccuuaucuauccauguuuucgacgaugaggaccucgaaccuggaagcuaucugggccgcgcacgggugccccuucugccauuggcuaaaaaugagucaauuaagggugauuuuaaccucacagacccggccgagaaaccuaaugggaguauacagguccagcuggauuggaaguuccccuacaucccacccgaauccuuucuaaagccugaggcacagaccaaaggcaaggacacuaaagauucuagcaagauuuccucagaagaggaaaaagccagcuucccaagucaagaccagauggcuucucccgaggugccuaucgaggcgggacaguacagauccaagaggaagccgccacacggcggggaacgaaaagagaaggaacaccagguagugagcuauucgcggcgcaaacauggaaagagaaucgguguucaaggcaaaaacaggauggaguaccugucacuuaacauucucaaugggaacacacccgaacaggucaauuauacggaguggaaguuuucugagaccaacaguuucauaggagauggcuucaagaaucagcacgaagaggaagagaugacucugucccauagcgccuugaaacaaaaggaaccucugcacccagugaacgacaaagagucuagcgagcaggguuccgaagugucagaggcacagacaaccgauagugacgaugucaucguucccccuaugagccagaaguacccgaaagcugacucugaaaagauguguauugagaucguguccuuagccuuuuaucccgaggccgaagugaugucagacgagaauauuaaacaaguauacgucgaauauaaguucuacgaucucccacugagugagacagaaacuccugugagccuucggaagccccgagcuggggaggagauccauuuucacuucuccaaaguuauagaccuggauccacaggaacagcagggcagacgcagguuuuuguucgacaugcucaacggacaagauccugaccagggccaccugaaguuuaccguggucucugauccccuagacgaggaaaagaaggagugcgaagaggugggguacgcauaucugcagcuuuggcagauccucgagucgggacgugauauucuggaacaagaguuggacaucguuagcccagaagauuuagccacgccgauuggucggcugaaagugucacuccaggcggcugccguacugcaugcaaucuacaaggagaugaccgaagaccuuuucuccuga

SEQ ID NO: 61966 - RNA, 3708 nt, Artificial Sequence
  derived and/or modified sequence opt3 from RPGRIP1L__Homo_sapiens__NP_001121369
augagcggccccaccgacgagacagccggggaucugccugugaaggacacuggacucaaccuuuucgguaugggcgggcugcaggaaacguccaccacaagaacuaugaaaucuaggcaagcugucucacggguuagucgcgaggaauuggaggaucgauuuuuacgucugcacgacgaaaauauccuacucaagcagcaugcaagaaaacaggaggauaagauuaaaaggauggccaccaagcugauacggcuugugaacgacaagaaacgcuacgagagaguaggaggcgguccaaagaggcuggggcgggauguggaaauggaggaaaugaucgagcaguugcaagagaaaguccacgaacucgagaagcagaaugaaacacugaaaaaccgccugauuagcgcgaagcagcagcuccaaacccagggauaucgacagacuccguacaauaacgugcaguccagaaucaauacaggcaggcggaaggcuaacgagaaugccggcuuacaagaaugcccccguaaagggauuaaguuccaggacgcagauguugccgagaccccucauccaauguuuacgaaauauggaaacucucugcuugaggaagcucgcggugagaucagaaauuuggaaaacgugauacagucgcaaaggggccagaucgaggaacuggagcaccuagcagagauucucaagacucagcugcggcgaaaagaaaaugagaucgaacuuucacuguugcagcuccgcgagcaacaggccaccgaccagagaagcaacauuagggauaaugucgaaaugaucaagcugcauaaacaguuaguggagaagaguaacgcucuguccgccauggaggggaaguucauacaacuccaggaaaaacagcggacacuucgcauuucucacgacgcgcugauggcaaacggagaugaguugaauaugcagcuaaaggaacaaagacugaaauguugcagccucgagaagcagcugcacuccaugaaauuuucagagaggcguaucgaagaacuucaggaccggauuaacgaccuggaaaaggagcgagaauugcucaaggagaauuacgauaaacuguaugacagugccuucagcgcugcccaugaggaacaguggaaguuaaaagagcaacagcugaagguacagaucgcacaacuagaaacugcucucaaaucugaucugaccgacaagacagagauccuugauagauugaagaccgaaagggaccagaacgagaaacugguucaggagaaucgcgaacuccagcugcaauaccuugagcagaagcagcagcuggaugaauugaaaaagcggauuaaacucuauaaccaagagaaugacauaaacgccgaugaacuguccgaggcguuacugcuaaucaaggcccagaaggagcagaaaaauggcgaccucucauuucuggugaaggucgauagcgaaauuaacaaagaccuugagagaaguaugagggaauugcaggcaacgcacgcugagacugugcaagagcuggaaaagacacgcaauaugcucaucaugcagcauaaaauaaacaaggacuaccagauggagguggaagccgucacccgaaaaauggagaaucugcaacaggauuacgaauuaaagguugagcaguaugugcaucugcuugacauucgggcugcccguauccacaaguuggaggcacagcucaaagauaucgccuacgguacuaagcaauauaaauucaagcccgaaauuaugccugacgauucuguagacgaguuugaugaaacaauccaccuggagagaggggaaaaccuauucgagauucacauaaauaaagugaccuuuuccagcgagguccugcaggcuucgggagacaaggaaccagugacguucuguaccuacgcguuuuaugauuucgagcuccagacaacucccguugugaggggccugcauccugaauacaacuucaccucucaguaucuuguccacgugaacgacuuguuucugcaauacauccagaagaauacaauuacuuuagagguacaucaggcauacuccaccgaauaugagacaaucgccgcuugccagcucaaauuccacgagauccuggaaaagucaggccgcauauuuuguaccgccagucuuauugggacuaaaggagauaucccaaacuucgguacgguugaguacugguuucggcugagagugccgauggaccaagcaauuagguuguaucgagaacgcgccaaggcucucggcuacaucacaagcaauuucaaagggcccgagcacaugcagucccugucucagcaggccccuaagaccgcacaacuaagcucaacugauaguaccgacggaaaccugaaugagcuccauauuacaauccggugcuguaaccaucugcaguccagagcgagccaccuucagccacaccccuaugucguguacaaguuuuucgacuuugcugaucacgacaccgccauaaucccuucuucaaaugauccacaauucgacgaucauauguauuuucccgucccgaugaacauggacuuggauagguaccugaaaagugagagcuuauccuucuacguguuugacgauucugacacucaggagaauauuuauaucggcaagguuaacgugccucucauuucgcuggcacacgaucguugcaucagcgguauauucgaacuuacagaccaucagaaacaccccgccgggacgauucauguaauccugaaguggaaauucgcuuaccuaccaccuuccggcucaauuaccacugaggaucucggaaauuuuauccgcagugaagaacccgaggucgugcagcggcugccacccgccucuagcguuuccacauuggugcuggcaccuagaccaaagccgaggcaacgauuaacccccgucgacaagaaagugucauucguagacauaaugccucaccagagcgaugugucucaggaaggcuccguugacgaggucaaggaaaacacagagaaaaugcagcaagggaaggaugacgugagucuccugagcgaaggacagcuugcugagcagucucuggccuccucagaggaugaaacugagaucaccgaagacuuggagccagaaguggaggaggauaugagugcgagcgacucggaugacuguauuauccccgguccuauuuccaaaaauaucaagcagccaucugagaaaauacggauugagaucaucgcccucagccugaacgauucacaagucacgauggacgacaccauucagcgccuauuuguugaaugcagauucuauagucugcccgcugaggagacaccggugucccuuccuaagccaaagucuggccaguggguguacuauaauuacagcaacguaaucuaugucgauaaagaaaacaauaaggcaaaaagggacauucucaaggccauacugcaaaaacaggagaugcccaaccgguccuugcgauuuacugugguuucagauccucccgaagacgagcaggaucuggaaugugaggacaucgggguggcucacgucgauuuagccgacauguuccaggagggaagagaucucauugaacaaaauaucgacguguuugaugcacgcgcggacggcgaggguauugggaagcugaggguuaccguggaagcccuucaugcucugcagagcguauacaagcaguaccgugaugacuuggaggccuga

SEQ ID NO: 61967 - RNA, 2085 nt, Artificial Sequence
  derived and/or modified sequence opt3 from RPH3A__Homo_sapiens__NP_001137326
augaccgacacaguguucagcaacuccucuaauagauggauguaccccucagauaggccucugcagaguaacgacaaggagcaacuccaggccggcuggagcguccacccagggggacagccggaucggcagcgcaaacaagaggaacuuacugacgaagagaaggaaaucauuaaucgaguuauagcucgugcagagaaaauggaggaaauggagcaggaaagaaucgguaggcugguggaucgguuggagaacaugcgcaagaauguagccggcgacggggugaacagaugcauuuuauguggagagcagcugggcaugcuagguuccgcgugcgucgugugugaagauugcaaaaagaauguuuguacgaagugcgggguggagaccaacaauaggcuccauucugucuggcuguguaaaaucugcauugaacagcgggagguguggaagcgcucgggagcuugguuuuucaaaggcuuucccaagcaaguacuuccucagccaaugcccaucaaaaagacaaagccucagcagccaguuucagaacccgccgcaccugagcaaccagccccggagcccaaacacccugcucgagcaccagccagaggcgacagcgaagauaggcgggggcccggacagaagacugguccugacccagcuagugcccccggccgugggaacuauggaccgccugugcgcagagcguccgaggcaaggaugucuagcuccucacgggauagugaaagcugggaccauucuggcggugccggggauuccucacgaagccccgcuggacugcgcagagccaauaguguccaggcaucuaggccagcuccuggcuccgugcaaagccccgccccaccccagccuggccagccagggaccccgggagguucgcggcccggcccugggccagcgggacgcuuccccgaccagaaaccugagguggccccaucugaccccggcacaaccgcaccgccuagagaagagaggacugguggggucggcggauacccagcuguuggcgcccgugaggaucggaugucccaccccucagggccuuauagucaagcuagcgccgcagcuccccagccagccgcggcacgacagccucccccaccggaagaggaagaggaagaggccaacuccuacgacucugaugaggcuacaaccuugggagcccucgaauuuagccugcuguaugaccaggauaauucaagucuccaauguacgauaaucaaggcaaaagguuuaaagccuauggacuccaacggccuggccgaucccuacgugaaacuucauuugcugccaggggcuagcaagucuaauaagcuaagaacuaaaacccucaggaacacacgcaaccccauuuggaaugagacucugguauaucacggaaucaccgacgaagauaugcagcggaagacacuuagaauuucagugugcgacgaggauaaauucggccacaacgaguuuaucggugaaaccagguucagucugaagaaauugaagccuaaucagcgcaagaacuuuaauauaugucucgagcgagucauuccaaugaaacgggccgggacgacuggcagcgcacguggaauggcgcuguacgaagaggaacagguggagagaguuggcgacaucgaggaaagggggaagauuuuagugucccugauguacucuacacaacagggaggucucaucgucggcaucauucgcugcgugcaucuugcugccauggacgcaaacggguauucggaucccuucguaaaacugugguugaagccugacaugggcaaaaaggccaagcacaaaacccagauaaagaaaaagacucuaaauccggaguuuaacgaagaguucuuuuacgauaucaaacauagcgaccuggcuaagaagucccucgauauuucaguuugggacuaugauaucggaaaaaguaaugacuacauaggugggugccagcugggcauuucugccaagggagaacggcuuaaacacugguaugagugucugaagaacaaagauaagaaaaucgagagauggcaccaauugcagaaugaaaaccaugugagcuccgacuga

SEQ ID NO: 61968 - RNA, 948 nt, Artificial Sequence
  derived and/or modified sequence opt3 from RPH3AL__Homo_sapiens__XP_011545302
auggccgacaccaucuucggcagcgggaacgaucagugggugugccccaaugacagacaacuggcucucagggcaaaguugcagacaggaugguccguccacacuuaccagacggagaaacagcggcgcaagcaacaucugucuccugccgaaguugaggcgauucuucaggugauacagcgagcugaacguuuagauguacuggagcagcaaagaaucgguaggcuaguggaacggcucgagaccaugcgcagaaacgucaugggcaaugggcugucacagugucuucugugcggagagguguugggcuuucucgguaguagcuccguuuucuguaaagacugcaggaagaaaguguguacaaagugcgggauugaagccucuccaggacagaagcggccgcuguggcuguguaaaaucugcucggagcagcgcgaagucuggaagcgaucaggcgcaugguuuuauaaaggccuccccaaguacauuuuaccucugaaaacuccagggagagccgaugacccccacuucaggccucuuccaaccgagcccgcugagcgggaaccucguagcagugagacaucccgcaucuauaccugggcaagaggaagggugguaucuagcgauuccgacucagauagugacuugucuagcuccucacuggaagaucggcuaccaagcacugguguucgagaccgcaagggcgauaagccguggaaagagagugggggaucuguggaagcccccagaaugggcuuuacacauccuccaggucaccucuccgggugucaaagcucgcuggcuucuggagagaccggcacgggcuccgccgaucccccugggggaccaaggcccggucuuacucggcgcgcgccggucaaggacaccccuggcagagcacccgccgcugacgccgcaccagcugggccuucaaguugccugggauga

SEQ ID NO: 61969 - RNA, 936 nt, Artificial Sequence
  derived and/or modified sequence opt3 from RPIA__Homo_sapiens__NP_653164
augcagagacccggcccuuucagcacccuguacgggagggugcucgccccacuuccgggacgggcugguggcgcagccuccgggggaggcgguaacucuugggaccugcccgggucacacguccgcuugccuggacgagcgcaaaguggcacacguggcggggcuggaaauacuagcacguccugcggugauucuaacucgaucuguccagcccccucaaccaugagcaaggcagaggaagccaaaaaguuagcuggcagagcagccguugagaaucaugugaggaacaaucagguacuggggauuggaaguggcuccacaauagugcacgcuguccagcggaucgccgaacgcgugaaacaggagaaccuaaaucucguuugcauuccuacuucuuuucaagcgagacagcugauccuucaguauggucugaccuugagcgaccucgauaggcauccagaaauugaccuggcaaucgauggggccgacgagguggaugcugaccugaaccucauaaagggaggcggcggguguuuaacacaggagaaaaucgucgccggauacgcaucccgguucauugugaucgcugauuuucgcaaggacucaaagaaucugggugaucaauggcacaaaggcauucccaucgaaguaauaccuauggccuauguuccagugagucgagcggucagccagaaguucgggggagugguggagcuuagaauggccgucaacaaagcaggcccgguugugaccgacaaugguaacuuuauuuuggauuggaaguucgacaggguacauaaauggucugaagugaauacugcuaucaagaugauucccggggucguggacacaggccuguuuaucaacauggccgagcggguuuacuucggaaugcaggauggcuccgugaauaugcgugagaagccuuuuugcuga

SEQ ID NO: 61970 - RNA, 654 nt, Artificial Sequence
  derived and/or modified sequence opt3 from RPL10A__Homo_sapiens__NP_009035
augagcuccaaggugucuagagacacccuguacgaggccgucagggaaguucuccacggcaaccagcggaaacgccgaaaguuccuugagacaguggaacugcaaaucucauugaaaaauuaugauccccagaaggacaaacguuuuagugggacuguaagauuaaagagcacgccuaggccaaaguucuccgugugcguccugggagaucagcagcauugugacgaggcuaaagcaguggauauuccgcacauggacauagaagcccuaaagaaacucaacaagaauaaaaagcugguuaagaaacuugcgaagaaauacgaugcuuuucuggccucugagucguugaucaagcaaauuccccggauccucgguccuggccugaacaaagcagggaaguucccaucacugcucacccauaaugagaacaugguggccaaagucgacgaaguaaagagcacaauuaaguuucagaugaaaaagguguuaugccuggcuguugcagugggacacgucaaaaugacugaugacgagcuuguguauaauauccauuuggccgugaacuuccuggucagucuacucaagaaaaauuggcagaacguucgcgcucuguacauaaaguccaccaugggcaagccccagagacuuuauuga

SEQ ID NO: 61971 - RNA, 651 nt, Artificial Sequence
  derived and/or modified sequence opt3 from RPL10__Homo_sapiens__NP_001243506
augggcagaaggcccgcccggugcuaccgcuauuguaagaacaaaccuuacccaaagagccgauucugccguggggugccggacgcuaaaaucagaauuuuugaucugggaaggaagaaagcaaaggucgacgaguucccccucuguggucacaugguuuccgaugaauaugagcagcuuucuucagaagcccuggaggcggcucggauaugcgccaauaaguacauggugaaaaguuguggcaaggacggguuucauauccgcguaagauugcacccuuuccaugugauuaggaucaacaaaauguuaagcugcgcaggagccgaucgguccaccucucaacgcucgggcgcuucaccaagcaguaugcugaugaaucuaaagacaugguggcucaaauccgguucuagccagauggcagucggguccucaacgagucccgugguugcccuguggacuagcggaggcccuuguacccacgaaggcuuucagugcgcugccccacuucugauuuugacaaacaaguucuauuuucucucuacuuacguguucgucuccaccuuucugacagggaaggagcugccccucggaaccuucgguucauuaccuuuucauuuccgaaauagacugacuacacagccauguagcuga

SEQ ID NO: 61972 - RNA, 645 nt, Artificial Sequence
  derived and/or modified sequence opt3 from RPL10L__Homo_sapiens__NP_542784
augggcagaaggcccgcccggugcuaccgcuauuguaagaacaaaccuuacccaaagagccgauucugccguggggugccggacgcuaaaaucagaauuuuugaucugggaaggaagaaagcaaaggucgacgaguucccccucgguggccacaugguuuccgaugaauaugagcagcuuucuucagaagcccuggaggcggcucggauaugugccaauaaguacauggugaaaaguugcgggcgcgacggauuucauaugagaguaagguugcacccuuuccaugugauccggauuaacaagauguuaagcugugcaggcgccgaucgccugcaaaccgguaugcgaggggcuuuuggaaaaccacagggcacagucgcaagagugcacaucggccagguuauuauguccaucaggacuaagcuacagaaugaagaacaugugauagaggcccuccggcgugcuaaauucaaguuucccgggcgccaaaagauccacauuucuaaaaaguggggauucacgaaauuuaacgccgacgaguucgaggauauggucgcgaagaaaugccugaucccugacgguuguggcgugaaguauguaccaucgcacgggccccuugauaaauggagaguucugcauucauga

SEQ ID NO: 61973 - RNA, 498 nt, Artificial Sequence
  derived and/or modified sequence opt3 from RPL12__Homo_sapiens__NP_000967
augcccccuaaguucgacccaaacgagaucaaaguggucuaccugagaugcaccggcggggaaguuggagccacaagcgcucucgcaccgaagauugguccccuuggccuguccccuaaaaaggugggggaugacauagccaaagcgacuggagauuggaagggcuugaggaucacgguaaaguuaaccauucagaaucggcaagcucagaucgagguggucccaucugccucagcacugauuaucaaagcccuaaaggaacccccucgcgaccguaaaaagcagaaaaacauaaagcacagugguaauaucacauuugaugagauugugaacaucgcucgacagaugagacauaggagccucgcacgggaacuguccgggacuauuaaggagauccuuggaaccgcccaaucuguuggcuguaauguggacggccgccacccacaugauauaauugacgauaucaacucgggggcugucgagugccccgccucauga

SEQ ID NO: 61974 - RNA, 495 nt, Artificial Sequence
  derived and/or modified sequence opt3 from RPL13__Homo_sapiens__NP_001230060
auggcccccagcagaaacggcauggugcugaagccucacuuccauaaagacuggcagaggcgggucgcuaccugguuuaaucaaccagcacgcaagauccgacguagaaaagccaggcaggcgaaggcucggcgcauugccccgagacccgcauccgggccuauaaggccaaucguucggugccccacagugcgcuaccacacuaaaguacgagccggaagagguuucucucucgaggaacuuaggguggcuggcauucauaagaagggggauucaagugcagaggaacugaaauuggccacgcaguuaaccggaccugucaugccagugcggaacguuuauaagaaagagaaggcucgugugaucacagaagaggagaaaaauuuuaaggccuucgcgagccugcgcauggcaagagccaacgcuaggcuauuuggcauucgggccaagcgagcaaaagaagcugccgagcaggacgucgaaaagaaaaaguga

SEQ ID NO: 61975 - RNA, 648 nt, Artificial Sequence
  derived and/or modified sequence opt3 from RPL14__Homo_sapiens__NP_001030168
augguguucagaagguuugucgagguuggccggguggccuacgugagcuucgggccccacgcuggaaagcugguagcaaucgucgacgugauugaucagaaccgcgcccucguugacgguccuugcacccaagugcgacgucaggcgaugccauuuaaauguaugcagcuuacagauuucauacugaaguuuccgcauuccgcucaccagaaauaugucagacaagccuggcagaaggcagacaucaauacuaaaugggccgcuacgaggugggcaaagaagauugaagcccgggagcgcaaagcuaagaugaccgauuucgacagauuuaaagugaugaaggccaaaaagaugaggaaccggaucauuaagaaugaaguuaaaaaguugcagaaagcggcauuacugaaggccucucccaaaaaggcuccuggcacaaaagggacugccgcagcugccgcggccgcagcugccgcuaagguaccagccaagaaaaucaccgcagccucaaagaaagcucccgcgcagaaggugccugcacaaaaagccacaggacagaaggcugccccagcacccaaggcccagaaaggccagaaggcuccugcccaaaaagcaccagcgccgaaggcuagugguaaaaaggccuga

SEQ ID NO: 61976 - RNA, 438 nt, Artificial Sequence
  derived and/or modified sequence opt3 from RPL15__Homo_sapiens__NP_001240313
augggcgccuacaaguauauccaggagcuguggcggaaaaagcaaagcgacgugaugagguuccuccuucggguccgcugcuggcaguaccgacagcuguccgcuuugcaccgugcacccagaccuaccaggccagauaaagcccggcgcuuaggguauaaggcgaaacagggauacguuauuuauagaauaagggugcggcgcgguggccgaaagagaccgguacccaagggggcuacauacggaaaaccugugcaucacggcgucaaccaacugaaguuugccaggucucuacagucaguggcagaagagagagccggucgucauuguggggcucuccgcguucugaauaguuauuggauggaaagccacucccauucuggaggcucggcagugggccagucaagacuuacugccacgagcgucaguaggguguga

SEQ ID NO: 61977 - RNA, 687 nt, Artificial Sequence
  derived and/or modified sequence opt3 from RPL17-C18orf32__Homo_sapiens__NP_001186284
auggugagauacagccuggaccccgagaacccuaccaaguccugcaaaucuaggggcucaaaucuccggguccacuucaagaacacacgcgaaacugcccaggcuaucaaagggaugcauauucgaaaggcaacgaaauaucuuaaggauguuacccugcaaaagcagugugugccauuucguagauacaauggagguguagggaggugcgcccaggcgaaacaguggggcuggacacaaggacgguggccgaagaaaagugcugaguucuuguuacacaugcugaagaacgccgaaagcaaugcagagcuaaaaggccucgacguggauucccuggucauagaacauauccaggugaacaaggcccccaagaugcgcagaaggacuuaucgggcucacggucgcauuaauccuuacaugucuucgccaugucauaucgagaugauucuuaccgagaaagaacagaucguucccaagccugaggaagagguggcacagaaaaagaaacugcgaucaagcaguuuggggaaguggugcgccuuucucgucuccucuuuccaauuuuguagcggauccaccaaaaacucauggagucacauauauacacugugguucccacccagccuggugguauacggccucagaaagcaguauaagaauccuaugauccagacuaaagcuaaguga

SEQ ID NO: 61978 - RNA, 555 nt, Artificial Sequence
  derived and/or modified sequence opt3 from RPL17__Homo_sapiens__NP_001030178
auggugagauacagccuggaccccgagaacccuaccaaguccugcaaaucuaggggcucaaaucuccggguccacuucaagaacacacgcgaaacugcccaggcuaucaaagggaugcauauucgaaaggcaacgaaauaucuuaaggauguuacccugcaaaagcagugugugccauuucguagauacaauggagguguagggaggugcgcccaggcgaaacaguggggcuggacacaaggacgguggccgaagaaaagugcugaguucuuguuacacaugcugaagaacgccgaaagcaaugcagagcuaaaaggccucgacguggauucccuggucauagaacauauccaggugaacaaggcccccaagaugcgcagaaggacuuaucgggcucacggucgcauuaauccuuacaugucuucgccaugucauaucgagaugauucuuaccgagaaagaacagaucguucccaagccugaggaagagguggcacagaaaaagaaaauaucacaaaagaaacugaagaagcagaaauugauggcccgagaguga

SEQ ID NO: 61979 - RNA, 567 nt, Artificial Sequence
  derived and/or modified sequence opt3 from RPL18__Homo_sapiens__NP_000970
augggcguggacaucagacacaacaaggauaggaaaguccggcgcaaggagcccaaaagccaggacauuuaccugcgacuccuuguuaagcuguaucguuucuuggccagaaggaccaauuccacauuuaaccaagugguauuaaaacggcuguucaugucucgcacuaauagaccuccacuaucacucaguaggaugauacggaagaugaagcugccggggcgcgaaaacaaaacggcuguggucgugggaaccaucacagaugacguucgagugcaggagguccccaaacuuaaggugugcgcacugagaguaacuagcagggcccggucccguauuuugcgcgcggguggcaagauccucaccuuugaucagcuggcucuggacucuccuaaaggguguggaacaguucucuuaucgggcccaagaaaggguagggaaguguaccggcauuucgggaaggcccccggaaccccucacucacauacuaaaccauauguccgaagcaagggccgcaaauuugagagagcaaggggccggcgcgccaguagaggguacaagaauuga

SEQ ID NO: 61980 - RNA, 591 nt, Artificial Sequence
  derived and/or modified sequence opt3 from RPL19__Homo_sapiens__NP_000972
augagcaugcugagacuccagaagaggcuugccuccucugugcugcggugcggcaaaaagaaagucugguuggaccccaacgagaccaaugaaaucgcuaacgcaaauucacgccaacagauucgaaaguuaauaaaagaugggcugaucauucguaagccuguuacagugcacaguagagccaggugucggaagaacacucuagcgcgcagaaaaggaaggcauauggguaucggcaagcggaaagggacggcuaaugcccgcaugccagagaagguaaccuggaugcgaagaaugaggauucuccggcgucugcuucgcagauacagggaaagcaaaaagaucgaccggcacauguaucauucccuguacuugaaggugaaaggaaacgucuucaagaauaaacgaauacucauggagcacauccauaagcugaaagcagauaaggcccgcaaaaagcugcucgcugaccaggcagaagccagaaggucuaagacaaaagaggcucggaagcgcagagaggaaagguuacaggccaaaaaggaggaaauuaucaaaacucugucgaaggaggaggaaaccaagaaauga

SEQ ID NO: 61981 - RNA, 483 nt, Artificial Sequence
  derived and/or modified sequence opt3 from RPL21__Homo_sapiens__NP_000973
augaccaacacaaagggcaaaagaagggggacucgguacauguucagccgccccuuucgaaagcacggaguggucccucuggccacguauaugcguaucuacaaaaagggugacauuguugauauaaaaggcauggggaccgugcagaagggaaugccacauaagugcuaucacggcaaaacagguagaguauacaaugugacucaacaugcugucgggaucgugguuaacaaacaggugaagggaaagauucucgcaaaaaggaucaauguccggauugaacacaucaagcauuccaagucucgcgacucauuccuuaaaagagugaaggaaaacgaucagaaaaagaaagaggccaaggaaaaaggcaccuggguacagcugaagaggcaaccggcgcccccucgggaggcucacuuuguucgcacaaauggcaaggaaccagaguuguuagagcccauaccuuaugaguucauggccuga

SEQ ID NO: 61982 - RNA, 471 nt, Artificial Sequence
  derived and/or modified sequence opt3 from RPL23A__Homo_sapiens__NP_000975
auggcccccaaggcuaaaaaggaggccccugcaccaccgaaagcggaagcuaaggccaaagcacugaaggccaagaaagcugugcucaagggcguccacagccauaaaaagaaaaagaucagaaccucccccacauucaggcggccuaagacucuucgccugcgacgucagccaaaauaccccagaaagucugcaccuaggcggaacaaauuggaccacuaugccauuauaaaguuuccauuaacgaccgagucagcuaugaaaaagaucgaagauaauaacacacugguuuucauuguggacguaaaagccaauaagcaucaaaucaagcaggcggugaaaaagcuauacgauauugacgucgcaaaagugaacacucucauccgccccgauggggagaagaaagccuauguuagacuggcuccugacuacgaugcccuugacguggcaaauaagauaggaaucauuuga

SEQ ID NO: 61983 - RNA, 423 nt, Artificial Sequence
  derived and/or modified sequence opt3 from RPL23__Homo_sapiens__NP_000969
augagcaagagaggcaggggaggguccucuggugccaaauuccggaucucacugggccuccccgugggggcugucauuaacugcgcagacaauaccggagccaagaaccuuuacauaaucaguguuaaaggcauuaagggucgccugaaucgauugccugcggcuggggugggagauaugguaauggccacagugaaaaagggcaagccagaguuacguaaaaagguccacccggcagugguuaucagacagaggaaaagcuaucggcgcaaggacggcguguuucuguacuucgaagauaacgccggggucauugugaauaacaaaggagagaugaaggguuccgcuaucacuggccccguagcaaaggaaugugccgaccuauggccuagaauagcuucuaaugccgggucgaucgcguga

SEQ ID NO: 61984 - RNA, 474 nt, Artificial Sequence
  derived and/or modified sequence opt3 from RPL24__Homo_sapiens__NP_000977
augaagguggagcugugcagcuucuccggcuacaaaaucuaucccgggcacggaagaagguacgcccggaccgacgguaaggucuuucaguuccucaacgcuaaaugugaaucugcauuucuuucaaagcgcaauccucgacaaauuaacuggacaguucuguaucguagaaaacauaagaagggccagagugaggaaauacagaaaaagaggacucggcgcgccgugaaauuccagagagcgaucacgggggcuagcuuggccgauauuauggcaaagaggaaucaaaaaccagagguacggaaggcccagcgcgaacaggcuauccgagcagccaaggaggcuaaaaaggccaaacaggcguccaagaaaaccgcaauggccgcugccaaggcaccgacaaaagcugcccccaagcaaaagauugugaaaccugucaaggugucugcgccaagaguuggaggcaaaagguga

SEQ ID NO: 61985 - RNA, 447 nt, Artificial Sequence
  derived and/or modified sequence opt3 from RPL27A__Homo_sapiens__NP_000981
augcccagcagacugaggaagacccggaaacuccgcggccacgugucccaugggcacggacgaaucgguaagcaucguaaacacccuggcgggagaggaaacgccggcggucuucaucaccacaggauuaauuucgacaaguaccauccaggguauuuuggaaaagucggcaugaagcacuaccaucugaagcggaaccagucuuucugcccgacaguuaauuuggauaaauuauggacucuggugucagagcaaacgcgcguaaacgcugcaaagaauaaaaccggcgccgcgcccauaaucgacguggucagaaguggguauuacaaggugcuaggaaaagguaagcucccuaagcagccaguuauugugaaagcuaaguuuuucagcaggcgggccgaagagaaaaucaaguccgucggcggggcaugugugcugguagccuga

SEQ ID NO: 61986 - RNA, 480 nt, Artificial Sequence
  derived and/or modified sequence opt3 from RPL29__Homo_sapiens__NP_000983
auggccaagagcaaaaaccacaccacacauaaucaguccagaaaguggcacaggaacggcaucaaaaagccccggucucaacgcuacgagucacugaaagggguggacccuaaguuccuccgaaauaugcguuuugcuaagaaacauaacaagaaaggacuuaagaaaaugcaggcaaauaacgccaaggcgaugagugcuagagccgaagcaauuaaggcccuggucaaaccaaaggagguuaaaccgaagauacccaaaggugugagcaggaaguuggaucgguuagcuuauaucgcacacccuaaacugggcaagcgcgccagagcuaggauugccaaggggcuacggcucugccgcccaaaagcgaaggcaaaagccaaggcuaaagaccagacuaaggcccaggcagcugcccccgcguccguaccugcccaagcaccaaagcgaacgcaggcucccaccaaagccucugaauga

SEQ ID NO: 61987 - RNA, 348 nt, Artificial Sequence
  derived and/or modified sequence opt3 from RPL30__Homo_sapiens__NP_000980
augguggccgcuaagaaaaccaagaaaagccuggaguccaucaacucuagacuccagcuugucaugaagucaggcaaauacguucugggguauaagcaaacauugaagaugauuaggcagggaaaagcaaaguuagugauacuggccaauaacugccccgcgcuacggaaaagugaaaucgaguacuaugcuaugcucgccaagacugguguacaccauuacagcggcaauaacauugaacuggggacggcauguggaaaauauuaccgcgugugcacccuugccaucauugacccuggcgauuccgacaucauacgaucuaugccagagcagacaggugaaaaguga

SEQ ID NO: 61988 - RNA, 378 nt, Artificial Sequence
  derived and/or modified sequence opt3 from RPL31__Homo_sapiens__NP_000984
auggcccccgcuaagaaaggaggggagaagaaaaagggaagaagcgcaaucaacgaaguggucaccagggaguacacaauuaauauacacaaacggauccaugguguuggcuucaagaagcgcgccccucgagcgcugaaagaaauucguaaguuugcuaugaaagagauggggacuccagacgugagaaucgauacgaggcucaacaaggccguaugggcaaaaggcauucggaaugugccguaucgcaucagagucaggcuuucccggaagcgcaacgaagacgaggauucucccaauaagcuguacaccuuggugacauauguuccugugacuaccuucaaaaacuuacagacagucaauguggacgagaacuga

SEQ ID NO: 61989 - RNA, 354 nt, Artificial Sequence
  derived and/or modified sequence opt3 from RPL34__Homo_sapiens__NP_001306164
auggugcagagacugaccuacaggcggcgccucagcuauaacacagccuccaauaagacucgacuuucucguacgcccggcaacagaaucgucuaccuguauaccaaaaagguugggaaagcuccuaagucagcaugcggaguguguccagguagguugcggggcguacgcgccgugagaccgaaagucuuaaugaggcugaguaagacaaagaaacacgugagccgggcguacgggggauccaugugcgcuaaguguguucgcgaccgaauuaaaagagccuuccuaauagaggaacaaaagaucguggucaaagugcucaaggcacaggcccagucucagaaggcuaaauga

SEQ ID NO: 61990 - RNA, 372 nt, Artificial Sequence
  derived and/or modified sequence opt3 from RPL35__Homo_sapiens__NP_009140
auggccaagaucaaagcuagagaccugaggggcaagaaaaaggaggaacuccuuaaacagcuggaugacuugaagguggaguuaagccaacugcgggucgcaaagguuaccgggggagccgcguccaaacuaucuaagauucgcgugguacgaaaaucaauagcucgugugcucacagucaucaaccagacucagaaggaaaaucugagaaaauucuacaaggguaagaaauauaagccccuugaucugaggccuaaaaagacgcgggccaugcgcagaagguugaacaaacacgaggaaaaucucaagaccaaaaagcagcaacggaaggagcgccuguacccacugcgaaaauaugcagugaaggccuga

SEQ ID NO: 61991 - RNA, 429 nt, Artificial Sequence
  derived and/or modified sequence opt3 from RPL36A__Homo_sapiens__NP_066357
augaucgcccccaccgacagccacgaggaagugagauccggcacaucuuacauucugccuuucgcuucaagguuucucaguuuccgggcagauagcgcccaugcguccauggucaacguuccaaagacucgccgaacguuuugcaaaaagugugggaaacaccagccgcauaaggugacccaauauaaaaagggaaaggacucucuuuacgcucaggguaaacguagauaugauaggaagcagucgggcuacgggggacagacaaaacccauauuccggaagaaagccaagacuaccaagaaaaucguacugcgcuuggagugcguggaaccuaauuguagaucaaagaggauguuagcaauuaaacggugcaagcacuuugagcugggcggugacaaaaagcgcaaagggcaagucauccaguucuga

SEQ ID NO: 61992 - RNA, 321 nt, Artificial Sequence
  derived and/or modified sequence opt3 from RPL36AL__Homo_sapiens__NP_000992
auggugaacguccccaagaccagaaggacauucugcaaaaaguguggcaaacaccagccucauaagguuacucaauacaaaaaggggaaggacagccuguaugcccagggacggcgccgauacgaucguaaacaguccgguuauggcgggcagacgaagccaaucuuuaggaaaaaggcuaaaaccacaaagaagauugugcucagacuugagugcguagaaccgaauugucggucuaaacgcaugcuggcaauaaagagaugcaaacacuucgaguugggaggcgacaagaaaaggaagggucaagugauccaguuuuga

SEQ ID NO: 61993 - RNA, 279 nt, Artificial Sequence
  derived and/or modified sequence opt3 from RPL37A__Homo_sapiens__NP_000989
auggccaagagaaccaaaaaggugggcaucgucgggaaauacggaacaagguauggugcuagccugcggaagaugguuaaaaagauugagauaucccagcacgcaaaguacacuugcucuuucuguggcaaaacgaagaugaaacgccgagccguggggaucuggcauugcggaucauguaugaagaccguagcgggcggugcuuggacauauaacacuaccagugccgugacagucaaaagcgcaauucguagacucaaggaacuuaaggaccaauga

SEQ ID NO: 61994 - RNA, 213 nt, Artificial Sequence
  derived and/or modified sequence opt3 from RPL38__Homo_sapiens__NP_000990
augcccagaaagaucgaggaaauuaaagacuuccugcucaccgccaggcggaaggaugcuaaaagcgugaagaucaaaaagaacaaggacaaugucaaauuuaagguucgcugcucccgauaccuuuauacacuggugauaacugauaaagagaaggcagaaaaauugaagcagucuuuaccuccaggccuggccguaaaggagcuaaaauga

SEQ ID NO: 61995 - RNA, 156 nt, Artificial Sequence
  derived and/or modified sequence opt3 from RPL39__Homo_sapiens__NP_000991
augagcucccacaagaccuucagaaucaaaagguuucuggccaagaaacagaagcaaaaccggcccauuccucaguggauacgcaugaaaacaggcaauaagauccgauacaacucuaagcguagacauuggaggcggacuaaacucgggcuuuga

SEQ ID NO: 61996 - RNA, 156 nt, Artificial Sequence
  derived and/or modified sequence opt3 from RPL39L__Homo_sapiens__NP_443201
augagcucccacaagaccuucacaaucaaaagauuucuggccaagaaacagaagcaaaacaggcccauuccucaguggauacagaugaaaccaggcucuaagauccgguacaauucaaagcgccgacauuggcguagaacuaaacucgggcuuuga

SEQ ID NO: 61997 - RNA, 1212 nt, Artificial Sequence
  derived and/or modified sequence opt3 from RPL3__Homo_sapiens__NP_000958
augagccacagaaaguucuccgcccccaggcauggcucucugggguuucucccucggaaacgcucaagucgacaccguggaaaggugaaauccuucccaaaggacgauccgagcaaacccguccaucuuaccgcuuuucuggguuacaaggcaggcaugacacacaucguuagagagguggacaggccugggucuaagguaaacaaaaaggaaguggucgaggccgugacuauuguugaaacgccacccaugguggucgugggaauaguaggcuauguugagaccccucgggguuugcgcacauucaaaacuguguuugcggaacauaucucggaugagugcaagagaagguucuacaaaaauuggcacaagucaaagaaaaaggcuuuuaccaaauauuguaagaaauggcaggacgaggaugggaagaaacaauuagaaaaggacuucagcaguaugaagaaauacugccaggucauucgggugaucgcccacacacagaugcgccugcuaccacuccgacagaagaaagcacaucugauggagauucaagugaacggaggcaccgucgccgaaaaacuugauugggcuagagagaggcuggagcagcagguucccgugaaucagguauuuggccaagacgaaaugaucgaugugauaggggucacuaagggaaaggguuauaagggcgugacaucccgguggcacaccaaaaaguugccucguaaaacgcaucgcgggcucagaaagguugcauguaucggagccuggcacccagcuaggguggccuucucugucgcgcgggcaggccagaaagguuaccaccaucgaacugagauuaacaagaagaucuauaaaauugggcagggauaccugaucaaggacggcaaacugauaaagaauaacgccagcaccgauuacgaccucuccgauaaaucaauuaauccguuaggcggguuugugcacuauggagaaguaacaaacgacuucguuaugcugaaggguugcguggucggcacuaagaaacgcgugcuuaccuugagaaagagucugcuaguccagacaaaaaggcgggcucucgagaagaucgaccugaaauuuauugauaccacgagcaaguucgggcauggacgcuuccaaacuauggaagagaaaaaggccuuuaugggcccccuuaagaaagacagaaucgcaaaggaggaaggugcuuga

SEQ ID NO: 61998 - RNA, 78 nt, Artificial Sequence
  derived and/or modified sequence opt3 from RPL41__Homo_sapiens__NP_066927
augagagccaaguggaggaaaaagcggaugcgccgacugaaacguaagagaaggaaaaugcggcagcgcagcaaguga

SEQ ID NO: 61999 - RNA, 1284 nt, Artificial Sequence
  derived and/or modified sequence opt3 from RPL4__Homo_sapiens__NP_000959
auggccugcgcuagaccccugaucagcguguacuccgagaagggcgaaucuucagggaaaaacgucacccucccugcaguuuucaaggccccaauuaggccggacauagugaauuuuguacacacaaaccuucggaaaaauaaccgccaacccuaugcggugagugagcuggcuggacaucaaacuagcgccgaauccugggguacgggccgagcagucgcccguaucccuagagugagagggggaggcacccaccggucuggucagggggcuuucggaaauaugugucgcggcggcagaauguuugcaccaacaaagacuuggaggcgguggcaucgccgaguuaacaccacacagaaaagauacgccauuugcucggcuuuggccgcgucagcauuacccgcccuggugaugagcaaggggcacaggaucgaggaagucccugagcuaccacucgugguagaggauaagguugaaggauauaaaaagaccaaagaggcugugcugcuucugaagaaauugaaggccuggaaugacauuaagaaagucuacgcaagucagcggaugcgugcugguaagggcaaaaugcgcaacagaaggcggauccaacgacgcgggcccuguauaaucuauaaugaagauaacggaauuaucaaggccuucagaaauauuccuggcaucacucuccugaacguguccaaacugaauauacucaaguuagcgccaggugggcaugugggaagguuuugcauuuggacagagucugccuuccggaaacuggacgagcuuuacggcaccuggcgcaaggcagcuagcuugaaguccaacuauaaucugccgaugcacaaaaugaucaacacggaucuaucaaggauucucaagagucccgaaauccagagggcccugcgugcuccucggaaaaagauccaccgaagaguccuuaaaaagaacccacugaagaauuugaggauuaugcucaaacugaaccccuacgccaagacuaugcgccggaauaccauauuaagacaggcaaggaaccauaaacugcgcguugacaaggccgcugcggcagccgcugcccuccaggcaaaaagcgaugagaaggccgcuguggccggcaagaaaccuguaguggggaagaaaggaaagaaagcagcggucggugugaagaagcagaaaaagccacuuguuggcaaaaaggcugccgcaacuaaaaagcccgccccggagaaaaagccugcugaaaagaaacccacaaccgaagagaagaaaccagccgcauga

SEQ ID NO: 62000 - RNA, 867 nt, Artificial Sequence
  derived and/or modified sequence opt3 from RPL6__Homo_sapiens__NP_001307069
auggccggcgagaagguggaaaaacccgacaccaaggagaaaaagccugaagcuaaaaaggucgaugcagggggaaagguuaaaaaggguaaccugaaagccaagaaaccaaagaagggcaaaccgcacugcagcagaaaucccgugcucguaagggggaucggacgguacucccgcucugcgauguauucacgaaaggcuauguacaaacguaaguauagugccgcaaaaagcaagguggagaaaaagaagaaagaaaagguccuugccacagugacuaaaccuguuggcggugacaagaacgggggaacgagaguggucaaacugaggaagaugccacgguacuaucccaccgaggaugugccucgcaaguuguuaucccauggcaaaaagccauucucucagcacguaagaaaacugagggcuucgauuacacccggcacuauacuaaucauucucaccgggcggcaucgcggaaagcgaguuguguuucugaaacaacuugcaucaggucuguugcucgucacaggcccucuggugcugaauagagugccacucaggcggacccaccagaaguucgucaucgccacuagcacaaagauugacaucaguaacguuaaaauaccgaagcauuuaaccgaugcuuacuuuaaaaagaaaaagcugcguaagccccgccaccaggagggggaaaucuucgacacggagaaagaaaaguaugagauuacugagcagagaaaaaucgaucaaaaggccguggacucccagauucuuccuaaaaucaaggcgauaccacaguugcagggauaccugaggucuguauuugcacuaaccaauggcauuuacccccacaaacucguguucuga

SEQ ID NO: 62001 - RNA, 801 nt, Artificial Sequence
  derived and/or modified sequence opt3 from RPL7A__Homo_sapiens__NP_000963
augcccaagggcaaaaaggccaaagggaagaaaguggcuccugcaccagccgucguuaagaagcaggaggcgaaaaaggugguaaacccgcuguucgagaaaagacccaagaauuuuggaaucggucaagacauucagccuaaaagggaucucacccgguucgugaaguggccacgcuacauacgacuucagcgucagagagcuauccuguauaagagguugaaagugcccccugccauuaaccaauuuacacaggcauuagaccggcagacugccacgcagcugcuaaagcucgcucacaaauaccgcccagaaaccaagcaagaaaagaaacagagacugcuugcaagggccgagaaaaaggcugccggcaagggggauguccccacaaaacggccuccaguucugcgcgcgggagugaauacugucaccacauugguggaaaacaagaaagcacagcucguaguuaucgcccaugacguggauccgauugagcuggucguguuccugcccgcucucugccgaaagaugggcgugccuuauuguaucauaaaagguaaggccagauuagggaggcugguccaccggaagaccugcacuacaguugcauuuacccaggugaauagcgaggacaaaggagcucuugccaaguugguagaagcgauccguacgaacuacaaugaucgcuaugacgagauuagaaggcauuggggcggcaacgugcuggggccaaaauccgucgcccggaucgcaaagcuagaaaaagcuaaggccaaggagcucgcuacuaaacugggauga

SEQ ID NO: 62002 - RNA, 747 nt, Artificial Sequence
  derived and/or modified sequence opt3 from RPL7__Homo_sapiens__NP_000962
auggagggcguggaagagaagaaaaaggaaguccccgccguuccugagacccugaaaaagaaaagaaggaacuucgcugaacucaagaucaagcggcuucgcaaaaaguuugcacagaaaaugcugcgaaaggcccguagaaaauugauuuacgagaaggcgaagcacuaucauaaagaguacaggcaaauguaucggacagaaauacgcauggcuagaauggccaggaaggcagggaauuucuacgugccagccgagccgaaauuagcuuuuguaauccggauucgcggaaucaacggugugagccccaagguccgaaaagugcugcagcuacucagacugaggcagauuuucaauggcacuuuuguuaaacuuaacaaggcauccaucaauaugcugcggauaguggaaccuuauaucgccuggggguacccaaacuugaagucugucaaugagcucauuuauaagcguggauacggcaaaaucaacaagaaacgcauugcucugacggacaaugcccugaucgcgagaucacucgguaaguacgggauaauuugcauggaggauuuaauccacgaaauuuauaccgugggaaaaagguucaaggaggcaaacaauuuucuguggcccuucaaacuuaguagcccucggggcggcaugaagaagaaaacaacucauuuuguagaagggggagacgccgguaaccgagaggaucagaucaaucgcuugaucagaaggaugaacuga

SEQ ID NO: 62003 - RNA, 954 nt, Artificial Sequence
  derived and/or modified sequence opt3 from RPLP0__Homo_sapiens__NP_000993
augcccagagaggacagggccaccuggaaaagcaacuacuuccugaagaucauucagcuccuugaugacuauccuaagugcuuuauagugggcgcugauaaugucggguccaaacaaaugcagcagauccggaugucucugcgcggaaaggcaguuguguugauggguaaaaacacaaugaugcgaaaggccauucguggccacuuagaaaauaacccagcgcuggagaagcuacucccgcauaucagagggaauguaggauucguguuuacuaaagaagaccugacggagauuagggauaugcuucuggcuaacaagguccccgccgcagcccgggcuggcgcaaucgccccuugugaagugaccguuccagcucagaauacagguuuggggcccgagaaaacuucauucuuucaagcccucggaauaaccacaaagaucagucgcggcaccauugagauccugagcgacgugcagcugauuaaaacuggcgauaaggucggggcguccgaagcaacacucuuaaacaugcugaauaucucuccuuucucguuuggacuugugauacagcagguauucgacaacgguucaauuuacaauccagagguuuuggauaucaccgaagagacgcugcacagcagauuucuagagggcgugaggaacgucgccagugugugccuccaaauuggguaucccacuguggcuuccgucccucauucuaucaucaauggauacaagcggguucuggcccuuagcguggaaaccgacuauacauucccacuggcagagaaaguaaaggccuuuuuggcugauccguccgcguucguggccgcagcucccgucgccgcugccacuaccgcagccccugcugcggcagccgcuccagccaaaguggaagcaaaggaggaaucagaggagagugacgaagauaugggcuuuggucucuucgacuga

SEQ ID NO: 62004 - RNA, 345 nt, Artificial Sequence
  derived and/or modified sequence opt3 from RPLP1__Homo_sapiens__NP_000994
auggccagcguguccgagcuggcuugcaucuacucugcacucauucuucacgacgaugaagucaccguuacagaggacaagauaaacgcccugaucaaagcggcuggcgugaauguagaacccuucuggccuggguuguuugccaaggcauuagccaacgugaauauuggaucacugaucuguaacgucggugcuggcgggccagcaccggccgcuggagccgcgcccgcaggcgguccugccccaaguacugcugccgcacccgcugaggagaaaaagguggaagccaaaaaggaggaaagcgaggaauccgaugacgauaugggguucggacuauuugacuga

SEQ ID NO: 62005 - RNA, 1824 nt, Artificial Sequence
  derived and/or modified sequence opt3 from RPN1__Homo_sapiens__NP_002941
auggaggcccccgcugcaggccuguuccuccuucuguuguuagggaccugggccccugcgccaggaagcgcuuccucugaagccccgccccugaucaacgaggacgugaagagaacagucgaucuaucaagucaccucgcaaaaguuacugccgaagugguacuggcucaucuugguggcgggagcacguccagggcaaccucuuuucuguuggcccucgagccugaacuggaggcucggcuggcccaccucggagugcaggucaagggcgaggacgaagaggaaaauaacuuagaggugcgcgagacaaaaauuaaggguaaaucggggcgauucuuuacuguuaagcugccaguggcgcuugaucccggagcaaagauaucagucaucguggaaaccguauacacacauguuuugcacccuuauccaacccaaauuacucagagcgagaaacaguucguggucuuugaaggcaaucauuacuucuauagucccuacccuacaaagacccagacgaugcgugugaaacuggccuccagaaacguggagucuuauacuaagcuaggcaauccaaccaggagcgaagaccuccuggauuacgggccguuucgggacguccccgcuuauucccaagauacauucaaaguucacuacgagaacaauucaccuuuucuuacuaucaccaguaugacacgcgugauugagguaagccacuggggaaacaucgccguggaagagaaugucgaccugaagcauaccggugcaguguugaagggcccauucucuagauacgauuaucagaggcagcccgacuccgggauaucaagcauccggaguuuuaaaacgauucucccugcugccgcgcaggauguuuacuaucgcgacgaaaucggaaacgugucuacuucccaccuguuaauucuggaugacagcgucgagauggaaauccgaccaagauucccccucuuuggcgguuggaagacacauuacauagugggguauaaucuuccgucguacgaguaucuguacaacuugggagaccaauacgcccuaaaaaugagguucguagaucacguuuucgacgaacaggugauugauucucugaccgucaagaucauucucccugagggcgcuaaaaauaucgagaucgacucccccuaugaaauuucacgggcaccagaugagcugcacuacacuuaucuugacacauuuggccguccugugauagucgccuacaagaaaaaccugguggaacagcauauccaggauauuguugugcacuauaccuucaauaagguauugaugcuccaagagccccuguuagucguggcugccuuuuacauccuguucuuuacgguuauaauuuaugugcgccuagacuucaguaucaccaaggauccagcagccgaggcuagaaugaaagucgcgugcaucacagaacaggugcucacucugguaaacaagaggauugggcuuuaccggcauuuugacgagaccgugaaccgauacaaacagagccgcgauaucuccacacuaaauucuggaaagaaaagccuggaaacugagcacaaggcacucaccucagagauugcccugcuucaaaguagacugaagacagaagguuccgacuugugugacaggguuagcgagaugcagaaacucgaugcucaggucaaggaacugguguuaaaaucugccguggaggcagaacggcuggucgccggcaaguugaaaaaggacaccuauauagagaacgagaagcucaucucagggaaacgccaggaacugguuacuaagauugaucauauccuugacgcuuuguga

SEQ ID NO: 62006 - RNA, 1848 nt, Artificial Sequence
  derived and/or modified sequence opt3 from RPN2__Homo_sapiens__NP_001129243
auggcucccccuggcagcuccaccguguuccugcucgcccuuacaaucauugcaucuacuugggcccugacgccaacccacuacuugacaaagcaugacgucgagagauuaaaagcgucacuggauaggccguuuacuaaccuagaaagugcuuucuauagcauaguugggcucuccucucugggagcccaggugcccgacgcaaagaucucgauuucaaaugagaccaaagaucuucuguuggccgcuguaagcgaagacaguuccgugacacaaaucuaccacgcagucgccgcucucucugguuuuggccugccucuggccagccaggaggcgcucuccgcauuaaccgcccggcugucaaaggaagagacugugcuugcuacaguucaggccuugcagaccgcaagucaucugagccaacaggcugaucuacgcucuauuguggaggaaaucgaggaccucgucgcccgacuggaugaacuugggggaguguaucugcaguucgaggagggcuuggaaacgacugcgcucuuuguagccgcaaccuacaaacugauggaccacguugguacagagccauccauaaaggaagaucaggugauccaauuaaugaacgcuauuuucucaaagaaaaauuuugagagccugagugaagccuucucugucgcuuccgccgcagccgugcucagccauaaccguuaucacgugcccgucguugugguaccugaggggucggcuucugacacucacgagcaggcgauccuuagacugcaagugaccaaugucuugucccagccacuaacacaggcaaccgugaagcuggaacaugccaaaucaguugcuaguagggccacggugcuccagaagacuagcuuuacacccgucggagauguguucgagcugaacuuuaugaauguaaaauucuccucuggcuacuaugacuuucuuguugaaguggagggcgauaaccgguacauugcaaauaccgucgaacugcgcgugaagaucagcacugaggucgggauaacaaacguggacuugucaaccguugacaaggaucagaguauugccccuaaaacgaccagagugacauacccagcuaaggccaaaggaacuuucaucgcagacucccaccaaaauuucgcgcucuuuuuccagcugguagaugucaacaccggugcugaguuaacaccgcaucagacuuuugugaggcugcacaaucagaagaccggccaagaaguuguguucgucgccgagcccgacaacaaaaauguguauaaguuugaacuagauacaagcgagcggaaaauugaguucgacucugcaucagggaccuacacucucuaucugaucaucggagaugccacgcuuaagaacccuauuuuguggaacguagcugacgugguuauaaaguuuccagaagaggaagcccccaguacaguccugagccagaaucucuucaccccuaaacaggagauccagcaccuguuucgcgaaccagagaagcgacccccgacugugguguccaacaccuucacagcacuuauucugucuccuuugcuccuguuauuugcucuguggaucagaauaggcgccaaugucucgaacuucaccuuugcgcccagcacuauuaucuuccaucuaggucacgccgcuaugcucgggcugauguacguuuauuggacacaacuuaauauguuccagacguugaaauaccuggcaauccucggauccgugaccuuucuggccggcaacaggauguuagcucagcaggccgugaagcggauugcagcggagcaaucaagucgucuggccaaauaucgcacucuuagaacagcucauuga

SEQ ID NO: 62007 - RNA, 375 nt, Artificial Sequence
  derived and/or modified sequence opt3 from RPP14__Homo_sapiens__NP_001092253
augcccgccccugcugcaaccuacgagagaguggucuauaagaacccaagcgaauaccacuauaugaaaguuugccuggaguuccaggacuguggcguggggcucaaugccgcgcaauuuaagcagcuucugaucuccgcuguaaaagauuuguucggagaaguggacgccgcauuaccgcuggauauucuaacauacgaggaaaagacucucucugccauacugaggaucugcucaaguggucuugucaaacuguggagcuccuugacgcuccugggcucuuauaaggggaagaaaugugcuuuucgggugauucagguuucgcccuuccugcucgcauuaucaggaaacagccgcgagcuggugcuugacuga

SEQ ID NO: 62008 - RNA, 489 nt, Artificial Sequence
  derived and/or modified sequence opt3 from RPP21__Homo_sapiens__NP_001186049
auggccggccccgugaaggacagagaggcuuuccagaggcugaacuuucucuaccaagcagcccacugcguccuugcgcaggauccugaaaaucaggcucuggcccgguucuauuguuacaccgagcgcacaaucgcaaaacgauugguuuuacguagaccacugagcuccucugccccgagggaccccucagugaagcggacucuaugccgcggguguaguagccuccugguaccuggacuuacgugcacccagagacaaaggcggugucgcggucagcgauggacagugcagacuugccugaccugucagagaucccaaagguuuuugaacgauccaggccaucuccuguggggagaccggcccgaagcucagcuggggucucaggcagauucgaaaccucuccagccauuacccaauacagcccacucaauuagcgaccgucugccugaggaaaagaugcaaacccagggcaguuccaaccaguga

SEQ ID NO: 62009 - RNA, 600 nt, Artificial Sequence
  derived and/or modified sequence opt3 from RPP25__Homo_sapiens__NP_060263
auggagaacuucagaaaggugaggagcgaagaggcccccgcuggcugcggggcagaaggagguggcccuggguccggaccauuugccgaccuggcgccgggcgcuguccacaugcggguuaaagaggguucuaagauccgcaaucucauggccuucgcaaccgccucaauggcucagcccgcaacacgagccauuguguuuaguggguguggacgugcuacuacgaaaaccguaacaugcgccgaaauacuuaagagaaggcuggcgggcuugcaucaagugacucgguuacgcuacagaagcgucagggagguguggcagucccugccuccaggccccacccaggggcagacaccuggagagccagcagccucucuaucgguucucaaaaacgugcccggucuggcuauccuucugucaaaggaugccuuggacccucggcaaccaggcuaucagccgcccaauccucacccagggcccagcaguccuccagcagcucccgccuccaagcgcucucucggagaaccggcggccggcgaggguagcgcaaaacgaucccagccugaacccggggucgcugaugaggaccagaccgccuga

SEQ ID NO: 62010 - RNA, 852 nt, Artificial Sequence
  derived and/or modified sequence opt3 from RPP38__Homo_sapiens__NP_001252530
auggccgcugcaccccaggccccuggcagagggagccuuaggaagacccggccacucguggucaaaacaucccuuaacaauccguacaucauucgcuggucugcgcuggagucagaagacaugcacuucauauugcaaacuuuagaggaucgacugaaggcuaucggacuacagaaaauugaagacaagaaaaagaagaacaaaacgcccuuucucaagaaagagagucgugaaaagugcagcaucgccguugauauuuccgagaaucugaaagagaagaagaccgacgcaaaacaacaggugucugguuggacuccugcccauguaagaaagcagcuugcuaucggcgugaacgaagucacaagggcacuggagcggcgcgaauugcuccuggugcugguuuguaaaucggugaagccagccaugauaaccucacaccucauccaguuaagccugaguagauccguccccgcuugccaggugccuaggcuuucugagcggauugccccaguaaucggguugaaauguguucuggcgcuagcauucaagaaaaauacaaccgauuuuguggacgagguccgcgccauuaucccccgagugccuagccucuccgugccauggcugcaggauagaauagaagacucaggagagaaccuugaaacugagccgcuggaaagucaagauagggaguugcucgacacaucauucgaggaucugucuaagcccaagcggaaauuagcugacggccgucaggccuccgucacccugcagccucucaagauuaaaaagcugaucccaaaucccaacaaaauucgcaagccuccaaagagcaaaaaggcaacgcccaaauga

SEQ ID NO: 62011 - RNA, 1092 nt, Artificial Sequence
  derived and/or modified sequence opt3 from RPP40__Homo_sapiens__NP_006629
auggccacccugagaaggcuccgggaggcuccccgccaccuucuggugugcgaaaagagcaacuucggcaaucauaaaucccgacaccgucauuugguccagacacacuacuauaacuacagaguuucuuuucuaaucccugagugugggauucugucagaagaguuaaagaaucucgugaugaacacuggaccauauuacuucgugaaaaaucugccgcuucaugaacugauaacgcccgaguuuaucaguaccuucauuaagaaagguagcugcuaugcauugacauacaacacucacaucgacgaggauaauaccguagcccuccugccuaacggcaagcugauucucuccuuagacaaggauacauaugaagagaccgggcugcaaggacacccaucucaguuuucgggcaggaaaaucaugaaguucauagucucaaucgaccuuauggaauugagccugaaucuagauaguaaaaaguacgagcggauuuccuggucuuuuaaagagaagaagccccucaaauucgacuuucugcuugcguggcauaagacugguagcgaagaguccacaaugaugucauacuucaguaaauaucagauccaggaacaccaaccuaagguggcucugagcaccuugcgcgaucuccaguguccaguucugcagucuuccgaguuagaagggacgcccgaggugucaugcagagcccuggagcucuuugacuggcuuggagcagucuucagcaacguggaucugaauaacgaaccuaauaacuuuauuaguacuuacuguugcccagagccgucuaccguaguugccaaagcauauuuguguacaaucacuggcuucauacuacccgaaaagauuugccugcuccuggagcaucuuugucacuacuucgacgaaccuaaacuggcuccaugggugaccuuguccguccagggcuuugccgauagccccgugucgugggagaagaaugagcacggguucaggaagggaggugaacaucucuauaacuuugugaucuucaacaaucaagacuacuggcugcagauggcugucggcgccaacgaucacugcccuccauga

SEQ ID NO: 62012 - RNA, 831 nt, Artificial Sequence
  derived and/or modified sequence opt3 from RPRD1A__Homo_sapiens__NP_001290340
augagaaacagcaauuggagguucugccagaccggcaucuacuccaagcccaaccggaaacugacauuucucuaucuugccaaugacgugauucaaaacucuaagcgcaaagggccugaguucacuaaggauuuugcuccagucauaguugaagcauucaaacacgugucaagugagacggacgaaagcuguaagaagcaucugggacgaguauuguccaucugggaggaacguucuguguacgagaaugaugucuuagagcagcugaaacaggcccuauauggugacaagaaaccgagaaagaggaccuacgaacagauuaaaguggaugagaacgaaaauugcucgucacucggcagccccagugagccuccacaaacacuggaccuuguucgggcgcugcaggauuuggagaacgcugccuccggggacgcagccgugcaccagcgcaucgcuucucuccccgucgaagugcaggagguaagccugcuggauaagauuacugacaaggaauccggagagagacucucaaaaaugguugaagaugcauguauguuacuggccgacuauaauggcaggcuugcugccgagaucgaugaccggaagcaauugacccgcaugcuggcggacuuucuacgaugccagaaagaggcacucgccgaaaaggagcauaaacuggaagaguacaagagaaaacuugcuagggugagucugguccggaaggaauugcguagccgcauacagucucucccugaucuguccagauuaccaaacgugacagguucacacaugcaucugcccuucgccggggacaucuauagcgaggauuga

SEQ ID NO: 62013 - RNA, 981 nt, Artificial Sequence
  derived and/or modified sequence opt3 from RPRD1B__Homo_sapiens__NP_067038
augagcuccuucucugagucagcccuggaaaagaaacucagugagcuuagcaacucccagcaaucugugcagacccugucguugugguuaauccaccauagaaagcacgcuggccccauugucucaguuuggcauagggaacugcggaaagcaaagagcaaucgcaaacuaacauuucucuaccuggccaacgacgugauacagaauaguaagcgaaaggggccugaguucacucgugaauuugaguccguacuuguggaugcguucucucacgucgcuagagaggccgacgaaggaugcaaaaagccacuggagagguugcucaacaucuggcaggaacggagcguguaugguggcgaguuuauucaacagcugaaacuguccauggaggauucaaagaguccgcccccuaaagcaacggaagagaagaagucccucaaacgcaccuuccagcagauccaagaagaggaagacgaugacuacccagggucuuauagcccccaggauccuucagccggaccauuacugacagaggagcuuauuaaggcuuugcaggaccuggaaaaugcagccagcggcgaugcuacuguuagacagaaaaucgccagucuaccccaagaggugcaggacgucucucuccuggaaaagauaaccgauaaagaggcggcagaaaggcuuuccaagacaguggacgaggccugucuguugcucgcugaguacaacggucggcuggccgcagaauuagaggaucgccgacagcuggcuagaaugcucguagaauauacccaaaaucagaaagacguucuuagcgagaaggaaaagaaacuggaggaguacaagcagaaauuggccagggugacucagguccggaaggaacuaaaaucgcauauccaaucucugccugaccucucccugcuuccaaacgugacagggggacuggcgccguugcccucagccggcgaucucuuuaguaccgacuga

SEQ ID NO: 62014 - RNA, 2805 nt, Artificial Sequence
  derived and/or modified sequence opt3 from RPRD2__Homo_sapiens__NP_001284602
auggccgcuggcgggggagguggcagcuccaaggcaucuucaaguagcgccuccucugcgggggcucuggagucgucacucgacagaaaauuccagagcgugaccaacacaauggaaaguauccaaggacuuuccucuuggugcauugagaauaagaaacaccauagcacuauagucuaccacuggaugaaguggcugaggcgguccgccuauccccaucgcuugaacuuauuuuaccuggcaaaugauguuauccagaacuguaaacgaaagaaugccauuaucuuccgugaaucauuugcugacgugcuaccugaggcagccgcucucguaaaggauccaagugugagcaaaucugucgaaagaauuuucaagaucugggaggacaggaacguguauccggaggaaaugauaguugcccugcgggaggcgcuuacguccaccaaucccaaagcagcccugaagucaaaaaucguggcugaauuucgcagccaggccuugauugaggagcuccugcuguacaagagaagugaagaucagaucgagcucaaggaaaaacaauuaucuacaaugagggucgacgugugcuccacugagacccugaagugucuuaaagauaagacaggcgguaaaaaguucagcaaagaauuugaggaggcaucgucuaaguuggaagaguucguaaacgggcuggacaagcagguuaaaaauggaccuucccuaaccgaagcucucgagaacgccggcaucuuuuaugaagcgcaguacaaggaggugaaagucguggccaaugcauauaagacuuucgcuaaccgggugaauaaccugaaaaagaagcuggaucagcugaaaucaacauugccagaccccgaggaaaguccugucccaagccccuccauggaugccccuucuccaaccggcagcgagucaccguuucaagggaugggaggugaagagagucagucccccacgauggaaagcgagaagucugcuacuccugagccaguuaccgacaaucgcgauguggaagacauggagcucucagacguagaagaugacggcaguaaaauuauaguggaggaucgaaaggagaaacccgccgaaaagagcgcagucuccacaucugugccuacuaagccaaccgagaacauuucgaaagccagcuccugcacacccguuccggugaccaugacggcuacuccuccccugccaaagccugucaacacaucauuaagucccucuccagcgcuggcacuccccaaucuugccaacguggaccuggcuaaaaucagcuccauuuugucaagccuaaccucuguaaugaagaauacugggguuuccccugccaguagaccaagcccgggaacacccaccucuccuuccaaccugacgucaggccucaaaaccccagcacccgccacaacuaccagucacaauccucuggcuaacauccuuagcaagguggaaaucacaccagagucgauucuguccgccuugucuaagacucagacccagagcgcacccgcgcuccaaggucugucaaguuuacugcaguccgucacagggaauccggugccugcuucugaagccgcaagccaguccaccucagccagcccagcuaacacuacggucaguacaauaaaaggaaggaaucuacccucuuccgcccaaccuuucauccccaagagcuuuaacuacucgccaaauucaucuaccagugagguguccagcacuucugcaagcaaagcuagcauuggccagucaccuggccuccccaguaccacauucaagcugccaagcaacucucuuggguucaccgccacucauaauacauccccggcggccccucccacggagguuaccaucugucagucaagugaagugagcaaaccaaaguuggaguccgaaucuacuucgcccagccuggagaugaaaauacacaacuuucucaagggaaauccugguuucucaggccugaaccuuaacauuccaauccuguccaguuuggggucuagcgcucccuccgaaucacacccuucugauuuucagcggggaccgacaagcaccaguaucgacaauauugauggcacaccaguacgugacgagcgcuccgguacucccacccaagaugagaugauggacaagccuacguccucuucagucgauaccaugucccuccugaguaaaaucauuagcccagggucgucuacacccuccagcacuagaucaccuccgcccggcagggacgaaaguuacccacgggaguuaucuaacuccgugagcaccuaucgaccuuucggacugggcucagaaagucccuacaagcagccaagcgacgggauggagcgcccuuccucucuaauggauagcucccaggaaaaauuuuaucccgacacaucauuccaggaggaugaggacuacagagauuuugaauauucuggaccaccgccuagugcaaugaugaaucucgagaagaaacccgccaagucgauacuuaagagcuccaaacuuucugacacuaccgaauaccaaccaaucuugucaagcuauucccauagggcucaggaguucgguguuaagagugccuuucccccuucugugcgggcacugcucgauagcucagagaacugcgaccgccuguccaguagcccaggcuuauucggggcguuuucugucagaggaaaugaacccggcuccgauaggucaccuagcccgaaacacccaugucguucgcaugguucucccacgcacgugcggcgaggggagaguccuggccugcaccauuuccaccauguagacgauuga

SEQ ID NO: 62015 - RNA, 330 nt, Artificial Sequence
  derived and/or modified sequence opt3 from RPRM__Homo_sapiens__NP_062819
augaaccccgcccugggcaaucagaccgacguggcuggacucuuccuugcaaacagcuccgaggcccuggaaagagcggucaggugcuguacacaggcuucuguugugacugaugacggguuugccgaggguggcccugaugaacggucauuguacaucaugcgcguagugcaaauugcagucaugugcguguuaagucugacgguuguguucgggauauuuuuccuaggauguaaucuccugaucaagagcgagggcaugauuaacuuucuugucaaagaccgacguccauccaaggaaguggaggccguaguuguggguccguauuga

SEQ ID NO: 62016 - RNA, 498 nt, Artificial Sequence
  derived and/or modified sequence opt3 from RPS10__Homo_sapiens__NP_001191020
augcugaugcccaagaaaaacagaaucgccauuuacgagcuccuuuucaaggaaggcgugauggucgcuaaaaaggacguucacaugccuaaacacccagagcuggcagauaagaaugugccgaacuugcacguaaugaaggccaugcagagcuuaaaauccaggggguaugugaaggaacaauuugcguggcggcauuucuacugguaucugaccaaugagggaauacaguaccuacgcgacuaucuccaucugcccccugaaaucgucccagcuacacuucgacguucuagacccgagacugguaggccucggccaaaaggccuggagggggaacgccccgccagauugacgaggggagaggcagaucgggacaccuaccgccgaucagccgugccuccaggcgcugauaagaaagcagaagccggugcugggagugccacagaguuucaguucagaggaggcuuuggcagggggcggggacagccgccccaauga

SEQ ID NO: 62017 - RNA, 456 nt, Artificial Sequence
  derived and/or modified sequence opt3 from RPS14__Homo_sapiens__NP_001020242
auggcccccagaaagggcaaagagaagaaagaagaacaggugaucagccuggggccucaagucgcugagggagagaacguuuucggugugugccacauuuuugcauccuucaaugacaccuuuguacaugugacagaucucucuggcaaggaaacuauauguagggucaccgggggaaugaaagugaaggccgaccgggaugagucaaguccauacgcggcuaugcuugccgcacaggacguugcccagcgcugcaaggagcugggcaucacggcuuugcacauuaaauuacgagcaacaggugggaaccguacuaagaccccgggacccggcgcccagagcgcucugagagcccuagcgagguccggcaugaaaaucgggcggauugaagaugugacaccuaucccaucugacucgacccgcagaaagggagguaggcggggccgccgacucuga

SEQ ID NO: 62018 - RNA, 393 nt, Artificial Sequence
  derived and/or modified sequence opt3 from RPS15A__Homo_sapiens__NP_001025180
auggugagaaugaacguccuggccgacgcucucaagagcaucaauaacgcagagaaaaggggcaagcggcagguucuuauucgccccugcuccaaagugauaguacgauuccugaccgugaugaugaagcacggguacaucggagaauuugagauuaucgaugaccaucgugccgguaaaauugucgugaauuugacaggcagauuaaacaagugugggguuaucucuccuagguucgaugugcaacugaaggaccuagaaaaauggcagaauaaccuccugccaucacggcaguuuggauucauaguccuuacuacgagugcgggcaucauggaucacgaggaagcucgcagaaagcauaccggugggaaaauucugggauuuuucuuuuga

SEQ ID NO: 62019 - RNA, 459 nt, Artificial Sequence
  derived and/or modified sequence opt3 from RPS16__Homo_sapiens__XP_005259194
augcccagcaagggcccucugcaguccgugcaagucuucgggaggaaaaagaccgccacagcuguugcacacugcaaaagaggaaacggucucaucaaggugaauggccggccacuugagaugauugaaccgcgcacucugcaguacaaauuguuagagcccguacugcuacucgggaaggaacgauuugccggaguggacauacgugucagagugaagggcggugggcauguugcgcagaucuauggagagucucaggaacugggcgcuuggaggcgguggcuuugggagggcgggcugcacucagccccugugccauucaacugugucaguuuuagccaauuguccgugucucccucgccuaaaccaugguggcccauuacgcgcaauauguggaugagacucccuaggcggcgcucaaagaccagcaguuccucuaugacaggaccaugcugguga

SEQ ID NO: 62020 - RNA, 459 nt, Artificial Sequence
  derived and/or modified sequence opt3 from RPS18__Homo_sapiens__NP_072045
augagccuggugauccccgagaaguuccagcacauucucagaguccuuaacaccaauauagacggcaggcggaaaaucgccuuugcuauuacagcaaucaaggggguuggacgccgauacgcccaugugguacugcguaaagcggauauugacuugacuaagagagcuggugaauuaacggaggaugaaguggagagggucaucaccauaaugcaaaacccucggcaguauaaaaucccagacugguuccugaaucgccagaaggaugugaaggacggcaaauacucccagguucuagccaacgggcucgauaauaagcugagagaagaccuugagaggcugaaaaagauucgggcacaccgcggauugcgacauuuuuggggccucagagugaggggucaacacacaaaaacuaccgggcggcguggacgcacagucggcgugucuaagaagaaauga

SEQ ID NO: 62021 - RNA, 411 nt, Artificial Sequence
  derived and/or modified sequence opt3 from RPS19BP1__Homo_sapiens__NP_919307
augagcgccgcucugcucagaaggggccuugagcuguuggcagccuccgaagcgccccgggacccuccagggcaggcuaagccgcgcggagcccccgugaaacgaccucguaagaccaaagcaauccaagcccagaaguuaagaaacucugcuaaagguaaggucccaaagucagcacuggaugaguacaggaaacgggaaugccgcgaccaccuaagaguuaaucucaaguuccugacaaggacucggaguacgguggccgagagcguaucccagcagauucuucgccaaaaccgaggcagaaaggcuugugauaggcccguggccaaaaccaaaaagaagaaagcggaagggacagucuuuacugaggaggacuuccagaaguuucagcaggaauauuucggaucuuga

SEQ ID NO: 62022 - RNA, 429 nt, Artificial Sequence
  derived and/or modified sequence opt3 from RPS20__Homo_sapiens__NP_001139699
auggccuucaaggacaccggcaaaacacccguggagccugaagucgcuauccacagaauuaggauaacucugacgagccggaacguuaagucccucgagaaagugugcgcagaucuuauccgcggggccaaggagaaaaaucugaagguaaagggaccagugcgaaugccgaccaaaacauugcguauuacuaccagaaagacacccuguggugaaggcucuaaaaccugggacagguuucagaugcggauccauaagcgcuuaauugaucugcacucaccuagugaaaucgucaaacaaauaacuagcaucuccauugagccagggguggagcuaaucgaaucuacagacgcggagcccauggauaccgaaggacagcaguacacgcucagaucgguuuucgagucaccuggcacuugcccauuuuga

SEQ ID NO: 62023 - RNA, 396 nt, Artificial Sequence
  derived and/or modified sequence opt3 from RPS24__Homo_sapiens__NP_001135754
augaacgacaccgugacaaucagaacuaggaaguucaugacgaaucggcugcuccagcgcaaacaaauggucauugauguucuucaccccggcaaggccaccgugccuaaaacagagauacgagaaaagcuggcuaaaauguacaagacuaccccagacguaaucuuuguguucggguuucguacacauuucggagguggcaagaccacuggguuuggaaugauuuaugauagcuuggacuacgccaaaaagaacgagccgaaacacagauuagcaaggcauggccuguaugaaaagaaaaagacaucccggaagcagcgcaaagagagaaagaauaggaugaaaaagguccgggguaccgcgaaagcuaacgugggggccggaaagaaaaaguga

SEQ ID NO: 62024 - RNA, 471 nt, Artificial Sequence
  derived and/or modified sequence opt3 from RPS27A__Homo_sapiens__NP_001170884
augcagaucuucgugaagacccugacaggcaaaacuauuacgcucgaggucgaacccagcgacaccauagagaacguuaaggccaaaauccaagauaaggaagggauuccuccagaccagcagagacuuaucuuugcuggaaaacagcuggaggaugguaggacauuguccgacuacaauauucaaaaggaaucuacuuuacaccuggugcuacggcuccgcggcggggcaaagaaacgaaagaaaaagucauauaccacaccgaaaaagaacaagcauaaacguaagaaaguaaagcuggccgugcuuaaauacuauaaggucgaugagaauggaaaaaucaguagacugaggcgggagugccccagcgacgaauguggcgcggguguguucauggcuucccacuuugaucgccauuacugcgggaaguguugcuugaccuauuguuucaacaagccugaggacaaauga

SEQ ID NO: 62025 - RNA, 255 nt, Artificial Sequence
  derived and/or modified sequence opt3 from RPS27__Homo_sapiens__NP_001021
augccccuggccaaggaccuccuucacccuagcccagaggaagagaaaagaaagcauaaaaagaaaaggcuggugcaguccccgaacucuuacuucauggaugucaagugccccggcuguuauaagaucaccacaguguuuucacacgcucaaacuguuguauugugcgugggguguaguacggucuuaugccagccuaccggagguaaagcacggcugacagaaggcuguagcuuccgccgaaagcagcauuga

SEQ ID NO: 62026 - RNA, 255 nt, Artificial Sequence
  derived and/or modified sequence opt3 from RPS27L__Homo_sapiens__NP_057004
augccccuggccagagaccuccuucacccuagccuggaggaagagaagaaaaagcauaaaaagaaaagguuggugcaguccccaaacucuuacuucauggaugucaagugcccgggcuguuauaagaucaccacaguguuuucacacgcucaaacuguuguauuaugcgugggguguaguacgguccugugccagcccaccggagguaaagcacggcuaacagaaggcuguagcuuccgccgaaagcagcauuga

SEQ ID NO: 62027 - RNA, 171 nt, Artificial Sequence
  derived and/or modified sequence opt3 from RPS29__Homo_sapiens__NP_001023
augggccaccagcaacuguacuggagccaucccagaaaguucgggcagggauccaggucuugccggguguguucaaaccgccacggucucauccgaaaauauggccuuaauaugugccgucaguguuuuagacaguacgccaaggacauuggguucauaaaacuggauuga

SEQ ID NO: 62028 - RNA, 882 nt, Artificial Sequence
  derived and/or modified sequence opt3 from RPS2__Homo_sapiens__NP_002943
auggccgacgaugcuggcgcagccgggggacccgguggcccugggggaccaggcauggguaacagagggggauucaggggcggcuuugggagcggaauccggggucgcggccgagggcguggaagaggcaggggucgggggcgcggagcgagaggcggcaaggcugaggacaaagaauggaugccggugaccaagcuggggaggcucgucaaagauaugaagauuaaaucccuugaggaaauauaccuguucucuuugcccaucaaggagucagaaauuaucgacuuuuucuuaggagccagucugaaggaugagguucuaaaaauuaugccugugcagaagcaaacacgggcaggucagcgcacucgauuuaaagccuucguagcuaucggcgacuauaaugggcacgugggacucggcgucaagugcagcaaagagguggcaacggccauaagaggugcuaucauucuggccaaacuuuccaucguuccagugaggcggggguacuggggcaacaagauuggaaaaccccauaccgucccuuguaaggugacaggccguugcgggucuguacugguucgcuugaucccagcgcccagaggaacugguauagugucggcaccugucccaaagaagcuccugaugauggccggcauugaugacuguuauaccucagcuagggggugcacagccacccugggaaauuuugcaaaagcuacuuucgaugccaucagcaagacauacaguuaucucaccccggacuuauggaaagaaacgguguuuacuaagucccccuaccaggaguucaccgaucaccuggugaagacacauacucgggucucuguucagcgaacccaagcgccugccguggcaacaaccuga

SEQ ID NO: 62029 - RNA, 795 nt, Artificial Sequence
  derived and/or modified sequence opt3 from RPS3A__Homo_sapiens__NP_000997
auggccgugggcaagaacaaaagacugaccaaagggggaaagaagggugcuaaaaagaaggucguugaccccuucagcaaaaaggauugguacgacgugaaagccccugcaauguuuaauaucaggaacauuggcaagacacucguaacucggacgcaggggaccaaaauagcguccgauggacuuaagggccgcguguucgaggucucucuggcugacuugcaaaaugaugaaguggccuuucgaaaguucaaauuaaucacagaggacguucaggguaagaacugccugacuaauuuucacgggauggaucuaacccgugacaaaauguguucaauggugaagaaauggcagacaaugauugaagcacaugucgaugugaagaccacugacggauaucuccugagacuuuucugcguaggcuuuaccaaaaagaggaacaaucagauccggaagacaaguuacgcccaacaccagcagguucgccagauuaggaaaaagaugauggagaucaugacgagagaagugcaaacuaacgaucugaaagaggucgugaauaaguugauaccagacagcaucggcaaagauauugagaaggcuugucaguccaucuauccgcuccaugacguguucguccggaagguuaaaaugcugaagaaacccaaguuugaacuggggaaacucauggaguuacacggagaagguucuucgucaggcaaggcaaccggggacgagacaggagccaagguggagcgcgcugauggcuacgaaccuccaguacaggagagcguguga

SEQ ID NO: 62030 - RNA, 732 nt, Artificial Sequence
  derived and/or modified sequence opt3 from RPS3__Homo_sapiens__NP_000996
auggccgugcagaucagcaagaaaagaaaguucgucgcugacggcauuuuuaaagcagagcugaacgaguuccucaccagggaacuugccgaagauggguacuccggaguugaggugcggguaacacccacucgcacggaaauaaucauucuggcgacccgaacacaaaauguguugggugagaagggccguagaaucagggaguuaacugcugucgugcagaaacgguuuggguucccugaaggaucuguugagcuguaugccgaaaagguggcaacccgcggccuaugcgccauugcucaggcagagucacucagauacaagcugcuuggugggcuggccgucaggcgggcuuguuauggaguguugcgcuuuaucauggagaguggcgccaaaggcugcgaaguaguugugagcgggaagcuccgaggacagagagcgaaauccaugaaguucgucgacggucugaugauacacucuggcgauccagugaacuacuauguggacacagcagucaggcauguucugcuccggcaagggguguuaggaaucaaaguaaagauuaugcugccgugggaucccaccggcaagaucgguccuaaaaagccacuucccgaccacgugucgauugucgagccuaaagaugaaaucuugccaacuacacccauaucagagcagaaagggggaaagccugaaccaccggccaugccccagccugugccaaccgcuuga

SEQ ID NO: 62031 - RNA, 792 nt, Artificial Sequence
  derived and/or modified sequence opt3 from RPS4X__Homo_sapiens__NP_000998
auggccagaggccccaagaaacaccugaagaggguggcugcaccuaaacauuggaugcucgacaaacuuaccggggucuucgccccacggccgagcacaggaccccacaagcugcgcgagugcuugccuuuaaucauuuuucugcgaaaccgucuaaaguacgcgcucacuggugaugaaguuaagaaaauauguaugcagagauucaucaagauugacggcaaagugaggacggauaucaccuauccagcuggguuuauggacguaauuuccaucgauaagacaggagagaauuuccggcugauauacgacacuaaaggccgcuuugccgugcauagaaucacccccgaagaggcaaaguauaaacuuugcaaggucaggaagauuuucguggguacaaaagggaucccucaccugguuacccaugaugcccggacuauucgcuacccagaccccuugaucaaggugaacgauacaauacaaauugaccucgaaaccggaaaaaucacggauuuuauuaaguucgacacuggcaaucuguguauggucaccggcggggcuaaccugggacgaaucggugugaucacaaauagagagaggcacccuggcucuuuugauguaguucacgugaaagacgcaaacggaaauucauucgccacucggcucaguaacauuuuugucauagggaagggcaauaagccauggaucagcuuaccgcgugguaaagggauucgccugaccaucgcugaggaaagagacaagaggcuugccgcgaaacaguccucuggauga

SEQ ID NO: 62032 - RNA, 792 nt, Artificial Sequence
  derived and/or modified sequence opt3 from RPS4Y1__Homo_sapiens__NP_000999
auggccagaggccccaagaaacaccugaagaggguggcugcaccuaaacauuggaugcucgacaaacuuaccggggucuucgccccacggccgagcacaggaccccacaagcugcgcgagugcuugccuuuaaucguuuuucugcgaaaccgucuaaaguacgcgcucacuggugaugaagugaagaaaauuuguaugcagagauucauaaagaucgacggcaaaguaaggguggaugucacguauccagcuggguuuauggacgugauuuccaucgagaagaccggagaacauuuccggcugguuuacgauacaaaaggccgcuuugccgugcacagaauuacugucgaggaagcaaaguauaaacuuugcaaggugaggaagaucaccguagguguuaaagggauaccccaucuggugacacacgacgcccggaccauccgcuacccugauccagucauuaaggugaaugacacugugcaaaucgauuugggaacaggcaaaauuaucaacuucauaaaguuugacaccggcaaucucuguauggucauugggggagcuaaccugggucgaguuggcgugaucacgaauagagagaggcaccccgggucuuucgauguagugcaugucaaagacgcaaacggaaauucauuugccacucggcugaguaacauuuucgugaucggcaaugguaacaagccuuggaucagccucccacgugggaagggcauucgcuuaaccguugcugaggaaagagauaaaaggcuggccacaaagcaguccucuggauga

SEQ ID NO: 62033 - RNA, 2226 nt, Artificial Sequence
  derived and/or modified sequence opt3 from RPS6KA2__Homo_sapiens__NP_001006933
augcccaucgcccagcugcucgagcuuuggaagaaaauugaaguggagccuauggaaauagagaccacagaagaggaccugaacuuggaugucgagccagcuacugaagacacggcagaggaagaggagggcguugugaaggaaaucgauauuagccaccauguaaaagagggguucgaaaaggccgacccgucccaauuugaguuacugaaagugcuaggacaggguucuuacggcaaggucuuccucgugagaaagguuaaagggucagaugcgggacagcuguaugcuaugaaggugcuuaaaaaggccacccugaaagucagggaccgggugcgcaguaagauggaacgagauaucuuggcagagguaaaucaccccuuuauuguuaagcuccauuacgccuuccagacagagggcaaacuguaucugauccucgacuuuuuacgugguggggaucuguucacuagacuuagcaaggaagugauguuuaccgaggaagacgucaaauucuacuuggcugagcuggcacuagcccucgaucaucugcacucccuuggaauaaucuauagggaccugaagccugaaaacauuuugcucgaugaggagggccacaucaaaauuacagacuuuggccugucuaaggaagcuaucgaccacgauaaacgggccuacucguucugcgggaccauagaguauauggcgccagaaguggugaaucgcagaggacauacucaaucagcagacugguggagcuuuggugucuuaauguucgagaugcugacaggcagucuccccuuucaggggaaggauaggaaggaaaccauggcccuuauucugaaagcuaaguugggaaugccucaguuccuauccggcgaggcccagucucugcuccgggcacuguucaaacgcaacccauguaaucgacuuggugcugggaucgacggaguugaggaaauuaagagacaccccuuuuucgugacgaucgauuggaacacucuguacaggaaagagaucaagccuccauuuaagccggccguaggccggcccgaagacaccuuccauuuugauccugaguucacagcgcguacuccaaccgacagccccggcgugccuccauccgccaaugcacaccacuuguuucgcggguucucauuugucgcuaguagccucauucaagagcccucucagcaggaucugcauaaagugccgguucacccuauagugcagcaauuacauggaaacaauauccacuucacagacgguuacgaaauuaaggaggauaucggcgucggguccuauucagugugcaaaagauguguacauaaggccaccgacacggaauacgcuguuaaaauaauugacaagagcaagagggaucccagugaggaaaucgagauccugcuacgguauggacagcacccaaacauuaucacucucaaagacguguacgaugacggcaaguuugucuaucuggugauggagcuuaugcgagguggggaauugcuggaucgcauucucagacagagguacuucucugagcgggaagccuccgacguccugugcacaauaaccaaaacuauggauuaucuucacagccaaggcgugguucaucgcgaccugaagccuucgaauaucuuguacagagaugagucuggaucccccgaaucaauuagggugugugacuuuggcuucgcaaaacagcuccgugccgggaacggacuguuaaugacaccaugcuacaccgcuaauuucguagcgcccgagguccugaagcggcaggguuaugaugcagccugugacaucuggagucuaggcauccuccuguacacgaugcuugcuggguuuaccccuuucgccaacggaccagaugacacaccggaggaaauuuuggcacgaauaggcagcgguaaguaugcccuguccgggggcaauugggacucuaucagcgaugcugccaaagacgugguuucaaagaugcuccacguggauccccaucagagacugacugcaaugcaagucuuaaaacacccuugggugguaaacagggaguaccugaguccaaaccagcuuucccgccaggacgugcacuugguuaagggagcgauggcugccaccuauuuugcacucaaucggacaccccaggccccuagacuggaaccaguccuaagcucuaaccuggcucaaaggcgcggcaugaaacgacucacuucaacccggcuguga

SEQ ID NO: 62034 - RNA, 2223 nt, Artificial Sequence
  derived and/or modified sequence opt3 from RPS6KA3__Homo_sapiens__NP_004577
augccccuggcccagcucgcugacccuuggcaaaagauggcaguggagagcccauccgauucugccgaaaacggccagcagaucauggacgagccgaugggggaagaggaaauuaauccccagaccgaggaggucucaauaaaagaaaucgcgauuacacaccauguuaaggagggacacgaaaaagcugauccuagucaauucgagcuucugaagguguugggucagggcagcuuugggaaaguauucuuagugaagaagaucuccggaucugacgccagacagcuguacgcaaugaaaguccuaaagaaagccacucucaaggugagggaucggguucgcacgaaaauggagcgagacauucugguggaagucaaccauccauuuaucgugaagcuccacuaugcuuuccagaccgagggcaagcuguacuugauacucgauuuucugcgugguggggaccuguucacaagacucucgaaagaaguaauguuuacugaggaagauguuaaguucuauuuagcagagcuggcccuugcuuuggaccaucugcacucacuaggaaucauuuacagggaucucaaacccgagaauauccugcuugacgaagagggccacauuaagcugaccgauuuuggcuugagcaaagaaaguaucgaccaugagaagaaagccuauuccuucugcgggacaguggaauacauggcgccugaggucgugaaccggcgcggacacacccaaucugcagacugguggagcuuuggugugcucauguucgagaugcugacuggcacauuaccauuucaggggaaggauagaaaggaaaccaugacgaugauacugaaagccaagcucggaaugccccaguuccuuuccccugaggcucagucacuguugaggaugcuauucaaacggaauccagccaaccgccugggcgcagguccggacggggucgaagagauuaagcgacauagcuuuuucaguacuaucgauuggaauaaacucuauagaagggaaauucaucccccuuuuaagccagcuaccggacggcccgaggacacauucuacuuugauccugaguucacugccaagaccccaaaagacucucccggcaucccgccuuccgcgaacgcccaccaacuguuucguggcuucucauuuguugcaaucacaagcgaugacgaaagucaggcuaugcagaccguggggguacacucuauugugcaacagcuucaccgcaauuccauacaguucacggauggauacgaggucaaggaagacaucggugugggcagcuauucgguuuguaaaagaugcauucauaaggccacuaacauggaguuugcugugaaaaucauagauaagucuaagagggaccccacagaggaaauugagauccuguugcgguacgggcagcacccaaauaucauuacccucaaagacgucuaugaugacggaaaguacguguauguaguuacugaacugaugaaaggcggugaguuacuggauaagauccuacgacaaaaauucuuuuccgaacgcgaggccucagcagugcuuuucacaauuaccaagacggucgaguaccugcaugcccagggggugguccacagagaccuuaagccuaguaacauauuguauguggaugaaagcggcaaucccgaguccaucaggauuugugacuucggauuugcuaaacagcugcgggcggaaaacggccuccugaugaccccaugcuacacagcaaauuucguugcccccgaggugcuuaagcgccagggguacgaugcugccugugacaucuggucucugggaguauugcucuauacuaugcugaccgguuacacaccuuuugcaaacggcccagaugacacuccggaagagaucuuagccagaauugggagcggaaaauucucacugaguggcgguuauuggaacuccgucagcgauaccgcuaaggaccuagugucuaaaaugcuccacguugauccccaucaaaggcugacagccgcacuuguguugcgucacccuuggauaguccauugggaccagcugccacaguaccagcucaaucggcaagacgcgccccaccuggugaagggggcuauggccgcaaccuauucagccuuaaaccgaaaucagaguccuguacuggagccagugggcagaagcacucuugcucagaggcgcggaaucaaaaagauuacguccacagccuuguga

SEQ ID NO: 62035 - RNA, 2301 nt, Artificial Sequence
  derived and/or modified sequence opt3 from RPS6KA4__Homo_sapiens__NP_001006945
augggcgacgaggaugacgaugaaagcugcgccguggagcugagaaucaccgaagcuaaccucacagggcacgaggaaaaggucuccguugagaauuucgagcuucugaaaguguugggaacuggugcauacggcaagguauuuuuagugaggaaagccgggggacaugacgcgggcaagcuguaugcuaugaaaguccuacggaaggccgcacucgugcagcgcgccaagacgcaagaacacacccgaacagagcguucuguucuggaacuugugagacaggcucccuuccuggucacuuugcauuacgcauuucagaccgaugccaaacuccaccugauucuggacuaugugucagguggggagauguucacacaucucuaccagaggcaauauuuuaaggaggcugaaguacggguuuacggaggcgagauaguguuagcccuggaacaccuucacaaauugggcaucauuuaucgcgaucugaagcuagagaacguccuccuggacagugaagggcauaucgugcuuaccgauuucggacugagcaaagaguuuuugacugaggaaaaggagagaacauucuccuuuugugguaccauugaauacauggcgccugagaucauaaggucuaagacgggccacgggaaagcaguggacugguggucgcucggaauccuguuauucgaacugcucacuggcgccucaccauuuacccuugagggugagcggaauacacaggcugaagucagccgccgaauccugaagugcaguccgcccuucccuccaagaauugggcccguugcccaggauuugcuacagaggcugcucuguaaagacccuaagaaacggcugggagcaggcccacaaggcgcucaggaggugcguaaccaucccuuuuuccaggggcuugauuggguagcccuggcggcccgcaagauuccugcaccauucagaccgcagaucagguccgaauuggacgugggaaauuuugcugaggaguucacucggcucgaacccgucuacucuccuccagguagcccucccccaggcgacccccgaauauuucaaggguauuccuucguggccccgucaauucuguuugaucacaacaaugcuguuaugaccgacggauuagaggccccuggcgcaggagaucgccccgggagagccgcuguggcgaggagugcaaugaugcagcaguacgaacuggaccuacgggagccagcccucggccaagguagcuucucugucugccgcagauguaggcagcgucaguccggccaggaauuugcugugaaaauccugucacggcgacuugaggccaacacacaaagagagguagcagccuugaggcugugccagagccacccuaauguugugaaccuccaugaaguccaccaugaucagcugcacaccuaucuugugcuggaguugcuccgcgggggagaacuguuagagcauauucggaagaagagacacuucagugaaucugaggcuucccagauccugaggagccuagucucggccgugucuuuuaugcacgaggaagcaggaguugugcaucgcgaccucaaacccgagaauauccuguacgcggaugacacgccaggcgcucccguaaagauuauagauuucggguuugcccgacuucggccucaauccccaggagucccgaugcagacucccuguuucacauugcaguaugcagccccugaacugcucgcucagcaaggcuacgacgagucaugcgaucuguggaguuuaggugugauccuguauaugaugcuuagcgggcagguuccauuucagggcgccuccggacagggcgggcaaucucaggcagcugaaauuauguguaaaauccgugagggaagauucagcuuggacggugaggccuggcagggcgugucagaagaggcgaaggaacucgucagggggcugcuaaccguggaccccgccaaacgccugaagcucgagggacugcggggcaguuccuggcuucaagaugguagcgcuagaucuucaccuccauugaggacucccgacguacuggaaaguagcgggccggcagugcgauccggcuuaaacgccacauucauggcuuuuaaucgcggaaagcgggagggcuucuuucucaaaucuguugagaacgccccucuggcaaagagaaggaaacagaaacuucguucggcgaccgccagccgccggggguccccagcucccgccaauccugguagagcacccgucgcuucaaagggcgccccaaggcgagcaaacgguccucugcccccaaguuga

SEQ ID NO: 62036 - RNA, 2409 nt, Artificial Sequence
  derived and/or modified sequence opt3 from RPS6KA5__Homo_sapiens__NP_004746
auggaggaagagggcgggagcuccggaggugccgcuggcaccucugcagacgggggagauggcggugaacagcugcucacagugaagcacgagcuuagaacugccaaccugacggggcaugcggaaaaagucggaaucgagaauuucgaguuguuaaagguucugggcaccggcgcuuacgggaaaguguuucuaguaaggaagauuucaggacacgacacagguaaacucuaugccaugaaggugcugaagaaagcaacuauaguccaaaaggccaaaaccacagaacauacccggacugagcgccaggugcuugaacacauccgacagagucccuuccugguuacauugcauuacgcuuuucagaccgagacgaagcuccaccugauucuggauuauaucaacggcggggagcuuuucacucacuuaagccaacgugaaagauuuaccgagcaugaagugcagauuuacgucggagagaucgugcuggcacuugaacacuugcauaaacugggcauaaucuauagggacauuaagcuagagaauauccuccuggauuccaacggucacguaguucuuacagacuucgggcugucuaaggaguuuguggccgaugaaacugagcgggcuuacucguucugcggaaccauugaauauauggccccugacaucguccgcggcggcgauucagggcacgacaaagcgguggauugguggagcuugggagugcucauguacgagcuguuaacaggugcaaguccauuuaccgucgacggcgaaaagaauagccaggccgagauaucuagaaggauucugaaaagcgagccgcccuacccucaggaaauguccgcucucgccaaggaucuuauccaacggcuguugaugaaagacccaaagaaacgccuaggguguggaccccgagacgcagaugagauuaaggaacaucuguucuuucagaagaucaacugggacgaucucgcugccaaaaagguuccugcgccauucaaacccgugaucagagacgagcuggauguaucaaauuuugccgaagaguucacggagauggacccuacuuauaguccagcagcccuuccgcagagcucugaaaagcuguuccagggcuacuccuuuguggcucccucaauuuuguucaaaaggaacgcugccgucauagauccucuccaauuucacauggguguggagcggccagggguuacaaauguggcacguagcgccaugaugaaggacagucccuucuaucagcauuacgaucuggacuuaaaggauaaaccucugggcgaaggaucuuuuuccaucugccgcaaguguguccacaaaaagagcaaccaggcuuucgcggugaaaauuaucucgaagagaauggaggcaaauacccaaaaggagauaacugcccuaaaacucugcgaaggccauccaaacauuguaaagcugcacgagguuuuucacgaccagcuucauacauucuuggugauggaacugcucaaugggggagagcuguuugaaaggaucaaaaagaaaaagcacuucucugagaccgaggcuuccuauaucaugcggaagcucgucucagccgugagucauaugcacgacgucggugugguucaccgagaucugaaacccgaaaacuugcucuuuacggacgagaaugauaaccuggaaauuaagaucauugacuucggcuuugcacgcuuaaaaccgccugauaaccagccccugaagaccccauguuucacacuacauuacgccgcuccugagcuccugaaucagaacggguaugacgaaagcugcgaucuuugguccuugggagugauacuguacacuaugcucucuggccaaguacccuuccagagccacgacagaucacugaccuguacaagugccgucgagaucaugaaaaagauuaaaaagggugauuuuuccuucgagggggaagcauggaagaaugugagccaggaggcgaaagacuuaauccagggccugcuuacuguugauccaaacaagagguugaaaaugucuggacuccgguacaaugaauggcugcaagacggcucacagcuaaguagcaacccccugaugaccccugauauccucggguccucuggagcugccgugcauacaugcgucaaggcaaccuuucacgccuucaauaaauauaagcgcgaggguuuuugucugcagaacguggacaaggcuccacuugccaaaagaaggaagaugaaaaagacuucgacgagcacagaaacccguuccucaaguucugagagcucccauucauccucuucccacagucacggcaaaacuaccccgacaaagaccuugcagcccagcaauccugcagacucuaacaauccagagacucuguuccaauuuuccgauucaguagcuuga

SEQ ID NO: 62037 - RNA, 2238 nt, Artificial Sequence
  derived and/or modified sequence opt3 from RPS6KA6__Homo_sapiens__NP_055311
augcugcccuucgccccucaggacgagccaugggauagagaaauggagguguuuagcggcgggggagcuuccucuggugaagucaacggccucaagaugguugacgagccgauggaagagggggaggcagauucaugccacgacgaaggagugguaaaagagauccccauuacccaucacgugaaggaaggcuacgagaaagccgauccugcgcaauucgagcuucugaaggucuugggucaggggaguuuuggaaaaguguucuuaguuaggaagaagacaggcccagacgcuggccagcuguaugccaugaaagugcuaaagaaagcaagccucaagguccgggaucgcgugcgaacuaaaauggaacgugacauacugguagagguuaaucaucccuuuaucgugaaacuucacuacgccuuccagacggaagggaagcuguauuugauucucgauuuucugagaggaggugacgucuucaccaggcuguccaaagaggugcucuuuacagaagaggaugugaaguucuacuuagcugagcuggcacuugccuuggaccaucugcaccaacuaggcaucgucuaucgggaucucaaaccugaaaacauucugcuugacgagaucgggcacauaaagcugacugacuuuggauugucuaaagaaucgguugaucaggagaagaaggcuuacucauucuguggcaccguggaauauauggccccagagguagugaaucgcagaggucauagccagagugcggacuggugguccuacgggguccucauguuugagaugcugacaggaaccuuacccuuccagggcaaggauaggaacgaaacuaugaauaugauccugaaggcaaaacucggcaugccucaauuccuuucugccgaggcucagagccuguugcggaugcuauuuaagcgcaacccagccaaucgacugggguccgaaggaguggaggaaauuaaaagacaccucuucuuugcaaacaucgacugggauaagcuguacaaaagggagguucagccgcccuucaagccugcuucagguaagccagacgauacauuuugcuucgaccccgaguuuaccgccaaaacgccuaaggauaguccaggccuucccgcgagcgccaaugcacaucagcuguucaaaggguuuucuuucguggcuacuuccauugccgaagaguauaagaucaccccgauaacaucagcuaacgucuugccuauugugcaaaucaauggaaacgccgcacaguuuggcgaaguauacgagcucaaagaggacauugguguugggagcuauaguguguguaagcggugcauccacgccacuaccaauauggaguucgcugucaagaucauugauaaaucuaagcgugaccccuccgaagaaauagagauccugaugcgcuacggccagcacccaaacauuaucacauuaaaagacguguuugaugacggaagauaugucuaccuggugaccgaucuaaugaagggcggggaacuccuggacaggauacuuaaacaaaaguguuucagcgagcgggaggcgucggauauuuuguauguuaucucuaagacgguggacuaccugcauugccagggaguaguccaccgagaucucaaaccuuccaauauccuguacauggacgaaucagcaagugccgauagcauucgcaucugugacuucgguuuugcuaagcagcuuagaggcgagaacgggcuguugcucacucccugcuauacagccaacuucguggcaccagaaguucugaugcagcaaggauacgaugccgcuugugacauuugguccuuaggcgugcuguuuuauaccaugcuagccgguuacacucccuucgcaaaugggccuaacgauacaccagaggaaauacuccugaggaucggcaauggaaaauuuucucuuagcggcgggaacugggacaauauuucagacggagcgaaggauuugcugagucauaugcuccacauggacccgcaucagcgguauaccgcugagcagauccugaaacacuccuggaucacgcaccgcgaucaguuacccaacgaccaaccuaagagaaaugaugucagccaugugguaaaaggugccaugguggcaaccuacucugcccugacacacaagacuuuccagccaguucuugagcccgucgcugccucaaguuuggcacagaggcguagcaugaagaaacggaccuccacaggccucuga

SEQ ID NO: 62038 - RNA, 1509 nt, Artificial Sequence
  derived and/or modified sequence opt3 from RPS6KB1__Homo_sapiens__NP_001258971
augagaaggcggcgccgacgugacggcuucuaccccgccccugauuuuagagacagggaggcugaagauauggcagggguguucgacaucgaucuggaccagccagaggaugccggaagcgaagacgagcucgaagaggguggccaacuuaacgaguccauggaucacgggggagucggcccguaugaacuggguauggagcauugcgaaaaguuugagauuucugagaccucaguuaaucgggggcccgagaaaauacgcccugaauguuucgaauuguuaagagugcugggaaagggcggcuacgggaaagcgaugaucguaaggaacgcuaaggacacagcccacacuaaagcagagcggaauauucuagaagaggugaagcauccauuuaucgucgaucucauuuaugccuuccagacgggagguaagcuguaccuuauccuggaguauuugaguggcggggaacucuuuaugcagcuggagcgcgaaggaauauucauggaggacaccgcuugcuuuuaccuggcagaaaucagcauggcccucggccacuuacaucagaaagguauuaucuaucgagaucugaagcccgagaacauuaugcuuaaucaccaagggcacgugaaauugacagacuucggacuguguaaggaguccauccaugacggcacuguuacccacacauuuugcggcaccauagaauacauggcuccugagauucuaaugagaucugggcauaacagggccguggauugguggucgcucggagcgcugauguacgacaugcuuacuggugcaccacccuucacaggcgaaaaucggaaaaagaccaucgauaagauucugaaauguaaguugaaccucccuccauaucugacgcaggaggcccgugacuuacugaaaaagcuccuuaaacgcaaugcugccucaagacugggggcaggaccgggcgaugcuggugaaguccaggcccaccccuuuuucaggcacaucaacugggaggaguugcuagcgcggaagguggaaccuccauucaaaccccugcuccagagcgaggaagacguaagucaauuugauuccaaguucacucgacagaccccuguugacucuccagaugacagcacacuguccgagucagccaaucagguguuucuuggguucacuuacgucgcacccagugugcuggagagcgugaaggaaaaauuuucuuucgagccgaagauccgcuccccuagaagguuuauuggcucaccccggaccccagucagcccuguuaaauucagucccggagauuuuuggggccgcggggcuucugccuccacagcuaacccacagacccccguggaauauccuauggagacgagcggaauagaacaaauggacguaacuaugucgggugaggccucugcaccauugccgaucagacagcccaauuccggcccuuacaagaaacaggccuucccaaugauuucaaagaggcccgagcaucuccguaugaaccuguga

SEQ ID NO: 62039 - RNA, 1449 nt, Artificial Sequence
  derived and/or modified sequence opt3 from RPS6KB2__Homo_sapiens__NP_003943
auggccgcuguguucgaccuggaucucgagaccgaagagggcagcgaaggggagggagaacccgagcuuuccccugcagacgccugcccacuggcggaguugagagcugccgguuuagaaccggucggccacuacgaggaaguugagcugacagagacuucugugaacguagggcccgaaaggaucggaccucauuguuuugagcuacuccgggugcugggcaaggguggguauggaaaagucuuccaggugcgcaagguucaaggcacgaaucuuggcaaaauuuacgcaaugaaggugcugcgaaaagccaagauaguccguaacgcuaaggauaccgcacacacaagagccgaaaggaauaucuuggagucagugaaacauccauuuauuguagaacucgcuuaugccuuccagacugggggaaagcuguaccugauccucgagugcuuaagugguggcgagcuguuuacccaccuugaacgggaggggauuuucuuggaagacacagcguguuuuuaucuggcagagaucacccuagcccucggacaucugcacagccagggcauaaucuaccgcgaucuuaaacccgaaaacauuaugcuguccucucagggucacaucaaguugacugacuucgggcucugcaaagagucgauucaugagggagcuguuacacacaccuuuuguggcacgaucgaauauauggccccugagauacuggugagaucaggccauaauagggcagucgauugguggagcuuaggggcucugauguacgacaugcucacuggaaguccacccuucaccgccgaaaaccggaagaagacaauggauaaaauuauccgcgguaaacuugcgcugccuccauacuugacuccggacgcccgagaucuagugaagaaguuucugaaaagaaaucccucccaaaggauuggcgggggaccuggcgacgcagcugaugugcagcggcacccauucuuucgucacaugaacugggacgaccuccuggccuggcgcgucgaucccccuuucagaccaugccuucagucugaggaagacguuagccaguucgauaccagguuuacacggcaaacccccguggacuccccggaugacacggcucugucagagagugccaaucaggcauucuuggguuuuacuuauguagccccuagcgugcucgauucuaucaaggagggguucuccuuucagcccaaacugcgaucaccacgcagauuaaacagcaguccuagggcucccgucucuccacugaaguucucccccuuugaaggcuuccggccuagcccaucgcuaccggagcccacagaacucccucugccaccccuuuugccuccacccccgccuucuaccacugcgccacugcccauccgcccucccuccggaacaaagaaaucaaagagaggcagggggcguccaggacgguga

SEQ ID NO: 62040 - RNA, 585 nt, Artificial Sequence
  derived and/or modified sequence opt3 from RPS9__Homo_sapiens__XP_006726028
augcccguggccagaagcugggucugcaggaagaccuacguuacaccucggcgcccauucgagaaaucccgacuggaccaggaacucaaacuuaucggcgaguaugggcugcguaacaaaagagaaguguggaggguaaaguuuacuuuggcuaaaauucggaaggcagcccgcgaguuacugacgcuagaugaaaaggacccgagaaggcuguucgagggaaaugcgcuccuucggcgccuggugcgaauaggugucuuggaugagggcaaaaugaagcucgacuacauccuggggcugaaaauugaagauuuucucgagagaagguuacaaacccagguguucaagcugggacuugcuaaaucuauccaccaugcccggguuuugauucgucagcgccacaucagagugaggaagcaggucgugaacauacccucauuuaucguacggcuggacagucaaaagcauauugauuucagccuacgauccccuuauggcggugggcgcccaggaagaguuaaaaggaagaaugcaaagaagggccagggcggggccggagcuggugacgaugaagaggaggacuga

SEQ ID NO: 62041 - RNA, 888 nt, Artificial Sequence
  derived and/or modified sequence opt3 from RPSA__Homo_sapiens__NP_002286
augagcggcgcccuggacgugcuccagaugaaggaggaagauguccuuaaauuccuggcugcagggacccacuugggagguacaaacuuagacuuucaaauggagcaguacaucuauaagagaaaauccgauggcauuuacauaaucaaucugaagaggacuugggaaaaacuacuccuggccgcgcgggcuauuguugccaucgagaaccccgcagacgugucuguaauuucaagucgcaauacggggcagcgagccgugcuuaaguucgcugcagccaccggagcuacaccuaucgccggccguuuuacuccagguaccuucacaaaccagauacaagcggcauuuagagaaccgaggcuguuggucgugaccgauccccgggccgaccaucagccucucacugaggcuagcuauguuaaucugccaacaaucgcccugugcaacaccgauucuccccuccgcuacguggacauugcaaucccuuguaauaacaagggggcucacuccgucggauuaaugugguggaugcuggccagagaggugcuuaggaugcggggcacgauuucgcgcgaacauccaugggagguaaugcccgauuuguauuucuaccgagacccugaagagaucgagaaagaggaacaggcggccgcagaaaaggcuguuacuaaagaggaauuucagggcgaguggaccgccccagcuccggaguucacagccacucaacccgaaguggcagauuggucagaggggguccaggugccuagcgugccaauacagcaguuucccaccgaagacuggagugcccaaccugcuacagaggauugguccgcggcaccaaccgcccaggcuacggaaugggucggagccacuacagacuggucuuga

SEQ ID NO: 62042 - RNA, 3534 nt, Artificial Sequence
  derived and/or modified sequence opt3 from RPTOR__Homo_sapiens__NP_001156506
auggagagcgaaaugcugcagucuccccuccuuggccugggggaggaagacgaggccgauuugaccgacuggaacuuaccucuggcuuucaugaagaaaagacacugcgaaaagaucgagggauccaaaucacuagcacaaaguuggaggaugaaggaucggaugaaaacagugagcgucgcccucguucugugucuuaauguggguguagacccaccggauguggucaagacuacgcccugcgcgcgccuggaguguuggauugacccuuuguccaugggcccacagaaggcucucgaaaccauaggggccaaccugcagaaacaguacgagaauuggcaaccccgagcacguuauaagcagucucuggauccuacaguggacgaaguuaaaaagcucugcacuucguuaagaaggaacgccaaagaggagcgggugcuguuucauuacaauggacacggcgucccacgccccaccgugaacggugaaguauggguuuucaauaagaacuauacacaguacaucccucuuucaauuuaugauuugcagaccuggauggggagcccaaguaucuuuguguacgacuguuccaaugcuggacugauugucaagucuuucaaacaauuugcacuacagagagagcaggaacucgagguggccgcuaucaacccgaaucauccccuggcccagaugccucuuccacccagcaugaagaacugcauacaacuggcggcaugugaagccacugaguugcucccuaugaucccagaucugcccgcugacuuauucacauccugccugaccacgccgauuaaaaucgcccucaggugguuuuguaugcagaagugcgugucacuugucccuggcguuacucuggauuugauugagaaaauccccggccggcuaaaugaccgccgaaccccacugggggaacucaacuggauauucacagcaauuacugacaccaucgcuuggaaugugcugccuagagaucuuuuucagaagcuguucaggcaagacuugcucguagccagucuguuucggaacuucuuacuggcggagcguauuaugcgcagcuauaacuguacacccgugucuuccccaagacuacccccuaccuacaugcacgccauguggcaggcaugggaucucgcugucgacaucugccugucacagcuuccaacgaucauugaagagggaacugccuuuaggcauagcccguucuucgcugaacaguugacagccuuucaaguguggcugaccauggguguugagaaucggaaucccccugagcagcucccaauagugcugcagguccuucugagucaggugcaccgauugcgcgcacucgaucuguuaggcagauuccuggaccuagggcccugggccguaucucucgcucuguccguuggaaucuuuccuuacgugcuuaaauugcugcaaagcucggcgagggaacuccggccacuguuagucuucauuugggcaaagauccuggccguggauucugagcuugucguggcuuugucccaccucguugugcaguaugaaucaaacuuuugcacuguagcccugcaguucauagaggaagagaagaacuacgcacuacccaguccggccacaaccgagggcgguagccugacgccuguccgcgacuccccauguacccccagacucaggucugugagcucauaugggaauauucgugcuguugccacagcacggagucugaacaaaucccuucagaauuugagccugacugaagagucuggaggcgcgguggcuuuuucaccuggcaacuuaaguaccagcuccucugccucgagcacacucgggucccccgaaaaugaggagcauauccugucauucgaaacuaucgauaagaugagacgagcaaguucuuacagcucccuuaacucacugauuggagucagcuuuaauucuguguauacccaaaucuggaggguauugcuccaccuggccgcugacccauacccugagguguccgauguugccaugaaaguccuaaacaguauugcauauaaggcuacagugaaugcccgcccccagcgggugcuggacaccagcucucucacucaguccgcgccagccucaccgacgaacaaagguguccauauacaccaggcuggcgggaguccucccgcaagcucgacauccucuagcucacugaccaaugacguugccaagcaaccagugaguagagaucuucccuccggaaggccuggcacuaccgguccagcuggggcccaguacacaccccacucucaucaguucccucgcacccgaaagauguuugacaaaggcccggaacaaacugcagaugacgcggaugacgccgcuggacacaagagcuucaucuccgccacagugcagacgggcuuuugcgauuggucagcacgguacuucgcucagccaguaaugaaaauucccgaggaacaugacuuggagagccagauccguaaggagagagaauggagguuccugcgcaacagucgggucagaaggcaagcccaacaggugauccagaaagggauuacccgauuagaugaccagauauuucucaaccgcaauccuggaguuccaucuguggucaaguuccaccccuuuacuccuuguaucgcaguggccgauaaggacuccauuugcuucugggauugggagaaaggugaaaagcuggacuauuuucauaacggcaauccgcgguacacaagaguuaccgcuauggaguaucuuaacgggcaggacuguagccugcuacucacagcgacugaugacggagccaucaggguguggaaaaauuucgcagaucuggaaaagaaccccgagaugguaaccgcuuggcagggcuugucggacaugcugccaacgacccguggugccgggauggucguggauugggagcaggaaacaggcuuacucaugucaucuggagacgugcgcauuguccggaucugggauacugacagagagaugaaaguucaagauauaccuaccggcgccgacaguugcgugacaucccugagcugugauucucacaggagccuuaucguagcugggcugggagacgguuccauucgaguguacgaucggcgcauggcauugucagaaugcagagucaugacuuauagggagcacaccgccugggugguuaaggcgagucuccagaagcggcccgacggccauaucgugagcgucucugugaauggggacguucgaauuuuugauccaagaaugccugaauccgugaacguccugcagaucguaaaaggacuaacggcucuggacauacacccccaagccgaucuuauugcauguggcucagugaaucaguucacagccaucuacaacaguagcggugagcucauuaauaacaucaaguauuacgacggguuuaugggccagcgcguuggagcuauauccugccuggcauuccauccacacuggccgcacuuggccgugggcucuaaugauuacuauaucucggucuacagcguggagaaaaggguacguuga

SEQ ID NO: 62043 - RNA, 996 nt, Artificial Sequence
  derived and/or modified sequence opt3 from RQCD1__Homo_sapiens__NP_001258563
augcacagccucgccaccgcugcacccgugccuacaacucucgcccaggucgacagagagaagaucuaccaauggauuaacgaacuuuccucuccagagacgagggaaaaugcgcuguuggaguuaaguaaaaagcgggaaaguguuccggaucuggcucccaugcuauggcauagcuucggaaccauagccgcacuccugcaggagaucgugaacauuuauccuuccaucaauccacccacacuuacugcccaccagucuaaccgcguaugcaaugcucuggcauugcuccaguguguggccucgcauccugagacccgaucagcuuuucuggccgcgcacauuccacuguuccucuaccccuuuuuacauacagucagcaaaacccguccuuucgaauaucugagacuuacuucauugggggugaucguugagacaggauuucaccacgugggucaagcagaccuggaacuaccaaccuccucugaucucccggccagcgcuucccagucagccggcauaacgggggcacuggucaagacugacgagcaggaggugaucaacuuccuucugaccacagaaauuauccccuugugccucaggauuauggagaguggaagcgaacugucuaaaacuguagcuaccuuuaucuuacagaagauacugcucgaugacacaggccuugccuacauuugucaaaccuaugagcgguucucccauguugcgaugauccuggguaagaugguguugcagcuaucaaaagaaccuagcgcccgccugcucaagcacgucgugagaugcuaccugaggcuuagugauaauccacgggcacgcgaggcucugcgacaguguuugcccgaccagcucaaagauacgacuuuugcccaagugcugaaggacgauacaaccacuaaaagaugguuagcucagcuggucaagaaccuacaggaggggcaaguuacagacccuaggggcauuccacugcccccgcaguga

SEQ ID NO: 62044 - RNA, 927 nt, Artificial Sequence
  derived and/or modified sequence opt3 from RRAD__Homo_sapiens__NP_001122322
augacccugaacggcgggggaagcggugccggcggguccagaggaggcggucaggagagggaacggcgccgagggucuacacccuggggaccugcuccaccgcuccaccguagaucaaugcccguggacgagagggaucuucaagcagcccugacuccuggcgcguugacggcugccgcagccggcaccgggacacagggaccacgguuagacuggcccgaagauagugaggacagccuguccucugguggcucggauucagacgaaagcgucuacaagguucuacuccugggggcuccuggagugggcaaaagugcacuugcccgcaucuucggugggguagaggauggaccagaggcugaagccgcgggccauacuuaugacagauccauuguggucgauggcgaggaagcaucucugaugguguacgacauaugggagcaggaugggggaaggugguugcccggucacugcauggccaugggcgacgcuuauguuaucguguacagcgucaccgauaagggguccuuugagaaagccucagaacuccgggugcagcugcgccgagcaagacaaacagacgacguaccuauuauccugguuggaaauaagagugaucucgugaggagccgggaggucucuguggacgaaggccgugcuugugccguggucuucgauugcaaauuuauugagaccuccgcggccuuacaucacaacguucaggcacuguucgaaggugugguacgccagaucagacuuaggcgggacucaaaggaggcuaaugcccgacgccaggcugggacuagaaggcgggagagcuugggcaagaaagccaagcgcuuucugggaagaauaguggcaaggaacagucguaaaauggccuuccgggcuaagucuaaauccugucaugaucuaagcguccucuga

SEQ ID NO: 62045 - RNA, 942 nt, Artificial Sequence
  derived and/or modified sequence opt3 from RRAGA__Homo_sapiens__NP_006561
augcccaacaccgccaugaagaaaaaggugcugcucaugggcaaaagcggguccggaaagacaucuaugagaucaaucauuuucgcuaauuacauagcaagggacacucggcgccuuggugccacgaucgaugucgagcacagucauguucgauuucugggcaacuugguguuaaaucugugggacugcgggggacaggauaccuucauggaaaacuauuuuacaagccaacgugacaauauuuucagaaacguagaggugcuaaucuacgucuuugauguggaauccagggagcucgaaaaagacaugcacuauuaccagucuugucuggaggcgauucuucaaaauucgccugaugcuaagaucuucugccugguucauaagauggacuuggugcaggaggaucagcgggaccucauauuuaaagaacgcgaggaagaucugagaaggcugucacggccacucgagugugccugcuuccgcacuagcaucugggacgagaccuuauauaaggcauggaguuccauugucuaccagcugaucccgaacgugcagcagcuugaaaugaauuugcgaaacuuugcccaaauuaucgaggcugaugaaguacugcuauucgagagagcaacauuucucguuauaucucacuaucaguguaaagaacagagggacgugcaucgguucgagaagauuagcaauaucauuaaacaguuuaagcuguccugcucaaaacuugccgcuaguuuccaaagcauggagguccguaacucuaauuucgccgcguuuaucgacaucuucaccuccaacacuuacgugaugguggucaugucagaucccagcauuccuagugcagccacacugauaaauauccgcaacgcuagaaagcacuuugaaaaguuggagaggguugacggcccaaaacacucucuccugaugcgguga

SEQ ID NO: 62046 - RNA, 384 nt, Artificial Sequence
  derived and/or modified sequence opt3 from RRAS2__Homo_sapiens__NP_001096139
augagagagcaguacaugaggaccggcgaaggguuccugcucguguuuagcgucacagaccggggauccuucgaggaaauuuauaaguuucaacgccagauucuucgaguuaaagaucgugacgaguuccccaugauacugaucgguaacaaggccgauuuggaccaccagagacaggugacucaagaagagggccagcaguuagcuaggcagcugaaaguaacguacauggaggcaucugccaagauucggaugaauguggaucaagcguuucaugagcuaguccgcgugaucagaaaauuccaggaacaggaaugcccuccaucaccggagcccaccaggaaggagaaggacaaaaaggggugucacugcguuaucuuuuga

SEQ ID NO: 62047 - RNA, 657 nt, Artificial Sequence
  derived and/or modified sequence opt3 from RRAS__Homo_sapiens__NP_006261
augagcuccggcgccgcuucugggaccggaagagguaggccccggggcgggggaccuggcccaggugacccgcccccuucagagacacacaagcugguggucguugggggaggcggcguggggaaaagugcacucacuauccaguucauucaaagcuacuuuguauccgauuaugacccaacgauagaagauucuuacaccaagaucugcucgguggacgguauucccgcccgccuugauauccuggacacagcgggacaggaggaguucggcgcuaugcgagaacaguauaugcgugccgggcauggauuuuuguuagucuucgcaauuaacgauagacagucauuuaaugaagugggcaaacuguucacucaaauccuaaggguuaaggaccgggaugacuuuccugugguccucguggguaacaaagccgaucuggagagccagcgccagguaccaagaagugaggcuuccgcauucggggccucucaccauguugcuuacuuugaagccagcgcgaaacuuaggcugaauguggacgaggcauucgaacaguugguccgggccgugcgcaaguaucaagagcaggagcugcccccuuccccaccgucagcuccccgaaagaagggaggcggcuguccuugcgugcuccuguga

SEQ ID NO: 62048 - RNA, 2934 nt, Artificial Sequence
  derived and/or modified sequence opt3 from RRBP1__Homo_sapiens__NP_001036041
auggacaucuacgauacccagacacugggcguggucguuuucgggggauuuauggugguaagcgccauugguauauuccucguguccacuuuuucuaugaaggagacgucauaugaagaggcucuugcaaaccaaagaaaagaaauggccaagacccaccaucagaaagucgagaagaaaaagaaggagaaaacaguggagaagaaaggcaagacuaaaaagaaggaggaaaaacccaaugggaagaucccugaccacgauccagcgccgaacguuaccgugcuguugagggagcccguccgggcuccugccguggcaguagccccaacacccguucagccuccaauuaucguggcucccgucgcaaccgugccugccaugccacaggaaaaauuagcuaguagcccgaaggacaaaaagaaaaaggagaagaaaguggccaaggucgagcccgcgguuuccucugugguaaauucgauucaagugcugacuucaaaagcagccauccuagaaacagcuccuaaggagggacgcaacaccgaugucgcccagagcccagaagcacccaaacaggaggcuccugccaagaagaaaaguggcuccaagaaaaaggguccacccgacgcggaugggccgcucuaccugccuuauaaaacgcuugugucuacuguuggaagcaugguguucaaugaaggcgaggcccagcgacugauagagaucuuguccgaaaaggcaggcauuauccaagacaccuggcauaaggcuacacagaaaggggaucccgucgccauucucaagcgucagcuggaggaaaaagagaagcugcucgcuacugaacaggaggacgccgcaguggccaaaucaaaguuaagagagcugaacaaggaaauggcugcggagaaagcaaaggccgcugccggagaagcaaaaguaaagaaacaacuuguugccagggagcaggaaaucaccgcugugcaggcccggaugcaagcaaguuaccgcgagcacgucaaggaggugcagcaguugcaggguaaaauaagaacacugcaagaacagcuagagaauggcccaaacacccagcucgcgaggcugcagcaagaaaauagcauucuucgggaugcucugaaccaggccacgucucaggucgaguccaagcagaaugcagaguuggccaagcuccgccaagaacugucaaaagugagcaaggaguuaguugagaaaagugaagcugugcgacaggacgaacagcagagaaaggcccuggaggcaaaagcugccgcguuugagaagcaaguacuccagcuucaggccucucauagggaauccgaggaagcucugcaaaagcgguuggaugaggucagccgugaacuaugccacacucagucgucucacgcaucccugcgcgccgacgcugagaaagcccaggagcagcaacagcagauggcagaacuccauucaaagcugcagaguagcgaggcggaagugagauccaaaugugaggaacuuucugggcugcacggacaauugcaggaggccagggcugagaacagccagcucacagaacggauccgaucaauugaggcccuguuagaagcaggccaggcucgcgacgcccaagauguucaggcaagucaggccgaggcugaccaacagcagaccagacugaaggagcuagaaucccaggugagcggucucgagaaagaagcgaucgagcugagggaagccgucgagcaacagaaggugaagaauaacgaucuucgggagaaaaauuggaaggcaauggaagcauuggccacugccgagcaggcuugcaaagaaaagcugcauucucucacacaggcaaaagaggaaucagagaagcaacugugucuuaucgaggcccagaccauggaagcgcuguuggcucuccugccugaguuaaguguacuggcccagcagaacuauacggaauggcuacaagaccucaaggagaaagggcccacccugcuuaagcacccacccgcuccugccgaaccaagcuccgauuuggcuucuaaacugcgcgaggcagaggaaacacagucgacucuccaggccgagugcgaccaguacagaagcauucuggcggaaaccgagggaauguuaagggaucugcaaaaguccguggaggaagaggaacagguuuggcgugcuaaagucggcgccgcagaggaagaacuucagaagucacgggugacagugaaacacuuggaggaaauagucgagaagcucaagggcgaacuggagaguucugaccaaguucgagaacauacuagccaccuagaggccgagcuggaaaaacauauggcugccgcauccgcugagugucagaacuaugccaaggaaguggcggggcucagacagcugcuuuuggagucacagagccaacuggaugccgcaaaaucugaagcucagaagcaguccgacgaguuagcccucgugaggcagcaacugagugagaugaaaagccacguagaagauggagacaucgcuggugcaccggccucuucccccgaggccccuccagcugaacaggaccccguccagcuuaagacccagcuggaguggacagaggcgauuuuggaagaugagcaaacccagcgccagaagcucacugcagaguucgaagaagcccaaacgucagcuugccggcugcaggaggagcuagaaaaacugagaacagccggcccucucgagaguagcgaaaccgaggaagcaucgcagcugaaggagaggcuugagaaagaaaagaaauugacuuccgaccuggggcgcgccgcuacccgauuacaggagcuccugaagacaacccaagaacagcuugcgcgggagaaggauacugugaaaaagcugcaggaacagcuagagaaagccgaggacggaucuagcucaaaggaaggcacaaguguuuga

SEQ ID NO: 62049 - RNA, 4431 nt, Artificial Sequence
  derived and/or modified sequence opt3 from RREB1__Homo_sapiens__NP_001003700
augaccagcuccucucccgccggccuggaggggucagaccucaguagcaucaacacaaugauguccgcugugaugucugucggaaagguuacugaaaaugguggcucgccucaggggauuaaaucaccaagcaagccgcccggaccuaacagaauaggcaggcggaaucaagagacgaaagaagagaagaguuccuacaacugcccacuuugugagaaaaucugcaccacacagcaccagcugacuaugcauauucgccagcacaauaccgauacagguggggcagaccauucuuguagcaucugcggaaaguccuugucaagugccagcucuuuagaucgacacaugcuggugcauuccggcgagcgucccuauaaguguaccguaugcggccaaucauucacuacaaacgggaauaugcacagacacaugaaaauucaugagaaggacccuaacagcgcgaccgcuacggccccacccaguccucuaaaaaggcggcgccucucuuccaagagaaaacugagccacgaugcagaaucggagagggaagacccagccccggcuaagaagaugguggaggauggacagucuggugaccuugagaaaaaggcagaugaagucuuucauugucccgugugcuucaaagaguuuguuuguaaguacggccuggaaacucacauggagacccacuccgacaauccuuugcggugcgauaucuguugcgugacauuccgcacucaucgagggcuccugagacacaacgcccugguccauaaacagcucccaagggacgcuaugggacggcccuuuauacagaauaacccuucaaucccagccggcuuccacgauuuagguuuuaccgacuucaguugccguaaguuuccccgcauuagccaagcguggugugaaacaaaucugagaaggugcaucuccgagcagcaucgguucgugugugacacuugcgauaaagcauuuccgaugcuuuguucuuuggcccugcacaagcagacgcacguagcugccgaccaggggcaagagaagccucaggcaacuccccuaccaggagaugcucucgaccagaaaggcuuccuggcccuucugggcuugcaacauacaaaggauguucgaccugcgcccgccgaagaaccacuccccgacgauaaccaggcaauucagcugcagaccuuaaaaugccaacugccucaggacccaggguguacuaaucuccuuagccugucaccguuugaagcugccaguuugggagguucccuaacagugcugcccgcuaccaaggauagcaucaaacaccucucucugcagccuuuccagaagggcuucauaauucaaccagacucaaguaucgucgugaagcccauuagcggggaguccgccaucgaacuugcagauauccagcagauucugaaaauggccgcuucugcgccuccacagauaucguugcccccguuuagcaaggccccugcagcuccacuccaagccaucuucaaacauaugcccccucugaagcccaaaccauuagugacgccucgcaccgucguugcaacauccacucccccaccgcugauuaacgcccagcaggcuucaccuggaugcaucagucccucucuaccacccccuccacucaagcugcuuaagggcagcguggaggccgcauccaacgcgcacuugcugcagucaaaaagcgguacccaaccccacgcugccacaagacucucucugcagcagccuagggcagagcuuccggggcaaccagaaaugaagacucagcuggagcaggacuccauaauugaagccuugcucccccugaguauggaggcuaaaaucaagcaggaaaucaccgagggcgaguuaaaagccuuuaugacagcaccuggaggcaagaagaccccagcuaugcggaaaguacuguaucccugucgcuucugcaaucaaguguuugccuucagcgggguccuaagagcgcaugugaggucucaccucggaauuuccccuuaccaguguaacaucugcgacuauauugccgcugauaaggcagcccugauacgucaucuucggacucacucaggugaacgaccguacaucugcaaaauuugucauuaucccuuuacgguuaaggcuaauugcgagagacacuugaggaaaaagcaccugaaagccacacgcaaggacaucgaaaagaacaucgaguacgugaguagcucggcagcggagcucgucgaugccuucugugcuccagacaccgugugccggcuguguggcgaagauuuaaaacauuacagagcccugaggauucacaugcgcacucauugcgggcgaggacuuggcggugggcacaagggccggaaaccuuuugaguguaaggaaugcuccgcagcuuucgccgcaaaacguaauuguauacaucacaucuugaagcagcaccuccauguacccgagcaggacauugaaucuuauguucuggccgcugauggacuaggcccagcggaggccccugcagcugaggccagcgggagaggagaagacucagguugcgccgcucugggcgauuguaagccccucaccgcauuucuggagccacaaaacggguuccuucacaggggaccgacacagccucccccaccccaugugaguaucaaauuggaaccugccuccucuuuugcggucgacuucaaugagccacuggauuucagccagaagggcuuagcucucgugcaggucaaacaagaaaacauuuccuuucugucacccagcagucuugugccuuacgacugcucuauggagccgaucgaucuguccauaccaaagaauuuccgcaaaggugacaaggacuuggccacccccagcgaggcaaagaaaccugaagaggaagccgggucgucagagcagcccucuccaugcccugcucccggcccaagucucccuguuacucugggaccguccggcauccuagaaagccccauggcaccagccccugcggcuacacccgagcccccugcccagccccugcaagggccggugcagcucgcaguaccaauuuauucuagcgcccuggucuccucaccuccccuugugggaaguagcgcuuugcugucuggcacggccuuacuccggccacugagacccaagccuccgcuucugcuacccaaaccaccuguuaccgaggaacucccaccucuggcauccaucgcucagauuaucucaagugugagcuccgccccaacuuugcugaagacaaaagucgcggaucccgguccugccucuaccgggucgaacacaacugcaagcgacucauuaggaggcuccgugccaaaggcugccaccacggcuacccccgcagccacaaccaguccgaaggagucuagcgaaccuccagcccccgcuuccucaccugaggcggcaucuccaaccgagcagggucccgccggcacaagcaaaaagagggggcgaaaacgcggaaugcggaguagaccgagggcuaauuccggcgggguagaucucgacagcucuggagaauuugccucaauagagaagaugcuggcaacuaccgauacgaacaaauucuccccuuuucuucaaacagccgaagacaauacccaggaugagguggcuggcgcgcccgccgaccaccacgguccaagugaugaagaacaggggagcccucccgaggacaagcuguugcgugcaaaacgcaacucguacacuaauugucuccagaagauuacaugcccacauuguccccggguuuucccuugggcuucuucccugcaaagacacaugcuaacccauacuggacagaagccauuuccgugccagaaaugugaugccuucuuuagcaccaagucaaacugcgaaaggcaccagcugcgaaaacauggcgucacaacguguagucuucggcgcaacggucucaucccccaaucuaaggaguccgacgugggcagccacgauucaaccggggaaagaccuuauaaaugccagacuugugagaggacauucacccugaagcacaguuuggugcggcaucagcgaauccaccagaaggcaagacaugccaaacaccacggaaaggacagcgacaaagaggagcgcggcgaggaagauuccgagaaugaaucuacacauagcgggaacaaugcugucuccgagaacgaagccgagcuggcgccaaaugcaucaaaccacauggccguuacuaggucucguaaggagggauuagcuagugccaccaaagacugcucgcaucgggaagagaaggugacggcuggcuggcccagcgaaccuggucaaggggaucucaauccagagucccccgcagcccugggacaggaccuucuggagccuagaucuaagaggccggcucacccaauuuuggccacagcagauggcgcgucacagcucguggguauggaauga

SEQ ID NO: 62050 - RNA, 1014 nt, Artificial Sequence
  derived and/or modified sequence opt3 from RRH__Homo_sapiens__NP_006574
augcugagaaacaaucucggcaacagcuccgacucuaagaaugaggaugggucaguguucagucagaccgaacacaacaucgucgccacauaccuuauuauggcuggaaugauaagcaucauuuccaauaucauuguucuggguaucuuuauaaaauauaaggaguugaggacucccacgaacgcaaucauuaucaauuuagccgugaccgacauuggcguaucuucgaucggguacccuaugucagcggcuagcgaucuguauggaaguuggaaauucggcuacgccgguugccaaguguaugcagggcuaaacauauuuuucggaauggccuccauuggccuccugacagucguggcuguugaccgguaccuuacuaucugucugccagaugugggccgccgaaugaccacaaauaccuauauuggguugauccucggagcauggaucaacggucuguuuugggcccugaugccgauuauaggcugggcuucuuacgcccccgacccuacuggggcgacaugcaccaucaauuggcguaagaacgauaggagcuucgucuccuacacgaugacugugauugcaaucaauuuuauaguaccacucaccguuauguucuauuguuacuaucaugugacauuaucaauuaaacaccauacuaccagugacugcacagaaagccugaacagagauuggucugaccagaucgaugucaccaagauguccgugaucaugauuuguauguuucuuguggccuggucacccuacagcaucgucugcuugugggcuaguuucggagacccuaagaaaauuccacccccuauggccauaaucgcaccacuguuugcuaagucuuccacguucuauaauccguguauuuacguuguggccaacaaaaaguuucggcgcgcgaugcuagccauguucaaaugccagacucaccagacaaugcccguaaccagcauccucccuauggaugugucgcaaaacccacuggcaucuggcagaaucuga

SEQ ID NO: 62051 - RNA, 2379 nt, Artificial Sequence
  derived and/or modified sequence opt3 from RRM1__Homo_sapiens__NP_001024
augcacgugaucaagagagacggcaggcaggagcgggucauguucgauaaaauuaccagccgcauacaaaagcugugcuacgggcucaacauggacuuuguugaucccgcccagaucacaaugaaagugauucagggacuuuauuccgguguaacuacgguggaacuggacaccuuggcugcagagacagccgcgacuuuaaccacaaagcauccugauuacgcuauccuggccgcacgaauugccgucucuaaucuacacaaagaaaccaagaagguguucucagacguuauggaggaucucuauaacuacaucaauccacauaacggcaaacacaguccgaugguggcuaagagcacucuggacauaguccuugcaaauaaagaucgucugaacuccgccaucauuuaugacagagauuuuucuuacaauuauuucggguuuaagacauuggaaaggucguaccuccugaaaaucaacggaaagguggcugagcggccccagcauaugcugaugcgcguaucaguuggcauucacaaggaggacaucgaugccgcgauagaaaccuacaaucucuuaagcgagagaugguucacgcacgcaaguccuacucuguuuaacgccgguaccaauaggccacaacuuuccucuuguuucuugcugagcaugaaagacgacuccauugaagggaucuaugauacacuaaagcagugcgcucucauuucaaaaagugccggaggcaucggcguggcagucagcuguauccgggcuacugggucuuacauugccggaaccaacgguaauuccaacggccuggugcccaugcuucgcguguauaauaacacagcgcgauacgucgaccaagggggaaacaagagaccuggcgccuuugcaauauaucuggagccauggcauuuggauaucuucgaguuucucgaccugaaaaagaauaccgguaaagaggaacagagggcucgggauuuauucuuugcccuguggauucccgaccucuucaugaagcguguugaaacgaaccaggauuggucacuuaugugcccuaaugaguguccagggcuggacgaaguguggggagaggaguucgaaaaguuguacgcuagcuaugagaaacagggccgcguaagaaagguggucaaagcccagcagcuaugguacgcaaucauagaaagucaaacugagacaggcaccccguacaugcuguauaaggauucuugcaacaggaaauccaaucagcagaaccucgggacuauuaaguguagcaaucugugcacagaaaucguggaguacaccucgaaggacgagguugccguguguaaccuugcuucucuggcguugaauauguaugucacguccgaacacaccuacgauuuuaaaaagcucgcagaggugacaaaaguaguugugcggaaccugaauaagaucauugacaucaacuauuaccccgucccugaagccugcuuaucaaauaaacgacaucgcccaauuggaauaggugugcaaggccuggcugacgccuucauccuaaugagauaucccuuugagagugcagaagcccagcuccugaacaagcagauuuucgagacuaucuacuacggggcucuugaggccagcugugauuuggcaaaggaacagggaccuuaugagaccuacgaaggcuccccagucucuaaagguauccugcaauaugacauguggaaugugacacccacugaucucugggacuggaagguucugaaagagaagauugcgaaauacgggauaaggaacagccuucugaucgcuccgaugccuaccgccucaacagcacagauuuugggcaacaaugagaguaucgaacccuauaccuccaacauuuacacucggcgcgugcucagcggagaguuucagaucguaaauccacaccuguuaaaggaucugacggaaagaggccuauggcacgaggaaaugaagaaccagauaaucgccugcaaugggucuauucaaucaaucccugagauucccgacgaucucaaacagcuguauaagacagucugggagaucagucagaaaaccgugcuuaagauggcugccgaaaggggagcauucauagaccagagccaauccuugaacauucauaucgcugagccaaauuacgguaaacugacuucuaugcacuuuuacggcuggaagcaggggcucaaaaccggaauguauuaccugcguacacggcccgccgcgaacccuauucaguucaccuuaaauaaggaaaagcugaaagauaaggagaaaguuucgaaggaagaggaggaaaaagagcgaaacacugccgcuauggugugcagccuugaaaauagagacgaguguuugaugugcggcuccuga

SEQ ID NO: 62052 - RNA, 1272 nt, Artificial Sequence
  derived and/or modified sequence opt3 from RRM2B__Homo_sapiens__NP_001165948
augcugcuccuuagacugcccccucacaggagccaugccuccccauuggacugcaaguuacaggaucggugucgcaaaugcuacucuccgcgaucaggccaggcuugucccccugcacuggccgcggcuuggcuacguagaugcgagaggcgcgggggacggccaagagguggcaggcggaaggaacucacccuggggcuucgccccgcccgauguagugcaccuggaccagccaaagacgaugcuuggagaccccaagcaggcaggagcuccucugacacaaacgagucggaaaucaagucaaaugaggaaccucuguugcggaaaagcagucgucgcuucgugauuuuuccaauacaguauccggauaucuggaagauguacaagcaggcccaggcuuccuucuggacugccgaggaggucgaccucucuaaagaucugccccacuggaacaagcugaaagcggacgaaaaguauuuuauuagccauauccucgcauucuuugccgcuuccgaugguauuguuaaugagaacuuaguggaaagauucucacaagagguacaggugccugaggccaggugcuuuuacggguuccagauccugauagaaaauguccacagugagauguauagccuuuugaucgacacguacauucgggaucccaaaaagcgagaauuucuguucaacgcaaucgagaccaugccauaugugaagaaaaaggcugacugggcccuacgcuggauugcggauagaaaaucuacauuuggagaaaggguuguggccuucgcagcugucgagggcguguuuuucuccggcucauucgccgcuaucuuuuggcucaagaaacgggggcugaugccuggacuuacuuucagcaaugagcugauaagucgcgacgaagguuugcauugugacuuugccugccucauguuccaauaccugguaaacaagccaucugaggaaagaguuagggagauuaucguggaugcagucaaaauugaacaggaguuuuuaaccgaggcccugcccgugggccucaucgggaugaauuguauccuuaugaagcaguacauugaguucguggcugaccgucuguuggucgaacuaggauuuuccaagguuuuccaggcggaaaacccguuugauuucauggagaauauaagccuggaaggcaaaacaaacuuuuucgagaagcgggugucggaguaucaacgauuugcaguaauggccgaaaccacugacaauguguucacacucgaugcugacuucuga

SEQ ID NO: 62053 - RNA, 1170 nt, Artificial Sequence
  derived and/or modified sequence opt3 from RRM2__Homo_sapiens__NP_001025
augcugagccucagagugccccuugccccuaucaccgacccacagcaacugcaguuguccccguuaaagggccugucucuagucgauaaagagaacacacccccugcucucucagggacuaggguucuggcaaguaagacggcccggcgcauuuuccaggaaccaaccgagcccaaaacaaaggcggcugccccuggaguggaagacgagccacuucugcgagaaaauccccguagauuuguaauauucccuaucgaguaccacgauauuuggcagauguauaaaaaggcagaggccagcuuuuggacugcugaagagguggacuuguccaaggauauccaacauugggaaucucucaaaccagaggagagguacuucauuucgcacguccuggcauuuuucgccgcuucagacgguaucgugaacgaaaaucugguugagcgguuuagccaggaagugcagauaaccgaggcccgcugcuucuauggcuuucagaucgcgauggaaaacauucauagugagauguacucccucuuaaucgauacauauauuaaggacccgaaagagagagaauuucuguuuaaugcaaucgagaccaugcccugugucaagaaaaaggccgauugggcucuuagguggauaggggacaaggaagccacuuacggagagcgggugguagcauucgcugccguugaaggcauuuucuucucugguagcuucgcguccaucuuuugguugaaaaagcgcgggcugaugccuggacuaacauucucaaacgagcucauuagucgagaugagggccugcacugcgacuuugccugucuuauguucaaacaucuggugcacaagccaagcgaagagagagucagggaaaucaucauuaaugcagugcggauagagcaagaauuuuugaccgaggcucuccccgugaaacugaucggcaugaacugcacguuaaugaagcaguauauugaguucgucgccgaucgucugaugcucgaacuuggguuuucuaaaguuuuccgcguggagaauccuuuugacuucauggaaaacaucucccuggagggaaagacuaacuuuuucgagaagagaguaggugaauaccagaggaugggcgugaugucaagcccaaccgagaauaguuuuacauuggacgcugauuucuga

SEQ ID NO: 62054 - RNA, 1866 nt, Artificial Sequence
  derived and/or modified sequence opt3 from RRN3__Homo_sapiens__NP_001287993
auggccgcuccccugcuccacaccagacuuccuggcgacgcagccgcgagcuccucugcugugaagaaacugggggccucaaggacaggaaucaguaacaugcgggcauuggagaaugauuucuuuaacagcccaccgcgcaagacuguccgauucgguggcacgguuaccgaaguguuacugaaauacaagaaaggggagacaaaugacuuugaacuacucaagaaccagcugcuugaucccgacauuaagcgucugccuugguugaauagaucccaaacuguaguggaggaauaucucgccuuccugggaaaccuggucucugcucagaccguguuucucaggccaugcuuaucgaugauagcaucacauuucguucccccucgggugaucauuaaagagggcgaugucgacgugagcgauagugacgaugaggacgauaaucugccagccaacuuugacacaugucaccgcgcccuucagaucauugcuagauacguacccuccaccccuugguucuugaugccaauccugguugaaaaguuuccguucgugaggaaaucugagcggacucuagaaugcuauguccauaaucuccugcgcauaagcguguacuuucccacacuucgacacgagauccuggaguugauuaucgaaaagcuccugaaauuagaugugaacgcguccagacaggguauugaggacgcagaagagaccgccacgcaaacuugugggggaaccgacucaacagaaggccuguucaauauggaugaggacgaggaaacugagcaugaaaccaaggcuggcccugagaggcucgaucagaugguccacccaguugccgaacggcuugacauccugaugaguuuggugcuaagcuauaugaaggauguaugcuacguggacgggaaagucgauaacggaaagacaaaagaccuguaucgugaucucauaaauauuuuugacaagcugcuucugcccacccacgcaucuugucaugugcaguucuucauguuuuacuugugcuccuucaaacucgguuuugcugaggccuuccuggagcacuuauggaagaaacugcaggauccuucaaacccagcgaucauucgccaagccgcaggcaauuacaucgggagcuuucuagcuagagccaaguucaucccccucauuacgguuaagaguugucuggaccuuuuggugaacuggcugcauauauaucucaacaaucaggacucuggaacuaaggcuuuuugcgaugucgcccugcacggcccguucuacuccgcaugucaggccguguuuuauacauucguauuuaggcacaaacagcuucugagcgguaacuugaaagaagggcuccaauaccugcagucguuaaauuucgagcggaucguuaugucucagcugaacccucuaaagauuugccuccccuccguggucaacuuuuucgcugcgaucaccaauaaauaucaacugguguucuguuacacuauaauugaacgaaauaaccgccagaugcuuccagucaucagaucaacagcaggaggcgacagugugcagaucugcaccaauccuuuggauacguuuuuccccuuugacccaugcguucugaagaggagcaagaaauucauugaucccaucuaucaggugugggaggacauguccgccgaggaacuccaagaguuuaagaaaccuaugaagaaagauauuguagaagacgaggaugacgauuuccugaagggcgaagucccacagaacgacaccgugauagggaucacaccgucuagcuuugauacucauuuccggucacccaguuccagcguuggaucuccuccaguguuauacaugcagcccucaccucuguga

SEQ ID NO: 62055 - RNA, 834 nt, Artificial Sequence
  derived and/or modified sequence opt3 from RRNAD1__Homo_sapiens__NP_001136032
augcccggcaucagcgccagagggcugucccacgagggaaggaagcagcucgcugugaaccuuacccggguccuggcauuguaccgcucuauuuuagacgccuauauaaucgaguucuuuacagauaaucugugggacacucuaccuugcucauggcaagaagcgcucgauggucugaaaccaccgcagcuugcuacgaugcuguugggcaugcccggggaaggagagguugugcgauaccguaguguauggccucucacccugcuggcccucaagagcacagcaugugccuuagcuuucacuagaaugccaggcuuucagacccccuccgaguuccuggaaaacccuucucagucgucaaggcuuacagcaccauuucggaaacaugugcgccccaagaaacaacacgagauuagaagguugggugaacuggucaagaagcuaagcgacuucaccgggugcacucaggugguugaugugggaaguggccagggccaucucucccgguuuauggcccuggggcuuggacugauggucaaaucuaucgagggugaccagcgcuugguggaacgagcucaaagacucgaucaggagcuguuacaggcccuggagaaggaagagaaaaggaauccucagauuugugcggcaggcgccacagcuagcggggcccgguccccagcagcuaccgaaucaggaugcccgaguggcccccgugguccuggggagccauguggaggccuccuucaacccggcagcacggccugcccuacugggggagacgcguauucuaccgguccagccgcaguacccuccggcacaggguucccguguuga

SEQ ID NO: 62056 - RNA, 2277 nt, Artificial Sequence
  derived and/or modified sequence opt3 from RRP1B__Homo_sapiens__NP_055871
auggcccccgcuaugcagccugcagagauccaauucgcccagagacuggcgagcuccgaaaagggcauuagggaccgggcugugaaaaagcuccgccaguacauaucugucaaaacccagcgagagacagggggauuuucacaagaggaacuucugaagaucuggaaagguuuguucuauugcauguggguucaggaugaaccauuacugcaggaggagcuagccaacacuauugcacagcucgugcacgccguaaauaacagugcugcacaacaucuguuuauccagacguucuggcagaccaugaaucgugaauggaagggcauugacagacuuaggcuggauaaguacuauauguugauccggcucgugcugcgccagagcuuugagguccugaaaagaaacgggugggaagaguccaggauaaagguguuccucgacguuuuaaugaaagaggugcuguguccggaaucucaaucgcccaauggaguccgguuucacuucaucgauauuuaccuugacgaguugucaaaggugggcgguaaagaacugcuagccgaucagaaccucaaguuuaucgacccuuucugcaagauugcugccaaaacaaaggaucauacucugguacagaccaucgcgcgcgggguuuuugaggcaauaguggaccaaagcccauucguccccgaagagacaauggaggaacagaaaaccaaggugggagauggcgaccuuagugccgaggaaauuccugagaaugaagugucccugagacgagcugucucuaaaaagaaaacugccuugggcaagaaccacagcaggaaggaugggcucuccgacgagcggggacgugacgauugugguacauuugaggacaccggcccacuguuacaguucgauuauaaagcaguugcugaccgccugcucgaaaugacgucaagaaagaauacuccccauuucaacaggaaacggcuuaguaagcugaucaaaaaguuucaggauuugagcgaggggucuuccauuucacaacuuagcuucgccgaagacaucagugcggaugaggacgaucagauccugucucagggaaagcacaaaaagaaaggcaauaagcuccuggaaaagaccaaccuugagaaggagaaggguucccgaguguuuugcguagaagaggaagacagcgagucgucucugcagaaacgcagaaggaagaaaaagaaaaagcaccauuugcaaccugagaauccagggccgggaggcgccgcacccucccucgaacagaaccggggccgcgagccugaggcuucagggcugaaggccuuaaaagcuagaguggccgaaccaggagcagaagccacaaguagcacuggugaggaguccggcucugaacaucccccugcugucccaaugcacaauaagaggaaacguccccggaagaaaagcccgcgagcgcacagagagaugcuggaaucagcagugcuaccucccgaggauaugagucaguccgggccaagcggaucucacccucagggccccagggguucaccaaccgggggcgcccaacuccugaagcgcaaacggaaacuuggaguugugcccgucaacggcaguggguugagcacuccugcuuggccaccgcugcagcaggaaggacccccuaccgguccagccgagggcgcaaacucccauacgacucucccccagagaaggcgccugcaaaagaaaaaggccgggccuggaucucuugagcuguguggcuugccaucgcagaaaacagcuagccucaagaaacgaaagaagaugcgggugauguccaaucugguagaacacaacgguguuuuagagucagaagccgggcagccccaagcacugggcaguucuggaaccugcagcucccucaaaaagcagaaacuacgugcggagucagacuucgugaaguuugacacuccguuccugccuaaaccacuauuuuucagaagggcuaagagcucuacagccacccaucccccuggccccgcaguccaguugaauaagacgccauccaguagcaaaaaggugaccuuugggcugaaccgcaauaugacagccgaguucaaaaagacugauaaaucuauucucgucuccccuaccggacccucacggguggcuuuugacccagaacagaagccgcugcacgguguuuuaaagacaccuacaaguagccccgccucguccccacugguggcuaaaaagccccuuaccacaaccccuagaaggcgaccacgcgcaauggauuucuuuuga

SEQ ID NO: 62057 - RNA, 1386 nt, Artificial Sequence
  derived and/or modified sequence opt3 from RRP1__Homo_sapiens__NP_003674
auggugagcagaguccagcugcccccugagauccaacucgcccagaggcuugcuggcaacgaacagguuacccgggaccgcgcagugcgaaagcugcguaaauacauuguagccagaacacagagggcggcugggggauucacucacgaugaguuguuaaagguguggaaaggucuguuuuauugcauguggaugcaagacaagccacuacuccaggaagaacugggccggacgauaucccagcuuguccaugccuuccagaccacagaagcacaacaccuguuuuugcaggccuucuggcagacuaugaaucgcgaguggaccgggaucgauagacucaggcuggacaaauuuuacaugcugaugcggauggugcucaacgagucuuuaaagguucugaagaugcagggaugggaagaacgccaaauugaagaacuuuuggagcugcuaaugacagaaauccuccauccgucaagucaggcucccaauggcgugaaaagccacuucauugagaucuuucuggaggagcuuaccaaggucggugcagaggagcugacugccgaucagaacuugaaauucauagacccuuuuugucgaaucgcugccagaacaaaggauucccucgugcugaauaacauuaccagggggaucuucgagacgauuguagaacaagcgccauuagcaaucgaggaccugcucaaugaacuugauacucaggacgaggaaguugccucugauucggacgagucaagcgagggaggcgaacggggcgaugcucugagucagaaacguuccgagaagcccccugccgggucuauaugccgcgcagaaccagaggcuggagaggagcaggccggugacgacagagauagcggcgggcccguguugcaauuugacuaugaggcggucgccaacaggcuauucgaaauggcaucccggcagucaaccccuagucagaaucgaaagcgccuguacaaagugauuagaaagcuccaggaucuggcuggaggcaucuuuccagaggacgaaauuccggagaaagccuguaggcggcuucuggagggucgcagacaaaagaaaacaaagaaacagaagagguugcuccgucugcagcaggaacgggggaagggagagaaagaacccccuagcccaggcauggagcgaaagagaucuaggcgccggggcgugggggcugaucccgaagccagagcagaggccggagagcaaccugguacugcugaaagggcguuacugcgcgaccagccacgaggccgggggcagcguggagcaagacagaggcgccggacccccagaccgcuaacauccgccagggcuaaagccgcaaacguccaagagccugaaaagaaaaagaagcgacgcgaguga

SEQ ID NO: 62058 - RNA, 1428 nt, Artificial Sequence
  derived and/or modified sequence opt3 from RRP9__Homo_sapiens__NP_004695
augagcgccaccgcugcagccagaaagaggggcaaacccgcguccggggcuggagccggugcaggcgccgggaagcggcgccgaaaagcugacucugcaggagaucguggcaagucaaaaggugggggaaagaugaacgaggaaaucaguagcgacuccgagucugaaucgcuggccccuagaaagccagaggaagaggaggaagaggaacucgaggagacagcucaggaaaagaaacuuaggcuggccaaauuguacuuagagcaacugcggcagcaggaagaggaaaaggcggaggcacgcgccuucgaggaagaucagguggcuggcagacuaaaagaggacguccucgaacaaaggggccggcugcagaaacuuguugccaaggagauucaggcaccggcuucagccgauauacgcgugcugcgagggcaccaguugagcaucacuugccucguagugacgcccgacgauagugcgaucuuuuccgccgcaaaggacuguucuauuauuaaguggagcgucgaauccggaagaaaacugcaugugaucccuagggcuaagaaaggugccgagggcaagccacccgggcacucaagucauguucugugcauggcuauaagcucugauggaaaauaucucgccuccggcgaccggucaaaguuaauccugauuugggaggcacaaagcugucagcaccuuuacaccuucacaggucaucgugaugccgugaguggguuggcuuuucgcagaggaacucaccagcuguauucuaccucccacgacaggagcgucaagguguggaauguagcggaaaacucguacguugagacacuauucggccaucaggaugcaguggccgcucucgacgcccugucucgggaaugcugugucaccgcaggcgggcgagacggaacugugcgcguguggaaaaucccugaggaaucccaacuugucuuuuauggucaccagggcucaauugauugcauccaucugauaaaugaggagcacaugguuaguggggccgacgauggaagcguggcuuuguggggccucuccaagaaaagaccacuggccuuacagagggaagcacacggucugcgcggggagcccggccucgaacaaccuuucuggauuucuagcguagcggcccuucugaacacagacuugguggcuaccggaucacauaguuccuguguccggcuauggcagugcggcgagggguuuagacagcuggaucuccugugugacaucccacuugugggauucauuaauagccugaaguuuucuucaaguggugauuucuugguugcaggcguggggcaggagcacaggcucggacguugguggcggaucaaagaagcccgaaacagcgucugcaucauuccgcugagaagggugcccguaccuccagcugccggcuccuga

SEQ ID NO: 62059 - RNA, 1098 nt, Artificial Sequence
  derived and/or modified sequence opt3 from RRS1__Homo_sapiens__NP_055984
auggagggccagagcguggaggaacugcucgccaaggcugaacaagacgaggcagaaaaacuucagagaaucaccguccacaaggagcuggaguugcaguucgauuuagggaaccugcuagccuccgacaggaaucccccuacaggacuccggugcgcggguccaacuccggaagcugagcugcaggcccuugcacgcgauaacacgcaacuguugauuaaucagcucuggcagcugcccaccgaacgaguugaggaggccauaguggcucgucugccugaaccaacaacuagacuccccagggagaaaccuuuaccacggccccgcccucugaccagauggcagcaauuugcaaggcuuaagggcauccggccaaagaagaagacaaacuugguaugggacgaagugucugggcaguggcgccgaagauggggauaccagagggcccgggaugacaccaaagaguggcugauugaagucccgggcaaugcugauccccuagaggaccaguucgccaagcguauccaagcgaaaaaggagcgcguggcaaagaacgaacucaauagacugaggaaccuugcccgggcucauaagaugcagcugccuucagccgcagguuugcacccaacugggcaucagaguaaggaggaacucggacgagcuaugcaaguugccaaagugagcacagcguccgucggccgcuuucaggagagacugcccaaggaaaaagugccuaggggcucugggaagaaacggaaguuccagccauuauuuggagauuucgccgcagagaaaaagaaucagcuggagcuccuucgcguaaugaacucgaagaaaccccaacuggacguuaccagagcuacgaauaagcagaugagggaagaggaucaggaagaggccgcuaaacgucggaagaugucacagaaagguaagcgaaagggcgggagacaaggaccgggcgguaaaaggaaagggggaccucccagccagggcggcaaacgcaaagggggauuggguggcaaaaugaacagugggccaccuggacuaggcgguaagcggaaagggggccagagacccggaggcaagaggcgcaaguga

SEQ ID NO: 62060 - RNA, 675 nt, Artificial Sequence
  derived and/or modified sequence opt3 from RS1__Homo_sapiens__NP_000321
augagcagaaagaucgagggcuuccugcuccuucuguuguuuggguacgaagccaccuuaggacuguccucuacagaggacgaaggugaggaucccugguaucagaaggcuugcaaaugugacugccaaggcgggccuaacgcacuauggucagccggagcgacgagucucgauuguauuccagaaugcccguaccacaaaccccugggcuucgagagcggugaggugacuccugaccagauaaccuguuccaauccagaacaguaugucgggugguacucuucguggacagcuaacaaggccaggcuuaauucacagggauuuggcugcgcauggcugagcaaauuccaagauaguucccagugguugcagaucgaccucaaggagauuaagguuaucucuggcauucugacucaggggcggugugauaucgacgaauggaugaccaaauauagcgugcaauaccgcacagaugagcgacugaacuggauauauuacaaggaccagaccggaaauaaccguguauuuuacgguaauuccgauagaacuucaacagugcagaaccucuuaaggcccccuaucauuagucgguucauccgccugauuccacuuggcuggcaugucagaaucgccauaaggauggaguugcuggaaugcgugagcaaaugugcuuga

SEQ ID NO: 62061 - RNA, 1086 nt, Artificial Sequence
  derived and/or modified sequence opt3 from RSAD2__Homo_sapiens__XP_011508716
augugggugcugacccccgccgcuuucgcaggcaagcuccuuagcgucuuuagacagccucuguccucuuuguggaggucauuaguuccacuguucugcuggcuacgggccacauuuuggcuccuggcgacuaaacgccgaaagcaacagcuugugcugcgugggccggacgaaacgaaagaagaggaagaggaucccccuuugccaaccacacccaccaguguaaacuaccacuucacuagacaguguaauuauaagugcggauuuuguuuccauacagcuaaaaccagcuuugugcucccucuggaagaggccaagaggggucugcucuuacugaaggaggcaggcauggagaaaaucaacuucuccgggggagaaccauuucuucaggaccggggcgaauacuuggguaagcugguccgcuucugcaaaguggagcuaagacuccccucuguuucgauugugucaaaugggagccugauaagggagcggugguuucaaaacuauggagaauaccuugauauccuggccauuaguugugacuccuucgaugaggaagucaauguguugaucggccgcggccaggggaagaaaaaccacguagagaaucuccagaagcugcgaagauggugcagggacuaucggguugcuuuuaagauuaacucugugaucaaucguuucaacgucgaagaggauaugacugagcagauaaaagcauuaaauccugugcgcuggaagguguuccaaugucugcucaucgaaggagagaacugcggugaagacgcccuuagagaggcugaaagguuugucauuggcgaugaggaguucgaacgguuucuggagcgacauaaagaaguuagcuguuuggugccagaguccaaucagaagaugaaagacucauaccuaauccuggaugaauauaugcgcuuccucaacugcagaaaggggaggaaagacccgaguaagagcauucuggauguaggaguggaggaggccaucaaguuuucuggcuucgacgagaaaauguuucuuaagcggggugggaaauacauaugguccaaggcggaccugaaauuggauugguga

SEQ ID NO: 62062 - RNA, 4326 nt, Artificial Sequence
  derived and/or modified sequence opt3 from RSF1__Homo_sapiens__NP_057662
auggccaccgcugcagccgcggcugccgugauggcacccccuggcugcccagggagcuguccgaacuucgccgucguuugcuccuuucuggagagauacggaccccuccuugaccugccugaauugccauuccccgaguuagaaagggugcugcaggcuccuccacccgauguagguaauggcgaggugccuaaggagcuagucgagcuccaccugaaacuuaugcggaagaucgggaaaucugugacagcagaccgcugggagaaguaucugauuaaaauaugucaagaauuuaacucaacuugggccugggagauggaaaagaagggauacuuggagaugaguguugagugcaaacucgcucugcugaaguaucucugugaaugccaguucgaugacaauuuaaaauuuaagaacaucauuaaugaggaagaugccgacacgaugcgacugcagccaaucggccgugauaaagacggucuuauguacugguaucaguuggaucaagaccauaacgugagaauguacauugaggaacaggaugaccaggaugggagcuccuggaaguguaucgucaggaaucggaacgagcuggcggagacccuagcacuccugaaggcccagauagacccggugcuucugaaaaauucuucgcaacaggacaacucaagccgcgaaagucccuccuuggaggaugaagagacaaagaaagaagaggagacuccuaagcaggaagaacagaaagaaucugagaagaugaaaagcgaggaacaaccaauggaccucgagaauagauccaccgcuaacguacuggaagagacaaccguuaagaaggaaaaagaggaugagaaggaauuagugaaacugcccgucaucgugaagcucgagaaaccucuuccagaaaaugaggaaaagaagauuaucaaagaggagucagacaguuucaaggaaaacgugaaacccauuaaggucgagguuaaagaaugcagggccgauccgaaggacacuaagagcucuauggagaaaccuguggcacaggaacccgagcggaucgaguuuggaggcaauauaaaguccucacacgaaauuacagagaaaagcaccgaagagacggaaaagcugaaaaacgaucagcaagcuaagaucccauugaagaaacgcgagauuaagcuaagugacgauuucgacucuccuguaaaaggcccccuguguaaguccgugacuccaaccaaagaguuucucaaggaugaaaucaaacaggaggaagagacaugcaagcgaaucagcacuauuaccgcccuggggcaugagggaaagcagcuugucaacggugaagugucggacgagagaguugcgcccaauuucaaaacagaaccuauagagaccaaguuuuaugaaacgaaagaggagucuuacuccccaucaaaggacaggaacaucauuacugaaggcaaugggacagagagucugaacagcgugaucaccuccaugaaaacuggagaauuggagaaggaaacagccccgcuccggaaggaugcagacucuagcauaucaguccuggagauucacagucagaaagcucaaaucgaggaacccgauccuccagagauggaaaccuccuuagacagcucugagauggccaaggaucugucaaguaaaacggcucuaagcuccaccgaaucuuguacaaugaagggcgaggagaaaucgcccaagacuaagaaagacaagcguccuccaauccucgaaugccuggagaaacuugaaaagagcaaaaagaccuucuuggauaaggacgcccagcgccugucccccauuccggaggaggugccuaaaucaacacucgaaagugagaagccagguucucccgaagcagccgagacuagcccucccuccaauaucauugaucauugcgaaaaacuggcuucagagaaggagguaguugaaugucagagcaccucuacagucgggggacaguccgugaaaaagguggaccuugagacccugaaagaagauagugaguuuacuaaggucgaaauggacaacuuggauaaugcgcaaacgagcggcauagaggagccaucugaaacaaagggcuccaugcagaaaucaaaguucaaauacaagcucgugccugaggaagagaccacugcaagugaaaacaccgagaucacaagcgagagacagaaagaagggauuaagcugaccaucaggaucucgucccggaagaaaaagcccgacucuccaccgaaaguuuuagagccugaaaauaagcaggagaaaacugagaaggaagaggaaaagacaaacgugggacgaacgcugcgcagaagccccaggauuucacggccaaccgccaaaguagcugagauacgcgaccaaaaggccgauaaaaagagaggugaaggcgaggacgaggucgaagaggaaaguacugcacuacagaaaacagauaagaaggagauccucaaaaaguccgaaaaagacaccaauucuaaggugagcaaaguuaagcccaaggggaaagugagguggacaggaucccguacucggggccgauggaaguauucaagcaacgaugagagugaggguucuggguccgaaaaaucaucggccgcuucagaggaagaggaagagaaggagucugaagaggccauucuggcagacgaugacgaaccuugcaaaaaguguggccuuccaaaucaccccgaguugauccugcucugcgauaguugugacuccggauaccacaccgcgugccugagaccuccguuaaugauuaucccagauggcgagugguucugucccccuugccagcauaaacugcuuugugaaaaguuggaggaacagcuccaagaccuggaugucgcucuaaagaaaaaggagagggccgaacgccggaaagagagacugguguauguagggauaagcaucgagaacauuaucccaccccaggaaccugacuuuucugaggaccaggaagagaagaaaaaggauagcaagaaauccaaggcaaaucuccuggaaaggcgcucaacgcgaacccggaaaugcauuaguuaccguuucgacgaguuugaugaggccaucgacgaagcuauagaggaugacauuaaggaagccgauggagguggcguggggagaggaaaagacaucagcacaauuacuggccacagggguaaggauaucucuaccauacuugacgaggaacgcaaggagaacaaacggccgcaaagagcagcugccgcgaggcgaaagaaacgccggagauugaacgaucuggacuccgacucaaauuuagaugaggaagagagugaagacgaguucaagaucagcgaugggucccaggacgaguuuguugucucugaugaaaaccccgacgagucggaagaggauccaccuagcaaugacgauucagacacagauuucuguuccaggcgucuccgccggcaucccaguagaccaaugaggcagucucgacggcugcgcagaaaaacuccuaagaagaaauauagcgacgaugacgaagaggaggaauccgaggaaaacucaagggacucugagagcgauuuuagugacgauuucuccgacgauuuuguggaaacccggcgaagacgcagcaggcguaaucagaagcggcaaauuaacuacaaagaggacucugagucagauggcucccagaagagucuuagaaggggaaaagaaauccgccgagugcacaagagacggcugagcucgucugaguccgaagagagcuauuugagcaaaaauagugaagacgaugagcucgccaaggagucuaagagguccguccgcaaacguggcagaagcacggacgaauacucagaggcugaugaagaggaggaagaggaagaggggaagcccagucggaaaaggcugcaccgcauugaaacagacgaggaggaaagcugcgauaacgcacauggagacgccaaucagccagcucgagacucccagccgagaguucuaccuucugagcaagaaagcaccaagaaacccuaccggaucgaguccgaugaagaggaggacuucgaaaacguggguaaggugggcucaccacuggauuauucucucguagaccugcccaguacuaaugggcagucgccuggaaaggccauagagaaccuuauuggcaaaccaacagaaaagagccagacccccaaagauaauuccacugcaucugcgucauuggccagcaacgguaccuccgggggccaggaggcuggagccccugaagaggaggaagacgagcuguuaagggucacagaucucguggacuacguuugcaauagugaacaacuguga

SEQ ID NO: 62063 - RNA, 1473 nt, Artificial Sequence
  derived and/or modified sequence opt3 from RSL1D1__Homo_sapiens__NP_056474
auggaggacagcgccuccgcuucucugucaagugcagccgcgaccggcacaagcacuuccacgcccgcugccccuaccgcaagaaagcagcucgauaaagaacaagugaggaaggccgucgacgcuuuacugacacacugcaaaucucggaagaacaauuacggguuguuacugaacgagaaugaaucgcuauuccucaugguugugcuguggaaaaucccaucaaaggagcuucgcguacgacugacuuugccgcauagcauucguagugauuccgaagacauaugucucuuuaccaaggaugagcccaacucuacaccugagaaaaccgaacaguucuauagaaagcugcugaauaaacacggaaucaagacugugagccagauuaucucccuccagacacuuaaaaaggaguacaagucauaugaagcaaaacugaggcuuuugaguagcuuugacuucuuucugaccgaugcccggauucgcagacuacucccaucucugaucgguaggcauuucuaccaacggaagaaaguccccguguccguuaaccuucugucaaagaauuugagccgcgagauaaacgacugcaucggcgggacggugcucaauauuaguaaaucuggauccuguagcgcuauccgaauuggccacgucgguaugcagaucgagcauauaauugaaaacaucguggccguaacuaaggggcugucggagaaauuaccugaaaagugggagucuguuaagcugcucuuugugaaaaccgaaaaguccgcggcacuuccaauuuucucaaguuuugucagcaauugggaugaggccacaaaaagaucccuguugaacaagaaaaagaaggaggcuaggcggaaacgucgcgaaagaaauuucgagaagcagaaagaaaggaagaaaaagcggcagcaagcccgaaagacugcaucugugcuaagcaaagacgauguggcucccgagucaggagacaccacagucaagaaaccugaaaguaagaaagagcagaccccagagcacggcaagaagaaacgcggcagagggaaggcccagguuaaagcgacgaacgaauccgaggaugaaaucccgcagcuggugcccaucggaaagaaaacuccugccaaugagaagguagaaauucaaaaacacgcaacagguaaaaagagcccagcuaaaucucccaacccuucaaccccaaggggcaagaaacggaaggcccuccccgcuagugagacuccgaaagccgcagagagcgaaacaccugggaagucccccgagaagaaaccaaagauaaaagaagaggccgugaaggagaaaucuccuucgcugggaaagaaggacgcucgccagacccccaaaaagccagaagcgaaauuuuucacgacccccagcaaguccgucagaaaagcaucacauacaccuaagaaguggccaaagaagccgaaagugccccagaguacuuga

SEQ ID NO: 62064 - RNA, 492 nt, Artificial Sequence
  derived and/or modified sequence opt3 from RSL24D1__Homo_sapiens__NP_057388
augagaaucgagaagugcuacuucuguagcggccccauuuauccugggcacggaaugauguuugugaggaacgacugcaaagucuuccgguuuuguaaguccaaaugccauaagaauuucaaaaagaagcgcaacccacgaaaaguucguuggaccaaggccuuuagaaaagcugcagguaaggaacugacaguggauaauucuuucgaguuugagaaaaggcggaacgaaccgauaaaguaccagcgcgaacucuggaauaagacuaucgacgccaugaaaagaguagaggagauuaagcagaaaaggcaagcgaaguucaucaugaaccggcuuaaaaagaauaaagaacugcagaaggugcaggauauuaaggaggucaaacaaaacauccacuugauacgcgcucccuuagccggcaaggggaaacagcuggaagagaagauggugcagcagcuacaagaggacguugauauggaagacgcaccuuga

SEQ ID NO: 62065 - RNA, 930 nt, Artificial Sequence
  derived and/or modified sequence opt3 from RSPH1__Homo_sapiens__NP_543136
augagcgaccugggcuccgaggaacucgaggaagagggggaaaacgauaucggagaguacgaggguggcagaaaugaagccggggagaggcacggacggggccgcgcucgacuucccaacggugacaccuaugaagggucuuacgaguucggaaagcgucauggccagggcauuuauaaauuuaagaauggggcaagauacauaggagaguaugugaggaacaaaaagcacggucaaggcacauucaucuacccugaugggucacgguaugaaggagagugggccaaugaccugcgccauggccacggugucuacuacuauauuaacaaugauacuuacacgggggaaugguuugcgcaucagagacacggacagggcaccuauuuguacgcugagacaggcaguaaauauguugggacuugggugaacggacagcaagaagguaccgccgaguuaauccaccugaaucauagguaccagggcaaguuccuaaacaagaauccaguagggccgggaaaauauguguuugacgucggcugcgagcagcacggugaauaccggcucacagauauggagcgcggggaagaggaagaggaggaggaacuggugaccguugugcccaaguggaaagcaacucagauuacagaacuugcccuguggaccccuacguugccaaagaaacccacuagcaccgacggcccuggacaagaugcuccaggcgcagaguccgccggggaacccggagaggaggcucaggcccuccuggaagguuucgagggcgaaauggacaugcgaccuggggaugaggacgcggauguccugagagaggaaucuagggaguacgaccaggaagaguuucgguaugacauggaugaaggaaacaucaauucggaggaggaagagacacgucagucagaccuccaagauuga

SEQ ID NO: 62066 - RNA, 2151 nt, Artificial Sequence
  derived and/or modified sequence opt3 from RSPH4A__Homo_sapiens__NP_001010892
auggaggacagcaccucccccaagcaggaaaaagagaaccaagaagaguugggcgaaacaagaaggccuugggaggggaagacugccgcuucuccacaguacucagagccggaaaguagcgagccccucgaagcaaaacagggaccugagacgggucggcagucccgaucuucgcgcccauggucaccccaaagccgugccaagaccccucuuggcgggccagcgggacccgagacaaguuccccugcuccagugucuccgagagaacccagcuccucaccuaguccacuggcccccgcaaggcaggauuuggccgcuccuccacagagcgaccggacuaccucugucauccccgaggcaggcacaccguauccugaucccuuagaacaguccucagacaaacgcgagagcaccccacaccauacuagccaaucugaagguaauacauuccagcagucccagcaaccuaagccccaccugugcgggagaagggauguuagcuacaacaaugccaagcagaaagagcuacgguuugacguguuccaggaggaagauucgaacucugacuaugaucuccaacagccagcucccggaggcuccgagguagccccuucaaugcuggaaauuaccauacagaaugcgaaggcauaccuucugaaaacgaguagcaacuccggcuuuaauuuguaugaccaucucucuaacaugcugacuaagauccugaaugagcgcccagaaaacgccguggauauuuucgagaauaucagccaggacgucaaaauggcucacuuuucaaagaaguucgaugcccuccaaaacgagaaugaauuacugccgaccuacgagauugcagaaaaacagaaggcucuuuuucugcaggggcaucuggagggaguggaccaggaacuagaggacgagaucgccgaaaacgcgcuccccaauguuauggagagugccuucuauuuugaacaagcuggugugggccuggggacagaugagacuuaccgaauauuccuugcacugaaacaguugaccgacacacacccuauccagagauguagguuuuggggaaagauucucggccuggagaugaacuacaucgucgccgaaguggaguuccgggaaggugaggaugaagaggagguagaagaggaagacguugcugaggaacgugauaacggggaguccgaggcccacgaagacgaggaagaugaguuaccaaaaaguuuuuauaaggcaccccaggccauuccuaaagaagagucucgcaccggagcuaauaaguacguguauuucgucugcaacgagccaggcagacccugggugaagcugccgccugugaucccagcgcaaauagucauugcaaggaaaaucaagaaauucuuuacgggccggcucgacgcccccauuaucucauacccucccuucccagggaaugaaaguaacuaucuucgagcucagaucgcccgcauuagcgcaggaacucauguuuccccucuggguuuuuaccaguucggcgaggaagagggggaggaagaggaagaggccgaaggaggcagaaauucuuuugaggagaaccccgauuucgaagguauacaggugaucgacuugguagagucgcuaagcaauugggugcaccauguccaacacauucugucccaggggagguguaacugguuuaauucaauccagaagaacgaagaggaagaggaggaagaggaugaagagaaagacgacagugauuauauagaacaagaggugggccucccacugcuuacaccgauuucugaggaccuggaaauccagaauaucccucccuggaccacucgguugagcuccaaccucauuccacaguacgcuaucgccguucugcagucaaauuuauggcccggagcauacgcguucagcaacggcaagaaguuugagaauuucuauauuggguggggacacaaauacucuccugauaacuauacaccacccgugccuccgccagucuaccaagaauaucccuccgguccugagauaaccgagauggacgauccaaguguggaagaggaacaggcuuuucgcgccgcacaggaggccguacugcuagcugccgaaaacgaggagagcgaagaggacgaagaugaggaagacgauuacgacuga

SEQ ID NO: 62067 - RNA, 921 nt, Artificial Sequence
  derived and/or modified sequence opt3 from RSPH9__Homo_sapiens__NP_001180270
auggacgccgauucccugcuccuuucccuggaguuggcuucuggcucagggcagggauuaagucccgacagaagggcaagccugcuaaccucccucaugcuggugaagcgggauuaccgcuaugaccgaguccuuuucuggggucguauccugggcuugguugccgauuacuauauugcgcaagggcucucugaagaccagcuggcuccuagaaaaacacuguacucgcucaacugcacugaguggucauuacugccaccggccacggaagagaugguggcacagagcaguguagugaagggaagguuuaugggcgaucccuccuaugaauacgagcacaccgagcuucagaaagucaaugaaggugagaagguguucgaagaggagauaguuaucgacaaagccguggcuauuaucccucgcggggcauuguuuaagacaccauucggacccacucaugucaaccggaccuuugaaggccugucucuaagcgaggccaagaaacucuccucauauuuccacuuuagagaaccuguggagcugaagaauaaaacacuucuggaaaaggcugauuuggacccaagucucgauuucauggacagccuggagcaugauauucccaaaggcucugaggccguaguucaaggggacuuuaccugguuacuguccagguguggauucgguuggccuugcucaugggacagcuguagugugucuaugcggguccucgaacacccagauggcgaggggcagugcccgggaggcgcggcacagcccgcccuugcugguccucaucuguugccauguagcccccaccaggaacuauggcugcgccuccgagggcacuggagagaggaacauggacuggcccuucacgcaaucgagugggagccugcuuggauguuucugaacaggguguga

SEQ ID NO: 62068 - RNA, 540 nt, Artificial Sequence
  derived and/or modified sequence opt3 from RSPO2__Homo_sapiens__NP_001269792
augcaguucagacuguuuagcuucgcccucaucauucuuaacugcauggacuacucccacugucaaggcaauagguggcggcgcucuaagcgagggugccguauagagaacugugauucaugcuuuaguaaagacuucuguaccaagugcaaagugggauuuuaucugcauagagguagguguuucgaugaaugccccgacggcuuugcuccuuuggaggaaacaauggagugugucgggugcgaaguuggacacuggagcgaguggggcacuuguucccggaauaaccgcacgugcgguuucaaguggggguuagagaccagaacaaggcagaucgugaaaaagccaguaaaggauacuauucugugcccgaccaucgcagaaucucggcgcuguaaaaugacaaugcgacauugccccggaggcaagagaaccccuaaagccaaggagaaaaggaauaagaagaaaaagcggaaacuaauugaacgugcgcaggagcagcacucgguguuucucgcuacugaccgcgccaaccaauga

SEQ ID NO: 62069 - RNA, 819 nt, Artificial Sequence
  derived and/or modified sequence opt3 from RSPO3__Homo_sapiens__NP_116173
augcaccugagacucaucagcuggcuuuucauuauacugaacuuuauggaguacaucggcucccagaaugccucuagggggcggcgccaacgacguaugcaucccaacgugucacagggaugccaggguggcugugcuaccugcagugacuauaauggguguuugagcugcaagccuagauuauucuuugcacuggaaaggauuggaaugaaacagaucggcgucugucuauccucuugcccaucggguuacuaugggacacgguacccggauauuaacaaguguacuaaaugcaaggccgacugugauacgugcuucaauaaaaacuuuuguaccaagugcaagucaggauucuaucuccaccugggcaaaugccuugacaauugucccgagggccuggaagcgaacaaucauacaauggagugcguuagcaucgugcacugugaaguaagugaguggaacccuugguccccaugcacuaagaaagggaagaccuguggauuuaaacgcgguacagagaccagagugagggaaauaauccaacaucccucugcuaagggcaauuugugcccuccaacuaacgagacacggaaguguaccguccagcgcaaaaagugccagaaaggggaacgaggaaagaaaggcagagagaggaagcggaaaaagcccaauaagggugagagcaaagaagccauuccugauuccaagucacucgagaguagcaaagaaaucccagagcagcgugaaaacaagcaacagcagaaaaagcgcaaggugcaggacaaacaaaagucuguuuccgugucaacgguccacuga

SEQ ID NO: 62070 - RNA, 705 nt, Artificial Sequence
  derived and/or modified sequence opt3 from RSPO4__Homo_sapiens__NP_001025042
augagagcuccccugugccuccuucuguugguggcccacgcagucgacauguuagcccugaacaggcggaagaaacagguuggcaccgggcuaggagguaauuguacaggcugcaucauuuguagcgaggaaaacgggugcuccacuugucaacagcgccucuuccuguuuauacgacgugagggaaucagacaguacggcaagugccuucaugauuguccuccagguuauuucgggauuaggggacaggaagugaaucggugcaaaaaguguggcgcgacgugcgagucuuguuuuucacaagacuucugcauccgcugcaaaagacaguuuuaccuguauaagggcaaguguuugccgaccugucccccugggacacucgcucaccagaacacuagggaaugccagggagagugcgagcuggguccauggggcggguggagucccuguacccauaauggaaaaacaugcggcagcgccuggggucuggaaucccggguacgcgaggcagggcgagccggacacgaagaggcugcaaccugucaagugcucucugagucgagaaagugcccuauucagaggccaugucccggcgaacggucaccuggccagaaaaaggggcguaaagaucgcagaccaaggaaggaccggaaguuagaucgacgccuggacgucagaccgaggcagcccggacuucaaccuuga

SEQ ID NO: 62071 - RNA, 831 nt, Artificial Sequence
  derived and/or modified sequence opt3 from RSRC1__Homo_sapiens__NP_001258763
augggcagaaggagcuccgacaccgaggaagagucucggucaaagcgcaaaaagaaacaccgacguagaaguagcuccucuucgucaagcgauaguaggacauacucccggaagaaagggggacgcaagucuagaagcaaguccaggucauggagucgggaccugcagccccgcagccauucuuaugaucgaagaaggcggcaccguuccucaagcaguucuuccuacgguagccgcagaaaaaggucgcggucucgaucccgcggcagagggaagucauauagggugcaacggagucgcagcaaauccagaacuaggcgugaaucuggaaacaucaaggccggccucgagcaucuuccuccagcugaacaggcaaaagcccggcugcaguuggucuuagaggcggcugccaaggcagacgaggcccugaaggcuaaagaacgaaaugaggaagaggcaaagagaaggaaagaggaagaucaggccacgcuaguugagcaagugaagcgcguaaaagaaauugaggcuauagaaagcgacucauucgugcagcagaccuuucggaguuccaaggaggucaaaaagagcguggagccgucugaaguuaagcaggccacaucaaccaguggucccgcgagcgcaguggccgauccuccauccacugagaaagaaaucgaccccacaucuauuccuaccgcuaucaaguaccaagaugacaacucgcucgcccacccaaaucuguucauugagaaagcagaugcugaagagaagugguuuaaaagacuuaucgcccugaggcaggagcgcuugauggggagccccgucgcguga

SEQ ID NO: 62072 - RNA, 1305 nt, Artificial Sequence
  derived and/or modified sequence opt3 from RSRC2__Homo_sapiens__NP_075388
auggccgcuagcgacaccgagagagauggccuggcacccgaaaagacauccccugacagggauaaaaagaaagagcagucugaagugucagucaguccacgggccagcaagcaccauuacucccgcucucgaucgcguucaagagagaggaaaagaaagagcgacaacgaagggcgcaagcacagaaguaggucccggucuaaagagggacgccgacaugagagcaaggauaaauccucaaagaaacacaagagugaggaacauaaugacaaggaacacagcucugauaaagguagagagaggcucaacuccucagagaauggcgaagaccggcacaagcguaaagagcgcaagagcaguagagggaggucucauucccggagccgaucgcgcgaaagaaggcaccggucucgcuccagagagaggaaaaagucacguagucggagccgagaacggaaaaaguccaggucucgcagccgggagagaaagaaaucaaggagucgcucccgagagcggaagcguagaaucaggagccgcucucggucaagaaguaggcaucgacaccgcacucggagcagauccaggacgcguucucgcucgcgggauaggaaaaagagaauugaaaaaccgcgacgguucagccgcucccuuucaagaacccccaguccuccacccuuuaggggacggaacacagcgauggacgcucaagaggcccuggcacgaagauuggaacgcgccaagaaguuacaggagcagagggaaaaagagaugguugagaagcagaaacaacaggaaauagcugcagccgcugccacuggcgguucugugcugaauguagcggcacuacucgccagcgggacccaggugacaccucagaucgcuauggccgcacaaauggcugcccugcaggcgaaggcccuugcagagaccggaauugcugucccauccuauuacaaccccgccgcugugaauccuaugaaauucgccgaacaggagaagaagcguaaaaugcuguggcagggcaagaaagaaggcgauaagucacaaagcgcagagaucugggagaaauugaacuuugggaauaaggaccagaacguuaaguuccggaaacucaugggaauuaagucugaagaugaggccgguugcuccaguguggacgaagagagcuauaaaacucugaagcagcaagaggaagucuuuagaaaucuggacgcucaguacgagauggcgaggucucagacacacacccagcgcggcauggggcucggauucacguccucaaugcgaggcauggaugcaguguga

SEQ ID NO: 62073 - RNA, 681 nt, Artificial Sequence
  derived and/or modified sequence opt3 from RSRP1__Homo_sapiens__XP_011540100
augagcaacuacgugaaugacauguggcccggcuccccucaggagaaggauucuccaucaaccaguagaagcgggggauccucuaggcugucgucacggagccgcagucgauccuucucucguagcuccagaucacacaguagggucagcucucgguuuuccucacgcagcagaaggaguaaaucucggucccgcagccgaagaaggcaucaacggaaguaucgucgcuacucgagaucuuauuccaggucacggagucgaagccgcuccagaagguaccgggaacgcagauaugguuucacaaggcguuacuaucggucuccgagccgauacagaucaaggagucgcucccggagcagaucuaggggccgcucauacugcgggcgagccuaugcuaucgcacggggacagcguuacuauggcuuugguagaacuguuuaccccgaggaacacaguagguggcgcgaccggagcagaacgaggucccgaucucgcaccccuuuccggcucucggagaaagauagaauggaacuucuggagauugccaagacaaacgcggcuaaagccuuggggacuaccaauauagacuuaccagcaagccugaggacagugcccuccgccaaggagaccucacguggaaucggcguaaguucuaacggcgcuaagccugaaauguuuuga

SEQ ID NO: 62074 - RNA, 834 nt, Artificial Sequence
  derived and/or modified sequence opt3 from RSU1__Homo_sapiens__NP_036557
augagcaagucccugaaaaagcucguggaggaaucuagagagaaaaaccagcccgaagucgacaugucagauaggggcaucaguaauaugcuugacguuaacgggcuguucaccuugagccacauuacacaauuagugcugucccauaauaagcuaacuaugguaccuccaaacauagcagagcucaaaaaucuggaagugcuuaacuuuuucaauaaccagaucgaggagcugccgacgcagauuucuucguugcagaagcucaagcaccugaaucugggaaugaaccggcucaauaccuuaccccgcgguuuuggcucacugccugcucuugaagucuuggaucugacauacaacaaucuaagcgagaacagucucccagggaauuucuuuuaucugacuacccuucgagcacuguacuuguccgacaacgauuucgaaauccucccaccugacauuggaaaacugacaaaguuacaaauccugucucuccgugauaacgaccuuauaagccugccaaaagagaucggcgaguugacccagcuaaaggaacugcauauucaggguaauagacucacugugcugcccccugagcuugggaaccuggauuugacaggacagaaacaaguuuuuaaggccgaaaauaacccaugggugaccccgaucgcggaccaguuccagcucggcgucucccacguguuugaguauauuaggucagaaacguacaaguaucuguacggccggcauaugcaggcuaaucccgagccucccaaaaagaacaaugauaaaaguaagaaaaucagccgcaagcccuuagccgccaaaaacagauga

SEQ ID NO: 62075 - RNA, 1518 nt, Artificial Sequence
  derived and/or modified sequence opt3 from RTCB__Homo_sapiens__NP_055121
augucaagauccuacaacgacgagcugcaguuccucgaaaagaucaauaaaaacugcuggaggauuaagaaaggcuuugugcccaauaugcaagucgaggggguuuucuaugugaacgaugcccuugaaaagcugauguuugaggaauugcggaaugcuugucgcggagguggcguagggggauucuuaccugcaaugaaacagauaggcaacguggccgcgcugccagguaucguccaccgaucuauugggcuaccggacgugcauucaggauacggcuuugcuaucggcaauauggccgcauucgauaugaacgaccccgaggccguugugaguccugggggagucgguuuugauauuaauugcggcgugcgucuccugagaaccaaccuugacgagagcgauguacagccaguuaaggaacagcuggcucaagcaauguucgaccacauccccgugggggucggauccaagggcgugauaccuaugaaugccaaagauuuggaggaagcucucgagauggguguggacuggucucugagggagggguaugccugggcggaagauaaggagcauugugaagaguacggacggaugcugcaggcagacccaaacaaagucucggcccgcgcuaagaaaagaggccucccccaguuaggcacacugggggccggaaaucacuaugcagaaauccagguuguggaugagauuuuuaacgaguacgcugccaagaagauggguaucgaccauaaaggccaaguaugcgugaugauucacucagggagcaggggacuuggccaccaggucgcgacugacgccuugguggcaauggaaaaggcuaugaaacgggauaagaucauaguuaaugaccgccagcuggccugugcucgaauugccaguccugagggucaggauuaucuaaaagggauggcagccgcuggcaacuacgcgugggugaacagauccucuaugacguuccucaccaggcaagcauuugccaaggucuucaauacaacuccagacgaucuggaccuucaugugaucuacgauguaagccacaacauugcuaaaguugaacagcauguggucgacggaaaggagcggacccuguuggugcaccguaagggcuccacacgcgccuuuccgccccaccauccucucaucgcagucgauuaucagcugaccgggcaaccaguguuaaucggagguacuaugggcacaugcucauacguucugaccgggacggaacagggaaugacugagaccuucggcacaacuugucacggugccgggagagcucucaguagggccaaaagccggcgaaaucuugacuuccaggaugugcuggacaaguuggcagacaugggcauugcgauacgcguagcuucucccaagcuagucauggaggaagccccugaguccuauaaaaacgugaccgauguugugaauacaugccaugacgcaggaaucagcaaaaaggccauuaagcugagaccaaucgcugucauaaaaggcuga

SEQ ID NO: 62076 - RNA, 3903 nt, Artificial Sequence
  derived and/or modified sequence opt3 from RTEL1__Homo_sapiens__NP_001269938
augcccaagaucgugcugaacggcgucaccguugacuucccuuuucagccauacaaaugccaacaggaguauaugacaaaggugcucgaaugucuucagcagaaaguaaaugggauucuggagagcccgacuggaacggguaagaccuugugcuuacuguguacaacucuagccuggagagaacaccucagggauggcauauccgcucggaaaaucgcagagcgcgcccaaggggaacuguuccccgaccgagcgcuuucuucauggggaaacgcugccgcagccgcuggcgauccuauugcaugcuacaccgacaucccaaagauuaucuaugccagucguacacauagccagcugacccaggugauaaaugaguugagaaacacuuccuacaggcccaaggucugugugcucgguucucgggagcagcugugcauccacccugaaguuaaaaagcaagagucgaaucaucugcagauucaccucugucgcaaaaagguggcuucaagaagcugccauuuuuauaacaaugucgaagagaaaaguuuagagcaggaacuggccuccccaauccuugauauugaggacuuggugaagucugggagcaagcacaggguaugucccuacuaucugucccggaaccuaaaacagcaagcggauaucauauucaugccuuacaauuaccuccuggacgcaaagucacgccgagcccacaacauugaucuuaaaggaacaguugugaucuuugacgaagcucauaaugucgagaagaugugcgaagagagugccagcuucgaucugaccccacacgacuuggcaucuggccucgaugugauugaccaggugcuggaggaacagacgaaagcugcccaacagggcgagccgcaucccgaauuuuccgcggacucaccuagcccaggguuaaacauggagcuggaagauaucgccaagcucaaaaugauccuucugagauuggagggagcaauugacgcugucgagcuacccggugaugacaguggcguuacuaagccugggucuuauauauucgaacuguuugccgaggcucagaucaccuuccagacaaagggauguauucucgauucccuggaccaaaucauacagcaccuugccggcagggccgguguguuuacuaauaccgccgggcugcagaaauuggcugauauuauccagaucguauucagcguggacccaucggaaggaucucccggcuccccggcgggccucggggcacugcaaucauacaagguccacauucauccugaugccggacaccggcguacagcucagcgcagugacgccuggagcaccacggcagccagaaaaagggguaagguguuauccuauuggugcuuuucucccggccauagcaugcacgagcugguucggcagggggugcgaucacuaauccucacaaguggaacucuggcuccagucuccagcuucgcccuugaaaugcagauuccuuuccccgugugcuuggagaacccacauauaaucgauaaacaccaaauuuggguaggcguugugccccgcgguccugacggggcacagcugucuucagcguuugacagaagguucagugaggaaugucucagcucccugggcaaggcucuuggaaauaucgcccgggucgugccauacggccuguugaucuuuuucccgucuuaucccgucauggagaagucgcucgaauuuuggcgcgcaagagaucuggccaggaaaauggaggcuuuaaagccucuguucguggagccacguagcaaaggguccuuuucagaaaccauuagugccuacuaugcacggguugcugcccccggaucuacuggugcgacauuccuagccgugugccgaggcaaggcuagcgaggggcucgacuuuuccgauaccaacggaagaggcguaauagucacgggucugccuuacccacccaggauggacccgcgcgugguucuuaaaaugcaguucuuggaugaaaugaaggggcagggcggagcaggcgggcaauuucugucaggacaggagugguaccggcagcaagccagcagagcugugaaccaggccaucgguagggucauucgccaccgacaggacuauggcgcaguguuccucugugaucaucgguuugcguucgccgacgcucgugcccagcugccuucuuggguaagaccacacgugaggguuuacgauaauuucgggcaugucauccgcgacguggcacaauuuuuccggguggcugaaagaaccaugcccgccccugcacccagggccacagcuccauccguccgaggagaggaugcgguuagugaggccaagagcccuggccccuuuuucucuacucgcaaagcaaaguccuuagaccugcacgugccaucacuuaaacagcggaguagcgguucgccggcugccggggauccugaauccucuuugugcguggaguaugaacaggagcccguaccagccagacagaggccccguggccuccuggcugcacuagaacacagcgagcaacgcgccggaucaccuggcgaggaacaggcgcauaguuguuccacccugucucuccugagcgagaagcggccagcugaagaacccagagggggaaggaaaaagauucgacuugucucccacccugaggagccgguggccggcgcacagacagaccgggccaaguuguuuaugguugcugugaaacaggagcugucacaagcaaacuucgccacuuuuacccaggcguuacaggacuacaaggguagcgaugacuucgcugcccucgcagccugccuggggccacuuuuugcugaagaucccaaaaagcauaaucuguugcaaggauucuaucaguuuguccgcccucaccauaaacagcaguucgaggaaguguguauccaacucacaggcagagguugcggcuacaggccagagcacaguauaccccggcgacagagagcccagccuguucuggacccgaccgggcgcacugcacccgauccaaagcuaacggugucuacagcugccgcgcagcaacuggacccucaggagcaccucaaccagggaaggccccaucuguccccacguccucccccaaccggcgauccggggagccagccucaauggggaucgggcguaccccgggccgguaaacaggggcagcacgcagucucagcuuaucuugccgacgcuagaagggcauugggaucugccggcuguagucagcuguuagccgcucucacugcguacaagcaagaugacgaucuggacaaggugcuugcagugcuggccgcucuaaccacagccaaaccagaagauuuuccccuccugcaucgcuucuccauguucguccgaccucaccauaagcagagauuuagccagaccugcacugacuugacaggucggccauaccccggcauggagccuccggggccacaagaagagaggcuggcaguucccccuguguuaacgcaccgcgcaccccagccaggaccuucucguagcgagaaaaccggcaagacucaguccaaaaucucaaguuuccucagacagcggcccgcugggacaguaggagcgggcggugaagacgccgggccaagccaaucuuccggaccuccgcacggccccgcagcuucagaguggggugaaccacauggcagggauauugccgggcagcaggcaaccggagccccuggcgggccccugagugcuggaugugugugccagggcugcggugccgaggacgucgugccauuucaauguccugcgugcgauuuccagcgcugucaggcaugcuggcagcgacaccuucaagccagcagaaugugucccgcuugccauacagccucccggaagcagucuguuaugcaaguguuuuggccggaaccacaguga

SEQ ID NO: 62077 - RNA, 492 nt, Artificial Sequence
  derived and/or modified sequence opt3 from RTKN2__Homo_sapiens__NP_001269870
auggagggccccagccugagagggccugcccucaggcuugcuggacugccaacccagcaagacugcaacauccaggaaaagauugauuuggagauacggaugcgcgaagguaucuggaaauuacugucccuaucuacacagaaggaccaggugcuccacgcagucaaaaaucugaugguuuguaacgcccgacuuauggcguacacuucagagcugcaaaaguuggaggaacagauugcuaaucagacgggccguugcgaugugaaauucgagaguaaggaaagaaccgccuguaaggggaaaaucgcaauuagcgacaucaggauaccgcucauguggaaggauuccgaccauuuuucuaacaaagagcggucgcgcagauaugccaucuucugccuguuuaagaugggagcuaauguauucgauacagacguggucaacguggauaaaacuauuaccgacaucuguuuugaaaauguuacaauucuguga

SEQ ID NO: 62078 - RNA, 1692 nt, Artificial Sequence
  derived and/or modified sequence opt3 from RTKN__Homo_sapiens__NP_001015055
auguucagcagaaaccacaggucccgggugaccgucgcccgcggcucugcucuggagauggaauuuaagcgagggcguuucagacucucacuuuuuagugaccugcccgaggauacagaauugcagaggaaauuagaccaugagauccggaugcgcgaaggagcaugcaagcugcuagccgcguguagccaaagagagcaggcucucgaggccacuaaaucccugcuuguuugcaauucuaggauucugucguacaugggugaauugcagcggcgcaaggaggcacaggugcucggcaaaacgucacgaagaccuagcgauagugggccaccggccgaaaggucccccugucggggacguguaugcauaucugaccugcgcaucccucugauguggaaggauaccgaguauuucaagaacaaaggcgaccuccacagaugggcuguguuuuuacugcuucaauugggugagcauauucaggauacagaaaugauccuggucgacaggacucuaaccgauauuagcuuccaguccaaugugcucuuugcagaggccgggccagacuucgaacugcggcuugagcuguacggagcuuguguugaagaggagggcgccuugacaggcgggcccaagcgacucgcgaccaaacugucaaguagcuuaggacgcuccuccgguagaagggugcgggcaucacuggauagcgccggcgggaguggaucuuccccuauccuccuuccaacucccgucgugggcgguccucgcuaucaccuguuggcucauacaacccuaacgcuggccgcaguacaggacggguuuagaacucacgaucucacccuggcuagccacgaagagaacccagccuggcuuccgcuguacggaucgguuugcuguagguuggcggcccaaccccucugcaugacacagccuacugcaucuggcacccugcgugugcagcaggcuggcgaaaugcaaaauugggcccagguccaugggguguuaaagggaacaaaccuguucuguuaucggcagccagaggacgcugacaccggugaggaaccccuacucacgauagccgugaauaaagagacucgagucagagcaggcgaacuggaucaagcccuugggaggccuuuuacauuguccaucucaaaccaguacggagacgaugagguuacccacacucugcagacagaaagucgcgaggcucuccagagcuggauggaagcgcuguggcaacuuuucuuugacaugucccaguggaagcagugcugugaugagauuaugaagaucgagaccccagcaccccggaaaccgccucaggcccuggcuaagcaaggcucuuuguaucaugaaauggccauugagccccucgacgauaucgcagccgugacggacauacugacccagagagaaggugcuagguuagagacaccaccucccuggcuggccauguucacugaucagccagcacuacccaauccuugcagcccagcgucaguagcuccggcccccgacuggacccacccucucccaugggggcgcccccgaacauucagucuggaugcagugccuccagaccacucuccccgggcccguagcgucgcuccgcuuccuccacagagaucucccaggacucgcggcuugugcucaaaaggacaaccucggaccuggcugcagagucccguguga

SEQ ID NO: 62079 - RNA, 4077 nt, Artificial Sequence
  derived and/or modified sequence opt3 from RTL1__Homo_sapiens__NP_001128360
augaucgagcccagcgaagacuccuucgagaccaugauggaacacaagaacccuucuucaaaacagauggagaguagcgaaggcuccucuaauacaacugaggccacgucggggucaggagugagaggugaggcuggcccagcaagcgggccggcccaagaaaagaaagagcccccuaguggaccacugcaggaaauggaggagcuccccaccgaucuucugcaggacauggaagaaccuuccucuggcccaaggaaggaaauugaggaucccccuaacgacuuguuacaggaucuggaagagagcugcaaugguucccaucaagcgcggggcgacccacuaucaggagcuagugaucgcaugaaagaggccagcgucaacccgucuggcgcacgagaggagcaggaagcccacacagaccucaaggaguccggccgugaagagacuccccaggagcagaaucaaaccgaacauucaacagcugagcugauggcaaugguuagaagcauaaucagucuuuacuuuaggaugcaggaucugaaggaacagcagcggguggccgaggaaauuuugaucaaagggauuaacgcuggacaacucccugccccaaagcacuucucuggugaccgcagagaguuucaugaguucaucguacugugucagcugacccuccaguccuaucccaggauguuuuacaaugaucgguuacgcgugggcuaugucauaaaccaccugagcgggcuugcguuggaaugggcaaaagcccugcuacaagaaaauucgccucucaucggagacuucccagcuuuucuggaagccaugucugagguguucgaguaccgacaggcacuuagaguugcugaagaggccauguuuacuauuaggcagggcggucgguccgcgacagaauauaucgaugaguuccagucacuggugcccauuuugggguggccggacgaaguccuccaagcccaccugugccagggauuaaacgaggagauccgucauuaccuguuucgcgugccucagcccgacagucucgauagccuuauaguacugauuuugcagaucgaagagaagcuagcagaaagaagggcuaugcugcggcucccaccugaggcccgaccccgcaaucugaccuggauugacuccccagcucccgaaagauggaugguuucuagcuggcuuccuucagaggugcacccagauaucaacagggcccaucuguucuugcuccugaugguccgggugaauccguaucacaguguggcaguccaagccuuaguugacuccggcgcugauggcaacuuuauggacgagaaauucgcgcaggaacacuacguggagcuguacgaaaagcccuauccucagccaguacagagcguggaugggucucuaaucggaaaugagcccgucuggcucuacacggaaccucugguguguauucaucaaaaccaccaggagucaauagaguucgacaucguuccaagucccaacuuuagcgugguccuugguauucgcugguugagagugcaugcaccggaaguagauuggaucaaggggaggugcacuuuccacuccccuuauugucugaaaaauugcuuucguccacccccucccuguauagcccucgagcggcaugggaugucucugcuuccaggacugccucaccccuacucggacuuggcugauguuuucaacccaaaggaagccgacgacgagaccagcgaucagccguccucagacggcagugaugaccucucugagagcgaaccuuccgagcugcagcaagccggugauucagaccacagcgaaacauuuuaugagugccccucuacugcaccaugggaacccgugggggcucgaaugcaggagagagccagguuacaggaggaauacugggaucugcaagacaugcuaaccaaucgccaggauuauauucagaugaucccugaacucuucgaccagcugcauggcgcagaaugguuuacaaaacuugaguugcggggaaccaucgucgaagaguccgugaacggccacagaacggaggaugucuggaaggcggcuuucgggcuggaacucgaggaaaugaaaaguuaccaaccauuugcccugagccccgacccuauuaucccgcagaaugugauucauuucauauuaaaggauaugcugggauuuuucguucuuucuuacggucaggagguguugaucuauuccaugucacaggaggagcaccuccaccauguaaggcaaguccuggugcgcuuucgacaccauaacguuuacuguagucuagacaaaagccaguuccaccggcagacuguggaguuccugggcuuugucgugacaccaaaggggguaaagcucaauaaaaacgugaugaccauuaucacuggauaucccacaccuggcucgaagcugucccuucguaauuucaucgaauuuguuuucccauacagacauuuugucgagagguucucuauuauagcagaacccuuggugcgccagcuguuaagcucauaucaauuuuacugggguguggaggagcaggaagccuucgagugccucaaacgggcuuuuagaaaggccccucugcuucaccacccgaaaccccagaacccauucuaucuggaaaccggggucacgggcaccgcauugcaugcuagucucauccaaauugacgaucagacaggaaagagggccuguugcgcguuuuacucccgaaauaucucuccuauugagguugaauacagccaggccgagaugaagauccugcccauacgcgcugcauucaugguguggugccgguaucuagagaacacugaggagccaaucaugauucugcucaauaccgaagaccuggccucccuuaacaaugauagauugacagugcuguuaccuggccacuggguauuuuucuucucacauuuuaacuucgacgucauggagcuccccgaacaggaugggggaagggcucugccaccggugcguaaccuucgcuggcggagagccuuucaaaggaauacugcagcgcgacagacccugcuacucgccagccgggguuucccucgcgaccccaguacagagucuggcgaggaagagaacgaggaacaggaugaacugaaugagcagaucuugagacaagagcuguuagcuaugauuccaaucgaccagauacucaacuccuuucuggcccacuucagcauggcacagauuagggcuguuauccuucacuuuuuccgggggcuguuguacuggaaaaauacccucgcccuggcagccauucuagugcugcuucgagucagacagugucucucgcugcgccccgcuccugcgaugaggguggcccguccacaaccccagcggucauugagacugaucuuagauucuagucucauagcaggauccagcaucacuacggcuauuacacagcugcuuacccagaugccugcccugguuggcgccaacacuaucccggcucaagaauuggcagagcucuuucuggguccagggagguggcagcgcaaugcccuacacucucaggcgcaccgaggccugcaauucacccccggauuuuggcuuacacucugcgaguucuucggcgugagaguaaccccucaggaagggcaucugcccgcuuugcggcagaacagguauuuagagcugcacgucgugggagacgaagaugugguccuccgcgaggcccugcaggacgaucuucaacguuacagacaguguggccugcaugacgguuugcaggacacuagccaggauaagcaagacaaugauguucaggaagcaccaccuucccacacagccgcuacgcacccgccacggccuaggcaucuaauggacccccaggugcuggaguuucucgggucacgccugcuucacauucauagugcagauggacaguuacaucugcucagccgagaacaagccgcgagagcuuugucucaguuccugacccucaucuaucggagggcccugcccauaccagcaugggagucccagccucgcgagcaagccagacuugaggaacugcccgacgaagaugaggacgcuaacuuggauuga

SEQ ID NO: 62080 - RNA, 2331 nt, Artificial Sequence
  derived and/or modified sequence opt3 from RTN1__Homo_sapiens__NP_066959
auggccgcucccggcgacccucaggaugagcugcucccacuugcagggccgggaagccaauggcugagacacaggggugaaggcgagaacgaagccgugacccccaagggggcgacuccugcuccacaggccggagagcccuccccuggcuugggugcacgggcccgcgaagcugcaucucgagaggccgggucaggaccagcucgucagagucccgucgccauggagacagcgagcacgggcguugcaggcguguccucugccauggaccauaccuucucgacaacuucaaaagauggggaaggaagcugcuacaccaguuuaaucuccgacauuuguuauccuccacaggaggauucuacauacuuuaccgguauacugcaaaaggaaaauggccacguaacuaucagcgaguccccggaggaacuagggacacccggaccuucacucccagacgugcccggcauugagaguagaggucuguucagcucugauuccgggaucgaaaugaccccugcugagucaacggaagucaacaaaauucuugccgacccacuggaucagaugaaggcagaggcuuauaaauacaucgacauaacuaggcccgaggaagugaagcaucaggagcagcaccauccggaauuggaggauaaggaccucgauuuuaaaaauaaggacaccgacaucagcauuaaaccugaaggaguucgggagcccgauaagccagccccuguggagggcaaaaucauuaaggaccaccuccuggaagagaguacauucgcgcccuauaucgaugaccucucugaagaacaacgcagagccccacagauaacuacccccgucaagauuacauuaaccgaaaucgagccuuccguggagacgacuacacaggagaaaaccccagagaagcaggauauuugccugaaaccgagccccgacacuguaccuacaguuaccgugucggaaccagaggaugacucucccggcuccaucacgccuccaucaagugggaccgagcccagcgcagcugaaucccaaggaaaggguucuaucagcgaggaugaacuuauuacagccauaaaagaggcuaagggcuugucauacgaaacugccgagaacccgaggccugucgggcagcuggcagaccggccagaggugaaagcccgcaguggacccccuaccauccccuccccacuagaucacgaagcuagcucugcggagucaggcgacagugaaauugagcucgugagcgaagacccuauggcagccgaggaugcucugcccuccgguuaugucucuuuugggcauguuggcggaccaccgccuucgcccgccagcccauccauccaguacucaauacuucgagaggaaagagaggcagaacuggacagugaguugauuaucgaaucuugugaugccagcuccgcuucagaggagagccccaagagggaacaagacucuccuccaaugaagcccuccgcccucgaugcaauccgggaggaaacaggcgugcgugcggaggagcgcgcuccuaguagaagggggcuggccgaaccggguagcuucuuagacuacccaucuacugagccccagccuggaccagaacugcccccuggcgauggggcacucgagccggaaacccccaugcuuccacggaaaccugaggaggacuccucaaguaaucagagccccgccgcuacaaagggaccaggcccucugggucccggggccccaccgccuuugcuauuucugaacaaacagaaggcaauugaucuccuguauuggcgagacaucaaacaaaccggcauuguauucggaucguuucuucuguugcuguucucccugacucaguuuucuguggucagcgugguugcuuacuuagcccuggcggcccuaucagcuacgauaaguuuccgcaucuauaaguccgugcuccaggcaguccagaagacagaugaaggccaccccuuuaaagccuaccuggagcuugaaauuaccuugucucaagagcagauccagaaguauacugacugccugcaguucuacgugaauagcacccucaaagaacugagaaggcuuuuccugguacaagauuugguugacucccucaaguuugcugugcugaugugguuacugacauaugucggggcccuauucaacggacucacccugcuuuugauggcaguggucucaauguuuacucugccagugguuuacgugaaacaucaggcgcagaucgaccaguaccucggucugguacggacacacauuaaugccgucguggcuaagauacaagccaagauccccggcgcaaaacgccacgcugaguga

SEQ ID NO: 62081 - RNA, 1638 nt, Artificial Sequence
  derived and/or modified sequence opt3 from RTN2__Homo_sapiens__NP_005610
augggccaggugcugcccgucuucgcccacugcaaggaggcuccuagcaccgcauccucuacaccagacucaacugaagggggaaacgaugacagugauuuuagagagcuccauacggccagggaauuuagcgaggaagacgaggaggaaaccacaucccaagauugggguacuccgcgggagcuuaccuuuucuuacaucgcguucgacggcguuguggggucgggaggccgccgagauucaacagcucguagacccaggccucagggucggagcguaagugaaccacgcgaccagcacccccagccuucccugggggauucuuuggagagcauuccauccuuaucacaaagucccgagccuggaagaaggggcgacccagauaccgccccgcccagcgaacggccucuggaggaccuacgccuccgacuggaucaucuuggcuggguggcaagagggacuggaucuggugaagacuccucaacaagcaguucuaccccacuggaggacgaagaaccccaggagccuaauagguuggaaacgggcgaggccggggaggagcucgaucugcggcugcgucucgcucagccauccagccccgaagucuuaacuccgcagcugucgccuggaucuggcacaccccaagcagguaccccauccccuucacgcaguagagacagcaacuccgggcccgaggagccacuuuuggaagaggaagagaaacaguggggaccccuggaaagggagccugugcggggccagugucuagauucuacugaccagcucgaguuuaccguugaaccacgacugcuuggcacagccauggaguggcugaagaccagcuugcuccuggcuguguauaaaacggucccgauauuagaacugucacccccucucuggacugccaucgggugggugcaacgcggaccaacacccccuaccccaguacuuagaguucuguugaagugggcgaaaagucccagguccagcggugugccgucucuaucacugggcgcagauauggggaguaaggucgccgaccuccuguacuggaaggauacucggacaagcggagugguguucaccggccuuauggucucccuguugugccuccugcacuuuucuauuguuucgguggcugcccauuuagcacugcuacuccugugugguacgaucagccuucgcguauauagaaaaguguugcaggcuguccaccguggggacggcgccaauccuuuccaggcguaccuggauguggaccucacccugacaagggagcaaacugagcggcuuucccaccagauuaccucacgaguugugagugccgcaacacagcugagacauuucuucuuggucgaagaucucguggacucucugaaguuagcucugcuauuuuauauccucacuuucguaggagccauauuuaacggccugacccuuuugauccuggggguuauuggacucuucacaaucccacuguuauacaggcagcaccaagcucagauugaccaguaugugggucuggucaccaaucagcuuagccauaucaaagccaagauacgcgcaaaaauucccggcacuggggccuuggcuuccgcggcagccgcugugucaggaagcaaggccaaggcagaguga

SEQ ID NO: 62082 - RNA, 3099 nt, Artificial Sequence
  derived and/or modified sequence opt3 from RTN3__Homo_sapiens__NP_001252518
auggccgagcccagcgcugcaacccagucccacucuaucucaaguagcuccuucggcgccgaaccuucugcgccagggggagguggcucgccgggggcuugccccgcccugggaacaaagucauguagcaguuccugcgcagacucuuuugugagcuccucaaguagccaaccugucucucucuucuccacuucacaggagggccuuagcagucuguguucugaugaaccauccagcgagauuaugacgucguccuuuuuguccucaagugaaauacauaacaccgguuuaacaauccugcacggggagaaaagccauguucuaggaucccagcccauucucgccaaggagggcaaagaccaccuggaucuucuggacaugaagaaaauggaaaagccucagggcacuucuaauaacgugagcgauucaaguguauccuuggcugcaggggugcauugcgacagaccaagcauccccgccucuuucccugagcacccagcuuuucucucaaagaaaauuggacaagucgaagaacagaucgauaaggagaccaaaaauccgaacggugugaguagcagggaagccaagacagcgcuggacgcagaugaccgguucacccugcucacugcccagaaacccccuacagaguacuccaagguugaaggcauauauaccuacucuuuaucgccaagcaagguguccggggaugacgucaucgagaaagauucacccgaaaguccuuuugaggugauuaucgacaaggcugccuucgacaaagaguuuaaggauucuuauaaagaaagcacggacgauuucggauccuggucaguacacacugacaaggagagcucugaagauauuuccgagaccaaugacaaacuguuuccacuucgcaacaaggaagcaggccgauaccccaugagugcuuugcugagccgucaguucucucauacaaaugccgcgcuagaggagguuuccagaugugugaacgauaugcacaauuuuacuaacgaaauccucaccugggaccuggucccgcaagugaagcagcagacagauaaaucaagugacugcauaaccaagacgacuggucuugauaugagcgaguauaauucggaaauuccuguggucaaccugaaaacauccacccaucagaagacucccguuuguucuaucgacgggagcacaccaauuaccaaaucaacgggagacugggccgaggcaaguuugcaacaggaaaaugcuaucaccggcaagccugugcccgauucccucaacucuacaaaggaguucagcaucaaaggcguacaggggaauaugcaaaagcaggacgauacucuggccgaguuaccaggaucucccccugaaaaaugcgacucacuggguagcggcguggcuaccgucaaggugguucucccagaugaccaccuuaaagaugagauggacuggcagaguucugcccugggggaaauuacagaggcagauuccagcggagagucggacgauacugugauagaagacaucaccgccgauacaucauucgagaacaacaagauucaggcugaaaagccggucucuauccccagugcggugguaaaaaccggcgagagggaaauaaaggagauuccuuccugugagcgggaagagaaaacuagcaagaauuuugaagaguugguuucugacagcgaacuacaccaagaccagccagauauccugggucgcucccccgcaucagaggccgcuugcaguaaagugccugacacgaacgucagccucgaggaugugucugaagucgccccagagaagcccaucacaaccgaaaauccgaagcugccuuccacugugucaccaaacguuuucaaugagaccgaauuuagucuuaacgugacaaccagcgcauaccuggaguccuugcaugggaaaaauguaaagcacauugacgauucuucgcccgaggaccucaucgccgcuuucacugaaacaagagauaaaggcauugucgacagcgagaggaacgccuuuaaggcaauaucagagaaaaugacggauuucaagaccacuccucccguggagguucugcaugagaaugaauccggaggcagugagaucaaagacauugggucuaaguauagcgaacaguccaaggagacaaacggaucagaaccauuagguguguuuccuacccagggcacacccgucgcgucucuggaucuagagcaagagcagcucacuaucaaagcucugaaggaacuuggggagcgccagguggagaaaagcaccagugcccagcgggacgcagaauugccauccgaagagguacugaagcaaacguucaccuuugccccggagagcuggccucagcgaucuuacgauauccucgaaagaaaugugaaaaacggaucagaccugggcauuucccagaagcccauaacaaucagggagacuacccggguugacgcugucaguagccuuucgaagacagaacuggugaaaaagcacguguuggcccgucuccugacugauuucucuguccaugacuuaaucuuuuggcgcgauguuaaaaagaccgguuucguguuugggacgacacugauuaugcuacucucccuggcagcuuucagcgugauuucaguagucaguuaccuuaucuuggcccugcucucugugaccauauccuucagaaucuauaaaagcguuauucaggcggugcaaaagucagaggaaggccacccauuuaaggccuaccuggacgucgauaucacuuuaaguagcgaggcuuuccacaauuauaugaacgcagccauggugcauauuaauagggcucugaaacuuaucauacgguuguuucucguugaggaccugguggauucccuaaagcuggccguauucauguggcucaugacauacgucggagcaguguuuaacggcauuacccugcuuaucuuggcggaacuguuaauuuucucugugcccaucgucuaugagaaauacaagacucagauagaccacuauguugggaucgcccgagaucagaccaaaagcauuguggaaaagauccaagcuaagcucccuggaauugccaaaaagaaagcagaguga

SEQ ID NO: 62083 - RNA, 600 nt, Artificial Sequence
  derived and/or modified sequence opt3 from RTN4__Homo_sapiens__NP_008939
auggacggccagaagaaaaacuggaaggauaaaguggucgaccugcucuacuggagagauaucaagaaaaccgggguuguguucggagccagccuuuuucuguuguuaucccugacaguauucucuauugugucagucacugcuuauauagcacuagcccuccugagugugacgaucagcuuuaggauuuacaaggguguuauccaagcgauucagaaguccgacgagggccaccccuuccgggcuuaucuugaaucugagguggccaucucggaggaacugguccagaaauacucaaauagcgcauuggggcaugugaacugcaccauaaaggaacuccgccgacuguuucugguagaugaccucguugauaguuuaaaauucgccgugcugaugugggucuuuacauaugugggagcucuuuucaauggcuugacucugcuaauccucgcacugauuucccuguuuucugugccugucaucuacgagcgucaccaggcccaaauugaccauuaucuugguuuggcuaacaagaauguuaaagaugccauggcgaagauccaggcaaagauaccagggcucaaaagaaaggccgaguga

SEQ ID NO: 62084 - RNA, 1191 nt, Artificial Sequence
  derived and/or modified sequence opt3 from RTN4IP1__Homo_sapiens__NP_116119
auggaguuccugaagaccugcgugcucagaaggaacgccuguacagcugucugcuuuuggcggagcaaaguugugcagaagcccuccguacgccgaaucucuacuacgucaccucguaguaccgugaugccagcaugggucauugacaaauacggcaagaaugaagugcuuagauucacacaaaacaugaugaugccgauaauccacuaucccaaugagguuauugugaaaguccaugccgcgagcgugaacccuaucgauguaaauaugagguccggguacggagcuacugcccugaacaugaagcgggacccauugcacguuaagauuaaaggugaagaguuucccuuaacccugggccgcgaugugucuggggucgugauggaauguggacuagacgugaaguauuucaaaccuggcgaugaggucugggcagccguuccacccuggaagcaggguacacucucggaguuugugguagugucagggaaugaagucagccauaaaccuaagagucugacccacacucaggcugcaucccuuccauacguggcccugacagcuuggucugccaucaacaagguuggaggcuugaaugacaaaaacugcaccggcaagagagugcucauacugggggcgagcggaggugucggcacguucgcaauccaggugaugaaagccugggaugcucauguaacugccguuuguucccaagacgcaucagagcuggugaggaagcucggggcugaugacgucauugauuauaaaaguggaagcguggaggaacaguuaaagucucugaaaccguuugacuucauccuugauaaugucggcgguuccaccgagacaugggcccccgacuuuuugaagaaguggucaggggcgacuuacgugacccugguuacaccuuuccuacucaacauggaccggcugggaauugccgauggcaugcuucagaccggcgugacgguagggagcaaagcacugaagcacuuuuggaaaggaguccacuaucgcugggcuuucuuuauggccagugguccaugcuuggacgauaucgcugaacucguggacgccggcaagauacgacccguuauugagcagacuuucccuuucucuaaagugccagaagcauuucugaaggucgagagagggcaugccaggggaaagacagugaucaauguaguguga

SEQ ID NO: 62085 - RNA, 1422 nt, Artificial Sequence
  derived and/or modified sequence opt3 from RTN4R__Homo_sapiens__NP_075380
augaagagagccagcgcuggcggguccaggcugcucgcaugggugcuuuggcugcaggccuggcaagucgcggcucccugcccuggagccuguguuugcuacaacgagccaaaagugaccacaucuuguccgcagcaggguuugcaggcaguacccgugggcaucccugccgcuucacaacggauuuucuuacacgggaaucgcauaagucaugucccagcagccagcuuucgagcuugccguaaccugacuauccuauggcuccacuccaaugugcuggccagaauugacgcggcagccuucacgggacuugcucuguuggaacagcucgaucugucugacaacgcccagcugaggucgguugaucccgcaaccuuucauggccucggucgguuacacacacugcaucuugaccgcuguggguugcaggagcugggaccuggccuauucagaggccucgcugcccugcaauaucuuuaccugcaggauaaugcguugcaggcccucccagacgauacuuuuagggaccuggggaacuuaacccaccuguuccuccacggaaaucggaucucaagcgugcccgaacgcgcauuucgaggucuucauagucuggauagauugcuacugcaccagaacagggucgcucaugugcacccucacgccuuccgggaccucggccgucugaugacacuuuaucuguuugcuaauaacuuguccgcccucccaaccgaggcacuggccccguuacgcgcucugcaauaccuaagacucaaugauaaccccuggguaugcgacuguagggcgcggccucugugggcauggcuucagaaguuccgagggucuagcuccgaaguuccaugcucauugccccagcgccuggccggaagagaucucaaaaggcuggcugccaaugaccuucaaggcugugcaguggccacugguccuuaucauccaauuuggacagggcgggcuaccgacgaggagccccugggauugccgaagugcugucagccugaugccgcagacaaagcgaguguccucgaacccggccgcccagcuagcgccggcaacgcacugaaggggagagugccucccggagauucuccacccgguaauggcuccgggccuaggcacaucaacgacucaccauuuggaacguuaccgggcagcgccgagcccccucugacugcugugcguccagaagguagugagcccccuggguucccaaccucuggcccccggcgaagaccgggaugcuccaggaagaaccgcacacggagccauugcagacuaggccaggccgggucgggagguggcgggacuggagauucugagggcuccggugcacucccuucacugaccuguagucuuacaccauuggggcuggcucucguccuguggaccguuuuaggccccugcuga

SEQ ID NO: 62086 - RNA, 699 nt, Artificial Sequence
  derived and/or modified sequence opt3 from RTP3__Homo_sapiens__NP_113628
auggccggcgacaccgagguguggaagcagauguuccaagaacugaugagagaggucaaacccuggcacagguggacacuccggccugauaaggggcuucugccaaacguuuugaaaccgggauggaugcaguaccagcaguggacuuuugcucgcuuccaaugcagcuccuguucucgaaauugggcaucagcccagguguuaguacuguuucauaugaacuggagugaagaaaagagccguggucaggugaaaaugagagucuucacgcagaggugcaagaaguguccccaaccucuauuugaggacccagaguucacccaggagaauaucucccggauucucaaaaaccugguguuucgcauacuuaagaaaugcuauagaggcagguuccagcugaucgaagagguucccaugauuaaggauaucucuuuggaagggccucacaauucggacaacugugaggcgugccuccagggauuuugugcuggcccaauucaagugacaucacugcccccuagccagacuccacggguccauaguaucuacaaaguggaggaaguaguuaagccgugggccuccggugagaauguguauucuuacgcaugccagaaccacauaugucgcaaucugagcaucuucugcuguugcgucauucucaucgugauuguggucaucguugugaagaccgccauauga

SEQ ID NO: 62087 - RNA, 741 nt, Artificial Sequence
  derived and/or modified sequence opt3 from RTP4__Homo_sapiens__NP_071430
augguggucgacuucuggaccugggagcagacauuucaagaacugauccaggaggccaagcccagagcuacuuggacgcucaaacuugauggcaaccugcaguuggacugcuuagcacagggguggaagcaauaccagcagagggccuucggaugguuucgguguagcuccugccagcgcucuugggcgucagcucaaguucagauucugugucacaccuauugggaacauuggacaagucagggucaggugcgaaugcgucuauucggccaaagaugccagaaauguagcuggucccaguacgagaugccugaauuuucuucggauucaacuaugaggauacucagcaaucugguacaacacauccuuaagaaauauuacgggaacggaacccggaagaguccagagaugccggugauucuggaggucuccuuggaaggcucucaugacacagccaauugcgaggcauguacccucgguaucugcgggcagggacuuaagagcuguaugacuaaacccuccaagucacugcucccucacuuaaaaacaggcaacaguagcccaggcauuggggccguguaucuggcuaaucaggcaaagaaccagucugccgaagcuaaagaggccaagggauccgguuacgagaagcugggccccucacgcgauccugacccauugaauaucugcguuuucauacugcuacucguguuuaucgucgugaaauguuucaccagcgaauga

SEQ ID NO: 62088 - RNA, 6681 nt, Artificial Sequence
  derived and/or modified sequence opt3 from RTTN__Homo_sapiens__NP_775901
auggugcuggcaggccucauccggaaacuugggcaccagcuggcugagauuagggaacgggcauugaaaagcauauuaugcaagaucgagcauaaccugauuuguuacgccgaccuuauccaggaacgccaacucuuccugcaccuucuggagugguuuaauuuccccuccgucccuaugaaggaagagguuuugaaccuccugucucgacuggugaaguauccaccggcgguacagcaccucguggaugucggagcuguggaguuuuuaucaaaacugcguaguaauguugaacccaaccuucaggccgagauugacgguaucuuggauggccuguuccugcucccuagcgaagugccagcacuguccucugccucguaccaaaccaaucagacagagcuuucaaagaaccccgagauacugacuggguauuuuccucaggacaagagcaauuuccagcaaauggaagucccacccagaccugugguaaaccagacgguuaaaugcuugaaguuuaguaccuucccauggcucccgcugacuacuaccgauaggcacguguuauccucuaaugagagcucccugcggucaaguaaccauacacucaucuggaauaccugugaacuucugaaagacgucauuaugcaggauuuucccgcugagaucuucuugcagcgcccuaagauugugcaaagccuacugucucuccugaaacuugcauuuggagacggcaagcacagacuggccuugcaguccgugucaugccuccagcaacuguguauguacuuaaggaaccggcugaauuuccaccgcgauccaggauuuuucagcaacaagcaugacacugucagucaaaauucuucccuaagcuauugccacgaagcucgagggacacaucacucgcagaaccccucuccuggauccucaaguccaagacccagcguugugggcaggaccggccagcggccgcguggggauggacaagacugggaugccgcguccucuagcgguucaaguucccacgcacauguaaacagccgcaucucugugcacucaccucucgacaugggccauauagaccugcccgagcuugagacggaagauacuuuggagcugcaguuccagcagcucagucugccacaauuuugugucagcauucuugaauccgccgugccucuguugagaaccgggucuaggcagguuaucauucgggugcucgagcuguuaacagaagacaugacucugaucggagaggcuaucucgaccgauauuugggacgauagcucccuauucggcauagacaugaaagagaagcuccugcuugucuugggugcccugggggaaacaaugugcuaccacaaaucaaguaucucucucgagcagcccgaagugaugcugguacaucaccgaauggcauuuauuagcaucuccuuauucgcuguucgccugcuucagaccuugcucccaguggagaaggccucagaauuucugagcgagcccaugucuacggcgcuauuccugcucucccuggauaugccuauaagucuugaguauccaaauauucacgaagccgucguggcauacuuggagcaacugaacagcgaaaauuacucuaucuauaaaagaacugcugaggccgucuacuccaucgaguguacaugcaacuuuuuaucagacauuggaaaggaaggcgagaaaaaucuccuggaacuuguggagcuggcugaucaggccuugaggaguuucagcuaucaucagcacuuuccgcucaucaaggaaauuauaucgaucuguuccaagauuuggaaaucugcacaggccagcccccugcuacaaggcgagucacagaagguucugcuccauaugcugagucacccucuuccacgggugaaagcugagaccuaccacugcugcuuggaaaucacuaaggagugucuggggguacauaacgucacaaaacccguguccucuuuaugcaauggaauccacuuccuccugcauccuaagguucuuuaugaaauuagcguguuugguauacaggagccagaauccgaggucaacaccgcggcaaaggccauccugcuauaccuccugcaaggccgcuugaugaugacggcucugaccuggaauaaauucauugagucauuaugucccgugaucccgauucuccagggguaugccgacacagaagauccucugggaaacugcauccuucuguugagcaaggcaaguucugacacugaggaaaugcucccauguaccacaagacugaaauccaugcuaaggcugcuucucguaaagaaacccagcgugcguucgcuggccuugaagcuguuagcuuuucaccucacuucagaggaaggcgccgacaccaagcggccucugauagaugcacgaguucuuucuagagucacagaccuguucaucgguaaaaagcccauugaguugaggcucgaugaccgccgggagcuggugaucaaacuagaaaccguggagaaggucuacgaaauuuucacaagugaugacguugaucuggugcuuagaaaauccgcggcugagcagcucgccgugaucaugcaggacauaaagaugcaugcaguagucaagaaacugugcuugauugauaagaucauugaguacuuaaaugaaugugugagccaagacgggaaaguuguggagugccugguccagccaugucucacgcugcuuaggaaggugcugugcggcgauccuguuaugcgcgugucuuugagccagcaguccucacuacugacaguacucuuucgagucagucugaucuuccacgaagacuguagcguggugaccgaggucggagcccuauuuugcuuacuacucuucgaugaaguuucucggauggacaugugguccgugaaccccucaaauaaaccaaguuugccgagcguauuuucccugccugugucugucuuccguagauaucaccuccccgugcauguuauaggccaccaugcugugucgccauacagcaucguccugccccuuucagccgacugccuggcauugaagccuguguccgauaugcuaaggauugcuuggaaccugaguugguaucacgggucugacaaucucuuaaaacaaaugaacagcgagacuaagacccaggagauccuggaugcccuuaagcuguccacagaagacauucucaccuugaaaaucacucauauggcgucaggacugcaggauugucuccacucuauaguucaggccgcuacacaccgcgaggugcgggcagccgucacgagaaugagcuuuuaccugcuuaacgacaggcuaagucugaaggguugcccaggccccugugggguaaccuugaaauccuuagcuuggcauacugcccugaaucgauuccuccaagugcugccugcaugcacagaagaugagaaacuucugauugacaucauccacuuucucaacaaauugauuaaggaacagcgcaagaauagcucucuggagcuacugaacuggauccucgagcuucuguuacggcauucagcgaauccguugcuggaucuccugguucuuaccgaaucccaggccagagaggaaacagacgauauuaggacugcugugcgucaacagcugcagaaagagcucauagccuuguucgacacccuguuacuaaacuuuauggaagucacggaucgcaaguguagugagcugcucuauguguuccagacccaacuugcacugaaauugcugcagugccucaagguaacagacgcuccacacuuuuacggacugcccagccuugagcggacucucagaggcauggccaaucugaccgcauucccugguuggucgucucacuccccauugacaaaaccccuggacaucugugugaaguauuuaagcgggcuacuggaagucauuacuucauucuacguugagaggggcggaaacgccaugaguuuuaugggcaagggggugaccaaaucuacgauccucugccuucugcauuugucccacgaaaugauggcucaggcgggaagccuggaguggaugucacucugguuccugccucuugguagucauagcgaggaacacauuccgacacagcaaggcuuagccuggcugaucccccucuggguggaucgagacccagagguccgguuuaccuccuuggggcugggaucugcacuaacuacacuggaaaccggcuguguggcucucgccaauagcugccagaacauauccggugggcuuuggggcacuguuguaaauauccuguuggaucagucagaguguucuauggugcgcagagaagccgcuuucauucugcagaaccuccuggucaucccuaugcccaccgagauuaucaaggacuacacauggcaaggaccaugcgugcaugaugaggacaguggcuuaucgcuuauagggaaaccugcacugcaggcccuccuauaucacugccacuuuuacgaacaucugaaucagaugguuaagcacuguuauuugggaaggugcauguucgaucugaacuuuagcgcguucgacagaaauuccgagucuaacgaucucaacggccuugacgauucauuuaaauucuggcgagcucccagcagaacgucccaggaccgcgacccaaguucucugagcaccucagaaacuacaguggccccguccuuggguaguaccgaguuucaaccucugguccagagcacaacucucuuacccgaagcaucucaugaucaguucguggcccaagggcaccaggaguccaccucaccaaggcccccucacgacagcucgcugucugcuccacuucccaagcuguguguauucgucacgccuagucuacucuccgcaaugugcagccuguuggauaaucugcucacaauugccccgcgugacaccgcgaaggcuuuucggcaggcccaucuuaucgagcuguuauguucaaucgcagaugccacucugauucagaccugcgugcaagaauugagagcucuccugccauccucucccccugccgagcacacacaggcacagguuagcuuccuacuugaauaccugaguucccucagcaggcuguugcagucuugucugcucguggagcccgaccuugucauacaagaugaacuggugaaaccauuaaucacuaacauuaucgguauucugaccaucugcacaaaggacguuuuggauaaagagcucauaucagcuuuuuaucauacguggacccaccuguucaaucuacuugccaugcugcuccgcaaggcgggcgccaucacucugccuuuugugacagucgcauuggcuaaacauuggaccgccgcuauugacauguucuguacuugcgcagguuuaagugccacaugucccgcccuguacaccgcuucccuccaguuucuuagcgugcugcuaacggaggaagcgaagggccaucugcaggcaaaaucuaagacucaccucugcugcucgccaaccguagccucauugcuggaugacagccaggagaaccaaaagucccuugaacagcugagugaugugauccuccaguguuaugaggggaaaucuagcaaggacauuuuaaaacgaguugcugccaaugcacugauguccuugcuggccgucucaagacgggcucaaaagcaugcgcucaaagccaaccuuaucgacaauugcauggagcagaugaagcacauaaacgcacagcugaaucuagauagucugaggccuggaaaggcugcccucaaaaagaaagaagacggcgugauuaaggaguugucuaucgcaaugcagcugcuucgcaacugucuguaccaaaaugaagagugcaaagaagccgcuuuagaggcccaucucgugccgguccugcacagcuuguggcccuggauccugauggaugacucccucaugcagauuucacuucagcugcuauguguauacacagcgaacuucccaaaugggugcagcucucuguguugguccaguugcggacagcacccugugcaagcaacccaucguggcgccguuagcaacucgcucauguuguguauccugaaguuagcuucccagaugccccuugagaauacuacagugcagcagauggucuuuaugcugcucucuaaccuggccuugucacacgauugcaagggugugauacaaaagagcaacuuccugcagaauuuucucagucuugcucugccaaaagggggaaacaaacaucuauccaaucugaccauuuuauggcucaagcuguugcuuaacaucucuagcggcgaagacggucagcagaugauucugagacucgauggcugucuggacuugcugacagagaugucaaaauauaagcacaaguccaguccucuacucccccuucugaucuuccauaauguuugcuuuagcccggcaaacaaaccaaagauauuagccaaugaaaaagugauuacuguccuggcugccugccucgagucugaaaaccagaaugcacagcggaucggggcggccgcucugugggccuugaucuacaacuaucagaaggcaaaaaccgcucuuaagucaccuuccgugaagaggcgcguagaugaggccuacagccuggccaagaagacguuccccaauucugaggccaacccacucaaugcuuauuaccugaaaugucuagaaaacuuggugcaacugcucaauaguucguga

SEQ ID NO: 62089 - RNA, 1803 nt, Artificial Sequence
  derived and/or modified sequence opt3 from RUFY1__Homo_sapiens__NP_001035542
augauggaggaaagagccaaccugaugcacaugaugaagcucagcaucaaagugcuucugcaguccgcuuugucuuuaggcaggucacuggacgcagaucaugcgccccuacaacaguucuuugucguuauggagcacugccucaagcaugggcugaaagugaagaaaaguuucauuggacagaacaagagcuuuuucgguccucuugaacugguagagaaguuguguccagaagccuccgacauagcuaccucugugcggaaccucccggagcugaaaacagccgucggccgcgggcgagcauggcuguaccucgccuuaaugcagaagaaacuggcugauuaucuuaagguguugaucgacaauaaacaucugcuaucggaguuuuacgaacccgaggcacucaugauggaagaggagggaaugguuauugugggccugcuugucggucugaacguguuggaugccaaucucugccugaagggggaagacuuagauucacaaguaggaguuaucgacuucagccuguaucucaaggaugugcaggaccuugauggcggcaaagagcacgaacguauuacugacguccuggaucagaagaacuacguggaggaauugaauagacaccuaaguuguacggugggggaccugcagaccaaaaucgacggacucgagaagacaaacuccaaacugcaagaggaacuuucugcugccacugauaggauaugcagccugcaggaggaacagcagcaauugcgggagcagaaugaacucauccgcgagagauccgagaagucagucgaaauuaccaaacaggacacaaagguugagcuggaaaccuauaagcaaacuaggcaggguuuagaugagauguacagugacguguggaaacagcugaaggaagagaaaaagguacggcuagagcucgaaaaagagcuggaacuucagaucggcaugaagacagagauggagauugcgaugaaguugcuggaaaaagauacccacgagaagcaagacacgcucguggcacugcgccagcagcuugaagaggucaaagccaucaaccugcagauguuucauaaggcucaaaaugccgaaagcucuuugcagcagaaaaacgaggcaauaacuuccuucgaggggaagaccaaucaggugaugucaagcaugaagcaaauggaagaacgacuccagcacagugaaagagcuaggcagggagccgaggaacggucucauaaacugcagcaagaguuaggcggucguauuggggcgcugcagcuacagcucucccaacugcacgagcaguguagcucgcuugaaaaggaguugaaaucugaaaaggagcagcgccaggcccugcaaagagaacuccagcacgagaaagauacauccucacuguuaaggauggagcugcagcagguugaaggacuuaagaaggaguugcgggaacuccaagacgagaaagcagagcugcagaagaucugcgaggagcaggaacaggcucuacaagagaugggccugcaucucagucagagcaaacugaagauggaagauauuaaagaggugaaccaggcccuuaagggccacgcuugguugaaagacgaugaggccacucauugucgacaaugcgaaaaggaguuuuccaucucucgcagaaagcaccauuguaggaauugcgggcacaucuucuguaauaccugcagcucaaacgaacuggcauuaccuaguuauccaaaacccguccgggugugcgacuccugucacacacuccugcuucagcgcugcagcucuaccgccucauga

SEQ ID NO: 62090 - RNA, 1863 nt, Artificial Sequence
  derived and/or modified sequence opt3 from RUFY3__Homo_sapiens__NP_001032519
augagcgcccugacacccccuaccgacaugccaacuccgacgaccgauaagaucacacaggcugcaauggagacuauuuaccucugcaaauucagaguguccauggacggcgaauggcuuugucugagggaguuggaugacauaucuuuaacccccgauccugaaccaacacacgaggaccccaacuaucugauggccaaugaacggaugaaccuaaugaauauggcgaagcucucaaucaaagggcugauugagagugcucuuaaccugggacgcaccuuggauagcgacuacgccccucuccaacaguuuuucgucguuauggagcauugccugaagcacggucugaaagcaaagaagacuuuucucggccagaauaaauccuucugggggccauuagaacugguggagaaacuuguacccgaagccgcugagaucacagcaucugugaaggauuugccuggacugaagaccccagucggccgaggucgugccuggcuaagacucgcucugaugcagaaaaagcugucggaguauaugaaggcccugauuaacaaaaaggaauugcucucagaguuuuacgaaccgaaugcgcugaugauggaggaagagggggcaaucauagccggauuacuggugggccucaacguuaucgacgcuaauuucuguaugaaaggcgaggaucuugacagccaagugggggucauugauuuuaguauguaucugaaggacggaaacuccucuaaagguacggaaggcgacgggcagaucacugccauuuuggaucagaagaauuacguggaggaacuaaacaggcaucugaaugcaaccguaaacaaucuccaggcuaaaguugacgcccuggaaaagagcaacacaaaacuuacugaggagcuggcgguggccaacaaucggaucauaaccuugcaagaggaaauggagcgcgucaaggaagaguccucauauauucucgaaaguaacagaaagggacccaaacaggauaggacagcagagggccaggcucugagcgaggcccggaagcacuuaaaagaagagacccagcugcgccuagacguggaaaaggagcucgagaugcaaaucucuaugcgacaggaaauggagcuggcuaugaagaugcuugaaaaagaugugugcgagaagcaggacgccuuggucucccugagacaacagcucgaugaccugagggcacuuaaacaugaacuggccuucaaguugcagucaagcgaucucgguguuaaacagaagagugagcuuaauucucgguuagaggaaaagacgaaccaaauggcugcgacuauuaaacagcuggagcagcgucuacgccaggcagaaagauccaggcaaagcgccgagcucgacaaucggcuguuuaagcaggauuucggggacaaaaucaacucgcuucaguuggaaguggaggagcugacacgacagcgcaaucaacucgaacuggaguuaaagcaggaaaaagagagaaggcugcagaacgaccggucuaucccuggacgcggcucccagaagucagaaaguaagauggauggcaaacacaagaugcaagaggagaauguaaaacuuaagaaaccauuggaagagagccacagacuccagccccauccuauggacgaacaggaucaacugcuacuguccgagaagccacagcucugucagcugugccaggaggacgggucucuuaccaaaaacguguguaagaauugcagcggaacuuuuugugaugcuugcucaacaaacgaauugccccugccgaguuccauuaaguuagagagggucuguaauccuugccacaaacaucucaugaagcaauacagcaccucucccucauga

SEQ ID NO: 62091 - RNA, 1371 nt, Artificial Sequence
  derived and/or modified sequence opt3 from RUNDC3B__Homo_sapiens__NP_001127877
auggccagcagaucccugggcgggcucucuggaaucagggguggcgggggaggcggugggaagaaaucacuuagugcucggaacgcagccguggagcgccgaaaucugauuaccgucugccguuucagcguuaagacauugauagacagauccuguuuugaaacuaucgaugacucuucgcccgaguucaacaauuuugcggcuauuuuagaacagauccugucacacaggcuaaaaggacaagugacgugguucggcuacgagagcccucggaguuuuugggauuauauucgcguagccugcagaaaggugucccagaacuguaucugcucuauagaaaauauggagaacgucagcuccucaagggcaaaaggccgggccuggauccgcguggcucucauggagaagcaucugagugaauacauuagcaccgcacuucgagacuucaagacaacuagaagguuuuaugaggauggggccaucguucugggagaagaggcuaauauguuggccgguaugcuccugggccugaacgcgauugacuucucuuuuugucucaaaggggagggauuagauggcuccuucccagcagugaucgacuacaccccguaucugaaguacauacagucaagcgauaguauuucuuccgacgaagaggaacuucggacauuggguagcucggggucugaguccucaacccccgaaaaugucggaccuccauuucugauggaugagaacaguugguucaauaaaugcaagcgugugaaacagaaguaucaacuaacucucgagcagaagggcuaccuggaggaacuucugcgcuugagagaaaaccagcucagcgaguccguaucucagaauaaaauccuguuacaaaggauugaagacagcgaucuggcccacaagcucgagaaagagcagcuugaauacaucaucguugagcugcaggaccaguugacagugcuaaagaacaaugaccugcggucacgacaagaacucaccgcucaucugacgaaccaguggcccaguccuggcgcccuugaugucaacgcaguggcucuggacacuuugcucuaucgcaaacacaauaagcagugguacgagaaauccuaucaaagccuggaucaguuaucugccgaagugucacugagucagaccagccuagacccagggcagucccaagagggagaugguaagcaggacacacucaacgucaugucugagggcaaggaagauacucccucgcugcuuggguuguguggaagccugaccuccguugcgucauacaaaagucucacaucucuuaagagcaaugacuaucuggccuccccuaccacggagaugacuucaccaggccugacaccgagcuga

SEQ ID NO: 62092 - RNA, 1362 nt, Artificial Sequence
  derived and/or modified sequence opt3 from RUNX1__Homo_sapiens__NP_001001890
augagaauccccguggacgccagcaccuccaggcgguucacaccuccaucuacugcucugucaccgggcaagaugagugaggcacucccccuuggggccccugaugcgggagcugcccuggcagguaaauugcgcagcggcgaccgauccauggucgaaguuuuagccgaucacccaggggagcuggugcguacggacucucccaacuuucuaugcucgguacucccuacccauuggagauguaauaagacacugccaauugcuuucaaaguggucgcacuuggagaugugcccgacggcacucugguuaccgugauggccgguaacgaugaaaauuacucagcugaguugaggaacgccacagcggcaaugaagaaucaggucgcccgguuuaacgaccuccgcuucguggggagaagcggaaggggcaaaaguuuuacccugacuauaacaguauucaccaauccuccacaaguugcuacguaucaccgggccaucaagauuacuguggauggcccgcgcgaaccccgaagacauaggcagaagcuggacgaucagaccaaaccugggucccucucuuuuagcgagcgguuauccgagcuggaacagcuucgucgcacagcaaugagagucucaccacaccaucccgcuccuacuccaaaccccagggccaguuugaaucacagcaccgcguucaacccgcaaccucagucucagaugcaggacacacggcaaauccagcccuccccaccuuggucauacgaucagagcuaucaguaccugggaaguauugccucucccuccgugcacccagcaacccccaucagcccuggucgagcuucgggcaugacgacucuaucugccgagcucuccucacgccugaguacagcuccagaccuuaccgccuuuagcgacccgagacaauuccccgcacugccuuccauaucugauccaaggaugcauuaucccggggccuuuacuuacagcccuacaccagugaccucaggaaucggcauugguaugagugcuaugggguccgcgacgcgguaucacaccuacuugcccccgccuuacccaggaagcucucaggcacagggcggccccuuccaagccucaaguccuagcuaucaucucuacuauggggcuuccgccggaucuuaccaguuuucgauggucgguggcgaacgcagcccacccagaauccugccucccugcacaaaugcauccacugggucagccuuacugaacccaagucucccgaaucagucugacguuguggaggcugagggaagccacuccaacucaccuaccaauauggcccccagcgcaaggcuugaagaggcgguauggcguccauauuga

SEQ ID NO: 62093 - RNA, 1815 nt, Artificial Sequence
  derived and/or modified sequence opt3 from RUNX1T1__Homo_sapiens__NP_001185560
augaucagcgugaagagaaacaccuggagggcccugucccucgucauuggcgacugccggaaaaaggggaauuucgaguacugucaggaucgcacagaaaaacacucuacuaugcccgacucaccuguugaugugaagacgcaaagucgacuuaccccaccgacaaugcccccuccacccacuacccagggagcuccucguacaagcuccuuuaccccaacuacacugaccaacgguacgucucauucgcccacugcauugaauggcgccccuucaccaccgaacggguucagcaauggacccaguuccucuagcuccucaaguuuagcgaaccagcagcugccuccagcuugcggcgccagacaacuaagcaaacucaagagguuucugaccacacuucagcaguucgguaaugacauaucucccgagaucggggaacggguacgcacucugguguugggacucgucaacuccacccugacaauugaggaauuucacucaaagcugcaggaggcaaccaauuucccucucagaccauuugugauccccuucuuaaaagccaaccugccgcuuuugcaaagggagcugcuacauugugcucggcucgcaaagcagaauccugcccaguaucuggcucagcacgaacaacuucuguuggaugccagcacgacuucgcccguugacucuuccgagcuccuguuagaugugaacgaaaauggcaaacgccgaacaccagacagaaccaaggagaacggcuuugauagggagccucugcauagcgaacaccccucgaaacggccaugcacuauuucucccgggcagcguuacuccccuaauaacggacucucauaucagccaaacggucuuccgcaccccacaccuccacccccucaacauuaccgccuggacgauauggcgaucgcacaccauuauagagacaguuacaggcacccaagccaccgggauuugcgagaccgcaauagacccaugggccuacaugggaccaggcaggaggaaaugauagaccaccggcugacggaucgcgagugggccgaagaguggaagcaucucgaccaucugcuuaacuguaucauggauauggucgagaagaccagaaggucccugacaguguugcgucggugccaggaagcugaccgagaggaacucaauuauuggauuagaagguacucugaugccgaggaccugaaaaagggaggcgguagcucaaguucccacagccgccagcaaucuccgguaaacccugauccaguugcauuagacgcucaccgggaguuccugcacagacccgccucaggguacgugccugaagagaucuggaaaaaggcggaagaggccgucaaugaagugaaaaggcaggcaaugacugagcuacagaaggcugugagugaagccgagcgcaaagcucaugauaugauuaccacagagcgagccaagauggaacggacugucgcagaggccaagcgucaggcugcggaagacgcacucgccguuaucaaccaacaggaggauagcuccgagucuuguuggaauugcggaagaaaagcuagugaaaccuguagcggcugcaacacagccagguauuguggcuccuuuugccagcacaaggacugggagaaacaucaccacauaugcgggcagacccugcaagcacagcagcagggagacacucccgccgugucaaguucuguaacgccaaauagcggugcuggcuccccuauggauacacccccagccgcaaccccgcgcucaacuaccccugggacacccagcaccauugaaacuacaccacgguga

SEQ ID NO: 62094 - RNA, 1500 nt, Artificial Sequence
  derived and/or modified sequence opt3 from RUNX2__Homo_sapiens__NP_001015051
auggccagcaacucccuguucucuaccgugacacccugccagcaaaacuuuuucugggacccuucaacgaguagaagguuuagcccaccguccucuucgcuccagcccggcaagaugucagaugucagcccuguuguggcugcacagcagcaacagcagcagcaacagcagcagcaacagcagcaacagcagcagcaacagcagcagcaacaggaggccgcggcugccgcagccgcugcagccgcugccgcggcagccgcugccgcaguaccacggcuucgacccccucacgacaaccgcacuaugguggaaaucauugcugaucauccagccgagcugguccguaccgacagucccaauuucuuguguuccguguuaccuucucacuggagaugcaacaaaacacugccaguugcguuuaagguggucgcccuaggggaagugccggauggaacuguaguuaccgugauggcagguaaugacgagaacuacagcgcugaacucaggaaugccuccgcugucaugaaaaaccagguggcccgguucaaugaucugcgcuuugugggcagaucagggaggggaaagaguuucacacuuaccauaacugucuuuacaaaucccccucagguugcaaccuaucaucgggccaucaaagugacgguagacggcccacgcgagccccgaagacacaggcaaaagcuggaugacagcaagccuucuuuguucuccgaucggcucucagaccugggucguauuccacaucccagcaugcgcgugggggucccgccucagaaucccagaccaagucugaacucugcuccuucccccuuuaauccacagggacagagccaaaucacugaucccaggcaggcgcagucgucuccuccaugguccuacgaccaaucauauccgaguuaccucagccagaugaccucccccucuauucacagcacaacuccuuuaucaaguacccggggcacaggccugccagcaaucaccgacgugccccgacgcauauccggggccagcgagcuuggaccuuucucugauccaagacaguuucccucaaucaguagcuugacggaauccagguucucuaacccgcggaugcacuauccugcuacuuucacauacaccccacccguuacuucggguaugagccugggcauguccgccacaacccauuaucacacguaccuaccucccccauacccugggucaagucagucucaaagcggacccuuucagaccuccucaacaccauaucucuacuauggcacuagcucugguuccuaccaguucccgauggugccugggggagaccgcagucccagcagaaugcugccacccuguaccacaacuucuaauggcuccacccuucugaacccuaacuugccaaaucagaacgauggcgucgacgcagaugggucacauaguagcucgcccacagugcucaauuccucuggaaggauggacgagagcguauggcguccuuauuga

SEQ ID NO: 62095 - RNA, 1131 nt, Artificial Sequence
  derived and/or modified sequence opt3 from RUNX3__Homo_sapiens__XP_011540653
auggccagcaacuccaucuucgacucuuuucccaccuacucaccuacauucauuagagauccaaguacuagcaggcgguuuacgccgcccuccccugcuuucccaugcggcgggggagguggcaagaugggggaaaauucuggagcacugucggcccaggcggcugugggccccggugggcgcgcccgaccugagguccguucaaugguugacgugcucgcagaucacgccggagagcuuguaagaaccgacagcccaaacuuucuguguaguguguugcccucccauuggaggugcaauaaaacauuaccugucgcuuucaaggugguugcacugggcgaugugccagacggcacugucgugaccguaauggccgggaacgaugaaaauuauucugcugagcuacggaacgccagcgcgguuaugaaaaaucaaguggcacgcuuuaacgaccucagauucgucggaagguccggucggggcaagucauuuacacugaccauaacuguguucacaaauccgacccagguggccacguaccaccgcgcuaucaaagucacuguugaugggccccgagaaccuagaaggaccagugagcuuaacccauuuagcgacccccggcaguucgaucguucuuuuccuacacugccaacuuugaccgagucccgcuuccccgacccgagaaugcauuauccuggagccaugucagcagcuuuccccuacagcgccacaccaaguggcaccucuauuuccagccucucgguggcggguaugccugccacgucuagguuucaccauacuuaucugcccccacccuacccuggggcaccacagaaucaauccggaccguuccaggcuaaccccucaccuuaucaccuguacuacggcacaaguagcggcuccuaucaguuuucuaugguagccgggagcucaaguggaggugaucgguccccaacccgaaugcucgcuagcuguacuucuucagccgcaaguguggccgcuggcaauuuaaugaaccccagccuugggggacaguccgacggcgucgaagcggacgguucucacucgaauagcccuacagcacuguccaccccagggcgcauggaugaggccguguggagacccuacuga

SEQ ID NO: 62096 - RNA, 1371 nt, Artificial Sequence
  derived and/or modified sequence opt3 from RUVBL1__Homo_sapiens__NP_003698
augaagaucgaggaagugaaaagcaccacaaagacucagagaauugccucccacucucaugucaaaggccuggggcucgacgagucaggacuugcuaagcaagcagccaguggucugguuggccaggaaaacgcgagggaggcuugcggggugauaguagaauugaucaaaagcaagaagauggccggacgggcaguguuacuggccggucccccuggcacggggaaaaccgcucuagcacucgccauugcucaggagcugggauccaaggucccauucuguccgauggugggcucugagguuuacucgacagaaaucaaaaagacugaggugcuuauggaaaauuuucgccgagccauuggccugcguaucaaagagaccaaggaggucuaugaaggggaggugacagaauugacccccugcgagacugaaaacccuaugggagguuacggcaagacaauaucacacguaaucauugggcucaaaaccgcgaagggaacgaaacagcugaagcuggauccaagcaucuucgagagucuccaaaaagagagaguugaagcaggcgacgugauuuauaucgaggccaauuccggugcugucaagaggcaggggcggugugauacuuacgccaccgaauuugacuuagaggcagaagaguaugugccccugccuaaaggagaugugcauaagaagaaagagauaauucaggacgucacacuucacgauuuggacguugcuaacgcccgcccacagggcggccaagauauccugucuaugauggggcagcuaaugaagcccaaaaagacugaaauuaccgacaaacucagaggagagaucaauaaggugguaaacaaguacaucgaucaggguauugcggaacuggugccuggcguccuuuucguggacgagguucauaugcuggauauagaaugcuuuacauauuugcacagggcccucgagagcuccaucgcaccaauugugaucuucgcuucaaaucgggggaacugugucauacgcggaaccgaggacauuacgaguccgcacggcaucccccuggacuuacuggaucgagugaugaucauuagaacuaugcucuacacaccucaggaaaugaaacaaaucauuaagauaagggcccagaccgaggguaucaauauuagcgaagaggcucuuaaccaucugggggagaucggcacuaaaacaaccuugcgguacucuguacagcuacugacgccagccaaucuccuggcaaagaucaacggaaaagacuccauugaaaaggagcacguugaagagauaucagaacuguuuuaugaugccaagagcagugcuaaaauccuugcggaccaacaggauaaguacaugaaauga

SEQ ID NO: 62097 - RNA, 1392 nt, Artificial Sequence
  derived and/or modified sequence opt3 from RUVBL2__Homo_sapiens__NP_006657
auggccaccgugacagcuacuacgaagguccccgagaucagagacguuaccaggauugaacggauaggcgcacacagccauauccgcgggcugggacucgaugacgcccuugagccucgacaggcgucccaagguauggugggccagcuggcugcccguagagcagccgggguaguguuggaaaugauuagggagggaaaaaucgcuggccgggcagucuuaauugccggucagccagggacaggaaagacugcuaucgccaugggcauggcgcaggcacugggcccggauacccccuucacagccauagcugggucugaaaucuuuucacuagagaugaguaaaaccgaggcccucacucaagcauuccgcagaagcauuggagugaggaucaaggaagagacagaaauuaucgagggugagguuguggaaauacagauugaccggccugcuaccggcacgggguccaaagucggaaagcugacucuuaagaccacagagauggaaacuaucuacgaucugggcaccaaaaugauugagucuuugacaaaggacaaagugcaggccggugauguaaucaccaucgacaaggcgacggggaaaauuucgaagcucggacgcucauuuacucgagccagagauuaugacgcaaugggcagccagacaaaguucguucaaugcccagauggcgaacugcagaaaaggaaggaggugguccacaccgugagucugcaugagauagacgugaucaacucccggacucagggguuucucgcuuuauucucuggagauacaggugaaauuaaaagcgagguccgugaacagaucaaugccaagguugcugaguggcgcgaagagggcaaagccgagauaauucccggggugcuguuuaucgacgaaguacacaugcuugacaucgaguccuucucauuuuugaacagagcacuggaaagugauauggccccugugcuaauuauggcuaccaauaggggaaucacgcggauucgaggcaccagcuaccaaucuccacaugguauacccaucgaccuccuggaucgccuucugauugucuccacaacuccuuauucagagaaggacaccaaacagaucuugagaaucaggugugaagaggaggauguggaaaugagcgaggacgcguacacaguucucacucggauugggcuggaaaccaguuuacgcuaugcaauacagcugaucacagccgcuucucucgugugcagaaagaggaagggcaccgagguccaaguggaugacauuaaacguguauacucccuuuuccuggaugagagccggucgacucaguauaugaaggaauaccaggacgccuuuuuguucaacgagcuaaaaggagaaacgauggauacaucuuga

SEQ ID NO: 62098 - RNA, 2130 nt, Artificial Sequence
  derived and/or modified sequence opt3 from RXFP1__Homo_sapiens__NP_001240658
augaccagcggcuccguguucuuuuacauccugauuuucgggaaguauuuuucucacggagguggccaggacgucaaaugcucacucggguacuuccccuguggaaacauaacaaagugccuuccucaacuguugcauuguaauggcguugaugacugcgguaaccaggccgaugaggacaauuguggggauaacaauggauggaguuuacaguuugacaaauauuucgcuagcuacuauaagaugacuucccaguacccauuugaagcagagacgccggaaugccuggugggcucuguacccgugcaaugucuaugccagggccucgagcuggauugugacgaaaccaaccuuagagccgucccuucggugucaagcaauguuacagcgaugagucugcaguggaacuugaucaggaaacucccacccgauugcuucaagaauuaucacgaccugcagaagcuguaccuccaaaacaauaaaauuacuuccaucucuauuuacgcuuuucggggguuaaacagccugaccaaacuuuauuugucccauaaucgcaucacauuccugaagccuggaguguuugaggaucuacaccgacucgaguggcugauaaucgaagacaaccaucuuucacguauuaguccacccaccuucuacggucugaauagcuugauccuccuggucuuaaugaacaacgugcugacuagacucccugauaagccacuuugucagcacaugccgaggcugcacugguuggaccuagagggcaaucauauucacaaccugcggaaucucacauuuaucucuugcuccaaccugaccguacuuguuaugcgcaaaaauaagauaaaccaucugaaugaaaacacguucgcccccuugcagaagcucgacgaguucucacuggaggggauugaaaucagcaauauucagcaaagaauguuuaggccuuuaaugaaccugagucacaucuauuucaaaaaguuucaguacugcggauaugcaccacacgugcggucuuguaaacccaauacugauggcaucuccagccuagagaaccuccuggccucgauuauacagcgcgucuucguguggguggucucugcuguuaccugcuuugguaauaucuucgugauuuguaugcgaccuuacaucagauccgaaaacaaacuuuaugcaaugucaauaauuaguuugugcugugccgacugccugauggggaucuaccucuuuguaaucggaggcuucgaucugaaguuuaggggcgaguacaauaagcaugcucaacuuuggauggaaagcacacacugucagcuggugggguccuuggccauucucucuacugaggucagcgugcuguuacugaccuuccuaacacucgagaaauauaucugcauuguuuacccauuucggugugugcgucccggaaagugccgcaccauaacgguccugauccuuauuuggaucacugguuucaucguggcguuuauuccguugucaaacaaggaguucuucaaaaacuauuacggcacaaaugggguauguuuuccucugcauagugaagacaccgaauccauaggagcacagaucuauagcguugccauuuuccucggcaucaaccuggcugccuuuauuaucauaguguucucuuacgguucaauguuuuauaguguccaccagagcgcaaucacugcuacagagauuagaaaucaagugaagaaagaaaugaucuuagccaagagguucuuuuucauugucuuuaccgaugcgcugugcuggauccccauauucgugguuaaauuucuuuccuugcuccagguggagauuccagggacgaucaccucuuggguagucauuuucauccugccuauaaacucggcccuaaaucccauccuguacacacucacuacccggccauuuaaggagaugauucaucgauucugguacaacuaucgccagagaaagagcauggacuccaaaggccagaagacauacgcacccucauucaucuggguggaaauguggccucugcaagagaugccaccggaacuuaugaaacccgauuuguuuacuuauccuugcgagaugagucugauuucucagagcaccagguuaaauuccuacucauga

SEQ ID NO: 62099 - RNA, 2193 nt, Artificial Sequence
  derived and/or modified sequence opt3 from RXFP2__Homo_sapiens__NP_001159530
augaucguguuccuggucuuuaagcaccucuucagccuuagacugauuaccauguuuuucuuguuacauuuuauaguucugaucaacgugaaagacuucgcccuaacacagggcuccaugauuacucccucuugccaaaagggguacuuuccuuguggaaaucucacgaaaugccugccaagggcuuuccacugugaugguaaggacgauugcggcaacggggcagacgaggaaaauuguggagauaccucaggcugggccacaaucuuugguacuguacaugggaacgcgaauaguguggcucuuacccaggagugcuuccugaaacaguauccgcaguguugcgacuguaaggaaacagaguuggaaugcgucaacggagaucucaagagcgugcccaugauuuccaauaacguuacccugcugucucucaaaaagaauaaaauccacucguuaccugacaagguguuuauaaaauacacuaagcugaagaaaaucuuccuucaacauaacuguauucggcacaucucacgcaaggccuuuuucggcuugugcaaucugcagauucuauaucucaaccacaauugcaucacaacccugcgaccaggcauauucaaagaucuucaucagcugacgugguugauucucgacgauaaccccaucacucguauuagccagagacuguuuaccggguuaaauagucuguucuuucucuccauggucaacaacuaccuugaggcacugccuaagcaaaugugugcccagaugccacaguugaauuggguggaccuagagggaaacaggaucaaauaucugacaaauucuacuuuccucagcugcgauucccugaccguacuugaccugucaaguaacacaaucaccgaauugagcccccaccucuuuaaggaccugaaauuacugcagaagcuaaaucucucuuccaacccucugauguaccuucauaagaaucaauucgagucauugaaacagcugcagagccucgaucuggaacggauugagauaccaaacaucaauacgcgcauguuucaaccgaugaagaaccuuagucacauuuauuucaaaaauuuuagauacuguucuuacgcuccccacguuaggaucugcaugccucugacugacgguauauccagcuucgaggauuugcucgcaaacaauauucugcggaucuuugugugggucaucgccuucauuacauguuuuggcaacuuauucgugaucgggaugcgcucguucauuaaggcugaaaauaccacucaugccaugucuauaaaaauccugugcugugcggacugccuaaugggaguguaucucuuuuucgucggcauuuuugauaucaaguaccgaggucaguaucagaaguacgcacugcuuuggauggaguccguucaguguagauugaugggguuccuggccaugcucucaacagaagugaguguacuguuacugaccuaucuuacguuggagaaauuucucgugaucgucuucccauuuagcaacauuaggcccggaaagcggcaaaccuccgugauacugaucugcauuuggauggcuggcuuccuaaucgccguuauuccuuuuuggaacaaagacuacuucggcaauuuuuaugggaagaacggaguguguuucccacuguacuacgaucagacagaagacaucgguucuaaaggcuauagccucgggauauuucugggagucaaucuuuuggcauuccugaucauuguguucucauacaucacuauguuuugcaguauucagaagaccgcuuuacagacaacugagguacguaacugcuucggccgcgagguugccguggcgaauagauuuuucuuuaucgucuucuccgaugccauauguuggauucccguguuugucgugaagauccucagccuguucaggguugaaauuccggacaccaugacaucuuggaucgugauauuuuuccuuccuguaaacucagcacugaaucccaucuuguauacccucacuacgaacuuuuucaaagauaagcugaaacaacuacugcacaagcaucagcggaaaaguauuuucaagaucaagaaaaagagccucuccacaucuauugucuggaucgaggacucgagcucccugaaacuugguguguugaauaagauaacccugggggacucaauuaugaaaccaguuaguuga

SEQ ID NO: 62100 - RNA, 1410 nt, Artificial Sequence
  derived and/or modified sequence opt3 from RXFP3__Homo_sapiens__NP_057652
augcagauggccgacgcugcaaccaucgccacaaugaacaaggcggcuggcggggauaaacuggccgaacucuucagccuugugcccgaccuguuggaagcagccaauacuuccggaaacgcuucuuuacaacugccugaucuauggugggagcucggucuggaacuuccagacggcgcaccgcccgggcacccuccaggaucaggcggugccgagagugcugauacggaagccagagucaggauucugauaagcguuguguacuggguagugugcgcguuggggcucgcaggaaaucugcugguccucuauuuaaugaaguccaugcagggcuggcggaaaucuucgaucaaccuguuugugaccaaucuugccuugacagacuuccaguuuguucugacucuacccuucugggcuguggagaacgcccucgauuuuaaguggccuuucggcaaagcaauguguaagauugucucaauggugaccagcaugaauauguacgcuaguguauuuuuccugacagccauguccguuacccgcuaucauucuguggcgagcgcccuuaagucccaccgaacucgugggcauggaagaggugacugcuguggcaggucacugggggauaguugcuguuuuagcgcaaaggcuuugugcgucuggaucugggcccucgcugcccuggcaucuuuaccauccgccauuuucucaacaaccgugaaagugaugggagaggaacugugucucguccgguuucccgacaaacuucugggccgcgauagacaguucugguugggucuauaccacagccaaaagguucugcucggguuugugcugccucuuggaaucauaauccugugcuauuugcuccugguaagguucauugcugaccggcgcgcggcaggcacgaaaggcggggccgcuguggccggaggucgaccaacuggcgcaagugccagaagguuaucuaaggucaccaaguccgugacaaucguugugcugagcuucuuucuauguuggcucccgaaccaggcucugacuaccuggucgauucuuaucaaauucaaugccguccccuuuucucaggaguacuucuugugccagguguaugcauuuccuguauccguuugucuggcgcauucaaacaguugccucaauccagugcuguacugccuuguccggcgugaguuccgcaaggcucugaaauccuugcucuggagaauagccagccccucuauuacaagcaugaggccuuuuaccgcaacgacuaagccagagcacgaggaucaagggcugcaggcccccgcuccgccucacgccgcagcugaacccgacuuacuguacuauccaccuggaguggucguguacucaggcggucgguaugaccuacuccccaguuccagcgccuacuga

SEQ ID NO: 62101 - RNA, 1308 nt, Artificial Sequence
  derived and/or modified sequence opt3 from RXRA__Homo_sapiens__NP_001278849
auggccgcccccagccugcacccuucccucggcccagggaucggaucuccgggucagcuucauucacccauuaguacccugagcuccccuauaaacggcauggggccacccuucucugugaucucgucaccuaugggaccacacagcaugaguguccccacaacuccuacguugggcuuuuccaccgguucuccacaauuaagcuccccgaugaaucccguuucaaguagcgaggacauuaagccuccacuggggcuaaacggagugcucaaaguacccgcacauccuucuggcaauauggccuccuucacaaagcacaucugcgcgauuuguggcgauagaucaagcgggaaacauuacggaguguauaguugcgaagguuguaagggcuuuuucaaaaggacuguccggaaggaccugaccuacacaugccgcgauaacaaggacugucuuaucgauaaacgacagcguaauagaugccaguauuguagguaccagaagugccuggcuauggggaugaaacgggaggccgugcaagaggaacgccagagaggaaaggacaggaacgaaaaugagguugagucuaccuccagcgcaaacgaagauaugccaguggagcggauauuggaagccgagcucgcugucgagcccaaaacugaaacauauguggaggcaaauaugggccugaacccgucgucuccuaaugaccccguaaccaacaucugucaggccgcugauaagcagcuguuuacgcucguugaaugggccaagcgcauuccacacuucuccgaguuaccucuggacgaucaagugauccuuuugcgagcggguuggaaugaacugcuaauugcaucauuuagucacagaagcaucgccgucaaagacgggauacuccuggcuacuggacuucaugugcacaggaacuccgcccauucugcaggcgugggcgcuauuuucgaucggguccugaccgaguugguuagcaagaugcgugacaugcagauggacaaaacagagcucgggugccugcgcgccaucguguuauuuaaucccgauucaaagggacugaguaacccagcggaaguagaggcccucagagaaaaaguguacgcaucccuugaggcuuauuguaagcacaaauaccccgaacagccugguagguucgccaagcuguugcuacggcugccagcucuccgaagcauuggccugaagugccuugagcaccuguuuuucuuuaaauugaucggggacacuccgaucgauaccuuccucauggagaugcuggaagcuccccaucagaugacauga

SEQ ID NO: 62102 - RNA, 1614 nt, Artificial Sequence
  derived and/or modified sequence opt3 from RXRB__Homo_sapiens__NP_001257330
augagcugggccgcuagacccccuuuccugccacagaggcacgcagccggccaaugcgggccggugggaguccggaaggagaugcauugugguguugcgucccgcuggcgacguagaaggcccuggcucgacccugcugccgcagccgcugcagccguggcuggcggggaacagcagaccccagagcccgaaccuggagaggccggccgggaugguaugggggacucuggacgcgauucaagaaguccagacagcuccucucccaacccucuuccacagggcguaccgcccccuucgccacccggcccuccacugcccccgucaacagcgccuagcuuagggggaaguggugcacccccaccucccccaaugcccccuccaccguugggcucccccuuuccugugaucucuagcuccauggggucaccaggacugcccccuccagcucccccgggcuucagugguccugucagcucuccacaaauuaauuccacugugucacuacccgggggaggcagcggcccucccgaagauguuaaaccaccugugcucggggucaggggacugcacugucccccaccgccugguggccccggggccggaaagcggcuuugcgccauaugcggcgaccgcaguucugguaaacauuacgggguguauuccugugagggcugcaagggauuuuucaaacgaacgaucagaaaggaucugaccuacagcuguagggacaacaaggauugcacaguagacaaacggcagcguaaucgcugucaguauugcagauaccagaaguguuuggcaacuggcaugaaaagggaggcuguucaagaagagagacagcgagggaaggauaaagacggagauggugaaggcgccgggggagcgccagaggagaugcccguggaccgcauucucgaagccgagcuggcagucgaacagaagucggaccagggcguggaggguccugggggcaccggaggcucuggguccucaccaaacgaucccgugacaaauaucugccaagcugccgacaagcagcuguuuacccucgucgaaugggcuaaacggauuccucacuucaguagcuuaccgcuggaugaccagguuauccuuuugagggccggauggaacgagcugcuaauagcauccuuuucucaucggagcaucgaugugcgcgacgguauucuccuggccacuggccuucacguacacagaaauucagcucauagugcgggggugggagcaaucuucgauaggucccugagccgugucuugacagagcucgugucuaagaugcgggacaugcgaauggauaaaaccgaacugggcugcuuaagagccauuauccuguuuaacccagacgcuaagggucucucaaaucccagugagguugaagugcuuagggagaaagucuaugccagccuggaaacguacuguaagcaaaaauauccugagcagcaggggcgcuucgcaaaguugcuacugcggcucccagcccugagauccauaggccuuaagugccuggagcacuuguuuuucuuuaaacucauuggagauacucccaucgacaccuuccugauggaaauguuagaggcuccucaucagcuggccuga

SEQ ID NO: 62103 - RNA, 1392 nt, Artificial Sequence
  derived and/or modified sequence opt3 from RXRG__Homo_sapiens__NP_008848
auguacggcaacuauagccacuucaugaaguuucccgccggguacggagguuccccuggccauaccgggucuacaucaaugaguccaagcgcugcacuguccacuggaaaaccgauggacucucaccccucguauacggauaccccugugucagccccaagaacacucagcgcggucggcacuccccuuaaugcucuggguaguccuuacaggguuaucaccuccgccauggggccacccucuggagcauuggccgcuccuccaggcauuaacuuaguggcaccgcccagcucccagcugaauguagugaacucagucaguagcucugaggacauaaagccucuaccaggccuccccgggaucggaaauaugaacuauccuuccacaucaccagguagccuggugaaacauauuugcgccaucuguggcgaucggaguucugggaagcacuacggaguuuauuccugcgaaggcuguaaagguuucuuuaagcgcaccauucgaaaggaccuuaucuacacuugccgugauaauaaagacugucugauagauaagagacaaaggaaccggugccaguacugucgcuaucagaaaugcuuggugauggggaugaagagagaggcuguccaggaagagaggcaacggagccgcgaacgagccgagucggaggcggaaugugcaacaucuggacaugaggacaugcccguggaaagaauccucgaggccgagcuggcuguagaaccgaaaaccgaguccuacggcgauaugaauauggaaaacucaacgaaugacccuguuacuaacauuugccacgccgcagauaagcagcuguucacccucguggagugggcuaagaggaucccccacuuuagugacuuaacacuggaagaucaggucauucuuuugcgggccggcuggaaugagcugcuaaucgcgagcuucucccaucguucugugagcgugcaggacgggauacuccuggccacuggacuucacguccaucgcucaagugcacacuccgcugguguuggcagcauuuuugacagagugcugaccgaguugguaucuaaaaugaaggauaugcaaauggacaaaucagaacucgggugucugagggccaucguguuauucaacccagaugcuaagggacugaguaauccuagcgaggucgaaacacuccgggagaaaguguaugccacccuugaagcauacacgaagcagaaauaucccgagcagccaggccgauuugccaagcuguugcuacgccugcccgcucucagauccauuggucugaagugccuugagcaccuguucuuuuucaaauugaucggggacacuccuaucgauacauuucucauggaaaugcuggagaccccauuacagauuacuuga

SEQ ID NO: 62104 - RNA, 687 nt, Artificial Sequence
  derived and/or modified sequence opt3 from RYBP__Homo_sapiens__NP_036366
augaccaugggcgacaagaaaagccccacaagaccuaagaggcaggccaaaccagcugcagaugagggguucugggacugcuccguguguacuuuucggaacucugccgaagcguucaagugcucaaucugugauguccgcaaaggaacgaguacccgaaagccgcguauuaauagccaacugguugcucaacagguggcccagcaguacgcaacacccccuccacccaagaaagagaagaaagaaaagguagagaaacaggacaaggaaaagccugagaaagauaaggagauauccccaucugugacuaaaaagaacaccaauaaaaagacaaaacccaagucggacauccucaaggauccuccaucagaagccaacagcauucagagugcuaaugcaaccacuaaaacauccgagaccaaccacacgucuagaccgaggcuuaagaaugucgaccggagcacugcccagcaacuggcugugaccguugguaacgugacagucaucauuacugauuuuaaagaaaagacccgcuccucaaguacaucuagcuccaccgugacgucaagcgccggcagugagcagcagaaucagucuuccagcgggucggagucuacugacaaaggauccucaagaaguagcacacccaagggcgauauguccgcgguaaacgacgaaucuuucuga

SEQ ID NO: 62105 - RNA, 1833 nt, Artificial Sequence
  derived and/or modified sequence opt3 from RYK__Homo_sapiens__NP_001005861
augagaggcgccgcuaggcuggggcggcccggacgcagcugccucccuggugcacgaggccuucgugccccaccgcccccuccacuguuguuacugcuagcgcuccugccccuucugccugcuccaggggccgcagccgcucccgcaccuagaccaccggaguugcaguccgccucugcuggacccucagugagucucuaccugagcgaagacgaggucaggcggcugaucggccucgaugccgaauuauauuacguucgcaacgaccugauuucccacuaugcgcuuucuuucucguugcuggugccuucagagaccaauuuucuacauuucacauggcacgcaaagagcaaaguagaauacaagcucgguuuucaaguggauaacguccuggccauggacaugccacaggugaauauaaguguucagggggaggugcccagaacucuuuccgucuucaggguggagcugucuuguacgggaaaaguagauagcgaaguuaugaucuugaugcagcucaaccugaccgugaauaguucaaagaacuuuacagucuuaaauuucaaacggcgcaagaugugcuauaagaaacuggaggaagugaagacuuccgcucucgacaaaaacaccagccgaacaauuuacgauccugugcaugccgcaccaaccacuucuacaagagucuuuuauaucuccguuggcguguguugcgcuguaauuuuccuuguggccaucauacuggcggucuugcaccuacauucaaugaagaggaucgagcuggacgauagcauuagugccucuuccagcucgcaaggccucucucagcccuccacccagacgacucaguaccugcgggcagacaccccgaauaacgcuacaccuaucacuucaagucuuggguaccccacccugcguauugagaaaaaugauuugcgcagcgugacacuccuggaagccaagggaaagguuaaagacaucgcuauauccagagagaggauuaccuuaaaggaugugcugcaagaagguacguuuggccggaucuuccacgggauucuaaucgacgagaaagacccaaacaaggaaaaacaggccuuugucaagacugugaaagaucaggcaucugagauccagguaacaaugaugcucaccgagagcuguaagcugcgaggacuucaccaucgcaauuugcugccuauuacucacguuugcauagaagagggcgaaaagcccauggugauccucccauauaugaacugggguaaucugaaacuuuuccugagacaauguaaguuggucgaggccaacaacccccaggcuauuucacagcaagaccucgugcauauggcgauccagauagcaugcgggaugaguuaccuggccaggcgggaagucauucacaaagauuuagcugcccgcaauugugugaucgacgauacacugcagguuaagaucaccgacaacgcacuauccagagaucucuuuccuauggacuaucacugccugggagauaaugagaacaggccagugcguuggauggcccuugagagcuugguaaauaacgaguucucuucagcuagugacgucugggccuucggcgugacgcugugggagcucaugacccugggccagacaccguacguugauauugaccccuuugaaauggcagcguauuuaaaagacggguaccggaucgcucaaccuauuaauuguccagaugagcuguucgccgugauggcaugcugcugggcccuugaccccgaagaacgaccuaaguuucagcaguugguccagugucucacugaguuccaugcugcccugggagcauauguguga

SEQ ID NO: 62106 - RNA, 15117 nt, Artificial Sequence
  derived and/or modified sequence opt3 from RYR1__Homo_sapiens__NP_000531
augggcgaugccgagggggaagaugaggugcaguuccugagaaccgaugaugaagucguucuccaaugcagcgcuaccgugcuuaaggagcagcugaaauugugcuuagcugccgaaggauuugguaacagacugugcuuccucgagcccacuuccaaugcgcagaacgugccuccggaccucgcuaucuguugcuuugugcuggagcagucucuuucaguccgggcccugcaagaaauguuggcaaauacgguggaggccggcguugaaaguagccagggugggggccaccgcacccuccuguacggucacgcuauucugcuccgacacgcacacucccguauguauuuaucuugucugacuacuucgagaucaaugaccgauaaacuugccuucgacgugggguugcaggaggaugcuacaggagaggccugcugguggaccaugcacccggcgagcaaacagagaagugaaggcgagaagguccgggugggcgacgauauaauccugguauccguuucuagcgaacgcuaccuacaucucuccacugcaucaggggagcugcaaguggacgccaguuuuaugcagacacuuuggaacaugaaucccauuuguagcagaugcgaagagggauucgucaccgguggccacgugcugagguuguuucacgggcauauggaugagugucucacgaucucuccugcugacuccgaugaccagcggcgccugguguauuacgaaggaggcgccgucugcacucacgcacgaucauuauggagacuggagccacucaggauuagcuggagugguucucaucuucggugggggcagccccugcguguucgccacgugaccacaggacaauauuuggcucuaacugaagaccagggccugguaguggucgaugccuccaaagcgcacaccaaggccacuagcuucuguuuuagaaucucgaaggagaaacucgacguggcaccuaagagggauguugaaggcauggggccacccgagauaaaauacggagagucucugugcuucgugcagcaugucgcuuccggucuuuggcugaccuaugccgcuccugacccaaaggccuugcggcucggcgugcugaaaaagaaggcaauguuacaccaagaagggcauauggaugacgcccugucacuaacgcgaugccagcaggaggaaagucaggcugcgcgcaugauccacagcacuaacggacucuacaaucaauuuauuaaaucccuggauucuuucagcggcaagccgagagguucagggcccccugcaggcacagcccuuccaaucgagggaguaauuuugagucugcaggaccucaucauauacuuugaacccccuuccgaggaucugcagcaugaggaaaaacagagcaaacuuaggucucugcggaaccgccaaucauuguuccaggaggaaggcaugcucaguaugguucugaauuguauugacagauuaaacguguauaccacugcugcccacuucgcagaguuugccggggaggaagcugccgagagcuggaaagaaaucgucaaucugcuauacgagcuccuggcaucccuuauuaggggaaaccguucuaauugcgcguuguucucgacaaaccuggauuggcucgugagcaagcuggaccgguuagaggcuuccucagguauccuggagguccuuuauuguguguugaucgagaguccagaaguucucaauauuauacaggagaaccacaucaaaucuauuaucagccugcuagacaagcauggccgaaaccacaaggugcuggauguacucugcucccugugugucugcaaugggguggccguuagaucaaaccaggaccuuauaaccgaaaauuugcugcccggaagggaguuacuccugcaaacgaaccuuauuaauuacgugaccagcauccgcccgaacaucuuugucggccgggcagaagguacaacucaguauucuaaaugguacuucgaggugaugguagaugaggugaccccuuuucugacagcccaggcuacucauuugagaguugggugggcccucaccgaaggcuauacacccuacccaggagcaggcgagggguggggagguaauggcgucggggacgaucuguacuccuauggauucgacggccuacaccuguggaccggucacguggcuaggccugugacaagucccgggcagcaucuccuggccccagaagaugucauuagcuguugccuugacuugucuguucccuccaucucauuucgcauuaacggcuguccugugcaaggaguguucgagaguuuuaaucuggauggcuuauucuuuccaguagucagcuucucggcgggggugaagguucgauuucuccugggaggccggcacggugaguucaaauuccuuccgcccccuggguacgccccaugccaugaggcugugcugccccgugagagacuacaccucgaaccuauaaaggaguauaggcgcgaaggaccacggggcccccaucuggucgguccguccagauguuugucucacacggacuuugugccuugcccaguugauacagugcagaucguacugcccccucacuuagagaggauucgagagaaacucgcagaaaacauccaugagcugugggcccuuacccgcaucgaacagggcuggacuuacgggcccguccgggacgauaauaagagacugcacccaugcuugguggacuuccauagccucccugagcccgaaaggaacuauaaucugcaaaugucaggagagacccuaaagacacugcuugcucucggcugucacguggggauggccgacgagaaagcagaagauaaccugaagaaaaccaaguugccaaaaacuuacaugaugaguaauggauauaagccggcgccucuggacuuaucccauguccgucucacacccgcccagacgacccugguugaucgccuugcugagaacggccacaacgugugggcccgggacagaguaggucagggguggucuuacagcgcagugcaggauauuccagcuaggcgaaauccccggcuggucccuuaccgcuugcucgacgaagccacuaagagauccaacagggauucacugugccaagcagugcggacacuacugggauauggcuacaauauagagccacccgaccaggaaccuagccagguugagaaccagagucgaugugauagagugcgcaucuuuagggccgagaaaucuuauaccguccaauccggucguugguacuucgaauuugaggcugugacaacuggcgaaaugcggguugggugggcgagaccggagcuuaggccagacguggaacucggagccgaugagcuggcauaugucuucaauggccaccgcgggcagcgauggcauuugggaagcgagcccuuuggcagaccuuggcagccaggugacguaguggggugcaugauugauuuaaccgaaaacacgaucauuuucacccugaauggagagguucucaugucggacucaggcucugaaacagcuuuucgggagaucgagauaggugacggcuuccugcccguguguagucuugggccuggacaggucggccaccugaacuuggggcaagauguguccagccuaagguuuuucgccaucugcggacugcaggaaggcuuugagccguucgccauuaauaugcagcgccccguaacuaccugguucucuaagggucucccacaauuugaaccugugccccuggagcauccacacuacgaagucagccguguugacgggacaguggauacuccucccugucuuagauuaacccaccggacguggggaucccagaacucacugguggagaugcuauucuugaggcugagucucccaguccaguuucaucagcacuuccgcugcacagcuggcgcaaccccgcuggccccucccggccuucaaccacccgcggaggacgaagcucgagccgcagagccugauccagacuaugaaaaucugagacggagcgccgggggauggucugaggcugaaaacgguaaagagggcacugcaaaggagggggcccccggaggcacaccucaggcggguggggaagcucagccggccagggcagagaaugaaaaagaugccaccacugagaagaacaagaaacgcggauuuuuguucaaggcuaaaaagguggccaugaugacccagccacccgcaacaccuacgcuacccagacugccacaugacguuguaccugcugauaauagggacgaucccgaaaucauucucaacaccacuacauacuacuauuccgugcgggucuuugccggccaagagccaucaugugugugggcgggcuggguuaccccugacuaccaccagcaugacaugaguuucgauuuaagcaaagugcgugucgugacaguaacuaugggggacgagcagggaaacguccacuccucucugaagugcucgaauuguuauauggugugggguggcgauuuuguuagcccggggcagcaaggacgcaucucacacaccgaccuugugauaggcugccuggucgaucucgccacggguuugaugacauucaccgcaaacgggaaagaauccaauacauuuuuccagguggagcccaacaccaagcuguucccagcuguuuuugugcucccuacacaucagaaugucauucaguucgaacugggaaagcagaagaacaucaugccccuuagugccgcuauguuucagucugagcgaaagaauccagcaccucagugucccccgagacuagagaugcaaaugcugaugccagugagcugguccaggaugccuaaccacuucuugcagguagaaacucggcgcgccggcgagagauuaggcugggccgugcagugucaggaaccccugaccaugauggcucuccauauuccagaggaaaauaggugcauggacauccuggagcuuucagagcggcuggaucuccaacgauuucacucucacacauugagacuguaccgcgcgguuugugcacuagggaacaauagggucgcccaugcucugugcagccacguggaccaggcccagcuccuucaugcacuggaagaugcccacuuacccggaccuuugcgggcugguuauuacgaccugcucauaaguauccaucuggaguccgcgugucguagcagaaggucuaugcuuucagaauauauugugccgcugacgcccgagacccgcgccaucacucucuucccaccuggccgguccacagaaaacgggcacccccgacacggauugccuggcgucgguguaaccacaagucugagaccaccccaucacuuuagcccuccaugcuucguggcagcuuuacccgccgcaggggccgcugaggccccggcgaggcuaucgccugcaauuccacuggaggcccuccgcgauaaagcacuucggaugcugggagaagccguuagagacggcggccagcaugcucgugaucccguagggggaucugucgaguuucaauucgugccuguuuugaagcugguguccacacuccuggucauggguaucuuuggcgacgaagacgugaaacagauacuuaagaugauugagccagaaguauucaccgaggaggaagaggaagaggaugaggaagaggaaggggaggaagaggacgaggaagagaaggaagaggaugaagaggagacggcacaggaaaaagaggacgaagagaaggaagaggaggaagccgcugagggagaaaaagaggagggccucgaagagggucuguugcagaugaagcugcccgaaagcgugaaauuacaaaugugucaccuacuggaguacuuuugcgaucaggaacuccagcacaggguugagucacuugccgcauucgcggagcgguacgucgacaagcugcaagccaaucagcgcagucgauauggguugcugaucaaggcuuucucuaugacugccgcagaaaccgcuagaaggacacgggaguuucgcuccccgccucaggaacagaucaacaugcuccugcaauucaaagauggaaccgacgaggaagauuguccccuuccagaggagauuagacaggacuuacuggauuuucaucaggaccucuuggcccacugcggcauccagcuggauggcgaagaggaagaaccugaagaggagacuacacuagggagcaggcugaugucacuccuugaaaaggugcgacuggugaaaaagaaagaggaaaagcccgaggaggaacggagugcagaggaaagcaagccacguuccuugcaagagcuggucucucauaugguugugagaugggcccaggaagacuucguacagagccccgagcucgugcgcgcuauguuuucccuguuacacaggcaguacgacggacuuggugagcugcuccgggcgcuaccuagagccuauaccauuucaccaucuagugucgaagauacaaugucgcuguuggagugucugggccaaauacgcagccuccuuaucgugcagauggggccgcaggaagagaaucugaugauucaguccaucggaaacauuaugaacaauaaaguuuucuaccaacaucccaacuugaugagggcacugggcaugcacgaaacugugauggaggucaugguaaaugugcucggugggggcgagucuaaggaaauccgauuuccuaaaaugguuaccucaugcugccgguucuuauguuauuuuugcagaauaagcaggcagaaccagcgcuccauguucgaccaccugaguuaccuucuggaaaauucuggaaucggccuagggaugcaaggaagcacgccacucgauguggcugccgccucagucauugacaacaaugaacuggcauuggcucugcaggagcaggaucucgaaaagguggucuccuaucuugccgguuguggccugcagaguugccccauguuaguggcgaaaggguacccugacaucggauggaacccauguggcggugagcguuaccuggacuuuuugcgguucgcuguuuuugugaauggggagagcguagaagagaacgccaauguggucguuagacuccugauuaggaagcccgaaugcuucggcccugcacuacgcggagagggcgggucuggacuucuggccgcuaucgaggaagcaauacgaauuuccgaggacccggcccgggaugguccaggcaucagaagggaccgcagacgggaacauuucggggaggaacccccugaggagaacagggugcaccucggacaugcgaucaugucauuuuaugcugcccugauugauuugcugggccguugugcacccgaaaugcaccucauacaagccgguaaaggggaggcacuucgaauccgcgccauucugaggagcuuagucccacuggaagacuuggugggcaucauuucgcucccucugcagauccccacacuaggaaaggacggcgcacuuguacagccaaagaugucugcuaguuucgugccggaucauaaagccuccaugguucuguuucucgaccggguguacgggauagagaaucaggauuuccuguugcacgucuuagacgugggauuucugccugauaugagggcggccgcaagccucgacaccgcuacuuucucaaccacagaaauggcccuugcacugaaccgcuaucuaugccuggcuguccuccccuugaucacuaagugugccccacuguuugccggcaccgagcacagagcgauuaugguggauuccaugcuucauacgguuuaccggcugucuaggggucgaagccucacaaaagcucaacgugacguaaucgaggauugcuuaaugagucuguguagauauauucgccccuccauguugcagcaucugcuccggaggcuuguguucgacgucccuauccugaaugaauuugcaaagaugccacuaaaacugcucaccaaccauuacgagagaugcuggaaguauuacugcuugcccacugggugggccaauuucggagugacaagcgaagaggaacugcaccuuacccgcaagcuguuuuggggcauauucgauucuuuagcucacaaaaaguacgacccugagcucuaucggauggccaugccgugucugugcgcaauugccggugcuuugccacccgauuacguugacgcgucauauaguuccaaagccgagaagaaagcaacuguggacgcugaaggcaacuuugauccuaggccagucgagacacugaacgugaucauccccgaaaagcucgacagcuucauuaauaaguucgccgaguacacccaugagaaaugggcauuugauaagauccagaacaauuggucuuauggggaaaacauagacgaggaacuuaaaacgcacccuaugcugcgacccuacaagacuuucucggagaaagauaaggaaauuuauagauggccaaucaaggagucacuaaaagccaugauugcuugggaguggaccaucgaaaaggcccgggagggagaagaggaaaagacugagaagaaaaagaccaggaagauaagccaguccgcgcaaacauacgacccgcgcgagggcuacaauccucagcccccagaucugagugcaguaacucucucucgugaauugcaggccauggcugagcaacuggccgaaaacuaucauaauaccugggggaggaaaaagaaacaggaguuagaagcaaagggaggcgguacgcacccucuucuggugcccuacgacacacucacugcuaaagagaaggcccgagauagggagaaagcucaggaacuguugaaguuucugcagaugaacggguaugccguuacccggggacucaaggacauggagcuugauagcuccucaauugaaaaacgcuucgcauuuggcuuccugcaacagcuacugagauggauggacaucagucaggaguuuaucgcgcauuuagaggccgucgugucuagcgguaggguggaaaaguccccacacgagcaggaaauuaaauucuuugcuaagauccuccugccuuugauuaaucaauacuucacaaaccacugucuuuauuuucugucaacccccgccaaaguccucggcagcgggggacaugcaucuaauaaggagaaggaaaugauaacuucccuguucugcaaauuggcugcccugguucggcaccgcgugagucuauuuggcaccgacgcaccggccguagugaacugucuccauauccuugcgagaagccuggaugcucgaacagucaugaagucggggccagagauugugaaagccggauuaagguccuucuucgagucugcaucagaagacaucgagaagaugguugaaaaucugcggcucggcaaagugagccaggcccguacgcaggucaaggguguggggcagaaccugacuuacaccacaguagcuuugcuuccuguucugaccacucucuuucaacacaucgcccagcaccaguucggagaugacgugauucuggaugacguccaagugaguugcuaucgcacacuauguuccauauacucuuugggcaccacgaagaauacuuacguggagaaacugagacccgcacucggcgaaugccuugcuaggcuggccgcggcuaugccagucgccuuuuuagagccccagcugaacgaguauaacgcauguagcguuuacacaaccaagucaccucgggaaagagccauccucgggcugccaaauuccguggaggaaaugugcccagauauucccguauuggagcgccuuauggcugacaucggaggucuggcagaaaguggcgcccgauauaccgagaugccucaugugauugagaucacucuccccaugcuguguagcuaccuaccaagguggugggaacgggggccugaggcgcccccaucugccuuaccugcuggagcaccgcccccaugcacagccgucaccucagaucaccugaacuccuugcucggcaauauacugagaaucauugugaacaaucuugguaucgacgaagcuagcuggaugaaacgucuggccguuuucgcacagccuauugugucucgcgcuaggcccgagcuccugcagagucauuuuaucccaacaauagggcgguugagaaagcgagccggaaaagucgugucggaggaagaacaacuuaggcuggaagcgaaggccgaggcacaggaaggcgagcuacucguacgcgaugaguucuccguucugugccgggacuuauaugcucuguacccuuugcucauuagauauguggauaacaauagggcccaguggcugacugaacccaacccgagcgcagaggaacuuuuucgcauggucggcgagaucuucauuuacuggucaaagucucacaauuuuaaacgugaagaacaaaacuucgugguucaaaaugagaucaacaauaugagcuuucugacggccgacaacaaguccaaaauggcuaaggccggggacauacagaguggagguucagaucaggaacggaccaaaaagaaaagacgaggcgacagguacucugugcagacaagccucaucgucgcgacuuugaagaagaugcugccaauugggcuuaauaugugugcuccuaccgaucaagaccugaucacauuagcaaaaacccgcuaugcccuaaaggauacugacgaggaagugcgggaguuccuccauaacaaccugcaucugcagggaaaaguagaaggcucccccaguuugagauggcagauggcucucuacaggggugugccagggcgcgaggaggaugccgacgaucccgaaaagauugucagacggguucaggaggugagcgcaguccuguauuaccuugaccaaacggaacacccuuauaaauccaagaaggccguguggcauaaacuguuaucuaagcagcgaaggcgugcuguaguggcgugcuuuagaaugacaccccucuacaaucugccaacacaccgggccuguaacauguucuuggagucauauaaagcagccuggauccuuacugaggaucauagcuucgaagaccgcaugauagaugaccugucgaaggcuggagagcaggaagaggaagaggaggaaguugaggagaaaaagccugacccgcuacaccaacucgugcugcauuuuuccaggaccgcacugacagagaagaguaaauuggaugaagacuaccucuacauggccuaugcugauauuauggccaagucuugccaccuggaggagggcggcgaaaauggggaggcggaagaggaagucgaggugagcuucgaggaaaaacagauggagaagcagcgacuucuguaccagcaagcaagauuacacacccggggagccgcugaaaugguucuccagaugaucucagccuguaaaggugagacuggcgcaauggucuccucuacacugaagcuagggaucaguauuuugaacggaggcaaugcugaggugcagcagaagaugcuggacuaucuuaaagauaagaaagaagugggauuuuuccaaagcauccaggcccucaugcagacgugcuccguacuggaccugaacgcguuugagcgccagaauaaggccgaaggguugggaauggucaacgaggauggcaccgugauaaauaggcaaaacggcgaaaaaguuauggcugacgaugaguucacucaggaccuuuuuagauuccuccagcuguuaugugaggggcauaauaacgauuuucaaaauuaccugcggacacagaccggaaacaccacaacuauuaauaucauuaucugcacgguggacuaucuacuccgucugcaggaaucaauaagcgacuucuacugguauuacucugguaaggaugucaucgaggaacagggcaaacgcaacuuuaguaaggcaauguccguggccaagcaaguuuucaacagcuugaccgaguacauucaggggcccuguacaggaaaucagcagucacuggcucacucuaggcuuugggacgcagugguaggcuuucuccaugucuucgcccacaugaugaugaaacuggcucaagauuccucgcagaucgaauuacugaaggaguugcucgaccugcagaaagauaugguggugaugcuucugagccuacucgaggguaacguugucaaugggaugauugcccgacagaugguggacaugcugguagaaaguucuuccaacguggagaugaucuugaaguucuuugauauguuccugaaacuuaaggacauugucggaagcgaagcauuucaagauuaugugacugacccaagaggccucaucucaaagaaagauuuccagaaggccauggacagucagaaacaguuuuccggcccugagauacaauuccuguuaagcugcucugaagcggaugagaaugagaugauuaacugugaagaguuugcuaaucgguuccaggaacccgccagggacaucggguuuaacguugcagugcuguugaccaaucucucagagcacgucccacaugacccucgccugcacaacuuccuugagcuggccgaaagcauccuagaguacuuuagacccuaucucggacggauugaaauaaugggugcuuccaggcgcaucgagcgaauuuacuucgaaaucucugagacaaauagagcccagugggagaugccgcaagugaaggaaaguaaacgucaguucauuuuugauguugugaacgagggcggggaagcagagaagauggaacuguucguaucguuuugcgaggacaccaucuucgagaugcagauagcugcccagaucagcgaaccugagggagaaccagagacugaugaagacgagggcgcgggugcagccgaggcuggggccgaaggagcugaggaaggcgcagccggcuuggaggggacggcggccacagcugcagccggagcuaccgcccgggucguggcagccgcugguagggcgcugcgcggccuuuccuauagaucauuacggaggcgaguuagacgccugcggaggcucacugcccgugaggcagcuaccgccguggcagcccugcuaugggcugcggucacaagagccggggcagcuggagccggcgccgcugcuggugccuuggggcugcucuggggcucucuuuuuggaggcgggcugguggaaggagcuaagaaaguaacugugaccgagcuccuggcggguaugcccgauccuacaagcgacgaaguccauggcgagcaaccagccgggcccggaggcgaugcagacggugaaggggccagugagggcgcuggagaugcagccgagggcgcuggggacgaagaggaagccguucacgaggcaggaccugguggcgcggauggggccguggcugugacggacggaggcccauuccgccccgaaggugccggcggguuaggagauaugggcgacaccacuccggcagagccucccacaccagaggggucccccauuuugaagaggaaacugggagucgacggcguggaagaggaacuuccuccagagcccgaaccugagccagagccggaacuggagcccgaaaaggcugaugccgagaauggugagaaagaagagguuccugaaccaacccccgagccuccaaagaagcaggcgcccccgucaccuccacccaaaaaggaagaggccgggggagaguuuuggggcgaacucgagguacagcgggugaaauuccugaacuaccuaucucgaaauuuuuauacucuuagauuccuggcucucuuuuuggcauucgccaucaacuuuauucuguuauucuacaaggucagcgacuccccucccggugaagaugacauggagggcagugcugcaggggaugugagcggagccggcucugggggaucauccggcuggggucugggggccggagaagaggcugagggcgacgaagaugagaacaugguuuacuauuuccucgaagagagcacagguuacauggaaccagcacuucgcugucugaguuugcugcauacccucguggccuuucuaugcaucauaggcuauaauugccugaaagucccgcuugugauuuucaagagggagaaggagcuggcgcggaaacucgaauuugacggguuguacaucacggagcagccugaagaugacgauguaaagggacaaugggacagacugguguuaaacacccccucuuucccauccaauuauugggacaaauuugucaagcguaaaguucuggauaagcacggcgacaucuacgggcgcgagaggauugcugagcuccuuggaauggaucuggccacauuggaaauaacugcacacaacgagcggaaacccaauccuccacccggccugcucaccuggcuaaugucgaucgacgugaaguaucagauuuggaaguucggugucaucuuuacagauaacagcuuccuguacuuagggugguacauggugaugucacugcucggacauuauaauaacuuuuucuuugccgcucaccuuuuggacauugccaugggcguuaaaacucugcgaaccauccuguccucugugacacauaauggcaagcagcucguaaugaccguggggcuucuggcagucgugguuuacuuguauacugucguggcuuucaacuuuuucagaaaauucuacaauaagagugaagaugaggacgaaccugauaugaaaugugacgauaugaugacgugcuaucuguuucacauguacgugggaguaagggccgguggcgggauaggagacgagaucgaggauccagcgggcgacgaauacgagcucuaucgcgucguguucgacauuacauuuuucuuuuucguuaucgugauucuacuggcaaucauucaggguuuaauaaucgaugccuuuggggaacuucgggaccaacaggagcaggucaaggaagauauggagaccaaguguuucauuugcggaaucggcagcgacuacuuugauacuaccccgcacggcuucgagacacauacgcuggaggagcacaaccucgcuaauuauauguuuuucuugauguaccugaucaacaaagacgaaaccgagcauacugggcaagaaucauauguguggaagauguaccaggagagauguugggacuuuuuccccgccggagacugcuuccgaaaacaguaugaggaucagcuguccuga

SEQ ID NO: 62107 - RNA, 14958 nt, Artificial Sequence
  derived and/or modified sequence opt3 from RYR2__Homo_sapiens__XP_006711865
auggccgacggcggggagggagaagaugagauccaguuccugaggaccgacgaugaagugguccuccaaugcacugcuacuauucacaaggagcagcagaaacuuugucuggccgccgaagguuuuggcaauagguugugcuucuuagagagcacguccaauucuaagaacguucccccugaccugucaauauguaccuuugugcuugagcagagucucagcgugcgggcgcugcaagaaaugcuugcuaauacaguggagaaguccgaagggcaggucgauguggagaaguggaaguucaugaugaagacugcccagggaggcggucaucgcacccuguuguacgggcacgcaauccuccugcgacauucuuauucgggaauguaccugugcugucucucaacaagccguaguuccaccgacaaguuagccuuugauguuggccugcaggaggacacuacaggcgaggcuugcugguggaccauucacccagcaucuaagcaaagaagcgagggggaaaaggugagggucggagaugaccuuaucuugguguccgugucaagugagcgguaucugcaucuaagcuacgguaacggcucucuccacguugaugccgcuuuccagcagacgcugugguccguggccccgauuucaagcgggagugaagcggcacagggauaucuuaucggcggugacguccugcgcuugcuccacgggcauauggaugagugucugacugugcccucuggagagcacggcgaagaacaaagaaggaccgugcauuacgaaggcggggccgucuccguucacgcucggagcuuauggcgccuggagacacuccgaguggccuggucgggaucucacauaagauggggucagccuuuuaggcuucggcauguaacuaccggcaaguaucuguccuugauggaagacaagaaucuacugcucauggacaaggagaaggcagaugugaagucaacagcuuucaccuuucguaguagcaaagagaagcuggacgucggggugcgcaaagaaguugauggaaugggcacguccgagaucaaguacggugacucugugugcuacauucagcacgucgauacugggcuuuggcugacauaucaaagcguggacguaaaaucaguuagaaugggcaguauccagaggaaggccauuaugcaucacgaaggacauauggaugacggcaucuccuugagccggucucagcacgaggaaucacgaaccgcgcgcgugauaagaaguacugucuuccucuuuaacagguucauucgggggcuggaugccuuaagcaaaaaggcaaaggcuuccacaguggaccugccaaucgagucugucucgcuaagccuccaggaucugauuggauacuuucaucccccugacgagcaccuugaacacgaggacaaacaaaaucgcuugagagcccugaagaacaggcagaaucucuuccaggaagaggguaugaucaaccuggugcuugaguguaucgaucgucugcauguuuauuccucagcugcccacuucgcagacguggccggccgggaagcuggggagaguuggaaaucuauuuugaauagccucuacgaacuguuagcggcacugauacgaggaaacagaaagaauugcgcccaguuuuccggcucacuagauuggcucaucagcaggcuggagcgccuugaggcuucuuccgguauuuuggagguacugcacuguguccucguggagaguccagaagcccugaacaucauaaaagaggggcauauuaagagcaucaucucuuuacuggacaagcacggccggaaucauaaaguucuugauguguugugcucccucugcgucugucacggaguggcaguaagaucaaaccaacaucugauuugcgacaaccuacugcccggcagggaucuccugcuucagacccgcuuggugaaucacguuaguagcaugcgaccuaacaucuuccugggggucucggaaggauccgcccaguauaagaaaugguacuaugaguuaaugguggaccacacggaaccauuugugaccgcugaggccacacaucuccgggucgguugggcaucuacugagggcuacagcccguaccccgggggaggcgaagaguggggugggaauggcguuggagaugaccuguucucauauggcuuugaugggcuucaccuguggaguggauguauugcgcguaccguguccucuccuaaccagcauuugcucagaacagacgaugugauaagcugcugucuggaccuauccgcuccaucaaucagcuucaggauuaauggccaacccguacaggguauguuugaaaacuucaauaucgacgggcuguuuuucccugucgugaguuuuucugccggaaucaagguucgcuuccuccugggcggucggcacggcgaguuuaaauuccuuccacccccgggguacgcaccuugcuaugaagccguguugcccaaggagaagcugaaagucgagcauuccagagaauacaagcaggagaggacuuauacccgagauuuacucggaccaacagugagccugacccaggcugccuucacuccuauucccguugacacgucgcaaauagugcuuccaccccaccuggaacgcauccgggagaaacuagcagagaacauucacgaacucuggguaaugaauaagaucgagcugggcuggcaguacgggccugucagagaugacaacaaaaggcagcauccauguuugguggaauuuucaaagcugccggagcaagaacguaauuauaacuuacagaugucucucgagacacugaagacccuucuggcuuugggaugccacgugggcauuagugaugagcaugccgaagacaaagucaagaaaaugaagcuccccaaaaauuaccagcugacuuccgguuacaagccugcgccaauggaucuuagcuucaucaaacugacccccucucaggaggccaugguugacaaacuugcugaaaacgcacacaaugugugggcccgcgaucggauaagacaaggguggacauauggaauccagcaggacguaaagaacaggcgaaacccucggcucgugccauacacccuguuggaugaccgcacuaaaaagagcaauaaagauucccugagagaggcugucaggacauuacucggcuaugguuacaaccuggaagcccccgaccaggaccacgcagcgcgggccgagguguguucaggcacgggggagcgauuuagaauuuuccgcgcugaaaagaccuaugccguuaaagcaggaaggugguacuuugaguucgaaacugugacagcuggcgauaugcgugucggguggagucggccgggaugccaaccugaccaggagcuuggcagcgaugaaagagccuuugcauucgacgguuuuaaggcccagagguggcaucaggggaaugagcacuauggacgcucuuggcaagcuggcgaugugguugguuguaugguggacaugaacgagcauaccaugauguucacacugaauggcgaaaucuugcucgaugacuccgggucagagcuggcguuuaaggauuucgacgucggagauggcuuuauuccaguaugcagucuagggguggcccagguuggacgaaugaacuucggcaaagacgugagcacucugaaguacuucaccaucugcggucuucaggaaggguacgagcccuuugcagucaauacgaacagagacauaaccauguggcucuccaaacggcugccucaauuccuacaggugcccucuaaucacgagcauauugaaguaacaaggaucgauggaacuauugacucgagcccauguuuaaaggugacccagaaaucauuuggcucccagaacaguaauacagauaucauguucuaucgccugucuaugccuauagagugcgcugaagucuuuagcaagacuguugccggcgggcuccccggagccggucuguucggcccaaagaacgaccuugaggauuacgacgcugauuccgacuuugaagugcugaugaaaaccgcacacgggcacuuggugccggaucgugucgacaaggauaaagaggccacgaagccugaguucaauaaccauaaagacuaugcgcaagaaaagcccucaagacuaaagcagcgguuucugcucaggcgcacaaaaccagauuacucuaccagccacagugcucgacugacugaggacgugcuugccgacgauagagacgauuaugacuucuuaaugcagacauccaccuacuauuacagcguucggaucuuucccggacaggaaccugcaaauguaugggugggcuggauuacuucugauuuccaucaauacgacaccgguuucgaucuggacaggguccgcacagugacgguuacccucggggaugagaagggaaaagugcacgaaucauuugccaucgacuccuuguguggcuucggcauuaagagaaguaacugcuauauggucugugcuggggagagcaugucgccaggacaggguaggaacaauaacggccuggagaucgggugcgugguagaugcagccucuggacuccugacuuuuauagcgaauggcaaagaacuuuccacauacuaucaggucgagcccagcaccaagcuguucccugcuguguuugcccaggcaacaucaccgaacguuuuccaauuugaauugggucggauuaaaaaugugaugccacuaagugccgggcuguucaagucugagcacaagaaccccgucccucaguguccaccccgucuccaugugcaguuuuuaucccacguucuguggagccgcaugccuaaucaguuccuuaaaguggacgucucacgaaucagugaaagacaaggauggcuggugcagugccucgauccguugcaguuuaugagccugcauauccccgaggagaacagguccguagacauucucgaacugacugagcaagaagaacuucuaaaguuccacuaccauacccugcgguuguauucugcugugugugccuuaggcaaucaccgcguugcacacgcucugugcagccaugucgacgagccacagcuccuguacgccaucgaaaacaaauauaugccuggccuucugagagcgggguacuacgaucucuugauugacauacaccuguccucauaugccacggcaaggcuaaugaugaauaacgaguacaucgugcccaugacagaagagaccaagucuauuacucuguuuccagaugaaaauaaaaagcauggacucccugguaucggccuuaguaccucgcugcggccccgaaugcaguucagcuccccaucuuucgugucaauuagcaacgaguguuaucaguacuccccggaguuuccuuuagacaucuugaagaguaaaacaauacaaaugcugacugaagcugucaaggaggggucucuccacgccagagaucccguaggaggcaccacagaguuccuguuugugccacuuaucaaacuguucuauacgcucuugauuauggguaucuuucacaaugaggaccugaagcauauuuuacagcuaaucgaacccagcguuuucaaagaggcugcaaccccugaggaagagucagauacucuggaaaaggagcucuccguggacgaugccaaacuucagggggccggagaagaggaggcuaaaggcggcaagcgcccaaaagaagggcuguugcagaugaagcugcccgagccugucaaacuccaaaugugccugcuucuccaguaccugugcgacugucaggugaggcaccggauagaagcgauuguugcauuuagugaugacuucguggccaaguugcaggacaaccaacguuuuagauauaacgaggucaugcaggcucugaauaugagcgccgcauuaacagccaggaagaccaaagaguuccgcucuccgccacaggaacaaaucaacaugcuacugaauuuuaaggaugacaaauccgagugccccuguccugaagagauccgggaucagcuccuugacuuccaugaagaucugaugacucacugcggaauugaguuggacgaggaugguucacuggacggcaacagcgaucucacaauacgagggagacugcuuucguuaguggaaaagguaaccuaccugaaaaagaagcaggcugagaaacccguggaaucugacaguaagaaauccagcacgcuccagcaauugaucucagagacuaugguuaggugggcgcaggaauccgucauugaggauccagagcuggugcgcgccauguuugugcuacugcaucggcaguacgacggaaucggcggucucgucagagcacuuccuaagaccuauacaauuaaugggguuucuguggaagauaccaucaaccuguuggcuagccugggacagauacguagucuccuguccguaaggaugggcaaagaggaagagaaguuaaugauccggggccuuggggacauuaugaauaacaaaguguucuaccaacaccccaaucugaugcgcgcccucggaaugcacgaaacugucauggaggugaugguuaacgugcuagguggcggggagagcaaggaaaucacauucccaaagauggucgcaaauuguugccgauuucuguguuauuucugcagaauuucuaggcagaaccagaaagccauguuugaccauuugucauaccugcucgagaauaguuccguaggacuugcuagcccugccaugcggggcucuaccccgcuggauguggcggcagccucgguuauggacaacaaugaauuggcucuggcccuccgcgagcccgauuuagagaagguggucagauaucuggcugguugugggcuucagucaugccaaaugcuggugagcaaaggcuacccagacaucggauggaacccugucgaaggcgagagguaucuagauuuccuccgauuugcaguguucuguaauggggaauccguugaggaaaacgccaacgugguagugcggcuguugauacguagacccgagugcuuuggaccagcucugcgcggugagggcgggaauggacuccuugccgcaauggaagaggcgauuaagaucgccgaagacccuaguagggauggccccucuccgaacagcgguuccucaaaaacacuggacacugaggaagaggaggaugacaccauccacauggggaaugcuauuaugacguucuacagugccuuaaucgaucuguugggccggugcgcaccagaaaugcaucucauacacgcuggaaagggcgaggccauuagaauccgcucuauucugaggagccuaaucccucuuggggaccuggucggaguuauauccauugcauuucagaugcccacaaucgccaaggacgguaacguggucgaaccagauaugucagcuggcuucugucccgaccauaaagcggccauggugcucuuucuggaucgaguauacgggaucgaggugcaggacuucuugcugcaccuccuugaaguuggauuucugccugauuuacgggcagcugccagccuggacaccgccgcauugucugcuacugauauggcccucgcgcugaauagauaucuaugcaccgcugugcuuccgcugcucacaaggugugcaccccuguucgcaggcacugagcaccaugccuccuugauugacaguuuacugcacaccgucuaccgccucagcaaggguugcucgcuuacgaaagcucagcgugauuccaucgaggugugucugcuaucuauuugcgggcaacugcggccaucaaugaugcagcaucucuugagaaggcuggucuucgacgugccucuucugaacgaacacgcaaagaugccccucaaauuacugacaaaucacuaugagcgcuguuggaaguacuauugcuugccuggcggauggggcaacuuuggggccgcgagcgaagaggagcugcaucucagucgaaaacuuuucuggggaauauuugaugcucugucccagaaaaaguacgaacaagagcuauucaaacuggcccucccauguuugucugcaguugccggcgcucugcccccugacuauauggaaagcaauuacguaucaaugauggagaagcaguccaguauggauagcgaagguaacuuuaauccacagcccguggacaccucuaacaucacuauuccggagaaacuugaguacuucaucaauaaguaugccgaacacucacaugacaagugguccauggauaaacuggcaaacggguggaucuacggagagauuuauagcgacucuaguaagguccagccuuuaaugaaaccauacaagcuccugucggaaaaagagaaggaaauauaucgguggcccaucaaagaguccuugaagacaaugcuggcuuggggcuggagaauugagaggacccgcgaaggugauagcauggcccucuacaauagaacucggaggaucucacaaacaucucaggugagcguugacgcggcccacggcuauuccccucgugcaauugauaugaguaacgugacccuuucacgagaccugcaugcuauggccgagaugauggcagaaaacuaccacaauaucugggcuaagaaaaagaaaauggagcuagaaucuaaagggggaggcaaccacccacugcucguccccuacgauacguugacugccaaagagaaggccaaggaccgcgagaaagcgcaggauauacugaaguuuuuacagaucaauggguaugcugugagcagaggauucaaagaccuugaacuggauaccccguccauugagaagcgguuugcauacaguuuccuccaacagcugaucagguauguagacgaagcccaucaguacauuuuggaguuugauggcgguagccgcgggaaaggagagcacuucccuuaugaacaggagaucaaguuuuucgcuaaggugguucugccccucauagaccaauacuucaaaaaccauagacuuuauuuucuguccgccgcaucucggccacuaugcucaggcggucacgccagcaauaaggaaaaagagauggucacaucgcuguucuguaaguuaggcgugcucgugaggcaccgaauuucccuguuugggaacgacgcuaccaguaucgucaauugcuugcauauucuuggacagacacuggaugcgcguacuguuaugaaaaccggccucgaaucuguaaagagcgcccugagagcauucuuggacaacgcugccgaggaucuggagaagacgauggaaaaucuaaaacaggggcaauuuacacacacucgcaaccagccuaagggaguaacccagaucauaaauuacacaaccguggcacuccuucccaugcugucauccuuauucgagcauaucggccagcaccaauuuggugaagaccugauucucgaggauguccaggugucuugcuaccggauccugacaaguuuguaugcccuugggaccagcaaauccauuuacguugaaaggcagagaucagcucugggagagugucucgccgcguucgcaggcgccuuuccaguggcuuuccuggagacacaucuagacaagcacaacaucuauagcauauacaauacgaaaucuagucgcgaacgggccgcauugucccugcccacuaacgucgaggaugugugcccuaauauuccaagccucgaaaaacuuauggaggaaaucguagagcuggcugagucaggcaucagguauacccagaugccgcacguuauggaagugauuuuacccaugcuguguucuuacaugucccgauggugggagcaugggccugaaaacaacccagagagagccgagaugugcuguacagcucucaauucggaacacaugaacacccuguugggaaauauccuuaaaauaauuuauaacaaucuggguaucgacgagggcgccuggaugaagcggcucgcagucuuuagccaacccauuaucaacaaggugaaaccucagcugcuaaagacucauuucuuaccacugauggaaaaauugaagaaaaaggcggccacaguggucagugaggaagaucaccucaaggcugaggccagaggggacaugucugaggcagaacugcuuauacuggaugaguuuaccacgcucgcucgcgaccuguacgccuucuaccccuugcuuauccguuucguugacuauaauagagcaaaauggcugaaggaaccuaacccggaggccgaagaauuguuucgaaugguggcggagguauucauuuacugguccaaaagccauaauuuuaagagggaagaacagaacuucgugguccagaaugaaaucaacaauaugucauuucucauuacugauacaaaaaguaagauguccaaggcugccgugagcgaccaagagcggaaaaagaugaaacgcaagggagauagauauucuaugcagaccucacugaucguugcagccuuaaaaaggcuguugccaauuggccucaacaucugcgcucccggugaccaggaacugauagcccuugcaaagaaucgguucagccugaaggauaccgaggacgaggugcgcgauauuaucagauccaacauccaccuccaagggaaauuggaagacccugcuauucgauggcagauggcccuguacaaggaucuucccaacaggacugacgauacaucugacccagagaaaaccgucgaacgggugcuggauauagcgaauguauuauuucaccuagagcagaagaguaaacguguuggacgcagacauuauugucucguggagcacccucagaggucgaagaaggcugucuggcauaaacugcugagcaagcaacggaaaagagccgugguugcaugcuuccgcauggcccccuuguacaaccucccacgacacagggcugugaaucuguuucuucagggcuaugaaaaguccuggaucgagacagaggaacacuacuucgaagacaaacugauugaggacuuagcaaagccgggcgccgagccucccgaagaggaugaagggacuaaacgggucgacccacuccaucagcugaucuugcuauuuucaagaacggcgcugaccgagaaguguaagcuagaagaggauuuccucuacauggccuaugcugacauuauggcaaaaucuugccacgaugaggaagacgaugacggagaggaagagguaaagagcuuugaaguaacagguagucagcguuccaaagagaaggagauggaaaaacaaaagcugcuguaccagcaggcccgcuugcaugauaggggcgcugccgagauggugcuccagacuaucucagcaucuaagggggaaaccggacccauggucgcugccacacugaaacuuggcauagcgauccugaacggugggaauagcaccguucaacagaagauguuagacuaucucaaagagaagaaagaugugggauucuuccagucccuggccggccuaaugcagaguuguagcgucuuggaccugaacgcauuugagcggcaaaauaaggcugaaggccuugggauggugacugaggaaggaucuggugagaagguacuccaggaugacgaguucacgugcgaccuguuuagauuccugcaguugcuuugcgagggccacaacucagauuuucaaaauuaccuccgaacccagacagggaacaauacuaccgugaacauuaucauuuccacaguugacuaucuguuaagggugcaggagagcaucagugauuucuacugguauuacucuggaaaagacgucauagaugaacagggccaacgcaauuuuuccaaggccauucagguggcaaaacagguuuucaacacccugacugaguacauccaggguccuuguacagggaaucaacagucgcuagcccauagccggcucugggacgcugucgugggauuucugcacguguucgcccacaugcagaugaaguugucacaggauuccucucaaaucgaacugcuuaaagagcucauggaccugcagaaggauaugguagucauguuacugaguauguuggaaggcaacgugguuaacggcacgauugggaagcagaugguggacaugcucgucgagagcucaaauaacguggagaugauacugaaauuuuucgauauguuccuuaagcugaaagaccuaaccuccagcgacacuuuuaaggaauaugauccagacggaaaagguguuaucucuaagagagauuuccauaaagcgauggagagucacaagcauuacacacaauccgaaaccgaguuucuccugagcugcgcugaaaccgacgagaaugagacauuggauuaugaagaguucgugaagagguuucacgaacccgcaaaagacauuggcuucaacguagccguccugcuuacuaaucucucagagcacaugccuaacgauacgcgccugcagaccuuuuuagagcuggcugaaucuguguugaauuacuuccagccguuucucgggcguaucgagauuaugggaucggccaagcggaucgaaagaguguauuucgagauaagcgaauccagucgaacacagugggagaaaccacaaguuaaggagucuaaaaggcaguuuaucuucgacgucgugaacgaaggcggugagaaggaaaagauggagcuguuuguaaauuucugugaagauacuauuuucgagaugcagcuugcagcccagaucucagagagcgaccugaacgaacgcuccgcuaauaaagaggaaagugagaaggaacggcccgaggagcaagggccuagaauggcguuuuucucuauucuaaccgugaggagcgcccucuuugcacugcgcuacaacaucuugacacugaugagaaugcuuuccuuaaaaucacugaagaaacagaugaagaaggucaaaaagaugaccgugaaagauaugguuacugccuucuuuagcucuuacugguccauuuucaugacgcuccugcauuuuguggcuagugucuuccggggauuuuuccgaauaaucugcucacuauugcugggcggcagccucguggaaggggcaaagaaaauuaagguugccgagcuucuggcuaauaugccagaccccacacaggaugaagugaggggagacggugaggagggcgaacguaagccucucgaggccgcgcugcccucggaagacuuaaccgauuugaaagagcugacugaagaguccgaccuucugucugauaucuuugggcucgaccugaagagagagggaggccaguauaaacuaaucccacacaacccgaaugcaggucuuagugaucugaugagcaacccuguacccaugccagaaguccaagagaaguuccaggaacagaaagccaaggaggaagagaaagaggaaaaggaggaaaccaagucagagccugaaaaagcugagggggaggacggagaaaaggaggaaaaagccaaggaggauaaaggcaagcagaagcuccggcaauugcauacacaccgcuacggcgagcccgaagugccagaguccgcauuuuggaaaaagauuauagcuuaucagcagaaacuguuaaacuacuucgccaggaauuucuauaacaugcgaaugcuggcgcucuuuguugccuucgcuaucaauuuuauucuucuguucuacaaggugucuacuagcagugucguggaagggaaagaguugccuaccagauccagcucugaaaacgcaaagguaacaucacuggacuccagcagucaucggaucauugccgugcacuauguccucgaggagucuucaggauacauggaacccacgcuacgcauccuggcuauacuucacaccguuaucuccuuuuucuguauuaucgguuacuauugccugaaggugccgcucgugauuuuuaaaagggagaaggaagucgcaagaaaauuggaguucgauggccuguacaucacugaacaaccaagcgaggacgauauaaaggggcagugggaccgguuagugauuaauacacagucguuuccuaacaauuauugggauaaauucguuaagcguaagguaauggacaaauacggagaguuuuauggccgcgacaggaucucugaacugcucgguauggauaaggccgcucuugacuucagugaugcccgagagaaaaagaaacccaagaaggacuccagccugucagcaguguugaacucuauugaugucaaauaccagauguggaagcugggggugguuuuuaccgacaauagcuuccucuaucuagccugguacaugacuauguccgugcugggccauuacaacaauuucuuuuucgcggcucacuuacuggauaucgccaugggauuuaaaacacucagaaccauacuuaguucagucacgcauaacggcaagcaauuggugcugaccguagggcugcucgcaguggucguuuaucuuuacacaguggucgccuucaacuuuuuccggaaauuuuauaacaagagcgaagacggagauacuccagacaugaaaugugaugacaugcugaccugcuacauguuccacauguauguggguguuagggcuggcgggggaaucggcgacgagauugaagaucccgccggugacgaguacgagaucuaucgcauuaucuuugauauaacauucuuuuucuuugugauuguaaucuugcuggcaaucauucaggggcucaucauagacgcuuucggcgaacuaagagaucagcaggagcaagugaaggaagacauggagacuaaguguuucauuugcggaaucggcaaugauuacuuugacaccgucccucacggguucgagacacauacccugcaggaacacaacuuagccaacuaccuauuuuuccugauguaucucauuaauaaagaugagacugaacauacgggacaggaguccuacguguggaagauguaucaggaacgguguugggaguuuuucccggcgggugacugcuuuaggaaacaauacgaggaucaguugaacuga

SEQ ID NO: 62108 - RNA, 14613 nt, Artificial Sequence
  derived and/or modified sequence opt3 from RYR3__Homo_sapiens__NP_001027
auggccgagggcggggaaggaggugaggacgaaauccaguuccugagaaccgaggaugaagugguccuccaaugcauugcuacaauacacaaggagcagaggaaauuuugucuugcagccgagggccuggggaaccgguugugcuucuuagaacccacuagcgaggcgaaguacaucccuccagaccuguguguuugcaauuuugugcuagaacagucccucucuguacgcgcucugcaggagaugcuugccaacacgggagagaauggcggugaaggggcagcccaaggaggcggccaucgaacccuguuguaugggcacgcugugcuccugcgucauucauucaguggaauguaccugacaugucucacuaccagcagaucccagacagauaaauuagcauuugacgucggucugagggagcacgccaccggcgaagcuugcugguggacuauucauccggccucuaagcagcggucggagggggaaaaagugcgcaucggagaugaccuuauuuugguuucagugagcagugagagauaucugcaccuauccgucucuaacggcaauauccagguggaugcgagcuucaugcaaacacucuggaacguacaccccaccuguuccgguucaaguauagaggaaggguaccugcuuggaggccauguugugaggcuguuucacggccaugacgagugcuugacgaucccuagcacugaucagaaugacucucagcaccggcgcauuuucuaugaagcagggggagccgguacccgagcuagaucccucuggagggucgagccacugcggaucucauggagcggcaguaacauucguugggggcaggccuuucgcuuaagacaccugacaacuggacauuaccucgcacuuaccgaagaucaaggccugaucuugcaggacagggcuaagucugauacaaaguccaccgccuucagcuuucgggcgucgaaagagcuaaaggagaaacuggacucuucccacaagcgagacauagaagguaugggggugcccgagauuaaauauggcgauucaguguguuucguccagcauaucgccaguggacucuggguuacguacaaggcacaagacgcuaagacuagccgccugggcccucuuaaaagaaaggugauucugcaccaggaagggcauauggaugacggauugacacuccagaggugccagcgggaggaaucccaagccgcucgcaucaucagaaauaccacugcccuguuuucucaguucguaagcgguaacaauaggacagcagccccaauuaccuuacccauagaggaggugcugcagacgcuacaggaucucaucgcuuacuuccaaccuccagaagaggaaaugcgucacgaggacaaacagaacaagcugcggucacuuaaaaaucgacagaacuuguuuaaggaggaaggcaugcuggcgcucguccugaauuguauugauagacuuaacguguauaacaguguugcacacuucgccgggaucgcuagggaggaauccggaauggccuggaaagagauacugaauuugcucuacaagcuguuagcagcccugauucgcggcaaccggaauaacugcgcucaguuuagcaauaaccuagacuggcucaucucuaagcuggauagacuugaaucaaguagcgguaucuuggaggugcugcauugcauucucaccgaguccccggaagcccugaauuuaaucgcagaggggcacauuaaaucuauaaucucgcugcuugacaagcauggcaggaaccacaaagucuuggauauucucuguagccugugccuauguaauggaguggcgguacgcgcuaaccaaaaucugaucugcgacaaccuccugccccgacggaaucuuuugcugcagacacguuuaaucaacgacguuacuuccauuagaccuaauauauuccucggcguggccgaagggucagcacaguauaagaaaugguacuuugagcugaucauugaucaggucgacccauuccuuaccgccgaacccacacaccugagggugggaugggcuaguucuagcgguuaugccccuuacccaggcgggggagagggcuggggugggaacggcgucggagaugacuuguauuccuacggcuuugaugggcuccaucuguggucaggacgcaucccccgggcaguggcuagcauuaaccaacaccuacugagaucugacgauguuguguccuguugccucgaccugggcguaccgaguaucagcuucaggauaaauggucagccuguccaggggauguuugagaacuucaauacugauggacuuuuuuuccccgugaugucuuuuuccgccggcguuaaggugcgauucuugauggguggccgccauggggaauucaaguuucugccaccuucaggauacgcgcccuguuaugaggccuuacucccaaaagaaaagaugcggcuggagcccgucaaagaauacaagagagacgcugauggcaucagggaccuucuggggaccacacaauuccuaagucaggcaagcuuuauuccuugcccaguggauaccucgcagguaauccucccgccccaccuggagaaaauucgugaccgcuuggccgagaacauccaugaacuguggggaaugaauaagauagaguuaggcuggacuuucgguaagauucgggacgauaacaaaagacagcacccuugucucguggaauuuuccaagcugccagagacggagaaaaauuauaaccuucaaaugucuacagaaacccugaagacuuugcucgcucuggggugccacaucgcccauguuaaucccgcagcggaggaagaccuaaaaaaggucaagcugccuaaaaacuacaugaugagcaauggauauaagccagccccccuugaucucucagacgugaaacuguugccgccucaggagauucugguggauaaguuagcugaaaacgcccacaaugucugggcaaaagacaggaucaagcagggcuggaccuacgguauacagcaagaucucaaaaacaagcgaaauccacggcugguucccuaugcucuucuggacgagcgcacaaagaaaaguaacagagauuccuugagggaggccgugcggaccuucgugggcuacggguacaacaucgaaccuucugaccaggagcucgcagauagcgccguagaaaaggucuccauugacaaaauccgauuuuucagaguggagcgcucauaugcuguuaggagcggaaagugguacuuugaauucgagguggucacuggcggggauaugcgugugggaugggcgcggcccggcuguagaccagacguugagcugggugccgacgaucaggcauuuguguucgaagggaauaggggacagcgcuggcaucaaggcagugguuauuuuggccgaacauggcagccuggggacguagucggaugcaugauuaaccuagaugacgcuucuaugaucuucacgcugaauggcgagcuucucauaaccaacaaaggguccgaacuggccuucgccgauuacgagauugaaaauggauuugugcccaucugcuguuugggcuuaagccagaucgguagaaugaaccuggggacugacgcuucgacauucaaguuuuauaccaugugcggacuccaagagggcuucgagccauuugcagugaauaugaaccgggaugucgccaugugguucucaaagaggcugccgacauuuguuaaugugccuaaagaccacccccauauugaaguaaugcgcaucgauggcacuauggacucuccacccugucuuaaggugacccacaaaacguucgggacccagaacaguaaugcggauaugauuuacugccgucuguccaugccugucgagugucacagcucuuuuagccauuccccaugcuuggacucagaagcuuuccagaagagaaaacagaugcaagagauacuaagucacacaacuacccaguguuauuacgccauccggauuuuugcaggacaggaccccagcugcguguggguugguugggugacaccugauuaccaucuguauucugagaaguucgaccucaacaagaauuguacugucaccgugacgcugggcgaugaaagggggcgcguucacgaguccgugaaacgaucaaacugcuacauggucuggggaggcgacaucguagccaguagccagagauccaaucggucuaacguggaucuugaaauugguuguuuaguugaccuggcuauggggaugcucucguucagcgcaaacggaaaggaguugggcacaugcuaucaaguggaaccgaauaccaaagucuuuccagccguguuccugcagcccacuucaacaucccucuuucaguucgagcugggcaagcuuaaaaacgcgaugccucugagugcugccaucuuuaggucugaggaaaagaauccaguaccccagugcccuccgcgcuuggaugugcaaaccauacagcccguccuauggagcagaaugccaaacuccuuccugaagguugagacugaaagggugucagagcggcacgggugggugguccagugucucgaaccuuuacagaugauggcacugcauauccccgaggagaaucguugcguggacauucuugaacugugugagcaagaagaucucaugcgcuuucacuaccauaccuugcgacuguauucugccguuugcgcucucggaaacagcagaguagccuacgcacuguguagucacguggaccuuucccagcuauucuaugcuaucgauaauaaauaccugccagguuuguuaaggagcggcuuuuacgaccugcucauuucuauccaucuggccucagcgaaggagcggaaacuuaugaugaagaacgaauauauaauuccuaucacauccacgacccgcaauaucagacuguuccccgaugagaguaaaaggcacgggcucccaggagucggcuugcggacuugccugaagccggguuuucgauucagcacaccuuguuuugugguuaccggggaggaccaccagaaacaaucgcccgaaauuccacuagagucucugagaacaaaggcccucuccaugcuuacugaagcagugcagugcagcggagcucauauacgcgaccccgucggcggcucaguggaguuccaguucguaccuguccugaaguuaaucgggaccuugcuggugaugggaguuuuugaugacgaugacgugaggcagauucuccugcuuaucgauccaagugucuucggugagcacucugccggcacggaagagggggcugaaaaagaggaagugacacaaguugaggagaaggcaguggaagccggagagaaagccggcaaggaagcucccgucaaaggucugcuccagacccgguugccugaguccgugaagcugcagaugugugaauuacuaagcuaccugugcgacugugagcuccagcaucguguagaggcgauuguggcauuuggggauaucuauguuucaaagcuucaagccaaccagaaauucagauacaaugaacugaugcaggcuuugaacaugagugccgcacugacugccaggaagaccaaagaguuucgcagcccgccacaggaacaaauaaauaugcuccugaacuuccagcuuggagagaauugccccugcccugaagagauccgggaggaacucuaugacuuucacgaggaucuguugcugcacuguggcguccccuuagaagaggaggaagaggaagaggaagacacauccuggacuggcaagcuaugcgcucugguguacaaaauuaaggggccaccuaagcccgagaaagagcagccaaccgaagaggaagagcgauguccuacaacgcucaaggaacuuaucucucaaaccaugauuugcugggcgcaggaggaucagauccaggacagcgagcuggugagaaugauguucaacuugcugaggcgccaauaugauuccauaggagaacuccugcaggcccuucggaaaacuuacacaauuucacauaccucugucagugacacuaucaauuuacuggcagcucucggucagaucagaucguugcugagcguacguaugggcaaggaggaagagcuacugaugauuaacgggcucggagacaucaugaacaauaaaguguuuuaccagcacccgaaccuuaugaggguucugggcaugcaugaaacagugauggaggucauggugaauguuuuggguaccgagaagucccaaauagccuuccccaagaugguggcaucuuguugccgguuucuguguuauuucugccgcauuucacgacagaaccagaaagccauguuugaacaccucagcuaccuguuagagaauuccagugucgggcuugcuucuccaagcaugagaggaucaacgccucuggauguggccgcguccaguguaauggacaacaaugaacucgcacuaagccuggaggagcccgauuuggaaaaggugguuacuuaucuggccggcuguggccuccagucuugcccaaugcuucuggcuaaaggguacccugacgucggauggaaccccaucgagggugaaagguauuuguccuuccugcgguucgccguguuugugaauucagagagcgucgaagagaacgcuucgguugugguaaagcucuuaauucgcagaccggaguguuucggcccagcacugaggggggaaggaggcaauggucuucuggccgcuaugcaaggggccaucaaaauaucugagaacccugcacuagaucuccccagucagggcuacaagcgagaaguguccaccggagacgaugaggaagaggaggaaauuguccauaugggcaaugcgaucaugagcuuuuauucagcccugaucgacuugcuggggcggugcgcuccagagaugcaccucauucagacaggaaagggugaagccauccguauuagauccauacuucgcucucuggugcccaccgaggauuuaguuggcaucauuagcaucccucugaaauugccgagucucaacaaggacggguccgugagcgaacccgauauggcagcuaauuucugcccagaccacaaagccccuaugguccuguuucuagacaggguauacggaaucaaggaucagacuuuccuucugcaucuccuggaggugggcuuuuugcccgaccugcgggcaucugccucacucgauacaguuagucuuuccaccacagaggcugcgcuggccuuaaacagauacauuuguagcgcagugcugccuuugcucacucgcugcgcuccacuguucgccgguaccgaacacuguacgucucuaauagacucgacacuucaaaccaucuauaggcugucaaaagggcgaagccucacuaaggcccagcgggauaccauugaggaaugccuguuggcaaucuguaaccauuuaagacccuccaugcugcagcaacuccuuaggcgccuggucuuugacgugccucagcuaaaugaguacugcaaaaugccacugaagcucuugacaaaccacuaugagcaguguuggaaguacuauugccugcccaguggcuggggaucuuacggccuugcugucgaagaggaacugcaccucacugagaaauuauucugggggauuuuugauagccugucccauaagaaauaugacccggauuuguuccguauggcccugccuugucucucagcgaucgcuggagcccuuccacccgacuaccuggauacccggauaacggcaacacuagaaaagcagaucaguguggacgccgaugguaauuuugacccuaaaccaauuaacaccaugaauuucucucugcccgagaagcucgaguacaucguuacuaaguaugcugaacacagccaugacaaaugggcaugcgauaagucccaaucaggcuggaaauacgggauuagcuuggacgagaacgugaagacacacccgcugaucagaccuuucaaaacccuuacugaaaaggagaaggaaauauauagguggcccgcccgcgagucucugaaaacaauguuagcgguaggauggaccguggagcgaacgaaggaaggcgaggcucucguccagcagcgggaaaaugagaaacugagauccguuagucaggccaaccaagguaauagcuacucgccagcaccuuuggaucuguccaacgugguccucucuagggaacuucaggggaugguggagguaguggccgagaauuaucauaacauuugggcuaagaaaaagaagcuggaacuagagucaaaaggcggaggcagccacccccugcucguuccauacgacacuuugaccgccaaggaaaaauuuaaggaucgcgagaaagcacaggaccuguucaaguuuuuacaggugaaugggaucauugucaguagaggaaugaaagauauggagcuugacgcuuccucuauggaaaagcgguucgccuauaaguuucugaaaaagauccucaaauacguggauagcgcgcaagaguucauagcccaccuggaagcaaucgucucauccggcaagacagagaaaagucccagggaccaggaaauuaaguuuuucgcuaagguguugcugccucucguugaucaguacuuuaccagccauugucuuuauuuccugucuucaccacuaaaaccgcuguccagcucugguuacgccagucacaaggagaaagagaugguagcaggguuauuuugcaagcucgcugcccuggugcgucaucgaaucucguuguucggauccgacagcacaacuauggucucaugccuucacauucuggcccaaacccucgacacgcgcacagugaugaaaucuggcagcgaacugguuaaggcggguuugagagcuuuuuucgagaacgcagccgaagaucuggagaagacuuccgaaaaucuaaaacucggcaaguucacccauagucggacacagaucaaaggggugucacagaacauaaacuauaccacugucgcucuucugcccauuuuaaccucuaucuuugagcacgugacacagcaccaauucggaauggaccugcuccugggcgauguacagaucagcuguuaccauauuuugugcucccuuuauagucuggggacgggaaagaauaucuacguggagaggcagcgcccugcccucggcgaaugucuggcaagccuagccgcugcgauaccaguugccuuuuuggagcccacucugaacagauauaauccucucuccgucuucaacaccaaaacaccacgggaaaggucuauucuugguaugcccgacaccguggaggauaugugcccugacaucccgcagcuggaaggguuaaugaaggagauuaaugaucuggcagagucaggagcucgauacacugaaaugccacacgugaucgaggucauacuccccaugcuguguaacuacuugagcuauuggugggaacguggcccugagaaucuucccccaucgacagguccuugcuguaccaagguuacguccgagcaucugagucucauccugggcaacauucuaaaaaucauuaauaacaauuuagggaucgacgaagccucuuggaugaagagaauugcaguguacgcccaacccaucauaagcaaagcucgcccagaucuguugcggucacacuuuauuccgacucucgagaagcugaaaaagaaagccguaaagacagugcaggaagaggaacagcuuaaggcggacggaaaaggcgauacccaggaggcagagcugcucauccuggacgaauucgccgucuugugcagggaucuuuaugcuuuuuacccuaugcugaucagauauguggacaacaaucgcuccaacuggcuaaagucucccgacgccgauagugaccaacucuuccggaugguugcagagguguuuauucugugguguaaaagccacaauuucaagagggaagagcagaacuuugucauacagaacgaaaucaauaacuuagcuuuccugaccggggauuccaaaucaaagaugagcaaggccaugcaagugaaaucuggaggccaggaccaggagcgaaagaaaacuaagagacggggugauuuguacaguauucagacaucccucaucguagcugcccugaaaaagaugcuuccaauugggcugaauaugugcacccccggagaccaagagcucaucagcuuggcaaagucaagguauucucaucgcgauacagacgaagagguucgugaacaccugagaaacaaucuucaucugcaggagaaauccgaugacccugcggugaaguggcaguuaaaccuauacaaagauguccucaagucggaagagccauuuaaucccgagaaaacuguggaacgagugcagaggauaagcgccgcugucuuccaccuggagcaaguugaacagccucugcggaguaagaaggccguguggcauaaauugcucucuaagcagcgcaaaagagcaguaguggcuuguuucaggauggccccgcuguacaaccuuccacggcaccgcuccaucaaucuguuuuuacacggcuaucagagauucuggauugagacggaggaauacagcuuugaggaaaagcucguccaagaccuggcaaaaucacccaagguggaggaagaggaggaagaggaaaccgagaagcagccugauccauugcaucagaucauucuuuauuucagucgaaacgcccugacagaaagguccaaacuagaggacgacccccucuacacuagcuauucuucaaugauggcgaagagcugccaguccggcgaggaugaagaggaagacgaggauaaagaaaagaccuuugaggagaaagaaauggagaagcaaaaaacacuguaccagcaggcucggcugcacgaacguggggccgcagagaugguuuugcaaaugaucucugccaguaagggagagaugucgccuaugguggucgaaacccucaagcuggguauagcuauucuuaauggcgggaacgccggagugcagcagaaaaugcuggacuauuuaaaggagaaaaaggaugcaggcuucuuucagagccucuccggucugaugcaaucauguucuguacuagacuugaaugcuuucgaacgccagaacaaagccgaggggcugggaaugguuacugaagagggcacgcuuaucgugagagagaggggcgaaaagguccuccagaaugaugaguuuacccgggaccuguucagauuucugcaguugcuuugcgaagggcauaacagcgauuuccaaaacuuucuccgcacacagaugggaaauacuaccacagugaacguuaucauuaguaccguggacuaccuguuacgacugcaggaguccauaucagauuucuacugguauuacucugguaaggacaucauugacgaaagcggccagcacaauuucuccaaagcgcuagcugucacuaagcaaaucuuuaacagucucacagaguauauucaggggcccugcaucggaaaucagcaaagccuggcccacucuagguugugggaugcagugguaggcuuccugcauguguuugccaacaugcagaugaaacuuucacaggacuccagccagauagagcuccugaaggaauuacuggauuugcuccaagacauggucguuaugcugcuuagucugcuagaggguaauguggucaacgggacgaucggaaaacagaugguggauacccucguagaaucuuccacuaauguggagaugauucugaaguucuuugacauguucuugaagcugaaagaucuuacaucgagcgacaccuuuaaggaauacgauccagacggcaaaggcaucauuucaaagaaagaguuccagaaggcuauggaggggcagaagcaauauacccaguccgaaaucgauuuucuccugucuugugcagaggccgacgaaaacgauauguucaauuacguugacuuuguggaccgguuccacgagccggcgaaagauauuggauucaacgucgccguguuacugacaaauuugagugagcauaugccuaacgacagcagacucaagugccugcuugaucccgcugaaucaguucugaauuauuuugagccauaccuaggucguauagaaaucaugggcggggcaaaaaagauugagcgcgucuacuucgaaaucuccgagagcucuaggacucagugggagaaaccucaggugaaggaaaguaaacggcaauuuaucuucgacgugguaaacgagggaggcgaacaggagaagauggaacucuuugucaacuucugugaggauacgauuuuugagaugcagcuggccucccagauaagcgaaucagacucugcugauagacccgaggaagaggaagaggacgaggauucgagcuauguguuggaaaucgccggugaggaagaggaggacgggucccuggaaccagcaagugcuuucgccauggcgugcgccucuguuaagcgaaaugugaccgauuuucuuaaaagggcaacauuaaagaaccugcgcaaacaauaccggaaugucaagaaaaugacugcuaaggagcucgugaagguucuguucucauuuuucuggaugcuauuugugggauuguuccagcugcucuucaccauucuuggcggcaucuuucagauucuguggagcacaguauucgggggaggucucgucgaaggcgccaaaaacaucagagugaccaagauacugggggacaugccugaucccacucaauuuggaauccacgacgacacgauggaggcagaaagggccgaggugauggagccgggcauuacaaccgaauuaguucauuucaucaaaggugagaagggggauacugacauuauguccgauuuguuuggacugcacccaaaaaaggaaggcagucuuaagcacggcccugaggucgggcugggagaccucucugaaaucauagguaaagaugagcccccaacccuggagagcacagugcagaagaaacgcaaggcucaggccgcggaaaugaaagcugcaaaugaggccgaaggcaagguagaguccgaaaaggcugacauggaggauggggagaaagaagacaaggauaaagaggaagagcaggccgaguaucuauggacugaagugaccaagaaaaagaaacgucgguguggacaaaaggucgagaagcccgaagcauucacagccaacuuuuucaaaggccuugagauuuaccagacgaagcugcuccauuauuuggcuagaaauuuuuacaaccugcgauucuuagcgcuguuuguggccuucgcaaucaauuuuauucuccuuuucuauaaaguuaccgaagagccucuggaggaagagacugaagacguggccaacuuguggaauucauucaacgaugaggaagaggaggaagcuauggucuuuuucgugcugcaggagagcacagguuacauggcaccgacccucagggcccuagcuaucauacacacuaucauuucucugguuugcgugguaggguacuauugucuuaaggucccacuggugguuuuuaaacgcgaaaaggagaucgcccggaagcucgaauucgacggauuguacauuacagagcagcccuccgaggacgauaucaaaggccaaugggacagacuggugauaaauaccccuaguuuucccaacaauuauugggauaaguucgucaaaaggaaggugauuaacaaauacggcgacuuauauggggcggaacgcaucgcagagcugcucggacuugauaagaacgcccuggacuuuucaccaguagaagagacgaaggcugaggccgcaagcuuggugucguggcuguccucuaucgauaugaaauaccauauuuggaagcucggugucguuuucaccgacaauaguuuucuauaccuggcuugguauacaacuaugagcguguuaggccacuacaacaauuucuuuuucgccgcgcaucugcucgauaucgccaugggguuuaaaacccuuagaacaauauugucauccgugacucacaacggaaagcagcugguccugaccgugggccuccuugcuguuguaguguaucuguacacagucguggcauucaauuucuuucggaaauucuauaacaagucugaagacgaugacgagccugauaugaagugcgacgacaugaugaccuguuacuuguuucacauguauguuggugugcgagccgggggcggaauuggcgaugaaaucgaggaccccgcuggggauccauacgaaauguacaggauugucuucgacaucacuuuuuucuuuuucgugauaguaauccugcucgcaauuauccagggacuaauuaucgaugccuuuggugagcugcgugaccagcaagagcaggugagagaagauauggagacgaaaugcuucauuuguggcaucgggaaugacuauuuugauacaaccccucauggauucgaaacucacaccuuacaggagcauaaccuugcuaauuaccuguuuuuccucauguauuugauaaacaaggacgaaacagagcacacgggccaagagagcuacgucuggaaaauguaucaggaacggugcugggauuucuuuccggccggugacugcuuccgcaagcaguacgaggaucagcugggguga

SEQ ID NO: 62109 - RNA, 294 nt, Artificial Sequence
  derived and/or modified sequence opt3 from S100A10__Homo_sapiens__NP_002957
augcccagccagauggagcacgccauggaaaccaugauguucacauuucauaaguucgcuggagacaaaggguaccugacuaaggaggaucucagagugcuuauggaaaaagaguuuccuggauuccuggaaaaccaaaaggacccauuggcagucgauaaaaucaugaaggacuuagaucagugcagggacgguaagguuggcuuucaguccuucuuuucucugauugccgggcuaacgauagcguguaaugauuauuucgugguacacaugaaacagaagggcaaaaaguga

SEQ ID NO: 62110 - RNA, 318 nt, Artificial Sequence
  derived and/or modified sequence opt3 from S100A11__Homo_sapiens__NP_005611
auggccaagaucagcucccccaccgagacagaaagaugcauugagucucugauagcuguguuccagaaauacgcaggcaaggacggguauaacuacacucucucaaaaacggaauuucuuaguuucaugaauaccgagcuggccgcguuuacaaagaaccaaaaagauccuggagucuuggacaggaugaugaagaaguuagauacuaauagcgacggucagcuggauuucuccgaauuucuaaaccucaucggcgggcuggcuauggccugucacgacucuuuccuuaaagcaguuccaucgcagaagcggaccuga

SEQ ID NO: 62111 - RNA, 279 nt, Artificial Sequence
  derived and/or modified sequence opt3 from S100A12__Homo_sapiens__NP_005612
augaccaagcuggaggaacaccucgagggcaucgugaacauuuuccaucaguacagcgucagaaaagggcacuuugacacacuuuccaagggagaacugaaacaauuguuaacuaaggagcuggccaauacgaucaaaaacauaaaggauaaggcuguuauugacgaaaucuuccagggucuagaugcaaaucaggacgaacagguggauuuucaagaguucauuucucucguagccaucgcgcugaaagcugcccauuaucacacccauaaggaguga

SEQ ID NO: 62112 - RNA, 297 nt, Artificial Sequence
  derived and/or modified sequence opt3 from S100A13__Homo_sapiens__XP_011508166
auggccgcugagccccugaccgaacucgaggaaagcaucgagacaguggucacuacguucuuuaccuucgcaagacaggaaggcaggaaggacucccuuucuguuaacgaguuuaaagagcuggugacacaacaguugccucacuuacugaaggauguagggucacuagacgagaaaaugaagagucucgaugugaaucaggacagcgaacugaaauucaacgaauacuggcggcuuauuggagagcuggccaaggagauacgcaagaaaaaggauuugaaaauccgaaagaaauga

SEQ ID NO: 62113 - RNA, 315 nt, Artificial Sequence
  derived and/or modified sequence opt3 from S100A14__Homo_sapiens__XP_005245419
augggccagugcagaagcgccaacgcugaggacgcacaagaguucuccgauguggagagggccaucgaaacccugauuaagaauuuucaccaguacucugucgaagggggaaaagaaacacucacucccucagagcuucgggaccugguuacgcagcaguugccucauuuaaugccaaguaacuguggucuggaggaaaagauagcgaaucuaggcagcugcaacgauuccaaacucgaguuccgcucuuuuugggaacugaucggggaggcugccaagucggugaaacuugagcgaccgguacguggacacuga

SEQ ID NO: 62114 - RNA, 312 nt, Artificial Sequence
  derived and/or modified sequence opt3 from S100A16__Homo_sapiens__NP_525127
augagcgacugcuacaccgagcuggaaaaggccguaaucguccucguugagaacuucuauaaauacguguccaaguauucucuugugaaaaauaagauuucaaaaaguagcuuuagagaaaugcugcagaaggaguugaaccacauguuauccgauacaggcaauaggaaggcugcagacaaacugauacaaaaccuagaugccaaucaugacgggcggaucucuuucgaugaauacuggacucucauuggagguaucacgggccccauugcgaagcugauccacgagcaggagcagcagucgucaagcuga

SEQ ID NO: 62115 - RNA, 285 nt, Artificial Sequence
  derived and/or modified sequence opt3 from S100A1__Homo_sapiens__NP_006262
augggcagcgagcuggaaaccgccauggagacacucaucaacguguuccacgcucauuccgggaaggaaggagacaaauacaaacuuucuaagaaggagcugaaagaauuguuacagacugagcugucagguuuucuagaugcacaaaaggacgucgaugccguugacaaggugaugaaagagcucgaugaaaauggcgacggggagguagauuuccaggaauaugugguccugguggcggcucuuacgguugccugcaacaacuuuuucugggagaauaguuga

SEQ ID NO: 62116 - RNA, 294 nt, Artificial Sequence
  derived and/or modified sequence opt3 from S100A2__Homo_sapiens__NP_005969
augugcagcucccuggagcaggcccucgcugugcuugucaccacauuccacaaguacucuugucaagaaggcgacaaauuuaagcugucaaaaggggagaugaaggaauuguuacauaaagagcugcccaguuucguuggagaaaagguggaugaggagggucuaaagaaacucaugggcagccuggacgaaaacuccgaucagcagguagacuuucaggaguaugcaguguuccuugcccugaucacugucaugugcaaugacuuuuuccaaggguguccugauagaccauga

SEQ ID NO: 62117 - RNA, 306 nt, Artificial Sequence
  derived and/or modified sequence opt3 from S100A3__Homo_sapiens__NP_002951
auggccagaccccuggagcaggcuguggcagccaucgucugcaccuuccaagaauacgcggggagguguggcgacaaguauaaacucugccaggcugagcuuaaggaacuguugcagaaagaguuagccacauggacuccuacggaauuucgggagugugauuacaacaaguucaugagcguucuggacaccaauaaagauugcgagguggacuuuguagaauaugugcgcucccuagcaugucucugccuguacugucacgaguauuucaaggauugcccaucugaaccgcccuguucacaguga

SEQ ID NO: 62118 - RNA, 306 nt, Artificial Sequence
  derived and/or modified sequence opt3 from S100A4__Homo_sapiens__NP_002952
auggccugcccccuggagaaggcucucgacgugauggucagcaccuuccacaaauacuccggcaaggaaggggauaaauuuaaacuuaacaagucugagcugaaggaauuguuaacaagagagcugccuucauuccuaggaaagaggacugacgaagcagccuuucagaaacucaugaguaaucuggauagcaaccgggacaaugagguugauuuccaagaguauuguguguuucuuuccugcaucgcgaugauguguaacgaguucuuugaagguuucccagacaagcagccgcgcaaaaaguga

SEQ ID NO: 62119 - RNA, 279 nt, Artificial Sequence
  derived and/or modified sequence opt3 from S100A5__Homo_sapiens__NP_002953
auggagacaccccuggaaaaggcccucaccacuauggugacgaccuuccacaaauacagcggcagagagggguccaaacuuacacugucuaggaaggaauugaaggaguuaaucaaaaaggaacugugccuaggagagaugaaggagucaaguauugacgaucucaugaaaagccuggacaagaacuccgaucaggaaauagacuuuaaagaguauucugucuuccuuacuaugcuguguauggcuuacaaugacuuuuucuuggaagauaacaaguga

SEQ ID NO: 62120 - RNA, 273 nt, Artificial Sequence
  derived and/or modified sequence opt3 from S100A6__Homo_sapiens__NP_055439
auggccugcccccuggaccaggcuaucggccuccuuguggcaauuuuccacaaguacagcgggagagagggagauaaacauacccuguccaagaaagaauugaaggaguuaauacaaaaagaacugacaaucgguucuaagcuacaggacgccgagauugcgaggcucauggaagaucuggaccggaacaaggaucaggaggucaauuuucaggaguauguuacuuuccuuggcgcucuggccuugaucuacaacgaagcacucaaaggguga

SEQ ID NO: 62121 - RNA, 306 nt, Artificial Sequence
  derived and/or modified sequence opt3 from S100A7A__Homo_sapiens__NP_789793
augagcaacacccaggccgagagauccaucauuggcaugauagacauguuccacaaguacacagggagggauggaaaaaucgaaaagcccucucugcucacuaugaugaaagagaauuuuccuaacuuccuuucagcuugcgacaagaaagguauucauuaucuggcaacgguguuugaaaagaaggauaaaaaugaggacaagaaaaucgauuucagugaauuuuugagcuuacugggcgacauugccgcggauuaccacaagcaaucccauggggcugccccauguucuggaggcucgcaguga

SEQ ID NO: 62122 - RNA, 306 nt, Artificial Sequence
  derived and/or modified sequence opt3 from S100A7__Homo_sapiens__NP_002954
augagcaacacccaggccgagagauccaucauuggcaugauagacauguuccacaaguacacaaggcgggaugacaaaaucgaaaagcccucucugcucacuaugaugaaagagaauuuuccuaacuuccuuucagcuugcgauaagaaagggacgaauuaucuggcagacguguuugaaaagaaggauaaaaacgaggacaagaaaauugauuucagugaauuuuugagcuuacugggagacaucgccaccgauuaccauaagcaaucccacggugcggcuccauguucuggcgggucgcaguga

SEQ ID NO: 62123 - RNA, 282 nt, Artificial Sequence
  derived and/or modified sequence opt3 from S100A8__Homo_sapiens__NP_002955
augcugaccgagcucgaaaaggcccuuaacagcaucauugacguguaccacaaauauucccugauaaagggcaauuuccaugcugucuacagagaugacuugaaaaaguuacuggagacagaaugcccccaguauaucaggaaaaagggggcagauguuugguuuaaggagcuagacauuaacacugauggagccgugaauuuccaagaauuucucauccugguaauuaaaauggguguggcggcucacaagaaaucucaugaggagucacacaaggaauga

SEQ ID NO: 62124 - RNA, 345 nt, Artificial Sequence
  derived and/or modified sequence opt3 from S100A9__Homo_sapiens__NP_002956
augaccugcaagaugagccagcuggagagaaacaucgaaacaauuauaaauacuuuccaccaauacuccgugaaacucggccaucccgacacgcuuaaccagggggaguuuaaggaacuggucaggaaagauuugcagaauuucuuaaagaaagagaacaagaaugaaaagguuaucgagcacauuauggaggaccuggauaccaacgccgacaaacagcuaucuuuugaagaguucaucaugcucauggcucggcugacaugggcaucacaugaaaagaugcacgagggagaugaggguccuggccaucaccacaaaccagggcuuggagaaggcacuccguga

SEQ ID NO: 62125 - RNA, 279 nt, Artificial Sequence
  derived and/or modified sequence opt3 from S100B__Homo_sapiens__NP_006263
augagcgagcuggaaaaggccaugguggcucucaucgacgucuuccaccaguacuccggcagagagggggauaaacauaaacuuaagaagucugaacugaaagaguugauuaacaaugaauuaucacacuuucuggaggagauaaaggaacaagagguuguggacaagguaauggaaacccuagauaacgacggagauggugagugcgacuuccaggaguuuauggcauucguggccauggucacaacugcgugucaugaauuuuucgagcacgaauga

SEQ ID NO: 62126 - RNA, 288 nt, Artificial Sequence
  derived and/or modified sequence opt3 from S100P__Homo_sapiens__NP_005971
augaccgagcuggaaacagccaugggcaugaucauugacguguucagcagauacuccgggucugagggaucaacucagacgcucaccaagggugaacuuaaaguccugauggagaaggaauugcccggcuuuuuacaaagugggaaagauaaggacgcuguugauaaacugcuaaaggaccucgaugcaaacggagacgcccagguggauuucagcgaguuuauaguauucguggcggcuaucacauccgccugccacaaguauuuugagaaagcaggccugaaguga

SEQ ID NO: 62127 - RNA, 300 nt, Artificial Sequence
  derived and/or modified sequence opt3 from S100Z__Homo_sapiens__NP_570128
augcccacccagcuggagauggccauggacacaaugaucagaauuuuccacagguacagcggcaaggaacggaaacgcuuuaagcucuccaaaggggagcuuaagcuguuguuacaacgagaacugacugaguuccuaucuugccagaaagaaacgcagcucguggauaagauaguccaggaccuggaugcuaacaaggacaaugagguugauuuuaacgaguucgugguaaugguggcagcccuuaccgucgcguguaaugacuauuuuguggaacaacugaaaaagaaaggaaaguga

SEQ ID NO: 62128 - RNA, 1062 nt, Artificial Sequence
  derived and/or modified sequence opt3 from S1PR2__Homo_sapiens__NP_004221
augggcagccuguacuccgaguaucucaaccccaauaaggugcaggaacacuacaacuauaccaaagagacacuugaaacucaagagacgaccucuagacaggucgccucagcuuucaucguuauucugugcugugcaauagugguagaaaauuuguuagugcugaucgccgucgcgaggaacaguaaguuucauagcgcuauguaccuauuccucgggaaucuggccgcauccgaccuucuggccggaguggcuuuuguugcaaacacauugcucucugguucggugacucugcggcugaccccuguccagugguucgcccgcgagggcucagcuuuuauuacacucagcgccaguguguucuccuuacuggcgaucgcaauugagcgacacguagccaucgcuaaaguuaaacuuuaugggucugauaagagcugccguauguugcugcuaauaggagccuccuggcucaucucacuggugcuuggcggucugccaauuuugggguggaauugucucggacaucuggaagcaugcaguaccgucuuaccgcuguacgcuaagcacuaugugcucuguguggucacuaucuuuagcauuauccuucuggccauaguugcguuguacgugagaauuuacugcguagugaggucuucccaugccgacauggcagcuccccagacacuagcccugcucaagaccgucacgaucgugcugggcguuuucauuguguguuggcuuccugcuuuuucaauccuguugcucgauuaugccugcccaguccacagcugucccauccuguacaaagcacacuauuucuuugccgugaguacuuuaaacucucugcuaaauccuguaauuuacaccuggcggucccgcgaccucagaagggagguucugcggccacuucaaugcuggcgccccggcguggggguccagggacgaagaagggguggcacaccugggcaucacuugcugccacuccggagcucgucuucccuggaacguggaaugcauaugccgacuucacccaccuuccuugagggcaacacaguggucuga

SEQ ID NO: 62129 - RNA, 1137 nt, Artificial Sequence
  derived and/or modified sequence opt3 from S1PR3__Homo_sapiens__NP_005217
auggccaccgcucugcccccuagacuccagccagugaggggcaacgagacacuucgggaacacuaccaauaugucgggaagcuggcaggacgcuugaaagaggccagcgaagguuccacuuuaacgaccguucuguuccuagugaucugcucuuuuauuguacucgagaaucugauggugcuuauagcgaucuggaagaacaauaaauuccauaaccgaauguacuuuuucauuggcaaucuggcuuugugugaccuccuggccgggaucgcauauaaggucaacauucugaugucaggcaaaaagacauuuagucucagcccgacugugugguucuuacgugaaggauccauguuuguugcccugggugcuucuaccugcucgcuuuuggcaaucgccauagagagacaccugacaaugaucaagaugaggcccuacgaugcuaauaaacggcaucgcguguuccuacucauugggauguguuggcugaucgccuuuacccuuggagcgcugccuauuuugggcuggaacugccuccacaaucugccagacuguucaacuaucuuaccccuguauagcaagaaauacauagcauucugcauuaguaucuuuacagccauucucgucaccaucgugauccuuuaugcuagaauuuacuuccugguaaaguccucuagcaggaaaguugccaaccauaauaacuccgagcggucaauggcauugcuacgcacgguggucauaguggugagugucuuuaucgcuuguuggagcccucuguucauucucuuccugaucgauguugccugccgagugcaggcguguccaauacuuuuuaaggcccagugguucauuguacuggcagugcucaauucugcuaugaaccccgucaucuacacuuuggccuccaaggaaaugagaagggccuuuuuccggcuggugugcaauuguuuaguucguggccgcggggcuagagcaucaccuauccagccagcccuggacccgagcaggaguaaaucuuccagcucgaacaacucuucccacucacccaaggugaaagaggaucuaccucacaccgcuccaaguagcugcauuauggacaagaaugcggcacuccaaaacggaaucuuuugcaauuga

SEQ ID NO: 62130 - RNA, 1155 nt, Artificial Sequence
  derived and/or modified sequence opt3 from S1PR4__Homo_sapiens__NP_003766
augaacgccaccggcacacccguggcuccugagagcugccagcaacuggcagccgggggacacuccagacucaucguccuucauuacaaucacucugguaggcuggcgggccgcgggggaccagaagacggcgguuugggggcuuuacggggacugucaguugccgcaaguugucuagugguacucgagaaccugcuugugcuggccgcuauuacuagccauaugcgaucccguagaugggucuauuacugcuuggugaauauaacgcucucugaucugcugaccggcgcagccuaucucgcuaacguuuuacugucgggcgccaggacauuccggcuugcgccggcacagugguuuuugcgcgaagggcugcuauucacugcccucgcugccucaaccuuuagccugcuuuucacagcaggagagagauuugcuaccauggugaggcccgucgccgaaaguggugcgacuaagacaucccggguguacggcuucaucgggcuguguugguugcucgccgcacuguuaggaaugcugccucuccuuggcuggaauugccugugugcuuuugaccgcugcucuagcuugcuaccacuguauuccaaacgauacauucucuucugucugguaaucuuugccgguguucuugcuaccauuauggggcuguauggagccaucuucagauuggugcaggcaucaggccagaaggcccccaggccugcugcgcggcguaaagcacgcagacuccugaagacggucuuaaugauacugcuagccuuucucgugugcuggggcccacuguucgggcuuuugcuggcugauguguuuggaaguaaccucugggcccaagaguaccugagggguauggacuggauccuugcacuggccgucuugaauagcgcuguuaaccccauuaucuacucuuuccggucccgagaggugugucgcgccguacucucauuccugugcuguggcugcuuaagacuggggaugaggggaccuggcgauugccuagcacgggcgguggaagcucacagcggugccaguacuaccgacucuucccuccgcccaagagauagcuuuagggggucgcguucucuguccuuccggaugcgagagccgcuuucaaguauuagcuccgucagaucuaucuga

SEQ ID NO: 62131 - RNA, 1197 nt, Artificial Sequence
  derived and/or modified sequence opt3 from S1PR5__Homo_sapiens__NP_001159687
auggagagcggccugcucagacccgccccuguguccgaagucaucguucuucacuacaacuauaccgggaagcugaggggagcucgguaccagccaggugcaggcuugcgcgccgacgcggugguaugcuuagcugugugugccuucauuguccuggagaaucuagcagugcuccugguucuugggcgacauccgcguuuucacgcccccauguuccuguugcucggaucucugacacugucagaucucuuagcuggcgcagccuaugcugccaacauacugcuuagugguccuuugacucugaaacuaagcccagcgcucugguuugcaagagaagggggaguguucgucgcccugacggcuuccgugcuuucucuguuggccaucgcacucgagaggucgcugaccauggcucggcgcggccccgccccuguaucaagcagaggcaggacauuagcgauggccgcagcugccuggggaguuagucugcuccuugggcuguugccagcucuagguuggaauugccugggccggcucgacgccuguuccacugugcugccccuuuacgcaaaggccuauguccuguuuugcguguuggcuuucguggggauucucgcggcaaucugugcccuguacgcucgcauuuauugccaaguccgagccaacgcaagaagguuaccugcccggccaggaaccgcuggcacaaccucuacucgugcccgcagaaaaccgaggagccuggcacuacuccggacacuguccguugugcuuuuggcguuuguagcuuguugggguccccuguuccuccugcuucuguuggauguggccugcccugcacgaaccuguccaguccuccugcaggccgaccccuuuuuagggcuggcuauggccaauucacuacucaacccuaucauauacacgcugacuaaucgcgaucuuagacaugcauugcugaggcucgugugcuguggacggcacaguugcggccgcgacccaagcggcucucagcaguccgcuucagccgcggaagccagcgggggacugagaaggugcuuacccccgggucuggauggcaguuucucuggguccgagcguagcucgccucaacgggacggacuugauaccucuggcuccacagguucacccggggcuccaacugcagcccgaaccuugguuagugagccugcugccgacuga

SEQ ID NO: 62132 - RNA, 369 nt, Artificial Sequence
  derived and/or modified sequence opt3 from SAA1__Homo_sapiens__NP_001171477
augaagcugcucaccggccuuguguucugcagccuggucuuggggguuuccucuagaucauuuuucagcuuuuuaggagaggccuucgacggugcuagggauauguggcgggcauacagugacaugcgcgaagccaacuauaucggcuccgauaaauacuuucacgcgcgagggaauuaugacgcugccaagcguggacccggcggugcaugggccgcugaggugauuucugaugcaagagaaaacauacagagguucuuugggcauggagccgaggacucgcuggcugaucaagccgcgaaugaauggggccggucaggcaaagacccuaaccacuuccgcccagcagggcuaccggagaaguacuga

SEQ ID NO: 62133 - RNA, 252 nt, Artificial Sequence
  derived and/or modified sequence opt3 from SAA2__Homo_sapiens__NP_001120852
augaagcugcucaccggccuuguguucugcagccuggucuuguccguuucuucaagaaguuucuuuagcuuuuuaggggaggccuucgacggagcuagggauauguggcgggcauacuccgacaugcgcgaagccaacuauaucgguucugauaaauacuuucacgcgcgaggcaauuaugacgcugccaagcgugggcccggaggcgcaugggccgcugaggugauuucgcuguucucagcagaacuauga

SEQ ID NO: 62134 - RNA, 393 nt, Artificial Sequence
  derived and/or modified sequence opt3 from SAA4__Homo_sapiens__NP_006503
augagacuguucaccggcaucguguuuugcagccucgucauggggguuacauccgagucuuggaggucauucuuuaaggaagcccuucagggagugggugacaugggccgggcuuacugggauauuaugauaaguaaccaccaaaauagcaaccgcuaucuguacgcacgagggaauuaugacgccgcgcagcguggacccggcgguguaugggcugccaaauugaucuccagaucuaggguguacuuacaggggcugauugauuguuaucuauucggaaacucgucaacuguccucgaggacagcaagaguaaugaaaaagcagaggaauggggccgguccggcaaggauccugaccgcuuuagaccagaugggcugccgaaaaaguacuga

SEQ ID NO: 62135 - RNA, 1425 nt, Artificial Sequence
  derived and/or modified sequence opt3 from SAAL1__Homo_sapiens__NP_612430
auggacagaaaccccagcccuccaccgcccggcagggauaaggaggaagaggaagagguggccgggggagacugcaucgguuccaccgucuacucuaaacacuggcuguucggcguucucucagggcuuauucagauagugaguccugaaaauacaaagagcuccucugaugacgaggagcaacugacugaauuggaugaggaaauggagaacgagaucugucggguaugggacaugucgauggaugaagacguggcuuuauuucugcaggaguucaaugcaccagauauuuuuaugggaguccuagccaaaucaaagugcccccgccuccgagaaaucugugugggcauucuggguaacauggcgugcuuccaggagaucuguguuagcauaaguuccgacaaaaaucuuggacaggugcuguugcauugccucuaugauucugacccuccaacgcugcuggaaaccagccgucucuuacugacaugucuuucccaagcugaggucgccucaguguggguagagagaauccaggaacaccccgcaauuuacgauaguaucugcuuuauuaugucuagcuccacuaacguugacuugcuggugaaggucggggaggugguggacaagcuauucgaucucgacgaaaaacugaugcuugagugggucaggaauggcgccgcucagccucuggaucagccacaagaagagucagaggaacagccgguuuuucgguuggugcccuguauccucgaggcagccaagcagguacgcagcgaaaacccugaguggcuggacguguauaugcauauauuacagcugcucaccacagucgaugacggcauucaagcuaucgugcacugcccagauaccgggaaagacauuuggaaucuucuguucgauuugguuugucaugaauuuugccagagugacgaucccccuaucauccuacaggagcaaaagacugugcuggccucugucuucuccgugcucagcgcgauuuacgcaucgcagacagagcaggaauaucugaaaauagagaagguagaccuuccacugaucgacucuuugauuagaguucuccagaacauggaacaaugccagaagaaacccgaaaauuccgccgagucaaacaccgaagagacgaagaggacugaucugacccaggacgauuuucacuuaaaaauccugaaggacauacuaugugaguuccucaguaauauuuuucaggcucugacaaaagagacuguggcccaaggagucaaggaaggucagcuuagcaaacagaagugcuccucugcauuccagaacuugcugccguucuacagcccuguggucgaggauuuuaucaagauccuccgggagguggacaaagcucuggccgaugaccuugaaaagaauuuccccucacugaaaguucaaaccuga

SEQ ID NO: 62136 - RNA, 1077 nt, Artificial Sequence
  derived and/or modified sequence opt3 from SAC3D1__Homo_sapiens__NP_037431
augcccggcugcgagcugccuguggggaccuguccagacaugugcccggccgcugaaagagcacagagggagcgggaacaccgccuccaucgacuugaggucguucccggaugucgucaagauccuccaagagccgacccccagagggcggugaaggaauacagccggccugcugccgguaaaccaagacccccuccaucccagcugcgcccgcccucuguauuguuagcaacagugagguaucuggccggcgaggucgcugagucagcagauaucgcccgggcugaaguggccaguuucguugcggaccgccuacgagcagugcuccuggaucuugcccugcagggggcuggagacgccgaggcagcugucguguuggaagccgcgcucgccacucugcugacgguaguugcaagacucggcccugaugcugccagggguccagcugaccccguguuacugcaagcccagguccaggagggguuuggaagccuucggcguugcuacgcacgcggcgccggcccucacccaagacagcccgcuuuccaaggguuguuucugcuauauaaccucggauccguggaggcgcugcaugaagugcuucagcugccggcagccuugagggcuuguccuccccuccggaaggcccuggcagucgaugccgcuuuccgagaggguaaugccgcacgcuuauuuagacugcuccagacccuuccauaccugccuucuugcgcgguucagugucacgugggccaugcuaggcgggaagccuuggcacgcuucgccagagcuuuuucgacacccaaagggcaaacucuaccacugggauucaugguaaaccuccuggcccuugacggccugagggaggcacgugauuugugccaggcucacggucucccccuggacggggaggaacggguggucuuuuuacgaggaagauauguggaggaaggccugccuccagccucaaccuguaagguucuaguggagagcaaacucaggggccgcacacuggaagaggucgugauggcggaagaggaggaugaagggaccgaccggccgggaagucccgccuga

SEQ ID NO: 62137 - RNA, 1764 nt, Artificial Sequence
  derived and/or modified sequence opt3 from SACM1L__Homo_sapiens__NP_054735
auggccaccgcugcauacgagcagcugaagcuccacaucacacccgaaaaauucuauguggaggccugcgacgauggcgcggacgauguccuuacuauugacagaguuagcacggaagugacccuggcuguaaagaaagaugugccuccauccgccgucacaaggccgauauuugggaucuugggaacuauucauuuaguggcagguaacuaccugaucguuauuaccaagaaaaucaaggugggcgaguucuuuucucacgucguguggaaggccacagacuucgauguacuaucauauaaaaagaccaugcuccaucugacugacauacaacuucaggauaauaaaacauuucuggcuauguugaaccacguucucaauguggacggguucuacuuuaguaccacguaugaucugacucauacccugcagcggcucagcaacacaucccccgaauuucaggagaugucuuuacuggagcgcgcagaccaacgauuugucuggaauggacaccuuuugcgugaacugucggcccagccugaggugcacagauucgcucuaccagugcuccauggcuuuaucacuaugcacucauguagcauuaacgguaaguacuucgauuggauccugauuaguaggcgguccugcuuucgcgccggggucagauauuacguuaggggaaucgacucugaaggccaugcggcaaauuucguggagaccgagcagauaguacacuacaacggcagcaaagccuccuucgugcagacacgggggucaauucccgucuuuuggagucaacgcccuaaucuuaaguauaagccacugccccagaucagcaaaguggcuaaccacauggacggauuccagcgacauuuugauucucagguuauuaucuacgguaagcaagugaucauuaauuugauaaaccagaaaggcuccgaaaagccucucgagcagaccuucgccacgauggucucaagccuggggaguggaaugaugagauauaucgcauuugacuuccacaaagaauguaagaauaugaggugggaucgguuaucuauucugcucgaccaaguggcugagaugcaggaugaacuuuccuacuuucugguagacagcgccggccagguuguggcgaaccaggagggugucuuccguucgaauugcauggauuguuuggaccgcacuaacgugauccaaucucuacuggccagaaggucccuccaggcacagcugcagcggcuugggguccugcaugugggacaaaaauuggaggaacaggaugaguuugaaaagauauauaagaacgcuugggccgacaaugcuaacgccugcgcaaaacaguacgccggcacaggcgcucucaagaccgauuucacucgaacagggaaacgcacccaccugggauuaauuauggacgguuggaacucaaugaucagauauuacaagaauaauuuuagugacggcuucaggcaggauagcaucgaccuguuucuagggaacuacuccguugaugagcucgaaucucauagcccacugucagugccgcgggacuggaaauuccuugcguugcccauuaucaugguagucgcauucaguauguguauuauaugccugcucauggccggagauacguggaccgagacacuggcuuaugugcuuuucuggggcguugccuccaucgguacuuucuuuauuauccuguacaaugggaaggacuucguggaugcaccucgcuugguccaaaaggagaaaaucgacuga

SEQ ID NO: 62138 - RNA, 13299 nt, Artificial Sequence
  derived and/or modified sequence opt3 from SACS__Homo_sapiens__NP_001264984
auggcccccuaccagggcccugcucuguauguguacaacaaugcagucuucaccccagaagacuggcacgggauccaagaaauugccagaagcaggaagaaagacgacccgcucaagguuggacgguuugguauaggcuucaacuccguguaucauaucacugauguucccugcauauuuucuggggaccagaucggaaugcuugauccucaccagacucuguucggcccacaugaaucaggucaguguuggaauuugaaagacgauaguaaggaaauuagcgaauuauccgaccaauuugcgcccuucguggggaucuuuggaucuacgaaagaaaccuucauaaacggcaauuuuccuggcacuuucuuucgcuucccacugcgacuacagcccucgcagcucucaagcaaccuguacaauaagcagaagguccuugagcuguuugagaguuuccgugcugaugccgacacugugcuacucuuccugaaauccguucaagaugugucucuguaugucagagaagcagacgggaccgagaagcucguguuuaggguaacaagcuccgaaucaaaagccuuaaagcacgagcggccuaacaguaucaaaauucugggaaccgcuaucagcaauuacugcaagaagacuccaucuaacaauauuacauguguuaccuaucaugugaacaucguccuugaggaagaguccacgaaagaugcacagaagacuucaugguuggugugcaauagcguggguggccgcgggauaaguucuaaacuggacucccuagccgacgaacucaaguucgucccgauuaucggaauugcuaugccccugagcucgagagaugacgaggccaaaggcgcgaccucugauuuuuccgguaaggcauucuguuuucuuccucugccacccggggaagagucaaguacaggauugccuguucacaucagcggcuucuuuggccucacugacaacaggcgguccaucaaauggcgcgagcuggaucaguggcgagacccagccgcuuuauggaaugaguuccuggugaugaacguagugcccaaggccuacgcaacccucauucuugauucuauaaagagacuggagauggagaagucaucagacuuuccguugagugucgaugugaucuacaagcuauggccugaggcuuccaaaguuaaggugcacuggcagcccguccuggaaccacucuucagcgagcugcuucaaaacgccgugauuuauucuaucucaugcgacuggguaaggcuggagcagguuuacuuuagugaauuggaugagaaucucgaauauacaaaaaccgugcugaacuacuuacagagcuccgggaagcaaauagcgaaggucccuggaaauguggacgccgcaguccagcugacggcugccucugguacuacacccgugcggaaaguuaccccagcuugggugcgucagguacuacgcaagugugcccaucucggcugcgcagaggaaaaacugcaccuuuuggaguucguccugucggaccaggccuauagcgagcuccuggggcuugaacuguugccccuccaaaacggaaauuuugugccuuucuccucaaguguuucugaucaggacgugauuuacaucacuagcgcugaguauccaagaucccuguucccgucauuagaaggcagguuuauccuggauaaccuaaagccccaucucgucgcggcacugaaagaggccgcucagacacggggucgaccuuguacccagcuucaauugcugaauccagagcgcuucgccagacucauuaaggaagugaugaacacguuuuggcccgggagggagcugaucguacagugguacccuuucgacgaaaaucggaaccacccaagcgugucuugguuaaagaugguuuggaaaaaucuguacauucacuuuuccgaggaucuuaccuuguucgacgaaaugccccucauaccgcgcacaauccuggaggagggccagacuugcgucgaacuaauuagacugaggaucccuagucucgugauccuggaugacgagagcgaagcacagcuuccagaguuuuuggccgauauugugcaaaagcugggaggcuucguccuaaagaagcucgacgcuucuauacagcauccccugaucaaaaaguauauucacuccccucuucccucagccguucugcagaucauggaaaagaugccauugcagaaacucuguaaccaaauuaccagucugcuaccuacacauaaggaugcacugcguaaauuucucgcgagccugacugacucguccgagaaggagaaacggaucauacaggaacuugcuaucuucaagcgaauuaaucacucuagcgaucaggggaucucaaguuacaccaaauugaagggaugcaaggugcugcaucacacagccaaauuacccgcagaccucagacuguccauuucugugaucgacagcuccgaugaggccaccauaaggcuugcuaacaugcugaagauugaacaacuaaaaacuacgucaugccucaagcugguauugaaagacaucgagaaugccuuuuauagccacgaagaggucacacagcugauguuaugggugcucgagaaccugaguucucuuaagaacgaaaauccaaacguucuggagugguugaccccgcucaaguucauucagaucucccaggaacaaauggugagcgcuggugaacuguuugauccugacauagagguccuaaaagaucuguucuguaaugaagagggcacuuacuucccaccaucgguguuuaccucacccgacauccuucauucucuccgccagauugggcugaagaacgaagcaaguuugaaagagaaggauguugugcagguagccaaaaagaucgaagcgcugcaggucggagccugcccugaccaagauguguuacucaagaaagcuaagacacugcuucugguguugaauaaaaaccacacccuccugcaguccagcgagggcaagaugacuuuaaagaagauuaagugggucccagcauguaaagagcggcccccuaauuauccggguucucugguuuggaagggggaccuuugcaaccucugugccccacccgauaugugcgacgugggccaugcuauccugauaggaagcuccuugccuuuaguagaaucaauucacgugaaucuggagaaagcccucggcaucuucacaaagccaagucugagcgcaguccuuaaacacuuuaagaucgugguugauugguacucuuccaaaacguucucagacgaagacuauuaccaguuucagcauauucuguuggagaucuacggguucaugcacgaucaucuaaacgaaggaaaggacaguuuuagagcgcugaaguuccccuggguguggaccgguaaaaaguuuuguccucucgcccaagcugucauuaaaccgauacacgaucuggaccuucagcccuauuuacauaaugugccaaagacuauggccaaauuccaccagcuguuuaagguuugcggcagcaucgaggagcucacauccgaucacauuucuauggugauccaaaagauuuacuugaaaucggaccaggaucugagcgaacaggagucaaagcagaaccuccaucugaugcuuaauaucauaagguggcuguauuccaaccaaaucccugcaagucccaauaccccagucccuauucaccauucuaaaaaccccagcaaguugaucaugaaaccaauucacgaauguugcuacugugacaucaagguagaugaccuaaacgaucugcucgaggacuccguggaaccgauaauuuuaguucaugaggacaucccuaugaagacagcugaguggcugaaagugcccugccuuucaacucgccugaucaauccagaaaacaugggguucgagcagucuggacagcgagaaccccucaccguccggauuaagaauauauuggaggaguauccuagcgugagugauaucuucaaagaacugcuccagaacgccgacgaugcaaaugccacggagugcuccuuucugauugacaugcguagaaacauggauaucagggaaaaucuucuagacccaggcauggcugcgugucacggucccgcccuguggagcuucaacaauucucaauuuucagauuccgacuucguaaacauuacccgcuugggggagaguuuaaagcggggcgaaguggauaaagucggaaaguuuggccugggguucaauagcguuuaccacaucacagacauaccuaucauuaugucgagagaguuuaugaucauguucgauccgaacauuaaucauaucucuaagcacauaaaagacaaguccaacccaggaauuaaaaucaauuggagcaagcagcagaaaaggcuccgaaaguuucccaaccaguucaagccuuuuaucgauguguucggcugccaacugccccuuacuguggaggcaccauauucauacaacgguacccuguuucgccucaguuuccggacacagcaggaagcuaaagucucugagguguccagcacuuguuacaauaccgccgacauuuauucauugguugacgaguucagucugugcgggcauagacuaaucauauuuacgcagagcguaaaguccauguaccugaaauaucucaagauugaggaaacaaacccuucucuugcccaagauaccgugaucauuaaaaagaaaagcuguuccucaaaggcucugaauacucccgucuuaucuguguugaaggaggcagccaaacugaugaagacaugcaguucgagcaacaaaaagcucccauccgacgagccuaaaucuucauguauccugcagauaaccguugaagaguuccaccacguguuuaggcguauugcggaucuucagagcccgcuguuccgcggacccgacgaugacccagcugcccucuuugaaauggcaaaguccggccaaaguaagaaaccuucugaugaguugagccagaagacugucgaaugcaccacauggcuguuauguacgugcauggacaccggugaggcccuaaaauucucacuguccgagaguggccggagacucgggcuugugcccuguggagcuguaggcguccagcugagcgaaauccaggaucaaaaguggacugugaaaccacauaucggggagguauuuugcuacuugccucugaggauuaagacaggacuccccgugcacaucaauggcugcuucgcagucaccucuaaccgaaaggaaauuuggaaaacagacacuaagggucgguggaauaccacguuuaugcgccaugugauaguuaaagccuaucugcaagugcuuuccguccucagagaucuggcgacaucaggggaguugauggacuacaccuauuacgcuguguggccggauccagaccugguacacgacgauuucagcgugaucugucagggauuuuacgaggacauugcccauggcaaggguaaagaauuaacuaagguuuucucggauggcucuaccugggucaguaugaagaacgugagguuucuagacgauuccauccugaaacggcgagacguggggagcgcagccuucaagaucuuccucaaauaucuuaagaaaacaggaucaaagaaucugugcgcugucgaguugccuuccucuguaaaacugggcuuugaagaggccggguguaagcagauucuccuggaaaacacuuucagcgagaagcaauuuuucagugagguguuuuuccccaauauacaggaaaucgaggcagaacuuagagauccauuaaugauuuuuguucugaacgagaaaguggacgaguucuccggaguccuccgcgugacccccugcaucccuuguagcuuggagggccacccgcugguucuacccucuaggcugauucacccagagggucguguggcuaagcucuuugauaucaaagacgggcgguucccuuacggaucaacacaggauuaucuuaaucccauaauccugauuaaguugguccagcugggcauggccaaagacgacauccucugggaugacaugcuggaaagagcggugaguguagccgagauuaacaaguccgaucauguggcagcuugcuuaaggagcucuauccuucugucgcucauagacgaaaagcuaaaaauucgcgauccucgagccaaggacuuugcugcaaaauaccaaacgaucagauuccugccauuuuugaccaagcccgccgguuucucacuggauuggaaaggcaauagcuucaagccugagacuauguuugccgcuacagaccucuauaccgcggaacaccaggauauuguuugucuucugcagccaaucuugaacgaaaauucccauaguuuccgggggugcggaucugucagccuggcagugaaggaguuucucggcuuacugaaaaagcccacuguggaccuugucauaaaccaacugaaagagguugccaaguccguggaugacgggaucacacuauaccaggagaacauuaccaaugcuuguuauaaauaccuccacgaagcccugaugcagaacgagaucacgaagaugucaauuaucgauaaguugaaaccguucaguuuuauacugguagagaaugcauacguggacucugaaaaggucagcuuccaccucaacuuugaggccgcuccuuaucuuuaccagcugccaaauaaauauaagaacaauuucagggaauuauuugagacugugggaguucgccaauccugcaccguggaagacuucgcgcuggucuuggagucaauugaucaggagcguggcacaaaacagaucaccgaagagaacuuucagcucuguagacggaucauuagcgaagguaucuggucucugauaagggagaagaaacaagaguucugcgagaagaauuacgggaagauucuacuucccgacacuaaccugaugcuccugccugccaaauccuugugcuauaaugauuguccauggaucaagguaaaagacacaaccgugaaguacugccaugcagauauuccccgcgagguugcugugaaacugggagccgucccgaagcgacacaaggcacucgaaagauaugccaguaacguguguuuuacaacucuuggcaccgaguucggccagaaagaaaagcugacgagccggaucaaaucgauauuaaaugcuuacccuuccgagaaggaaaugcugaaagaguugcuccagaacgccgacgaugcgaaggcaacagagaucugcuucgucuuugaccccaggcagcauccaguggaucgcauuuucgacgauaagugggccccucugcaagggcccgcucuauguguuuacaauaaccagccauuuaccgaagacgacgugagaggaauccagaaccuugguaaaggcacuaaggaggggaaucccuauaaaaccggacaguacggcauugguuucaacucuguauaucacaucacagauugcccuucauuuauuagcgggaaugacauccuguguauauucgauccacaugccagguacgcuccgggagcaacaaguauuucccccggccggauguuucgugaccucgaugccgacuuccgcacccaauuuucugaugugcuggacuuguauuuaggcacgcacuucaagcuggauaacugcacaauguuucgauucccucucagaaaugcugaaauggccaaagucagcgagaucucauccguuccagcaagugacaggauggugcagaaccuucuggauaagcuacggagcgacggggcggagcugcucauguuuuugaaucacauggaaaagaucucuauuugugagauagauaaaucaaccggagcccugaacguccuuuacuccgugaaggguaaaaucacugacggcgaccgccugaagagaaaacaguuccaugcuagcguaauugauucugugacaaagaagaggcaacucaaagacauccccguucagcagauuaccuauacuauggauacagaagacagugaggggaauuuaaccacguggcugaucugcaaccggucgggauucuccagcauggaaaaggugucaaaaucugucauaagcgcccacaagaaucaggauaucacuuuguuuccucgaggcgguguggcagcuuguauuacccauaacuacaaaaagccacacagagccuucugcuuucugccccucucccuugagacagggcugccuuuccacgucaauggacauuuugcacuagacagugcccgcaggaaccuguggcgggaugacaauggcgugggcguucguucagauuggaacaacucucucaugaccgcuuugaucgcgccggccuacguagagcugcuuauucaacugaaaaagagauauuucccagggagcgaccccacauuauccgugcuccagaauacuccuauccacgucgugaaggauacccugaaaaaguuuuugaguuucuuucccguuaacaggcuggaccuccagccagaucuuuacugccuggugaaagcacuauauaauuguauacaugaagacaugaagcgccugcucccugucgugcgggcucccaacauugacggaagcgauuugcacuccgccguaaucaucacguggauuaauaugucuacaucaaacaaaacucgaccauucuuugacaaucuguuacaggaugagcuucaacaucugaagaacgccgacuacaauauaaccacaagaaagaccguggcagaaaacguuuauaggcucaaacaccuguugcuggagaucgguuucaaucucgucuacaacugcgaugaaacugcuaaucuuuaucacugucugauugacgccgauaucccggugagcuacgugaccccugcggacauucgcucguuucuaaugacauucuccagucccgauacgaacugccauaucggcaagcugccaugucgguuacagcagacuaaucucaaacuguuccacucuuugaaacuucuggucgacuacugcuuuaaagaugcugaggagaacgaaauagagguugaagggcucccccuguugaucacccuggacagcgugcuacagacauucgacgccaagagaccuaaguuucucaccacuuaucaugagcuuauuccaucacguaaagaucuguucaugaacacauuauaccugaaguauuccaauauccuccugaacuguaaaguagcaaagguguuugacauuucuaguuucgccgauuugcuuagcuccguccugcccagggaauacaaaaccaagucaugcacgaaguggaaagacaauuuugcuagcgagucuuggcucaagaacgcauggcacuucaucagugaguccgugagcguuaaagaagaucaagaggaaacuaagccuacauuugacauuguggucgauacccugaaagacugggcccuauugccgggaaccaaguucacugugucagcgaaucagcugguaguuccagagggcgaugugcuccuuccccugucuuuaaugcauauagcugucuuuccuaacgcccaguccgacaaaguguuccacgcacugaugaaggccgguuguauccaacucgcucugaauaagauuugcucgaaagauagcgccuucgugccauugcuuaguugucacacagcaaacaucgagucucccaccuccauccugaaggcucuccauuauaugguccagacaagcacuuuucgggccgaaaaacugguugagaaugacuucgaagcgcuauuaauguacuuuaacugcaaucugaaccacuugaugucacaggaugacauuaagauacucaaaagucugccuugcuauaaguccaucagcgggcgcuacgugucuauuggaaaguucggcacguguuacguacuuaccaaaucaauccccagcgccgagguggaaaaguggacacaguccucuaguucggcauuucuggaggagaaaauucaucucaaggaacuguaugaggucaucggcugcgugccaguugacgauuuggaaguguaccuuaaacaccuguugccgaagauagagaaucucagcuaugacgcuaagcuggaacacuuaaucuaccugaaaaaccgauuguccucagccgaggagcucucugaaauuaaggagcaacuguucgaaaaacuugagagccugcucaucauucaugaugcaaauaguagauugaagcaggcuaaacacuuuuaugacaggacuguccggguguucgaaguaaugcugccugagaaacuuuuuauccccaacgauuucuuuaagaaacuggagcaguuaauaaagcccaagaaccauguuaccuucaugacauccuggguggaauuucuacgcaauauugggcucaaguacauccugucacagcaacagcuguugcaguucgccaaagagauuucugucagagccaacaccgaaaauuggagcaaggagacucuccagaacacgguggacauccugcuucaccauauauuccaagagaggauggaucuguuauccggaaauuuucucaaagaacugaguuugaucccuuuccuuugucccgagcgagcgccagcugaauuuauucgguuccacccucaguaucaggagguuaacgguacccugccccuaaucaaguuuaauggcgcacaagugaacccgaaguucaaacagugcgacguccuccagcugcuguggacaagcuguccaauuuugccugaaaaggccacuccccucucuaucaaagagcaggaggggucagaucugggaccacaagaacagcuugaacaggugcugaauauguuaaacguaaaucucgaucccccucuggauaaggugauaaacaauugccguaacauuuguaauaucaccacacuagacgaagagauggucaaaaccagagcuaagguuuugcgcuccaucuacgaauuucugagcgccgagaagagggaguuccgguuucagcuuagaggcguggcauucgucaugguggaagaugguuggaaacuccugaagccggaggaaguagugauuaaccuggaguacgaaagugacuuuaaaccauauuuguacaaacuuccccucgagcuggggacuuuccaccaauuauuuaaacaucugggaacagaggacaucauaucuacgaagcaguauguugaagugcuaucccgcauuuucaagaacucggagggcaaacagcucgauccuaaugaaaugaggaccgucaagcgagugguuagcggccuguuccggucauugcagaacgacuccgucaaagugagaucugaucuggagaaugugagggaccuugcccucuaccugcccagucaagaugggcgcuuaguaaagagcucaauccuggucuuugacgaugcuccacacuauaaaucccguauucagggaaacaucggugugcagauguugguugaccucagccagugcuaccugggcaaggaucauggguuccacacuaaacuuauaaugcuguuuccucaaaaacuacggcccagacuccugucuaguaucuuggaggaacagcuggacgaggaaacaccaaaggugugucaguucggagcgcuuugcucccuccaaggcaggcugcaguuacuguugagcucagagcaguuuauuaccggucucauccgcauuaugaaacacgaaaaugauaacgccuuccuggcaaaugaggagaaggcuauccgacuuuguaaagcccugcgggaagggcuaaaggucucuugcuuugagaagcuccagaccacacugagagugaaaggcuucaacccuauuccgcauucgaggagcgaaacuuuugcauucuugaagcgcuuuggaaaugccguuauccugcuuuauauacaacacuccgacaguaaagacaucaacuucuuacuggcucucgccaugacgcugaagucugcgaccgauaaucuaauuucagacacaagcuacuugaucgcaaugcugggcuguaacgauauuuacagaauaggggagaaacucgacucccuuggagugaaguaugauaguucugaacccagcaaacuggagcucccaaugccugguacucccaucccagccgagauucauuacacccuguuaauggacccuaugaauguauuuuaucccggcgaauacgucggguauuugguggaugcugagggaggcgacaucuacgguuccuaucagccgacauacaccuacgccauuaucgugcaggaaguugagcgggaagaugcagacaacagcagcuuccuggggaagauauaucagaucgauauuggcuacucugaguauaagaucgucuccagucuugaccuguacaaauucucaaggccagaggaaagcucgcaaucccgugauucugcuccuaguacucccacgagcccaacagaguuucucacccccggacugcgaucaauuccuccccuauucuccggccgcgaaucucacaagacuagcaguaaacaucaguccccaaagaaacuuaaggugaauagccugccugagauccucaaggagguaaccucuguggucgaacaggccuggaaauugccggagucagaaagaaagaaaauaauucggaggcuguauuuaaaguggcaccccgacaaaaacccagagaaccacgacaucgcuaaugaaguguuuaagcaucugcagaacgagaucaaucgccucgagaagcaagccuuccuugaucagaacgcagacagagcgucccggaggacauuuagcacaagugccucucgauuccagucagauaaauacuccuuucaacguuucuauaccagcuggaaucaggaagcuacaucgcacaagucugagagacagcagcaaaacaaagaaaagugcccucccagugccgggcagacguacucccagcgcuuuuucguuccaccuaccuuuaaaagcgugggaaaucccgucgaggcacggagguggcugagacaggcucgcgccaacuucucagcagcccggaaugacuugcauaagaacgcgaaugaaugggugugcuuuaaguguuaccugucuacuaaacucgcucuaauugccgcagauuaugccguuagggguaagagcgacaaagaugugaagccgacagcucuggcccagaaaauugaggaguacucccagcagcuugaaggccugaccaacgacguacacacucucgaggcauauggggucgauaguuugaagacacgauacccugaccuguuaccauucccccagaucccuaaugauagauucaccucagaaguggcuaugcggguuauggagugcacggccuguauuaucauuaaacuggaaaacuuuaugcaacagaagguguga

SEQ ID NO: 62139 - RNA, 900 nt, Artificial Sequence
  derived and/or modified sequence opt3 from SAE1__Homo_sapiens__NP_001139185
augguggagaaggaagaggccggcgggggaaucagcgaagaggaagcugcacaguacgacagacaaauuaggcuguggggucucgaggcccagaaacggcuucgcgcgucccgaguccuguugguuggcuuaaaggggcugggagcugagauagccaaaaaccuaauccucgcaggcgugaagggucugaccaugcuugaucacgaacagguaacacccgaggacccuggggcccaguuccugauucguacuggaucugugggcagaaauagggcugaagcaucauuggagcgggcccaaaaccucaauccaauggucgaugugaaaguugacacggaggauaucgaaaagaagccggagagcuuuuucacccaguuugacgcugugugccugacauguugcagucgcgaugucauugugaaaguagaccagaucugucauaagaacuccauaaaauucuuuacuggcgauguuuucggguaucacggauacaccuuugccaaucugggugaacaugaguucguggaagagaagacaaaagucgcgaaggugucucagggcguggaggacgggcccgauaccaagagagcaaaacucgacucgucagaaacuacaauggucaagaaaaagguuguguuuugcccuguaaaagaggccuuagaaguggauuggagcagugagaaggcuaaagccgcacugaagaggaccacguccgacuauuuccuuuugcaaggaccagucucugcuggccccagcucccagcagcugcuacuccugcgguggcacgaaggugagugggacuguggggugccuuggccacagguuaacucacgcuuuggaaguccccgagaugccaauugcagcaugccuacuuguaucccaugcccgcuucccucuuga

SEQ ID NO: 62140 - RNA, 2862 nt, Artificial Sequence
  derived and/or modified sequence opt3 from SAFB2__Homo_sapiens__NP_055464
auggccgagacccugcccggcagcggggacuccggaccugguacagcuucucucggcccagggguggcagaaacuggaacgagaaggcuuucagagcugcgggucaucgauuugcgcgccgaauuaaagaaacgaaaccuggacaccggcgguaauaagaguguucuaauggagcgucucaaaaaggcggugaaagaagaggggcaggauccggacgagauuggaauagaacuggaggcuacaagcaagaaguccgccaaaagaugcguaaagggccuuaaaauggaagaggagggcacugaagauaacgggcuggaggacgauucuagggacggacaagaagauauggaggcaucguuggaaaaucuccagaacauggguaugauggacaugucagugcuggaugagaccgaggucgccaauagcagugcucccgacuucggcgaagaugggacagacggacugcucgacuccuuuugugauucuaaggaguacguggcagcccaguuacggcagcugccugcucaaccacccgaacacgccguugacggcgaggguuucaaaaacacccuugaaacuagcuccuugaauuuuaaggugacaccugauaucgaggagucacugcuagaaccagagaacgaaaagauucucgacauccugggggagaccugcaaaagugaacccgucaaggaggagagcucugaacuugagcagccuuucgcgcaggauacguccucagugggaccagaccgcaaacuggcagaagaggaggauuuguuugacagcgcccauccggaagagggcgaucucgaccuggcuagugaaucuacugcccacgcacaguccagcaaggcugauucguuacuggccguaguuaaaagagagcccgcggaacaaccuggcgacggggagaggaccgacugugagccagugggacucgaacccgccgucgagcagucuuccgcagcuucagaacuugccgaggcuaguagcgaggaacuggccgaggcaccuacagaagccccaucccccgaggcucgggauucuaaggaagacggucgcaaauucgauuuugacgcgugcaaugaggugccgccugcacccaaggaaagcucaaccagugagggcgccgaucagaagauguccagcuucaaagaggaaaaggacauuaaaccaaucauaaaggaugagaaagggcgagugggaucuggcucagguagaaacuugugggucagugggcuaagcuccacuacaagggcuaccgaccugaagaaucucuuuucuaaguauggcaaaguugugggagccaagguagugacgaacgcacggucgccuggcgcccguuguuacggguucgucacuaugagcacauccgaugaagcuaccaaaugcaucucacaucugcaccgcacugagcuucauggaagaaugauuaguguggagaaggccaaaaaugaacccgcagguaagaagcugucugacaggaaagagugugaaguuaagaaagagaaguugagcuccguggaucggcaccacucagucgaaaucaaaauugagaagacagugaucaagaaagaggaaaagauagagaaaaaggaagagaaaaagccagaagacauuaaaaaggaggagaaggaucaggacgaacucaaacccggcccuaccaaccgaagccgcguaacgaagucuggguccagaggaauggagaggaccguugugauggacaaaaguaagggcgaaccagucaucagcgugaaaacaacuucucgguccaaggagcgcucaaguaagagccaagauagaaaaucggaauccaaggagaaaagggacauucugucuuuugauaagaucaaagagcagcgugaacgggagcgacagagacaaagggaacgcgagauccgggagaccgaaagaaggcgcgagcgagaacagcgggagcgugaacagagauuagaggcguuccaugagaggaaggaaaaggcucgccugcagcgggagagacuacaacucgaaugccagaggcagcgacuggagcgcgaacggauggagagagagaggcuugaacgugagcgcaugcgggucgaaagagagaggcgaaaagaacaggagcggauucaccgcgagagagaagaguugaggcggcaacaggaacagcugcgauaugagcaggagagacgcccggguaggcgucccuacgaccucgaucggagagacgaugccuauuggccugaagggaagaggguggcaauggaggaccgcuaccgagccgauuuuccaagacccgaccaucgguuccacgauuucgaccacagggaucgcggccaauaucaggaccaugcuauagaccguagagaaggaagccggccuaugaugggcgaucacagggacgggcagcauuacggagaugaccgccacggucauggcgggccacccgagcgacacggaagagauucacgggacggcugggguggguacggcagugauaaaaggcuguccgaaggacgcggccuuccgccuccacccagagggggaagggacuggggcgagcacaaucagcggcuggaggaacaucaagcccgugcauggcagggugcuauggaugccggggcggccucucgcgagcacgcucgauggcagggaggcgaaagagguuugagcggcccuuccgggcccggacauauggcaucaaggggcgggguugccggacggggcgguuuugcucaagggggacacagccagggccacgugguaccagguggcgggcucgagggaggcggggucgccagucaggaccgcggaucuagagugccucauccccacccacauccgccucccuauccacacuucacaaggcgguacuga

SEQ ID NO: 62141 - RNA, 2754 nt, Artificial Sequence
  derived and/or modified sequence opt3 from SAFB__Homo_sapiens__NP_001188267
auggccgagacccucagcggccucggggacuccggagcugcaggggccgcggcucuuucuucagccaguagcgaaacaggcacuagaaggcuguccgauuugcgggugaucgacuuacgcgcagagcugcgaaagcguaacgucgauucuucggggaauaaaucaguucuaauggaaagacucaagaaagccauugaggacgaaggaggcaaccccgaugagauagagaucacgagcgaagguaauaagaaaaccaguaagagguccucuaaggggcggaaaccugaggaagagggaguggaggacaacggccuggaagagaauagcggcgaugggcaggaagacguagagacaucccuugaaaaccugcaagauauugacaucauggauauuucaguguuggacgaggcugagaucgauaauggaagugucgcagacugcguggaagacgaugacgccgauaaccuccaggagagccugucugacucccgcgaacugguugagggugaaaugaaggagcucccagagcaguuacaggaacacgcuauagaggauaaagaaacuaucaauaaccuggacaccucaagcagugauuucacaauucuucaagagaucgaggaaccgucuuuggagcccgaaaaugagaagauucuggacauccuaggcgaaaccuguaaauccgagccugugaaggaggaaagcucggagcucgaacagccauuugcccaggauacuucuuccgucgggcccgacagaaagcuggcggaggaagaggaucuuuucgacucagcacauccugaggaaggagaccuggauuuggccagugagagcacagcucacgcccaguccucuaaagcagacagccuccuggcugugguaaagagggaaccagccgagcaacccggcgauggugaacggaccgacugcgagccuguuggguuagagccagcgguggaacagucaagugccgcauccgagcuggcugaagccagcucugaggaacucgcugaggccccgacggaggcacccucaccugaagcccgcgauaguaaagaggacggacgaaaguuugauuucgacgcuuguaacgaagucccacccgcgccuaaagagagcuccacuucugagggcgcagaucagaagaugucgagcccagaagacgauuccgacaccaaaagacuuucaaaggaggaaaagggcaggaguucuugcgggcggaauuuuugggugagcggacuguccucaacaacucgugccaccgauuugaaaaaccuauucagcaaguacgguaaaguggucggcgcuaagguugugacaaaugcccgcucucccggggcaagauguuauggauuuguaaccauguccacggccgaggaagcuacuaaaugcauaaaccaucugcacaagacagagcuccauggcaagaugauuaguguggagaaagccaagaacgaaccggucgguaaaaagaccagcgacaaaagggacucugaugggaagaaggagaaauccucaaauagugaccggagcacuaaccugaagcgagaugacaaaugugaucgcaaggacgaugcgaaaaagggcgacgauggaucgggcgaaaaguccaaagaccaggaugaccaaaagccugggcccucugagagaagcagggcaacaaaaucaggaagucgggguaccgaacgcacggugguuauggauaaguccaaaggcgugccagucaucucugugaagaccagcggguccaaagagagagcuucaaagagccaggacaggaagagugccucucgugagaaacgguccguaguuagcuucgacaaggugaaagaaccucgaaagucgagagauucagagucucacaguaggguccgcgaacgguccgagagagaacagaggaugcaagcacagugggagcgcgaggaacgagagcggcuugaaauugcccgugagagacuggcuuuucagaggcagcgcuuggagcgggaaagaauggagagggaacgacucgagcgcgaacggaugcacguggagcaugagagaaggcgugaacaagagcgcauccaccgggaaagagaggaacugaggcgacagcaggaguuacgguacgagcaggaacgcagacccgccgucaggcggccauaugaccuggaucgaagagacgaugcauacuggcccgaggcuaaacgcgccgcgcuagacgaaagguaucauagcgauuucaaucgucaagaccgguuucacgauuucgaccacagagauaggggacgcuacccugaccauucuguggaccgaagagagggcagccgguccaugaugggugaaagggaggggcagcacuauccagagcgccauggcggaccggaacgucacggcagagauucacgggacggguggggagguuacggcagugauaagaggaugagcgaggggcgcggacugcccccuccaccccgaggcagacgggacuggggugaucaugggaggcgcgaagacgauagaucuuggcagggcacagccgacggaggcaugauggauagggaccacaagcgguggcaggguggagagcguuccaugucaggccacagugguccugggcauaugaugaaccgcggaggcaugagcggucgaggcuccuuugcuccagggggagcaucuagaggccaccccaucccgcaugggggaaugcaaggcgguuucgggggacagucgaggggcagccggccuucagaugcccgcuucacuagaagguacuga

SEQ ID NO: 62142 - RNA, 2715 nt, Artificial Sequence
  derived and/or modified sequence opt3 from SAGE1__Homo_sapiens__NP_061136
augcaggccagcccccugcaaaccucccagccuacaccaccggaggaacuccacgcugcagccuacguguucacuaacgacggccagcagaugagaucugaugaggucaaucuuguugcgacggggcaucaaucaaagaaaaagcacaguaggaaaagcaagcggcauuccucuucgaaacgccgaaagucaaugagcaguuggcuggacaagcaggaagaugcugccgugacccacuccaucugcgaggaacguauuaacaauggacagcccguagcagacaacguguugucuacagccccuccauggcccgaugcuacuauagcacauaauaucagagaggagaggauggaaaacggucagagccggaccgacaaagucuuauccacagccccuccacaacuggugcacauggcugccgcgggcauucccucaaugaguacccgcgaucuacacagcacuguuacacauaauaucagagaggaaaggauggagaacgggcagccucagccagacaaugugcucucuaccggaccgacgggccugauuaacauggcagccacucccaucccugcuauguccgcccgggaucuuuaugcaaccgucacacacaaugugugugagcagaagauggaaaacguacaaccagcucccgacaauguucuguugacucuccgcccucgaagaauaaacaugaccgauacagguaucucaccaaugagcaccagggaccccuacgccacgauuacuuauaaugugccggaggagaaaauggagaaggggcagccucagcccgauaacauccugaguacagcgucuaccggacugauuaacgucgccggcgcaggcacuccagcuaucuccacaaaugggcucuacagcaccgugccucauaacgugugcgaagagaaaauggagaaugaccaaccccagccaaacaaugucuuaucgacgguucagcccgugauaauuuaucugaccgccacaggaaucccugguaugaacacucgggaccaguacgcuaccauuacacacaauguaugugaagaacguguggucaacaaucaaccacuuccgucuaacgccuuguccacugugcugcccggccuagcauaucucgccaccgcugauaugccugcgaugucaacacgcgaccagcacgcaaccaucauccauaaucugagagaagagaagaaggauaacagucagccaacucccgacaauguucuuagcgccgugacgccugaacugauuaacuuggcuggggccggaauaccacccauguccacaagggaucaguacgcaaccgucaaucaccaugugcacgaggcccggauggagaacggccaacgaaaacaggacaacguacucucuaauguucugagcgguuuaaucaacauggcuggggccucaauuccggcaaugaguucccgcgaucuguacgcgacuaucacccauagcgugagagaagagaagauggaaucuggaaaaccucagacagacaaggucauaucaaaugaugcuccacagcucggccacauggccgcaggcgggauucccaguaugagcaccaaagaccuuuaugccacugugacacaaaacguccacgaggaaaggauggagaauaaccagccucagcccuccuacgaucugucuacgguguugccaggacuaaccuaucugacuguugcugguaucccugccaugucgacacgggaccaguacgcaaccgugacacauaauguacacgaggaaaagaucaaaaacggccaagcugccagcgacaaugucuuuuccacugugcccccagcguucauuaacauggccgcuaccgggguuucaaguaugucuacgcgcgaucaguaugcagccgugacccauaauaucagagaggaaaagauuaacaauagccagccggcuccuggaaacauacucuccacagcacccccauggcugaggcacauggccgcggccggcaucucaagcacuauuacccgugaccuuuacgucacagcuacucacucugugcaugaggagaagaugaccaauggucaacaggcccccgauaacucccugaguacgguaccuccagggugcaucaacuugagcggcgcaggaaucucuugucgguccacacgagaccucuaugcuaccgugauucacgauauacaggaagaggaaauggagaaugaccagacucccccugauggcuuucugucaaacagugacagcccggaauuaaucaauaugacagggcauugcaugccacccaacgcccuggauucguucucccacgacuuuaccucucuaagcaaagaugagcuccuguacaagccugacucaaaugaguucgcaguuggaacuaaaaacuacagugucuccgccggugauccacccgugaccgugaugucucuugucgaaacaguuccuaauacgccgcaaauuagccccgcuauggcgaagaaaaucaacgacgacauuaaguaucaguugaugaaggaggugagaagguuuggccagaauuacgaacgcaucuucauacugcucgaggaagugcagggguccaugaaaguaaagcggcaauuugucgaguucaccaucaaagaggccgcaagauuuaagaaagugguucugauucagcagcuugaaaaggcucugaaggagaucgauucacauugucacuugaggaaagugaagcacaugcgcaaacgauga

SEQ ID NO: 62143 - RNA, 1218 nt, Artificial Sequence
  derived and/or modified sequence opt3 from SAG__Homo_sapiens__NP_000532
auggccgcuagcggcaagaccuccaaaucugagcccaaccacgugaucuucaagaaaauuucaagagacaagagugucacaauauaccuggggaauagggauuauaucgaccauguuagccaggugcaaccuguagauggagugguccucguggacccagaucuuguuaaagguaagaagguguacgucacucugacgugcgcauuucgguauggccaggaagacauugaugugaucggguugaccuuccgccgagacuuauacuuuucccguguacagguuuauccgcccgugggagccgcgucuacaccuacuaaacugcaggagucgcuacucaagaaacugggcucaaacaccuacccauuccuucugacauuucccgauuauuugccuuguagcgucaugcuccaaccagcuccccaggacagugguaaguccugcgggguggauuucgaagugaaagccuuugcaaccgacucuacugaugccgaggaagacaagauuccuaagaaaagcuccgucagacugcugaucaggaagguucagcacgcuccacucgagaugggaccgcagccccgggcagaggccgcuuggcaauucuuuaugucagacaaaccuuuacaucuggccgugagucuuaauaaggaaauauacuuccacggcgagccaauccccguaacagugaccgucacgaacaauacugagaaaaccgugaagaaaauuaaggcguuuguugaacagguggcaaacgucguguuguacagcucugauuauuacguaaagccuguugccauggaggaagcucaggagaaagugccacccaauuccacacugacuaagacccuaacacuccugccgcuucuggccaacaaucgcgaaagaaggggcaucgcauuggacgggaaaauuaagcaugaggauaccaaccucgcuucaagcacgaucauaaaagaaggaauugaccggacuguccuggguaucuuagugaguuaucagauuaaggucaagcugacagugucuggcuuccucggggagcuuaccuccagcgagguugccacugaagugccuuuucgccugaugcacccccaaccagaggauccugcgaaagaaucguaccaggacgccaauuugguauucgaggaguucgcacgacacaaccuaaaggaugcuggagaagccgaggaaggcaaaagagacaagaaugaugucgacgaguga

SEQ ID NO: 62144 - RNA, 3684 nt, Artificial Sequence
  derived and/or modified sequence opt3 from SALL1__Homo_sapiens__NP_001121364
augaacgacaccgugaauaagacagaucaggucgacugcagcgaucuguccgagcacaacggccucgacagagaagagucuauggaaguugaggcccccguggcuaauaaaucagggaguggaacuagcuccgguucucauucgucaacggcaccuagcaguuccucuagcuccucaaguagcucuggcgggggaggcuccucaagcaccgguacaagugccaucacuaccucucuuccacaacugggggauuugacaaccuuaggaaacuucuccguaauuaauagcaacgugauaaucgaaaaucugcagucgacuaaggucgcgguggcucaguuuucucaggaggccagguguggcggcgcauccgggggaaaacuagccguuccggcucucauggagcaacugcuugcacugcagcagcagcaaauucaccaguugcagcucaucgaacagauucggcaucaaauccugcugcucgccucacagaacgcugacuuacccacaaguagcuccccuucucaggguacccugcgcacgagcgccaauccacuuucaacuuugaguucccaccugagccaacagcuagcggcagccgcuggccucgcccagucucuggcaucacagagugcuagcauauccggggugaagcaacuucccccuauccagcugccacagucuucgagcggaaacaccauuauccccuccaauucaggcaguucuccuaacaugaauauuuuggccgcggccgucacaacuccaagcuccgagaaaguggcaucaagcgcuggugccucucauguauccaacccggcuguuaguagcagcuccucacccgccuucgcaaucaguagccuccugucgccugccuccaauccauuacugccccagcaagcuagcgcgaacagcguguuuccuucaccacuccccaacauagggaccacagcagaagaucuuaauagucuguccgccuuggcucagcagcgaaagucuaagccgccuaacgucaccgccuucgaggcaaaaagcacguccgacgaggccuuuuucaagcacaaaugccguuuuugugcuaagguguucggaucagauagcgcccuacagauucaccugagaagucauacuggcgaaaggcccuuuaaaugcaauaucuguggcaaccgguucucuacaaaggggaaucucaaggugcacuuucaacgccauaaagagaaguacccacacauucagaugaacccuuaucccgucccagaacaccuggacaauauccccaccuccacuggaaucccuuacgguaugagcauuccaccggagaaacccguuacaucguggcuugauaccaagccugugcugccaacguugaccacaucaguaggccucccccugccuccaacuuuacccucucugauaccguucaucaaaaccgaagaaccugcaccaauucccaucagucauuccgcgacaagcccucccgggucugugaagucugacuccggaggcccagagucagcuacuagaaaccuaggugggcucccugaagaggccgaaggcaguacccugcccccaagcggaggcaaaucugaggaauccgggauggucacaaauucagugccgaccgcaaguagcuccguucuuucuucgccugccgcugauugcggacccgccgguagcgcaacuacguuuacaaacccauugcugccccucaugucagagcaguucaaggcuaaguucccuuuuggcgggcugcuugacuccgcccaggcgagugagaccucuaaacugcaacaguugguggaaaauauagacaagaaagccacugauccaaacgaguguauuaucugccacaggguccucagcugucaguccgcucugaagaugcauuaucggacccacacaggagaacgccccuucaaaugcaagaucuguggccgagcauuuaccacuaaggguaauuuaaaaacacauuacucagugcacagagccaugccuccgcugaggguacaacacucuugcccaauuugccagaagaaauucacgaacgcuguugugcuacagcagcauauccggaugcacaugggcgggcaaauucccaauaccccugucccagacagcuauagugaguccauggaaagcgauacuggaucuuuugacgagaagaacuucgaugaccucgauaacuuuucagacgagaauauggaagauugucccgagggcuccauaccugacacaccgaaaagugccgaugcaagccaggacucgcugucuuccagcccccuuccauuggaaaugucaaguaucgcggcccuggagaaccagaugaagaugauuaaugcugggcucgccgagcagcugcaagcaucuuuaaaguccguggaaaacggaagcaucgagggugacguccugaccaaugauucaaguagcgugggcggggacauggaaucccagucugcuggaagcccugccaucuccgagucaacaucuaguaugcaggcacuuucgcccagcaacuccacucaggaguuccauaaaucuccaucaauugaggagaagccucaacgugccguucccagcgaauuugcuaauggcuuguccccaaccccggugaacgguggggcgcucgaucugacgaguucucacgccgagaaaauaaucaaggaagacagccuaggcauucuguucccuuuucgcgauagaggaaaauucaagaauaccgcaugcgacaucuguggcaagacauuugcuugccagucagcccucgauauucacuacaggucccauacuaaagagcggcccuucaucuguaccguaugcaaccgaggguucaguacaaagggaaaucugaaacagcacaugcuuacucaucaaaugcgcgacuugccaagccagcuguuugaacccucuuccaacuuaggcccuaaucagaacucagccgucauaccagcuaauagccucucgucucugaucaagaccgaggugaacgguuucguucacgugaguccccaggauuccaaagacacgccuacaagccaugucccgucagggccacuuuccucuagcgcaaccagucccgugcuguugccugcccuccccagaaggacuccaaagcaacacuauuguaacacaugcggaaaaaccuuuuccucuucuucagcgcugcagauucacgagcggacucauaccggcgaaaagccuuucgcuuguacaaucugcggucgcgccuuuacgaccaagggcaaucuaaaaguacacauggggacucauauguggaacaguacacccgcaagaaggggacgucggcuguccguggauggcccaaugaccuuccucgggggaaauccuguuaaguuuccggagauguuccagaaagaccuggccgcucgaagcggcucuggugaucccucgucauuuuggaaccaguacgcagccgcgcuuagcaauggguuggcuaugaaggccaacgaaauuuccgucauccaaaauggaggcauaccaccuauucccgguagucugggcucugggaacagcuccccagugucaggauuaacaggcaaucucgagagacugcagaacagugaaccuaaugcaccccuugccgggcuggagaaaauggcuucuagcgagaacggaacuaauuucagguuuacccgcuucguggaagacuccaaggagaucgucacgucauga

SEQ ID NO: 62145 - RNA, 3024 nt, Artificial Sequence
  derived and/or modified sequence opt3 from SALL2__Homo_sapiens__NP_005398
augagcagaaggaagcagcggaaaccccaacagcugaucuccgacugcgagggcccuucugccucagaaaacggggaugcuagugaggaagaccacccacaggugugugcaaagugcugugcccaguucaccgauccgacagaguuucucgcgcaucaaaaugcuugcagcacugaucccccugucaugguuauuauaggaggucaggaaaacccaaauaacuccucugccucgucagagccccgcccugagggccacaauaacccacaggugauggacacggaacauagcaaucccccugacaguggguccucuguaccaaccgauccgacauggggacccgagcgacguggcgaagagagcuccggucacuuccuuguggcagccacugggaccgcugcaggaggcggcgggggacugaucuuggccucaccuaaauuaggugcuacaccacugcccccugagaguaccccagcgcccccgccucccccaccucccccacccccuccaggcgucgggagcggacaucuaaacauuccgcucauccuggaggaacuuagagugcugcagcaaaggcagauucaccagaugcagaugacugaacaaaucugucggcagguuuugcuccugggcucucugggucagacagugggggcccccgcauccccuucagagcucccaggaaccggcacggccagcaguacuaagcccuuacugccucuguuuucuccaauaaaacccguccaaaccuccaagacauuggcuagcucgucuuccucaaguagcuccucuagcggcgccgaaacuccgaagcaggcauucuuucaccuguaccauccucuagggucacagcacccauucagugcuggaggugugggccgcucccauaaacccaccccugcccccagcccagcgcucccugggucuacagaccagcugaucgccucaccccaccuugcauuuccaaguaccacgggacuguuggcugcccaaugccucggcgcugccagaggucuggaggcaacugccagcccgggguuacugaagccuaaaaauggcuccggagagcucucuuauggcgaaguaauggggccccuugagaagccaggagguaggcacaaaugucgguucugcgcuaagguuuuuggcucggauagcgcgcugcagauucauuugcgcucccacacaggggaacgacccuacaaguguaacgugugcggaaauagauucaccacuaggggcaaccuaaaaguccauuuucaccggcaucgugagaaguauccucacgugcagaugaauccacaccccgugccugaacaucuggacuacgucaucacaucaaguggucucccguaugggaugucuguuccacccgagaaagcagaggaagaggccgcuaccccuggcggaggcguggaacgcaagccacugguagccagcacgaccgcacuuuccgccacagagucacugacuuugcucagcaccucugcugggacagccacugcacccggacugccugcguucaacaaauuuguguuaaugaaggcugucgaaccgaaaaauaaggccgaugagaacacucccccagguuccgagggcagugcaauuagcgggguggccgaaucuuccacagcuaccagaaugcagcugucaaagcuaguuaccagucucccuagcugggcccugcuuacgaaccacuucaaaucgacaggauccuuccccuuuccauacguguuggagccucugggcgcaucucccagcgaaaccucaaagcuccaacagcuggucgagaaaaucgacaggcagggugcuguggccguaaccagugcggccuccggggcuccaacuacaucugcaccggccccuagcuccucagcuagcaguggccccaaucaguguguuauaugccuucgggugcugucuugcccacgagccuugcgccuccauuauggacaacacggcggggagagacccuucaaguguaaagucugcggaagggcauuuuccacccggggcaaccugcgcgcgcacuucgugggucauaaggccagcccugcugccagagcacaaaauucguguccaauuugccagaagaaauuuacuaacgcugucacauuacagcaacacgugaggaugcaucuugggggacagauccccaauggcgguacggcccuaccugaaggcgggggagcagcccaggagaacggcucagaacaaucuaccguuaguggggcucguuccuucccgcagcagcagagccaacagccaucucccgaggaggaacucagcgaggaagaggaagaggaagaugaggaggaagaggaagacgugacugacgaggauucccuggcgggacggggcucagaaagugguggggagaaggccauuagcguacgaggagacucugaggaagcauccggcgcugaggaagaggucgguacaguggccgccgcugcaaccgccggcaaagagauggauucaaaugaaaagacaacucagcagaguagccuuccucccccaccucccccagacuccuuggaucaaccucagccgauggagcaggggucuucgggaguucugggcgggaaagaagagggaggcaagcccgaaagaagcucauccccagcgagugcucucaccccugagggugaggccacgucugugacccuggucgaagaguuaagccugcaggaagcaaugaggaaggagcccggggaauccucaucucgcaaagccugugaggugugcggacaggcuuuuccaagccaggcagcccuugaggaacaccagaagacacauccuaaagagggccccuuguucacuuguguauuuugccggcaagguuuccucgaaagagcgacccugaagaaacacaugcuacuggcucaccaucaggugcagccguuugccccacacggcccucagaacaucgcagcccucagucugguucccggguguuccccaagcaucacaucuacuggacuuucacccuucccuaggaaggacgauccgaccauucccuga

SEQ ID NO: 62146 - RNA, 3903 nt, Artificial Sequence
  derived and/or modified sequence opt3 from SALL3__Homo_sapiens__NP_741996
augagcagaaggaagcaggccaaaccccaacaccugaaguccgacgaggaacuccuuccuccagauggcgcuccggagcaugcagcccccggggaaggagcggaggacgcugauucugguccugaaucacggaguggcggggaggagaccagcgugugcgaaaaauguugcgccgaguucuuuaagugggcagacuuccuggaacaccagcgcuccuguacaaaauugccacccgucuuaaucguucaugaggaugccccugcuccacccccugaggacuuuccagaaccgucucccgcaucgucaccuagcgagcgagccgaaagugaggcugccgaagaggcgggagcagagggcgccgaaggugaggcucguccaguggaaaaggaggccgaacccauggaugcagagccugcuggggacacuagagccccaaggcccccgccugcggcccccgcaccaccuacgcccgcuuacggagccccauccaccaacguaacacuggaggcucuacucucuacuaagguggccgucgcacaguucagccagggcgcccgggcugcgggcggguccggagccgguggcgggguggcagcugccgcaguuccccugauucuugaacaacugauggccuugcagcagcagcaaauacaccagcuccagcugaucgagcagauucgcucacaaguggcucugaugcagagaccuccaccgaggcccagucucagcccugccgcagcgccaucugcucccggaccugccccaucccaguuacccggccuggcagcccuuccguugucagcuggugccccugcagcugccaucgcggggagcggaccagccgcucccgcagccuuugaaggcgcucaaccucugagucggcccgagucuggcgccuccaccccagggggaccugcagaacccagcgcgccagccgcuccgucggccgcuccugcacccgccgcaccagcccccgcuccugcgccacagucugccgcauccucacagccccagagugcuagcacaccuccggcccuagccccagguucccuccugggcgcugcacccgggcuuccuucuccacuguugccccaaaccagcgccucaggagucauuuucccuaauccgcucgugaguaucgcggcuacugccaacgcacuggaucccuuauccgcccugaugaaacaucgcaagggcaaaccaccuaauguaagcguuuuugagcccaaggcuucugcagaggacccauucuuuaaacacaagugccgauucugugccaagguguuugguucagauagugcgcuccagauacaccuuagaagccauacaggggaaaggccuuucaaaugcaacaucuguggcaaucgguuuuccaccaagggaaaccugaaaguccacuuccagcgucauaaggagaaauauccccacauucagaugaauccauacccggugccugaauauuuggacaacgugcccacgugcucuggcaucccauacgggaugucgcuacccccugagaagccagucacuaccuggcuggauagcaaacccguucucccuacagugccgacuuccguaggacugcaacuuccacccaccgugccuggugcucacggcuaugccgacucacccagugcaacaccagccucucgcagcccucagagacccuccccagcuucaagcgagugugccucucuguccccuggguugaaucaugucgaaaguggagugagcgcaaccgcugagucuccgcagucccuccugggcggucccccauuaacgaaggccgaaccuguuucacugcccugcacuaacgcgagggccggggacgcaccagugggcgcucaggccagugcugcaccuacaagcgucgauggagcccccaccucgcuaggcuccccggggcucccagccgugucugagcaauucaaggcucaguuuccuuucggaggucugcuugacagcaugcagacuucagaaacaaguaaauugcagcaacugguagagaauauugauaagaaaaugaccgaccccaaccaguguguuaucugccaccgggugcucuccugccagucugcgcugaagaugcauuaccgaacgcacaccggcgagcgcccauuuaaauguaagauaugcgggagagcauucacaacuaagggaaaucuuaaaacccauuuuggcguccacagggccaagcccccucugcgggugcaacacagcuguccgauuugccagaaaaaguucacaaacgcugucguguugcagcagcauauccgcaugcacaugggugggcaaauucccaauacuccacucccugaaggcuuucaggaugccauggacuccgagcuggcauaugaugacaaaaacgccgaaaccuuaucaagcuacgaugacgauauggacgagaacaguauggaagacgaugcugagcugaaggacgcggccacagaucccgcaaagccucuacucucuuacgcuggauccuguccacccagcccuccaucgguuaucucaucuaucgccgcacuggagaaucagaugaaaaugauugacagugugauguccugccagcaacuuaccggccucaagagcguagaaaacgggucuggagagagcgauagacuguccaaugacucaaguagcgccgucggcgaucucgaaucuagguccgcugguucacccgcccugagugagagcuccucuucgcaggcguuaagcccggcaccuucaaacggggaauccuuccguaguaaaucuccaggacugggcgcccccgaggagccucaggaaauaccacuuaagacugagcggcccgacagcccggcugccgcuccugguuccggcggggcacccggacgagccggcaucaaagaagaggcuccauuuucauuguuguuccugucuagagagagggggaaguguccuagcacggugugcggaguuuguggcaagcccuuugccugcaaaagugcacuagaaauucauuaucgcucccacacaaaggagcggccauucgugugugcgcugugcagaagggguugcagcaccauggggaaucucaaacagcaucugcuuacucaccgcuugaaggaacugcccucucaauuauuugauccuaacuucgcccucggaccaucacaguccaccccgagucugaucagcucggcugcccccacaaugauaaaaauggaggucaauggccacgguaaggcaauggcucuuggcgaagggccuccacugcccgccggagugcagguaccugcaggcccacaaaccgugauggggcccggauuggccccuaugcucgcuccgccaccccgacggacuccuaaacagcauaacugucagucuugcggcaagacauucuccagcgcgucagcccugcagauucacgagcguacgcauaccggugagaagcccuuuggguguacuaucugcgggagagcauucacaaccaaaggcaaucuaaagguucacauggguacacacauguggaacaaugcuccagccaggcgcggccggagacugagugucgaaaacccuauggcccuccugggaggagacgcacuuaaauuuucugagauguuccaaaaggauuuggcugccagggcgaugaauguggaccccuccuuuuggaaccaguacgcugccgcaaucacuaauggccuggccaugaaaaacaacgaaauuagcgugauccagaaugggggcauuccacaguuaccggucucacucggagguagugcucugccuccccuugggagcauggcauccggaauggauaaggcccgaaccggcucuagcccacccauaguuucccuggacaaggcgucaucugagacggcugccagucgcccuuucacccgguuuaucgaagacaacaaagagauuggcaucaauuga

SEQ ID NO: 62147 - RNA, 3162 nt, Artificial Sequence
  derived and/or modified sequence opt3 from SALL4__Homo_sapiens__NP_065169
augagcagaaggaagcaggccaaaccccaacacaucaacuccgaggaagaccagggcgagcagcagccucaacagcagaccccagaguucgcugaugcagccccggcggcucccgccgcaggggaacugggagccccugugaaucauccagguaacgacgaagucgcuucugaggaugaggcaacaguuaagcggcuccgccgagaagagacucacgugugcgaaaaauguugcgccgaguuuuucucaauuagugaguuucuugaacauaagaaaaauuguacgaagaaucccccuguacugauaaugaacgacagcgagggcccagugcccuccgaagauuucucuggggcugucuugucgcaccagccuaccucaccaggaagcaaggacugccaucgugagaacggcgguaguuccgaagauaugaaagagaagccggacgccgagucugugguuuacuuaaaaacagaaacugcgcugcccccuaccccacaagauaucagcuaucuagcaaaggggaaaguggccaauacaaacgucacccuccaggcucugagaggaacuaagguggccguaaaucagagguccgcagacgcucuccccgccccuguuccaggcgcgaacucaauucccugggugcuggagcagaucuugugucuccaacagcagcaacugcagcagauucagcugacagaacaaauccggauacaggucaauaugugggccagucacgcacuccacagcucuggcgcuggggccgauaccuuaaagacgcugggaucccauaugucacaacaggugagcgcugccguggcacuuuugagucagaaagccgguucucagggccugucccuagacgcucucaagcaggcgaaacugccgcacgcaaacaucccuagcgccacuucgucucuuucccccgggcuggcuccauuuaccuugaagccugauggaacacgcguccuccccaauguuaugucaagacugccaagugccuuacugccccaggcaccuggcagcgugcuuuuccaauccccauuuucuacuguagcccuugacaccagcaaaaaggguaaagggaagccgcccaacauuucagcuguggacgucaagccuaaagaugaggccgcacuguacaagcauaaaugcaaguauuguaguaaaguguucggaacagacuccagcuugcagauccaccuaaggucucacaccggcgaacggccauuuguuugcucaguguguggccaucgcuucacgacuaaggggaaucugaagguccacuuucaucgacacccccaggugaaagcgaacccucaacucuucgcugaguuucaggauaagguagccgcaggaaacgguauuccauacgcccugaguguucccgacccgaucgaugagccuagccuuucccuggacucuaaaccaguguuggucacaaccucggugggccucccccagaaucugagcuccgggacuaacccuaaggauuuaacaggaggcucacugcccggugaccuacagccagggccuagucccgaaucugagggcggaccaacccucccgggcgucgggccuaauuauaacagccccagagcuggagguuuccaaggcuccgggacgccagaacccggaucagagacccugaaacuucagcaguugguggaaaauauagauaaggccacaacugacccuaacgagugccugauuugucauaggguucucagcugccagucuucccugaagaugcacuaccggacccacacaggcgagcguccauuccaaugcaaaaucuguggucgcgcauuuaguacuaaggggaaucuuaaaacccaucugggcgugcacagaacaaacaccagcauuaagacucagcauucuugccccaucugucagaaaaaguucacgaaugcuguaauguugcagcaacacaucaggaugcacaugggaggccagauuccuaacacaccgcucccagaaaaucccugcgauuuuaccggguccgagccuaugacugucggagaaaacgguucaaccggcgccauaugucaugacgacgugaucgagaguauugauguugaggaagugagcucgcaggaggcgccauccucuagcucaaagguccccacaccucugccgaguauccacuccgccucucccaccuuaggguucgcuaugauggcaagccuggacgccccaggaaaagugggcccugcucccuuuaaucuacagcggcaagguucccgagaaaacgggucaguagagagcgauggccucacuaaugacaguucuucccugaugggagaucaggaauaucagagccgcucgccagacauacuugagacaacgucauuccaagccuugucuccugcaaacagucaggcggaguccauuaagagcaaaucucccgaugccggcagcaaggcugaauccucagagaacaguagaaccgaaauggaggggaggagcucucugccauccacuuuuauccgggccccgccuacauacgugaaaguugaaguccccggaaccuucgugggcccaucaacacucagucccgguaugacuccucuguuagcagcucagccacgcagacaggccaagcaacaugggugcaccagguguggcaaaaauuuuagcuccgcaucugcccugcagauccacgagcguacgcauaccggagagaagcccuucgugugcaacauuuguggucgggcuuuuacaacuaagggcaaucuuaaaguccacuacaugacccacggggcgaacaauaacucggcccgaagaggaaggaaguuggcaaucgaaaauacaauggcucuccugggcacugacgggaaacgcguuagcgagauuuucccuaaggaaauacuagccccgucagugaacguggauccaguagucuggaaucaguauaccuccaugcugaacggaggccucgccgugaaaacgaaugagaucaguguuauucagucugguggggugcccacacugccugucagccuuggagcuaccuccgugguuaacaaugcaacugugucaaagauggacggcucucaaagcgguaucagugccgauguagaaaagcccuccgcgacagacggcgucccaaaacaucaguuuccucacuucuuggaggagaacaagaucgcugugagcuga

SEQ ID NO: 62148 - RNA, 1338 nt, Artificial Sequence
  derived and/or modified sequence opt3 from SAMD14__Homo_sapiens__NP_777580
auggccagcuccaagcugagagagcccguggacgaagucuucgaucucgaccuugcuguuccugagaccgcaaggcuggauucuucauugcacaaagcccgggcgcaguuacuggcuaagggccgccgacaucguccaaguagaagcaggcuacgggacuccgccucuucggcagaagauggggagggaucagacgguccgggcgggaaagugacagauggaugcggcagcccccuccaccgccugagaaguccucuucauuccgguccagggucucccgccggaggcagcuuuugucuggacccuccaggcuugaggcggucccucgaugaagacgagcccccuccaucaccgcugacucgcuaccgaccccugcacaacgcugcaagucaugaggggcucgccgcugccagcugcucuccuccaagauccgcgcccucaagcgauaguucuccuuccuucguaaggcggcacccacgugcagaaccccacagcgaggacgauucgcgcgacgccucuccgccugaacccgcuuccccaacgaucggauuagacaagaaaaccagaaggaaguuucuggaucuuggugugacauugcggcgagccucaacuggcaagagucgcaaagagaaggggagcaauagacuguccaugggaucuagggagagcgucgaaggcucaggucggagugggggauccccuuuccuacccuuuagcugguucaccgacucuggcaaaggcucagcaaguagcggguccacaaccucuccaacuuguucgcccaagcaugagggauuuagcccuaaaaaguccgcuucacaagcccagcuccuggcgcacgcccaggaagcacuuaguaacucuuggugccuggugcaggauuucgguagcacacaaauuggcauggaguccaccuugucagacgauagcacgccaccgucuuccagucccaagauaccuagcgggccauggcaggaagcuaaauguucuuaucccuaccauacucucucccagucaagugacgaguuucuggaugagccuuuaccacccguucaccacuggaccagccagcaagugggacaguggcugcagucgcucaaucuugaacaguaugccgcugaguucgccgcacgccaagucgacggcccgcagcuguugcagcuagaugguuccaagcugaaaucucucgggcugagcaacucacaugacagagcccuugugaagaggaaacugaaggaaauggcugcggcagccgagaaagaacguaaggcucaagagaaggccgcacggcagcgagagaaauugagaaggcgcgaacaggaggccaagaaaaguuga

SEQ ID NO: 62149 - RNA, 1617 nt, Artificial Sequence
  derived and/or modified sequence opt3 from SAMD1__Homo_sapiens__NP_612361
auggccggcccuccugcucugccaccgcccgagaccgcagccgcggcuacaacugccgcagccgcuagcuccucugcagccucaccucacuaccaggaauggauccucgacacgauugauagucuuagaagcaggaaggcucggccagaccuggagcgcauaugccgaauggugcguagaaggcaugggcccgaaccugagcggacccgcgccgaauuggagaaauuaauccaacagagagcgguccugaggguuuccuauaagggaucuauuucguaccggaacgcagcccgcgugcagccaccccgaagaggugcuacaccuccagccccgcccagggcaccucggggcgcuccagccgcggccgcagcugccgcucccccuccaacucccgccccgccucccccacccgcacccguagccgcugcggcaccagcccgugcuccccgcgccgcagccgcugccgcaaccgcgccuccaucaccggggcccgcucagccuggaccaagagcccaaagggcagcuccccuagccgccccuccacccgcaccggcugccccuccagcgguggcucccccugccggcccccggcgagcaccaccucccgccgucgcugcccgcgagccaccgcucccucccccaccccagccuccagcacccccucagcagcaacagccgccacccccucagccacagcccccuccggaagguggggcggugagagccggaggcgcugccaggcccguuagccugcgggaggugguccgcuaucuuggcgggaguggaggugcaggcgggagacugacaaggggacgugugcaaggcuugcucgaagaggaggcugccgcacggggucgacuggaaagaaccaggcugggggcccucgcuuuaccacgcggagaucggccuggcagagcgcccccagccgcauccgcuaggccuucucgcagcaaacgaggcggggaggaacggguacuggagaaggaagaggaggaagacgaugacgaggaugaagacgaggaagaugacguuuccgagggaucagaggugcccgaaagugaucguccagccggugcccagcaccaucagcuuaauggcgagagagggccgcaaagcgcuaaagaaagggucaaggaguggacuccuuguggaccccaccagggccaggacgaaggucgcgggccagcacccggcucuggaacaagacagguguucuccauggccgcgaugaacaaggagggcgggaccgcuucaguggccacgggaccugauagcccaagucccgucccuuugccgccagguaaacccgcacugccuggcgccgacgggacucccuuuggaugcccaccuggccggaaggagaaacccucugacccaguugaauggaccgugauggauguaguggaguacuucacagaagcugguuuuccugagcaagcaacugccuuccaggagcaggaaaucgacgggaagucccuacuccugaugcagaggaccgauguccuuacaggccugagcauucgauugggaccggcgcucaaaaucuaugagcaucacauaaaggugcugcaacagggccacuuugaagacgaugaccccgauggguucuuaggauga

SEQ ID NO: 62150 - RNA, 1893 nt, Artificial Sequence
  derived and/or modified sequence opt3 from SAMD4A__Homo_sapiens__NP_001155048
augauguucagagaccaggugggcguccuggccgggugguuuaagggauggaacgagugcgaacaaaccguugcucuccuuagccuguugaaaagggugucccagacacaggcacgguucuuacagcugugucuagagcacucucucgccgauugcgcggaacugcauguacuugagcgcgaagcuaauucacccgguaucauuaaccaauggcagcaggagaguaaggacaaagugauaagccuguugcucacucaucugccucugcucaagccaggcaauuuagaugccaaagucgaguacaugaagcugcuuccgaagaucuuggcacacuccauugaacacaaccagcauaucgaggaaucucgacaacugcuaucguaugcccucauucaccccgcuacgucacuggaggaccguagcgcacuugccauguggcugaaucacuuggaggauagaaccaguacauccuuugggggacagaacaggggccggucugacagcguggauuacggucagacucauuauuaccaccagcgccaaaauuccgacgauaaacucaacggguggcaaaauucaagagacaguggaaucuguauaaacgcuagcaauuggcaggauaagucuaugggcugcgaaaacggccauguuccucuguauuccucaagcagugugccaaccacaaucaauaccauugggacuucuacauccaccaacguccccgccugguuaaaaagccugaggcuccacaaguacgcggcacuuuucucgcagaugacguaugaggaaaugauggcccugacugagugucaguuggaagcucagaaugugaccaaaggagcccggcacaagaucguaauuucuauccagaagcuaaaagagcgccaaaaccugcucaagucccuggagcgagacauaauugaagguggcucacuuagaaucccucugcaggaguugcaucagaugauucucacaccaaucaaagcauacaguagccccuccacuaccccugaagcuaggcggcgugagccacaggccccgcgccaacccucucugauggggccugaaagccagucaccagauugcaaggacggagcggccgcaacaggcgcuaccgccacgcccagugcuggugccuccgggggauuacagccucaccagcugagcucuugugacggcgagcuagcaguugccccacuccccgagggcgaucugccggggcaauuuacuagagugaugggaaaagucugcacacagcuuuuggugucaaggccugacgaagagaacaucaguagcuaccugcagcucauugauaagugucugauacaugaggcuuucaccgaaacucagaaaaagcggcuucuguccuggaagcaacaggugcagaaauuguuucgaucuuucccccgcaagacacuccuggacaucucggguuauagacaacagaggaaucggggcuuugggcagagcaacuccuuaccaaccgcgggaucagucggcggugggaugggccgcagaaauccuaggcaguaccaaauucccagucguaacguuccaucugcacggcugggacuacucggcacgagcggguucguguccucaaaucagcgaaacaccacagccacucccaccaucaugaaacagggaagacagaaucugugguuugcuaacccugguggcagcaauucuaugccauccaggacacacaguagcguacaacgcacucggucucuuccggugcauaccucaccccagaacauguugauguuccagcagccugaauuucaacugccagucacagagcccgauauaaauaacagacucgagucccugugcuuaaguaugaccgaacacgcccugggggacggaguggauaggacuagcacgauuuga

SEQ ID NO: 62151 - RNA, 522 nt, Artificial Sequence
  derived and/or modified sequence opt3 from SAMD5__Homo_sapiens__NP_001025231
augugcaccaacaucguguacgaguggcugaaggcccuccagcuuccccaauaugcugagagcuucgucgacaauggcuacgaugaccuggaaguuuguaaacagauuggggauccugacuuggaugcaauaggaguguuagccccagcgcacagaaggcggauccuggaagcuguacgccgacuacgugagcaggacgccaacgcagccggucucuauuuuacacuggaaccgcagcccgcuccuccagggcccccugcagaugccgugccaacuggcagaaggggagagcccugcggcgguccugcucaagggacgcggggagacucccgcggccauaccacagccccaagaucuagggagcuugucucauacccgaagcugaaauugaagauuaugauccgggauaaacucgugcgcgacggcauucaccugaguaagcccccuuauagccgaaagguuccaauggcggggauccuggaauaccucaugaauuggcccaaauccucucagucgagauga

SEQ ID NO: 62152 - RNA, 4770 nt, Artificial Sequence
  derived and/or modified sequence opt3 from SAMD9__Homo_sapiens__NP_060124
auggccaagcagcugaaccuccccgagaauaccgacgauuggacaaaagaagacgugaaccaauggcuugagagccacaagaucgaucagaaacauagagaaauucugacugagcaggacgucaauggcgcuguuuugaaguggcugaaaaaggaacaccugguggauauggggauaacgcauggaccugcaauccagauugaggagcuauucaaggaacucaggaaaaccgccaucgaggacuccauucaaacaucuaagauggguaaaccaucaaagaacgcgccgaaagaucagacuguaagucagaaggaacggcgcgagaccagcaagcagaaacaaaagggcaaagagaaucccgacauggcuaacccuuccgccaugucuacaaccgcaaaggggucgaaaucacugaagguggaacuuaucgaggauaaaauagacuacacuaaggaacgacagccaagcaucgaucugacaugcgucaguuaucccuuugacgaguucuccaauccuuaccguuauaaguuggauuuuucucuccagccagaaaccggacccggcaaccugauugacccuauccacgaguucaaagccuuuacgaauacugcuaccgcaacagaggaagacgugaagaugaaauucagcaacgagguuuuuagauucgccuccgcuuguaugaacucaaggacuaaugguaccauucauuuuggggugaaggauaaaccacacggaaagaucgucggcauaaaggugacaaaugacaccaaagaagcccugauuaaccacuucaaucucaugaucaacaaguacuuugaggaucaucagguacaacaggcgaaaaagugcauucgggaaccgcgcuucguugagguguuacugcccaacaguacgcuuagcgacagauuugucaucgagguggauaucauuccucaguucucugaaugucaauaugacuacuuccagauaaaaaugcagaauuauaacaauaagaucugggagcaguccaagaaauuuucauuguucgugagggauggcacuagcaguaaggacauuaccaaaaacaaggucgauuuucgggcauucaaagccgacuuuaagacacuggcugaaucucgcaaggccgcagaggaaaaauuccgagcuaagacuaauaaaaaggagagagaggggccaaagcuaguuaaacuccugacaggaaaccaagaucuucuggacaauuccuacuacgaacaguauaucuuggugaccaacaaaugccaccccgaccagacgaagcaucucgauuuucugaaggagauaaaaugguucgccguauuagaauuugacccugagagcaauauuaacgguguggucaaggcguacaaagagucgaggguggccaaucugcacuucccaucuguuuauguggaacagaagaccacacccaacgagacuaucuccacccucaaucuuuaccaccaaccgucauggaucuuuuguaacggccggcuggauuuggacagugaaaaauauaagccuuucgaucccagcuccuggcagcgugagcgcgcaucugacgucagaaagcuaauuagcuuucugacacaugaagauaucaugccaagggggaaauuccucgugguauuccugcuucugucaaguguugacgauccucgggaccccuugauugagacuuuuugcgcuuucuaccaggaucucaagggaauggagaauauacuguguaucugcgugcacccacauauuuuucagggcuggaaagacuuacuggaagcccgacuaaucaagcaccaagaugagaucuccagccaguguauuucugcucucucacuggaagagauaaacgguaccauccuuaaauugaagagugucacacagagcuccaagcgccugcuccccucuauugggcugucgaccgugcuucugaaaaaggaagaggacaucaugacugccuuggagauuaucugcgaaaacgagugugaaggaacgcuccuggagaaagacaagaauaaauucuuagaauuuaaggcaagcaaggaggaggauuucuauagaggcggcaaagucuccugguggaacuuuuacuucucaagugaaucuuacagcuccccuuuugugaagagggacaaauaugagcggcuggaagccaugauacagaauugcgcugauucaagcaagccaacaucuaccaaaaucauucaucuauaccaccacccggggugcggagguacuacccucgcgaugcauauccugugggagcuucgcaagaaauucagaugugcaguuuugaagaacaagacaguggacuuuuccgagauuggcgaacaaguaaccagucugaucacuuauggggccaugaauaggcaggaguacguccccgugcuccuguuaguugaugacuucgaggaacaggauaacguguaucugcuucaauacagcauacagacagcuauugccaaaaaguauauccguuacgaaaaaccuuuggucauuauccucaauugcaugcggucucagaacccagagaaguccgcacgaauacccgacucaaucgccgugauucagcaacugaguccuaaagagcagagagcuuuugaacuaaagcugaaggagaucaaagaacagcacaagaauuucgaggauuucuacagcuuuaugauuaugaaaacgaacuucaauaaggaauauaucgagaacguagugaggaauauacucaaaggacagaacauuuuuaccaaggaggccaagcuguucucguuucuugcauuguuaaauuccuacguuccagacacuacaaucucuuuaagccaaugugaaaaauuccucggcaucgguaacaagaaagcguuuugggggaccgagaaguucgaagauaaaaugggcacauauucaacuauucugaucaagaccgaggucauugaaugcggaaacuacuguggcgugcgcauaauccauagucuuauugcugaguuuucccuggaggaauugaagaaaucuuaucaccucaauaagagccagaucaugcuggacaugcuaacggagaaccuguucuuugauaccgggaugggaaaauccaaguuccuccaggacaugcacacacugcuuuugacucggcauagagacgaacacgagggugagaccggcaauugguucucacccuuuauugaagcccugcauaaagaugaggggaacgaagcaguggaggccgucuuacucgaaagcauccacagguucaauccgaacgcuuuuauaugccaggcccuggcacgccauuucuacaucaagaagaaagacuuuggaaaugcucuuaacugggccaagcaagcgaaaauuaucgagccugauaauaguuauauuucugacacacugggccagguuuacaaguccaaaauccgaugguggauagaggaaaacggugggaauggcaacauuagcguggaugaccuaaucgcccuccuggauuuggcugagcacgcaucgucagccuucaaggaaucucagcaacagagugaggaccgggaauacgaggugaaagagcgucuguauccaaaguccaagagaagguacgauacuuauaauaucgcuggauaccagggcgaaauugagguaggguuauauaccauacagauccuccaacugauucccuuuuucgacaacaaaaaugaacuuagcaagcgcuacauggucaacuuugugucuggaagcuccgauaucccuggugaccccaacaaugaguauaaacuggccuugaagaacuacauuccauaccucacgaaacugaaguucucacuaaagaaaaguuuugacuucuuugaugaauauuucguucugcuuaagccucggaauaacaucaaacagaaugaggaggcaaagacaagaaggaaaguggcgggcuacuucaagaaguaugucgacauauuuugucuccuggaagagagccagaacaauaccggguugggaucuaaauucuccgaacccuuacagguggagcgaugccgccggaaccugguugcccucaaggcugauaaauuuucaggccugcuugaguaccugaucaagagucaagaagacgccauuagcacuaugaaauguaucgugaaugaguauacauucuugcucgaacagugcaccguaaagauucaguccaaggagaaacugaacuuuauccuagcaaauauaauucugucuuguauccagccaacuucgagacuugucaagccgguggaaaaacucaaggaucaacugagggagguguugcagccuaucgguuuaaccuaccaguucagcgagcccuauuuucuggcuucacuccuguucuggccagaaaaccagcaacuugaccagcacuccgagcagaugaaagaauacgcccaagcacugaagaauaguuuuaaagggcaguacaagcauaugcaccguacaaagcagcccauugccuauuucuuuuugggcaaaggaaagcgccuagagcggcugguccauaaaggcaagaucgaucagugcuucaaaaagacgccugacauaaacucucucuggcaaagcggggauguuuggaaggaagagaaagugcaggagcugcuuuuaagacugcagggaagggcugaaaauaacugccucuacauugaguauggcaucaaugaaaagauuaccaucccaauaacucccgcguuuuugggucagcugcgauccgggcggucaauugagaaaguaucuuucuaccucggauucagcaucggcgguccucuggccuaugacaucgaaauuguguga

SEQ ID NO: 62153 - RNA, 4755 nt, Artificial Sequence
  derived and/or modified sequence opt3 from SAMD9L__Homo_sapiens__NP_001290426
augagcaaacaggugucccugcccgagaugaucaaagacuggaccaaggaacacgucaaaaaguggguuaacgaggaucucaaaauuaaugaacaauacggccagauacuucugucugaggaagugacaggguugguauuacaggagcugacugagaaggaccuaguggaaaugggacucccuugggguccagcccugcuuaucaagagaucauauaacaaacugaauaguaagagcccggaguccgauaaccaugaccccggccaguuggauaauucuaaaccuucgaagacggaacaccagaaaaacccaaagcauaccaagaaagaggaggaaaauucaaugagcaguaacauugacuacgaucccagggagauccgggacauuaagcaggaagaguccauccucaugaaagaaaauguccuggaugagguggcuaacgcaaagcacaaaaagaaagggaagcugaagccugagcagcucacaugcaugccauaucccuucgaccaguuucaugauucucaccgcuacauagaacacuauacuuuacaaccugagaccggagcccugaaucuuaucgacccaauucaugaguucaaagcguugacaaacaccgaaacugcuacagaaguugauaucaagaugaaauuuagcaaugagguguuccgauuugccuccgcauguaugaacucacguaccaauggcacgauucacuucggugucaaggacaaaccgcauggggagaucgugggaguaaagauaaccaguaaggccgcuuuuauugaccacuucaacguuaugaucaaaaaguacuuugaagagagcgaaauuaacgaggcaaagaagugcaucagagaacccagguucguggagguccugcuacagaauaacacuccuucugaucgguuugugaucgagguggacacaauuccaaaacacuccauauguaaugauaaguauuucuacauccagaugcagauuugcaaggacaaaaucuggaagcaaaaccagaaucucucacuguuuguccgcgaaggcgccagcaguagagauauacuugcuaacucuaaacagagggacguugauuucaaggccuuccugcaaaauuugaaaucccucguggcgagccggaaggaggcagaagaggaguacggcaugaaggccaugaaaaaggaaucggaggggcugaaauuaguaaagcugcucauuggaaaccgcgacucucuugauaauuccuauuacgacugguauauccuggugacuaacaaaugucaucccaaucagaucaagcacuuggauuuucuaaaagaaauuaagugguucgcuguccuggaguuugacccugaaucaaugaucaacggugugguuaaggccuacaaagagagucgaguggcaaaucuccauuucccaaaccaguaugaggacaagaccacaaauaugugggaaaagauuagcacccugaaccuuuaccagcaacccuccuggauauuuugcaacggcagaucugaucuuaagagcgagacguauaaaccguuggaaccucaccucuggcagagggagcgggcuucagaaguccguaagcugaucuuauuccugacugacgagaauauuaugacacgcgggaaguuucuagugguauuccuccugcuuaguuccguugagagccccggagauccauugaucgaaaccuuuugggccuucuaccaggcgcugaaaggcauggagaacaugcucuguaucucugucaauucacauauuuaccagagauggaaggaccugcuucaaacuaggaugaaaauggaagaugagcugacaaaccacaguauaagcaccuugaauaucgaacucgugaacuccacgauucugaaguuaaaaucugugacccggucgagccgacgcuuucugccugccagagguuccucaagugucauccuagagaagaagaaagaggacgugcucacagcacuggaaauucuuugcgagaaugaauguacugagaccgauaucgagaaggacaaaucuaaguucuuggaauuuaaaaagagcaaggaggaacacuucuaucggggagggaaaguuuccugguggaacuucuacuuuucaagcgagaauuauucuuccgauuucgugaagagggacaguuacgaaaaacugaaggaucucauacauugcugggcugagagccccaaaccaaucuuugccaagauuaucaaccuguaucaccaucccggcuguggcgggacaacuuuagcuaugcacguacugugggaccuuaaaaagaauuuccgcugcgccgucuugaagaacaaaaccacagauuuugcagagauugccgaacaggugaucaaucucguuaccuacagagcuaagucucaccaggacuauauaccugugcugcuacuggucgacgauuucgaggaacaggagaacguguacuuucuccaaaaugcgauucauuccguacuggcagaaaaagaccuuagguacgagaagacuuuggugaucauucugaacugcaugcguucacggaacccagaugagagugccaaauuagcugacagcaucgcccucaauuaucagcugucguccaaggaacagcgagcauucggagccaagcugaaagagauagaaaagcagcacaaaaacugugagaauuuuuacucuuucaugaucaugaaaagcaacuuugaugaaacguauauugagaauguugucagaaacauccugaaaggucaagacguggauucaaaggaggcucaguugauuaguuuccucgcccugcuauccucuuacgugacagacagcaccaucuccgucucacagugcgaaauauuucugggcauuaucuauacuagcaccccgugggagcccgaaagucucgaggauaagauggggacauacucuacccugcuuaucaaaacugagguugcagaauauggaagguacacaggcgugcgcauuauccauccuuugauugcgcuguacuguuuaaaggagcucgaacgguccuaucaccuggacaaaugccaaauagcucuuaauauccuggaggaaaaccuauucuacgauagcgguauugggagagacaaguuccagcaugaugugcagacgcuccuguugaccaggcagcgcaaaguauauggcgacgagacugacacacuguuuucgccauuaauggaggcccuccaaaauaaggauaucgaaaagguccugucagcaggaucucgacgguucccccagaacgccuuuauuugucaggcucuugcccgucacuucuacaucaaagagaaggacuuuaauaccgcacuggauugggcuagacaggccaaaaugaaggcgccuaaaaacaguuauauauccgacacauugggccaaguguacaagagcgaaaucaagugguggcucgaugggaauaaaaacugcaggucuauuacuguuaaugaccugacccaccuacuggaggccgcugaaaaggcaagccgcgccuucaaagagucccagcggcagacggauucaaagaacuaugagaccgaaaacuggaguccacagaaaagccaaagaagguacgacauguacaauacagcuuguuuucuuggagagaucgaagugggucucuauacuauucagauccugcaguugacccccuucuuucauaaggagaacgaacugucuaaaaagcacaugguccaauucuuauccggcaaguggacaauaccgccugauccacgaaaugagugcuaccucgcccugucaaaauuuaccagucaucuuaagaaccugcagagcgacuugaaacgcuguuucgauuucuuuauugacuauauggugcuccugaagaugcgguacacucagaaagagaucgcagaaaucaugcuauccaagaagguuucuagaugcuucaggaaauauacggagcuguuuugucaccuugaccccugccuccugcagucgaaggaaagccaauuguuacaggaggagaauugccguaaaaagcuggaagcgcuccgcgccgaucgguucgcugggcugcuugaguaccugaacccuaauuauaaagacgccacaaccauggaaucaauugugaacgaguacgcauuuuugcuacagcaaaauuccaagaagcccaugacuaacgaaaaacaaaauaguauacuggcuaacaucauucucucuugucugaagccaaauagcaaacuuauccagccuuuaacaacccugaagaaacagcucagagagguauugcaguucgucggacugucccaucaauaccccggcccauauuuucucgccugccugcuuuucuggccggagaaccaggaacuggaucaggacucaaaguugauugagaaguacgugucuagccuaaauaggaguuuucgaggucaguauaaacggaugugucgcuccaagcaagcaagcacucuguucuaccucgggaaaagaaagggcuuaaacucuaucgugcacaaagccaagauagaacaguauuuugauaaagcucagaauaccaacucacuguggcacuccggagacgucuggaagaagaacgagguuaaagaucuucugaggcggcucacaggccaagcggaagggaaguugaucaguguggaguacggaacggaggagaaaauuaagaucccuguaauuagcguguauucggguccccugcgaucuggcagaaauaucgaacgcgucuccuucuaccucggguuuagcauagaaggaccacuggccuacgacauugaggugaucuga

SEQ ID NO: 62154 - RNA, 1881 nt, Artificial Sequence
  derived and/or modified sequence opt3 from SAMHD1__Homo_sapiens__NP_056289
augcagagagccgacagcgagcaacccuccaagaggccucggugcgaugacucuccacgcaccccgucaaacacacccagugcugaagcagauuggagcccuggccuggagcuccacccagacuacaaaacuugggggcccgaacagguguguuccuuccuucgacguggagguuuugaggaaccuguccuguugaagaauaucagagagaacgagauuacgggcgccuuacugccaugccuagaugaaucuagguucgagaaucucgggguuucgucacugggagaacggaaaaagcugcuuagcuauauacagcgcuuggugcagauccauguagacaccaugaaagugauuaacgaucccauccacggccauauugagcuccacccucugcuggucagaaucauagacacaccacaauuucagaggcuccgguacaucaagcaguuaggugggggauauuacguguucccgggcgcgagucauaaucgcuuugagcacucccugggcguuggguaucuugcuggauguuuggugcacgcccugggugaaaagcagcccgagcuacaaauuucugaacgagauguccucugcgugcagaucgcaggccugugucaugaccuugggcacggaccuuucagccauauguuugauggcagauucauuccacuggccaggcccgagguaaaauggacucacgaacaggguuccguuaugauguuugagcacuugaucaacucaaaugggauaaagccugugauggagcaguacggacucauuccagaagaggacaucugcuucauuaaagaacaaaucgucggcccccuggagaguccgguggaagauagcuuauggccuuauaagggccggcccgagaacaaaucuuuucuguacgagaucguguccaauaagcguaacgggauugacgucgacaagugggauuacuucgcucgcgacugucaucaccucggaauacagaauaacuuugauuauaaaagauucaucaaguucgcaaggguuugcgaaguggacaaugagcuucggauuugugcccgagauaaagaaguagguaaccuguacgacauguuucauacccgcaauucauugcacagaagggcuuaucagcauaaggugggcaacaucauagauacaaugauuaccgacgccuuccuaaaagcggaugacuacaucgagaucacuggggcaggaggcaagaaauaucggauuagcacagccaucgaugacauggaggcuuacaccaagcugacggacaacauuuuucucgaaauacuguauaguacugauccaaaacuuaaggacgcccgcgagauccugaagcaaauugaauacagaaauuuguucaaauacgucggugagacccagccuacagggcagaucaagaucaaaagggaagauuaugagucucuccccaaggagguggcauccgcuaagccaaaaguucuguuagacgugaagcugaaagccgaagauuuuauugucgacgugauaaacauggauuacggcaugcaggagaagaaucccaucgaccacguuagcuucuauugcaaaacugcgccuaaccgugccauucggaucaccaagaaucaaguaucgcagcuacucccagaaaaguuugcagagcagcugauucgaguguacuguaaaaaggucgauagaaaaucucuuuaugcugccaggcaguacuucgugcaauggugcgcugaccgcaacuuuacaaagccgcaggauggagacgucaucgcccccuugauaaccccucagaaaaaggaauggaaugauuccacgucagugcagaacccaacucggcugagagaggcaaguaagagcaggguucaacucuucaaagacgaccccauguga

SEQ ID NO: 62155 - RNA, 1410 nt, Artificial Sequence
  derived and/or modified sequence opt3 from SAMM50__Homo_sapiens__NP_056195
augggcaccgugcacgccagaagccuggagccccucccuuccucugggccagacuucggaggucuuggcgaagaggcugaauuugucgagguugaaccggaggcaaagcaggagauccuggaaaacaaagaugugguagugcagcauguccacuucgacggguugggaaggacaaaggaugacauuauaaucugcgagauuggcgauguguuuaaagccaagaauuuaaucgaaguuaugcggaaaucacaugaggcgcgcgagaagcugcuacgacucgguauuuuccgucagguggacguccugaucgauacuugucagggggacgaugcccuucccaacggacuggacgugacguuugaaguaaccgaguugagaaggcucacaggcaguuacaauacuaugguuggcaacaaugaagggagcauggugcugggacugaagcucccuaacuuacugggucgggcugagaaagucaccuuccaguuuuccuauggcacaaaggaaaccucuuacgggcuuucguucuuuaaaccacgccccggaaauuucgagagaaacuuuucagugaauuuguauaaggugacuggccaauucccuuggagcagucugagggagacagaucgggguauguccgcagaauacucuuuuccaauauggaaaaccagccacacggucaagugggaggggguuuggcgcgaacuaggaugccucucccgaacugccucauucgcugugagaaaggagaguggccauagccugaaaucuucccuuucacacgcaaugguaaucgacagcaggaacaguucuauucugccccggcguggcgccuugcucaaggugaaucaggaacuggcuggguauaccggaggugaugucuccuucaucaaagaggacuuugaguuacagcugaacaagcagcucauuuucgacagcguguuuucggccucuuucuggggcgggaugcuuguuccuaucggagauaaaccauccucaauagcggaccgcuuuuaccugggcgguccgacaaguauuagaggguucagcaugcacuccaucggcccccaaucugaaggagauuauuugggcggggaggcauacugggccggaggucuacaucuguacacuccucucccauuuaggcccggccaagggggauucggcgaacuguuucggacccacuucuuucuuaaugcugguaaccuguguaauuugaacuauggggagggcccuaaggcccauauucgaaaacucgcagaaugcauccgcuggagcuacggagcuggcaucgugcugagauuagggaacauugccaggcuggagcuaaauuauugugucccaaugggagugcagacaggugaccggauaugcgauggcguacaguucggggcgggaauccgcuuucucuga

SEQ ID NO: 62156 - RNA, 1326 nt, Artificial Sequence
  derived and/or modified sequence opt3 from SAMSN1__Homo_sapiens__NP_001243299
auggagaucagacuggacacccucagcgccucccuuggcaggucuucaacacugaacaauugcaacuuggaagauaaguuagcuugguacgagggggaagcauauauguggcaccauuggaaacccuucccugagaauccacuguggacuugucuagacuuucagauugcccaagugggaccgugggaucacugcaguagcuguauacggcauacgcgccucaaguccucuugcucggacauggaucugcuucacucauggcgaagcaguuccuucgguaacuuugaccguuucagaaauaacucucugagcaaacccgaugacuccaccgaagcgcaugagggcgauccuacaaaugggucaggagagcagaguaagacuagcaacaauggcgguggguugggaaagaaaaugagggcuaucucuuggaccaugaagaaaaaggucggcaaaaaguacauuaaagcccucuccgaagagaaggacgaagaggauggcgagaacgcacacccauauagaaauucagaccccguuaucgggacacacaccgaaaaggugagccugaaagccagugauucuauggacucccuguacagcggacagucgucuuccucagguauuacaaguuguagcgacggcacuuccaaccgcgauucuuuuagacucgacgaugacgggccuuauagcggaccauucugcggcagggcucggguacauaccgauuuuacgcccucaccuuacgacacugauaguuuaaagaucaaaaagggugacauaaucgauauuaucuguaaaaccccaauggggauguggacaggaaugcugaauaacaaggugggcaauuucaaauuuauuuaugucgacgugaucuccgaggaagaggcagccccgaagaagauaaaagcuaaccgccgaagcaacucuaagaaaucaaagacucuucaggaguucuuggaacggauucaucugcaagaguacaccaguacacuacuccugaauggcuacgaaacccuugaggaucugaaagacaucaaggaaagccacuugauugagcucaacaucgaaaaucccgacgauaggcggcgucuguuauccgccgcggagaacuuucuggaggaagagaucauucaggaacaggagaaugaaccugagccacucucucuuucgagcgacauaucccugaacaagucacaguuggaugacugcccccgcgauaguggguguuauaucucuagcggaaauuccgacaacgguaaagaggaucuagaaucagagaaucugagcgacaugguucacaagauuaucauaacggaaccuucugauuga

SEQ ID NO: 62157 - RNA, 879 nt, Artificial Sequence
  derived and/or modified sequence opt3 from SAP30BP__Homo_sapiens__NP_001288768
auggccggcaagaaaaacgugcugagcucccucgcugucuacgcagaggacucugaacccgagucagauggggaagccggaaucgaggcgguugguagugcugccgaagagaagggcgggcuugugagcgacgcauauggagaggaugacuucuccagacugggcggugaugaagacggguacgaggaagaggaggaugaaaauucuaggcagucggacaacaccgaggccgaaaaacgggauccucaagaguugguagcuucauuuagcgaacgcgugcgaaauaugaguccagacgagauuaagauaccgcccgagccuccaggacguugcuccaaccacuuacaggauaaaauccagaagcuguaugaaagaaagauuaaagagggcauggacaugaauuacaucauucagaggaagaaagaguuccggaaccccucuaucuaugaaaagcuaauacaauuuugugcaaucgaugaacucggcacaaauuacccuaaagacauguucgacccacauggguggagcgaggauuccuauuacgaggcccuggcuaaggcccagaagauugaaauggacaaacuugagaaggcgaaaaaggaacgcacuaaaaucgaguuugucacgggaaccaagaaagguacaacuaccaacgcaacaucaaccacuacaaccacggccaguacugcuguggccgaugcacagaagagaaagagcaaaugggacucugcuauucccguuaccacaaucgcccagccuacuauacugaccacaaccgcgacguugccagccguggucacugugacaaccuccgcaucaggcagcaagacuacaguaauuagugcuguugggaccaucgugaaaaaggccaaacaauga

SEQ ID NO: 62158 - RNA, 429 nt, Artificial Sequence
  derived and/or modified sequence opt3 from SAP30L__Homo_sapiens__NP_001124534
augaacggcuucagcaccgaggaagacuccagagaggggcccccugccgcuccagcagccgcggcuccgggauacggucagucuugcugucugaucgaagauggcgagaggugcgugcggcccgccgggaaugcaucauuuaguaagcgcguccaaaagagcauuucccagaagaaacucaaacuugacauagauaaaucuguugaccuguuccaguuacaggugaacacauugcgacguuauaagagacacuacaagcugcaaacuaggccuggauuuaauaaagcccagcuagcugaaacgguaucgcggcauuuccgcaacaucccagugaaugagaaggagacccucgcauauuuuauuuacauggucaaaucaaacaagagcagacuggaucagaaaagugaaggcgguaagcagcuugaguga

SEQ ID NO: 62159 - RNA, 537 nt, Artificial Sequence
  derived and/or modified sequence opt3 from SAPCD1__Homo_sapiens__NP_001034740
augggcagccagggguccggaggugugccccugguccaagccccuuacaccguucuccuucugccauugggcacaucuagacaggacccgggggcucagucauucuuuuuauggcugaggcggaugcaggcacuagagcgcgaacaagaugcccucuggcagggacuggagcuucugcagcacggccaggcgugguucgaagaccauuugcgagaggcucaacgucagcagcuccaccugggugcccugggggaaaacuuucucacugauuuacauagugagcccggaagaccuccacuggcacagauccaaaaggugaauauuugccuucagaacuugauacacgagaaauucagccccuccccucugaauaaggccucuucguguacgacccaggacucaaaagaaaggcggcgcgagcaaaaccuauggcagcagcaggaacucagcagacaacagaagggcguaacacagccaaaagaggagauggcucagaggggcugcacuaaggggccccggggaccuacccgcguguga

SEQ ID NO: 62160 - RNA, 1185 nt, Artificial Sequence
  derived and/or modified sequence opt3 from SAPCD2__Homo_sapiens__NP_848543
auggccggcgcugcaauggccgagagagggagggugcccccuccagcgccggcucccagcaccgaaggacugccucgggccuuccuccagucccuucgcacacuguuugacaucuuggaugaccgacguagagguugcguccacuuaagggagauugaaucucgguggcagggcacugaugcacgcgagcugccaagagggguucuagaaggacucaggcaaguggcccccgcuucaggcuaccugacguucgagcgguuuguagcaggucuucgcaccagucuguugagcgccgacgggggaccucgagauccaacaagagcucccgccaggccuggcgaccagccaccgcccccuccacagcggcucguguucgcgcccgcagaugagccucguacuguccuggaacgcaagccacugccccucggcgugagagccccguuagcugggccuuccgccgcagcuaggucucccgagcagcugugugccccagcggaagccgcaccuugccccgcugagccagagcggucgcagucagccgcucuugaacccagcaguuccgccgacgcaggagccguugcuugucgagcguuggaggcagauucuggugacgcccgcagagcuccuagggcccggggcgaacgcagaaggcauaccauagcaagcgggguggauugcggacugcuaaaacagaugaaggagcucgaacaggagaaagagguccugcuucaaggccuggaaaugauggcccguggucgggacugguaucagcagcaguugcaacgagugcaggagagacagaggcgccucgggcaaucccgggcuucagccgauuuuggagcagcgggcaguccaagaccgcugggcagguuacugcccaagguacaggaaguugcucgcugucucggggagcuucuggccgcagccugcgcuagccgagccuugccuccaucuuccucaggacccccuuguccagcacuaacaagcaccagucccccgguguggcagcagcaaacuauccugaugcucaaagaacagaaccggcugcuuacacaggaggucaccgagaagucugaacguauuacgcagcuggagcaagaaaaguccgcuuugaucaaacaacucuucgaggccagagcgcugagccagcaggacgguggcccuuuagacucgacuuuuauuuga

SEQ ID NO: 62161 - RNA, 597 nt, Artificial Sequence
  derived and/or modified sequence opt3 from SAR1A__Homo_sapiens__NP_001136120
augagcuucaucuuugaguggauuuacaacggcuucuccucugugcugcaguuucucgggcuuuauaagaaaucaggaaagcuggucuucuuggguuuagacaaugccggcaaaaccacacugcuacacaugcucaaggaugacagacuggggcaacauguucccacucuucacccuacgagugaggaacugaccauagcuggaaugacauuuacuaccuucgauuugggcggucaugaacaggcaaggcggguguggaaaaacuaccucccagccaucaaugggauuguauuucugguggacugcgcggaucacagccgccuggucgaguccaagguggaacucaacgcuuuaaugacagacgagaccaucucuaauguuccgauucugauccuuggaaacaagauagaucgaacugacgccaucucggaggaaaaauugcgugagauuuucggccuguauggccagacaaccgggaagggaaaugugacgcuaaaagaacucaacgcaagacccauggaggucuuuauguguucagugcugaagaggcaggguuacggcgagggguuccgguggcuuagccaauauaucgauuga

SEQ ID NO: 62162 - RNA, 597 nt, Artificial Sequence
  derived and/or modified sequence opt3 from SAR1B__Homo_sapiens__NP_001028675
augagcuucaucuuugacuggauuuacuccggcuucucuucagugcugcaguuucucgggcuuuauaagaaaaccggaaagcuggucuucuuggguuuagauaacgccggcaaaacaacucugcuacacaugcucaaggacgauagacuggggcaacauguucccacgcuucacccuaccagugaggaacugacaauagcuggaaugacuuuuaccacauucgacuugggcggucaugugcaggcaaggcggguauggaaaaauuaccucccagccaucaacgggauuguguuucuggucgauugcgcggaccacgagcgccugcucgaaagcaaggaggaauuagauucccugaugaccgacgagacuaucgcuaaugugccgauucuuaucuugggaaacaagauagaucgacccgaggccaucucugaggaacgucugagagaaauguucggccuauauggccagacaaccgggaaaggaucgauuucacucaaggagcugaaugcaaggccucuugagguuuuuauguguagcgugcugaaacggcaggguuacggcgaaggguuccgcuggauggcccaauauaucgacuga

SEQ ID NO: 62163 - RNA, 2757 nt, Artificial Sequence
  derived and/or modified sequence opt3 from SARDH__Homo_sapiens__NP_001128179
auggccagccuguccagagcucucaggguggcagccgcgcacccccggcagucuccuacccgcggcauggggccaugcaaccuuucaagugcugccggaccgacagcagagaagaguguccccuaccaacgaacucugaaagaaggucagggcacguccguuguggcccaggggccuucucguccauugcccucgaccgcuaauguaguggucaucggaggcgguucauuagggugucagacacuguaucaucuagcaaagcucggaaugagcggcgccgugcugcuugagagagaaaggcugacuagcggcaccacauggcacaccgcuggguugcucuggcaacugcggccuuccgacguugagguggaacugcucgcccauacucgcagagucgugucuagggaguuagaggaagagacaggacugcacaccgguuggauucagaacggcgggcuuuucauagcgagcaaucggcagcgcuuggaugaauacaaacgacugaugucccuaggaaaggcauauggcguagagucacauguucucaguccagccgagacgaaaacucuguacccccuuaugaacguggacgaucuguaugguaccuuguacgucccucacgacgggacaauggauccagcuggaacuugcaccacacucgccagagcagcuagcgccaggggcgcccaggugaucgaaaauuguccggugaccggcauucgggucuggacggacgauuuugggguucgucgcguggcgggaguagagacucaacacgguucuauccagacacccugcguggucaacugugcaggcgugugggcuuccgccguugggagaauggcuggagugaaggucccucugguggccaugcaucacgcauauguaguuaccgaaaggauugagggcauccagaauaugccaaacgugcgggaccaugaugccucagucuacuuacgacugcagggugacgcucucagcgucgggggcuacgaagcgaaucccauauucugggaggaggugagugauaaguuugcauucggacuuuuugaccuggauugggaaguguucacucaacacaucgagggcgccauuaaccgcguuccuguguuggagaaaacagggaucaagucuaccguaugcggaccagaguccuuuacgcccgaccacaaaccgcuaaugggugaagcuccugagcugagaggcuucuuucucggguguggauucaauagcgccggcaugaugcugggugggggcugcggacaggagcuugcacauuggauuauccacggcaggcccgaaaaggacaugcauggguaugauauacggcgcuuucaccauucgcugaccgaccacccaagauggauuagggagcguucucacgaauccuacgccaaaaacuauucagucguguucccucaugaugagcccuuggcuggacggaauaugcgaagagacccacuccacgaagaacuguuaggucagggcuguguuuuucaagagaggcaugggugggaacgccccggaugguuccacccucggggcccagccccggugcuggaguacgauuauuacggugcauaugggaguagagcgcacgaagacuacgcuuacaggcgccuacucgccgaugaguauacauucgcauuucccccucaucacgacacuaucaagaaggagugccuggccugucgaggcgcugccgcagucuucgauaugagcuacuuuggaaaauucuaucuugugggcuuggacgcucggaaggccgcggauuggcuguuuuccgccgacguaucucguccacccgggagcaccguguacacaugcaugcucaaccauagaggaggcacugaaucagaccugaccguuaguaggcuugcuccuucccaccaggcaagcccacuggcccccgcuuucgagggugauggguauuacuuggccaugggaggcgcagucgcgcagcauaauuggucucacauuacaaccgugcuccaggaccaaaaaucacagugccagcugaucgauaguagcgaagacuuagguaugaucuccauucagggcccggccucucgcgcuauacugcaagaggugcuagaugccgaccucucgaacgaagcauuuccuuucagcacucacaagcugcuucgggcugccgggcauuuggucagagcaaugaggcuguccuuuguuggagagcucggcugggagcugcacaucccaaaagccucaugugugcccguguaucgagcuguaauggcggccggggcaaagcauggauuaauuaacgcuggcuaccgcgccaucgauagucugucuauagaaaaagguuaccggcacuggcaugccgaccuuagaccugaugacagccccuuggaggcugggcucgcauucacgugcaagcugaaguccccagucccuuuucuaggaagggaagcccuggagcagcagcgugcggcuggccuccgccggagacugguguguuucacaauggaagauaaaguucccauguuuggucuugaggccauuuggaggaauggccagguggucgggcacgugcgacgggcagacuucggauucgccaucgauaagaccaucgcuuauggcuacauucacgacccaucagggggaccgguuagcuuggacuuugugaaaucuggcgauuaugcacuggagcgcauggguguaacuuacggggcccaagcgcauuuaaaguccccuuucgaccccaacaauaaaagagucaagggaaucuauuga

SEQ ID NO: 62164 - RNA, 2175 nt, Artificial Sequence
  derived and/or modified sequence opt3 from SARM1__Homo_sapiens__NP_055892
auggugcugacccuccuucugagcgccuacaaguugugcagauucuuugcuauguccggccccaggccuggggcagagcgguuagccgucccaggaccggacgguggcgggggaacaggccccuggugggcggcuggugggcgcggaccucgagaaguuucuccaggcgccggcacugaggugcaggaugcacuggaacgugcccuacccgagcuccaacaggcucugucagcacuuaaacaggccgggggagcuagagccguaggugcgggccuggcagaaguguuccaguuggucgaggaggccuggcuccugccugcuguggggagggaaguugcccaaggacugugugacgcaauccggcucgauggcgguuuagaccugcuuuugcgccugcuacaggcuccagagcucgaaacgagagugcaggccgcgaggcugcuugagcagauucuggucgccgagaaccgggaucgcguggcacgaauaggguugggaguaauccucaaucuggcuaaggaaagagagcccguugaauuagccaggaguguggcuggcauucuggagcacauguuuaaacauagcgaagagaccugccaacggcucgucgccgcaggcgggcuugacgccgugcuguauuggugucgucgcacagauccugcuuugcuaagacacugcgcgcuggcacucggaaacugugcccugcaugguggccaggcugugcagaggcggauggucgagaagcgagccgcagaauggcuuuucccacuggccuuuuccaaagaggacgaauugcuccgccugcacgcuugcuuagccguugcagugcuggcgacuaauaaggagguagaaagagagguggagaggucugggacccuagcucucgucgaaccgcugguggccucgcuugaucccggacgguucgcacgcuguuugguugacgccucagauacaagccagggcagagguccugacgaucugcaaaggcucgugccacugcuugacaguaaccgucuggaggcucagugcaucggggccuuuuacuugugugcagaagcugccauuaagucccuccagggcaaaaccaaggucuucucugacaucggagcgauacaaagccugaaacgguuaguguccuauucaacuaauggcacaaagagugcccuggcuaaacgagcacuaagacuccugggggaggaaguacccaggccuauccuuccaagcguucccucuuggaaggaggccgaggugcagaccugguugcagcagauuggauuuuccaaguacugcgaaucauuccgcgagcaacaggucgauggugaccugcuccugcgguuaacggaagaggagcugcagacugaucuuggcaugaaaagcgggaucaccagaaagagguuuuuccgcgaauugacagagcucaaaacuuuugcuaacuauaguaccugugaccgaucuaaucuggccgauuggcuaggaucccuggacccgcgguuccgucaguacacauauggccucgugagcugcggucuggauagaucgcuuuugcauagggucucugaacaacagcuguuagaggacugcgggauucaccucggcgugcaccgcgcacggauccugaccgcggccagagaaaugcuucauuccccucugcccuguacgggaggcaagccaucaggggauacuccugacguuuucauaaguuacaggcgaaacagcggaucccaguuggcuucucuccugaaagugcaccuacagcugcaugguuuuagcguauucauugaugucgagaagcucgaggccggcaaauuugaagacaagcugauccaaucagugaugggggcacgcaauuucguucuuguguugagucccggagcucuggacaagugcaugcaggaucacgacuguaaagauuggguccacaaggagauugugacagccuuauccugcggcaaaaacaucguaccaaucauugacgguuuugaauggcccgagccucaggugcucccagaagauaugcaggcaguucugaccuucaaugggauaaaguggagccaugaguaccaagaggccacuaucgagaaaauuauccgguuucuucagggcagaucuucaagggacaguagcgcuggauccgauacaucucuggaaggcgcggccccgauggggcccaccuga

SEQ ID NO: 62165 - RNA, 633 nt, Artificial Sequence
  derived and/or modified sequence opt3 from SARNP__Homo_sapiens__NP_149073
auggccaccgagacaguggaacugcacaagcucaaacuugcugagcugaagcaggaaugcuuggcaagaggcuuagagacuaaagggaucaagcaagaccugauucauaggcuacaggccuaccucgaagaacacgcggaggaagaggcuaacgaagaggauguccugggagacgagacggaagaggaagagaccaaacccauagaacuuccuguuaaggaggaggaaccaccggagaagacaguggauguagccgcagagaaaaagguggucaaaaucacuagcgagauuccccagaccgaacggaugcagaagcgcgccgagcgauucaaugugccuguuucccuggagucuaaaaaggcugcacgugccgcuagauuugguaucucaagugugccaacaaagggcuugagcuccgacaacaaacccauggucaaucucgauaagcugaaagaaagggcccaacgguucgggcugaacgugucuucgauuucacgcaagagcgaggacgaugaaaaacucaagaaaagaaaggagagguuuggaaucguaaccaguuccgcgggcacugguacaaccgaagacacggaggcaaagaaacggaagcgcgccgagcgauucgggauagcuuga

SEQ ID NO: 62166 - RNA, 1563 nt, Artificial Sequence
  derived and/or modified sequence opt3 from SARS2__Homo_sapiens__NP_001139373
auggccgcuagcauggcaagaaggcuguggccccuccuuacccggcgcggcuuccgaccucgugggggaugcaucuccaacgacucuccaagaaggucauuuacaacugagaagcggaaucgcaaccuguuguacgaauaugccagagaggguuacagugcguuaccgcagcuggauauugaaagguucugugcuugccccgaggaagccgcacacgcccuagagcuccggaaaggcgagcugcgcagcgcugaccuuccugcaauaaucuccacguggcaagaacugcgacaguugcaggagcagauuagaucucucgaagaggagaaggccgcugugaccgaagccgucagggcgcugcuggcaaaucaagauucgggggagguucaacaggugcggcucgacccaggagccggcucaaucuuuggucccacauucuuaccuuuuccagggcagcugagccuuuugguagaagcucagcuggaggaacaguucuaucuacaggcccucaaacugcccaaccagacucauccugaugugccagucggagacgagagucaagcacgugugcuucacaugguuggcgauaagccgguguuuuccuuccagccccgcggccaucuggagauuggggaaaaauuggacaucauaagacagaagaggcucucucacgucagcggacaucgguccuacuaucugcgaggugcuggcgccuuacugcaacacgggcucgugaauuuuaccuucaacaaacuucugcgcagaggauuuacaccuaugaccguaccagauuugcuaaggggcgcgguuuucgaggguugugggaugacucccaaugccaacccuucacagaucuacaauauugacccagcacgguuuaaggaucugaaccucgcuggaacagccgaagugggccuggcuggcuauuucauggaccacaccgucgccuuccgcgaucuucccgugagaauggugugcaguagcacguguuacagggcagagacuaauaccgggcaggaaccgcguggacuguaccggguccaucacuuuacaaagguugagauguucggugugacuggcccuggguuggagcagucuucccaacuccuggaagaguuuuuaucacugcagauggaaauccuaaccgagcucggacugcauuuccgaguacuugacaugcccacacaggaauugggccugccagccuauagaaaauuugacauugaggcuuggaugccugguagggggcgcuucggcgaggugaccagcgcgaguaacugcacggauuuucagucucggagacuccacaucauguuccaaacugaagcaggagagcugcaguuugcccacacagucaaugcuaccgccugugcagugcccaggcuucugauagccuugcucgaauccaaccagcagaaggacggcagcguucuggugccacccgcuuuacaaucguaccuggggacugaucgcauuacagccccuacccaugucccacuacaguauaucggaccgaaucagccccgaaaaccuggucucccaggccagcccgcagugucuuga

SEQ ID NO: 62167 - RNA, 2403 nt, Artificial Sequence
  derived and/or modified sequence opt3 from SART1__Homo_sapiens__NP_005137
augggcagcuccaagaaacacagaggggagaaggaagccgcuggaaccacagcagccgcggguacuggcggggcuacggagcagcccccuaggcaucgggaacacaaaaagcauaaacaccgcucuggaggcucaggugggaguggaggcgagcgacguaagagaagcagggaacggggcggggagcgcggauccgguagaaggggcgccgaggcagaagcccggucuucgacccaugggcgcgagcgaucacaagcugaaccaagcgagagaagggugaagcgggagaaacgugacgauggauacgaagcagccgcuaguuccaagacaucuagcggcgacgccuccucacugaguaucgaggaaacuaacaaacuccgcgcgaaacuuggucugaaaccguuggaggucaaugcaauuaagaaggaagccgggaccaaagaggagcccguuacagcugaugugauaaacccuauggccuuaagacagagggaagaacugcgggaaaagcuagcagcugccaaagagaagcgacuccugaaucagaaacuuggaaagaucaaaacccugggcgaagacgauccaugguuggacgauacugcggccuggauugagcgcagcagacagcuccaaaaggagaaggaccuggcagaaaagagggcuaagcugcucgaggaaauggaucaggaguucggcguaucuacauuaguggaagaggaguuugggcagcggcgccaggaccuguauuccgccagagaucuucaaggauugaccgucgaacacgcuaucgacucauucagggagggugaaacgaugauucugacucuaaaagauaagggcgugcuccaggaggaggaagacguucuggugaacgucaaucuuguggacaaagagcgugccgaaaagaacguagagcugcggaagaaaaagcccgauuacuugccuuaugcagaagacgagagcguugaugaccucgcccagcagaaaccacgaaguauccugucuaaguacgaugaggaauuagagggggaaagaccccacuccuuuaggcuggagcaaggaggcaccgcugacggucuccgcgaacgggagcuugaggaaauaagagcgaaacugagguugcaggcacagagccuaucgacaguggggccucgccuggccucugaguaucucacuccagaagagauggucaccuucaagaagacaaaacgacgggugaagaaaauccguaagaaagaaaaggagguggucguuagagcugaugaccugcuuccgcugggcgaucaaacccaggacggagauuuuggcuccagguugcgcgggcggggaagaaggcgagugucagagguagaagaggaaaaggagcccgugccucagccacuccccagugacgacacgcgcgucgagaauauggauauuagcgacgaagaggaagguggcgccccuccacccggguccccucaggugcuggaggaagaugaggcagaguuagaacugcaaaaacagcuagagaagggacggagacucaggcagcugcagcaacuucagcaguugcgugacucuggcgaaaaaguuguggagaucgucaagaaacuggaaagccgccagcgggguugggaggaggaugaagacccggagagaaagggggccauuguguucaacgcuacuucagaauuuugcaggacacucggcgagauccccaccuacggacuggccggcaaucgagaagaacaagaggaacuuauggauuucgagcgggacgaggagcgcagugcaaacgggggauccgagagcgauggugaagagaauauaggcuggucuacuguaaaccuggacgaagagaaacagcagcaggauuuuucagcgaguagcacaaccauuuuggacgaggagccaaucguuaauagagggcucgcugccgcacuguuacugugucaaaacaagggacuacucgagacgaccgugcagaaggucgccagggugaaagcuccuaauaagucccugcccucugccgucuauugcauugaagauaaaauggcaaucgacgacaaguacucgcggcgagaggaauacagaggcuucacacaggauuuuaaagagaaggacgguuauaagccagaugugaaaaucgaauacguugacgagacugggcgcaaacuuacccccaaggaggcuuucaggcaauugagccaucguuuucacggcaagggauccggcaaaaugaagacagaacggagaaugaagaaacuggaugaggaagcccuccugaagaaaaugucaaguucugacacuccuuuagggaccguggcgcugcuucaggagaagcagaaagcccagaagacaccauauauuguauugagcggauccggcaagucaaugaacgcuaacaccauaacuaaauga

SEQ ID NO: 62168 - RNA, 2892 nt, Artificial Sequence
  derived and/or modified sequence opt3 from SART3__Homo_sapiens__NP_055521
auggccaccgcugcagagacaagcgccuccgaacccgaggcggaaucuaaggcuggcccuaaagccgacggggaggaagaugaggugaaggcagccagaacuaggcggaaaguccugucacgcgcuguugcagccgcuacguacaagaccaugggaccagccugggaccagcaagaggaaggugugagugagagcgauggcgacgaauaugcgauggcauccucugccgagucgucaccgggggaguacgaaugggaguaugaugaagaggaagagaaaaaccagcucgagaucgaacgacuugaggaacagcugagcauuaauguauacgacuauaacugccacguggauuugauacguuuacugagacuagagggagaacucacaaaggucaggauggcucggcagaagaugagugagaucuucccccugacugaggaacuuuggcuggagugguugcaugacgaaauuuccauggcccaagauggccucgaccgcgagcacguguacgaucuguuugaaaaagcaguuaaggacuauaucuguccuaauauuuggcuggaguacggucaguacucugucgggggaaucggccagaaaggcgggcucgagaaggugagaagcguguucgaaagggcuuuauccucaguaggacugcauaugaccaaaggucuugccuugugggaggcguaucgggaauuugagagugccauaguugaggcagcucgccuggaaaaggugcacagccuauuccgaagacagcucgccaucccacuguacgauauggaggcuacauuugccgaauaugaggaauggucugaggaccccauuccugaguccgucauccaaaacuacaauaaggcacuucagcagcuggaaaaauauaagccauacgaggaagccuugcuccaggcugaggcgcccaggcuggcagaauaucaagccuacauugacuucgagaugaaaaucggcgauccugcucggauacaguuaauuuuugagcgugcccugguggaaaacugccucgugccagaccuuuggauccgcuacucacaguaucuggauagacaauugaaggucaaagaccuaguucugagcgugcauaauagggcaauucggaacuguccguggaccguagcccucuggagucgauaccugcuugcuauggagcgccacgggguggaucaccaggucaucucugugacuuucgaaaaggcccugaaugcaggauuuauccaggcgacagacuauguugagauuuggcaggcuuacuuggauuaucucagaaggcggguggacuucaaacaagauuccagcaaggaacuggaggaguuacgcgccgcauuuaccagagcccuggaauaccuaaagcaggaggucgaagagagguucaacgagucgggcgaccccucuugcgugauaaugcagaauugggcucguaucgaagcccggcucuguaacaauaugcagaaagcacgagagcugugggauuccauuaugacgagagguaacgcuaaguaugccaauauguggcuugaauacuacaacuuggagagggcgcauggggacacucaacacugccgcaaagcccugcaucgggcuguacaguguaccucagacuauccugaacacguuugcgaggugcuccugacaauggagagaacugaaggaagucuugaggauugggacaucgcaguccagaagaccgaaacaaggcuggcccgcgugaacgagcagcgaaugaaagcugccgaaaaggaggcagcguugguccaacaggaggaagagaaggccgaacagcggaaacgugcuagagccgagaagaaagcacucaagaaaaagaagaaaauaaggggcccagaaaagcgcggcgcugaugaggacgaugagaaagaauggggagacgaugaggaagaacagcccagcaagcggagaaggguggaaaauuccauuccugccgcaggggaaacccaaaacguugagguggccgcugguccagcgggcaaaugugccgcaguagacgucgaacccccgucuaagcagaaggagaaagcugccagccugaagcgagauaugccuaaaguguuacacgacucaaguaaggauuccaucacgguuuuugugagcaaucugcccuacucuaugcaggaaccagacacuaaacuacgcccucucuucgaggccugcggggaggucgugcaaauccggcccauuuucucaaacagaggagauuuuaggggcuauuguuacguagaguucaaggaggagaaaagugcucugcaggcacuugagauggaccguaagagcguggaaggucgcccaauguuuguuucccccugcgucgacaagucuaaaaauccugauuucaagguguuucgguauucgaccagcuuggagaaacauaagcuguucaucuccgggcucccauuuucaugcacaaaagaggaacuggaggaaauuuguaaggcccacggcacugugaaggacuuaagacuggucacaaacagggcgggaaaaccgaagggccuugcuuacguugaguaugaaaaugagagucaggccucucaggcagugaugaaaauggaugggaugaccauaaaggagaacaucauuaaaguggccaucagcaaucccccucaacgaaagguaccagaaaagcccgagacgcggaaagcuccuggagguccaauguugcucccccagaccuacggcgcacgcgggaagggaagaacacagcugucccuacugccgagggcccuccagcggccuucagcggcugccccacaagcagaaaacggccccgccgcugccccugcagucgcugcccccgcggccacugaggcaccaaaaaugagcaaugcugacuucgccaagcuguuucuucgaaaauga

SEQ ID NO: 62169 - RNA, 3744 nt, Artificial Sequence
  derived and/or modified sequence opt3 from SASH1__Homo_sapiens__NP_056093
auggaggacgccggcgcugcagggcccggaccugaaccagagccggaacccgagccugaaccagagcccgccccugagccagaacccgagccuaagccaggugcgggcaccagcgaggcuuucuccagacuguggacagaugugauggggauccucgacggaucucuuggcaacauugaugaccuggcccagcaauacgcagauuauuacaauacuugcuuuucagacgucugugaaaggauggaggaauugcggaaacgccgaguuagucaggauuuagagguggaaaagccggacgccagccccacgucccugcagcuacguucucagauagaggaaucgcucgguuucugcucagcuguaagcaccccugagguggagcggaaaaacccacugcacaagaguaauuccgaagauucuagcgucgggaaaggagacuggaagaagaaaaacaaguauuuuuggcaaaauuucaggaaaaaccagaagggcaucaugcggcagacauccaaaggcgaggaugugggguacguugcaucagaaauuacuaugagugacgaggaacgcauccagcuuaugaugauggugaaggagaagaugauuaccaucgaggaagcccuggcuagauugaaagaguaugaagcccaacauaggcagagcgcggcacucgaucccgccgacuggccugacggaucuuacccaacauuugaugguuccucaaauuguaacagccgggagcagagugacgaugaaaccgaggagucugucaaguucaaacgccugcacaagcugguaaauuccacucgaagagugaggaaaaagcucauacggguugaagagaugaaaaagcccagcacagaaggcggggaggagcauguguuugaaaacucgccggucuuagacgagcguucugcucuguauuccggagugcacaagaaaccucuuuucuuugauggcucacccgaaaagccaccugaggacgauagugacagcuugaccacgucccccucuagcucaagucuggauacuuggggugccgggcgcaagcuagugaagaccuucuccaaaggagaaagcagaggccucaucaagccacccaagaaaaugggcacauuuuucucuuacccugaggaggaaaaggcacagaaagucucaaggagucugacugagggggaaaugaagaaaggacuugguagccugucccauggccggaccugcucuuuugggggauucgacuugacaaaucgaucgcuccacguuggcagcaacaauuccgauccaauggguaaggagggggacuucguguacaaggaaguaauuaaaucaccgaccgcuagucgcaucucucugggcaagaaagucaagagcgugaaagagacgaugagaaagaggauguccaagaaauauucaagcucuguguccgagcaagacaguggauuagauggcaugcccgggagcccuccacccucucagccugacccagaacaccuggauaagcccaaacucaaggccggagguuccguugagucacuucggaguagccugucgggccaguccucuaugagcgggcaaacugugucaacaaccgacaguuccacuucuaaccgcgaaagcgucaaauccgaggauggagacgaugaggaaccgccuuacagaggcccauuuugugguagggcgcgugugcauacagacuucacccccucaccuuaugauacggacagcuugaagcucaaaaagggggauauuaucgacauaauuaguaagcccccaaugggcaccuggaugggacugcucaauaacaaaguaggcacauuuaaguucaucuacguugaugugcugucugaggacgaagagaaaccuaagcggcccacucgaagaaggcgcaaagggcggccaccgcagccuaaguccgucgaagaccuucuggauagaauuaacuugaaggagcacaugcccaccuuucucuucaauggauaugaggaccuggauacauuuaaauuacuggaagaggaagaccuagaugagcucaacaucagggacccagaacaucgcgccgugcugcuuacugcagucgaguugcugcaggaguacgauagcaauucggaccagucagguucucaagaaaagcuccugguggauagucagggccuuuccgggugcagcccccgagacucuggauguuaugagagcuccgaaaaccuggagaauggcaaaacccggaaggcuucauugcucagugccaaaagcucuacagaaccuucccugaagucauucagucguaaccaguuagguaauuacccaacccugccccuaaugaaaagcggggaugcucucaaacagggccaagaggagggaagacugggcgggggacuugccccugacacuuccaagucuugcgauccgccaggcguuacggguuugaacaaaaauaggcgcucgcugcccgugagcaucugucggucaugcgaaacacucgaggggccucagaccguagacacuuggccaagaucccacagucuggacgauuuacaggucgaacccggagcagagcaggacgugccuaccgaaguuacagagccgcccccacaaauugugccugaggucccccagaagaccacugccucuagcacaaaagcucagccacuggaacaggauuccgcgguggacaacgcacuuuugcucacgcaaucaaagagguuuucugagccucagaagcugaccacuaaaaagcuagaaggcagcauagccgcuaguggucgaggccuguccccaccccagugucucccgcgcaauuacgaugcccaaccucccggggcaaaacacggacuggcccggacaccacuugagggccauagaaaggggcacgaguucgaaggaacccaucaccccuugggcacaaaagaggguguagacgcugaacagaggaugcagccuaagaucccaagccagcccccuccggugccagccaaaaagucucgugagcgccuggcaaacggguuacaucccguuccuaugggacccucaggcgcgcucccauccccugaugcucccugccugccagucaagcgggguaguccugccagcccgacuucgcccucugacugcccuccagcacuugcccccagaccacuguccggccaagcuccugggucacccccgagcaccaggccaccucccugguugagugaacucccagagaauacgucucugcaggagcacggagugaaacuaggccccgcccugacccgaaagguguccugugcaagaggggucgaucucgaaacacugacugagaacaaacuucacgcugaaggaauugacuugaccgaggaaccuuauagcgauaagcauggccgcugcgguaucccggaggcccugguucagagauacgcggaggacuuagaccagcccgaaagggauguggccgcuaauauggaccaaauacgggugaaacagcuccgaaagcagcacagaauggcaauuccaucagggggacugacagagaucugucgcaagccuguaagucccggcugcaucagcuccgucucugauuggcuuauuagcaucggucugccuauguaugccggcacucuauccaccgcuggguuuucaacgcucucucaggugccaagucugucgcauacauguuugcaagaagccggaauuaccgaggaaaggcacauacguaaacuguuaagcgcagcgcggcuauucaagcugcccccuggcccagaggccauguga

SEQ ID NO: 62170 - RNA, 1143 nt, Artificial Sequence
  derived and/or modified sequence opt3 from SASH3__Homo_sapiens__NP_061863
augcugagaaggaagcccagcaacgccuccgagaaagaaccuacccagaagaaaaagcucucucuucaacggucaaguagcuucaaagacuuugcuaaguccaagccaucuucgccgguggucucagagaaagaguucaaucuggaugacaacauccccgaagaugacagcggcguuccuacaccagaagaugcagggaagaguggaaagaaauuggguaaaaaguggcgcgccgugauuucccgaacuaugaaucguaagaugggcaaaaugaugguaaaggcguuaucugaggagauggcugacacgcuggaagaggggagcgccucccccaccucaccugauuacagucuagacagcccaggacccgagaaaauggcacucgccuuuucugaacaggaggaacacgagcugccugugcuuuccagacaggcuucaacaggcagcgaacugugcaguccaucuccggguuccgggagcuucggagaggaacccccugcaccacaguauacuggccccuuuuguggcagggcccggguccauaccgauuucacaccuucgccauacgaccacgauucuuugaagcuccaaaaaggggacgugauacagaucauugagaagcccccgguuggaaccuggcugggucugcucaacggcaaagugggguccuuuaaguucaucuaugucgauguguuaccugaggaagcuguaggacaugcccgccccucaagaaggcagaguaagggcaaacggccaaagccuaaaacucugcacgagcuuuuggaacgcauuggucuggaggaacauacaagcacccuacuccugaauggguaccagacgcuugaggacuuuaaggagcugcgagaaacucacuugaacgagcucaauaucauggacccccaacacagagcgaaacuguuaaccgcagccgaacugcuccuugauuaugacacaggauccgaggaagcugaggagggcgccgaaucuagccaggagccaguugcacauacugugucagaacccaaggucgauauaccuagggacaguggcugcuucgagggguccgagagcggacgggaugacgcugaacuggccgguaccgaggaacaguugcagggccuaucucuggcgggggccccauga

SEQ ID NO: 62171 - RNA, 516 nt, Artificial Sequence
  derived and/or modified sequence opt3 from SAT1__Homo_sapiens__NP_002961
auggccaaguucgugaucagacccgcuaccgcagccgacugcagcgauauucugaggcucauaaaagagcuugcgaaguacgaauauauggaggaacaggucauccugacagagaaagacuuguuagaagauggcuuuggggagcacccuuucuaccauugucugguugcugaggugccaaaggaacacuggacuccggagggacauuccauuguagguuuugccauguauuacuucacguaugaccccuggaucggcaaacuacucuaccuggaagacuuuuucgugaugucugauuaucggggguuuggaauuggcucagagauccuuaagaaccugagucaagucgcaaugcgcugccgauguagcuccaugcacuucuugguggccgaguggaaugaaccuucuauaaacuuuuacaagcguagaggugcuucggaucucucaagcgaggaaggguggaggcuguucaaaaucgacaaggaguaccugcucaaaauggcaaccgaagaguga

SEQ ID NO: 62172 - RNA, 513 nt, Artificial Sequence
  derived and/or modified sequence opt3 from SAT2__Homo_sapiens__NP_597998
auggccagcgugagaaucagggaggcuaaggaaggcgacugcggggauauucugcggcucauacgcgagcuugcagaauuugagaaacuguccgaccaggucaagaucucugaagaggccuugcgagcggauggauuuggugacaaccccuucuaccacuguuuaguugcugagauucugccugccccaggcaaacuacucgggccgugcgugguaggauauggcaucuacuauuuuauuuacucaaccuggaagggucguacaaucuaucuggaagauauauacgugaugcccgaguauagagggcaaggaaucggcaguaaaauuaucaagaaggucgcagaaguggcccuugacaaaggcuguagccaguucaggcuggcuguuuuggauuggaaucagcgggcaauggaccucuacaaggcccugggggcucaggaucugacugaggccgagggauggcauuucuucugcuuucaaggugaagcgacgcgcaaacucgcaggcaaguga

SEQ ID NO: 62173 - RNA, 2388 nt, Artificial Sequence
  derived and/or modified sequence opt3 from SATB1__Homo_sapiens__NP_001182399
auggaccaccugaacgaggccacccagggcaaggaacauagcgagauguccaauaacgugucugaucccaaagggccuccagcuaagaucgcaagacucgaacaaaauggaucaccgcuugguaggggccggcuggggaguacaggagccaaaaugcagggcguccccuugaagcacagcggucauuuaaugaaaacuaaccugcgcaaggggacgaugcuaccuguuuucugcgugguagagcacuacgaaaaugcgauugaguaugacuguaaggaggaacaugcugaguuugugcucguccgaaaagauaugcuguucaaccagcuuauagaaauggcccuguugucccucggauacucucacucgucagcagcccaggcuaagggccugauccaagugggcaaauggaauccaguuccccugagcuaugugaccgacgcaccugaugccacagucgcugacaugcuccaggauguguaccacguaguuacuuuaaagauucagcugcauaguugcccaaaacuugaggacuugcccccugagcaguggucccacaccacagugcguaacgcccugaaggaucuacucaaggacaugaaucaaucuagccuggcgaaagaauguccacuuucccagucaaugaucaguagcauugucaacucuaccuauuacgcaaauguguccgccgcuaagugccaggaguuugggagaugguauaaacauuucaagaaaacuaaggauaugaugguggaaauggacucacugagcgaguugagucagcaaggagccaaccacgucaauuuuggucagcagccgguucccggcaacacagcagaacaaccuccaucucccgcucagcucucccacgggagccagccuucggugaggaccccacugcccaauuuacauccgggacugguaucuacgccuaucucaccccagcucgugaaccaacagcuugucauggcccagcuguugaaccagcaauacgcggugaaucggcuacuggcccagcagucacucaaccagcaauaccugaaucacccaccucccguuagucgcagcaugaacaaaccacuugagcaacagguguccacuaauaccgaggucucuagcgaaauauaucagugggugagagaugagcugaagagggcaggcaucucacaggcuguauucgcccggguugcuuuuaaccgcacacaggguuugcucagugaaauucugcgaaaggaggaagaccccaaaacugccucccagagcuuacuggugaaucuaagagcaaugcaaaacuuccuccagcugccugaggccgagagggaccggaucuaccaggaugaacgugagcgcucucuuaaugcugcgucagcaauggggccagccccguugauuaguacacccccuagcagaccaccccaggucaagaccgcuaccaucgccacggaaaggaacggaaaaccugagaauaacacuaugaauauaaacgcauccauuuaugacgaaauccaacaggagaugaagcgggccaaagugucucaggcucuguuugccaaggucgcagcgacaaagucgcagggcuggcucugugagcugcuucgauggaaagaagauccaagccccgagaaucgcacccugugggaaaacuuguccaugauuagaagguuccucucacugccgcaaccugagcgggacgcuaucuacgagcaggaaaguaacgccgugcaucaccauggcgaucgcccaccccacaucauucacguuccugcagagcagauacagucucccagcccaacuacauuagggaagggagaauccagagguguguuucugccuggccuacccaccccagccccguggcucggggcugccccucaacagcagcaacagcagcagcaacagcagcagcaacagcagcaggcacccccacccccucaaccacagcagcagccccaaacgggaccuaggcugccgccacgucagcccaccguagcuuccccugccgagagcgacgaagagaaucggcagaaaacacgaccaagaacuaagaucucugucgaggcgcuuggcauuuugcaauccuucauccaggaugugggucuguaucccgacgaagaggccauacagacccucagugcucagcuggauuuaccuaaauacacaauuaucaaguuuuuccaaaaccagagguauuaccugaagcaucacgggaaacuuaaggacaauagcggcuuggaaguugauguggcagaguacaaagaagaggagcuccugaaggaccuagaagagucuguccaggacaaaaacacuaauacccuguucuccgugaagcucgaagaggaacugucaguagagggaaacacagauaucaauaccgaccuuaaggauuga

SEQ ID NO: 62174 - RNA, 2028 nt, Artificial Sequence
  derived and/or modified sequence opt3 from SATB2__Homo_sapiens__XP_005246453
augauccccguguucugcgucguugagcagcuggacggcagccucgaauacgauaacagagaggaacacgccgaguuugugcuuguaaggaaggacgugcuguucucccaauuggucgaaaccgcuuuacuggcacuaggguauucucauucaagugccgcgcaggcucagggaauuauaaaacucggucgguggaauccucugccacuuagcuacgugacagaugccccggacgcaacuguugccgauaugcugcaggacguguaucacgucgugacguugaagauccaacuccaguccuguucuaaacuggaggaucugcccgcugagcaguggaaccaugcaaccguacgcaaugcccucaaggaauuacugaaagagaugaaccagucgacacuugcuaaggaaugcccuuugucacaaagcaugauuaguuccaucguuaauucuacuuacuaugccaacgugagcgcgaccaagugucaggaguuuggccgaugguacaaaaaguauaaaaagauuaaagucgagcguguggaaagagagaaucuguccgacuacugcgugcuagggcagaggccaaugcaccuccccaacaugaaucagcuggcaucacuuggaaagacaaacgaacaaaguccucauagccagauccaccacucuaccccaauacggaaucagguccccgcccugcaaccuaucauguccccaggcuugcucucaccgcagcugagcccccaguuaguucgccagcaaauugcuauggcccaucugaucaaccagcagauugcagugaguagacuccuugcucaccagcauccucaagccaucaaucagcaguuccugaaccacccacccauaccuagggcgguaaagccagagcccacuaauucuuccguggaagucagcccggauauuuaccagcaagugcgggacgaguugaaacgcgccucgguuucucaggcaguguuugcucgagucgccuucaacagaacacagggucuacuguccgagauccucaggaaggaagaggauccucggaccgcuucacagagucugcuugugaaccugcgugccaugcaaaauuuucucaaccuccccgaaguagagcgcgacagaauuuaucaggaugaaagggagcggagcaugaauccaaacguuuccauggugucuagcgcaucaaguuccccuaguucuucacgaacgccccaggccaaaacuagcaccccaacaacugaccugcccaucaaggucgacggggcuaauaucaacauuaccgcggcaauauacgaugagauccaacaggaaaugaaacgcgccaaggugagccaggcuuuauucgccaaagucgcagccaauaagucccagggauggcugugugagcuacucagauggaaggaaaacccuucuccagagaauaggacacugugggaaaaccuuugcaccauucggcgcuuuuugaaucugccgcaacacgagagagacgugaucuaugaggaagagucgaggcaucaccauagcgaacguaugcagcacguugugcaguugcccccugagccaguacagguccugcaucggcaacagucccagcccgcuaaagagucaaguccuccacgagaagaggcacccccgccuccacccccuacggaagauucuugugccaagaaacccagaagcaggacuaagauaucccuugaggcgcugggcauuuugcagucauucauccacgacgugggccucuacccagaucaagaagcuauccacacacugagcgcccaguuagaccugccuaaacauaccauuaucaaguuuuuccagaaccaacgcuaucacguuaagcaucacgggaaacuaaaggagcaccucggaucugcaguggaugucgccgaguacaaagacgaggaacugcuuacugaauccgaggaaaaugauagugaggaggguagcgaagagauguauaagguggaagcugaggaagagaacgccgacaaaucuaaggcagcucccgccgagauugaucagcgguga

SEQ ID NO: 62175 - RNA, 1899 nt, Artificial Sequence
  derived and/or modified sequence opt3 from SATL1__Homo_sapiens__NP_001012998
augaaccagagcggcaccaaucaauccucucugucagacaguaaccaggccgggaucaaucagcccagcacaaacucccucggaaugaaucagauggauaugaaccaagguucugcuucgcuuuacgagaugaaucagguggacaugaagcagccuucaaugagccaggcaggcaugagacaaagugggacuaaccugccagauauuaaucagccggacaugaaacagcccgauacguggcaguugggaaggucccaaccuggcauguuacagcaggaacugucucagcuaguccucagcaaggccgguauaucccagccagaccccucacagccugggccaagucagagcggacccucucaaucccggaugcgccagaucggcaccaaccagucaggcaugagccagccuguuaugcaacagcuggauagucagucugggggaucccagccaagcaugcgacaaguggguacaucgcagcuuggcacuucucagauugggaugucccagccgggaaccuggcaaacaggccugucacagcccguauugcgucagccuaauaugaguccacccgguauguggcaaccuggggugcagcagccaggaaucagccagcaaguccccucccacccggacaugucucagccuggcaugagccaacaggugcccucacaaccaggcauuagacagccugauaccagucaguccugcaaaaaccagacugacaugagccaacccgaugcgaaucagucuucacucagugacagcaaccagacagggaucauacaaccaucccccucucugcugggaaugaaucagauggauaugaaccaguggucggcuagccucuaugagaugaaccagguugacaugaagcaaccuuccaugucacaggccgguaugaggcagaguggcaccaauuuaccagacaucaaccagccggggaugaaacaacccggaacguggcagcugggccggucucagccugguauguggccacagagccuuuccgaauuggugcugucagaggcaagcauuucucaacccgggccuccacagcgcgcccccucccagaguggcccgagacagagcucuacuucccaagcuggaaccaaucagucaggcaucagucagccugucauguggcaacuagauaugaggcagagcgggggaucgcagccauccaugcgccagguggguacaucucaaagcggcacuucacagauugggaugagucagcccggaaccuggcagacaggccucucccaaccuguaccccggcagccaaacaagucuccucccgguauguggcagcgagggauguggcagccaggcaugagccaacagguuccgucccagcugggaaugagacaaccuggcaccucacagagcaguaagaaucagacggggaugucucaucccggaaggggucagccaggcaucugggaacccgggccuucccaaccaggacuuagccagcaggaccugaaccaguuggugcucucgcaacccggccugucacagccuggucggucucagccgagugucucccagauggggaugcgucaaacuagcauggauuacuuccagauacgccacgcagaggccggcgacuguccagagauuuuaagacugaucaaagaacucgcugccugcgagaauaugcuugaugcgauggaacugacagcagccgacuugcuaagggauggauuuggcgacaacccccuguucuauugucucauugcugaggugaaugaucagcagaagccuucugggaaacugaccgugggauuugccauguacuauuucacuuacgacagcuggacaggcaagguccuuuaucuggaggauuuuuacguuacccaagcauaccaggacucccaucacaacucaauguga

SEQ ID NO: 62176 - RNA, 1152 nt, Artificial Sequence
  derived and/or modified sequence opt3 from SAV1__Homo_sapiens__NP_068590
augcugagcagaaagaaaaccaagaacgagguguccaaacccgccgaaguccagggcaaguacguuaaaaaggagacaucuccucuccuuaggaaucugaugccaucauucauccggcacgggccgacuauuccccgccgaacggacauaugcuugccugauaguagcccaaacgcuuuuuccaccucuggagacgugguaucgcguaaucaaucauucuuaagaacacccauccagaggacuccucaugaaauuaugcggcgcgagagcaacagacugagugcaccauccuaucuagccaggucucucgcggaugugccccgggaauacgguagcucccagucauuugucaccgaggugaguuucgcuguugagaauggcgacagcgggucucgcuauuacuauuccgauaacuuuuucgacggacagcgaaagagaccucugggcgauagggcccacgaagacuaccgguauuacgaguacaaucaugaucuuuuucaacguaugccacagaaccagggucgccacgcaucagggaucggaagaguggccgcuacaagccugggcaauuugaccaaccauggcagugaagaccucccgcugcccccuggguggucugucgauuggacuaugaggggacggaaauauuacauugaccacaauacaaacaccacgcacuggucccauccacuggagcgagagggucuucccccuggcugggaacgcguggagagcucggaguucgggacuuauuacguagaucacaccaauaagaaagcacaguauagacauccaugugcccccucuguuccgagguacgaccaaccucccccagugacauaucagccucagcagacugaacggaaccaauccuuacugguccccgcuaauccauaccacaccgccgaaauccccgacuggcuucagguguacgcgcgcgcaccugugaaguaugaucacauauugaaaugggagcuguuucagcuagccgaccucgauacauaccaaggaaugcugaagcuccuguucaugaaggaguuggaacagaucgucaaaauguaugaggcuuacagacaggcccuccugaccgaauuagagaacaggaagcagcgucaacagugguaugcacagcagcauggcaaaaacuuuuga

SEQ ID NO: 62177 - RNA, 753 nt, Artificial Sequence
  derived and/or modified sequence opt3 from SBDS__Homo_sapiens__NP_057122
augagcaucuucacccccacaaaccagauuagacugacuaauguggccgucguuaggaugaagcgggcuggcaaacgcuuugagauagcaugcuacaagaacaaagugguaggguggcgauccggaguggaaaaggaccucgaugagguccuucaaacgcacucuguguucguuaaugugucaaaaggucaggucgccaagaaggaagaccugaucagugcguuuggcaccgaugaccagacagagauuuguaaacagaucuugacuaagggggaagugcaaguaagcgauaaagagcgucauacccaguuagagcagauguucagagacauugcuacaaucguugccgauaagugcgugaacccugaaaccaaaaggccauauacugucauacugaucgagcgggcaaugaaggacauucacuacuccgugaagacaaauaaaucuaccaagcagcaagcccuagaagugaucaaacagcucaaggagaaaaugaagauugagcgcgcucauaugagacugagguuuauccuuccggucaacgaaggcaaaaagcugaaggagaaauugaagccccucauaaaaguuauugaaucggaggauuauggacagcagcuggaaaucgugugucugauugacccugguugcuuccgggagaucgaugagcucaucaagaaagaaacgaaggggaagggaucauuagagguacugaaucuuaaagacguggaagagggcgaugaaaaguuugaguga

SEQ ID NO: 62178 - RNA, 5682 nt, Artificial Sequence
  derived and/or modified sequence opt3 from SBF1__Homo_sapiens__NP_002963
auggccagacuggcugacuacuucgugcucgucgcuuuuggcccccacccuagggggagcggagagggucagggccaaauccuucagcgguucccagaaaaggauugggaggacaacccguuuccccaggggauugaacuguucugccagccuuccggauggcaauuguguccagagcgcaaucccccuaccuuuuucguugccguguuaacugauauaaacucugaacgacauuauugcgcgugucugacuuuuugggagccagcugagcccucacaggaaacgacccguguggaggacgccacggaaagagaggaggaaggcgaugagggugggcagacucaccuaaguccuaccgcaccagccccgagcgcucagcuauucgcacccaagacacuggugcuugucuccaggcuggaccauaccgaaguguuuagaaauucuuugggacucaucuacgccauucacguugagggccugaacgugugccuggaaaaugucaucggcaaccucuuaacuuguacagugccucuggcugggggaucgcaacgcaccauuucacuuggugccggcgauagacagguaauccagacgccauuggcggacagccugcccguuaguaggugcuccguggcacuacucuuccggcagcuggggauaacuaauguccuuucucuguuuugugccgcuuugaccgagcauaagguacucuuccugagccgcuccuaucaacgauuagccgaugcaugcagaggacugcucgcacuucuguuuccuuugagguacucauucacauaugugccaauccuacccgcccagcugcucgagguccugaguacuccgaccccuuucauuaucggcguuaacgcggccuuucaggcagaaacacaagagcuucuggacgugauuguagcugauuuggacggugggaccgugacgauccccgaauguguccacauaccaccucuccccgagccacugcagagccagacucacucuguguuauccaugguucuggaucccgaacuagagcucgccgaccuggcuuucccuccaccgacaaccucaacuagcagucuuaaaaugcaggacaaggaguugcgggccguguuucugcgucucuucgcacaacugcuucagggauaccgcuggugccugcaugucgugcggauucaccccgaaccuguaaucagguuucauaaagccgcuuucuugggccagcggggccucguugaggaugacuuucugaugaagguguuagaagggauggcguucgcaggauuugucucugagcgaggugugccauaucgccccacagaucuguucgacgaacucgucgcccacgagguggcuagaaugagggccgaugagaaucacccucagcggguucuccgccaugugcaagaacuggcagagcagcuuuacaagaacgaaaauccauaccccgccguagcuaugcacaaaguccagagaccgggcgaguccagccauuugaggcgugugccucggccauuuccccgacuggacgaggggaccguucaguggauuguggaucaagccgcagcgaagaugcagggagcuccucccgccgucaaagcagaaagaaggacgaccgugccaucgggcccucccaugacagccauccucgagcgcuguucuggucugcacguaaacuccgcucggagauuagaagugguuaggaauugcaucucauaugucuucgaggggaagaugcuggaagccaagaaacuuuugccagcagugcuccgcgcucugaaaggccgagccgcgcggcguugccuagcccaggagcugcaucuccacgugcagcaaaacagagcuguccuggaccaccagcaguuugauuucguugugaggaugaugaauuguugccuucaagacuguacaaguuuggaugagcauggaauugcagccgcucuguuaccgcucgugaccgccuucugccgcaaacugagcccuggcguaacacaguuugcauacuccuguguccaggaacacgugguuuggucuacuccccaguucugggaggcgauguuuuauggggacgugcaaacccauauacgggcccuuuaccuggaaccaacagaggacuuggcucccgcccaggaagucggagaggcaccuagccaggaggaugaaagaucagcucucgacguggccagugagcagaggcgacuguggccaacccuaucccgcgaaaagcaacaggagcugguucagaaagaagagagcacuguguucucucaggcaauccacuaugccaaccggaugucauaccuccugcuucccuuggauaguagcaaguccagacuguuaagggagcgugcuggucucggcgaccuggaaucugcgucgaacagccuuguaacaaauuccauggccgggucagucgcagagaguuaugauacagaaucuggauuugaggacgcugagaccugcgauguggccggcgccgugguccgcuucauuaaccgguuuguugacaaaguguguacugaaagcgguguaaccuccgaucaccugaaggggcuacaugugauggucccugacaucgugcaaaugcacauagagacacucgaagcuguucagagagagucaaggcgacugccgccaauucagaaacccaaguugcugcggccucgcuuacucccaggcgaagagugcgugcuggauggacuuagagucuaccuguugcccgacggcagggaggaaggggcaggagguagcgccggcgggccugcgcuccugccggcugagggagccguguuccuaaccacuuaccggguuaucuuuacaggcaugcccacggauccacuggugggugaacaagucguagugcgaucuuucccuguugcagcccuuaccaaggagaaaagaaucuccgugcagacucccgucgaccagcuccugcaggacggguugcaacugcgcaguuguacauuucaguuacucaagauggcuuucgaugaagaggugggcagcgacucugcagagcuguuuaggaaacagcuucauaagcugcguuauccaccugauauucgggccaccuucgcguucacauugggauccgcucacacucccggcagaccaccgaggguaaccaaagacaaggggccuucacuccgcacgcugagucgaaaucuagugaagaacgccaaaaagaccaucggaagacagcaugucacacggaaaaaguacaaucccccaagcugggaacacaggggccaacccccuccagaggaucaggaagacgagauuucgguuuccgaggaacuggagcccucuacucuuaccccuagcucagcacucaaaccgagugaucgcaugacaauguccucucugguggaacgugccugcuguagagacuaucagcgguuggguuuagggacucugagcuccucacucagcagggcuaagagugagccauuucgcauaucucccgugaaccgaauguacgccaucugcagauccuauccuggacugcuuauugucccccagagcgugcaagauaaugcacugcagcggguuucgaggugcuaccgccagaacagauucccaguaguguguuggaggucaggccggucuaaggcugucuugcuacguagugguggccugcacgggaaaggagugguuggccucuuuaaggcccagaaugcgccuucccccgggcaaagccaggccgacucuagcucccuggaacaggagaaauaucuucaagcaguggucucaaguaugccacgcuacgcugaugccagcggacgaaacaccuuaucuggcuucuccucagcucauauggguagucacgugccuagcccgagagcaaggguaacgacacuguccaaucccauggccgccucugcuucgcggcgcaccgcgccaagagggaaguggggaagcgucaggacuucaggccgguccaguggucucggcacagacguggggucucgauuggcaggaagagaugcccuggcuccuccccaggccaacggcgggccaccugaccccggauuucuccgcccgcagagggcagcccuguacauccuuggcgacaaagcucagcugaaggguguucggagcgauccauugcaacagugggagcuagugccuaucgaagucuucgaggcgcgucaggugaaggccuccuuuaaaaagcugcucaaagcaugcguucccggguguccagcugccgaacccucuccugccucauucuuaagaagccuggaggacagugaauggcuuauucagauacauaagcugcuccaaguguccgucuuggugguagagcugcucgauagcggaucuucagugcugguuggccuugaggacgguugggauaucaccacucaggucgugucccuagugcagcuguugagugacccguuuuauaggaccuuagaaggcuuccgccugcucgucgagaaagaauggcugagcuuugggcaccgguucucgcaucgaggagcccacacacuugcuggccagucuuccggguucacgcccguauuucugcaauuccucgauugcgugcaccagguucauuugcaguuuccaauggaguucgaauuuagccaauucuaccugaaguuucuaggauaucaccaugugucaagaagguuccgcaccuuucugcucgacagugauuacgagcggauugagcuuggccuguuauaugaagagaaaggugaaagacgugggcaggucccuuguaggucugugugggaguacguugaccgguuguccaagcgcacucccguguuccacaauuauauguacgccccugaagaugcggagguccugcgaccauacagcaacgugucaaaucucaagguaugggacuuuuauacagaggaaacccuggcagagggacccccuuacgacugggaacuugcccagggcccacccgagccgccugaggaagagagaagugauggcggggcuccacagagcaggcggcgcgugguuuggcccugcuaugacuccuguccuagagcccaaccagaugcuaucucuaggcugcucgaagaguugcagcgacuggaaacagaguuaggacagcccgcagagcgguggaaagacacuugggaucgugucaaggccgcucagagacuagaaggucgcccggacggcagggggaccccuagcucccugcucgugucaacggcaccccaccaucggagaucucuuggaguguaccugcaagagggcccagucgguaguacauugucgcugagccucgauuccgaccagucuucagggagcaccacuuccggaagucgccaggcagcgaggcgaucuaccagcacacuguauucacaguuccaaacugccgaauccgagaaccggaguuacgaaggcacccuuuauaaaaagggcgcuuuuaugaaaccuuggaaggccagaugguucguucucgauaagacaaaacaccagcugagguacuacgaccaucgcguggauacggagugcaaggggguaauugacuuggcagagguggaagcugucgcccccggaaccccaacuaugggugcacccaaaacaguggaugagaaggccuucuuugacguuaaaaccacucgucggguguauaacuucugugcucaggacgucccuagcgcgcagcaauggguagauagaauccagucuugccuguccgacgccuga

SEQ ID NO: 62179 - RNA, 5550 nt, Artificial Sequence
  derived and/or modified sequence opt3 from SBF2__Homo_sapiens__NP_112224
auggccagacuggcugacuacuucaucguggucggcuaugaucacgagaagcccgggagcggcgaaggucucggcaaaauuauacagagguuuccucaaaaggacugggaugacaccccauucccgcaggggaucgagcuauuuugccagcccgggggcuggcagcugucccgggaacgcaaacaaccuacuuucuuuguugugguuuugacugauauugacucugaucgacacuacuguucaugcuuaacguucuaugaggcagaaaucaaccugcaggguaccaagaaagaggagauugaaggggaggccaaggugaguggacuuauccagccagcggaagucuuugcucccaagagccucgugcugguuucccgucuuuacuauccugagauauucagagccugucugggcuugaucuacacaguguaugucgacucucucaaugugucgcuggagucacugauugccaaccucugcgccuguuuaguaccagcugcaggcgggagccagaaacuguuuagucuuggagccggugauaggcaauugauccagacuccccugcacgacucccuaccuauuaccggcacaucuguugcucuccuguuccagcagcuugggauccaaaaugugcugagcuuguuuugcgccguccucaccgaaaacaaggugcuguuccauuccgcgucauuucagcgguuaagugaugcaugucgcgcccuggagagccucauguucccacuuaaauacucuuacccguauauacccauucugccugcucaguugcuagaagugcuguccucaccaacucccuucaucauuggaguccacagcguuuuuaagacagacgugcaugagcuccuggauguaaucaucgccgaccuugacggcgguaccauuaaaauaccugaaugcauccaccugaguucuuugccagagccccuccugcaccaaacgcaguccgcauuaagccugauucuacauccggaucucgagguggcugaccacgccuucccucccccaagaacugcgcugucgcauucuaagaugcuugauaaggaagucagggccguguuuuugcggcuguucgcacagcucuuucagggguaccgcuccugucugcaacuuauccgaauacacgcugagccuguuauucacuuccauaaaaccgccuuucugggacagagaggcuugguggaaaaugacuuccucacaaagguccugucaggcauggcuuuugccggguucgugagugagaggggacccccauaucggagcugcgauuuauuugacgaacugguagcauucgagguugagcguaucaaaguggaagagaacaaucccgucaagaugaucaaacacgugcgcgaacuagccgagcagcucuuuaagaacgaaaauccuaacccacauauggcuuuccagaaagucccgagacccacugaggguucccaccugagggugcauauucuuccuuucccagagaucaaugaagcgcggguucaagaguugauucaggaaaacguggcaaagaaucagaacgcacccccugcuacccgaauagagaagaaauguguagucccagccggacccccggugguuucuaucauggauaaggugacaaccgucuuuaauagcgcacagcgccuggaggugguaagaaacugcauuucauucaucuuugaaaacaaaauccucgagacggaaaagacucugccugccgcuuuaagggcccugaaagggaaggcagcgcggcaaugccuuacagacgaguugggacuccacgugcagcagaaucgcgcuauucuggaucaccagcaauucgacuacauaaucagaaugaugaacuguacccuacaggauugcaguucccuggaagaguauaauauugccgcagcccuccugccacuuacuagcgcuuuuuacaggaaguuggcccccggcguuucucaguucgcauauacauguguccaagaccauccuaucuggaccaaccagcaguuuugggagacgaccuucuacaaugcugugcaggaacaagugcguucacuguacuuaagugccaaagaggacaaccacgcgccccaucucaagcagaaagauaagcugccagacgaucacuaucaggagaaaacugccauggaccuugcugcagaacagcugcgguuguggccuacucucagcaaguccacccaacaggaacugguccagcacgaggagucuacaguauuuucgcaggccauucauuucgcuaaucuaauggugaaccugcucgugccccuggauacuagcaagaauaaacuuuugcgaaccuccgccccaggugacugggaaucagggaguaacucuaucguaacaaauagcauagcaggcuccgucgcggagucauacgauaccgaaagcggauuugaggacucugaaaacacugauaucgccaauuccgugguuagauucauuacgagguuuaucgacaaggugugcacagagaguggcgucacccaagaucacauuaaaagccugcauuguaugaucccggggauaguggcuaugcacauugagacuuuagaagccguucaucgcgagucucggagacucccucccauccagaagccaaaaauucugaggcccgcacuucugccuggagaagagaucgugugcgagggucuacgcguacuccuggacccagauggccgagaagaggcuaccgggggauugcugggcgguccccaguuacucccugccgaaggggcacuguuccuuacaaccuaucggauacuguuccguggcacuccgcacgaccaauuggucggagagcagacaguggugagauccuuuccaaucgccucaauuacgaaggaaaagaaaaucaccaugcagaaccagcuccaacagaauaugcaggagggccugcagauuacaagugcuagcuuccaacuaaucaaggucgcguuugacgaggaaguuucgcccgaggugguagaaauauucaaaaagcagcugaugaaauuuagguacccucaguccauuuucucuacauuugccuucgcagcugggcagaccacaccacaaaucauccuucccaagcagaaagagaagaacacuagcuuucgcaccuucucaaagacgauugugaaaggagccaagcgggccgguaaaaugaccaucggcagacaguaucuccugaagaaaaagacagggacuauugucgaagagagggugaaccgaccuggauggaaugaggaugacgauguuaguguguccgacgaaucugaguugccgaccagcacaacucugaaggcuuccgaaaaaucaaccauggagcaguuagucgaaaaggcauguuuucgcgauuaccaacggcucggccuggguacgauaagcgggaguucuuccagaagcaggcccgaguauuuccguaucacagccucgaaccgcauguacucacuuugccggucuuacccaggccuguuggugguuccucaggcggugcaggacaguucccuccccagagucgcuagguguuaucgacacaaucggcugccaguagugugcuggaaaaacagccgcucuggaacccuacugcuuagaagcggcggguuccauggaaagggcguugugggucucuuuaaaucccaaaauucaccucaggccgcacccacaaguagccuggagucuuccucaaguauugaacaggagaaguacuugcaggccuuacugaacgcugucagcgugcaccaaaagcucaggggaaauuccacacugaccguacggccagcauucgcccuuucuccgggagugugggcgucgcugcgaagcucaacuagauugaucuccaguccuaccucuuuuauugaugucggcgcucgccuagccgguaaagaccauagcgcauccuucucaaacucuagcuaucugcagaaucagcuccugaagaggcaggccgcucuuuacaucuuuggcgagaaaagucaauuacguaacuucaagguugaguuugcccugaauugugaguucgugcccguggaauuucacgagauacggcaggucaaagcauccuucaagaagcucaugagagcuugcaucccaagcacaauucccacggauucugaagugaccuuuuugaaagcccugggggacucagagugguucccucagcuccauaggaucaugcagcuggcgguuguaguguccgaaguccuugagaacggaaguagcgugcugguuugcuuggaggaaggcugggauauuacugcccaagugacaucgcuaguccagcugcucucugacccauuuuaucgcaccuuagagggguuccagaugcugguggaaaaggaguggcuuuccuucggacacaaauuuagccaacgaucaagucugacacucaauugucagggcucugguuucgcacccguauuuuugcaguuccuggauugcguccaccaggugcauaaccaauacccuacugaauuugaguucaaucucuauuaccugaaguuucuugcuuuccacuacguuuccaacagauuuaaaaccuuccuacuggacagcgacuaugagcgguuggaacaugggacguuauuugaugacaagggagagaaacacgccaagaagggcguguguaucugggaaugcauagauaggaugcacaaacgcucaccgauuuucuuuaacuaccuguauaguccacucgagaucgaagcucugaagcccaaugucaacgugagcucccuuaaaaagugggacuacuauaucgaggagacacugucuaccgguccuagcuacgauuggaugaugcucacucccaaacauuucccauccgaagacucagauuuggcaggcgaggccgggccucguucucagagacggaccguuuggcccuguuaugacgaugugaguugcacacagccagacgcccugacuucgcuauucagcgaaauugagaagcuggagcacaagcucaaucaggcuccugaaaaauggcaacagcuuugggagagggucaccguggaucugaaggaagaaccgcgcacagaccgaucccagagacauuuaucucggucacccggaauaguaagcacgaacuugccauccuaccagaaaaggagucugcuccaucugccugacucuagcaugggcgaggaacaaaauucauccaucagucccagcaacgggguggagcgcagagcggcaacccuuuacucucaguauacuuccaagaaugaugaaaacaggucauuugagggaacacuguacaaacggggcgcccucuugaaggguuggaagccacguugguucguucuggacgucaccaaacaucaguuacgcuauuacgauagcggggaagacacuucguguaagggacacauugaucuagcugagguggaaauggugaucccugccggccccucuaugggugcaccgaaacacacaagugacaaggccuuuuucgaucugaaaaccuccaagcgagucuauaauuuuugcgcucaggacggccaaagcgcgcagcaguggauggauaagauucaaucauguaucuccgacgccuga

SEQ ID NO: 62180 - RNA, 4182 nt, Artificial Sequence
  derived and/or modified sequence opt3 from SBNO1__Homo_sapiens__NP_001161328
augguggagcccggccaggaccugcuccuugccgcucugagcgaauccgggaucucuccuaacgauuuguucgacauugauggaggugacgcaggcuuagccaccccaaugccgacacccucaguccaacagaguguuccucugagcgcgcuagagcucgggcuggaaacugaggcugccgugccaguaaagcaggaacccgagacggugccuaccccagcacuucugaaugucagacagcaacccccuuccacaacuaccuuuguguugaaccagauaaaucaccucccaccgcugggaucuacaaucguuaugaccaaaacucccccugugacaaccaacaggcagacgauuacucugaccaaguucauccagacaacugccucgacccggccaucagucagcgcucccacagugcgcaaugcaaugaccagugccccuuccaaagaucaaguacagcucaaggacuuacugaaaaacaauucucuuaacgaguugaugaagcugaagccacccgcuaauauugcccagccgguugcgacggcagccacugaugugagcaacggcacagucaaaaaggaauccucaaauaaagagggugcucgaauguggaucaacgacaugaagaugcguaguuuuagcccuaccaugaaagugcccguggucaaggaagaugacgagccagaggaagaggaugaagaggaaauggggcaugccgagacuuacgcagaguauaugccuauaaagcuaaaaaucggacucagacaccccgacgcuguuguggaaacaucuucccugucaagcguaaccccacccgaugugugguacaagacgaguauuucugaggaaaccaucgacaauggcuggcuuuccgcccugcaguuggaggcgauuacauaugccgcacaacagcaugaaacuuuccucccuaacggcgacagggcuggguuucugaucggagauggugccggcgucgggaaaggacggaccauagcuggcauuaucuacgagaauuauuuacugagccgcaagagagcccucugguucucggugucuaacgaccuuaaauacgaugcagagagggaccugcgggauauuggugccaagaacaucuugguucacucccuaaauaaauuuaaguaugggaagaucucaaguaaacauaacggaagcgugaagaaaggcgucauuuucgcuacauacuccucucugauaggcgaaagccagucagggggaaaguacaaaacucgccucaagcaacugcuucacuggugcggugacgauuuugacggcgugaucguauucgaugagugucacaaggcgaaaaaucugugcccaguugggaguuccaagccgaccaaaacaggauuggcagugcucgaacugcagaacaaguuacccaaagcccgagucguguaugcuagcgccaccggcgcaucugagccuagaaauauggccuacaugaacaggcuggguauuuggggcgaagggacuccauuucgggaguucucagacuuuauccaggcugucgagcgucgcggagugggcgccauggaaauaguugcaauggauaugaagcuaagagggauguauauugcgaggcagcucaguuucacgggagugacauucaagaucgaggaaguacugcuuagccaauccuacgucaaaauguauaauaaggcugugaaauuguggguuaucgcccgggagcgauuucagcaggcagccgaccugauugacgcugagcagcgcaugaagaaaucuauguggggucaauucuggucggcccaucagagauuuuucaaguaccucuguaucgcaagcaaggugaaaagggucgugcagcuggcucgggaagagauuaagaacggcaaaugcguagugauagggcuucaguccaccggagaagcccgcacucuggaggcguuggaagagggcgguggggagcucaaugauuuuguuucaaccgccaagggcguccugcaaaguuuaaucgaaaaacacuuccccgcuccugacagaaagaaacuguauucucuacucggaauugaucugacagcaccaagcaacaauuccucacccagggacagcccguguaaggagaacaagaucaaaaagcguaaaggcgaagagaucacccgggaagccaagaaagcucgaaaggucgggggacuuacugguucuuccagugaugacagcggcucugaguccgaugccucagacaaugaggaaagugauuacgagagcucgaagaacauguccucuggggacgaugacgauuuuaauccuuucuuggacgaaagcaacgaggacgaugaaaacgacccauggcugauuagaaaagaucauaagaaaaauaaggagaaaaagaagaaaaagucaauagaccccgauaguauccaguccgcacuccuggcgucuggauuaggcagcaaaaggccuuccuuuucaagcacacccgugauuaguccagccccuaacucuacgcccgcuaauuccaacaccaauagcaacucgucacugaucacuucucaggacgccguggagcgcgcacagcaaaugaagaaagaucuuuuggacaagcucgaaaagcuggcugaggaucuaccaccgaauacacuggacgaacucauugaugagcugggugggccugagaacguugccgaaaugaccggccggaaaggaagaguggugaguaaugacgauggcuccaucagcuacgagucuaggagcgaacuugacguacccgucgagauauugaacaucacagaaaagcagcgcuucauggacggggauaaaaauauugcaaucauuuccgaggccgcuucaaguggaaucagccugcaggcggaccgacgggccaagaaccaacguagaagggugcacaugacuuuagagcucccauggucugcagaucgcgcuauacagcaguuuggccggacccacagauccaaucagguuacggcccccgaauauguguuccugauuucagagcuugccggugaacaaagguuugcuaguaucgucgcaaaacgacuggagagcuugggggcccucacccauggagaccgccgggcgacagaauccagagaucugucuagguucaacuucgacaauaaguacggccguaacgcucuagagauugugaugaaaucgaucguuaaccuggauagcccuauggugucaccacccccugacuauccgggugaguuuuucaaggauguacgccagggccucauaggggucggacugaucaauguggaagaccgguccggcauucuuacuuuggauaaggacuacaacaauaucgggaaauuucugaacagaauuuuaggaauggaggugcaccagcagaaugcccucuuccaauauuuugcagacacccugacagccgucguucagaacgcuaagaaaaauggcagguacgauauggguauccuugaccuggggaguggagaugaaaaggugcgaaaaucugacguaaagaaguuccuaacuccaggcuauagcaccuccggucauguggagcucuacacgauaucagucgaacggggcaugucuugggaggaggcaacaaaaauuugggccgaacugaccgggcccgaugacggauuuuacuugagccugcagauccgcaacaauaagaaaacugcgaucuuagugaaggagguuaacccuaaaaagaaacucuuccugguguauagaccaaauacaggcaagcagcuuaagcuggaaauuuacgcugauuugaaaaagaaauauaagaaggucgugagugacgaugcccucaugcacuggcuggaccaauacaacuccagcgcagauaccugcacucaugccuauuggagggggaauuguaaaaaggcuucucuaggacugguuugcgagaucggccuucggugucgaaccuacuaugugcucugcgguucaguccuguccguauggacaaaaguggaggggguuuuggccagugugagcggaacgaacgucaagaugcagauugugagacugcgcaccgaagacggccagaggauaguagguuuaaucauucccgcaaauugugugucgccucucgucaaccugcuuucuacuuccgaucaaagccagcagcuggcuguucagcaaaaacaguuguggcagcagcaccacccgcaaucaaucacaaaccucaguaaugccuga

SEQ ID NO: 62181 - RNA, 3930 nt, Artificial Sequence
  derived and/or modified sequence opt3 from SBNO2__Homo_sapiens__NP_001093592
augagagagccccugccuggcagcgccuccugggggaccccaggaccgcccucugcugguacaaugucacagcuccaacuuuggcugcaguucgaagcauugaacaaggacaguagcuacuuugaggauuucuccaauaucucuauauuuucgucaagcguggacaguuuauccgauauugucgacacuccugauuuccugccagccgacucucuaaaccagguuagcacgaucugggaugacaaucccgcgccuuccacccacgauaaacucuuucagcugucaaggccauucgcuggcuuugaagacuuccuucccagucauagcacaccucuguuggugucuuaucaagagcaguccguacagucacagccagaagaggaggaugaagccgaggaagaggaggcagaagaacucgggcacacugaaaccuacgccgacuaugugccgagcaagaguaaaauuggaaagcaacaucccgaucgggucguggagacaucuacccuguccagcguuccuccacccgacaucacuuacacacuggcucucccuucggacucuggcgcauuauccgcccugcagcuugaagcuauuaccuaugccugccagcagcacgagguguugcugccaucaggucaacgcgcgggguuucuaaucggagauggcgcaggcgucgggaaaggacgaacgguggccgguguaauacucgagaaccaucugcguggcagaaagaaggcucuuugguucaguguuagcaaugaccugaaauacgaugccgaaagggacuugcgggauaucgaggcaacugggauugcugugcacgcccucuccaagaucaaauauggagacaccacaacuucugaaggcguccuguuugcgaccuacagcgccuuaauuggugagucacaggcagggggacagcaccgcacaagacugaggcaaauccucgauugguguggcgaggcuuucgagggcgugauaguguuugacgagugccauaaggccaaaaacgcugggaguaccaagaugggaaaggccguccuugaucugcagaauaaauugccccuagcacggguuguguacgccuccgcuacgggugcgagcgaaccgcgcaacaugauuuauaugucucgacugggcaucuggggagaggggacuccuuucagaaauuucgaagaguuucuccacgcaauugaaaagaggggcguaggugccauggagaucguggcuauggacaugaaagucucagggauguacaucgcccggcagcugaguuucagcggcgugacauuucguauugaggaaauaccccuugcaccagccuucgaguguguuuauaaccgcgcugcccuguugugggcagaagcgcucaauguguuucagcaagcugccgauuggaucggacuggaguccagaaagucuuuauggggccaguucuggucggcacaucagagguuuuucaaauaccugugcauugccgcuaagguccggaggcuaguggagcucgcccgcgaggaacuggcaagagacaaauguguaguuaucgggcuucagagcaccggagaagcuaggacucgggagguguugggugaaaacgacggccaccugaauugcuuugucuccgccgcggaggggguguuccucucacugauacaaaagcacuuuccuaguacaaagcgcaaaagagauaggggagccggcucuaagcguaaacggcgacccagaggucgaggggcuaaggcaccacgccuugccugugagaccgcuggcgucauucggaucagcgacgauuccucaacggaaagcgaccccggacuggauucugacuucaacuccaguccugagagcuugguggaugacgauguugugaucguagacgccgucggccucccaucugaugacagagggccgcugugcuuacugcagagggauccccauggaccuggugugcuagaacgcguugagcgacucaaacaggaccugcuugacaaggugcggcguuugggcagagaacugccagucaauacccucgaugagcugauugaccaguuagggggaccccaaaggguggcagagaugacaggccgcaagggucggguaguguccagaccugaugggacuguugcguuugaaucaagggccgagcagggccugaguaucgaccacgucaaccuucgagaaaaacagcgcuucaugagcggagagaaguugguggcuauuauaucggaagccuccucuagcggcgugucacuccaggcagaucggagaguccaaaaccagaggcgucgcguucauaugacccuggagcuaccauggagugcugaccgggccauccagcaauucgggagaacacacagguccaaucaggugucugcacccgaguauguguuucugauuagcgaacucgccggagagcgacgguucgcuuccaucguagcgaaacgccuggaaucacuuggcgccuugacucauggugauagaagggcaaccgagagccgggaccugaguaaguacaacuuugagaauaaauaugggacacgagcuuuacacuguguccucaccacuauccugucucagacggaaaacaaggugccgguuccucagggauacccaggcggugugcccacauucuuuagagauaugaagcaaggccuucuguccgucgggauuggaggccgcgagagcaggaaugggugcuuggacguggaaaaagauuguucgauaaccaaguuccucaaccguauccugggacuagagguucacaaacagaaugcccuguuucaguacuucucagacacuuuugaucaucucauugaaauggacaagcgggagggcaaauaugacauggguauccuggaucuugccccugggauugaggaaaucuacgaggaaucucagcaaguguucuuggcucccggacacccacaggacggccagguagucuuuuauaagauaaguguggauagaggucugaagugggaggacgcauucgccaaauccuuagcgcucaccggcccuuacgauggguuuuaucugagcuacaaggugaggggaaacaaacccucuugccuucuggcugaacagaaucgcggccaauucuucacagucuauaagccaaacaucgggcgacagagccagcuagaggcccucgacucccugagacggaaauuucauaggguuaccgcagaggaagccaaggagccgugggaaucaggauacgcuuugagucugacucacugcagccacucugcauggaaucgccauugucguuuagcccaagagggcaaagauugccuccagggucugagacuucggcaccauuacaugcuguguggggcguugcucaggguguggggacgcauugcugccguaauggcagacguguccucaaguagcuaucugcagaucguccgacuaaagacaaaggauagaaagaaacaggugggcauuaaaaucccugaagguugcguucggagggugcugcaagagcuucgccucauggacgccgaugucaagagaaggcaggcucccgcccugggcuguccagcacccccugcuccacggcccuuggcccugccuugcgggccgggagagguguuagaccucacguacuccccacccgcggaagccuucccuccacccccucacuuuucuuucccggcaccccugucgcuugacgcuggcccagggguugugccucugggaacccccgaugcccaggcugacccagcagccuuggcccaucagggcugugauauaaacuuuaaagagguccucgaagacaugcugcguagccuacacgcugguccucccucagagggggcgcugggagagggcgcaggcgccgggggagcugccgguggcgggccagaacgccaauccguaauucaguucaguccgccuuuucccggagcacaggccccacuuuga

SEQ ID NO: 62182 - RNA, 1773 nt, Artificial Sequence
  derived and/or modified sequence opt3 from SBSN__Homo_sapiens__NP_001159506
augcaccuggccagacucgugggcagcugcucccuucuguuguuacugggggcucuaucuggaugggcagccucagacgaucccaucgagaaggucauugaagguauaaacaggggccucaguaaugcggagcgggaaguugggaaagcucuggacggaaucaacagcggcauuacccaugccggucgcgagguggaaaagguauucaaugggcuuuccaacaugggaucucacacaggcaaagagcuggauaagggcgugcagggguugaaucauggaauggacaaagucgcacacgagaucaaccaugguauuggccaggccgggaaggaagcugagaagcucggacacggcgugaauaacgcagccggucagguugggaaagaagcugauaagcugauccaccauggagugcaccauggcgccaaucaggcgggcucggaggcagggaaauuuggacagggugucgacaacgccgcuggccaagccgggaaugaggcaggacgauucggccagggugugcaccacgcugccgggcaggcgggcaacgaagccggacguuuuggccaggggguacaucacgcagcuggacaagccgguaaugaggcuggcagauucgggcagggagcccaucacggccugucagaagguuggaaggagacugaaaaauuugggcagggcauacaucacgcagccggacagguuggcaaggaggcugagaaguucgggcaaggagcgcaccaugcagccggucaggcuggcaacgaagccgggagguuuggacagggcgugcaccauggucucagcgagggguggaaagaaacggagaaguucggccaaggaguccaccacaccgcaggccagguggggaaagaagccgagaaguuuggacagggcgcucaucacgccgcaggucaggcggggaaugaggcuggacgguucggccaaggugcccaucacgcagccggccaggcugggaacgaagccggacgcuuuggccagggggugcaucacggauuaagugagggcuggaaagaaacagagaaguucggucaggggguccaccaugcagcuucccaauuuggaaaagaaacugagaagcugggccacgguguucaucacggcgugaacgaggccuggaaggaagcggagaaauucgggcagggaguacaucacgccgcuucucaggugggcaaggaagaggauagagucgugcaggggcuucaccauggaguuagccaagcaggcagggaggccggucaguucgggcacgacauccaucacaccgcuggacaggccggcaaagaaggugauauugcagugcacggcguccagccuggggugcaugaggcgggaaaggaagccggccaauuugggcagggaguacaccauacauuggagcaggcuggcaaagaagccgacaaggcaguucaagguuuccacaccggggugcaucaggcuggaaaggaggccgagaaacugggccagggcgucaaucacgcagccgaucaggcugggaaggaaguggagaaacuaggacaaggugcgcaccaugccgcaggccaggcugggaaggaacuccagaacgcccacaauggagucaaccaggccuccaaagaggcuaaucaacugcuuaacggcaaucaucagucagguaguagcucucaccaagggggagcaacuacaaccccacuggccuccggcgcgucagugaacacgccguuuaucaauuugcccgcucucuggcggagcguugccaacauuaugccuuga

SEQ ID NO: 62183 - RNA, 900 nt, Artificial Sequence
  derived and/or modified sequence opt3 from SC5D__Homo_sapiens__NP_008849
auggaccuggugcucagagucgccgauuacuauuucuuuacccccuacguuuauccugcuacauggccagaggacgauaucuucaggcaggcaauuagccuucugauagugacuaacguaggcgccuacaucuuguauuucuucugcgcgacguuauccuacuauuuuguguucgaccacgcucugaugaagcauccgcaauuucucaaaaaucagguccggcgcgaaauuaaguucaccgugcaggcccuacccuggaucucuauucugacaguugcacuuuuucuguuggagauccgaggguacucaaaacuccacgaugaccugggagaauuuccuuacggucuguuugagcucguggucaguauaaucagcuucuuauuuuucacugauauguucauuuauuggauccaucguggccugcaccauagacuuguguacaagagguugcacaaaccacaccauauuuggaagauccccaccccuuuugccucccacgcuuuccauccaauagacggguuucugcagucucuacccuaucacauuuacccuuucaucuuuccacuccacaagguaguuuaucugucgcuuuacauucuggugaacaucuggacaaucucaauucaugauggagacuuccgggucccgcaaauauugcagcccuuuaucaauggcagcgcacaccauaccgaucaccauauguucuuugacuauaacuacggucaguacuucacucucugggaucgcauugggggaaguuuuaaaaauccuuccucuuucgaaggcaagggcccacugagcuaugugaaagagaugacagaggggaagagauccucacacaguggaaacgguuguaaaaaugaaaaguuauuuaacggcgaguucaccaagacggaauga

SEQ ID NO: 62184 - RNA, 4392 nt, Artificial Sequence
  derived and/or modified sequence opt3 from SCAF11__Homo_sapiens__NP_004710
augaagaaaaagaccgugugcacacugaacaugggcgacaaaaaguacgaggauauggaaggggaggaaaauggagacaacacuaucagcacgggucuccuuuauuccgaggccgauagaugucccauuugccugaauuguuuguuagaaaaagaggucggcuucccugagucuugcaaccacguguuuuguaugaccugcauacugaagugggcugaaacacuagcaucauguccaaucgacaggaagccguuccaggccguguuuaaauucagugcgcucgagggguacguaaaggugcaagucaaaaagcagcugcgggaaacuaaagauaagaagaaugagaacagcuuugagaaacagguguccugccaugaaaauucuaagucguguauucgccgaaaagcuaucguucgugaggaccuucugucagccaaggugugcgauuugaaauggauucacagaaacagccucuauagugaaaccggaggcaagaaaaaugcagccaucaagauaaacaagccccagagguccaauuggucuacaaaccaauguuuccggaacuuuuucagcaauauguuuuccucagucagucauagcggugagucuuccuucaccuaccgcgcuuauugcacugaauuuaucgaggcaucagagauuagcgcccugaucagacagaaaaggcacgaacuggagcucaguugguucccugacacauuaccagggauuggacggaucggcuuuauacccuggaauguggaaaccgagguacugccucuuauuucuuccguuuugccacgcacgaucuuccccacuagcaccauuucguucgaacauuuuggcacaucuugcaagggguacgcucuggcccacacucaggagggagaggaaaagaagcagaccuccgguacaucaaacacccgaggcaguagaaggaaaccugcgaugacgacuccaacacggcguagcacccgcaacacuagagcagagacagccucccaaucucagaggagcccgaucucagauaauagugggugugacgcucccggaaacuccaauccuagccuaucugugccaucaagugccgaaagcgagaagcagacccggcaggcacccaagcgaaaauccguccgcagaggcaggaagccuccacuccugaaaaagaaacuucggucuucgguggcugcccccgaaaagagcuccucaaacgauaguguggacgaggagacggcggaaucugauaccagcccgguccuggagaaggaacaccaaccugacguugacuccucaaauaucugcacagugcagacucauguagagaaccagagcgccaauuguuugaaaucuugcaacgagcaaauugaagaguccgaaaagcacaccgcaaauuaugauacagaggaacgcguggguaguucuagcuccgagucaugugcucaggaccuccccguccuggugggggaggaaggagagguuaaaaaguuagaaaacacuggcauagaggccaaugugcugugccucgaaagugagaucagcgagaacauucuugaaaaaggcggggauccacuggagaagcaggaccagaucucgggauugucccaaucugaagucaagaccgauguguguacaguacaucuaccuaaugacuucccaaccugccugacuagcgagucaaaaguuuaccagcccgugaguuguccccucuccgaucugucugaaaacgucgagagcguggucaaugaggaaaagauaacggaguccucacuuguggaaauuacagagcacaaagacuuuacccugaagacugaggaauugaucgagagcccuaaacucgaaaguucugagggugaaaucauucagaccguugauagacaguccguuaagagcccagagguacaacuguuaggccacgucgagacagaagacguggagaucauugcuaccugcgauacuuucgggaacgaagacuuuaacaauauacaggacucggagaacaaucugcucaaaaacaaucuccugaacacaaaacuugaaaagucauuggaggagaaaaaugaaucucugacggagcauccgaggaguaccgaacuccccaagacucacaucgagcagauucagaaacauuucuccgaagauaacaaugagaugaucccuauggagugugacagcuuuugcucugaucaaaacgaaagcgagguugaaccauccgugaaugccgaccugaagcagaugaacgaaaauucagucacacacugcagugagaacaauaugcccagcucugaucuugcagacgaaaaaguggagaccguaucccagccuucagaaaguccaaaggauacaaucgacaagacuaaaaagccccguacccggcgaagcagauuccauuccccgucuacgaccuggucgccuaacaaagauacaccacaggagaagaaaaggccccaaagcccuucaccccgccgggaaacuggaaaggaguccagaaagagucagucuccaagcccuaaaaacgaguccgccaggggccgcaagaaaucacgaucucagagccccaagaaagacauugcucgggaacguagacaaagucaguccaggagcccaaagcgcgauaccacacgggagucuagaaggucagaaucccugaguccgcgacgcgagacuagccgggaaaauaagagaucgcagccuagggugaaagacucuucccccggugaaaagagccguucacagagucgcgagcgggaaucugauagagacgggcaaaggcgagagcgggaacgcagaaccaggaaauggucccggagccgaucacacaguagaagcccaucccgcuguaggacgaagucuaaaagcuccucauuuggccguauagaccgggauucuuacagucccagauggaagggaaggugggcgaacgacggcuggcgcugcccucgagggaaugauagauaucggaaaaacgacccagagaagcagaaugaaaacacaaggaaggagaaaaaugauauccacuuggacgcagaugaccccaacucggccgauaagcaucgcaaugacuguccuaacuggauuaccgagaaaaucaauagcggaccggauccacguacuagaaaccccgaaaagcucaaagagucccacugggaagagaaucggaacgaaaauucugguaacucauggaacaagaauuucggcagcggguggguuuccaacaggggacgcggccgagguaauagagggcggggcacauacaggaguucuuuugcuuauaaggaccagaacgaaaaucgcuggcagaacagaaaaccucugagcggaaauucaaacuccaguggcagcgagucuuucaaguuugucgaacaacaguccuacaaaaggaagucagagcaggaguucagcuucgauaccccagccgaccggucgggguggacuucugcaaguuccugggccgugcguaaaaccuuacccgcugacgugcagaauuauuacagccgccgaggaagaaacucauccgguccucaaucuggcuggaugaagcaggaggaggaaacaagcgggcaggauaguucccugaaggaccaaacgaaucagcaggucgauggaagccagcuaccgauuaacaugaugcaaccccagaugaauguuaugcagcagcaaaugaacgcccagcaucagccaaugaauaucuuuccuuaucccgugggcgugcacgcaccacucaugaacauacagaggaauccuuucaacauccacccccaacugccacuucauuugcacaccgguguaccgcugaugcaggucgcgacuccuacaucugugucacaggggcuacccccacccccuccacccccuccgccaagucagcaaguuaacuacauugcuucccagcccgacggcaaacagcugcaaggaaucccuucuagcucgcaugugucaaauaacaugagcacccccgucuuaccagccccuacagcagcccccggcaauacugggauggugcagggaccauccaguggcaacaccucuagcuccucacacaguaaggcuucuaaugccgcaguuaaacuggcugagagcaagguguccguagccgucgaagcgucagccgauagcucuaaaacggacaagaaacuucagauucaggagaaggcugcacaagaagugaaguuggccaucaaaccuuuuuaccagaacaaggauauaacaaaagaggaguauaaggaaauugugcggaaggcugucgacaaaguuugccauuccaagaguggugaggugaauagcaccaaaguagccaaccucgugaaggcauacgucgauaaauauaaguacucgcgcaaagggucccagaagaagacucuggaggagccggugucuaccgagaaaaauaucggauga

SEQ ID NO: 62185 - RNA, 3939 nt, Artificial Sequence
  derived and/or modified sequence opt3 from SCAF1__Homo_sapiens__NP_067051
auggaggaagaggacgaaagccgcggcaagaccgaggaauccggggaggauaggggagacggucccccugaucgggacccaacacugucuccgucagccuucauccuccgcgcuauucagcaagcagugggcaguagccuucagggggaucugcccaacgacaaagauggaucccgaugccacggcuugcguuggagaaggugucggucuccucgcucggagccaagaucacaggaaagcggugggacugacacggccaccgucuuagauauggcgacagacaguuuucuggcuggccuaguuuccgugcucgaucccccugacacuuggguaccaucuaggcuggaucuucggcccggcgagagcgaagacaugcuggaguugguggccgagguccgcauaggcgaccgagauccuaucccacucccggugcccucccugcugccuagacucagggcauggcggaccgggaagacaguuucaccacagaguaauagcucucguccaaccugcgcccgccauuuaacucugggaacaggugacggcgggccugcuccacccccggcaccuuccucagccagcaguucucccuccccaagcccuucgucuuccucacccaguccacccccuccaccgcccccuccagcucccccugccccacccgcgccgagauucgauauuuacgacccuuuucacccaaccgaugaagcauauucacccccucccgccccagagcaaaaauacgacccuuucgaacccacgggauccaacccaucuagcucagcuggcacuccgaguccugaggaagaggaggaagaggaagaggaagaggaggaagaggaagaggaugaagaggaggaagagggucuuucccagagcaucucuaggauuucagaaaccuuggccgggaucuaugacgauaauagucugagccaggacuuucccggagaugaguccccacggcccgacgcacagccuacacaaccaacucccgcuccuggcaccccgccacagguggacucuacacgagccgauggcgcgaugcgcagaagggucuucgugguagggaccgaggccgaagcaugucgggagggaaagguuucgguggaagucgugacggcugguggcgccgcucuacccccuccacuccugcccccuggggacagcgagauagaagagggagagaucgugcagccggaagaggaaccccgccuugcccuguccuuguuuagaccaggcgguagggcagcccguccuacucccgcugcgucagcaacaccaaccgcccagccucucccccaaccaccggcuccucgggcccccgagggggaugacuuccugaguuuacaugcagaaucugauggcgagggagcccugcaggucgaccucggcgagccagcucccgccccuccagcagcggauagccgauggggagggcuugaccugagaaggaaaauuuugacucagcgccgggaaagauacaggcaacgcucccccagcccugcuccggccccagcacccgccgcugccgcagguccucccacacgaaagaaaagccggcgugagagaaagaggucuggcgaagcuaaggaggccgcguccaguagcucugggacccagccagccccucccgcuccagcauccccuugggauagcaaaaagcaccgcagucgggacagaaaaccgggaagccaugccucguccucugcuaggcgacgcagccggucaagaaguaggucccguucuacgcgccggagaagcagguccaccgaucgacggcgcggcgguucaagaaggagccggagucgagaaaagagacgcaggcgucggagaucugccuccccuccacccgcaacaagcucgucaucuaguuccaggcgcgagcgacacagagggaagcaccgggacggcggaggcagcaaaaagaaaaagaaaaggucucgcagccguggggagaagagauccggagaugguucagaaaaagcgcccgcccccgcuccucccccgaguggcagcacuucuugcggggaccgggacuccaggcgccgaggagccguuccaccuucaauccaggaucuaaccgaccaugaucuguuugcaauuaagagaacaaucacugugggccggcucgacaagagugaucccagggguccaagccccgcuccugccuccucuccgaaacgcgagguacuguaugacucggaagggcuuagcggcgaggagagaggaggcaagucaucccagaaagauaggcggcguaguggggcagccucuagcuccucaucuagccgcgaaaagggaagucgaagaaaagcucuggacggcggugauagggaccgggaucgcgacagagauagggaccgggaccgauccagcaagaaggcgagacccccaaaagagucugccccuucauccgggcccccuccaaagcccccugugaguagcggaucgggaucuuccagcucaaguucuuccuguagcucacgcaaagucaaguugcaaaguaaaguggcaguucucauaagggaaggugugagcuccaccacaccagcuaaggaugccgccucugcuggccuggggagcauuggagucaaguucucccgggaccgugagucaagaucucccuuuuuaaaaccggaugaaagggcaccuaccgagauggccaaggcggcuccaggcaguacuaaacccaagaaaacgaaggugaaggccaaagcaggggccaagaaaacaaagggaaccaaaggcaagacuaaaccuucgaagacccgcaagaaaguacggagcggugggggauccggcgguucuggcgggcagguuucacugaagaaaagcaaggcugacuccugcagucaggcagccggaacaaaaggcgcggaggaaaccucuuggagcggggaggaacgagcugccaaggugccaucaacucccccgccuaaggcagcucccccaccucccgcccuaacaccagauucccagacggucgacaguagcuguaaaacccccgaggugucuuuccucccugaagaggccacugaggaagcaggagucagaggcggugcugaggaagaggaagaggaggaagaggaagaggaggaagaggaagaggaagaggagcaacagccagccacaaccacagcgacuuccaccgccgcagcugccccgucaacggcucccagcgcagggucgaccgccggagauucuggcgccgaagacgguccugcuaguagggugucccagcugccaacacuucccccuccaaugcccuggaacuugccugcgggcguugauugcacuaccagcggggugcuggcacucacagcccugcuuuuuaagauggaggaagcuaaucuggccucacgcgcaaaagcccaggaguugauccaagcuacuaaccagauucucucccaccggaagccgccaucuagccugggaaugacccccgcgccuguacccacgaguuuaggccugccaccugggcccuccagcuaccuacucccaggaucucugccgcuuggcgguugugggucaacaccucccaccccaacuggauuggccgcaacaagugacaaaagagaaggcuccucaucuucggagggccguggggauaccgacaaguaucugaagaaacuccauacucaggagagggcugucgaagaggugaagcuggccaucaaacccuacuaccagaagaaagacaucaccaaggaagaguauaaggauauuuuacggaaagcaguucacaagauaugccacucaaaaagcggagaaaucaauccugugaaggucuccaaccuggugcgcgccuacguacaacgauauagauacuucaggaaacauggucggaagccaggcgaucccccugggccgccaagacccccuaaagagccaggacccccugacaagggcggucccgggcuuccauugccgccucucuga

SEQ ID NO: 62186 - RNA, 3399 nt, Artificial Sequence
  derived and/or modified sequence opt3 from SCAF4__Homo_sapiens__NP_001138916
auggacgccgugaacgcuuucaaucaggagcuguuuagccucauggauaugaagcccccuaucuccagagcaaaaaugauucuuauaaccaaggccgcgaucaaagcuauuaagugcaaaccagaauacaaggucccgggccuguauguuaucgacucuauugugaggcaaucacggcaccaguucgggacagauaaggacguauuuggaccccgcuucaguaaaaacaucacugccacguuucaguacuuguauuuauguccuagcgaggauaaguccaaaauagugcgaguccugaaucuauggcagaagaacgguguguucaaaaucgaaauuauccaaccacuccuggacauggcagccggcaccucuaaugcugcacccguugccgagaacgugacaaauaacgaagggucgccuccacccccugucaaggugucaagcgagccaccgacucaggcuacccccaauaguguaccugccguuccacagcuucccuccucugaugcguuugcagccguggcucagcuguuccaaacaacccagggacagcaguugcaacagauucuccagacuuuucaacagccuccaaagccccagagcccggcccuggacaacgcagucauggcucaggugcaagccaucacagcgcagcugaaaaccacgccuacucagcccuccgagcagaaggccgcauucccaccucccgaacagaaaaccgcuuuugauaagaaacucuuagaccguuucgauuacgacgaugagccagaagccguggaggagucaaagaaagaagacacaacugcugucaccacaaccgcccccgcagccgcuguuccuccagcgccgacggcaacugugcccgccgcugccgcacccgccgcugccaguccacccccuccacaggcacccuuuggcuucccgggugacgggaugcagcagccugcguauacacaacaucagaauauggaucaguuccagccaagaaugaugggaauacaacaggaccccaugcaccaucagguaccucugcccccaaacggccaaaugccuggcuuugggcuuuugcccaccccaccguucccucccauggcucagccagugauucccccuacuccacccguccagcagccuuuucaagccagcuuccaggcacagaaugagccgcugacacagaagccacaccaacaggaaauggagguggaacagcccugcauccaggagguuaagaggcauaugucugauaaccggaaaucccgcucaagaagcgccaguaggucuccuaagcggcgccgauccagaagcggaucgaggucucggcguucccgccacagaaggucacggagucgaagccgcgacagaaggcggcacuccccacgcucuagaagccaagagaggcgugaucgggaaaaagagcgagaaagaaggcagaagggucuaccccaggugaaaccugagaccgcuucagucuguaguacgacccucugggugggccaacuggacaagcgcacaacucagcaggauguagccucccuucuggaagaguuugggccgauugagagcaucaauaugauucccccacggggaugcgcauacaucguuauggugcauagacaggacgcuuauagggccuugcaaaagcucucucgcggcaacuacaaagucaaccagaagucaauaaaaaucgcgugggcccugaauaaggguauuaaagcugauuacaagcaguauugggacguggaauuaggggucaccuacaucccuugggauaaggugaaacccgaggaacuggagaguuucugugaaggaggcaugcucgacagcgacacacuuaacccagauuggaagggcauaccuaaaaagcccgagaaugagguugcacagaacgggggagccgaaacuucccacaccgagccagugucuccgauuccuaaaccccugccaguacccgucccuccaauccccgugccugcuccgaucacaguuccacccccucaagugcccccacaucagccuggucccccagucgugggcgccuugcagccuccggcauuuaccccuccacuagggauuccucccccaggauucggcccugguguacccccgccaccucccccacccccuuuucugcgaccgggguucaaucccaugcaccucccaccuggcuuucugcccccuggaccacccccuccaaucacucccccggugucgauuccuccaccccacacgccuccaauaagcauccccaacuccacaauugcgggcaucaaugaagacaccacuaaggaucuuucaaucgggaacccgauuccuaccguugucaguggagcccgggguaaugcugagucuggcgacagcgugaagauguauggguccgccgugcccccagcagcuccuacaaaccugcccaccccacccgucacucagccuguuucauugcucggaacacaaggcguggccccagguccggugauagggcugcaggcacccagcacgggcuuacugggagcccguccuggccuaaucccacuccagagacccccugggaugccacccccucaucugcagagguucccgcuuaugccaccccgcccuaugcccccacacaugaugcaucggggaccucccccagguccgggcggguuugcuaugccucccccacacggaaugaaaggccccuucccuccacauggucccuucguaagaccugggggcaugccgggauugggcgggccaggacccggcccuggugggccagaggauagggacggacgacaacagcccccucagcaaccccagcagcagccacaaccgcaggcgccucagcagccccaacagcagcagcaacagcagccaccucccucucaacagccaccucccacccagcagcaaccgcagcaguuucgcaaugauaaccggcagcaauucaauuccggcagagaccaggaaagguuuggucgucgcaguuucggcaaccgggucgagaaugauagagaaagguacgggaaccgaaacgacgaucgggacaauagcaaccgcgauagaagggaguggggacggcgaucuccagacagagaccgccacagggaucuggaggaacguaaucggagauccucaggccacagggaccgcgagcgagauaguagagaccgggaaagcaggcgcgagaaggaagaggcccgugggaaagaaaagccugaggugacugauagagcaggaggcaacaaaacaguugagcccccaauuucgcaaguggguaaugucgacaccgcuuccgaacucgagaagggggugucugaagccgccguucugaaacccagcgaggaacuuccugcugaggcaacaucaaguguggagccggaaaaggauuccggaucugccgcggaggcuccacgguga

SEQ ID NO: 62187 - RNA, 4014 nt, Artificial Sequence
  derived and/or modified sequence opt3 from SCAF8__Homo_sapiens__NP_001273118
augccccagccucugcucccagcccuuccgccccugagcuccccuucuggcgcugggucaugcggaccaagugguggcgaguguagcgggagaagguuguuccggcgccgagcacguggauuaagauccgacaacauggaagccgugaagaccuuuaauucugaggauugcgcgucgacacccgcuuguacugacugcuucucaagcaguauggauacgagguccauccuguacucucuaaacgacuauaaaccuccaauuagcaaggccaaaaugacccaaauaacaaaggcagccaucaaagcuauuaaguuuuacaagcacgucguucaguccguggaaaaauucauccagaaguguaaacccgaguauaagguaccuggccucuacgugauugauucaaucguccggcagagucgccaucaauuuggucaggaaaaagacguguucgcaccaagauuuagcaauaacauaaucucuacuuuccagaaucuguauaggugcccgggggaugacaaguccaagauuguucgggugcuuaaccuguggcagaaaaauaacgucuuuaagucagagaucauucaacccuugcucgauauggccgcuggaaucccuccacccgugguaaccccuguucuggccagcacaaccacugcgaugaguaauacaccaggcacccccgugacgccggucacuccugcaaacguggugcagggccugcccgacccaugggucucucagauaaccaauacagauacucucgccgcuguugcccagauuuuacaauccccucaggggcagcaacugcagcagcuuauccagaccuugcaaauucagcagcagaaaccccaaccaagcauccugcaggcacuagacgcuggacucgugguacagcugcaggcccuuacagcgcaacugaccgccgcagcugccgcugccaacacguugacuccccucgagcagggugugucguucaauaagaaacugauggaucgcuuugacuucggcgaagacucugagcacuccgaggaaccuaagaaagagaucccagcaucacaguuaagucaugucagcgaauccgugaacaauucuauuuuucaccagauagccgagcaacugcagcagcaaaaccucgaacaucuucgacagcagcuguuggagcagcaacagccgcagaaggcuacaccccaggauagccaagaagggaccuucggaucagagcacagugcguccccuagccagggcaguucacagcagcacuuccuagagccagaaguuaaccuggacgauaguaucgacauucaacagcaggauauggacaucgaugagggucaagacgggguggaagaggaagucuuugagcaggaggcaaagaaaguggccguaagaagcaggucccggacucauucucguucgcgcagcagaucccccaggaagcggcgaucacgcaguagaucuggaagcaggaaacggaagcaccgcaaaagauccaggucacguagccgggaacgaaagagaaagucuuccaggaguuacagcucugagcgccgggcuagagaaagggagaaagaacgccagaagaaaggccucccuccaauacgauccaagacacugucaguuuguaguaccacgcuuugggugggccaggucgauaaaaaggccacccaacaggaccugacaaauuuguucgaggaguuugggcagauugaaagcaucaacaugauucccccgcggggaugcgcauauguguguaugguccaucgucaggaugccuucagagcucuccaaaagcugucguccgguucuuacaaaaucggcagcaaggugaucaaaauugccugggcauuaaauaaggggguuaaaacugaguacaagcaguuuugggacguggaccugggaguaaccuauauaccuugggaaaaggucaaaguggaugaccuagagggcuucgcggagggugggaugaucgaucaggaaacaguuaacacugagugggaaaccgugaagucaagugagccagucaaagaaacagugcagaccacucaaucccccacgccuguagagaaggagacagugguuaccacucaggcugaagucuuucccccaccuguggccaugcuccagauucccguggcaccagccgucccgaccguuucucuggugccucccgcuuucccagugagcaugcccguaccuccacccggcuuuuccccuaucccgccacccccuuuccuuagggccucauuuaauccaagccagcccccuccgggauucaugcccccaccugugcccccaccugucguucccccaccgacaaucccucccguggucccaaccaguuuggugcaacccucucuguccaugacuccugagacaguuaaagacgugggcuuugggagccucguaauuccaggagguucggucgcaucaaaccuggcuacgucugcccuucccgcgggcaauguguucaacgccccuaccaagcaggcugaaccggaggaaaaagugccacaccugauagaucaccagaucaguuccggggagaauacucgcagcgucauucccaacgacaucucuagcaaugcagccauuuugggaggccaaccucccaacguuacauccaauucagguauccucggggugcagcggccaaacguaaguagcaauucugagauacugggcgugagaccuuccaacgucucaaguagcuccggaaucauugcugcccagcccccaaacaucuuaaauaacucuggcauucuggggauccagccuccgucggugagcaauucauccggacuacucgguguucugcccccaaacauaccuaauaacaguggccuuguggggguccaacccccaaaugugccuaacacccccggauugcugggcacacagccgccagcagguccucagaaucugcccccacucucuauucccaaccagaggaugccuacuaugccgauguuagauauccgacccgggcugauuccacaagcgccuggcccccgcuucccucuuauccagccaggaauacccccucagcggggcaucccacccccgagcguuuuggacuccgcccuccauccuccacccagagggccuuuuccacccggagauauuuucucacagccggaaaggccuuuucuggcucccggccgucaaucuguggacaaugucaccaacccagagaagcgcaucccucuagguaaugauaacauucagcaggaaggggaccgggauuacagauuucccccaaucgagacgagggaaagcauaagucgacccccuccaguagacgugcgggacguugugggacgcccgauugaucccagagagggcccugguaggccaccccuggacggccgggaucacuucgggcgaccuccagucgacaucagagagaaucucgugcgccccggaaucgaucaucugggcaggcgugaccacuucggguuuaacccugaaaagccguggggacaucggggcgauuucgacgagagagaacacaggguacuuccaguguauggugggcccaaaggauugcacgaggagcgcggccgauuuagauccgguaacuaccgguucgauccuaggagcggccccuggaaucgcggguuuggacaagaaguccaucgugacuucgaugacagacggaggccaugggagcgccagcgagauagagacgaccgggauuuugacuucugcagggaaaugaacggcaaucgccuggggagagauaggauucagaacaccuggguuccucccccacacgcccggguguucgacuauuuugagggagcaacaucucagcguaagggcgauaaugugccgcaagucaacggugaaaauacugagcgccaugcucagccucccccaauccccgugcagaacgacccugaguuauacgaaaaacucaccucauccaaugagauuaacaaggaaaaaucugauacaguugccgacauagagagcgaaccaguaguggagucgacugagaccgaagggacguga

SEQ ID NO: 62188 - RNA, 1821 nt, Artificial Sequence
  derived and/or modified sequence opt3 from SCAI__Homo_sapiens__NP_001138349
auggugagaggcgccaggcagccccaacagccucggagccgccuggcuccacgacucaccgggacagucgagaagccgccccguaaaagaaggucccggacugaauuugcacuuaaggagaucaugucuucaggaggugccgaagacgauauuccucagggcgagcgcaaaacgguuaccgacuuuugcuaccuguuggauaagaguaaacaguuauucaacgggcugagagaccuaccacaauauggacagaagcaguggcagagcuacuuuggcaggacauucgauguguauacuaagcucuggaaauuucaacagcagcaccggcagguacuggacaaucgcuacggucuuaagcgauggcaaauaggggaaaucgcguccaaaauuggacagcuguauuaccauuauuacuugagaaccucugagacaucguaccucaacgaggcuuucucauuuuauagcgccaucaggcagcggaguuacuauucccaagugaauaaggaagaucgucccgagcuggucgugaaaaagcugcgcuacuaugcaagauucauuguugugugucucuuacugaacaagauggacgucgugaaagaucuuguaaaggaauugucugacgagaucgaggauuacacccacagguuuaauacugaagaccagguugaguggaaccuggugcuacaggaagucgccgcuuucauagaggcagauccugugauggugcucaaugacgacaacacaaucgucauuaccagcaaucggcuggccgaaacgggcgcuccacuucuggagcagggcaugaucguugggcaauugucccucgccgaugcgcugauuaucggaaacugcaauaaccaggugaaauuuucagaguuaacuguagacauguuccgaaugcugcaggcacucgaacgcgagcccaugaaucuugccagucagaugaacaagccugguaugcaagaaagcgcugauaaaccaaccagaagggagaauccgcauaaguaucuguuguacaaacccacauuuucucagcuauacacuuuccuggccgcauccuucaaggaacucccugcuaacucagugcugcuuauauaucugagcgccaccggcgucuuuccaacagggcggagugacucugagggacccuacgauuucggcgguguguugaccaacuccaaucgcgacauuaucaacggggaugcgauucacaagagaaaucagagccauaaagagaugcacugucuccacccuggagaccuguauccauuuacgaggaagcccuuauucaucaucguugauucgucuaacuccguggccuacaaaaauuuuacuaaccuguucggccagccgcuagucugccuccugucaccuacagcauaucccaaggcccuucaagaccagagucagcguggcagcuuguuuacccuguuccucaauaacccacugauggcuuuucuuuucguguccgggcugucuagcaugcggcgaggauugugggaaaaaugucaggaguaccucagaaagauuaauagggauauagcucaacuguuaacucauucacgcaguaucgaccaggccuuucugcaguucuuuggugacgaguuccuacggcuccugcuuacaagauucauuuucugcuccgcaaccaugaggaugcacaagaucuuccgcgaaacgcgaaacuauccugaaagcuacccccaauugccacgggaugagaccguagagaauccccaucugcagaaacacauacucgaacuggccucuauuuuagacguucguaacguguuuuucgagaauacaaucgaugacuacuga

SEQ ID NO: 62189 - RNA, 990 nt, Artificial Sequence
  derived and/or modified sequence opt3 from SCAMP2__Homo_sapiens__NP_005688
augagcgccuucgacaccaaccccuuugcugauccuguggacgucaauccauuccaggauccguccguuacacaacugacuaacgcaccccagggcgggcucgccgaguuuaauccuuucucugaaacgaacgcggcuaccacagugccaguaacucagcuucccggaucaagucagccugccgugcugcaaccaagcgucgagcccacccagccuacaccacaggcagugguuuccgccgcucaggcagguuuguuaagacaacaggaggaacuggacaggaaggccgcugaacuagagcggaaagagcgcgaacuccagaauaccguggccaaccugcacguccgacagaauaacuggccgccccuuccuucuuggugcccagugaagcccuguuuuuaccaagauuucucgacugagaucccugcggacuaucagcguauuugcaaaaugcuguacuauuuguggaugcuccauucaguaacacuguuucugaaucucuuagcaugucuggccugguucagcggcaacaguuccaaggggguugauuuuggacuuucuauauugugguuccugaucuuuaccccaugcgcuuuccuauguugguacagacccauuuauaaagccuuuaggagcgacaauuccuucucauucuuuguguucuuuuucgucuuuuucugccagaucggcauuuacaucauacaacucguggguaucccggggcugggagauaguggcuggauugcagcucuuagcacgcuggacaaccacucuuuggccaucuccgugauuaugauggucguugcgggcuuuuucacucucugugccgugcugucaguauuuuuacugcagcgggugcauagccucuaucgcagaaccggggcaaguuuccagcaggcucaagaagaguuuucucagggaaucuucuccagcaggacauuucaccgggccgcuucgucugccgcacagggugccuuccagggcaauuga

SEQ ID NO: 62190 - RNA, 762 nt, Artificial Sequence
  derived and/or modified sequence opt3 from SCAMP5__Homo_sapiens__XP_006720483
auggaguucagaaccaagaggugcggccaggccacagggcccgcuggaaacaucauggcagaaaaagugaauaacuuuccuccacugccgaaguucauuccccucaaaccuuguuuuuaccaagacuucgaggccgauauaccaccccagcacgucagcaugacuaagcggcuuuauuaccuguggauguuaaauuccguuacguuggcggugaaccugguagguugccuagcuuggcucaucggcgggggaggcgccaccaauuuuggucuggcauuccuuuggcugauuuuguuuacaccuuguucuuaugugugcugguuccgcccaaucuacaaagccuuuaagacugacucaaguuucagcuuuauggcuuucuuuuucaccuucauggcacagcucgucauuuccaucauacaggccguggggauccccggauggggcguuuguggcuggauugcuacaaucucguuuuucgggaccaacauuggaucugccguggucaugcugaucccuacugugauguuuacaguaauggcgguuuucucauuuauagcacugagcauggugcauaaguucuaucgagguaguggcggguccuuuucuaaagcccaagaagaguggaccacgggagcuuggaagaauccacacguccagcaggccgcacagaacgcugccaugggcgcggcccaaggugcaaugaaucagccgcagacucaguacagcgcuacccccaacuauacauacuccaaugaaauguga

SEQ ID NO: 62191 - RNA, 3465 nt, Artificial Sequence
  derived and/or modified sequence opt3 from SCAPER__Homo_sapiens__NP_001139395
augaagaccaaauacaucuucugcaacauuacagaaagaaaggacgccgaaggcugggagacugugcagagggggcggcccauacgcagccgauccacggcugucaugccuaaaguuucucuggcaaccgaagccacacguucaaaggaugacagugauaaagagaaugugugucuccuuccagacgaaagcauccaaaagggacaguuuguaggugauggcacuuccaacaccauugagucucacccgaaggacucgcugcauucaugcgaucaccccuuggcggagaaaacacaguucaccgugagcacuuuagacgaugucaagaauaguggguccaucagagacaacuaugugaggacaucugaaauuagcgcuguucauaucgauaccgaguguguguccgucaugcugcaggccggaacgccuccacuacaagugaaugaagagaaauuucccgcagagaaggcccggauagaaaacgagauggacccuucagauaucaguaauagcauggcugaaguacucgcaaagaaggaggaacuggccgaccgccuugagaaggcuaacgaggaagccauugcgucugcaaucgccgaggaggaacagcugacuagagaaauugaggcugaggaaaauaacgacaucaauauagagaccgauaacgacuccgauuucucagccagcaugggcagugguucuguuuccuuuugcgggaugagcauggacuggaaugauguguuggcagacuacgaagcuagggagucguggcggcagaacacaucuuggggagauauugucgaagaggagccagcccgacccccuggccacggcauccauaugcacgaaaaacucuccucaccaagucgcaagagaacuauugcggagagcaaaaagaaacacgaagagaagcagaugaaagcccaacagcugagggagaagcugcgggaagagaagacccucaaauuacagaagcugcuugaacgugagaaagacgugcgcaaguggaaagaagaguugcuggaucagagaaggcggaugauggaggaaaagcuacuccaugcagaguucaagcgagaagugcaacugcaggcuaucgucaaaaaggcccaggaggaagaggcuaaaguuaaugagaucgccuuuauuaacacacuugaagcacaaaacaagcgccacgacgugcuguccaaauugaaggaguaugaacagagacucaaugagcugcaggaagagaggcagcggcgccaagaggaaaagcaggccagagaugaggcuguacaggaaaggaaacgugcguuagaggcagagcggcaggcccgaguggaggaacugcucaugaagagaaaagaacaagaggcuaggauagaacagcagcgccaggagaaggagaaagcccgggaagacgcagccagagagagggcucgcgaccgagaggaacggcuugccgcacugaccgcggcucaacaggaagccauggaggaguugcagaagaagauccagcuaaaacaugaugaaucuauucguagacacauggagcaaaucgaacagaggaaggagaaagcagccgaacugagcucagggcgccacgcuaacacggacuacgccccgaagcucacucccuaugagcggaaaaagcaguguagucugugcaauguccuuauauccagcgagguguaccuguucucucauguuaaaggaagaaagcaccaacaggcagugagggaaaacacaucaauucagggucgagaguugagugaugaagaggucgagcaucucagccugaagaaauauaucaucgacauugugguagaauccaccgcuccugccgaggcguuaaaggauggcgaggaacgccagaaaaauaagaaaaaggccaagaaaaucaaggcucggaugaacuuuagagcaaaagaauacgagucucugauggagacuaaaaauucggggagcgacuccccauacaaagccaagcuacaaaggcucgcuaaggaucugcuuaaacagguucaggugcaggacucaggaaguugggccaacaauaaggucucugcauuggaucguacacugggcgaaauuacccgcauacucgagaaagaaaacguggcggaccaaaucgccuuccaggcugccggugggcugacggcacuugagcacauucugcaggcugucgugcccgccaccaauguuaacacaguguugcggaucccuccaaagagccucuguaaugcaaucaacguauauaaucugacuugcaacaacuguuccgaaaauugcucagaugucuuauuuagcaacaaaauuaccuuccugauggaccuacucauacaucagcugacaguguacguucccgaugagaauaacacuauccuuggaagaaauaccaacaagcaaguguuugagggcuugacaaccggccugcucaaggucucugccgugguacugggguguuuaauugcuaauaggccggacggaaacugccagccugcgacucccaaaaucccaacgcaggaaaugaagaauaaaccuucccaaggugaccccuucaacaaucgagugcaggaucugauuaguuauguugucaacaugggccuuaucgacaaguugugcgccuguuuccucagcgugcaggggccaguggaugagaaucccaaaauggcaauauuucugcagcacgcugccggacuacugcacgccaugugcacacucuguuucgcugucaccggccggucuuacuccaucuuugacaacaaucgccaagauccuacuggucugaccgcagcccuucaggcgacagacuuggcugggguucugcauauguuauauugcguguuauuccacggcaccauucuggauccaucaacugccaguccgaaggaaaacuacacacagaacacgauccagguggcaauucaaagccuuagauuuuucaauucguuugccgcucugcauuugcccgcauuccaguccaucguaggagccgagggccucucucuggcguuuaggcacauggcuagcucacuacuggggcacuguagucaggucuccugcgaaucucuccugcaugaggugauaguuugugugggauauuucaccgucaaccacccugacaaucaggugauuguucaaagcggucggcauccaacugugcuucagaaauugugccagcugcccuuucaguacuucuccgauccucgauuaaucaagguacucuuuccaucacugauugccgcauguuacaacaaucaccaaaacaagaucauacuugagcaggaaaugagcugcguccugcuagccacauucauccaggaccucgcucaaacccccggccaggccgagaaucagccguaucagccuaaagggaagugucugggaagucaagauuacuuggaacuggcaaacagauucccacagcaggcuugggaggaggcccgccaguuuuuccucaaaaaggagaaaaaguga

SEQ ID NO: 62192 - RNA, 3840 nt, Artificial Sequence
  derived and/or modified sequence opt3 from SCAP__Homo_sapiens__NP_036367
augacccugacagagagacucagggaaaagaucagccgggccuucuacaaccacggccuucugugcgcuuccuaucccauuccuauaaucuuguuuacuggguucuguauuuuagcaugcuguuacccacugcuaaaacucccgcugcccggaacggguccuguggaguuuaccacaccagucaaggacuauucucccccuccaguugauucagaccgcaaacagggcgaacccacugagcaaccugaaugguacgugggggccccaguagcguaugugcagcagaucuucgucaagaguagcguguuuccguggcauaaaaaucuucuggcuguugauguguuccgaucccccuugucucgugccuuucagcucgucgaggagauuagaaaccacgugcugagggacucgucaggaauccggagccuggaggagcucugcuuacaaguaaccgaucugcuuccuggcuugcgcaagcugagaaaucuacucccagaacaugguugucugcuucugagucccgggaacuucuggcagaaugacugggagagguuucacgcagauccugacauaaucggaacaauucaucagcacgagccaaagaccuugcagacuuccgccacacucaaagaucuguuauucggcguucccggcaaguacucuggggugagccuguauacccggaaacgcauggucuccuacacgaucacucucguguuucaacacuaccaugcuaaguuccuuggaucacugcgagcaagauugaugcuacugcacccgaguccuaacugcagccucagggccgaaucucuggugcauguccacuuuaaagaggaaauugguguugcugagcuuaucccccuggugaccacauauauaauuuuguucgccuacaucuauuucuccacucggaagauugacaugguaaagucaaaauggggccucgcgcuggcagccguggucaccguguuaagcagucugcuaaugucuguugggcucuguacacuguuuggacuuaccccaacguugaauggcggugaaaucuucccuuaccugguggucgugaucgggcucgagaacguacugguucuuacuaaguccguggucagcacacccguggaucuggaggucaaauugcguauugcucagggacucucgucugaauccuggucaauaaugaagaauauggccaccgagcugggcaucauuuuaaucggcuauuuuacucuggugccagcaauacaggaauuuugccuauuugcuguuguggggcucguaagugacuucuuucugcagaugcuuuucuuuacaaccgucuugagcauugauauccgcagaauggagcuggccgaccucaacaaaaggcugcccccugaagcguguuuaccauccgccaagccggugggacaacccacgcgguacgagcgacagcuggcaguucgcccuucuaccccacacacaaucacucuucagcccagcucauucagaaauuugaggcucccuaaacggcugcgcguggucuauuuucuagcuagaaccaggcuggcccaacgucucauuauggcugguacagugguauggaucggcauucugguguacacugacccagccgggcuucggaacuacuuggcagcccagguuaccgagcagaguccccugggagaaggcgcuuuagcgccgaugccugucccauccgguaugcuucccccuagccaucccgauccagcauucucuauauuuccucccgacgccccaaagcugccggagaaucagacaucaccuggggaaagucccgagcgaggcggaccagcugaaguggugcacgauagccccgucccugagguuaccuggggcccagaggacgaggaacuuuggagaaagcuguccuucaggcauuggcccacuuuguucucuuauuacaacaucacgcucgccaaacgcuauauuucgcugcuaccugugaucccggugacacugcggcucaauccaagagaagcacuggaggggaggcacccccaagauggacgcagcgccuggccuccacccgguccuaucccggcuggccauugggaggccgggcccaagggaccaggcgguguacaggcacacggggacgucacccuuuacaaaguggcggcuuugggccuggccacuggaauuguuuuagugcuccugcuucugugccuauaucgaguccucuguccucggaacuacggccagcugggcggaggucccggccguagaaggcgcggggaauugccaugcgaugacuauggauacgcaccucccgagaccgaaauagugccacugguuuuacggggccaccucauggauaucgagugccuggccuccgacgguaugcuucuggugucauguugcuuggcugggcauguaugugucugggaugcccagacaggcgacugccucaccaggauuccgagaccuggacgacaacgccgggacaguggcguggggucuggacuggaagcacaggagagcugggagagacuauccgauggcgguaaggcugggcccgaggaaccaggagacucacccccucugaggcaccguccacgcgggcccccuccgccaagccuuuuuggugaucagcccgaccucacuugucugaucgauacaaacuucucugcccagccucgguccagucaacccacgcagccagaaccuagacauagggcggugugcggccgaagccgggacucucccggguacgauuuuuccuguuugguccagcgcguuuaucaggaggaaggacuggccgcugugugcaccccagcauuaagaccuccgucacccggcccaguacucagucaagccccugaggacgaagggggaagccccgaaaaaggcucgccaucccuggcuugggccccuucugcagaggguagcauuuggucacuugaacugcaggggaauuugaucguggucggaaggaguuccggccggcucgaggugugggaugcgauagaagguguucuguguugcucuagcgaggagguguccucaggcaucacugcccuagucuuccuggacaagcgaauuguggcugccagacuuaacgggagccucgauuucuucagucuggaaacacacaccgcauugucucccuuacaguuucgcggaacaccgggcaggggguccagcccagcuucgccuguuuacucaucuagugacacuguggccugucaccugacccauacgguccccugcgcacaccaaaagccaaucaccgcccucaaagcugcggccggacgucugguaacaggcucccaggaucauacucuucggguguucagacuggaggacagcugcuguuuguuuacccuacagggucacucuggggcaauuacaacuguuuauaucgaccagaccauggugcuggcuagcggaggccaagauggugccauaugccucugggacguccugacgggcuccagggugucacauguauucgcccaccgcggggaugugacaagucuuaccuguacuacaagcugcgucauuucuuccggauuagacgaucugaucucaauuugggaccgaaguaccggcaucaaguuuuacagcauacagcaggaucucggguguggagcuuccuugggcguuaucucugacaaucugcucgugacuggugggcagggaugcgugucguucugggaucugaacuauggcgaccuucugcaaaccgucuacuugggcaaaaauagcgaagcacagcccgccagacagauucuagugcuggauaacgcggcuaucguuuguaauuuugggucagagcucuccuuaguauaugugccuaguguccuggagaagcucgacuga

SEQ ID NO: 62193 - RNA, 1821 nt, Artificial Sequence
  derived and/or modified sequence opt3 from SCARA3__Homo_sapiens__NP_057324
augaaggugagaagcgccggcggggacggagaugcucugugcgucaccgaggaagaccucgcaggggaugacgaggauaugcccacauucccuuguacucagaaaggcaggccagggccgcggugcucccgcugucaaaagaaccuuucucugcacacgucaguucgaaucuuguacuuauuucuggcccuacuccugguggcgguagcugugcuugccagucuggucuuccguaaaguggacagcuuguccgaagauauuucucucacccagucgauauaugacaagaaacugguucugaugcagaagaaucuccagggauuagaucccaaggcacugaacaauugcucauuuugucaugaggccggccaacuugguccugaaaucagaaaauugcaggaggagcuggaagggauucagaagcuacuccuggcucaggaggugcaacuugaccagacacugcaggcacaggaagucuugagcacuaccaguaggcaaaucucccaggagaugggaucuugcagcuucuccauucaccaggugaaccaaucacucggccuguuuuuagcccagguacggggcuggcaggcuacaaccgccgggcuggaucucagucuuaaagaccugacucaggaguguuacgauguuaaggcggcagugcaucaaaucaauuucacagucggacagaccagcgaauggauacacgguauccagcgcaaaacggacgaggaaacuuugacccuacagaagauugugacagacuggcaaaacuauacuagacuguuuucuggccucaggaccacauccaccaagacgggggaggccgugaaaaauauccaggcuacucugggagccucaagccagcggauuagucagaacucugaauccaugcaugaucuuguccugcaaguuaugggcuugcagcuccagcuggacaauaucagcucguucuuagaugaccacgaggagaacaugcacgaucugcaguaccauacacacuaugcacaaaaucgcaccguggaacgauuugagucucuagaagguagaauggcuucccaugagauagaaauugggacuaucuucacaaacauuaaugccaccgacaaccacguacacucaaugcucaaguaccuggaugacgugaggcuuaguugcacguugggauuucauacccacgcggaggagcuguauuaccucaauaaaagcgucuccaucaugcugggcacaacugaucuucugcgggaacguuucucuuugcucagcgcccgccuggacuuaaacgugagaaaccugucaaugaucguugaggaaaugaaggcaguggauacccagcauggcgagauucuaaggaaugucacaauacuccggggugcuccaggacccccugguccacgaggcuuuaaaggggacaugggagugaagggccccguaggugggcgcggcccuaaaggagacccaggcagucuggggccgcuuggaccccaggguccucaaggccagccaggggaagccggacccguuggcgagagagguccuguggggccaaggggcuuccccggauugaagggcuccaaggggagcuucggaacugguggcccgcgggggcagccuggacccaaaggcgauaucgguccaccugggcccgagggcccacccggaucuccuggcccaucagggccgcagggaaagcccggcauugcugguaaaaccgggaguccuggacaacgcggcgccauggguccaaagggcgaacccgggauccagggaccuccaggccugcccgggccgccuggaccacccggcagccaguccuuuuacuga

SEQ ID NO: 62194 - RNA, 1488 nt, Artificial Sequence
  derived and/or modified sequence opt3 from SCARA5__Homo_sapiens__NP_776194
auggagaacaaggccauguaccugcacaccgugagcgacugcgauacauccucuaucugugaagacucauucgauggcagaagucucagcaaacuuaaucugugcgaggacgggcccugucauaagaggcgggcuuccauuugcuguacucaguugggaucuuuaucggcacugaaacacgccguccuaggucucuaucugcuuguuuuucugauauuggugggcaucuucauucucgcgguaucacgcccucgaagcaguccagaugaccugaaggcucugacgcguaacgugaauagacucaacgaauccuuuagggauuuacaacugcggcuuuugcaggccccgcugcaggcagaccuaaccgagcaggucuggaaagugcaagaugcccuccagaaucagucugacagccugcuugcucuggcaggggccguucagcgcuuggaaggagcucucuggggccugcaagcccaggcggugcagacagagcaggcagucgccuuacugagagauaggacuggucaacaguccgacaccgcucagcucgagcuuuaccaacugcaaguggaaucaaacaguagccaguugcuacugcggcgccaugccgggcuccuggauggacuugcacgaagaguaggcauccugggcgaggaauuggcugacguugggggagugcucaggggucugaaucacucuuuauccuaugacgucgcccugcaucggacacgucuacaggaucuccgcgugcuggugucaaacgcgagcgaggacaccagaaggcuucgguuggcccacgucggcauggagcugcagcucaagcaggaacuggcaaugcuuaaugcuguuacugaggaucugcgauugaaggacugggaacacaguauugcccuccgcaacaucucucuggcuaaagggcccccuggaccaaagggcgaucagggugacgaggggaaagaaggaagacccggcauaccuggcuuaccagggcugaggggacuacccggugagcggggcacaccugggcucccaggaccgaagggcgaugacgguaaacugggggccaccggccccaugggaaugcgcggcuucaagggggauagaggaccuaagggugagaaaggcgaaaagggggacagggcaggagaugccuccggcguggaggcuccaaugaugauccgucuuguaaaugguagcgggccccaugaaggccggguggaggucuaccacgaccgaagauggggaacggugugcgacgauggcugggacaaaaaggauggggacguuguguguaggauguugggauuucgcggugucgaagagguguaucggacugcgagauucggccaggggaccggaaggauuuggauggaugacguagcaugcaaaggcacagaggaaacuaucuuucgcuguucguucucuaagugggguguuaccaacugcgggcaugccgaggaugcuuccgugacauguaaucgacacuga

SEQ ID NO: 62195 - RNA, 1521 nt, Artificial Sequence
  derived and/or modified sequence opt3 from SCARB1__Homo_sapiens__NP_001076428
augggcugcagcgccaaggcuagaugggcagccggggcgcugggaguggcuggucuccuuugugccguccugggcgcaguuaugaucgugaugguacccuccuugauuaaacagcaaguguuaaagaacgucaggauagacccuucuucacugaguuucaauauguggaaagagaucccaauuccguuuuaccuaagcguguauuucuuugauguuaugaaccccuccgaaauccucaagggggagaaaccucaggugcgggaacgcggaccauacgucuaucgagaguuccgucacaagucuaauauuaccuuuaacaauaacgacacagugucguuccuggaauacagaacuuuucaguuccagcccucaaagagccauggcagugaguccgauuauaucguaaugccuaauauacuuguucugggugccgcugugaugauggagaacaaaccaaugacguugaagcucaucaugacccuggcauuuacaacucugggggaaagggccuucaugaaucggaccgucggagagauuauguggggcuacaaagacccccucgugaacuuaaucaauaaguauuuuccuggcauguucccauuuaaagauaaguucgggcuguucgcugaacuuaacaauucugacagcggauuguuuacaguguucaccgguguccaaaacauuucccgcauccaccugguugauaaguggaauggccuaucaaaaguggacuuuuggcauagugaucagugcaacaugauaaacgggacuagcggacagauguggccgcccuucaugacaccugagucuucccucgaguuuuacucaccagaagccuguagaagcaugaagcugauguacaaagagaguggcguauucgaagguauucccaccuauagguuuguggcgccuaagacgcuuuucgcaaaugggucuaucuacccacccaacgagggauuuugcccgugucuggaauccggcauucagaaugucagcacuugccgguucucggccccuuuguuucucucucacccccauuuccugaacgcugacccaguguuagccgaggcaguuaccggccugcacccuaaucaagaggcucacucccucuuucuugauauccaucccgugacagggaucccaaugaacuguucagucaaacugcaguugagucuauauaugaaaagcguggccggaauuggucagacuggcaagauagaacccguaguucugccucuccugugguucgcggaguccggggccauggaaggagagacccuucacacauucuacacccagcugguguugaugccaaaggucaugcauuaugcacaauacgugcuccuggcuuuaggcugcguccugcuacucgugccgguuaucugucagauucgcucucagggucccgaagacacggugagccaaccugggcuggccgcuggcccagaucgacccccuucaccauauacuccccuuuugccggacaguccuuccggacagccacccagcccuacagccuga

SEQ ID NO: 62196 - RNA, 1008 nt, Artificial Sequence
  derived and/or modified sequence opt3 from SCARB2__Homo_sapiens__NP_001191184
augggcagaugcuguuucuacaccgccgggacacugagccuccuucuguuggugacuuccgucacguuacugguugcuaggguguuucagaaggcaguagaccaaucuaucgagaaaaagauugugcuacggaacggaaccgaagccuucgauucaugggagaaacccccucucccagucuauacacaguuuuacuucuuuaaugugacuaacccggaagagauacugcgcggugaaacaccccgaguugaggaggugggcccuuauaccuaccguagucuugacugguggaucaccgauaagugcaauaugauuaacgggacugacggagauagcuuccacccacugaucacaaaagacgaagucuuguauguguuucccuccgauuucuguagaucuguauacauuaccuuuucggacuaugagucaguucagggccucccugcguucagguacaaggugccagcugaaauccuggccaauacgagcgauaacgcagguuuuugcauacccgaggggaauugucugggaaguggcguccucaacguguccaucugcaagaauggcgccccuauuaucaugucuuucccacauuuuuaccaggcugacgagcgguucgugagcgcaauugaagggaugcacccgaaccaagaggaucaugaaacuuucgucgacaucaaucccuuaaccggaauaauucugaaagccgcuaagcgcuuucagaucaacauuuauguuaaaaaguuggaugacuucguggagacaggugacaucagaacuaugguauuuccugugauguaccuuaaugaauccguccacaucgauaaagagaccgccucaaggcugaagaguaugauuaacacaacccuaauaaucacgaauauuccauauaucauaauggcgcucggcguguucuuugggcugguuuucacuuggcuugcauguaagggacagggcagcauggacgaggguacagccgaugaacgggcuccccugauucgcaccuga

SEQ ID NO: 62197 - RNA, 2616 nt, Artificial Sequence
  derived and/or modified sequence opt3 from SCARF2__Homo_sapiens__NP_699165
auggagggcgccgggcccagaggagcugguccugcaaggcggcgcggcgccgggggaccaccgagcccccugcucccuucccuucuguuguuacugcuacucuggaugcugccagacaccguggcgccccaggaacuuaacccucgaggccguaaugucugcagagcuccagguucucaaguucccacauguugcgccggguggaggcagcagggagaugaguguggcaucgcagugugcgaaggcaacucaacuuguagugagaaugaaguaugcgugcggccuggggagugucgcugcagacacggauacuucggugccaacugugacacgaagugcccaaggcaguuuuggggcccggauuguaaagagcugugcagcugccauccccacgggcaaugugaagacgucaccggacagugcacaugucaugcucggcgcuggggcgcacgaugcgagcacgccugucagugccagcaugguacuugucacccuagauccggggcuuguaggugcgaaccaggaugguggggcgcccaaugcgcgucugcauguuauugcucggccaccucacggugcgauccccagacaggcgcuuguuugugccacgccgggugguggggacguagcuguaauaaccagugcgcauguaauaguuccccuugcgagcagcaaucuggucgcugucagugcagagagaggaccuucggcgcucggugugaccgauacugccaguguuuucgcgggagaugccauccaguggauggaacuugcgccugugaacccggcuauagggguaaguacugccgggagccguguccugcgggguucuauggccucggaugccgcagaagguguggccaaugcaaagggcagcagcccuguacaguugccgaaggacguugccugaccugugagccagguuggaacggcacgaagugcgaccagccuugugcaacuggguuuuacggagaaggcugcagccaccggugucccccaugccgagauggucaugcuugcaaucacgugaccgggaaauguacaagaugcaacgccggcuggauuggagacaggugugagacuaagugcuccaauggcaccuauggggaggauugugcuuucgucugcgccgacuguggaucaggucacugcgauuuucaaaguggccgcugucugugcagccccggggugcauggaccucacugcaacguaacauguccaccgggccuccauggugcagacugcgcccaggcuuguucuugccacgaagacaccugugaucccguuacgggggcgugccauuuagagacuaaucagcggaagggcgugaugggagcaggcgcccugcuugucuugcuggugugucuacuccugucccuucuggggugcuguugcgcuuguagaggaaaagacccuacaaggcgcccacgaccccggcgugaauugucacucggcagaaagaaagccccucacaggcugugcggucgcuucagccggauaaguaugaaguuaccaagaaucccccugaggcgacagaaacucccgaagguggucguugcacaccaugaucuugacaacacccugaauugcuccuuuuuggagccuccaucugggcuagaacaacccagcccuucguggucuucccgcgccucauucaguagcuuugauacuacagacgagggacccguguacuguguaccacacgaggaagcuccugccgagucccgggaucccgaagugccaaccgucccggcagaggcgccugcucccucuccagugccccugacgaccccugccagcgcagaagaggccauuccacuccccgcuucaagugacuccgagagaagcgccucuucaguugaaggcccugguggcgcacuguacgcuaggguggcccgucgcgaggcgcggccggccagagcucgaggggaaaucggaggccuuagucugagcccaucccccgagaggcggaagccuccacccccugauccggcaacaaaacccaaggucucuuggauucaugggaaacacucggccgcugccgcaggacgcgcgccaagcccucccccaccuggcuccgaggccgcucccucaccaaguaagagaaaaaggacuccgucugacaagagcgcccacaccguggaacaugguuccccucggacacgagaucccacuccaagacccccuggguugccagaggaagcaaccgcucucgccgcacccucaccuccgcgcgccagggcucguggacggggcccaggucuguuagagcccacagacgcgggcgggccucccagaagcgccccagaagcagcuucuaugcuggccgccgagcuaaggggaaaaacccgcucccucggccgagcugagguagcacugggggcccagggaccuagagaaaagcccgcgccaccucagaaggcuaaacggaguguuccgcccgccagcccagcaagggccccucccgcuacugagacgccaggcccugaaaaggcagccacagaccuucccgcgccggagaccccacgcaaaaagacuccuauccagaaacccccacguaagaagucuagagaagcugccggugaguuggggcgggcaggagcccccacccuguga

SEQ ID NO: 62198 - RNA, 1290 nt, Artificial Sequence
  derived and/or modified sequence opt3 from SCCPDH__Homo_sapiens__NP_057086
auggccaccgagcagagacccuuccaccugguggucuuuggcgcuagcggguucacaggacaauuuguuacugaagagguggcaagggaacagguagacccugagcgguccucucgccucccaugggccguggcgggucgaucacgugaaaaacuucagagaguccuggagaaggcugccuugaaguuaggcaggccgacgcugaguagcgagguggggaucauuauaugcgauaucgcaaaccccgccucccuagacgaaauggcuaaacaggcaaccguugugcucaauugugucggaccuuaccgguucuauggcgagccagugauuaaggccugcaucgaaaacggugcuucuuguauugauaucucgggggagccccaauuucuggagcuuaugcagcugaaauaccaugaaaaggccgcggacaagggaguauauauaaucggcucaagcggcuucgauaguauuccugcagacuuggggguuaucuacacacgcaauaaaaugaacggaacucucaccgccguggaguccuuucugacaauucacucugguccagaaggccugagcauccaugaugggaccuggaaguccgcuauauauggauucggcgaccagucaaaucucagaaaauuaaggaacgucaguaaucugaagcccgugccucuuauugguccaaaauugaagcggcgcuggccgaucagcuacugccgagagcugaagggguauucuauucccuuuaugggauccgaugugucagucguuagaaggacucagcgguaccuauacgaaaaccucgaggagagcccugugcaauaugccgcauacguaacagugggcggcaucaccagugucaucaaacugauguucgcugggcuuuucuuucuguuuuucgugcguuucggaauuggucgccaguugcucauaaaguuuccaugguucuuuucuuucggcuauuuuuccaaacaggggcccacgcagaagcaaaucgacgccgcgagcuucacucugaccuuuuucggacagggcuacucgcaggguacagggacugauaaaaauaagccuaacauuaaaaucuguacccaaguuaagggcccagaagccggauauguggcaacacccauagcuaugguccaggccgcuaugaccuuacugucugacgccucccaccucccgaaggcaggcgggguguuuacgccuggagccgcuuucucaaaaacuaaacuuauugauagacugaauaagcaugguaucgaguuuaguguaaucagcuccucugaaguuuga

SEQ ID NO: 62199 - RNA, 993 nt, Artificial Sequence
  derived and/or modified sequence opt3 from SCD5__Homo_sapiens__NP_001032671
augcccggcccugccaccgacgcugggaagaucccauucugcgaugcaaaagaggaaauuagagccggacuggagagcuccgaagguggcgggggaccggagaggcccggcgcgcggggucagcgccaaaacauaguguggcgaaaugucguucucaugucucuucugcacuugggggcuguguacucauuaguacugaucccuaaggccaaaccacuaacacuccugugggcauauuuuuguuuccuucuggccgcuuugggagugacugcaggcgcccaucgucucuggagucacagaagcuacagggcuaagcugccccugcggauuuuucucgccgucgcgaacuccauggcauuccagaaugacaucuuugaauggucucgcgaucauagagcccaccauaaauauucggagacggacgcugauccucacaacgccaggcggggcuucuuuuucucacacauugggugguuauuugugcgcaagcaucgagacguuaucgagaagggaagaaaacuggaugugaccgaccuuuuggcagauccagucgugaggauacagcggaaguacuauaaaaucagcguaguucugaugugcuucgugguccccacucuagugccuugguacauuuggggugaaagucucuggaacuccuauuuucuggcuucuauccuucguuacacaauuagccugaauaucuccugguuggucaauucagccgcgcacauguacggcaaccgcccauaugacaagcauauaaguccgagacagaauccccucguggcccugggggcaauuggagagggcuuccacaacuaccaccauaccuuuccuuucgauuauagcgcuucugaguucgguuuaaauuuuaacccaacaaccugguucaucgacuuuauguguuggcuggggcucgccacugauaggaaacgggcuacaaagcccaugauugaagcccgaaaggcacgcaccggagacuccucagccuga

SEQ ID NO: 62200 - RNA, 1080 nt, Artificial Sequence
  derived and/or modified sequence opt3 from SCD__Homo_sapiens__NP_005054
augcccgcccaucugcuccaggacgauaucagcuccucuuacaccacaacuacgaccauuacagcuccuccaucaagagugcuucaaaacggcggggacaagcuggagacuaugccguuguauuuagaagaugacauaaggcccgauaucaaagacgauauuuacgacccuaccuauaaggauaaagagggaccaagucccaaggucgaauacguuuggcggaauaucauucugaugagccuacuccaccugggugcacuuuauggcaucacacugauaccuaccugcaaauucuacacuugguuguggggaguguuuuauuacuucguauccgcccucgggaucacagcgggcgcucaccgccuguggucucaucgaucguacaaggcccgucugccacucagauuauuucugauuaucgcaaacaccauggccuuccagaaugacguguaugagugggcuagggaucaccgggcacaucacaaguuuucagaaacgcacgccgacccccauaacagccgcagagguuucuuuuucagucacgucggguggcuuuuggugaggaaacauccugcuguuaaggagaaaggauccacucuggaucuaucugaccucgaggccgaaaagcuggugauguuucagcggcgcuacuauaaaccaggccuucugaugauguguuucauuuugccgacccucguccccugguacuuuuggggcgagacauuccagaauagcguguuuguagcgacuuuccugcgauaugcaguuguguuaaacgccaccuggcuggucaauuccgcugcccaccucuucggguacagaccuuaugacaagaacaucucaccaagggaaaauauacuugugagucugggagcagugggugagggcuuucacaacuaccaucacagcuuccccuacgauuauucugcuuccgaguaccgguggcauauuaauuuuacaaccuucuuuaucgacugcauggccgcguuggggcuagccuaugaucguaagaaagucucaaaggcagcuauucuggcccgcaucaaaagaacgggagacggcaacuacaagagcgguuga

SEQ ID NO: 62201 - RNA, 1653 nt, Artificial Sequence
  derived and/or modified sequence opt3 from SCFD1__Homo_sapiens__NP_001244305
augcccaccgaggaaaacaucgacagaaugugccaggaucugaggaaucaacucuacgagagcuauuaccuuaacuucauuuccgccauaucucggucaaagcuggaagacaucgcuaaugcagccuuggcggcuagugccgugacacaggucgcaaaaguuuuugaucaguauuuaaacuucauuacucuggaggacgauauguuugugcuauguaaucagaacaaggaacucguaagcuaccgcgccaucaaucgaccugacauuacggauaccgagauggagacagugauggacacuaucgucgauucccuguucugcuuuuucgugacccuuggcgcuguuccaauaauccguuguucuagagggacagcagccgaaaugguggcugucaaacuggacaagaaauugagggagaaccuccgggaugcccgcaauucgcuguuuaccggagacacucugggugcgggccaauucucauuucagagaccgcucuuagugcugguagauaggaacauugaccuugcaacacccuugcaccauaccuggacguaucaggcccugguucacgacgugcuagauuuccaucucaaucgggucaaccuggaagagagcagugggguggaaaauuccccugcuggagcccgcccaaagcgaaagaacaaaaagucuuacgaccuuacucccguggauaaauuuuggcagaagcacaaaggcagcccuuucccagaggucgcagaguccguucaacaggaacuggagucauauagagcucaggaagacgaggugaagagguugaagaguaucaugggucucgagggggaagaugagggagccauuagcaugcugucugacaauaccgcgaaauuaacauccgccguaucaagccugcccgaacuccuugagaagaaacggcugaucgauuugcauacuaacguggcaaccgcuguccuagaacacauaaaggcccguaaacuggacguguacuuugaguacgaggaaaagauuaugaguaaaacaacccucgauaagucucugcuugacaucauuuccgauccugacgcuggcacgccagaggacaagaugcgccuguucuugaucuauuacaucagcacucagcaagccccgucggaagcagaucucgagcaguauaaaaaggcccugacagacgcuggcugcaacuuaaauccccugcaguacauuaaacaauggaaggcguucaccaaaauggcaucugccccugcuuccuaugggucaacuacaaccaagccaaugggacuacucaguagaguuaugaacacggguagccaguuugugauggaaggcgucaagaaucuggugcuuaaacagcagaacuugcccguaaccaggauacuggauaaucucauggagaugaaguccaacccugagacagacgauuaccgguauuucgacccaaaaaugcugcgagggaaugauucuagcguuccccgcaacaagaauccguuucaagaagccaucguguucgucgugggaggcgguaacuacauugaguaccagaaucuugucgacuauaucaaagggaagcagggaaagcacauacuguacggcuguucagaauuguuuaacgcaacucaguucauuaaacaacucagucagcugggccagaaguga

SEQ ID NO: 62202 - RNA, 2055 nt, Artificial Sequence
  derived and/or modified sequence opt3 from SCFD2__Homo_sapiens__NP_689753
augagcgccuccggcgugcugucuuucacccagcaagggugggagcagguccucgcuaagguuaaaagagcagugguauaccuugacgccgcgugcgcugaaucacugcacuggggaugugguaguacaagguuguuagaggccgugggcgggcccgauugccaucugcgggaauuugagccugacgcaaucggaggcggugccaagcagccaaaagcugucuucgugcuaagcugucuccugaaggggcgcacuguugaaauucuucgagauauaaucugccguucccacuuucaguauuguguggucgugacgaccguaucucaugcaguucaccugacagccaaccaugugccggcugccgcggcagccgagauggagggacaacagcccgucuucgaacaguuggaggaaaaacucugcgaguggaugggcaauaugaacuacacugcugagguguuucacgugccucugcugcucgccccagucgcaccccacuucgcuuuaaccccugccuuugcgucgcuguucccacuuuugccccaggacguucaucugcuaaauucagccagaccugauaagaggaagcucggcagccugggggacguggauaguacaacccuuacuccagaacuguugcuccaaauucggugucugguauccggauuaucuagccugugcgagcaccucggugugcgcgaagaguguuuugcagucggcucccuuucacaggugaucgcugccgaccuggcuaacuaugccccggcgaaaaauagaaagaaaacagccgcugggagggcgaguguuguguucgucgaucggaccuuggaccuaacgggagcagugggccaucacggugauaaccugguagaaaagauuaucagcgcccucccccagcugccugggcacacuaaugacguuauggugaacaugauagcucuuaccgcccugcauacagaggaggaaaauuacaacgucguggcaccaggaugcuugucucaguccucagauacuaccgccaaagcucucugggaggcccuguuaaauacaaagcacaaggaagcagucauggaggugcgccgacaucugguugaagcggcuagcagagagaaccuacccaucaaaaugaguaugggcagggugaccccuggccaacucaugucuuauauucagcuguuuaagaauaaccuuaaagccuugaugaaucacugugggcugcuccagcugggacuugcaacggcccaaacucugaagcauccacagacagcuaaaugggacaacuucuuggccuuugagcggcuccuguuacaguccaucggugaaagcgcaaugucgguaguccugaaccagcuacuccccaugauuaagccggugacccaacguacuaaugaggacuacucuccugaggaacugcuuaucuugcugauauauauuuacuccguuacaggcgaacucaccguggauaaagaccugugcgaggcugaggaaaaggucaagaaagccuuagcacagguguucugcgaggaaucagggcugaguccccuuuugcagaagaucacggauugggacagcuccauuaaccucaccuuccacaaaucuaagaucgccguagaugagcuguuuacaagccuacgcgacaucgcuggagcaagaucacugcucaaacaguucaagaguguguacguuccaggcaaucacacucaucaagccuccuauaagccucugcuuaaacaggucguggaggaaauuuuucaccccgagaggccagauagcguggacauagaacauaugucuucagguuugaccgaucuguuaaagacaggguucaguauguuuaugaaagucagccggccccacccuuccgacuacccacuccugauccuuuucguugugggcggagugacuguaucugaggucaagauggugaaagaucugguugcuucguugaagccgggcacccaggugauuguccucagcacacgacugcuaaagccccugaacaucccugaacuccuguuugccaccgaccgccuucacccagacuugggguucuga

SEQ ID NO: 62203 - RNA, 1854 nt, Artificial Sequence
  derived and/or modified sequence opt3 from SCG2__Homo_sapiens__NP_003460
auggccgaggcuaagacccacuggcugggcgcagcccucagccuuaucccccugauuuucuugauauccggggcggaagcugccucuuuucagagaaaccaauuacugcagaaagagccugaccuaaggcucgaaaaugugcagaaguucccaucaccggagaugauccgggcacuggaauacauugagaaccuucgccagcaagcccauaaagaggaaaguagccccgauuauaauccuuaccagggagucuccguuccacugcagcagaaggagaacggugacgaaucucacuugcccgagcgagauucgcucucagaggaagacuggaugcguaucauucuggaggcucugagacaagcagaaaaugagccucagagcgccccaaaagaaaacaagcccuaugcucucaauagugagaagaacuuuccuauggauauguccgacgauuacgagacacagcaguggccagaaaggaaauuaaagcauaugcaauucccgcccauguaugaggaaaauucucgggacaacccuuuuaaacgcacuaaugagaucguggaagaacaguacacgccacagagccuggccacccuugaguccguauuccaagaauugggcaagcugacagggcccaacaaucagaaaagagagaggauggaugaggagcagaagcuauauacugacgaugaagacgauauauacaaggcgaacaauaucgcauacgaggacguggucggaggcgaggacuggaacccuguggaagagaaaauugaaucacagacccaagaggagguucgggauaguaaggaaaacaucgagaaaaaugaacagauuaacgacgagaugaagcgcagcggucagcucgggauccaggaagaggaucugcgaaaagagucuaaggaccaacuuuccgaugacgugucaaaagucauagccuaucugaagagauuggugaaugcugccggaagcggcaggcuccagaacggccagaauggggaacgggcaacacgucuguuugagaagccauuagauagucagucuauuuaccaacugaucgaaauuucccgcaaccuccagauucccccggaggaccuuaucgaaaugcugaaaaccggagagaagccuaaugguagcguagagcccgaaagagaguuggaucuaccaguugaccuggaugacaucucggaagcugaccucgaucacccugaccuguuccagaacaggaugcuuucuaaauccggcuaucccaagacuccagggcgggccggaacagaggcgcugcccgauggcuugucaguggaagacauacucaaucuguuagguauggagagugccgcaaaccagaaaaccagcuacuuuccuaauccauauaaccaagagaagguccugccgcgacuacccuacggggcuggacgcuccagaucuaaucagcucccuaaggccgcuuggaucccacauguggaaaacaggcagauggccuaugagaaucugaacgauaaagaccaagaacuuggcgaguacuuggcacggaugcuggugaaguaccccgagauuaucaacagcaaucaggucaaacgcguuccuggccaggggucaagugaagaugaccuccaggaggaggaacaaauagaacaggccauuaaggagcaccugaaccagggauccagccaggagacggauaaacuugcuccagugucuaagagauuccccguagguccgccuaagaaugacgauacuccaaacaggcaauauugggacgaagaucuguugaugaaagugcucgaguaccugaaucaggaaaaggcggagaaaggccgugaacacaucgcaaagcgggccauggagaacauguga

SEQ ID NO: 62204 - RNA, 711 nt, Artificial Sequence
  derived and/or modified sequence opt3 from SCG3__Homo_sapiens__NP_001158729
auggccgcuauccaggacggccuggcaaagggggagaacgaugaaaccgugagcaauacacucacucuuacgaacggacuggagagaaggaccaaaacauacuccgaagacaauuucgaggaauugcaauauuuucccaacuucuacgccuuacugaagucuauugauucagagaaagaggcgaaggaaaaagagacucuaauaaccaucaugaagacacucauugacuuugucaagaugaugguuaaauaugguaccaucaguccugaagagggcgugagcuaccuggagaaucuugaugaaaugauugcucugcagacuaagaacaaauuggagaagaaugccacagacaacaucuccaaacucuucccagcaccgucugaaaagucgcacgaggaaaccgauucaacgaaggaggaggccgcuaaaauggaaaaggaguaugggagccugaaagacaguacuaaggaugacaauuccaaccccggaggcaaaaccgaugaaccuaaggguaaaacagaggcauaccuggaagccauacggaagaauaucgaguggcucaagaaacaugacaagaaagggaacaaggaggauuaugacuuaucuaaaaugcgcgacuuuauuaauaagcaggcugaugccuacguagaaaagggaauccuggacaaagaggaagcggaggcaauuaagcgaaucuacagcucccuuuga

SEQ ID NO: 62205 - RNA, 639 nt, Artificial Sequence
  derived and/or modified sequence opt3 from SCG5__Homo_sapiens__NP_001138229
auggugagcagaauggucuccaccaugcugucuggccuccuuuucuggcuggccucaggguggacacccgcuuuugcauacaguccuaggacuccagaccggguuagcgaggccgauauccagcgcuuguuacacggagugauggaacaacuggguauugcgcgaccgcguguagaguaucccgcucaucaggccaugaaccuagugggcccucaguccauagaagggggagcacacgagggccuccagcaucuggguccauucgggaauauccccaacauugucgccgaacuuacgggagacaauaucccuaaggauuuuucugaggaccaaggcuacccagaucccccuaacccaugcccggugggcaaaaccgcugacgaugggugucuggagaauacacccgacacugcagaguucucgagagaauuucaguugcaccagcaucucuucgauccugaacacgacuauccaggacuggguaaguggaacaaaaagcugcucuacgagaaaaugaagggcggggagaggcggaagcgcagaucaguuaaucccuauuuacagggacaaaggcuggauaacguggucgccaaaaagagcgugccucacuuuagugacgaagauaaagacccagaguga

SEQ ID NO: 62206 - RNA, 276 nt, Artificial Sequence
  derived and/or modified sequence opt3 from SCGB1A1__Homo_sapiens__NP_003348
augaagcuggccgugacccucacacuugucacucuggcuuugugcuguagcuccgcaucugccgagaucugccccucauuccagagaguuauugaaacguuacugauggacaccccuaguagcuacgaggcggcuauggaacuauuuuccccagaucaagacaugagggaggccggcgcacagcucaaaaagcugguggauacacuuccgcagaaaccccgggaaucuauaaucaagcugauggagaaaauugcccagucgucauuguguaacuga

SEQ ID NO: 62207 - RNA, 273 nt, Artificial Sequence
  derived and/or modified sequence opt3 from SCGB1D1__Homo_sapiens__NP_006543
augagacugagcgugugccuccuucuguugaccuuagcccuguguugcuacagggcuaacgcagucguuugucaggcccuaggcuccgagaucacaggguuccuccuggcgggaaagcccguguuuaaauuccaacuugcuaaguuuaaagccccucuggaagcaguagccgcuaagauggaggugaaaaagugcgucgacacuauggcauaugaaaagcggguguugauuacgaaaacccucgguaagauagccgagaaaugugaucgcuga

SEQ ID NO: 62208 - RNA, 273 nt, Artificial Sequence
  derived and/or modified sequence opt3 from SCGB1D2__Homo_sapiens__NP_006542
augaagcugagcgugugccuccuucuggucaccuuggccuuauguugcuaccaggcuaacgcagaguucugucccgcccugguuuccgaacuacucgacuuuuucuuuaucucugagccucuguucaaacuuucacuggcgaaguuugaugcuccaccggaagccguggcagccaaauugggcguaaagagaugcacagaccaaaugagucuccagaaaaggagccugauugcugaggugcuggucaagauacucaagaaauguuccguguga

SEQ ID NO: 62209 - RNA, 288 nt, Artificial Sequence
  derived and/or modified sequence opt3 from SCGB2A1__Homo_sapiens__NP_002398
augaagcugcucauggugcuuaugcuggccgcuuuguuacugcacugcuacgcagacagcggcuguaaacuacucgaggauauggucgaaaagaccaucaacuccgacauuucuauacccgaguauaaagaacugcuucaggaguucaucgauucagacgccgcggcugaagccauggggaaguuuaaacaaugcuuccugaaucagagucauagaacauugaagaacuuuggacucaugaugcacacuguuuacgauagcauuugguguaauaugaaguccaacuga

SEQ ID NO: 62210 - RNA, 282 nt, Artificial Sequence
  derived and/or modified sequence opt3 from SCGB2A2__Homo_sapiens__NP_002402
augaagcugcucauggugcuuaugcuggccgcuuugagccagcacugcuacgcaggcuccgggugucccuuacuggagaacgucaucucuaaaaccauuaauccucaaguuucaaagacagaauauaaagagcuacuccaggaguucauagacgauaacgccacuacgaaugcgaucgacgaacugaaggaaugcuuucuuaaccagaccgaugagacacugaguaauguggagguauucaugcaguugauuuacgacagcucccucugugaucuguuuuga

SEQ ID NO: 62211 - RNA, 291 nt, Artificial Sequence
  derived and/or modified sequence opt3 from SCGB2B2__Homo_sapiens__NP_001020762
augagagugaccagcgccacaugcgcucugcuccuugcacugaucuguuccguccaguugggcgacgccugcuuagauauugacaagcugcuagcgaacguuguguucgauguaucucaagaccuccugaaagaggaacuugcuagguacaaucccucaccucugacugaggaaaguuucuugaacgugcagcaguguuuugccaaugucagcgugacggagcgguuugcacacuccguugugauaaagaaaauccuccagucuaacgauugcauugaagccgcuuucuga

SEQ ID NO: 62212 - RNA, 315 nt, Artificial Sequence
  derived and/or modified sequence opt3 from SCGB3A1__Homo_sapiens__NP_443095
augaagcuggccgcucuccuuggccugugcguggcauugagcuguuccucugccgcggcuuucuuagucgggucagccaaacccguugcacagccuguggccgcucuggagagugcagccgaagcuggagccgguacccuagcgaacccacucggcacacugaauccgcuuaagcuguugcucagcucccuggggauccccguaaaccaccugauugagggaucucaaaaaugcguggcagaacucggcccucaggccgucggugcugugaaggccuuaaaagcacugcuuggggcuuugacuguuuuuggauga

SEQ ID NO: 62213 - RNA, 282 nt, Artificial Sequence
  derived and/or modified sequence opt3 from SCGB3A2__Homo_sapiens__NP_473364
augaagcuggugaccaucuuccuccuugucacaauuagccugugcuccuacucugccacugcauuuuugauaaacaaaguucccuuaccuguggacaagcuggcuccacuaccgcucgauaauauccugcccuucauggacccucuuaaacuguugcucaagacgcugggcauuucaguagaacaccugguggaagggcucagaaaaugugucaacgaguuaggaccagaagccagugaggcggugaagaagcugcuugaggcuuugagccaucugguuuga

SEQ ID NO: 62214 - RNA, 831 nt, Artificial Sequence
  derived and/or modified sequence opt3 from SCGN__Homo_sapiens__NP_008929
auggacagcuccagagagcccacccugggcaggcucgaugccgcuggguucuggcaaguguggcagcgguuugacgcagaugaaaagggauacaucgaggaaaaagagcuugacgccuucuuucugcacauguugaugaaguuagguacagaugacacugucaugaaagcgaaccugcauaagguuaaacagcaguucaugacgacccaggaugcuucuaaggacggccgcauucgaaugaaggaacuagccgggauguuucucucagaggaugagaauuuccugcuucuguuucguagagaaaacccuuuggacaguagcguggaguucaugcaaauauggaggaaauaugaugcagacuccucuggauuuaucucggccgcugaacuccggaauuuccugcgcgaucuguuucuccaccauaagaaagcaauuucagaggccaaguuagaggaauacacaggcacuaugaugaaaaucuucgacagaaacaaggacgguaggcuggaucuuaaugacuuggcucggauucuggcccuacaggagaacuuucuccugcaguucaagauggaugcgugcagcaccgaggaacgcaaacgagacuucgaaaagaucuuugcauauuacgauguaaguaaaacaggggcccuugagggaccagagguggacggcuucgucaaggauaugauggaacuggugcagccguccauaucuggcguugacuuggauaaauuuagagagauccuccugaggcacugugacgugaauaaggaugggaaaauucaaaagagcgaauuagcucugugccucggacuuaagaucaaccccuga

SEQ ID NO: 62215 - RNA, 1425 nt, Artificial Sequence
  derived and/or modified sequence opt3 from SCHIP1__Homo_sapiens__NP_001184036
auggagagaagcggccagagggugaccacaugggacugcgaucaagggaagcacuccgacucugauuaccgggaagacggaauggaucuggguucagacgccggcaguagcuccucuucgucacgcgcuagcagucaguccaacucuacuaaagucacgcccuguagcgagugcaaguccucaaguagcccugggggaucucucgaucuuguuuccgcacuggaagacuaugaggaaccauucccgguguaccagaaaaagguaaucgaugagugggcccccgaggaagacggcgaggaagaggaggaagaggaugaacgagaccagcgugguuauagagaugacaggagcccugcgcgggagccaggggacgugucagcucgcaccagaaguggaggcggcgggggaaggucugccacaacugcaaugcccccuccaguccccaaugguaacuugcaucaacacgauccucaggacuuacggcauaauggcaacgugguuguggccgggcgcccauccuguagccgaggaccgagaagggcuauucagaaaccccagccugcaggcggucggcguucggggcgcggaccagccgcuggcggccugugccuacaacccccugaugggggaaccugugucccagaggaacccccggugccucccauggacugggaggcccucgaaaagcaccuggcgggucuucaguuuagagagcaggaagcacagaagaaugagagggaaucuauacggcaaaaacuggccuugggcuccuucuuugaugacgggccaggaaucuacacaucaugcaguaagagcggcaaaccuucccucucuagccgacugcagucagguaugaaccugcagauuuguuucguaaaugauaguggguccgacaaggauagcgacgcugaugacucuaaaaccgagacuucacucgacacacccuuaaguccaaugagcaagcaauccucuucguauagcgaucgcgacaccacggaggaagaguccgaaucacuggaugacauggauuuucuuacuagacagaagaaauugcaggccgaggcaaagauggcucuggccauggcgaaacccauggccaagaugcagguugaaguggagaaacaaaacaggaagaaaaguccugucgcagaccuacucccacauaugccgcacaucucugagugccugaugaagcggagccuuaagcccaccgaucugcgcgacaugacaauuggccagcuccaggugaucgugaaugauuugcacucccagauagaaucacugaacgaggaauuaguccaacugcuccuuaucagagacgagcugcauacugagcaggaugcuauguugguugacauugaagaucuaaccaggcacgccgagagccagcagaaacauauggcugaaaagaugccugccaaauga

SEQ ID NO: 62216 - RNA, 2148 nt, Artificial Sequence
  derived and/or modified sequence opt3 from SCIN__Homo_sapiens__NP_001106177
auggccagagagcuguaccacgaagaguucgcuagggcaggcaagcaggccgggcuccaaguguggcggaucgaaaaacuugagcugguccccguuccucagagcgcgcauggagacuuuuaugugggugaugcuuacuugguauuacacaccgccaagacaucccgcggcuucacuuaucaucugcacuuuuggcuagggaaagaaugcucucaggacgagucaacggcagccgcuauuuucaccgugcagauggaugacuaccucggaggcaagccaguccaaaaccgagagcugcaggguuaugaaaguaaugauuuugugagcuacuucaaagggggacuuaaguauaaggcaggcggcguugccuccgggcugaaccauguguugacaaaugaccucacugcuaaacgucugcugcacgucaagggaagaagggugguacgggccaccgagguuccgcucucuugggauucguuuaacaaaggugacuguuucauaaucgauuuaggcacagaaauuuaccaguggugcgggucaagcuguaauaaguacgagcgccugaaagcgaaccagguggcaaccggaaucagauauaaugagaggaagggccggagugaacuuauugucguggaggaagguuccgagcccucugaauugaucaaggugcugggggagaaaccugagcuaccagacggaggcgaugacgaugacauaaucgccgacauuagcaaccgcaagauggcuaaacucuacauggucuccgaugccucaggcaguaugcgaguuacugugguagcagaagagaaucccuuuagcauggcuaugcugcuuucugaagagugcuucauccuggaccacggggccgcgaagcaaauuuuuguguggaaaggaaaggaugccaacccucaggaaagaaaagcagcuaugaagacagccgaggaguucuugcagcagaugaauuauuccaagaacacccaaauccagguccucccagaagguggcgagacgcccauauuuaaacaguucuucaaggacuggagggauaaagaccaaucagauggguuuggaaagguguacguuacugaaaaaguggcucagauuaagcagaucccuuucgacgccagcaagcugcauaguucuccacagauggcagcccaacacaauauggucgaugacggcuccgguaaaguggagauuuggcggguagaaaacaaugggcguauccagguugaucagaacagcuauggcgaguuuuacggaggcgacuguuauaucauuuuauacaccuacccgcgcgggcagauaaucuauacauggcaaggagcuaacgcgacuagagacgagcugaccacaucggcauuccucaccgugcagcuugauaggucucuggguggccaggccguccagauucgggugucccaagggaaggaacccguccauuugcuaucacuguuuaaagacaagccucucaucauauacaaaaauggaacgaguaagaagggcggucaggcuccagcacccccuacucgacuguuccaggugcgcagaaaccuugccagcauuacaaggaucguugagguggauguagacgccaauucccugaacucuaaugaugucuuuguguugaaacucccacagaacagcggguauaucuggguuggcaagggagcuucacaagaagaggagaaaggcgccgaauacguggcaaguguccugaagugcaaaaccuuacggauucaggagggggaagaacccgaagaguucuggaacucccugggagguaagaaggacuaucagacuagcccgcuacucgagacacaagcggaagaucacccuccccgccuguacggcuguucuaauaaaaccgggagauuugugaucgaggaaauuccaggagaguucacgcaggacgaucuugcugaagacgauguaauguugcuggacgccugggagcagauauuuaucuggauuggcaaggaugcaaaugagguggagaaaaaggagucacucaaaagugccaagauguaucuggaaaccgacccuagcgguagggacaaacguacacccaucguuaucauuaagcaggggcacgagccacccacuuucaccggcugguuucuuggaugggauuccucuaagugguga

SEQ ID NO: 62217 - RNA, 240 nt, Artificial Sequence
  derived and/or modified sequence opt3 from SCLT1__Homo_sapiens__NP_001287826
auggccgcugagaucgacuuccugagagaacagaacaggcggcucaaugaggauuuucgccgauaccaaauggagagcuucuccaaguauucuucagugcagaaagcagucugccagggcgaaggggacgauaccuuugaaaaccuuguuuucgaccagaguuuucuggcccccuuggugacagaguacgauaagcacuuaggagagcugaauggucaacuaaaauauuaccaggcguga

SEQ ID NO: 62218 - RNA, 1362 nt, Artificial Sequence
  derived and/or modified sequence opt3 from SCLY__Homo_sapiens__NP_057594
augcccggcagcuccggggccggaauggaggcugcaguggccccugguagagacgcgccagcuccggccgcaucucagcccucaggcugcgggaagcacaacaguccugaaaggaaagucuacauggauuauaaugccaccacaccacuggagcccgaaguuauccaagcuaugacuaaggcaaugugggaggccuggggaaacccuagcuccccauacucugcuggccggaaagccaaggacauuauaaaugcggcacgcgaaucgcucgccaaaaugaucggugggaagccccaggauauuaucuucacgucaggaggcaccgagagcaacaaucuugugauucauaguguagugaagcacuuucaugcuaaccagacauccaaaggccacacugggggacaucacucuccugucaagggugccaaaccacacuucaucaccagcuccguggagcaugacucaauacgacugccguuggaacacuuaguugaggaacagguggcagcugucacauuugugcccguaaguaagguuagcggccaagccgagguggaugacauccuggcggccguccguccuaccacuaggcuagugacaauuaugcucgcaaauaacgagaccgggaucgugaugccaguccccgaaauuucucagagaaucaaagcucugaaucaggagcggguugccgcuggacuuccuccaauacuggugcauacggaugccgcacaggccuugggcaagcaacgcguagacguggaagaucucggugucgacuuccugacuauuguggggcacaaguuuuauggacccagaaucggcgcucuguacauuaggggccucggggaguucaccccguuauauccuaugcuguuuggagguggccaggaacggaacuuccgccccgggacagagaauacuccaaugaucgcgggacuuggcaaagcagccgaguugguuacccagaacugugaggcuuacgaagcccacaugcgagaugugagagacuaucuggaagagaggcuagaagcagaguuuggucagaagcggauccaucucaauucccaauucccugggacacagcgucugcccaauaccugcaacuuuucaauucgcggcccaagacuucagggacacgucgugcuggcccaauguaggguauugauggcuagcguuggcgccgcaugccauagugaucacggggaccagcccucuccugugcuccuguccuacggagucccauucgacguggcgcggaacgcuuuacgacugagcgucggucgcucgacgacuagagccgagguggaucucguugugcaggaccuuaaacaggcaguagcccaacuggaagaucaggcuuga

SEQ ID NO: 62219 - RNA, 2103 nt, Artificial Sequence
  derived and/or modified sequence opt3 from SCML2__Homo_sapiens__NP_006080
augggccagaccgugaacgaggacagcauggaugucaagaaagaaaaucaagagaagacaccccaguccucuacuucaaguguucagagagacgauuuccacugggaagaguaccugaaagaaacggggagcaucuccgccccuucugagugcuuuaggcagucgcaaauuccaccggugaacgacuucaagguaggaaugaaacucgaggcucgggauccccgcaaugcaaccucaguguguauagccacagucaucgguauuacuggcgcgcgacuucgucugagauuggacgggagcgauaacaggaaugacuuuuggcgguuaguggauaguccugacauccagccaguuggaaccugcgaaaaggagggcgaucugcuacagcccccucucgguuaucagaugaacacauccucuuggccaauguuccugcuuaagacccugaaugggagcgaaauggcuuccgccacuuuguuuaaaaaggagcccccuaaaccaccgcucaacaauuucaaggugggaaugaaacuggaggcaauugacaagaagaaccccuaccugaucuguccugccacaauaggcgaugucaaaggcgacgaagugcauaucaccuuugacggguggucaggagcuuucgauuauuggugcaaguacgacagucgcgauauuuuuccagcagguugguguagacucacgggcgacguauuacaacccccugggacuagcguuccaaucgugaaaaauauugccaagaccgagucuucccccucagaagcuagccagcacaguaugcagucuccgcagaaaacaacucugauccuuccuacccaacaggucaggcgguccagccgcauaaagcccccaggaccuacagccgugcccaaacgaucgucuuccgugaagaacauuaccccaagaaagaaaggccccaauucagguaagaaagagaagccuuugccagucaucugcaguacgagcgcggcaucccugaaaucucuaacuagggaucgggggaugcucuauaaggacguugccagcggaccguguaagauugugaugucaacaguaugcguguacgucaacaaacauggcaauuucggcccccaccuggauccuaagcguauccagcaacuuccagaccauuuugggcccggaccugugaacguugugcugcgcagaaucguccaggcuuguguggauugcgccuuggaaaccaaaacuguauucgguuaucucaagccagacaacaggggcggggagguuauuacagcaaguuuugauggagagacccacuccauacagcugcccccggugaauagcgcuucuuucgccuuacgguuccuggaaaacuuuugucacucacuccagugcgacaaucuucugaguagccaaccuuucuccucuucgcgaggccauacgcacagcuccgcggagcaugacaaaaaccagucagccaaggaagaugucaccgagcgccagaguacaaagagaucuccacagcaaacugugcccuacgucgugccuuugagccccaaacuaccaaagaccaaagaauacgcauccgagggugagccucuguuugcugggggcucagccauccccaaggaagagaaucucagcgaagacucuaaauccaguagccugaacucuggaaauuaucuuaacccagcuugcaggaauccgauguacauucacacauccguuucacaggauuucagucggagcgugccuggcacuaccucgucccccuuaguaggggacaucucuccaaagagcucaccccacgaggucaaguuucagaugcagcgcaaaagugaagccccuuccuauauagcagugccagaucccucuguuuugaagcaaggauucagcaaagacccuuccacauggucaguggaugaggucauucaguuuaugaagcauaccgacccgcagaucagcgguccacucgccgaucuguucagacagcacgagaucgacggcaaagcucuguuucugcuaaagagugaugugaugaugaaauacauggggcucaagcugggacccgcgcuuaaguuguguuauuacauugaaaaacugaaggagggcaaauauucuuga

SEQ ID NO: 62220 - RNA, 1245 nt, Artificial Sequence
  derived and/or modified sequence opt3 from SCML4__Homo_sapiens__NP_932347
augcagagccaaagaauccccggcaggaagcgggggcgcccuucccugcacucuaccccaaugaaaauggccgugcauaaccucuacucagcuagugcaggaagccuuccggccgucaagauucccaaaaagcgaggucguaaaccuggcuauaagauaaaguccagaguucugaugacaccauuggcguuaucucccccuaggucgacuccagagcccgaccugucaagcaucccucaggaugcugccacggugccaagucuagcagccccgcaggcucucaccguaugccuguacauuaauaaacaggcaaacgccgggcccuaucuugaacggaagaaagugcaacagcugccugagcacuucggaccagaacgccccuccgcugucuugcagcaggccgugcaagcguguaucgacugcgcacaucagcagaagcucguguuuucucugguuaaacagggcuacgguggggagauggucagcguguccgccucauucgauggaaagcaacaccugagaagucucccuguaguuaauagcauuggcuauguguuaagguuucuggcuaagcugugucggucuuugcugugcgacgaucuauucucccaucagccauuuccccgcggcuguucagccagcgaaaaaguccaggagaaggaggaagggcgaauggagagugugaaaacagugacuaccgaagaguaccucgucaacccgguuggaaugaauagauauucuguggacacauccgcaagcaccuucaaccacagggguucgcugcacccuucuuccucacuuuacugcaagcggcaaaauaguggcgauagccaucuugggggaggccccgcugccacugcgggugggccacguacauccccuaugucuagcggaggccccucagccccaggcuugagacccccugcaaguuccccaaaacgcaacaccacgagccucgaggggaauaggugugcuucuucaccgagucaggacgcccaggaugcucggcgaccccgcagcagaaacccuuccgccuggacuguagaagacguggucugguuugugaaggaugcagacccacaggcccugggaccccacguugaguuauucaggaaacaugaaaucgaugguaaugcucugcuccuucugaagucugacauggugaugaaguacuugggccuaaaacuggggccugcgcucaagcugugcuaucacauagacaaacuuaagcaagcaaaauuuuga

SEQ ID NO: 62221 - RNA, 5871 nt, Artificial Sequence
  derived and/or modified sequence opt3 from SCN10A__Homo_sapiens__NP_006505
auggaguuccccaucggcucgcuggaaaccaacaauuuuagaagguucacaccugagucccucguggaaauugagaagcagauugccgcuaaacaagggacuaagaaagcacgggaaaagcaccgcgagcagaaagaccaggaggaaaagccacgaccgcagcuugaucugaaggccugcaaccaauugcccaaauuuuacggagaguuaccugcggaacugaucggugagccacuggaggaccucgaucccuucuauucuacgcaucguaccuuuaugguccugaauaagggcagaacaauuucaagguucagugcuacucgggcccuuuggcuguuuagcccuuucaacuugauccgcagaaccgcaauuaaaguuuccgugcacucuugguuuagccucuucaucacaguaaccauacuggugaauugugucugcaugacuaggacagaccugccagaaaagaucgaguacguguuuaccguuauuuauacguucgaagcccucaucaaaauuuuagcucggggguuuugucugaacgaguucacuuaccuucgcgaucccuggaauugguuggacuucucagugaucacccuggcauaugucggaacagccauagaucuucgaggcauuagcggucucagaacuuuuagggugcugcgggcucuuaagaccguaaguguuaucccugggcugaaggugauugucggagccuugauccauuccgugaaaaagcucgcggacgugacaauccugaccauuuucugcuuaucugucuuugcacugguuggccuccagcuuuucaaaggcaaccugaagaauaaaugugugaagaacgauauggccguaaaugaaacgacuaacuacagcucccaccguaaaccagacauauauaucaauaagcgcgggacaucagauccguugcuaugcggaaacgguagugacagcggccauugucccgauggguacauuugccugaagaccucugacaauccugacuuuaacuacacuuccuucgauucauuugcuugggccuuccucagccuguuuagacuuaugacacaggacaguugggagaggcuguaucagcaaaccuugcggacgucuggaaaaaucuacaugauauucuuugugcucgucauuuuccugggcuccuuuuauuuagugaaccugauccuagcaguugugaccauggcuuacgaggaacagaaucaggccacaacugaugagaucgaagcgaaggagaaaaaguuccaggaagcccucgagaugcugcgaaaagagcaagaaguccuugcagcuuuggguauugacaccacaagccugcacucgcacaacgggucuccacucacuuccaagaaugccucagagcgcagacauaggaucaagccccgggugagugaaggaagcaccgaggauaacaaauccccucgcucugacccauauaaucagagaaggaugagcuuccugggccuugcuucaggcaagcgucgggccagucacggguccguauuucauuuccgaagccccggaagagauauuucucugccggaagguguuacagacgauggcguguuuccuggggaccacgagucacacaggggaaguuugcuccugggcgguggggcaggccagcaaggacccuuaccacgcagcccucugccccagccauccaaccccgauucucggcauggcgaggacgaacaccagccuccaccgaccucggagcuagcccccggggcugucgacgugagcgcguucgaugcaggacagaaaaagacuuuucucuccgccgaauaccuggacgagccuuucagagcucaaagggccaugucagucgugaguauaaucacgucuguucuugaggaauuggaggaaagcgagcagaaauguccacccugccugacaucccucucacagaaguaucugauuugggauuguugcccuaugugggugaaguuaaaaaccauccuguuuggucuuguaacugacccauucgcagaauugaccaucacacucugcauugucgugaauaccauauuuauggccauggagcaucacggcaugagccccacuuucgaggcuaugcugcagaucgggaacauuguuuuuacaaucuucuuuacggccgaaaugguguucaagauuaucgcauucgauccguacuacuauuuucagaaaaaguggaauauauucgacuguaucauugucaccgugucucuacuggagcucggaguagcgaaaaagggcucccugagugugcuucgcagcuuucgauugcugcggguuuucaaguuagcuaaaucuuggccuacucucaacacacugaucaagauuaucgguaauuccgucggggcccuuggcaaccugaccauaauuuuggcaaucauuguguuuguguucgcccucgucggaaaacagcugcuaggcgaaaauuaccguaacaauagaaagaacaucucagcuccacaugaggauuggcccagguggcacaugcacgacuuuuuccauaguuuucugauaguuuuccgcauccucugcggggaauggauugagaacaugugggccuguauggaggugggacagaaaagcaucugccugauucuauuuuugacagugaugguacuggguaauuuagucgugcucaaccuguucaucgcacuucugcuaaauucguucuccgcugauaaccucacugccccugaagacgauggcgagguuaauaaccugcaaguggcguuggcccggauacaggucuuugggcacagaaccaagcaggcucuguguucuuucuuuagcaggucaugccccuucccacagccuaaagcagaacccgaguuagugguuaagcucccacugaguuccucuaaggccgaaaaucauauugcugccaacacggcacgaggaagcuccggcggucuucaggcgccgcgcgggccucgggacgagcacucagauuuuaucgccaaucccaccguguggguaagcgucccaaucgcugagggcgaaagugaccuggacgauuuggaggacgauggaggcgaagacgcccaaucuuuccagcaggaggugauucccaaagggcaacaggagcagcuccagcaaguggaaagauguggagaucaccugacaccuagguccccaggcacugguaccagcucggaggaccuagcacccucacugggggaaacauggaaggaugagucugucccucagguuccggcugaaggaguggacgauacaaguuccagcgagggcucuaccguagacugccuugauccagaggaaauccuccguaaaauucccgagcuggccgacgauuuggaggaaccugacgacuguuuuacggaagguugcauacgccauuguccaugcugcaagcuggauacaaccaaaagccccugggacgugggcuggcagguccggaagacuuguuauagaaucguggagcacuccugguucgagucauuuauuaucuucaugauuuuacucaguagcgggucucuggcauuugaagauuacuaucuugaccagaagccuacaguuaaagcccuguuggaguacaccgauaggguguucacuuuuaucuucgucuucgaaaugcuccugaaguggguggcuuauggauuuaaaaaguacuucaccaacgcguggugcuggcuagacuuucugauaguuaauaucucccuuauuucacucacagccaaaauccuggaguacagugaaguggcaccgauuaaggcuuugcgaacguuacgggcccugcgcccccucagagcccugagcagguucgagggcaugcgggucguaguggaugcucuuguuggggcaaucccauccauaaugaacgugcuguuggucugucuaauauuuuggcugaucuucucuaucaugggagugaaucucuuugccggcaaguucuggcgaugcauuaacuauaccgacggugaguuuucgcugguaccucuuagcauagugaauaacaaaucagauuguaagauccaaaacuccacugggaguuucuuuugggucaauguuaaagugaacuucgacaauguggcgaugggauacuuagcucugcuccaggucgccacauuuaagggcuggauggauauuauguaugcagccguggacucuagagaaguuaacaugcagcccaaaugggaggacaauguauacauguauuuguacuucgugaucuucauuaucuuugguggcuucuuuacccugaaccucuucgucggggugauaaucgauaauuuuaaccagcaaaagaagaaacugggaggccaggacauuuucaugacagaggaacaaaagaaauauuacaaugcuaugaagaaacuugggagcaagaaaccacaaaagccuaucccccgcccacugaacaaguuucagggauucguuuuugauauugugacuaggcaggcauucgacaucaccauaauggucuugauuugccuaaauaugaucacgaugaugguggagacagaugaccaguccgaagagaaaaccaagauccugggcaaaauuaaccaauuuuucguagccgucuuuacuggugaaugugugaugaagauguucgcgcuccgucaguacuauuucaccaauggguggaacguuuuugauuucaucguggucguguuaucaauagcuucucugauuuuuagcgccauccuuaaaagucugcaguccuacuucagcccgacacucuuucggguuauuagauuggcaaggaucggacgcauacugcgacucauuagagccgcuaagggcauccggacucugcuuuucgcccuaaugaugucucugccugcauuguuuaauaucgguuuacuacucuuccuggugauguuuauuuauucaaucuucggcauguccaguuuuccccaugucaggugggaggcugggauugacgauauguucaacuuucagaccuucgccaacagcaugcuuugccuguuccaaauaacaacgucggcgggaugggacggccucuugucuccaauccugaauaccgggcccccuuacugugauccaaaccuacccaauuccaacggaacucgcggcgacugcgguagcccugccguggggauuaucuuuuucacaaccuauaucauuauaucauuucugaucguagugaauauguacauugcaguuauccucgaaaacuucaaugucgcuacugaggagaguacagaaccgcuuucugaggaugacuuugacauguucuaugaaaccugggagaaguuugauccagaagccacgcaguucauuacuuuuuccgcucugagcgacuucgcagauaccuuaucaggacccuugcguaucccuaaacccaacagaaauauacugauccagauggaccucccacuggugccuggcgauaagauucacugucuugacauccuguuugccuucacuaaaaacgugcucggcgagaguggggaguuggauagccugaaggccaauauggaagagaaauuuauggcuaccaacuuauccaagucuagcuacgaacccauugcgacuacacuacgguggaagcaggaggacaucuccgcaaccgucauacaaaaagccuacaggucauauguacugcaucgcucuauggcucucaguaauacaccaugcgugccucgagccgaagaggaggcagccucgcuuccggaugaaggauucguugcuuucacugcgaacgagaauugcgugcugcccgacaagagcgaaaccgccuccgcaacgucuuuuccaccuucauacgagagcgucacaagagguuuguccgaucgggugaacaugaggaccaguucuagcauucagaaugaggacgaagcuacuucaauggagcugaucgcccccggcccauga

SEQ ID NO: 62222 - RNA, 5376 nt, Artificial Sequence
  derived and/or modified sequence opt3 from SCN11A__Homo_sapiens__XP_011531622
auggacgauagaugcuaccccgugaucuucccugacgagaggaacuuucggccauucaccagcgauucccuggccgcuauugaaaagcgcauagcaauccagaaagagaagaaaaagucuaaagaccaaacaggcgaagucccgcagccccgaccucagcucgaucuuaaggccucacguaagcugccaaaauuguauggggacauucccagagaguuaaucggaaagccucuggaagaucuagacccauuuuacaggaaucacaaaacuuucaugguucucaaccggaagcgcacgauuuauagauuuagugcgaaacaugcucuguucaucuuuggucccuucaauagcauaaggucccuugccauccgggugucuguacacucgcuguuuucaauguucauuaucggcaccgugauuaucaacugugucuuuauggcaacagggccugccaagaauagcaacaguaauaacacugauauagcugagugcguguucaccggaauuuacaucuuugaggcauugauuaagauccucgcccgcggcuucauccuggacgaauucuccuuucugcgagauccauggaauuggcucgacucuauuguuauagguaucgcuauugugagcuauaucccggggauaacaauuaaauuacugccccuuagaaccuucagggucuuucgggccuugaaggcgaucuccgugguaucacgucugaaaguuaucgugggagcacuacuccgcagugucaagaaacuggugaacgugauuauccuuacuuucuuuugucugagcauuuucgccuuggucggccagcaacucuuuaugggcucucugaauuuaaagugcauauccagagauuguaaaaacaucucaaauccugaggcuuacgaccauugcuucgaaaagaaggagaacagcccagaguuuaaaaugugugggauuuggaugggaaauagugccugcucuauccaguaugaauguaagcacacaaaaaucaaccccgacuacaacuacaccaauuucgauaacuuugguugguccuuccuggcaauguuuaggcucaugacgcaggacagcugggagaagcuuuaucagcaaacucugcggaccacaggcuuguacucgguuuucuucuuuauugugguaauauuccuagggucuuuuuaucugaucaaucucacucuggcuguggucaccauggccuacgaagagcagaacaaaaauguggcggccgaaauugaggcaaaggagaagauguuccaggaagcucagcaacuucugaaagaggaaaaggaggccuugguugcuaugggaaucgaucgauccucacucacaagucuggaaaccagcuauuuuacgccuaaaaagcgcaaauuauucggcaacaagaagagaaaauccuuuuuccugagggagucugguaaggaccagccacccgggagcgauucagacgaggauugccagaaaaagccgcaacuacucgaacagacuaaacggcugagucagaaucuuuccuuggaccauuuugaugagcacggagacccucugcagcgccaaagagcccucagcgcagugucuauucugacaaucaccaugaaggaacaggagaagucacaggaacccugucuuccaugcggcgagaaccuggccaguaaauacuuggucuggaauugcuguccucaguggcucugcgugaagaaaguacugaggacuguuaugacagaucccuucaccgaguuagcuauaacgaucuguauuaucauuaacaccguguuucuggcgauggaacaccauaagauggaggcaagcuucgaaaaaaugcuaaauaucggcaaccucgucuuuacauccauauucauugccgagaugugccugaagaucauugcucuugacccauaucacuacuuccgucggggguggaauaucuuugacucuauaguggccuugcugucguucgcagaugucaugaacugugugcuccaaaaacgaagcuggcccuuucugagauccuucaggguuuuacgcguguuuaagcuggccaagucauggccuacucuuaauaccuugaucaaaauuaucggaaacaguguaggugcucucggcucucugacagucgugcuaguuauugugaucuucauauuuagcgucguggggaugcagcuguucggacgguccuuuaacucacagaagagcccaaaacucugcaauccgacuggccccaccguaucuugucugagacauuggcacaugggugacuucuggcacuccuuucuugugguuuucaggauuuugugcggggaguggaucgaaaacaugugggaguguaugcaggaagccaaugcaaguagcucucugugcgucaucguguucauuuuaaucacagugauuggcaagcucgucguucugaaccuuuuuauagcgcuguugcucaauuccuucucaaacgaggaacgcaauggaaaccuggagggcgaggcucgaaaaaccaaggugcaacuagcccuggaucgguuucguagagcauucuguuuugugaggcauacucucgaacacuucugccauaaguggugccgcaaacagaaucugccucagcagaaggagguagccgggggaugugcugcccaaaguaaagacaucauuccacuugucauggaaaugaagcgggguagcgagacgcaggaagaguugggcauccugacaucggugcccaaaaccuuagggguuagacacgauuggacuuggcucgcaccucuggcugaggaagaggacgauguggaauuuuccggagaggacaacgcccagaggauuacccaaccagaacccgagcagcaggcguacgagcuucaucaggaaaauaagaagccgacaucucaacgaguccagagcguggagaucgauauguucucagaagacgagccucaccugaccauacaggauccacgcaaaaagagugacguuacuuccauccuaucugagugcagcacaauugaucuccaggacggcuuugguuggcugcccgaaauggugccuaaaaagcaacccgagcgguguuugccaaaaggguucggcugcuguuuuccuugcuguuccguagacaagagaaagcccccaugggucaucugguggaaccugaggaaaacgugcuaucagauugugaagcacucaugguucgaaagcuuuaucauauucgugauuuuacucaguucuggagcccugaucuucgaggauguccaucuugaaaaucagccgaaaauccaggagcuguugaacuguaccgacauuauauuuacucacaucuucauucucgagaugguucugaaguggguggcuuuuggcuucgggaaauacuuuacauccgcauggugcugucuagauuucaucauuguaaucgugagcgucaccacacugauaaaucuuauggaacucaagucguuucguacucugcgcgccuugcggccucugagagcuuuaucacaauucgagggaaugaaagugguugugaacgcccucaucggugcaauucccgcgauccugaacguccuucuggugugcuugauuuuuuggcucguuuucugcauccugggcguguauuuuuucucugggaaguuuggaaaguguauaaauggcaccgacagugucauuaacuacacgaucaucaccaauaaaucccagugcgaaagcgguaacuucucuuggauuaaucagaagguaaacuucgauaauguggggaacgccuaucuagcucugcuucaaguugccacauuuaaaggcuggauggacaucauauacgcagcuguggauagcacugagaaggaacagcagccagaguucgaguccaauucacucggauauauuuacuuugucguguucaucauuuuuggcaguuucuuuacccugaacuuguucaucgggguaauaauugacaauuuuaaccagcaacagaaaaaguuaggaggccaggauaucuucaugacagaagagcagaagaaauacuauaaugccaugaagaaacuggguagcaagaaaccccaaaagccuaucccaaggccccucaacaagugucaggggcugguguuugacauugucacuucucagaucuucgauauuauaaucauuucccuuaucauccugaauaugauuucaaugauggcagaaaguuacaaccagccuaaagccaugaagagcauauuggaccaucuaaacuggguuuuuguggugaucuucacccuggagugccucauuaaaaucuucgcucugcgacaauauuacuuuacgaauggauggaaccuuuucgauugugucgugguuuuacuguccauuguaucuacaaugaucucgacccucgaaaaucaggagcacauaccguuuccacccacuuuguuccggaucgugcgccuggcgagaauuggcaggauccuccggcugguccgagccgcaagagguauucgcacacuucuguuugcuuugaugaugagccuaccuucacuguucaacaucggccucuuacuguuucuuauaauguucauuuaugccauccuggggaugaauugguuuuccaaggugaacccagagaguggaauugacgacaucuucaauuuuaaaaccuucgccucuagcaugcucugcuuguuucagauauccacuucagcuggcugggauucucugcucagccccaugcugaggaguaaggaauccuguaacagcucuucagagaauugccaccuuccugggaucgcaaccuccuacuucguuaguuauauuaucauuagcuuccuaaucguggucaacauguacauagccgugauucuggaaaauuuuaacacagcgacggaggagucggaagacccguugggagaggaugacuucgauaucuuuuacgaaguaugggagaaguucgaccccgaagcuacccaguuuaucaaauauucugccuuauccgauuucgcagacgcccugccagagccucuccgugucgcuaagcccaauaaauaccaauuucuggugauggaucuuccaaugguuagcgaggaccggcugcauuguauggauauucucuucgcauuuacugccagaguguugggcgguucagacgggcuggacaguaugaaggcgaugauggaagagaaauucauggaagcuaacccucuaaagaagcuguaugagcccaucgucacaaccacaaaaaggaaggaagaggagcgcggagccgcaauaauucagaaagccuuucgaaaguacaugaugaaagugacuaagggcgaucagggugaccaaaaugaucucgaaaacggcccacacucuccgcuucagacccugugcaauggggacuuauccagcuucggaguugcuaaaggcaaggugcauugugauuga

SEQ ID NO: 62223 - RNA, 6030 nt, Artificial Sequence
  derived and/or modified sequence opt3 from SCN1A__Homo_sapiens__NP_001159435
auggagcagaccgugcugguccccccuggcccagacagcuucaacuuuuucacaagagaaucccucgccgcuaucgagaggcggauugcagaagagaaggccaaaaauccgaagcccgauaaaaaggacgaugacgaaaacgggccuaaaccaaauucugaucuugaggcgggaaagaaccugcccuuuauauacggugacaucccuccagagaugguuucagaacccuuggaggauuuagacccuuauuacauuaauaagaaaacuuucaucgugcugaacaagggcaaagcuauuuuucgcuucagugccacgagcgcacuauauauccucaccccauuuaauccgcugcgaaagauagccaucaaaauucuuguacacucccuguucucuauguugaucaugugcacaauucucacuaacuguguguuuaugaccaugucgaaucccccugauuggacaaagaacgucgaauacaccuucacugggaucuauacauuugagucacugauaaagauuaucgcucguggauucugccuggaggacuuuaccuuccucagagauccauggaauugguuagacuucacggugauuacuuuugcauacguuaccgaauucguggaucugggcaacgucagcgcccuuaggacauuucggguguugcgcgcucugaaaacuaucaguguaauccccggucuaaagaccauuguuggggcccucauacaauccgugaaaaagcugucugacgucaugauccuuacaguguucugucugagcguguuugcguugauuggacuccagcuguucaugggcaauuuaagaaacaaaugcauccaguggccuccaaccaaugcaucccuggaggaacauucaauagagaagaacauuacggucaacuauaauggcacucucaucaacgaaacaguuuuugaguucgacuggaaaaguuacauccaggauagcagguaccacuauuuucuugagggguuccuggacgccuugcuauguggaaauucuuccgaugcuggucaaugccccgaaggcuacaugugugugaaggccgggcggaacccgaauuauggauacaccucauuugacacuuucagcugggcauuucugagucucuuccgccugaugacacaggauuucugggagaaccuuuaucagcugaccuugcgagcugccggcaagacguacaugauuuuuuucguacucgugaucuuucuggguucuuucuauuuaauuaaucugauacuagcggucguggccauggcauacgaagagcagaaccaagcuacccucgaagaggccgagcagaaagaagcugaguuucagcagaugaucgaacaacugaagaaacagcaggaggccgcacaacaggccgcuacagcgacugcauccgaacauagcagagagccuucggccgcugggaggcuuucugacuccucaagugaggccagcaaguuguccucuaaaagcgcaaaggaacggcguaaucgcagaaagaaaaggaagcagaaagagcagucaggaggcgaagagaaggaugaggacgaauuccaaaaaagugaguccgaagauagcauucggcgaaagggcuuucgcuucucuaucgaggggaacagacugaccuacgaaaagagguauucaaguccccaccagagccuccuguccauccggggaucucuuuuuucgccacgcagaaauagcaggacaucccuguucucauuucguggucgggccaaagacguuggcagugagaacgauuucgcugacgacgagcauucuacuuuugaagauaaugagagccgaagagacuccuuguucgugccuaggcgccacggggaacggagaaacucaaaucucagccagaccucuagguccagucgcaugcuggccgucuuccccgcaaacggaaagaugcacagcacaguggauugcaacggcguaguuucuuuagugggugggccauccguccccaccucaccugugggccagcugcuaccagaggucauuauagacaaaccggcgacugaugacaauggaacgacaaccgaaacugagaugcgaaagcggcguaguagcucguuucauguguccauggauuuccucgaggaccccucucaaagacagagggcuaugagcaucgccucaauucugaccaacacaguugaagagcuugaagagagucgccagaaauguccuccaugcugguacaaguuuuccaauaucuucuugauuugggauuguucucccuauuggcugaaggugaaacacguagucaaccucgugguuauggacccuuuuguggaucuggcaaucaccauaugcaucgucuuaaauacucuguucauggccauggaacauuacccaaugacagaccacuuuaacaaugugcuuacgguaggcaacuugguguucaccgggauuuuuacugcugagauguuccucaagaucauugccauggaucccuauuacuauuuucaggagggauggaauaucuucgacgguuucauaguuacacugagccuagucgaacugggccucgcaaacguggaggggcuguccgugcuucggucauuuagauugcugagggucuucaaauuagcuaagagcuggccgacccucaauaugcugauuaaaaucauuggaaacaguguuggcgcccuugguaaucugacauuggugcucgcgaucauaguguuuaucuucgccguagucgggaugcaacuguuuggcaagucuuacaaagacugcguguguaagauugcuuccgauugccagcuaccucgauggcacaugaacgacuucuuucauagcuuccugaucguuuuucgcgugcucuguggagaauggauugagacuaugugggauugcauggaggucgcaggccaggccaugugucugaccguguucaugaugguuauggugaucgggaaucuuguagucuugaaccuguuuuuagcucuccugcuuucgucauucucugccgacaaccuggcagcgacggaugacgauaaugaaaugaacaaucuacagauagccguggaccggaugcacaagggaguggcuuacgucaaaagaaagauuuaugaguuuauccaacagaguuucaucaggaaacagaagauucucgaugaaaucaaaccacuggacgauuugaacaauaagaaggacuccugcaugagcaaccauaccgccgagauugguaaagaucuggacuacuuaaaggacguuaauggcacaacuucugggauaggaaccggcagcuccguggaaaaauauaucauugaugagucagacuacaugaguuucaucaacaaucccagccucacaguaacugugccuauugcagucggugagucugauuuugaaaaccugaauaccgaggacuucuccucagaaagugaucuugaggaaagcaaggagaaacugaacgaguccucuucgagcucagaaggguccacgguggacaucggcgcucccguugaggaacaaccaguggucgagccugaagagacauuggagcccgaagccuguuuuaccgagggaugcgugcagcguuucaaguguugccagauaaauguugaagagggccgcgggaagcagugguggaaccuccggagaacuuguuuuaggaucguggagcacaauugguucgaaacauuuauugucuucaugauccugcuaaguucuggagcacuggccuuugaggauauuuauaucgaccaacgaaaaaccauaaagacuaugcuugaauacgcugauaaaguauucaccuauauuuuuauccucgagaugcuguugaaguggguggcguacggcuaccagacauauuucacgaacgccuggugcuggcuggacuuuuuaaucguugaugugagccucgucucccugaccgcaaacgcucuugguuacucagaacugggggccauuaaaucuuugcggacucuccgcgcccugagaccacuaagggcucugagccgguucgagggaaugcgagugguagugaaugcacuucucggcgccauaccgaguaucaugaacguccuguugguuugcuuaauuuucuggcugaucuuuuccauuaugggugugaaucucuucgcgggcaaguuuuaucauuguaucaacacaaccacaggggacagauucgacauagaggaugugaauaaccacacugacugccugaagcuuaucgaacgcaaugagaccgcuagguggaaaaacgucaaggugaauuuugauaacguuggauucggcuaccugagcuugcuacagguagccacguuuaaaggguggauggacauuauguaugcagccguggauucucguaaugucgaacugcagccuaaguacgaggaaucacucuauauguaccuguacuucgugaucuuuauuaucuucggauccuuuuucacacuuaacuuauuuauaggcguuauuaucgacaauuucaaccaacagaaaaagaaauucggugggcaggauaucuuuaugaccgaggagcagaagaaguauuacaaugcuaugaaaaagcugggaaguaaaaagccccaaaaaccaauuccccggccuggcaacaaguuccaggguaugguguuugacuucgucacuagacagguguuugauaucagcauaaugauucucaucuguuugaauaugguaaccaugauggucgaaacagacgaucaaucggaguaugugacuaccauucugucuaggaucaaccucguuuucauagugcuguuuacaggcgaaugcguccuuaagcugauuuccuugcgccacuacuauuucacgaucggguggaacaucuuugacuucgugguugugauucuaagcaucgucggaauguuucuggcagagcucauugaaaaauacuucgugucaccaaccuuauuucgaguaauaagacuggcccggaucggcaggauucuucgccugaucaagggggcgaaaggaauccguacucucuuguucgcucugaugaugagucuccccgcccuguucaauauuggccuucuacuguuuuuggugauguucauauaugcaaucuuugguaugucuaacuucgccuacguuaagagagaggucgggauugaugacauguuuaauuucgagacauuuggaaacuccaugaucuguuuauuccagauuaccacuagcgcuggcugggacggucugcucgccccuauccugaauucaaaaccgccagauugcgaccccaacaaggugaauccuggcaguagcgugaagggggauuguggaaacccauccgucggcauauuuuucuuuguaucuuacaucauuaucagcuuccuugugguugugaauauguauauugcagucauccuggaaaacuuuuccguggcuacagaggaaucagccgagccccucucugaggacgauuucgaaauguucuacgagguuugggaaaaauuugacccugaugcgacccaguucauggaguuugaaaaguugagucaguucgccgcagcucuggagccgccccuaaaucugccacaaccuaacaaacuccagcuuauagccauggaccugcccauggugucgggggaucggauucauugcuuagacaucuuguuugcuuucacgaagaggguccugggagagagcggcgaaauggaugcacuccgcauucagauggaggaacgauuuauggccuccaauccaucuaaagugucauaucagccuaucacuaccacacugaagagaaagcaagaggaaguaagcgccgugauaauccagcgggcuuacaggcgccaccuucugaaaagaaccguuaagcaggcguccuucacuuauaacaaaaauaagauuaaagguggggcaaaccucuugaucaaggaggacaugauuaucgauaggauaaacgagaauaguauuacagaaaagaccgaccugacaaugucuacugccgcuugucccccaagcuacgaccgggucaccaaaccgaucguggagaagcaugaacaggagggaaaagaugaaaaggccaaaggcaaguga

SEQ ID NO: 62224 - RNA, 657 nt, Artificial Sequence
  derived and/or modified sequence opt3 from SCN1B__Homo_sapiens__NP_001028
augggcagacugcucgcccuuguggucggggcugcacugguuagcuccgccugcggagguuguguggagguagacucugaaaccgaggcgguguacggcaugacauucaagaucuugugcauuucauguaaaaggcggagugaaacuaacgcugagacguuuaccgaauggacauuccgccagaaggggacugaggaguuugucaaaauauuacgauaugaaaaugaggugcugcaacuagaagaggaugagcguuucgaaggaagaguuguguggaacggcagcagggguaccaaggaccuccaggaucuguccaucuuuauuacaaaugucaccuacaaccacucuggggacuaugagugccauguguaccggcuucuguucuuugaaaauuaugagcacaacacuucgguaguuaaaaagauccauauugaaguggucgauaaggccaaucgcgacauggcaucaaucgugagcgagauaaugauguacguguugaucgucguucucacaauuuggcugguggccgagaugaucuauuguuacaaaaagauugcugcagccaccgaaacggcugcccaggagaacgcgagugaauaccuggcaaucacuuccgagucuaaagaaaauugcaccggaguacagguggccgaguga

SEQ ID NO: 62225 - RNA, 6018 nt, Artificial Sequence
  derived and/or modified sequence opt3 from SCN2A__Homo_sapiens__XP_005246807
auggcccagagcgugcugguacccccuggcccagacuccuucagauuuuucaccagggagucucucgcugcaaucgaacaacggauugccgaggaaaaggcgaaacgcccgaagcaggagcgaaaagaugaagacgaugagaacgggcccaagccuaauucagaccuugaggcuggaaaaagucugccauuuauauacggugauauacccccugaaaugguuagcgugccauuggaggacuuagaucccuauuacauuaacaagaagacauucaucguccugaauaaaggcaaggccauuucccguuuuucugcaacuccugcccuauauauccucacgccauucaacccgauaagaaaacuggcuaucaagauucuugugcacucgcuguuuaauauguugaucaugugcacaauucucacaaacugugucuucaugacuaugucaaaucccccugacuggaccaaaaacguggaauacacauuuaccgggaucuauacuuucgagagccugauaaagauucuggcaaggggauuuugccucgaggauuucacauuuuuacgggacccauggaauuggcuggauuucaccguuaucacguucgccuacgugacugaauuugucgaccuuggcaacgugagugcuuugcgcaccuucagaguacugagggcccuaaagacaauuuccguuauccccggucucaaaacuaucgugggggcgcugauucagucugucaagaaacuuagcgaugugaugauacugaccguguuuuguuuguccgucuucgcacucaucggacugcaguuauuuaugggcaaucugcggaacaagugccuccaauggccuccagacaauucaaguuucgagauuaacaucaccagcuuuuucaauaacucucuugacggcaacgggaccacguuuaaucgcacuguuuccauauucaacugggaugaauauauugaggacaaaucacauuuuuacuuccuggaaggacagaaugaugccuugcuaugugguaacagcagugacgcuggccagugccccgagggguacaucugugugaaggccggacgaaauccgaacuauggcuacacaucuuuugauaccuucuccugggcauuccugagccucuuuagacugaugacucaggacuucugggagaaucuuuaucaacugacauugagggcugccgguaaaaccuacaugaucuuuuucguacucgugauuuuucuggggucguucuauuuaaucaaccugauucuagcggucguggccauggcauacgaggaacagaaucaggcuacgcucgaagaggccgaacagaaggaggcugaguuucaacagaugcuggaacagcuuaagaaacaacaggaggaagcccaggcagccgcugcggcagccucugcugagucccgggauuucucaggagccggcggcauagggguuuuuagugaaagcuccucuguggcaagcaaguugucaaguaaauccgagaaggagcugaaaaaccgucgcaagaagaaaaagcagaaagaacaaagcggagaggaagagaagaaugacagagucaggaaaucugagucagaagauaguauccggcgaaaggguuuccgcuuuagccucgagggcuccagacugaccuaugaaaagagguucucuucgccucaccagagccuucuguccauucgggggucauuguuuaguccccgcagaaacucuagggccagccucuucuccuuccguggacgggcuaaagacaucggcucagagaaugauuuugccgacgacgaacauagcacauucgaggauaacgacucucgaagagauucccuguuugugccacacaggcauggugagcgccggcacaguaauguaagccaggcaucuagagcguccaggguuuuaccuauccugcccaugaacgggaagaugcacucagcuguggacugcaacggcgucgugagucuagucggaggcccaagcacucucaccucggccgggcagcugcuucccgaaggaacaacuaccgagacagaaauucgcaaacgacgguccucuagcuaccaugugucaauggauuugcuggaggacccuaccagucgucaaagagcaauguccauagccucuauccucacuaauacgauggaggaacuggaggaaagcaggcagaaguguccaccgugcugguacaaauucgcuaacauguguuuaauuugggauugcugcaagcccuggcugaagguuaaacaccuugugaauuugguagucauggacccuuuuguggaucucgccaucacaauuuguaucguucugaacacccuauucauggcaauggagcauuauccaaugacugaacaguuuuccucagugcugagcgucgguaaucucguguucaccggcauauuuacagcugagauguuccugaagaucauugccauggaccccuacuauuacuuucaggaaggguggaacaucuucgauggauucauuguaagucuuucuuugauggagcugggcuuagcgaauguggagggucucuccguucugcgcagcuuucggcuucugagagucuucaaauuggccaagucguggccuacccucaacaugcugaucaaaauaauuggcaauucagugggggcucuaggaaaccugacucucgugcuggcaaucauugucuuuaucuucgccguugugggcaugcaacuuuuugggaagucuuauaaagaaugcguguguaagauaaguaaugacugcgaguugccaagguggcacaugcacgauuucuuucauuccuuccugaucguauuucgagucuuauguggagaauggauugagacaaugugggacugcauggagguggcuggucagacgaugugucucaccguuuucaugauggugauggucaucggcaaccuggugguucuuaaucuguuucuagcccuccuguugagcucuuucagcuccgacaaccuggcagcgacugaugacgauaaugaaaugaacaacuuacagauugccguggggcgcaugcagaagggaaucgacuuuguaaaacggaagauaagagaguucauucaaaaggcuuucgucaggaagcagaaagcccucgaugaaaucaagccccuggaggaccuuaauaacaagaaagauucaugcaucaguaaucacacaaccauugaaaucggcaaggaccugaacuacuugaaagaugguaaugggacaacuagcggcauuggaucuuccguggagaaguauguggucgacgagucagauuacaugaguuuuauaaacaauccgagccucaccguuacggugccuaucgcaguaggcgaauccgacuucgagaaccugaauaccgaagaguuuucuucggaaagcgauauggaggagucaaaagaaaagcuaaacgcuacauccaguucugaggggagcacuguggacauuggagccccagcagaaggcgagcagcccgaagucgagccugaggaaucccuggagcccgaagccuguuucaccgaggacugcgugcguaaguuuaaauguugccaaaucucaauugaggaagguaaggggaaacuuugguggaaucuccgcaagacaugcuacaaaaucguugagcauaacugguucgaaacuuuuauaguguucaugauccuguugucuagcggagcucuggcguuugaggauauuuauaucgaacagcggaagaccauuaagacgauguuagaguacgccgacaaagucuucacauauaucuuuauacucgagaugcugcuuaaguggguggcauacggcuuccagguuuauuuuaccaaugcuugguguuggcuggauuucuugauuguggacgucagucucguaucccugacugccaacgcccuagguuacagcgaacugggcgcuaucaaaucucuuagaacacucagggcacugcgaccauugcgggccuuaucacgcuucgaggggaugagagugguugugaaugcgcugcucggagcuaucccuuccauuaugaacguccugcuugugugccugauauuuugguugaucuucaguauuaugggcguaaaccuauuugccgggaaguucuaucacuguaucaauuacaccacuggagaaauguuugaugugagcgucguuaacaauuacucggagugcaaagcacugauugaaucuaaccagaccgccagguggaagaaugugaaagugaacuucgacaaugucggccucgguuaucugucccuuuuacaaguggcuacauuuaagggguggauggauaucauguacgcagccguugacagccggaacguagagcugcagcccaaguaugaggauaaucucuacauguauuuguacuucgugauauuuaucauuuucggaucauuuuucacgcugaaccucuuuaucggcgucauuaucgacaauuucaaccagcagaaaaagaaauucgguggccaagauauauuuaugaccgaggaacagaagaaauauuacaaugcgaugaagaagcuggggaguaaaaagccacagaaaccgauuccucgacccgcuaacaaguuccagggaaugguguuugacuucguuacuaaacaaguguuugacaucucuaucaugauucuuaucugucugaauauggucacaaugaugguggaaaccgaugaccagucccaggagaugacaaacauauuguacuggauuaaucuaguauucaucguccuguuuacuggcgaaugcgugcucaaguuaauuagccugagauauuacuauuucaccaucggguggaacauauuugauuucguuguggucauucuuucaaucgugggaauguuucuggccgagcucaucgagaaguacuucguuaguccaacguuguuucgcgugauuaggcuggcacguaucggccggauucucagacugauaaaaggugccaaggggaucaggacacuucuauucgcucugaugaugagcuugcccgccuuauucaacauuggacugcuccuguuucuugucauguucaucuaugcaaucuuuggcauguccaauuucgcuuacgugaaacgcgaaguagguauugacgauauguuuaacuucgagaccuuuggcaauucuaugauaugucuguuccaaaucacuaccagcgccgggugggacggacucuuggcgccuauucugaacuccggcccacccgauugcgacccugauaaggaccauccggggucaucugugaaaggagauuguggcaauccaaguguugguaucuuuuucuuugucucguauauuaucaucagcuuccuagugguggucaacauguacaucgccguaauucuggaaaauuuuuccguggcaacagaggagucugcugaaccccucucagaggacgauuucgaaauguucuacgagguuugggaaaaguuugacccugacgccacucaguucaucgaguuugcuaaacuuagcgauuucgcagacgcccuggauccacccuuauugauugccaaaccuaacaaggugcagcugaucgcuauggaccucccgauggucuccggggaucgaauacacugccuggacauucuuuuugcguucaccaaaagagugcugggagagaguggcgaaauggaugcacuccggauccagauggaggaaagguuuauggccucuaaucccagcaagguuucauaugagccaauuacaacgaccuugaaacgcaagcaagaagagguguccgcuaucauaauccagcgugccuacagacgguaucuguuaaagcagaaagucaagaaagugaguagcauuuacaagaaagacaagggcaaagagugugaugggacuccuaucaaggaagacacacuaauugauaagcugaacgaaaauucuacccccgagaaaacugacaugacaccauccaccacgucaccucccagcuaugauucgguaacuaagccagagaaagaaaaguucgagaaagacaagucugagaaggaagacaaaggaaaggauaucagggagaguaaaaaguga

SEQ ID NO: 62226 - RNA, 648 nt, Artificial Sequence
  derived and/or modified sequence opt3 from SCN2B__Homo_sapiens__NP_004579
augcacagagacgccuggcugcccaggccugcuuucagccucaccggccuuucccuguuuuucucuuuggugccaccggggcggucaauggaggucacaguucccgcaacuuuaaacgugcugaauggaagugaugcccgccuaccuugcacguuuaacagcuguuacaccguaaaucauaagcaguucucccucaacuggacauaucaagaaugcaauaacuguucugaggaaauguuucugcaguuccgaaugaaaaucauuaaucuuaagcuggagcguuuucaggacagaguggaguucucggguaacccaucaaaauacgaugucagcgugauguugaggaauguucagcccgaggacgagggcauauauaacugcuacaucaugaauccuccagaucggcaccgcgggcauggaaagauucaccuccaagugcugauggaagaacccccugaaagagacaguacugucgcggugaucguaggcgcuuccguugguggguuucuggccguggucauucucguguuaaugguggucaaauguguuaggcggaagaaggagcagaaacugucuaccgaugaccuuaagacagaggaagagggaaaaaccgauggcgaaggcaacccagacgauggggcaaaguga

SEQ ID NO: 62227 - RNA, 5856 nt, Artificial Sequence
  derived and/or modified sequence opt3 from SCN3A__Homo_sapiens__NP_001075145
auggcccaggcucugcucgugcccccuggaccagaaucauuccgacuuuuuaccagggaaucccuggcagccaucgagaagcgggcggcugaagagaaggccaagaaaccgaagaaagaacaagacaacgaugacgagaauaagcccaagccuaacucugauuuggaggcagggaaaaauuuaccauucauuuacggagacauacccccugaaauggucucagagccacuggaagaucuagaccccuauuacaucaacaagaaaacauuuauuguuaugaauaaggguaaagccaucuuccgcuuuagugcuacuagcgcacucuauauucugacgccucuuaacccagugcgaaagaucgccauaaagauccugguacacuccuuguucucuaugcucauuaugugcaccauccugacaaauuguguguuuaugacucugucgaacccgcccgauuggaccaaaaaugucgaguacacauucaccggcauuuauacuuuugagucacucaucaagauauuagcucguggguucugccuggaagacuuuacauuccuuagagauccuuggaacugguuggacuuuagcgugauuguuauggccuacgugaccgaguucgucgaucugggaaaugugagugcgcuaaggacguuccggguacuccgcgcacugaaaacuaucuccguuauuccaggccuuaagaccaucgugggugcccugauccagucugucaaaaaguugagcgacgugaugauucucacaguguuuugucuguccgucuucgcuuuaauagggcugcagcucuuuaugggaaaccuuagaaauaaaugccugcaguggcccccuucagauagugccuucgaaacuaacaccacaagcuauuuuaauggcaccauggacucuaacggcacguucguuaacgugacuauguccacauuuaauuggaaggacuacaucggggaugacucacauuucuacguauuggauggacaaaaggacccacuacugugugguaacggcagcgaugcagggcagugccccgagggauauauuugugugaaagcuggcaggaauccgaacuacgguuauaccaguuuugacacuuucucuugggccuuucucucccuguuccggcuuaugacacaggauuacugggaaaaucuguaucaguugacccuccgcgcggccgggaagacguacaugaucuuuuucguccuggugauauucuuaggaaguuuuuaucugguuaaccuaauucucgcaguggucgcuauggccuacgaggagcaaaaucaggcuacccuggaagaggccgaacagaaagaggcagaguuccagcaaaugcuugagcaguugaagaaacagcaagaggaagcccaggcuguggcggcagccucggcugccucucgagacuuuuccggcaucggcgggcugggagagcuccuggaaucaaguagcgaggcauccaaacuuucuagcaagucagccaaagaauggagaaacaggcggaagaaacgucgccagagagagcaccuggaggguaauaacaagggcgaaagggauaguuucccuaaauccgagagcgaagacucuguaaagcggagcagcuuuuuguucagcauggaugggaaucgacucacauccgacaagaaauuuugcucuccccaucagucgcuguuaagcauccgcggaucccuguucucaccaagaaggaacaguaagacuucuauuuuuagcuuccggggccgcgcuaaagacguugguuccgagaaugauuuugccgacgaugagcacucaaccuucgaagacagcgagucuagaagggauucccuauuugugccucaucgucacggggaacggcgaaacaguaauggcacaacuaccgagacagaagucagaaagaggcgccucagcucuuaccaaaucuccauggagaugcuggaggacucaaguggacggcagagagcagugagcauugcgucgauacuuaccaacacuauggaagaguuggaagaguccaggcagaaaugucccccaugcugguaucgcuucgcuaacgucuuccugaucugggauuguugcgacgccuggcucaaggugaagcaccugguuaauuuaauugugauggaucccuuuguagaccuggcaaucacgaucugcauuguccuuaacacauuguucauggccauggaacauuacccuaugaccgagcaguuuucuagcgugcucacuguuggcaaucugguguucaccgggauauuuacagcugagaugguccuaaaaaucauugccauggauccauauuacuauuuccaagaaggauggaacaucuuugacgguauuaucgugucacugagucucauggagcugggccuuuccaauguagaaggguugucugugcugcggagcuucagauuacuccguguuuuuaagcuggcaaaauccuggccgacccuuaacaugcugauaaagaucauuggaaauucagucggcgcuuuggguaaccucacucuggugcuagccaucauuguguucaucuuugcggucguugggaugcagcuguucggcaaaagcuacaaggagugugugugcaaaauaaaugaugacuguacacuccccagauggcacaugaacgacuucuuucauaguuuccugauuguguuuaggguacuuugcggagaauggaucgagacgaugugggauuguauggaggucgccggccagaccaugugcuugauuguguucaugcugguuauggugaucgggaauuuagucgugcucaaccuguuucuugcucugcuacucucuuccuucagcucggacaaucuggcagccacugaugacgauaacgaaaugaauaacuugcagauagcuguuggacgcaugcaaaaggguaucgacuaugugaagaacaaaaugcgggaguguuuucagaaggccuucuuuagaaaaccuaagguaauugaaauccacgagggcaauaaaauugauucaugcaugucuaacaauacagggaucgagauaaguaaggaacugaacuacuuaagggacggaaauggcaccacauccggugucgggacuggcagcucuguggagaaguacgugauugaugaaaacgacuauaugagcuucaucaauaacccaucccucaccgucacgguucccaucgcagugggagagucagauuuugaaaaucugaacaccgaggaguucaguagcgaaucugagcuugaagaguccaaagaaaagcugaaugcgacaucaaguagcgagggcuccacuguagacguggucuugccucgagagggggaacaggccgagaccgaaccagaggaagaucucaaacccgaggcuuguuuuacagagggaugcauuaagaaauucccguucugucaggugucuacugaagagggcaaggguaagaucugguggaaccugcgcaaaaccugcuacucgauuguugaacacaauugguuugagacguucauaguguuuaugauccuacugagcucaggggcccuugcauucgaggacauuuauaucgaacaacggaagacaauuaaaaccaugcucgaguacgcugacaaggucuuuacuuauaucuucauacuggaaauguugcugaaauggguggccuacggauuucagacauauuucaccaacgcauggugcugguuagauuuucucaucguugacgugucccuggucagucuuguagccaaugcucugggcuacucugaguugggugcgauuaagagccucagaacucugagggcccuacguccucugcgcgcacuuucccgguucgaaggcaugagagugguugugaacgcucucgucggggccaucccaucaauuaugaacgugcuguugguauguuuaaucuuuuggcugauauucucuauuaugggagugaaucucuuugccggcaaguucuaccauugcgucaacaugaccacagggaauauguucgauaucagcgacguuaacaaucugagugauugucaggcucuuggaaaacaagcaagguggaagaacgugaaagugaauuuugacaacgucggcgccgguuaucuggcguugcuacagguggcuacguucaagggguggauggauaucauguacgccgcaguugacucccgagauguaaaacugcagcccguguaugaggagaaucucuacauguaucuguacuuugucauuuucauaaucuuuggcagcuucuuuacccuuaacuuauucauuggcgugaucauugacaauuuuaaccagcaaaagaaaaaguucgguggccaggauaucuuuaugacugaagaacagaagaaauauuacaaugccaugaagaaacuggggucuaagaaaccucagaagcccauaccacggccugcuaacaaguuccaaggaaugguuuuugacuucgugacacgccaggucuucgacaucucaauuaugauccucauuugcuugaauauggugaccaugaugguagaaacagaugaccagggcaaauacaugacucugguccucuccagaaucaaccugguguuuauaguucuuuucaccggggaguuugugcugaaguuggucagucuaaggcacuauuacuucacgauuggauggaauaucuuugauuucgugguugugauccugagcauugucggcauguuucucgcagaaaugaucgagaaauauuucgugucgcccacauuauuucggguaauacgacuggccagaauuggucgcauccuuaggcugauuaagggggcgaaaggaauccguacccucuuguucgcucugaugaugucucucccagcccuguuuaacauaggccuucuacuguucuuggugauguuuauuuacgcaaucuucgguauguccaacuucgccuauguuaagaaggaggcuggcaucgacgauauguuuaauuucgaaacuuuugggaacagcaugauuuguuuauuccagaucaccacaucagccggaugggacggccugcucgcaccgauucugaauagugcuccucccgauugcgacccagauacuauacaucccgggucuuccgucaaaggagacuguggcaacccuagcguggguaucuuuuucuuugugucauacauuaucaucaguuuccuugucguagugaauauguauauugccguuauacuggagaacuuuagcguggcgaccgaagaguccgccgaaccacucucugaggaugacuucgagauguuuuacgaagucugggagaaguucgaucccgacgcaacacaauuuaucgaguucagcaaauuguccgacuucgcugccgcucuggauccuccgcuacugauugcaaagccaaauaaagugcagcucaucgccauggaccuucccaugguuucaggggaucggauucacugccuggacaucuuauuugccuucacgaagagaguguugggagagucuggcgagauggaugcucugaggauacagauggaagaccgcuuuauggcgaguaacccuucgaaggucagcuacgagccaaucaccacuacacucaaacgaaagcaagaagagguguccgcagccauuauccagagaaauuuccgguguuaucugcuuaaacagaggcugaagaacauuucuucaaauuacaacaaagaagcuaucaagggccgcauagaucuccccauuaagcaggacaugaucauugauaaauugaaugggaacagcaccccugagaagacugacggauccaguucuacaaccagcccgcccucauaugauuccguaacgaaaccagacaaggagaaauuugaaaaggauaaaccugagaaggaaaguaaggguaaagaggugcgugaaaaucaaaaguga

SEQ ID NO: 62228 - RNA, 648 nt, Artificial Sequence
  derived and/or modified sequence opt3 from SCN3B__Homo_sapiens__XP_011541199
augcccgccuucaacagacuguuuccucucgcuagccuugugcugaucuacugggucuccguuugcuucccaguguguguagaggugccgucugaaaccgaggcaguccagggcaaucccaugaaguugaggugcauuucauguaugaaacgggaagagguggaagccacaacuguuguggagugguuuuaucgcccugaagggggaaaggacuucuuaauauacgaguaucgaaacggucaccaagaggucgaaaguccauuucagggccgucugcaguggaaugggagcaaagaucuacaggacguguccaucacgguacucaacguuacccugaaugauucuggacuuuacacaugcaacgugucgagagaguucgaguuugaagcgcauaggcccuucgucaagacuacccggcugauuccuuugcgcgugacagaggaagcuggcgaggacuuuaccucaguggucagcgaaaucaugauguauauucuccugguuuuccugacucucugguuacugaucgagaugauauacuguuauagaaaagugaguaaggccgaggaagcagcccaagagaaugcuuccgauuaccuugcaaucccaucugaaaacaaggagaauagcgccguacccguggaagaguga

SEQ ID NO: 62229 - RNA, 5511 nt, Artificial Sequence
  derived and/or modified sequence opt3 from SCN4A__Homo_sapiens__NP_000325
auggccagacccucacugugcacccucgugccucuuggcccagagugucugaggccguucacacgggaauccuuggcugcaaucgagcaacgcgccgucgaagaggaagcgcgauuacaacguaacaagcagauggagauugaggaacccgagagaaaaccuaggucugaccuggaagcugggaagaaucuaccaaugauauacggagaucccccuccagagguuaucgguauuccccucgaggaccuggauccuuauuacucaaacaaaaagacuuuuaucgugcuuaauaaaggcaaggccauuuuccgguuuagugcaacgccagcccuguauuugcucagcccguucuccguagugcgcagaggggcuaucaagguccugauacacgcacuguuuucuauguucaucaugauuaccauccucacaaacugcguguuuaugacuaugucggaucccccuccauggagcaagaauguugaauacaccuucacaggaauuuauaccuuugagagcuuaaucaagauacuggccaggggcuucuguguggaugacuuuacuuuccuucgggaucccuggaacugguuggacuuuagugucauuaugauggcuuaccugacagaguucguggaucuagguaauaucuccgcccuccgcaccuuccgaguacugagagcgcuuaaaacgauuacuguuaucccugggcugaagaccaucgugggagcauugauucagucugucaaaaagcucagcgacgugaugauacugacaguguuuugcuuauccgucuucgcccugguuggccuccagcuuuuuaugggcaaccugaggcaaaagugugugcgguggccacccccguucaaugauacuaacaccacaugguauucaaaugacaccugguacgggaacgauacgugguacggaaaugagaugugguaugguaacgacaguugguacgcuaaugacacuuggaacagccaugccucuugggcaacaaacgauaccuuugacugggaugcuuauaucuccgacgaaggcaauuucuacuuuuuggaggggucaaacgaugcccuacugugcggaaauagcagugacgcgggccacuguccugaggguuaugaaugcauuaaaacugggcguaaccccaauuacggauauacaucuuacgauaccuucuccugggccuuucucgcacuguuccgccuuaugacgcaggacuacugggagaaccuguuucaguugacccucagagcugccggcaagacauauaugaucuucuuuguagugauaauuuuccugggcagcuucuacuuaaucaaucugauccuagcugucguggccauggcauaugccgaacagaacgaggcuacucucgcggaagauaaagagaaggaggaagaguuucaacagaugcuggaaaaauucaagaaacaucaggaggaacuugagaaggcaaaggccgcucaggccuuggaagggggcgaagcagacggugauccagcccacggcaaagacuguaaugggucgcuggacaccucucaaggagagaagggcgcuccuaggcaguccucaaguggugauagcgggauuuccgacgccauggaggaacucgaggaagcacaucagaaaugucccccauggugguacaagugugcgcacaaaguucugaucuggaacugcugcgcucccuggcuuaaguuuaagaauauuauacaccugaucgugauggauccuuucgucgacuugggcauuacaaucuguaucgugcucaacacucuguuuauggccauggagcauuauccaaugaccgaacacuucgauaauguauuaacaguuggaaaccugguguuuaccggcauuuucacugcagagaugguccuaaaacucauagccauggacccguacgaauauuuucaacagggguggaauaucuucgauucuauuaucgugacgcugagccuugucgaguugggacuggcuaacgugcagggucucucaguucugcggaguuuucgauuacugcgcguguucaaacuugccaaauccuggcccacauugaacaugcucauuaagaucauaggcaauagcguaggggcacugggaaaccuaacccugguccucgcuaucauuguguuuaucuucgccguugugggcaugcagcuguucgguaaaucuuacaaggagugcgucuguaagauugcgcuugacugcaauuugccuagauggcauaugcacgacuuuuuccacucauuucugaucguguucaggauauuauguggggaauggauugagacuaugugggacugcauggaaguagccggccaagcuaugugucucaccguguuucugaugguuauggucaucggaaaccuuguggugcugaauuuguuccucgcacugcuacugaguagcuuuuccgccgauucucucgcugccucggacgaggauggcgaaaugaacaaucugcagauugcaaucgggcggauaaaacuuggaaucgguuucgcgaaggccuuuuugcugggcuuacuccaugggaaaauucugagcccaaaggacaucaugcuuucccugggagaggcugacggcgccggugaggcaggggaagcuggcgagacagcccccgaagaugagaaaaaggaaccuccagaggaggaccuaaagaaagauaaccacauucucaaucauaugggacuggcagacggacccccgucaaguuuggaacuggaucacuuaaacuucaucaauaacccuuaccucaccauacaggucccaauugccucugaggaaagcgaccuggagaugcccacugaggaagagacagauacguuuuccgaaccugaggacucaaagaaacccccacagccucuuuaugaugggaauagcucuguuugcuccaccgcugacuacaagcccccagaagaggauccggaggaacaagcggaggaaaacccugagggagaacagcccgaggaguguuucacugaagccugcgugcagcgcuggccaugucuguauguggacaucagucagggcagagguaaaaagugguggacauugaggcgugcaugcuucaaaaucguagagcauaauugguuugaaaccuucauugucuuuaugauccuccugagcucuggggcucuagccuucgaggauauuuacauagaacaacggcgagugaucagaacaauucuggaguaugccgacaagguuuuuacuuacaucuucauuauggagaugcuucucaaguggguggcuuauggauuuaaagucuacuucaccaacgcauggugcuggcuggacuuuuugaucguggauguuuccauaaucucacugguggccaacugguuaggcuacagugaacucggucccauuaagagccugaggacgcuucgcgcgcugcggccuuugagagcucucucgagguucgagggcaugcgcguagucgugaaugcccugcuaggggcaaucccauccauuaugaacgugcugcuugucugucucaucuuuuggcugauauucucuauuaugggaguuaauuuguuugccggcaaauucuauuacugcaucaacaccacaacuagcgaacgauucgacaucucagaggugaauaacaagagugagugugaauccuuaaugcacaccgggcagguacgguggcugaaugugaaagucaacuaugauaaugugggacucggcuaccugucucuucugcagguugcuacauuuaaggguuggauggacauuauguaugcagccguggauagccgugagaaggaggaacaaccccaauacgaagucaacuuguauauguaccuauacuucgugauauuuaucauuuucggguccuuuuucacucugaaucucuuuaucggaguuauuaucgacaacuucaaucagcagaaaaagaaacugggcgguaaggauauauuuaugaccgaggagcagaaaaaguauuacaacgcgaugaagaaacuuggcucaaagaaaccucagaagccgaucccaagaccccagaauaaaauucaggggaugguguaugacuuagucacgaagcaggcuuucgauaucacaauuaugauccugauaugccucaacaugguaaccaugaugguggaaacugacaaccagagccaguugaagguugauauucuguacaauaucaacaugaucuuuauuaucauauucacaggagagugugugcucaaaaugcuggcccuuaggcaguauuacuuuaccgucggcuggaauauuuucgacuucgugguagugauccugaguauugucggguuggcacuaucugaccugauccaaaaguauuuuguuuccccuacucucuuccgcgugauacgguuagccagaauuggaagggugcugcgacuuauccgcggcgcuaaagguauccggacccugcucuuugccuugaugaugagccugccagcacucuucaacauugggcugcuucuauuucuggucauguucaucuacucgauuuuuggaaugucaaauuucgcuuacgugaagaaagaaucuggcauagaugacauguuuaacuucgagacauuugguaauaguaucauuugcuuguucgaaaucacgaccuccgccggcugggauggguuacugaaccccauccucaauagcggaccuccggacugugaucccaaccuggagaauccaggcacuucuguuaagggggacugcggaaacccuagcauuggcauaugcuuuuucugcuccuauaucauuaucucauuccuuauuguagugaauauguacaucgcgauaauccuggagaacuuuaaugucgccacagaagagaguagcgaaccccucggugaggaugacuucgaaauguuuuaugagaccugggagaaauucgauccagacgcaacacaguuuauugcuuacucuagauuguccgauuucguggacacucugcaggaaccucuaaggaucgccaagcccaacaagauuaaacugaucacccucgaucuuccaaugguuccgggggacaagauacacugucuggacauuuuauuugcuuugacgaaagaggugcugggagauucaggcgaaauggacgcacucaagcagacaauggaggagaaauucauggccgccaauccuaguaaggucagcuaugaacccaucaccacuacccugaagcguaaacaugaggaagugugcgcuauuaagauccaacgcgcguaccggagacaccuucugcagagguccaugaaacaggcaucuuauauguaccgacauucgcacgauggcagcggggacgaugccccagagaaggaaggacucuuggcuaacacaaugucaaaaauguacggucacgagaacggcaauuccaguucucccagcccugaggaaaagggggaggccggagacgcaggcccaacuaugggucugaugcccauauccccuucagauaccgccuggccgccagcucccccucccgggcaaacaguacggccaggagucaaggaaucuuuaguguga

SEQ ID NO: 62230 - RNA, 285 nt, Artificial Sequence
  derived and/or modified sequence opt3 from SCN4B__Homo_sapiens__NP_001135820
augcccggcgccggggacggagguaaggcuccugcaagauggcugggcaccgggcuccuuguggaggaagucgauaacacaguuacucugaucauuuuggccgugguaggaggcgugauagguuuacugauccuaauucuccugaucaaaaagcugauuaucuucauacuuaaaaagacgagggagaaaaagaaggaaugcuuggucagcuccucugggaaugacaacaccgagaauggacucccaggcucaaaagcggaagagaagccgcccaguaaaguguga

SEQ ID NO: 62231 - RNA, 6048 nt, Artificial Sequence
  derived and/or modified sequence opt3 from SCN5A__Homo_sapiens__NP_000326
auggccaacuuccugcuccccagaggcaccagcuccuuuaggcgguucacacgcgagucucuugcugcaaucgaaaagcgaauggccgagaaacaggcgcgugggucaacuacgcugcaagaaaguagagagggauugccugaagaggaggcuccaaggccgcaguuagaccugcaggccagcaagaaacuacccgaucucuacgguaauccuccacaggaacugauuggcgagccccuugaagaccuggauccuuuuuauuccacccaaaagacauucauaguguugaacaaagggaagacuaucuuucgguucucugcaaccaaugcccucuacguccugucgccauuucaccccauucgcagagcugcaguuaagauccuggugcauucacucuucaacauguuaauuaugugcacaauccugaccaauuguguauuuauggcccagcacgacccuccaccguggacuaaauauguggaguacacauucaccgcuauauauacguuugagagccuugucaagaucuuggccaggggauucugccugcaugcguuuacuuuccuacgggaucccuggaacuggcucgacuucagugugauuaucauggcauacaccacagaauuuguugaucugggcaauguguccgcccuucgcacuuuccgaguccugagagcuuugaaaaccauuucugugaucagcggucucaagacaauaguaggggcccugauucaguccguuaaaaaguuagcagacgugaugguccugaccguguuuugucucucaguguucgcucuuaucggacugcaguuguuuaugggcaaccuaaggcacaagugcguccggaauuucacggcccugaacggcacuaaugggaguguugaggcggauggacucgugugggaaagccuggaccuuuaucugucugauccugagaacuacuugcucaaaaaugguacauccgacguacuguuauguggcaacucaagcgaugccgggaccugcccagaaggauaccguugucugaaggcaggcgagaaucccgaccaugguuauacuaguuuugacucuuucgcuugggccuuucuagcucucuuccgccugaugacacaagauugcugggagagacuuuaccagcagaccuugagguccgccgggaaaauuuauaugaucuuuuucaugcuggugaucuuucucggaagcuucuaccuggucaaccuuauucuggcagugguugccauggcuuaugaagagcagaaccaagcgacgauagcagaaaccgaggaaaaggagaaacgguuccaggaggccauggaaauguugaagaaagagcacgaagcucucacaauccgaggcguggacacugucucgcgcucuucccuggagaugucaccuuuagccccagugaauagucacgaaagaaggagcaagcggcgcaagagaauguccucuggcaccgaggaguguggggaagauaggcugcccaaaagcgacucagaggauggaccgcgugcaaugaaccaucuaagucucacacggggucugucccgaacuagcaugaagccuagaucuucaaggggcaguauuuuuaccuuccgccggagagaccuugggagcgaagccgauuuugcugacgaugagaauuccacagccggagagucugaaucgcaccauaccagcuugcugguacccuggccacucaggcgcacuuccgcacagggccaaccuucacccgguacgagugcgccagggcacgcucugcacggcaaaaagaacucuacaguugacugcaauggaguggucagcuuacugggcgccggggaucccgaggcaaccuccccuggaucacaucuuuugcgaccagugaugcucgaacacccgcccgacacuaccacaccuagcgaggaaccagguggcccccagaugcugaccucucaggccccuugugucgacggguucgaggagccaggagcucggcagcgugcccuauccgcagugaguguucugacuagcgcucucgaagagcuggaagagucuagacauaaaugccccccgugcuggaacaggcuugcccaacgcuacuugaucugggaauguugcccucuguggauguccauaaagcagggcgugaaguuaguagucauggauccauuuacagaccucacgauuaccauguguaucgugcugaauacucuuuucauggcgcuggagcacuauaacaugacaucagaguuugaagagauguugcagguugguaaucucguguucaccgggaucuuuacagccgaaaugacuuucaaaauuaucgcucuggaucccuacuacuauuuucagcaaggcuggaacauuuucgacaguauaaucgucauucuaagccugauggagcucggacugucgcggauguccaaucuuucuguguugagaagcuuuaggcuguuacgaguauucaagcucgcaaaaucauggccuacccugaacacgcuuaucaagaucauuggcaauagugugggggcccugggaaaccuaacccucguucuggcuauaaucgucuucauuuuugccgugguggguaugcaguuguucggcaaaaauuacuccgaacugcgcgauucugacagcggguuacucccccgguggcauaugauggauuuuuuccacgcauuucugaucauuuucagaauccuuugcggagaguggauagagacaaugugggacuguauggaagucuccggccagucacugugcuugcucguuuuucugcuagugauggugaucgguaaccugguaguccuuaaccucuuccuggcguugcuguuaagcaguuuuucugccgauaaucucacugcuccagacgaggauagggaaaugaacaaucugcagcuugcccuggcacguauucaacgcggguugcgguucgugaagagaaccacaugggacuuuuguugcggccuccugaggcagcgaccucagaagcccgcugcccuagcagcccagggacaacugccauccuguaucgcuacuccguauagcccucccccacccgagaccgagaaaguuccuccaacgcggaaggaaacacgcuucgaggaaggcgagcagcccgggcagggaaccccuggcgauccggaaccagugugcguccccauugcgguggccgagucggacacugacgaucaagaggaagacgaggaaaacucacuugguacagaggaagagucuaguaaacaggagucccagccuguuagcgggggaccagaagcacccccugauucuagaaccuggagccagguguccgcuacugccucaagugaggccgaagcuagcgcaucucaagccgacuggaggcagcaguggaaggcggagccgcaggcucccggcuguggugaaaccccagaggauuccugcucagagggcaguacagccgacaugacgaauaccgcagaacuccuggagcaaaucccugauuuggggcaggacguaaaagaucccgaagacugcuucacugagggauguguccggcgaugcccauguugcgccguggauacaacccaggcuccuggcaaggugugguggagauuacgcaagacauguuaccacauagucgagcauagcugguuugaaacuuucauuaucuuuaugauucugcucuccucuggggcacuggccuucgaggacaucuaucuugaagagaggaaaaccauaaagguucuguuggaauacgcggauaaaauguuuacguauguguucguacuagagaugcugcucaaguggguggcuuacggauuuaaaaaguacuucacaaacgccuggugcuggcuggacuuucuuaucgucgacgugucguuaguuagccugguggcaaauacccucggcuucgccgagaugggucccauuaaaucauugcguacucugcgggcucucagaccacugagggcccuuucccgcuuugaagggaugcgagucgugguuaacgcacuggugggagcuaucccgaguauuaugaaugucuugcuaguaugucugaucuucuggcucauauuuucuauuaugggcgugaacuuauucgccgguaaguucggcagaugcaucaaucagaccgagggggaucugccucuuaacuauacaaucguuaauaacaagagccaaugugaaucccugaaucucacuggagaguuguacuggaccaaagugaaggucaacuuugacaacgugggcgcgggguaucuggcccuccugcagguagcaacauucaaaggauggauggauauuauguacgcugccguggacucacggggcuaugaagagcagccccaaugggaguacaaucuuuauauguacaucuacuuugucauuuucauaaucuuugguucuuucuuuacgcuaaaccuguucauugggguuaucauugauaauuuuaaccagcagaagaaaaaguugggaggccaggacaucuucaugaccgaagagcaaaagaaauauuacaaugcuaugaagaaauuagguagcaagaaaccacagaagcccauaccuaggccacugaacaaguaucagggcuuuaucuucgauauugugacuaaacaggcauuugacgugacaaucauguuccucauuugccugaauauggucaccaugaugguggaaacugaugaccaaagucccgagaagaucaacauacuugccaaaauuaaucugcucuucguugccaucuuuacaggggaauguaucguaaaguuggcugcgcugcgccacuacuauuucaccaacuccuggaauauuuuugauuucguggucgugauacuaagcaucguuggaacggugcugucugacauuauccagaaauacuuuuucucaccuacucucuuucgugucauuagacuugcacggaucggcaggauacugcgcuuaauccgaggggccaagggaauuagaaccuugcuguucgcucucaugaugucccugccggcccuuuuuaacaucggccugcucuuguuccuggugauguuuauuuauaguaucuucgguauggcaaauuuugccuacguaaagugggaggcugggauagacgauauguucaacuuccagacauuugcgaauagcauguuaugccuauuccagauuaccacuucggccggaugggacggccugcucucuccaauccuuaacacaggccccccuuacugcgaucccacccugccaaacuccaaugggagccggggagacugugguucaccugcagucggcaucuuguuuuucacaacuuauauuaucauaaguuuucugauugugguuaacauguacaucgcuauuauccucgagaauuucucuguggccaccgaagaguccacggaaccccugagcgaggaugacuuugauauguucuaugagauaugggaaaaauuugacccagaggcaacacaauucauugaauacucaguccuuagugauuuugccgacgcucucagcgagccucugaggaucgccaagccgaaccagaucuccuugauuaauauggaucugcccauggugucuggggaccgcauccauugcauggauauuuuauucgcguuuaccaaaagaguucuaggagaaagcggcgagauggacgcacugaagauacagauggaggaaaaauucauggccgcuaacccauccaagaucucauaugagccuauuacuaccacacucaggcggaaacacgaagaggugucugccauggucauccagcgugcuuuccgccgacaccuucugcaaagaaguuugaagcaugcaucguuucuguucaggcagcaggccgguagcgggcucuccgaagaggacgcucccgagcgggaaggacugaucgccuacgugaugucugagaauuuuucacgcccacuuggcccucccagcuccaguucuauuagcucaacuuccuucccgccaaguuaugauagcguaaccagagcaacgucugacaacuuacaagugaggggcuccgauuacucacacagcgaagaccuggcggauuuuccucccucgccagaccgggaucgagagucuauaguuuga

SEQ ID NO: 62232 - RNA, 5049 nt, Artificial Sequence
  derived and/or modified sequence opt3 from SCN7A__Homo_sapiens__NP_002967
augcuggccagccccgaaccuaagggccucgugccauucaccaaagaauccuuugaacuuaucaagcagcacauugcuaaaacucauaacgaagaccacgaggaagaggaucugaagccgacucccgacuuggaggucgggaaaaaguuaccuuucaucuacggcaaucugucucaagguaugguuucagaaccacuagaggauguggaccccuauuacuauaagaaaaagaacacguuuaucguacucaauaaaaaccggaccauuuucagguuuaaugcagccaguauccugugcacacuuagcccuuucaacuguauucggcgcacuaccaucaaggugcugguccauccauuuuuccaguuguuuauacucaucuccgugcugauugauugcguuuucaugucucugacaaaucuccccaaauggcgaccuguguuagaaaacacccugcuuggcaucuacacuuuugagauuuuggucaagcuguucgcgcguggggugugggcuggaucguuuucauuccuuggcgacccauggaauuggcucgauuucagcguaacaguuuuugaggugaucauaagauauaguccgcuggacuucauucccacccuucagacggccaggacucugcggaucuugaagauuaucccucucaaccagggucugaaauccuuagucggggugcugauccacugucucaagcaacuuauuggagugauaauccugaccuuguuuuuccuaucuauuuuuagccugaucggcaugggccucuucauggggaaucugaaacauaagugcuuucgcuggccacaggaaaacgagaaugaaacacuucacaacagaacuggaaaucccuacuauauaagggagaccgaaaacuucuacuaccuggagggugagcgguaugcauugcucuguggcaaccgcacagaugccgggcagugcccugaaggauacgucuguguuaaagcuggcauuaauccagaccaggguuuuaccaacuucgauuccuuugggugggcacuguucgccuuauuucgacugauggcucaagacuaucccgaggugcuauaccaccagauccucuaugccucaggaaagguauacaugaucuucuucguggucgugaguuuucuguucagcuuuuauauggcgucucuuuucuugggcauucuggcaauggccuacgaagaggaaaaacagagaguuggcgagaucuccaagaagauugagccgaaauuucagcaaacggggaaggaacuccaggagggaaaugaaacugaugaggcuaaaacaauacagaucgaaaugaagaaaaggucaccuauuagcaccgacacaagucuggacgugcuugaggaugccacacugcggcauaaggaggaauuggagaagucuaaaaagaucugcccccucuacugguauaaauucgcaaagaccuuucugaucuggaacuguuccccaugcugguuaaaacugaaggaguucguccaccguauuauaauggcuccuuuuacggaccuauuccucaucauuuguaucauucugaaugugugcuuucuuaccuuggagcauuaccccaugagcaagcaaacaaacacucugcucaauaucgguaaccugguauucauaggcaucuuuaccgccgagaugauuuucaaaaucauugcgaugcacccauauggguacuuccagguuggauggaauaucuuugauucgaugauaguguuccacggcuuaauugaacugugccuugccaacgucgcagguauggcuuugcuccgccuguuuagaaugcuaaggaucuucaagcuggggaaauauuggcccacauuucagauucucauguggucucuguccaauucauggguggcccuuaaggacuugguccuguuacucuucacuuuuaucuucuuuagugcugccuucggcaugaaacuguuuggaaagaacuacgaggaguucgugugucauauagauaaggacugccagcuuccucgguggcacaugcaugauuucuuucacagcuuccugaauguuuuucgaaucuuguguggcgaguggguggaaacccucugggacugcauggagguagcagggcaauccugguguauuccauucuaucugauggucauccuaauuggaaaccugcucgugcuguaccuauuuuuggcccugguuucuagcuucucaaguugcaaagaugugacagcugaggaaaauaacgaggcgaagaacuuacagcucgcagucgcccgcaucaaaaaggguauaaauuacgugcugcuuaaaauucuguguaagacccagaacguaccgaaagacacuauggaucaugugaaugaaguuuaugucaaggaggacaucuccgaccacacgcuaagcgaacucucuaacacacaggauuuucugaaggacaaagagaagucaaguggcaccgagaaaaaugcuacugaaaacgagagccaauccuugauccccucuccuucggugagcgaaaccgugccaauugccuccggggagucagauaucgaaaaucuggacaacaaggagauucagaguaaaucuggagauggcgguagcaaggagaagauaaaacaguccucaagcucugaaugcuccacagucgacaucgcaauuagugaggaagaggagauguucuacgggggcgaaagaagcaagcaccucaaaaauggauguaggcggggaucuucccuagggcagaucucaggagccaguaagaaagguaagauuuggcaaaacauccgcaagaccugcuguaaaauaguugagaauaacugguuuaagugcuucaucggccuggugacucuucugagcacagggacguuggcuuuugaagauauuuauauggaccagagaaaaaccaucaagauucuccuggaguacgccgauaugaucuucacuuauauauuuauucuagaaaugcugcuuaaauggauggcauacggauucaaggcguauuucucgaauggcugguacaggcucgacuuugugguagucaucguguucugccuguccuugaucgguaagacacgugaggagcugaaacccuuaauuucuaugaaguuucuccggccucugcgaguucuuagccaguucgaaagaaugaaaguggucgugagggcucugauaaagaccacauugccaacucucaacguuuuucuggugugucuaaugaucuggcugauuuucucaaucauggggguagaucuuuuugccggccgcuucuacgagugcauugaccccaccaguggagaacgguuuccguccucugaggucaugaauaaaagcagaugugaaucccuccuguucaacgagucaauguugugggagaacgcaaagaugaauuuugauaacgugggcaauggguucuuaagccugcuccagguggccacguuuaacggauggaucaccauaaugaauagugcuaucgacucugucgccguuaacauucaaccucauuucgaagugaauaucuauauguacugcuauuucauuaacuuuaucauauucggcguauuucugccacuuuccaugcugauuacagugaucaucgacaauuucaacaaacacaagauuaaguugggugggagcaauaucuuuauaacugucaaacagaggaagcaguaccgccgauuaaagaaacugauguaugaggauucgcaacggcccgugccucguccccucaacaaacugcagggauucauuuuugacguugugaccucacaggcauucaaugucaucgugaugguucuuauuuguuuucaggcuaucgccaugaugauagauacagacgugcaaucuuuacagaugaguauugcgcuguacuggaucaacuccaucuucgucaugcucuauacuauggaaugcauuuugaagcugaucgccuuuagauguuucuacuuuaccauugcuuggaauauauucgauuucaugguagugaucuuuagcauuacgggccucugccugccaaugacaguugguucuuaccuugugccucccagccugguccaguugauccuacuguccaggaucauucauaugcuccgcuuaggcaaggggccaaaaguguuccacaaccugaugcuuccgcugaugcucucauugccugcacugcucaacauaauccugcuuauuuuucuaguaauguucaucuaugccguguuuggaauguacaauuucgcuuaugucaagaaagaggccggcauuaacgacguuaguaauuuugaaaccuucgggaacagcaugcuguguuuguuucagguggcaaucuucgcgggaugggauggcauguuagacgccauauuuaauucuaagugguccgauugcgaccccgauaaaaucaacccagguacucaagugagaggggacuguggaaaucccucagucggcauuuucuacuuugugaguuauauccugauuagcuggcucaucauaguuaacauguacauuguaguggucauggaguuccugaauaucgcuuccaagaagaaaaacaagacacuuucugaggaugacuucagaaaauuuuuccagguguggaagagguuugacccugaucgaacccaguauauugacucgagcaaacugucagauuucgccgcagcucucgacccacccuuguuuauggccaagccuaauaagggucagcugaucgcacuagaucugccgauggccguuggcgaccgcauacacugccucgauauccuucuggcuuucacuaaacgggugauggggcaagacgucagaauggaaaaggugguauccgagauugaaaguggauuuuuauuggcgaacccauucaaaauaaccugcgagcccauuacaacgacccugaagaggaaacaggaggccgucucugcaacuaucauacagcgugcuuacaagaauuaccgccuccggagaaacgauaagaauacaagcgacauucauaugaucgauggcgacagggacgugcacgccaccaaagaaggggccuauuuugauaaggcuaaagagaaguccccuauccaaucacagauuuga

SEQ ID NO: 62233 - RNA, 5820 nt, Artificial Sequence
  derived and/or modified sequence opt3 from SCN8A__Homo_sapiens__NP_001171455
auggccgcuagacugcucgcacccccuggcccagacaguuucaagccguuuacccccgagucccuugccaacaucgaaaggcggauugcggagucuaaacugaagaaaccuccaaaggcugaugggucacaccgcgaagacgaugaggacaguaaacccaagccuaauagcgauuuggaagccgggaaguccuuaccauucauauacggugacaucccccagggccugguggcagucccucuagaggauuuugacccauauuaccucacacagaagacuuucguugugcugaaccgagggaagacgcuuuuucguuucucugccaccccggcucuguauauuuugucgcccuuuaaucucaucagaaggauugcaaucaaaauacugauccauucaguauucagcaugauuaucauguguacaauucugacuaacuguguguuuaugaccuucaguaauccuccagauugguccaagaacgucgaguacacauuuaccggaaucuauacuuucgaaucucucgugaaaauaauugcccggggcuuuugcaucgacgguuucacauucuuacgcgaucccuggaauuggcuggacuuuagcguuauuaugauggcuuacaucaccgaguucgugaaccuugggaaugucuccgccuugagaacguuuagggugcugcgggcgcuaaagacuaucucaguaauuccuggacucaagaccauaguuggcgcacugauccagagugugaagaaacuuagcgaugucaugauucugacaguguucuguuugucuguguuugcccucaucggccugcaguuauucauggggaaccugcgcaauaaaugcgucguuuggccaauaaacuuuaaugaauccuaucucgagaacggaacuaaagguuucgacugggaggaauacauuaauaacaaaaccaacuuuuacacagugcccggcaugcuugagccgcuguuguguggaaauucaagcgacgcuggacagugcccugaaggcuaucaauguaugaaggccggucgaaaccccaauuacggguauaccaguuucgauacguuuucuugggcauuccuagcucuguuuagacucaugacucaggacuacugggagaaccuguaucagcuuacacugagggccgcgggaaaaaccuacaugaucuucuucguauuggugaucuuugucggcuccuucuaucucgugaaucugauuuuagccguuguggcaauggcuuacgaagaacaaaaccaagccacucuggaggaagcugagcagaaggaagccgaguuuaaggcaaugcuagaacagcucaaaaagcagcaagaggaggcccaggcugcggcaauggccacaagcgcuggcaccgucucggaagaugccaucgaggaagagggggaagagggagguggcucuccacgguccucaagugagauuagcaaacuguccucuaagagcgcaaaagaacgucgcaauagaaggaagaagcggaaacagaaggagcuuucagaaggggaggagaaaggagacccugaaaagguguucaaaagugaguccgaagauggcaugcgacgcaaggccuuuagauugcccgacaacaggauaggucggaaguucagcaucaugaaucaaucucugcucucaauuccagggagucccuuucugagccgccacaacuccaaaucuucgaucuucagcuuuagaggcccuggaagguuccgugauccaggcuccgagaaugaauuugcugacgaugagcauucaacgguagaggaaagugaggggcggcgagacucucuuuucaucccgauuagagccagggaacgccggagcuccuacucaggauauagcgguuacucucagggcuccagaaguagcaggauauuucccucucugcgccgauccguuaagcggaacucaaccguggauugcaauggggucgugaguuugaucggaggcccugguagccacauugggggccgucuccugccagaggcaacaacugaagucgagaucaaaaagaaaggacccggcucguuacugguguccauggaccagcuagcgucuuaugggagaaaggacaggauuaacagcaucaugucaguugugaccaauacacucguagaggaacuggaggaaagucagcgcaaguguccuccaugcugguacaaauucgcuaacacuuuccuuauaugggagugucaucccuauuggaucaaguugaaagaaauugucaaccugaucgugauggauccguuuguugaccucgccauuaccaucugcauagugcugaauacauuauucauggcaauggagcaccacccuaugaccccacaauuugagcauguccuggccgugggaaaccuuguauucacugguauuuuuacggcugaaauguucuugaagcucaucgccauggaucccuacuauuacuuucaggagggcuggaauauuuucgacggguuuaucgugucccugucucuaauggaacugagccucgcagauguugagggacuguccguccuucggucauucagauugcugaggguguuuaaauuagcuaagagcuggccuacacucaacaugcugauaaaaaucauuggcaauagugugggugcccuugggaaccugaccuugguccucgcgaucauuguuuucaucuucgccguggugggcaugcagcuguuuggaaagucuuacaaggagugcguauguaaaauaaaucaggacugcgaacuaccccgauggcacaugcaugauuucuuucacuccuuccugauugucuuucgcgugcucuguggcgaguggaucgaaacuaugugggacugcauggagguugcugggcaagcaaugugucugaucguguucaugauggucauggugauuggaaaccuuguuguguugaaucuguuuuuagcccuccugcuuagcucguucucagcugauaaccuggccgcaaccgacgaugacggcgaaaugaauaaccuacagaucucuguaauucggauaaagaaaggugucgcguggacaaagcucaaagugcacgccuuuaugcaggcucauuucaagcagagagaggccgaugaggugaagccacuggacgaauuguaugagaaaaaggcaaauugcaucgcuaaccacaccggggccgacauucauaggaauggagauuuucagaaaaacggcaacgguacuacaaguggcaucggguccagcgucgaaaaguacauuaucgacgaggaucacaugucuuucauaaauaacccuaaucugacgguucgugugcccaucgcaguaggagaaagcgacuuugagaacuuaaauaccgaggauguguccucagaaagugacccagagggcagcaaagauaagcucgacgauacuucuuccucagaagggaguacaauugacaucaagccggaggucgaagaggugccuguugagcagcccgaagaguaucuggauccagacgccuguuucaccgaaggaugcgugcagcgcuucaaauguugccaggucaacauugaggagggccuugguaagagcugguggauccugcggaaaacaugcuuuuugauaguggaacauaauugguucgagacuuuuauuaucuucaugauccuccuguccucuggggcucuagcguuugaagauauuuacauagagcaaagaaagaccaucaggacgauucuggaauaugccgacaaaguuuucaccuacaucuuuauucuugagaugcuccugaaguggacagcauauggauucgugaaguuuuucacuaacgcuuggugcugguuggacuuucugaucgucgccguagugguuaaugccuuagugggcgcuauacccucgaucaugaacguccuccuggugugccuuauuuucuggcugaucuuuagcauuauggguguaaauuuguucgcaggcaaauaccacuacuguuucaacgagaccucagaaauccgauuugagauagaagaugugaauaacaagacagagugcgaaaaacucauggaggggaauaacacugagauucgguggaagaacgucaaaaucaauuucgacaacguuggagccggcuaucuggcgcuacugcaaguggcuaccuuuaagggguggauggauaucauguacgccgcaguggacucccgcaaaccugaugaacagccaaaguaugaggacaauauuuacauguauaucuacuucgucauauuuauuaucuucggcagcuuuuucacgcuuaaccucuuuauuggagugaucauagauaauuucaaccaacagaagaaaaaguuuggugggcaggacauuuucaugacagaggagcagaaaaaguauuacaaugccaugaaaaagcugggaucuaagaaaccccaaaagccuaucccgagaccauugaacaaaauccagggcauuguuuuugauuucguaacccagcaggcuuucgacaucgugauuaugauguuaauaugucugaauauggucacuaugaugguggaaacagauacccaaagcaagcagauggagaacauccucuacuggauuaaucugguuuuugugaucuucuuuacuugcgaguguguccuuaaaauguucgcacugaggcacuauuacuuuaccaucgguuggaacauuuucgacuuugugguagucauauuguccaucgugggcauguuccuagccgacauuaucgaaaaguauuuuguuucacccacacuguuccgggugauucgacucgcgagaaucgggcgcauacugaggcuuaucaagggagcuaaaggcauucguacguuacuguuugcccucaugaugucuuugccugcacuguucaauaucgggcuccugcuuuuucuggucauguucauuuucagcaucuuuggaaugaguaacuucgccuacgugaagcaugaggcuggcauagaugacauguuuaauuucgaaaccuuugguaacuccaugauuugcuuguuccagaucacuacaagcgccgggugggauggacuacugcucccaauuuuaaaucggcccccugacuguucucuggauaaagagcacccgggcucaggcuuuaagggggacugcggaaaccccuccguugguaucuucuuuuucgugaguuauauaaucauuagcuuucuuaucgucgugaacauguacauugcaaucauacuggagaauuucucgguagcuaccgaagagucugccgauccacucuccgaagacgauuuugagacauucuaugaaauuugggagaaauucgacccugaugcgacucaguuuaucgaguacuguaaguuggccgacuucgcagaugcucuggaacauccccucagagugccaaagccuaacaccaucgagcugauugccauggaccuucccaugguuagcggcgacaggauccacugccuagauauacuguuugcuuucacgaaacgcgucuugggggacucaggagaauuagauauucugcgacaacagauggaggaaagauuuguggcaaguaauccaucuaagguguccuacgagccgaucacaaccacucuccggaggaaacaggaggaagucagcgccguagugcugcaacgcgccuaucguggccaccuugcuagacgggguuucauuuguaagaaaaccacaucaaacaagcuggagaaugggggaacucauagggaaaagaaagagaguaccccuagcacagcgucccuccccucuuacgacagcguuacgaagccagaaaaagagaagcagcagcgcgcagaggaaggccgaagagagcgggccaaaaggcagaaggaagugcgcgaguccaaaugcuga

SEQ ID NO: 62234 - RNA, 5934 nt, Artificial Sequence
  derived and/or modified sequence opt3 from SCN9A__Homo_sapiens__NP_002968
auggccaugcugcccccuccaggcccgcagagcuucgugcacuuuaccaagcaaucccucgcucuuaucgaacagagaauugcagaaaggaaaucuaaggagcccaaagaagagaagaaagacgaugacgaagaggccccuaagccaucaagugaucuggaggcggggaagcaguugcccuucauuuacggagacaucccuccagguauggucagcgaacccuuagaggaucuggacccuuauuacgcugauaaaaagacuuuuauuguucuaaacaaaggcaagacuaucuuccgguuuaaugccacgccagcacucuauaugcuguccccguucucuccccuucgccgaauuucgaucaaaauacuggugcauucauuguuuagcaugcucaucaugugcaccauucugacaaacuguaucuucaugacuaugaauaacccuccagacuggaccaagaauguagaauacacauuuaccgggauuuauacuuucgagagucuggugaagauccucgcccguggauuuugcgucggcgaguucacauuuuuaagagaucccuggaacuggcuggacuucgugguuauaguguucgcuuaccuuaccgaauuugucaauuuggguaacguguccgcacugaggacguuccggguacuacgcgcccucaaaacuauuucuguuaucccugggcugaagaccauugugggagcucuuauccagagcgucaaaaagcuguccgaugugaugaucuugacaguguuuugucucucagucuucgcccugauuggcuuacaacuguuuaugggcaaucucaaacacaagugcuucagaaacagucuugagaauaacgaaacucuggagagcauaaugaauaccuuggaaucugaggaggacuuuaggaaauauuucuacuaccuagaaggguccaaggaugcgcugcucuguggauuuucaacagacagcggucagugcccagagggcuauaccuguguuaagaucgggcggaaccccgacuacggauauacgaguuucgauacuuuuucuugggcauuccuggcccuuuuucgccugaugacacaggacuacugggaaaauuuguaucagcaaacccuccgagcugccggcaaaacuuacaugauuuucuucgugguagugaucuuucuggguuccuucuauuuaauaaaccugauucuagcagucguggcuauggccuacgaggaacagaaccaggcgaauaucgaggaggccaagcagaaagaacucgaguuucaacagaugcuggauagacuuaagaaagaacaggaggaagcagaggcuaucgccgcugccgcagccgaguacacaagcauuaggcggucgcguaucaugggguugucugaauccucaagugagaccagcaagcuguccucuaagagcgcuaaagaacgcagaaacaggcggaagaaaaagaaucagaagaagcucucaaguggagaggagaagggcgacgcggaaaaacuguccaagagcgagucugaagauucaauucgacgcaaaaguuuccaucuuggcguugaggggcacagaagggcacaugaaaagcggcugagcacgccgaaccaguccccuuugucuauacgcggaucgcucuuuagcgccagaagguccucacguaccagucuguucucuuuuaaaggucggggccgagacaucgggagcgagacagaguucgcugaugacgaacacuccauuuuuggagauaaugagucaagaaggggcagcuuauucgugccccaccgcccacaggaacggagaucuuccaacaucagucaggccagcaggucuccucccaugcugccagucaaugguaagaugcauuccgcaguggacugcaacgggguaguuagccuaguggauggccgcagugcccucaugcugcccaauggacaacuuuugccugagggcacuaccaaccagauccacaagaaacgacgguguagcucguaucugcucuccgaagacaugcugaaugacccaaacuuacgucagagagcuaugucuagggccagcauucugacaaauacugucgaggagcuugaagagucacgccagaagugcccgcccuggugguaccgguuugcacauaaauucuugauauggaacuguaguccuuauuggaucaaguuuaaaaagugcauuuacuucaucgugauggauccauucgucgaccucgcgauuaccaucugcauagugcugaauacacuauuuauggcuauggaacaccaccccaugaccgaggaguucaaaaacguucuggccaucgggaaccucguguuuacuggaauuuucgcagccgagaugguacugaaacuuaucgcuauggauccuuaugaguacuuucaagucgguuggaauauuuucgacuccuugaucgugacgcugucuuuaguugaacucuuucuggccgauguggagggccuuagcguccugagauccuucagguugcuccgaguguuuaagcuggcaaaaucauggccaacacuaaacaugcugauaaagauuaucgggaauagcguaggagcucucggcaaccugacccuuguguuggccauuaucguuuucauauuugcggucguggguaugcagcuguucgggaaaaguuauaaggaaugugugugcaaaaucaaugacgauuguacuuuaccccgcuggcauaugaacgacuucuuucacucuuuccucauugucuuucggguucugugcggcgaguggaucgagaccaugugggauuguauggaaguggccggacaggcuaugugccuuauuguguacaugaugguaauggucaucggcaaucuggugguucuaaaccucuuccuggcauugcuguuauccagcuuuucgucagacaaucucacagccauagaggaagauccggacgcuaacaaucugcagauugccgugaccagaaucaagaaggggaucaacuacgucaaacaaacucuuagggaguucauucugaaggcauuuucuaaaaagccuaaaaucagucgugaaauucgccaggcggaggauuugaauacaaagaaggagaacuauauauccaaucauacgcucgccgaaaugagcaaaggacacaacuuccugaaggagaaagacaagaucucugguuuuggcagcuccguggacaaacaucuaauggaagauucagacgggcagaguuucauucacaacccaagccugaccguuacugugcccaucgcuccuggagagucugaucuugaaaauaugaacgccgaggagcucuccucagacagugauagcgaauacuccaagguacggcugaauagaucuucgagcucagaguguuccacagucgacaaccccuugccaggcgaaggugaggaagcagaggcugagccuaugaauagugaugaacccgaggccugcuuuaccgacgggugugugaggcgauucucuugcugucaggugaacauugaaagcggcaagggaaaaaucugguggaauauacggaagacaugcuauaaaaucgucgagcacuccugguuugagucauucauuguucugaugaucuuacucucuagcggcgcacuggccuucgaagauauuuacaucgagcgcaagaaaacuauaaagauuauccuugaauaugcugacaaaaucuuuaccuacauuuucauacuggagauguugcucaaguggaucgcguauggguacaagacguacuuuaccaacgccuggugcuggcuggauuuccuaauuguggacguaagucuggugacacuugucgcaaauacucucggauauuccgaucugggcccaaucaagucauugagaaccuuaagggcucugcggccgcuccgagcccugucuagauuugaagguaugcgcgugguugugaacgcccuuauuggggcuaucccuucaauaaugaauguccuguuggugugucuaaucuucuggcugauauuuuccaucaugggaguuaaccucuucgcaggcaaguuuuacgagugcauuaauacaacugacgguaguagguuccccgccagccaagugccaaaccguucggaguguuuugcgcugaugaaugucucucagaacguacgguggaaaaaccuuaaggugaauuucgacaacguuggcuuaggguaucugucccucuugcaaguggcuaccuuuaaaggauggacgaucauaauguacgccgcagucgauagcgugaauguagacaagcaacccaaguaugaauacucacuguauauguacauuuacuucguggucuucaucaucuuuggcaguuucuuuacacucaaccuguucauugggguuaucauagauaauuuuaaccagcagaaaaagaaacuuggaggccaggacauuuucaugaccgaggaacaaaagaaauauuacaaugccaugaagaagcuggguucuaaaaagccucagaaaccaauccccagaccugggaacaagauucagggaugcaucuuugauuuggugacuaaucaggcuuucgacauauccauuauggugcuaaucugucugaacauggucacaaugaugguggagaaagaaggccaaagccagcauaugaccgagguucucuauuggaucaauguaguguuuauuaucuuauucacuggugagugcguccugaaacuuauuucacugaggcacuacuauuuuaccgugggcuggaacauauucgauuuuguuguggucaucauuaguaucguggggauguuccucgcagacuugaucgaaacauacuucguaagcccgacgcuguuucgcgucauucgacucgccagaauaggacggauccugaggcuugugaagggcgcgaaagggauucgcacccuacuguucgcuuugaugauguccuuaccagcccuguuuaauaucggacuccugcuuuuccugguuauguuuauuuaugcaaucuucggcaugucuaacuuugccuacgugaagaaagaggaugguauaaaugacauguucaacuuugaaacuuucgggaauagcaugaucugucucuuucagauuacaaccuccgcuggaugggauggcuugcuggcccccauccuaaacucaaagccuccagacugcgaccccaaaaagguccauccugguucuaguguggagggcgauugugggaacccgucgguuggaauuuucuacuuugugagcuauaucauaauuuccuuccuggucgugguaaauauguacaucgcagugauucucgaaaacuucucuguugcuacagaggagucaacugaaccccuuagcgaggacgauuuugaaauguucuaugaggucugggagaaguuugacccagaugccacccaguucaucgaauuuuccaaacugagugacuucgcggccgcauuagauccucccuugcugauagcuaagccaaauaaagugcaacucaucgccauggaccugccuauggugucuggcgaucguauucacugccuugacauccuguuugcuuucacgaagagaguccucggggagagcggagaaauggauucauugcggucccagauggaggaaagguuuaugagugcaaaccccagcaaaguaucuuacgagccaauuacaaccacucugaagcgcaaacaggaggacguguccgccaccguuauccaacgagccuauagacgguacagguuacgccagaaugugaagaacauaucaagcauuuauaucaaggauggcgacagagacgaugaccuacugaauaaaaaggauauggcuuucgacaacgucaaugaaaacucgucuccggagaaaacagaugcgacaaguuccaccacaagcccucccucauacgacuccgugacgaagccagauaaagaaaaguacgagcaggacaggaccgaaaaggaggauaaagguaaggacucuaaagagagcaagaaauga

SEQ ID NO: 62235 - RNA, 588 nt, Artificial Sequence
  derived and/or modified sequence opt3 from SCNM1__Homo_sapiens__NP_001191785
augcugagagacggcagguucgccugcgcuaucuguccccaccggccugugcucgauacccuugcaaugcugacagcccaucgcgcggggaagaaacacuugagcuccuuacagcuguuuuacggaaagaaacaaccagguaaggagcgaaaacagaacccgaagcaucagaaugaacuacguagagaggaaacuaaggcugaggcaccccuccugacgcagaccaggcuuauuacacaaucugcccugcaccgggccccucauuauaacucaugcugucgcagaaaauacaggccagaagcucccggcccuagugucagcuuguccccaaugcccccuucugagguuaagcuccagucggggaaaauaucacgggagccagaaccggcagccggaccccaggcugaggaaagcgccacugugagugcgccugcaccaaugucccccacccgcagacgagcccuggaccacuaucugacacucaggucuagcggcuggaucccugauggucgggggcguuggguaaaggacgagaauguggaguucgauuccgacgaagaggaaccacccgauuuaccgcuggacuga

SEQ ID NO: 62236 - RNA, 2010 nt, Artificial Sequence
  derived and/or modified sequence opt3 from SCNN1A__Homo_sapiens__NP_001029
auggagggcaacaagcuggaagaacaggacagcucacccccucaaucuaccccagggcucaugaaaggaaauaagagagaggagcagggucuuggcccggaacccgccgcuccucagcagccaacagcagaggaggaagcccugaucgaguuccacaggucauaccgggaauuguuugaguucuuuugcaacaauacuacgauucauggggcgauacgcuuaguguguagucaacacaaccgaaugaaaaccgcuuucugggccguccuguggcuaugcacauuuggaaugauguauuggcaguucggccuccuguuuggugaguacuucagcuaucccguuucccuuaauaucaaccugaacucugauaaguugguguuuccugcaguaacuauuuguacccucaauccauaccguuaucccgaaaucaaagaggaacuggaggaacuggacagaauuacagagcagacccucuucgauuuauacaaguauucgucauuuacuacacugguggccgggagcaggagucggcgcgaccuuagaggaaccuugccucauccacugcagaggcuacgggucccgcccccuccacacggcgcucgccgagcaagauccguggccucuagccucagggauaauaacccccaaguugacuggaaggauuggaaaaucggcuuccagcugugcaaucagaacaaguccgacuguuuuuaccagacguacucaagugggguggaugcuguccgggagugguaucguuuccauuacauaaauauccuuagccgccugccugaaacuuugccaucucucgaggaagacacccugggaaacuucauuuuugccugcagauucaaucaaguguccuguaaccaggcgaacuauucacacuuucaccaucccauguacgguaauugcuauacauucaacgauaaaaauaacagcaauuuauggaugaguucuaugccgggcaucaacaaugggcugucccucaugcuuagggcagagcagaacgacuuuauuccucuguugagcacuguaaccggagcccggguuauggugcacggccaagaugaacccgcuuucauggacgacgguggguuuaaucuacgaccaggagucgagacaucgaucucuaugcgcaaggagacccuggauagacucggcggcgacuacggggauuguacgaaaaacggauccgacgugccuguggaaaaucuguaucccucaaaguacacucagcaggucugcauacauaguuguuuccaggagagcaugauuaaggaaugcgguugcgccuacaucuuuuauccaaggccccaaaacguugaguacugugauuaucggaaacacuccucuuggggcuacugcuauuacaaacuucagguggacuucagcucagaucaccugggguguuuuacaaagugccgcaagccuuguaguguaaccuccuaucaguugagcgcaggauacucuagauggccaucagugacaagucaggaaugggucuuccaaaugcucagcaggcagaauaacuacacugugaauaacaaacguaacggcguugcuaaggugaauaucuuuuucaaagagcugaacuauaagaccaauuccgagucuccgucggucacgauggugaccuuacugagcaaccuagguucccaguggucacucugguucgggaguucuguacugagcguuguggaaauggccgagcuugucuuugacuugcuggugauuauguuccucaugcugcuucggcgauuuagauccagguacuggucacccggccgcggaggcagaggggcgcaggaagucgccagcacacuggcaucuuccccuccaagucauuucugcccccacccuaugagcuugucucucucccaaccaggacccgcuccguccccugcccugacugcuccacccccugccuaugcaaccuuagguccccggccaaguccuggcgggagcgccggagcuucguccucuacauguccccugggcgguccauga

SEQ ID NO: 62237 - RNA, 1923 nt, Artificial Sequence
  derived and/or modified sequence opt3 from SCNN1B__Homo_sapiens__NP_000327
augcacgugaagaaauaccugcucaagggccuucauagacugcagaaagggcccggauauaccuacaaggaguuguuagucugguauugcgacaacacaaauacucacgguccuaaaaggaucauuugugaaggcccaaagaagaaagccaugugguuccugcuaacgcuccuguuugcugcacuuguuugcuggcaaugggggauauucauccggaccuaccugagcugggagguguccguaucuuugucagugggauuuaagacaauggauuucccggccgucacuauuuguaacgcgagucccuuuaaauauagcaagaucaaacaucuccugaaggaccuggaugaacucauggaggcuguguuagaacgcauucuggccccugagcuuucccacgcaaaugccacccgaaacuugaauuucucuaucuggaaccauacaccacugguucuaauagacgagcguaauccccaccacccuauggugcucgaucuguuuggcgacaaccauaauggucuuaccucgucaagcgcuagugaaaagaucugcaacgcacacggguguaaaauggccaugagacugugcuccuugaauaggacucaguguacauuccggaacuuuaccucugcuacgcaggcccucacugagugguacauucugcaggcgaccaauaucuucgcacaagucccacagcaggaauuaguggagaugagcuaucccggagagcagaugauucuggccugccucuuuggcgcugaaccuuguaacuaccgcaauuucacauccaucuuuuacccacauuauggcaacugcuacauauucaacugggggaugacugagaaggcccuuccgucagcaaaucccggaaccgaguucggucugaaauugauucuagauaucggccaagaagacuauguaccuuuucuggcuaguacagccgggguuagacucaugcugcacgaacagaggagcuacccauucauucgggaugagggaaucuaugcgaugucuggcaccgagacguccaucggugugcuugucgacaagcugcagcgcaugggggaacccuacucaccuuguacugugaacggaagcgaggugccaguccagaauuuuuauagugauuacaacacaaccuacucuauucaagccugcuugcgauccugcuuccaggaccacaugauaagaaauuguaacugcggccauuaucucuacccccugccgaggggcgaaaaauauuguaauaaccgggauuuuccugacugggcacacugcuacagcgacuuacagaugucgguugcucaacgugagacuuguaucgggaugugcaaggaaucuuguaaugauacacaguauaaaaugaccauuuccauggccgacuggcccucagaggcuagugaggauuggaucuuccaugugcugagccaggaacgcgaccaguccacgaacauaacccuaucuagaaagggaauuguaaagcucaauaucuacuuucaagaguucaacuauaggacaaucgaagagagcgccgcaaauaacauuguguggcugcuuucaaauuuggguggccaguuuggguucuggaugggaggcaguguccugugccucaucgaauuuggugagauuauaaucgauuucguguggauuacuaucaucaaacugguugcccuugcuaagucccugcggcagcgacgcgcgcaggcaagcuacgccgggccaccucccaccguggcugaguuggucgaagcccacacaaacuuuggcuuccaaccagacacugcacccagaucuccuaacaccggaccauacccgucagagcaggcccuccccauuccuggcacaccacccccuaauuaugauagucugagguuacagccacuggacgugauagaaagcgauuccgagggggacgcuaucuga

SEQ ID NO: 62238 - RNA, 2688 nt, Artificial Sequence
  derived and/or modified sequence opt3 from SCNN1D__Homo_sapiens__XP_011540201
augcccggcgccugccaucugcaggggagcgcugugaccgaggacaacacagcaccuucccucccagucgccagaccgccccaaaggccuaaggaaguuucuucacagccauguagugugaauggagcguggcccagcuuccuuggugagucccggggcauggggccuaaaggagcucgcgaugccugcccaucucuguugucguuucgauuaacuuggucaugguguagcgaccaccguacgccuaccugcagagaacugggcaguccccacccaacaccguguacuggucccgcaaggggguggccucggcgcggaggcggcccaugcggguucaccuccgccggacauguacuaugugguuacccccucugccugcuuucuggcccuauccagggguguggaacaggcgcugcacacgcccagagcugcccagauguggucggugagaagccccaagccugugccguguccgggggaccggcggcagaccuguggggcuugugcgauauuucaaaaccucccgccgcuagucucgaaagacauccaagcccuauauggcacucuaggaaguccgcccagcggggccgccaccgauggcagcugcugcccucaagagcagggaggcaggaggcucggggaagcauccucuuacaaaguugccagcugccaccccaguggcuuucuaccgaggccuggacuggugaauggaaacagccucauggcggggcguugacaucccguagcccaggaccgguugcuccccaacgcccuugucaccugaagggcuggcagcauagaccaacccagcacaacgcagcuugcaagcaaggucaggccgcugcccagacgcccccuaggccagggcccccgucggcaccuccacccccucccaaagagggccaccaggaagggcuaguggagcucccagccucuuuucgggagcugcuuacuuucuuuuguaccaaugcuacaauucauggcgcgauccgacuggucugcucccgcgggaacagauugaagacuaccucauggggacuccugaguuuaggugcacugguggcccucuguuggcaacuuggccuguuguucgaaaggcacuggcaucggccuguacuaauggcuguuagcgugcacuccgagcgcaaacugcucccccuggucacacuuugcgacgggaauccaagaaggccgucuccugugcugcgucauuuggaacuccuggaugaguuugcccgggaaaacauugacagcuuauauaaugugaaccugucaaagggacgagcagcccuaagugcuaccguccccagacacgagccacccuuccaccucgauagggagauccgccugcagcggcuuucccauagcggcucuagaguuaggguggguuuucgcuuguguaauucaacgggaggcgacugcuucuaccgaggauauacuucuggcguagccgcagugcaggauugguaccacuuucauuaugucgacauacuggcgcuccugccugcugccugggaagauagccacgggucccaggacggacacuucgugcuuucuuguucguacgacggucuggauugccaagcacggcaguuucguacauuccaucacccaaccuauggcagcuguuacacuguugacgggguguggacagcccagagacccggaaucacccauggcgucgguuuggugcucaggguagagcagcaaccucaucugccguuacuguccacgcuagcugggauucgcguuauggugcacggccggaaccacaccccauuccucggacaccauucauuuagugucagacccggcacagaagccacuaucucuauuagggaggaugaagugcaccgacuggggagcccuuacggacauugcaccgcaggcggugagggggucgagguggaacuuuugcacaauacauccuauacucgccaggcuugccugguuucauguuuccagcagcucaugguggagaccugcagcuguggauacuaucugcauccauuacccgccggcgcggaauacugcaguuccgcccggcacccugcuuggggucacuguuuuuauagacuguaccaagaccuugagacacauagguugccgugcaccagucguuguccccgcccaugccgggaaagcgcauucaaacucucuacuggcacguccagauggccuucagccaagagugcuggguggacacuggccacccuaggagagcagggccugccccaccagagccauaggcaacgaucgucccucgcaaagaucaacauaguauaucaggagcugaauuaccggucugucgaagaggcgccaguguacagcguuccucagcuuuugucagccauggggagucuguguuccuuaugguuuggagcuucugugcucagccugcuugaacuguuggagcuccugcuagaugccuccgcacugacucucguccugggcggucgcagacuuaggcgggcuugguucucauggccccgagccagcccagcaaguggggccucuuccauuaaaccggaggcuagccagaugccucccccagcgggaggcaccucggacgaucccgaaccuucagguccacacuugcccagagugaugcugccuggcguauuagccggggugucugcagaggaaaguugggcuggaccgcaaccacucgagacacuggacaccuga

SEQ ID NO: 62239 - RNA, 1950 nt, Artificial Sequence
  derived and/or modified sequence opt3 from SCNN1G__Homo_sapiens__NP_001030
auggcccccggcgagaagaucaaagcuaagauuaaaaagaaccugccugugaccgggccacaggcaccgacaauaaaagaacucaugagaugguacugccuuaauacuaacacgcacggauguaggcggaucgucguuagccgcggucgacugcguagauuguuauggauuggcuucacccugacagccguggcgcuaauccucuggcaaugcgcucugcuuguauuuuccuucuauacugugucugucucaauuaaggugcauuuuaggaagcuggacuuccccgccguuaccaucuguaauauaaacccuuacaaauauaguacagugcggcacuugcucgcagaucuggagcaggaaacccgcgaggcccugaagucgcucuacggguuuccagaauccagaaaaaggcgggaggcugagucuuggaauagcgucucagaaggaaagcagccccgcuucagccaucgaaucccuuuacugauuuuugaccaggaugagaaaggcaaggcaagagacuucuuuacugguaggaagcggaaaguagggggaaguaucauucacaaggccuccaacgugaugcauaucgaaucuaaacaaguugugggcuuccagcuuugcagcaaugauacauccgacugugcuaccuauacguuuucaaguggcauaaacgccauucaggagugguacaaguugcacuauaugaauaucauggcgcaggucccacuggagaaaaagauuaacaugagcuacucugcagaagaacuacucgugacuugcuucuuugaugggguguccugugacgcccguaauuucacccuguuccaccaucccaugcacggaaacugcuacacauuuaauaaccgcgaaaaugagacuauccuuucaaccagcauggguggcagugaauaugggcugcaagucaucuuguacauuaacgaggaggaauauaacccuuuccucguuucuuccacaggagcuaaagugauaauccauagacaggaugaguacccauuuguagaagacgugggcaccgagauugaaacggccauggucacuagcaucgguaugcaccugacagagucguucaaguuaucugagccguauucccaguguaccgaagaugggucagacgugcccauaaggaauauuuacaacgcagcuuauagucugcagaucugccuccacagcuguuuucaaacuaagaugguugagaaaugcggaugcgcccaguacucccagccucuuccacccgcggccaauuacuguaacuaucaacagcauccuaauuggauguacugcuauuaccagcugcaccgggcauucgugcaggaagaguugggcugucaaucugucugcaaggaggcuuguagcuuuaaagaguggacacuaaccacgucacuggcccaguggccaagugugguauccgagaaguggcuccugcccguucuuaccugggaucagggccgacaggugaacaaaaagcugaauaagacagacuuggcuaaacuccugaucuucuauaaggacuuaaaccaacgcagcauuauggaaucuccggccaauucaaucgagaugcugcuaaguaacuuugggggacagcucggucuguggaugagcugcuccgucgugugugucauugaaauaaucgagguguucuuuauugauuucuuuucuaucaucgcaagaaggcaguggcagaaagccaaggaguggugggcuuggaaacaagcgccucccugcccagaagcaccucggucgccccagggccaggacaauccagcccuugauauugacgaugacuugcccacuuucaacagcgcucugcaucucccuccagcccuggggacccagguuccgggaacacccccuccaaaguacaauacucuucgccuggagagagcauucuccaaccaauugaccgauacacagaugcucgacgaacuguga

SEQ ID NO: 62240 - RNA, 906 nt, Artificial Sequence
  derived and/or modified sequence opt3 from SCO1__Homo_sapiens__NP_004580
auggccaugcuggugcucguccccggcagaguuaugaggccucuugggggacagcuguggcgguucuugccacgcgguuuagaguuuuggggcccggcugaagggaccgcacgagugcugcuacgucaauucugcgccagacaggcggaggcuuggagggccagcggacggcccggcuacugucucgguacacgcccucuguccacugcaagaccacccccuccauggucucagaaggggcccggagacucaacgaggccuaguaaaccaggcccgguaagcuggaagucccuugccaucaccuuugcuauuggcggggcacuguuggccggaaugaaacacgugaagaaagaaaaggcugagaagcucgaaaaagagcggcagcgccauauagguaagccccugcugggcgggccuuucucucucacaacucacaccggagagcgaaaaacagauaaggacuauuuaggccaauggcugcuuaucuacuuugguuucacccauugcccagaugucugucccgaagaguuggagaaaaugauucaggugguugacgaaaucgauucgauuacuacacugccugaccuaaccccacucuuuaucucaauagaucccgagagagacacgaaggaagccaucgcgaacuaugugaaggaguucagcccgaaacuggucgggcuuacuggaaccagggaagagguggaucagguagcacgggccuaccguguuuauuacaguccuggccccaaggacgaagaugaggacuauauuguggaucacacaaucauuauguaccugaucggcccagacggggaguuuuuggacuacuucggacagaauaaacgcaagggugaaauagcugccuccauugcaacucauaugagaccuuauaggaaaaagucuuga

SEQ ID NO: 62241 - RNA, 801 nt, Artificial Sequence
  derived and/or modified sequence opt3 from SCO2__Homo_sapiens__NP_001162582
augcugcuccuuaccagaagccccacagccuggcacaggcugucccaguugaagccucggguguuaccaggcacucuagggggacaagcucugcaucuccgcucuuggcugcuuucacgacaggguccggcagagacgggcgggcagggacagccccaaggcccuggucugcguaccagauugcucaucacagggcuguucggagccggccugggcggggcguggcucgcuuuaagggccgaaaaagagcggcugcagcagcagaagcgcacugaagcacuuagacaagccgcugucggacagggugacuuucacuugcuggaucauaggggccgggcacgcugcaaagccgacuuccgagggcaguggguucuaauguacuuuggauucacccacuguccagauauuugccccgacgagcucgaaaagcuggugcagguagugagacaacuugaggcugagccuggccugccacccguccagccuguguuuauaacaguugauccagaaagggacgauguggaggccauggcgcgguauguccaggacuuccauccgcguuugcucggucugaccgggaguacuaaacaaguggcacaggccagccacuccuaccgcguauauuacaacgcuggacccaaggaugaagaccaggauuauaucguugaccacucuauugccaucuacuuacugaauccugauggccucuuuacagacuauuacggcagaucgaggucagcagagcagauuagcgacagugugcggcgacauauggcugccuuccgcuccguccuuucuuga

SEQ ID NO: 62242 - RNA, 471 nt, Artificial Sequence
  derived and/or modified sequence opt3 from SCP2D1__Homo_sapiens__NP_848578
auguggaagagaagcgaccaccagcccaaaaucaaggccgaggauggcccucugguggggcaauucgaaguccucggauccguuccagagccggcuaugccccauccucuugaacugucugaguuugaaucauucccaguguuucaggacauuagguugcacauacgggagguaggugcacaguuagugaaaaaggucaacgccguguuccagcuggauaucaccaaaaauggcaagacaauucuacgcuggacuaucgaccucaagaacgggaguggagauauguaccccggcccugcgcgacugccagcugacacgguuuuuaccauucccgagagcguguucauggaacuuguccuggguaaaaugaauccucaaaaggccuuuuuggcagggaaauucaagguguccggaaaaguacuccugucuuggaagcuggagcguguuuuuaaggauugggccaaauucuga

SEQ ID NO: 62243 - RNA, 1359 nt, Artificial Sequence
  derived and/or modified sequence opt3 from SCPEP1__Homo_sapiens__NP_067639
auggagcuggcccucagaaggagccccgugccucgguggcuucuguuguuaccacugcuacucggccugaacgcuggggcagucaucgacuggccgaccgaagagggaaaggaaguuugggauuacgugacaguacgcaaagacgccuauauguucugguggcuuuacuaugcgacuaauuccugcaagaacuuuucugagcugcccuuggugauguggcuccaggguggcccugggggaucaaguacgggcuucgguaauuuugaagagauugggccacuggauagcgaccugaaaccccgaaagaccacauggcuccaagcugccuccuuacuguucgucgauaacccugugggaacuggcuuuucuuacguuaauggcucgggggcauaugccaaagaccuugcuaugguggcaucagauaugauggucuugcugaagaccuucuuuagcugucacaaggaguuccagacagugccauuuuacauauucagugaauccuauggagguaaaauggccgcuggcaucgggcuagagcucuacaaggccauucagcguggaaccaucaaaugcaacuuugcgggcguagcacugggugacucuuggauuagccccguugauuccgugcuuucaugggggccuuaccuguauaguaugagcuugcucgaagacaagggacuggccgaggucucuaaaguggcugaacagguguuaaaugccgucaacaagggccuguacagagaggcaacugagcucuggggcaaggcugaaaugaucauagagcaaaauacagaugggguuaacuucuauaauauccuuaccaaauccacgccaacuucaaccauggaaagcagucuggaguuuacacagucucauuuggugugucuaugccagaggcacguacggcaucugcagcgcgacgcccucucccaacugaugaacggaccgauuagaaagaaacuuaagaucauucccgaggaucagagcugggguggccaggcgacuaauguguucgucaacauggaagaggacuucaugaaaccugugaucucgauaguugacgaacuguuggaggccgggauuaaugugaccgucuacaacggacagcucgaucugaucguggacacaaugggccaagaagcauggguaaggaaguuaaaauggccagagcugcccaaguuuucucagcuaaaguggaaagcucucuauuccgauccuaagucacuggagaccagugccuucguuaaaagcuacaagaaccuugcuuuuuauuggauuuugaaagccggucacauggugccauccgaccagggggauauggcacugaagaugaugcggcucgucacgcaacaggaauga

SEQ ID NO: 62244 - RNA, 4893 nt, Artificial Sequence
  derived and/or modified sequence opt3 from SCRIB__Homo_sapiens__NP_056171
augcugaagugcaucccccucuggagauguaacaggcacguggagagcgucgacaaacggcauugcucccuucaggccguuccugaagagauuuaccgcuauucucgaucacuggaagaguuguuacuggaugcuaaucaacuacgugaacucccaaagccguucuuuagacugcuuaaccugaggaaauugggccucagugacaaugagauacagcggcugcccccugagguggcaaacuucaugcagcugguagaacucgaugugagccgcaaugacaucccagagauucccgaauccaucaaguuuuguaaagccuuagagauugcggauuucucugggaacccucugucgagacuuccagacggauuuacccaguugaggucacuggcucaccuagcccucaaugaugucagccugcaagcacuucccggugacgugggcaaccuggccaauuugguuacacucgagcugcgggaaaacuuacugaagagucucccugcuucccuuucuuuccuggugaaguuggagcagcuagaucucgggggaaaugaccuggaaguccugccagauacucuuggcgcacugccgaacuugcgcgagcucuggcuggaccgaaaucaguuaagcgcccugcccccugaacuagguaaccucagaaggcuggugugccuugauguauccgagaaucgguuggaggaacugccagcugagcucgggggacugguucuucugacggacuugcuccugucacagaacuuacugcgucgccuacccgacggcaucggccaacucaaacagcugaguauacuuaagguggaucagaacagauugugugaagucaccgaggccaucggggacugcgaaaaucugagcgagcucauucugacagagaacuuacugauggcgcuuccuaggucuuugggaaaacucacuaagcugaccaaucuaaacguggaucggaaucaucuggaagcacucccacccgagaucgguggcuguguggcccuguccguccuuucauugcgagacaaccgccuggcuguuuuaccgccugaacucgcccacacaaccgagcugcaugugcuugauguagcagggaauagacugcagagcuugcccuuugcucucacucaccugaaccuaaaagcccuguggcucgcggaaaaucaagcccagccaaugcugagguuccagacagaggacgaugcacggaccggagagaaggugcuuacgugcuacuugcugccucaacagcccccacccaguuuagaagacgcuggccagcaggguucucucuccgagacuuggagcgaugccccuccaucgcgcgucucugugauucaauuucuggaagcuccgaucggggacgaggaugccgaggaagcagccgcugagaagagaggacuucagaggcgugcgacuccccacccuuccgaacugaaaguuaugaagcggucaauagagggccgaagaagugaagcauguccaugccagcccgacagcggcuccccucuaccagccgaggaggagaaaaggcucucugcugaaagcgggcugucagaagacagucgccccuccgccagcacagugucugaggcagaaccggagggaccuucagccgaggcucaggguggcagucaacaggaagccacuaccgcagggggagaggaagaugcggaggaagacuaucaggagccaacaguccauuucgcugaggaugccuugcugcccggcgacgaucgggaaauugaggaaggucagccugaggcacccuggaccuuaccagggggcagacaaaggcucauccgcaaggacacgccucacuacaaaaagcauuuuaaaauuagcaagcugccccagccagaggccgugguagcacuucugcagggaaugcagccggauggcgaagggccuguugcccccggagguuggcacaacggcccacacgcacccugggcuccucgagcccaaaaggaggaagaggaagaggaggaaggguccccacaggaggaagaggaagaggaggaagaggaaaaucgggcggaggaagaggaggccucuacugaagaggaagacaaagagggagcuguggucucggcacccagcgugaagggcgucuccuucgaucaggccaacaauuugcucaucgagccugcucguaucgaagaggaggaacugacacuaaccauucugagacaaacuggugggcuuggcauaucaaucgccggaggcaaagggaguacaccguauaagggagacgaugaagguauuuuuaucucuagggugagcgaggagggcccagcagcgcgcgccgggguucgggugggagacaaacuccuggaaguaaacggcgucgcuuugcagggugccgagcaucacgaagcaguggaggcucugagaggggccggcaccgcaguucagaugaggguguggcgagaacgcauggucgagcccgagaaugccgugacgauaaccccuuuacggccagaagaugacuacucccccagagagaggcguggaggcgggcuccgccugccucuucugccgcccgaaucaccaggaccuuugcggcagagacauguagcuugucucgcgaggagcgagcgaggccuggguuucucuauugccgggggaaagggcuccacacccuaucgggcuggugacgcuggcaucuucgugagucgcaucgccgaagggggagccgcucacagagcaggcacucuacaaguuggggauaggguccugagcauuaacggaguggacgugaccgaggcccggcaugaucacgcggucucucuucucacagcugccuccccaacuaucgcacuguuguuagagcgagaagccggcgguccucugcccccaucaccgcucccucacaguucgcccccaaccgcugcaguugccacaaccucgauuacuacggcgacacccggggugccuggacugccaucccuugcucccucucuguuggccgcagcccuagagggcccuuacccgguggaagagauaagacugccacgcgcugguggcccccucgggcugagcaucguaggaggcucagaccauaguucccacccuuuugggguccaggagcccggaguguucauuucuaagguucuuccaaggggcuuagccgcacguagcggucugcgggugggggauagaauccucgcugucaacggacaggacgugagggaugccacccaucaggaagcgguuuccgccuugcugcgcccuugccucgagcugucacuucuggugcgaagagaccccgcaccaccuggcuugcgggaacuaugcauccaaaaagcuccgggugagaggcugggcauuagcauacgcgggggagcccguggccacgcugggaaucccagagauccaacugacgaaggaaucuuuauuaguaagguaucuccuaccggcgcagccggucgggaugggaggcuccgcgucggauuacgacugcuugaggugaaccagcagucccugcucggcuugacacacggcgaggccgugcagcugcucagaagcgucggggacacccugacuguucuugugugugauggauucgaagcuagcacagacgcggcacuagagguaucacccggugugaucgccaauccauuugcugccggcauugggcaucggaacucucuggaaaguaucuccagcauagacagggaguugucuccugaaggacccggcaaagagaaggaguuaccgggucaaacgcugcacugggggccagaagcaaccgaggccgcuggacgcggccuccagccucugaaacuugauuacagagcgcuggccgcaguccccagcgcuggcuccgugcagaggguuccaucaggggccgcaggagguaagauggccgaaagucccugcagcccuucuggccaacagccgcccuccccaccuucacccgacgagcucccugcuaaugugaagcaggccuaucgggcguucgcagccgucccaaccagucaucccccugaagaugcuccagcccagcccccgacaccugggccagcugcaagccccgagcaauuguccuuucgugagcgccagaaauacuucgaacuggaggugcgaguuccucaggccgaaggaccacccaagagagugucucuagucggcgcugacgaucugaggaaaaugcaggaggaggaagcccggaagcuccaacagaaacgcgcacagaugcuuagagaggcggccgaagcuggugccgaggcaaggcuggcuuuagacggggaaaccuugggagaggaggaacaggaggaugaacaaccgccuugggccucgcccagcccaacaucacggcaguccccugcaagucccccaccccugggcggcggggccccuguacgaacugcuaaggcggagagacgccaccaggaaaggcuccgggugcagucuccagagccgcccgccccugagcgugcacugagcccagcugaacuuagagcccuggaggccgaaaagagggcacucuggcgcgcugcccggaugaaauccuuggagcaagacgcgcugcgagcucagaugguuuuaucaagaucucaggaaggaagggguacccgcggcccccuagagcggcuggccgaggcaccuagcccagcccccacgccuaguccgaccccaguggaagaucucgggccccaaacauccacuagcccuggaagacuuucucccgacuuugcugaggaacugcguucauuggagccauccccuagucccggcccacaggaggaagauggugaggucgcacuggugcuccuggggaggccgagcccuggagccguaggccccgaagacguggcgcuuuguucgucucggcgcccaguccgacccggcagaagggggcucggaccuguuccauccuga

SEQ ID NO: 62245 - RNA, 1305 nt, Artificial Sequence
  derived and/or modified sequence opt3 from SCRN1__Homo_sapiens__NP_001138986
auggugcaggacggcaccuucaagacaagagauagcacuuggacgugcgaguccaccaggauggccgcugcacccccuucuuacuguuuugucgccuucccaccgcgggcgaaagacgggcugguuguguuuggaaagaacucagcucgcccccgagaugaaguacaagagguggucuauuucagugccgcagaccacgaaccugagagcaaaguggaaugcacauacaucuccauugaucagguuccacguacuuaugccauaaugaucucuagacccgcuuggcucuggggugcagagaugggcgccaaugagcaugggguguguauugcuaacgaagccaucaauaccagggagccugcggcagaaauugaggcccuucugggaauggacuugguccgguuaggccuggagcgcggugaaacagcuaaggaggcccuagaugugaucguaucgcuccuggaagaacacgggcagggaggcaacuacuuugaagacgcaaauucaugccauagcuuccagagugcuuaucuuauaguugauagagacgaggccugggugcuggagaccaucggcaaauacugggcggccgaaaaggucacugagggggugagguguauuugcucccaauugucucucacaaccaagauggaugcagaacacccagagcugcggagcuaugcucagucccagggaugguggacgggugaaggcgaguuuaacuucucagagguguuuagucccgucgaagaccaucuggauuguggggccggaaaagacagccucgagaagcaggaagagucuaucacuguucaaaccaugaugaauacauuacgcgacaaggcuuccggcgugugcauugauucagaguucuuucugacuaccgccagcgguguaagugugcuuccucagaaccgaucuuccccauguauccacuacuucacagggaccccggaccccagcagaucgauauuuaaaccuuucauuuucgucgaugacgugaaauugguuccaaagacgcagucucccugcuuuggagaugacgauccugcaaagaaagagccaagguuccaggagaagcccgaccggcgucacgaacuguacaaagcccaugagugggcucgcgcgaucauugaauccgaucaagagcagggcagaaagcuaaggucaacuaugcucgagcuggaaaaacagggccuugaggcaauggaagagauccugacaaguagcgaaccguuggacccugccgaggugggggaucucuuuuaugacugugucgacaccgagaucaaguucuuuaaauga

SEQ ID NO: 62246 - RNA, 366 nt, Artificial Sequence
  derived and/or modified sequence opt3 from SCT__Homo_sapiens__XP_011518583
auggcccccagaccucugcuccuucuguuguuacugcuaggcgggagcgcugcaaggccagccccgccccgggcgcgccgacacuccgacggaaccuucacaucugagcucucacgucugagagaaggugcuaggcuucagcggcuguugcaaggccucguggggaagcgcagugagcaggaugccgaaaacagcauggcauggacuagacuguccgccggacugcucugcccuucuggcucgaauaugccaaucuuacaggcuuggaugccccuggacgguacguggucaccuuggcuuccacccgggccuauggucagcgagccagcaggagccgcugccgaaggcaccuugaggccgcgguga

SEQ ID NO: 62247 - RNA, 1323 nt, Artificial Sequence
  derived and/or modified sequence opt3 from SCTR__Homo_sapiens__NP_002971
augagaccccaccugagcccuccacuccagcaacuucuguugccgguguuacuggccugcgcugcacauuccaccggcgcccuacccaggcucugugacguccugcagguucuuugggaggaacaggaucagugccugcaagaguugucucgggaacagacaggggaccucggaacugagcagccugugccagguugugaaggcaugugggauaacaucucaugcuggcccaguagcguaccugggcgcaugguggaggucgaguguccacgauuccugcguaugcugacguccagaaauggaucucucuuuaggaacugcacccaggacggcuggucggaaacauucccccggccuaauuuagcguguggugugaacguuaaugauucaagcaacgagaagcgccacaguuaccugcuuaaauugaaggugauguauacugucggguacuccucuagccuggugaugcuacucguagcucugggcauucuuugcgccuuuagaaggcugcauuguacccggaauuauauacacaugcauuuguucguuuccuuuauccuccgcgcacugucaaacuucauuaaagacgccguguuauuuaguagcgaugacgucacauacugcgaugcucaccgagcaggauguaagcuggugaugguccucuuccaauauugcaucauggccaauuacucuuggcuucugguggaaggcuuguaucuacacacccugcucgcuauuuccuuuuucucagagagaaaauaccugcagggguuuguugccuucggaugggguagcccagcgaucuuuguggcacuuugggccauagcuaggcauuuccuggaggacguaggcugcugggauaucaacgccaaugcaaguauuugguggaucauucgggggccggugaucuugucuauacucauuaacuucauccuguuuauuaauaucuuacguauccugaugcgcaagcuaagaacucaggaaacaaggggaaacgaggucucccacuacaagcggcucgcucgaagcacccugcuuuugauuccccuguucggcauacauuauaucguguuugccuucucgccugaagacgcgauggagauucagcucuuuuucgaacuggcccuugguucuuuucaagggcugguuguggcagucuuguacuguuuccucaauggagaggugcagcuggagguacagaaaaaguggcaacaguggcacuuacgcgaauuuccacugcaccccguugcuuccuucucaaacaguacgaaagccagccaucuagagcagucccagggcacuugcagaaccucuaucauauga

SEQ ID NO: 62248 - RNA, 2967 nt, Artificial Sequence
  derived and/or modified sequence opt3 from SCUBE1__Homo_sapiens__NP_766638
augggcgccgcugcagugagauggcaccugugcguccuccuugcccuggggaccaggggacgguuggcggguggcagcggguuacccggauccguugacguggaugaguguucugaaggcacagacgauugccauaucgacgcuauuugucagaacacuccuaagucauacaaaugccuguguaagccagguuauaaaggggagggaaagcaaugcgaagauauagacgagugugaaaaugauuacuauaacggcggcugcguacacgaguguaucaauauuccggggaacuaccgcugcacguguuucgacggauuuaugcuagcccaugauggucacaauugccucgacguggaugagugccaggacaacaauggcgggugucagcagaucugcgucaacgcaaugggaaguuaugaaugucaaugccauagcggcuucuuucuguccgauaaucagcacaccuguauucaccgaucuaacgaggguaugaauugcaugaacaaagaccaugggugugcccacaucugccgugaaacacccaagggaggcguggcuugugacugcagaccuggcuucgaucuugcacagaaucagaaggacuguacucugaccugcaacuacgggaauggagguugccaacauucgugugaggauacagacaccggcccaacuugcgggugucaccagaaauaugccuugcacucagauggaaggacaugcauagagaccugugcuguuaacaacggcgguugcgaccggacguguaaggauacugccaccggggugcgcugcagcugucccgucggcuuuacacuccagccugacggaaaaacuugcaaggauaucaaugaaugucuggugaacaauggcgggugcgaccauuucugcagaaacaccguaggaaguuuugagugugguugcaggaaaggcuacaagcugcucacagaugaacggaccugucaggacauugacgagugcuccuucgaacgcacgugugaucacaucugcauuaauucuccagggagcuuucaauguuuaugccaucgaggauacauccuguauggcacuacacacuguggugacguugaugagugcuccaugucaaacgggaguugugaccagggcugcgugaauaccaagggaagcuacgagugcgucugucccccuggcagaaggcuucauuggaacgggaaagauugcguggaaacuggaaaguguuugucucgggcgaaaacauccccacgugcacagcugucaugcagcaaggccgguggcguggagaguuguuuccuaucuugcccggcucacacccucuuuguccccgacuccgaaaauagcuauguucugucguguggggugccuggaccacaaggcaaagcccuucagaagcgcaacgguacgucuuccgggcugggccccucaugcagugaugcaccuaccacaccaauaaaacagaaggcuagauucaagauuagggacgccaaaugucacuugcggccccauagccaggcgcgagccaaggagacugcacgccaaccgcuccuggaucacugccauguaaccuuugugacauuaaaaugugacuccucuaagaaaagaaggcggggacgcaagagcccuucaaaggaagucagucacaucacugcugaguucgagauugaaaccaaaauggaggaagccuccgauacaugcgaggcugacugccugagaaagagggccgaacagagccuccaggcagccaucaaaacccuucguaagucuaucggccggcagcaauucuacgugcagguuucagggacugaguaugagguggcucagcgacccgcgaaagcacuggaaggacagggcgccuguggugcugggcaagucuugcaggauaguaagugcguggccuguggaccaggcacgcacuuugguggcgagcuagggcagugcguaagcuguaugccuggaacauaccaggacauggaaggccaacuguccugcacccccuguccaucuucggacgggcucggacugcccggcgcaagaaauguuagcgagugcggugggcaguguuccccuggauucuuuucagccgauggcuucaagccaugccaggcuuguccgguggguacuuaucaacccgagccuggcaggaccgggugcuuuccaugcggaggcgggcuucugacaaaacaugaaggaaccacaaguuuccaggacugugaggccaagguccacugcucucccggccaucacuacaacacuacgacccaucgcuguauucggugcccuguggguacuuaccagccagaauuugggcagaaucacuguauaacaugccccggaaacaccagcacagauuucgacggcuccacuaaugucacccacuguaaaaaccaacauugcgguggcgaguugggggauuauacgggauacaucgaaucaccgaacuauccuggcgacuacccagcaaaugcggaguguguguggcacauugcucccccucccaagagaaggauccucauaguugugccagagauuuuucugccuaucgaagaugagugcggggacguauuagucaugcgcaaaagcgccucucccaccuccaucacaacuuaugaaaccugucagacauacgagcgaccaauugcauucaccagucggagccguaagcuguggauccaguuuaagucuaacgaaggaaauuccggcaaagguuuccaggugccguauguuacuuacgaugaggacuaccaacagcuaauugaggauauagugagagacgggaggcucuaugccucagaaaaccaucaggagauccugaaggauaaaaaguugauuaaagcucuuuuugacguccuggcccacccucagaauuacuucaaguauacggcacaagaaaguaaagagauguucccccgcagcuuuaucaagcuccugcggucgaagguguccagauuccuuaggccauacaaauga

SEQ ID NO: 62249 - RNA, 2424 nt, Artificial Sequence
  derived and/or modified sequence opt3 from SCUBE2__Homo_sapiens__NP_001164161
augggcguggccgggagaaacaggcccggagcugcaugggccguccugcuccuucuguuguuacugccuccacuacuccugcuugcgggugcuguuccgcccggccgggggcgcgccgcaggaccucaggaggacguggaugaaugcgcccaaggccuggacgauugucacgcugacgcauugugccagaauaccccaacaagcuacaaguguuccugcaaacccgguuaucagggggagggacgacagugugaagauaucgacgagugcggcaacgaacucaauggcggguguguacaugauugccugaacauuccuggaaauuaccguuguacuugcuucgacgguuuuaugcuggcccacgauggccauaacugucucgacguggaugagugcuuagagaauaacgggggaugccaacacacgugugucaaugugaugggcucuuaugaaugcuguugcaaggaggguuucuuucugucagacaaccagcauaccuguauacacagaagugaagaggggcuuagcugcaugaauaaagaucacggauguucccauaucugcaaggaggcuccaaggggcucuguugccugugaaugccggcccggcuucgaguuggcgaaaaaccagcgcgacuguauucugacaugcaaucacgggaacggagguugccagcauucgugugacgauacugcagacggcccugaaugcucaugucacccacaauacaagaugcacaccgaugggagaagcugccuagagagggaagacacagugcucgaggucaccgagaguaauacuacauccgugguagauggagacaagcggguuaaacgccgacugcuuauggaaaccugugccgugaacaacggcgguugcgauagaacguguaaggacacuucuaccgggguccauugcagcuguccggugggcuuuacacugcaguuggauggaaaaacuugcaaggacaucgaugagugucagaccaggaauggcgggugcgaccacuucugcaaaaacauugugggauccuuugacugugguugcaagaagggcuucaaacuccugacagaugaaaagucaugucaggacgucgaugagugcaguuuagaccggaccugugaucauagcugcaucaaucaccccgggacguuugcuugugccugcaaccguggauauacucuguacggcuucacacauuguggugacaccaaugaaugcucuauaaacaaugggggcugucaacagguuugcgugaacacuguaggauccuaugagugccagugucacccuggcuacaaacuccacuggaauaagaaagauugcguggcaucaugugaccuuagcugcaucgucaagcgcacagagaaaagacugaggaaggcuauucggaccuugcgaaaggccgugcaucgcgaacaauuucaccuacagcugagugggaugaaccucgauguugcgaaaaagccacccagaacgucugagaggcaggccgaauccuguggagugggucagggccaugcagagaaucaaugcgucagcugucgggcugggaccuacuaugacggagcccgcgaaagaugcauccuguguccuaacggcacauuccagaaugaggagggucagaugacuugcgaaccaugucccaggccggggaacucgggcgcucuuaaaaccccugaggccuggaauaugucugaaugcggaggccugugccagcccggggaguacuccgcagauggauuugccccaugucaauugugcgcucucggcacauuccagccugaggcgggucguacuucauguuuccccugcgggggaggccuggcaaccaagcaccagggugccacaaguuuucaggacugugaaacccgggugcaaugcagcccaggccacuucuauaacacuacgacacaucgauguauuagaugccccguagggaccuaccagccugaguuuggcaaaaacaauuguguuuccugcccaggaaacacuaccacagauuucgacgggucuaccaauaucacucaguguaagacaagcucaaacagugugacgaccuaugaaacuugccagacauacgagaggccgauagcuuuuaccucccgcagcaagaaauuauggauucaauucaagucuaaugaaggaaacucagcccggggcuuucagguccccuaugugacauacgacgaggauuaccaggagcugaucgaagacauugucagagaugguaggcuauaugcaagugagaaucaccaagaaauccucaaagacaagaaacugaucaaggcccuuuucgauguguuggcucauccucagaacuacuuuaaguauacugcccaggagagccgcgaaauguucccacgauccuuuauucggcugcuccguucuaaaguuucgagauuccugaggcccuacaaguga

SEQ ID NO: 62250 - RNA, 2982 nt, Artificial Sequence
  derived and/or modified sequence opt3 from SCUBE3__Homo_sapiens__NP_689966
augggcagcgggagagugcccggacugugccuccuuguccuguugguucacgccagggcugcacaguacuccaaggccgcgcaagacguggaugaguguguagaagguaccgacaacugccauaucgaugcuauuugucagaauacaccucggucuuauaaaugcauauguaagucaggcuacacuggggacggaaaacacugcaaggauguggacgagugugaacgcgaggauaacgccggcugcguccaugacugugugaauaucccagguaacuaucgaugcacguguuacgauggguuccacuuagcacaugacggacacaauugccuggauguugacgaaugcgccgagggcaacggcgggugucagcagaguugcgugaauaugaugggaagcuaugagugucacugccgugaaggcuuuuuccuauccgauaaccaacauaccuguauucagagaccggaggaagguaugaauugcaugaacaaaaaucacgggugugcucauaucugcagggagacacccaagggaggcauugcaugugagugccggccugguuuugaacucacuaagaaccagcgcgacuguaaacugaccugcaauuacgggaacggaggcugccagcacacaugugacgauaccgagcaaggcccaagaugcgggugucacaucaaguucguccuucauacugacggaaaaacaugcauagaaaccugugccgugaauaacgguggcugcgauucuaagugucacgacgcugccacggggguacauugcacuugucccguuggauuuaugcugcagccugauaggaaaaccugcaaggacaucgaugagugucgguugaacaauggcgguugcgaccacauuugccgcaacacaguggggucguucgaauguucaugcaagaaaggcuauaagcuccugaucaaugagcgaaacugucaggauauugacgagugcagcuuugauagaacuugugaccauaucugcgucaauaccccaggaaguuuccagugucugugccacaggggcuaccucuuauacgggauaacacacuguggagacguggaugaaugcuccauuaaccgggguggcugucguuuugggugcaucaauacccccggaucuuaucaaugcacguguccugcgggccagggucgccugcauuggaacgggaaagacugcacugagccacuuaagugucagggcagcccgggagcauccaaagccauguugucaugcaauagaaguggcaagaaagauacaugugcucugaccugccccagcagggcccgguuccuaccugaaucugagaacggguuuacuguguccuguggaacaccaucaccccgagcagcuccugcccgcgcgggucacaauggcaacagcaccaauaguaaccauugccacgaagccgcaguccucucuauuaagcaaagagcuuccuucaagaucaaagacgccaaguguaggcugcaccuucggaauaaagggaagacggaggaggcuggacgcaucaccggcccagguggggcccccugcagcgaaugucagguuacauuuauucaucugaaaugcgauucgucuagaaagggcaagggaaggcgugcacggacuccgccuggcaaagaggugacccgauugacacucgaacuggaggccgaaguaagagcugaggagacuaccgcguccugcggguuacccugucugaggcagcgcauggaacggagacucaagggaucacuuaaaaugcugaggaagaguauaaaccaggaccgcuucuugcuacgacuggcaggccucgauuacgagcuggcccacaaaccaggucuuguggcuggggaacgggccgagccuauggagagcugccgucccggacaacauagagcaggcacaaagugugucuccugcccacaggguaccuauuaccacggccagacugaacagugugugcccugcccugccgggacguuccaagagagggaaggacagcugucuugugacuugugcccaggcagcgaugcucaugggccgcucggagccacaaacguuaccacuugugcaggccagugucccccuggucagcacucaguggacggguuuaagccaugccaacccugcccucgcggaaccuaucagccagaggcgggccggacacugugcuuccccugugguggcggguuaaccacuaaacacgaaggagcuaucaguuuucaggauugcgacacaaagguccaguguuccccgggccauuacuauaauacgagcauucacagaugcaucaggugugccauggggucuuaccaaccugauuuccgacagaacuuuugcucacgcuguccaggaaauaccaguacugacuucgacggcagcacauccguggcacagugcaaaaaccggcaaugugguggggagcugggagaguuuaccggcuacauagaaucucccaauuauccugguaacuaccccgccggcguagagugcauuuggaauaucaacccaccucccaagagaaaaauccuaauuguugugccagaaaucuuccucccgucggaggaugaauguggggacguccuggugaugaggaagaauagcuccccuucaaguauuacaacuuaugagaccugccagacguacgagcgucccauagcuuuuaccgcccgcucucggaaacuuuggaucaacuucaagacaagcgaagcaaauuccgcuagaggauuucagauuccauaugucacuuacgaugaggacuaugaacaguugguggaggauaucguuagggacggccgacuguacgccucagaaaaccaucaagagauccucaaggauaaaaagcugauuaaagcguucuuugaggugcuugcccacccccagaauuacuucaaguauaccgaaaaacauaaggagaugcugccuaagagcuucauaaaauugcuccggucuaagguauccaguuuucugcgcccauacaaauga

SEQ ID NO: 62251 - RNA, 2376 nt, Artificial Sequence
  derived and/or modified sequence opt3 from SCYL1__Homo_sapiens__NP_001041683
augugguucuuugccagagaccccgugagggauuucccuuuugagcugaucccagaaccgcccgagggcgggcucccuggaccaugggcacuucaccggggucgcaagaaagcaaccggcagccccgucuccauuuucguuuacgacgugaagccuggggccgaagaacagacacaaguagcgaaagcugccuuuaagcgauucaaaacucugcgucauccaaacauauuggcauauaucgauggauuagaaacggagaagugccugcacguggucaccgaggccgugacaccccuaggcauuuaccucaaggcuagaguugaagcuggugggcugaaagagcuugaaaucucuuggggacugcaucagauugugaaggccuugucauuucucgucaaugacuguagucugauccacaacaaugugugcauggcugccguauucguugauagggcgggcgaguggaaacugggcgggcucgacuauauguacagcgcacagggaaacgguggcgggccuccacggaagggaauaccggaguuagaacaguaugaucccccugagcuggccgacuccucuggccgcguggucagagaaaaauggucggcugauauguggaggcuugguuguuugaucugggagguguuuaaugggccacugccccgggccgcagcucuacgcaacccuggaaagauuccaaagacucucgugccccauuacugcgaacuggucggcgccaauccgaaaguucgaccuaaccccgcgagauuccuucaaaauuguagggccccaggcggguuuaugucaaaccgguucguggagaccaaucuguuuuuggaggaaauccagauuaaggagccugcagaaaaacagaaguucuuccaggagcucagcaaaagucuggacgcuuuucccgaagauuucugccgucacaagguauuaccacaacugcucacagccuuugaguucggaaacgcuggugccgugguccuuacuccccuguuuaaagugggcaaguucuuguccgcagaggaauaucagcagaagaucauaccuguuguggucaaaauguuuucuagcaccgaccgcgccaugagaauuaggcuacugcagcaaauggagcaguucauccaguaccucgaugaaccaacagugaauacccaaauuuuuccgcacguaguucauggguuccuggacacgaaccccgcuauccgggagcagacugugaaguccaugcuucuguuggcgccuaaacucaaugaagcaaaccugaacgucgaguuaaugaagcacuuugcccgacugcaggcuaaagacgagcagggaccaauccgcuguaauaccacagugugccuaggcaagauugguucauaccucagugccagcacuagacauaggguccugaccucugcauucucccgggccacacgcgaucccuuugcuccuucaagaguggccgggguucuuggcuucgcagcgacccacaacuuguauagcaugaaugacugugcucaaaagauacugccagugcucugcggacugacgguagaucccgagaaaagugucagggaccaggccuucaaggcaauccguucuuuucuuuccaaacuggagagcgugucggaagauccgacucaguuggaggagguugaaaaggacgugcacgccgcuucuuccccuggcaugggaggggccgcagcuucaugggccgguugggcggucacaggcgugaguagccucaccuccaaacugauucggucucauccaacuacagcccccaccgagacgaacaucccucagcgacccaccccagaagggcacugggagacacaagaagaggauaaggacacugcugaggauagcucaaccgcagacagaugggaugacgaagacuggggaaguuuagagcaggaagccgaguccguacuggcucagcaggaugacuggagcacaggcggucaagugucuagggccucacagguuaguaauagcgaucauaaguccucuaaaucgccugaaagcgacugguccucaugggaggcagaggggaguugggaacagggcuggcaggagcccucuagccaagaaccaccgccugauggaacucgccuagcguccgaguacaacuggggcgggcccgaaucaagcgacaagggagauccauucgccacccucucugcucggcccuccacacagccuagaccagacaguuggggugaggauaauugggagggccuggaaaccgacagcaggcaggucaaagccgagcuugcacgcaagaaacgagaggaacggcguagagagauggaagcuaagagggccgagcgcaagguggcaaaagggcccaugaaguugggagcccggaaacuggauuga

SEQ ID NO: 62252 - RNA, 2067 nt, Artificial Sequence
  derived and/or modified sequence opt3 from SCYL3__Homo_sapiens__NP_065156
augggcagcgagaacuccgcccugaagucuuacacccucagagaacccccuuucacacuuccaucagggcuggcuguguauccggcagucuugcaggacggaaaauuugccaguguuuucguguacaagagggagaaugaagauaaaguaaacaaggcggcuaaacacuuaaagacucugcggcaucccugccuacuccgcuuucugagcuguacgguggaggccgacgguauccaccuugucaccgaacgagugcaaccucuggagguugcauuggagacacucuccucugccgaagugugcgcuggcauuuaugauauacugcuggcacucaucuucuuacaugaccgugggcaccugacucauaauaacgucugucuuucgucaguguuuguaagcgaggauggacacuggaaguugggcgguauggaaaccguuugcaaagugagucaggccacaccagaguuccugagauccauucagucuaucagggaccccgcuagcauuccuccagaggaaaugucccccgaguuuaccacucuaccugaaugucacgggcaugcccgggaugcguucucauuuggaacacucgucgagagucugcuuaccauccugaaugaacaggugagcgcagacguguugucuuccuuccaacagacgcuccacucaacucuguuaaacccaauaccgaagugccgccccgcccuguguacccuccuuagccaugacuuuuucagaaaugauuuucuggaggucguuaacuucuugaaaagucuaacacugaagucugaggaagagaaaacugaguucuuuaaguuccuccuggauaggguguccugccuuagcgaggaacugaucgcuucgcgguugguaccucuccuguuaaaucagcugguguuugccgagccagucgcagugaagucuuuccuacccuaccuccugggcccuaaaaaggaccacgcucagggcgagaccccaugucuuuugucccccgcccuguuucaaucacgcguuauuccggugcuccugcagcuuuucgaaguccacgaggaacaugugcgaaugguacuguugagucacaucgaggcguauguugaacauuuuacacaggagcagcucaaaaaggugauucugccucaagucuuacuggggcuaagagauaccagcgacuccaucguggccauaacgcuccacucucuggcaguccuugugagcuugcugggacccgagguugugguagguggcgaaaggacuaaaauuuucaagcggacagcuccaucauuuaccaaaaacacugaccucagucuggagggggauccuuucucccagcccaucaaguuuccaauuaauggauuaagcgacgucaagaacacaucugaagauucagagaauuuccccaguagcuccaaaaagucugaggaauggccugacuggucggagccagaagaaccggaaaaccagaccgugaauauccaaaucuggccccgugagccuugcgaugacguuaaaagccaguguacgacccuggauguggaggaauccucaugggacgauugcgagccaaguucucuugacacaaaggucaaccccggcggugggauuacugccaccaaaccugugacaagcggagaacagaagccaauacccgcuuugcucucccugacugaggaaucaaugccguggaaaagcucucuaccucagaagaucucccugguacaacgcggcgaugacgccgaccagauugagccacccaaggugaguagccaggagagaccucucaaaguucccucugaacugggccuuggggaggaauuuaccauccaggucaagaaaaagccagugaaggauccugagauggacugguucgcagauaugauacccgaaauuaaaccauccgccgcuuucuugauccugccggaguuaaggacagagauggugccuaagaaagacgaugucucacccguuaugcaauuuaguagcaaguucgcggcagccgaaaucaccgagggagaagcugaggguugggaggaagagggcgaacucaacugggaggacaauaacugguga

SEQ ID NO: 62253 - RNA, 933 nt, Artificial Sequence
  derived and/or modified sequence opt3 from SDC1__Homo_sapiens__NP_001006947
augagaagggccgcucuguggcucuggcuuugcgcacuggccuugagcuuacagcccgcgcugccucaaaucguggcuaccaaccuaccaccggaggaccaggauggcuccggggacgauucugacaauuucucaggaaguggugccggcgcacuccaggauauuacacugagccagcaaacucccuccacguggaaggacacccagcuucugacagccauaccuacuucuccagaacccaccggguuggaggcuacagcagccucgaccucaacucucccugcuggagaaggcccaaaagagggugaagccgucguucugcccgagguggagccugggcugacagcgcgggaacaggaggcaaccccacgcccgcgagaaacgacucagcuccccaccacacaccaagccagcacuaccacagcuaccacggcccaggagccugcaacaagucauccacaccgugauaugcagcccggacaucacgagacuuccaccccugcuggcccaucucaggccgacuuacauacuccccacacagaagauggcgggccgagcgcgaccgagagagccgcagaagacggagcuuccucacaacugccugccgcugaggguaguggcgaacaggauuuuacguucgagaccagcggggagaacacagccguaguggcagucgaacccgacaggcggaaucagucuccaguggaucaaggagccacuggcgcuucccagggucuuuuggaccgcaaggagguucuagggggagugaucgcgggcggccuggucgggcucauuuuugcagugugucugguaggauucaugcuuuacagaaugaaaaagaaagacgaagguucauauagccuggaggaaccuaagcaggccaacggcggggcuuaccagaagcccaccaaacaagaggaguuuuaugccuga

SEQ ID NO: 62254 - RNA, 606 nt, Artificial Sequence
  derived and/or modified sequence opt3 from SDC2__Homo_sapiens__NP_002989
augagaagggccuggauccugcucacccuuggccugguggcuugcgucagcgcagagucccgggccgaauugacaucugacaaggauauguacuuagacaacucaaguauugaggaagcgagcgggguuuaucccauagaugacgaugacuacgcuuccgccucuggaucgggugcagaugaggacguggaaucaccugagcugacuacgagccgcccacuaccgaaaauccuccugaccagugccgcucccaagguagagacaacuacccuuaauauucagaacaaaaucccugcacaaacaaaguccccagaagagaccgauaaagaaaaggugcaccugucugacagcgagcgaaagauggaucccgccgaggaagacacuaaugucuauacagagaaacauuccgauucauuguucaagcguaccgaagugcucgcugccguuauugcgggcggggugaucggauuucuguucgcaauauuucugauccucuuacuggucuacagaaugaggaaaaaggacgagggcaguuaugaccuuggugaacggaaaccuagcucugccgcuuaccagaaggccccaacgaaggaguucuaugcauga

SEQ ID NO: 62255 - RNA, 1332 nt, Artificial Sequence
  derived and/or modified sequence opt3 from SDC3__Homo_sapiens__XP_011540764
augcccacccagaugcuguucccucuccacggccuuuuucuguacagcuccgugaacucuuauacaucaaguaagacucaacauagaugcuuguuacugugggaaagcaauaacgacccauccuaccagccgcccucuacggcccagagguggcggucggaaaauuucgagcgcccugucgaucuagaagggucaggagacgaugacagcuuuccagaugacgagcucgaugaccuguauagugguuccggcucuggguacuucgaacaggagagcggaaucgagaccgcuaugcgauuuucccccgauguugcacuugccgugucaacaacuccugcgguacugccaaccacaaacauucaacccgugggcaccccuuucgaagaguugccaagugaacguccgacucucgagcccgcuacaagcccucuggucgugaccgagguuccagaagaacccucucagagagccacgacuguguccaccacaauggcaacuaccgccgcuacaucaaccggugacccuacggucgcaacugugccagccacaguagcuaccgccacucccagcacaccggcggcaccucccuuuaccgccacgaccgcuguuauaaggacaacuggggugcggcgccugcucccauuaccucugaccacagucgccacugcaagagcuaccacacccgaagccccaagucccccuaccacugcggccgugcuugauacggaggcaccaacaccgagguuggugucuaccgcuacuucccggccccgcgcccugccucgaccagcuaccacacaggaacccgacaucccugagagaagcacccuaccacucggaacuacagcccccggcccgacggaggucgcacagaccccuacuccagaaacauuccugaccacaauuagggaugagcccgaaguuccugugucgggcgggcccucuggagacuuugagcuuccagaagaggagacuacccaaccugacacggccaaugaaguaguggcugucgguggcgcggcagccaaggcuuccucacccccagggacccugccgaaaggagcccggccuggccccgguuugcucgauaacgcaaucgacagugggagcuccgccgcucagcugccacagaaaucuauuuuagagcguaaggaagugcugguugccgugaucgucggaggcgugguaggcgcacucuucgcggcuuuucuuguuacacuguugauauaucgcaugaaaaagaaggaugaggggagcuacacucuagaggagcccaaacaggccucagugaccuaucaaaagccugacaaacaggaggaguucuacgcauga

SEQ ID NO: 62256 - RNA, 597 nt, Artificial Sequence
  derived and/or modified sequence opt3 from SDC4__Homo_sapiens__NP_002990
auggcccccgcuagacuguucgcacuccuucuguuuuucgugggcggggucgccgaaagcaucagggaaaccgagguuauugacccucaggauuuguuagaaggacgguacuuuuccggugcgcugccagacgaugaggacgugguaggcccggggcaagaaucugaugacuucgagcuaucaggaaguggcgaucucgacgaucuggaggacagcaugauaggucccgaagugguccacccucuugugccacuggauaaccauauccccgagcgcgcuggguccggaucucagguuccuacagaaccaaagaaauuggaggagaaugaagugauucccaagcgaaucucgccugucgaggaaucagaggacgugagcaacaaaguaaguauguccucuacuguucagggcagcaauauuuuugaacguacggaggugcucgccgcacugaucgucggcgggauagugggaauccuguucgccguguuucucauuuuacugcuuauguauagaaugaagaaaaaggaugaggguuccuacgacuugggcaagaaaccaaucuauaagaaagcuccgaccaacgaguucuacgcauga

SEQ ID NO: 62257 - RNA, 879 nt, Artificial Sequence
  derived and/or modified sequence opt3 from SDCBP2__Homo_sapiens__NP_001186713
augagcucccuguaccccucucucgaggaccuuaagguggaucaggccauccaagcucaggucagagcaucaccuaaaaugccagcccugccgguucaggcgaccgcuauuagucccccuccaguguuguaucccaacuuagccgaacuggagaauuacaugggccuaagccucuccucucaggaaguacaagagucgcugcuucagauaccugaaggggacucaacagcagugagcggaccaggucccggccagauggucgccccugugacuggguauagucugggaguuaggcgggcugagaucaagccaggcgugcgcgagauucacuugugcaaagaugaacgagguaagacggggcuccgucugagaaaagucgaccagggacuguucgugcaacucguacaggcaaacaccccggccuccuuaguuggccugagguuuggcgaucagcuuuugcagaucgacgggcgggauugugcuggauggucuagccauaaggcccaccaaguggucaagaaagcguccggugacaagauugugguggucguucgcgauagacccuuccagaggacagugacuaugcauaaagacucaaugggccacguaggguuugugaucaagaaaggaaagauagucagucuggugaagggcagcucugcagcccggaauggucuacucaccaaccauuacguuugcgagguggaugggcagaaugucaucggacugaaagacaagaaaauuauggaaauccuugcuacagccggcaacgugguaacccugacuauuaucccuuccguuauauaugagcacauggugaagaaauugccacccguccuccugcaccauacaauggaucacucaauuccugacgcauga

SEQ ID NO: 62258 - RNA, 879 nt, Artificial Sequence
  derived and/or modified sequence opt3 from SDCBP__Homo_sapiens__NP_001007069
augagccuguaccccucccucgaggaccuuaaggcccagaccgcuuucucugcaaacccugccaauccagcgauccugucagaagcuagugccccgauuccccacgauggcaacuuguauccuagauuauacccagagcugagccaauauauggggcuaucccucaaugaagaggaaauaagggcaaacguggccgucguuucuggagcuccccugcagggucagcuuguggcacggccuucgucaaucaauuacaugguagccccagugacaggcaacgacgucgggauucgccgagcugagaucaaacagggcauucgugaggugauccugugcaaggaucaagacggaaaaauagguuugagacucaagagcaucgauaaugggauuuuuguucagcuggugcaggccaacagucccgcgucccuggucggacucagguucggcgaccagguguuacaaaucaauggcgaaaacugugcaggguggucuagcgauaaagcccauaagguacugaagcaggcuuuuggagagaaaauuacuaugacgauccgggaccgcccuuucgaaagaaccauaacaaugcacaaggauuccacuggucauguuggcuuuauuuucaaaaaugggaagaucaccucaauugugaaagacaguagcgccgcaaggaacggacuuuugacagagcacaauaucugcgagaucaacggccagaaugucauuggucugaaggauucucagauagcugacauccuauccaccucagggacuguggugacaauuaccaucaugccagccuuuauauucgaacauauuaucaagcggauggcgccgagcaucaugaaaagucucauggaucacacgauucccgaggucuga

SEQ ID NO: 62259 - RNA, 1308 nt, Artificial Sequence
  derived and/or modified sequence opt3 from SDCCAG3__Homo_sapiens__NP_001034796
augagcggcuaccagagaaggcccggggccaccccucugucccgggcucgcucucucgcaaucccagacgccccggcguucuaugagcgacguucaugccuuccccaacugaacugugaaagaccucacggaagggauuuggacaguccauuuuucgguauucggcccgcuuuuaugugcuacgugccuagcccagucuuagccuccguuggcgauacagacuucggguauggaaagggcaaauguucuaagcagucgcccucaggugcacaugggacucacuuuggagaugaccgcuucgaggaucuggaagaggccaauccuuuuagcuucagagaauuucuaaaaacgaagaaccucggccugaguaaagaggacccagcuuccaggauauacgcaaaggaggccucucggcauagccuuggccuggaucacaauuccccgcccucacagaccgggggauaugguuuggaauaccagcaaccuuucuuugaggacccaacaggcgcuggggaucuccuggacgaagaggaggaugaagacacuggauggaguggcgccuaucugcccagcgcgaucgagcagacccauccugaacgcgugccagcagguacaucucccugcuccaccuaccucucauucuuuagcacuccgagugaguuagccgggccugaaucucugcccuccugggcucuuagcgacacagauucgcgaguaucuccagccuccccugcaggaucacccagugcugacuucgccgugcacggcgagagcuugggcgauagacaccugaggacccuacagauuuccuacgacgcgcucaaggaugagaacucuaaacugcggcguaaacuuaaugaaguccagagcuucucagaggcccaaacggaaauggugcgcacucuggagagaaaguuggaagcaaagaugaucaaagaggagagugacuaucaugaucucgaauccguugugcagcaggucgagcagaaccuggaauuaaugaccaagagggcugugaaggccgagaaucacguaguuaaacugaagcaagaaauuagccuccuucaggcucaggugucuaacuuucaacgggagaaugaggcccugcgaugugggcagggagcaucauugacagucgugaaacagaacgccgacguggcucuacagaaucugcgcgucguuaugaacagugcgcaagcaagcaucaagcagcucguguccggugccgaaacucugaaucuuguagcugagauacugaaaucuaucgauagaauuucggaagugaaggacgaggaggaagauagcuga

SEQ ID NO: 62260 - RNA, 2142 nt, Artificial Sequence
  derived and/or modified sequence opt3 from SDCCAG8__Homo_sapiens__NP_006633
auggccaagagccccgagaacuccacccuggaagagauccucggccaguaccaaagaucucuuagggaacacgcuucacggaguauucaucagcugacaugcgcauugaaagagggggacgugacuauaggagaagaugccccuaaucuuagcuucuccacgucugucgguaacgaggacgcgcgcaccgcuuggccagagcugcagcagucgcacgccguuaaucaacuaaaggaucuccugcgacagcaggcagacaaagaaucagaggugagcccgagucguagaaggaagaugucccccuuacggucucuggaacaugaggagacaaacaugccuacuaugcacgauuugguacauaccaucaaugaccagagccaauauauucaccaccucgaagccgaggugaaauuuuguaaggaggagcuguccggcaugaagaacaaaauccaggucgugguucuggaaaaugaggggcuccagcagcaauuaaagucacagcgccaggaggaaacacugagagagcaaacccuuuuggaugcuaguggaaacaugcauaauagcuggauuacuacaggcgaagacucuggugugggggagaccuccaaaaggccauucucacacgauaacgcagacuuuggaaaggccgcuagcgccggcgaacagcuggagcuagagaaacucaagcugacguacgaagagaagugcgaaaucgaggaaagucagcuuaaauuccugcggaaugauuuggcggaguaucagcgcacuugugaggaccucaaggaacaacugaaacauaaggaguuuuuacuggcagccaauaccugcaaccgagucggcgggcucugucuuaaaugcgcucagcacgaagccgugcugucucagacacacacuaacguacauaugcagaccauagagagauugguuaaggagagggaugaccuaauguccgcacuggugagcguccggucgucucucgcugacacacaacagcgugaagccuccgcguacgaacaggugaaacaggugcugcaaaucucagaagaggccaauuucgaaaagaccaaggcacuuauucagugugaucagcugcgcaaagaguuggagagacaggcugaaaggcucgagaaggaacuggccagucaacaggagaaacgggcuaucgaaaaggacaugaugaaaaaggagauuacgaaggagcgagaauauaugggaagcaaaauguuaauccugucccagaacauagcccaacuagaggcacaggucgaaaagguuacuaaagagaagauuucugccaucaaccagcucgaagagauucagagccaacuggcuucacgcgagauggaugugacaaaaguaugcggugaaaugagauaccagcuuaauaagaccaacauggagaaggacgaagcggagaaagagcacagggaauuucgggcaaagacuaaucgcgauuuggagaucaaagaccaggaaaucgagaagcugagaauugaacucgaugagaguaaacagcaucuggagcaagaacagcagaaggccgcucuugccagggaggaaugucugcguuugacagagcuccugggcgaauccgagcaccaguuacaucugacccggcaagagaaggacagcauacagcagucuuucucaaaagaagcaaaggcccaagcucuacaggcccagcagcgagagcaagaacucacgcagaaaauccagcagauggaggcacaacacgauaagaccgaaaacgagcaguaucugcuuuugacaagucagaauacuuuucugaccaaacucaaggaggaaugcuguacacuggcgaaaaaguuagagcagauuagccaaaagacuagauccgaaaucgcucagcugucucaggagaaaagguacaccuacgacaaacuugggaaguugcagcgccggaacgaggaacucgaggaacaaugcgugcagcacggaagaguccaugagacaaugaagcagaggcugcgccaacuagauaaacacucgcaggccaccgcacagcagcuggugcaacuccugagcaagcagaaucagcuuuugcuggaacgacaguccuuaucagaggagguugaccggcuccguacucaacugcccaguaugccucagucugacugcuga

SEQ ID NO: 62261 - RNA, 636 nt, Artificial Sequence
  derived and/or modified sequence opt3 from SDF2__Homo_sapiens__NP_008854
auggccguggucccccugcuccuucugggcggguuguggagcgcuguuggagcauccucuuuaggugugguaaccugcggcucaguggucaagcugcuaaacacaagacacaaugugaggcuccauagucacgacguucgguacgggagcggauccggccagcaaucugugacuggugucacgucgguggaugacucaaacagcuauuggcgcauccgagggaaaagugccaccguaugugagcguggaacaccuauuaagugcggccagccaauaagacugacucauguuaauaccggcaggaaccuucacucccaucacuucacaucuccgcugagcgggaaucaggaaguguccgcguuuggagaggaaggugagggcgauuacuuggacgauuggaccguccucuguaacgggcccuauugggugcgggacggagaagugcgcuucaaacacucaaguacugagguccugcugagcguuacaggcgagcaguacgguagaccuaucucugggcaaaaggaagugcauggaauggcucagccaucccagaauaacuauuggaaagccauggagggcauuuuuaugaagcccucagaacucuuaaaggcagaggcccaccaugcugagcuguga

SEQ ID NO: 62262 - RNA, 666 nt, Artificial Sequence
  derived and/or modified sequence opt3 from SDF2L1__Homo_sapiens__NP_071327
auguggagcgccggcagagggggagcugcauggcccgugcugcucggucuucuguuggccuuacuggucccuggcgggggagcggcuaagaccggcgccgagcuaguuacaugcgguuccgugcucaaacugcuuaacacucaccauaggguacggcugcacucucaugacaucaaguacgggucaggaaguggccagcaaagcgugacgggcgucgaagcauccgaugacgccaauucuuauuggcgcauucgagggggaucggaggguggcuguccacgugggucaccggugagaugcggacaggcuguuagguugacccacgugcucacaggcaaaaaccugcauacucaccacuuccccagcccucugaguaauaaccaggaagucuccgcauuuggugaggauggggaaggagacgaucucgacuuauggaccgugcgguguucuggccagcauugggagcgcgaggccgcuguaagauuccaacacguuggcacaagcguguuucuguccgucaccggggaacaguacggaucaccaauaaggggucagcaugaggugcacggcaugcccagugccaauacucacaacacauggaaggcgauggaagggaucuucauuaaaccuagcguggagccaucugcaggacaugaugagcuuuga

SEQ ID NO: 62263 - RNA, 609 nt, Artificial Sequence
  derived and/or modified sequence opt3 from SDF4__Homo_sapiens__XP_011539858
augguguggcccugggucgccauggcuagcagauggggcccucugaucgggcucgcaccaugcugucuuuggcuguugggagccguuuuacugauggacgcguccgcuaggccggccaaccacucuucaacccgggagcgcguggcaaaucgagaagagaacgaaauucuacccccugaucaucucaaugguguaaagcuggagauggacggccaccuuaaccguggguuccaucaggaaguguuucugggaaaagauuugggcgguuucgacgaggaugccgagccaagaaggagucggcgcaagcucauggucauauuuagcaaaguggacguuaauacagauagaaagaucuccgcuaaagaaaugcaaagguggauuauggagaagacugcagaacacuuccaggaggccauggaggaaucuaagacgcauuuucgggcuguggaccccgauggggacggacacgucucgugggaugaguacaaagugaaguuccuggccucaaaaggccacagcgaaaaggagguagcggacgcaauccgccugaacgaggaacucaaaguugaugaggaacgacauggcccuccagggcccagagccuuauga

SEQ ID NO: 62264 - RNA, 348 nt, Artificial Sequence
  derived and/or modified sequence opt3 from SDHAF1__Homo_sapiens__NP_001036096
augagcagacacuccaggcugcagcggcaagugcucucucuuuaccgcgaccuguugcgagccggccgugggaagcccggagcugaggcaagagucagggccgaguuccggcagcaugcggguuuaccucgcucagauguucugagaaucgaauaucuauacaggcggggccgccgacagcuccagcugcuuagaagugggcacgcuaccgccaugggagcauuugugaggccacgggccccgacaggcgaacccggugggguaggaagccaaccugacgauggcgacuccccacguaacccccaugauucuacuggcgcuccugagacgcgcccagacgggagauga

SEQ ID NO: 62265 - RNA, 501 nt, Artificial Sequence
  derived and/or modified sequence opt3 from SDHAF2__Homo_sapiens__NP_060311
auggccgugagcaccgucuucuccacaucuucacugaugcucgcucuuaguagacacagccuguugucccccuuacugucuguuacuucguuuaggcgguucuaccgcggcgacucaccuacggauagccagaaggacaugaucgagauuccacuaccgcccuggcaagaacgaaccgaugagaguauagaaacaaaacgugcaagacuccuguaugaguccaggaagcgggggaugcuugaaaacugcauccuguugucucucuuugccaaagagcaucugcagcacaugacugagaagcagcugaaucucuacgaccgcuuaauuaacgaaccuagcaaugauugggacaucuauuacugggcgaccgaggcuaaaccagcccccgaaauuuucgagaacgaggugauggcacugcuuagagauuuugccaagaauaagaacaaagaacagagguugcgggcuccugaccuggaguaucuauucgaaaagccacgcuga

SEQ ID NO: 62266 - RNA, 327 nt, Artificial Sequence
  derived and/or modified sequence opt3 from SDHAF4__Homo_sapiens__NP_660310
augacccccagcagacugccuuggcuccuuuccugggugucugccacagcuuggagggcagcccggucaccacuguugugccacaguuuacgcaagacuagcuccucucagggcgggaaaucggagcuggucaagcaaucacucaaaaagccgaaacuacccgaaggacgauucgacgcgccugaggauagccaucuggaaaaggagccacuugaaaaguuucccgacgauguuaacccugugacgaaagagaaggguggcccacgugggcccgagccuaccagauacggagacugggaaaggaaaggccgguguaucgauuucuga

SEQ ID NO: 62267 - RNA, 1851 nt, Artificial Sequence
  derived and/or modified sequence opt3 from SDHA__Homo_sapiens__NP_001281261
augagcggcgucagagggcuguccaggcuccuuucugcccggcgccuggcuuuggcaaaggccuggcccaccgucuuacagacaggaacucgagguuuccacuuuacgguugacggcaacaaacgugcgucagcuaaggugagugauagcaucuccgcccaauacccuguaguggaccaugaguucgaugcagucgugguuggggccggaggcgcuggucugagagcagccuuugggcuaucugaagcuggauucaauaccgccugcgugacaaaacucuuuccaacuaggucgcacaccgucgcggcacagcuggagaacuauggcaugccguucucacggacagaagacggcaagauuuaccagcgcgccuuugggggacagagccuuaaauucgguaagggcgggcaagcucauagauguugcuguguggccgauaggaccggacacagucuguugcauacucucuauggccggucccugcgcuacgacacaucuuauuuuguagaguacuucgcacuggaucucuuaauggaaaauggugagugccgagggguuauagcucuguguaucgaggacggaagcauucacagaaucagggccaagaacaccguggucgcgacgggcggcuaugggcggacuuacuuuuccugcaccucagcccacacaaguacuggagaugguaccgcaaugauuacacgugcuggccuucccugucaggacuuggaguucgugcaguuucauccuaccgggaucuacggagccggcugccugauaacggaagguugucgcggggaaggcggaauccuaauuaauagccagggcgagagauucauggagagguaugcuccaguggccaaagaucucgcaucucgggacgucguuucccgaucaaugacucuggaaauccgcgaggggagaggaugcggucccgaaaaggaucacguguaccuucaacugcaucacuugccuccagagcagcucgccacaaggcugcccggcauuagcgaaaccgcuaugaucuucgcggggguagacgugacuaaagagccuauaccagucuuaccgacagugcacuauaacaugggaggcauucccaccaauuacaagggucagguucugcggcaugugaacgggcaggaccaaaucgucccuggccucuaugcauguggagaggccgcuugcgccagugugcacggcgcaaaucgccuuggggccaacucucuguuggaucuaguaguuuuugguagagcuugcgcccuguccauugaagagagcuguaggccaggagacaaagugcccccuaucaagccaaaugcaggcgaagagucggucaugaaccucgauaagcugcguuucgcggacgggucuauccggacguccgaacuucgacugucaaugcagaaaaguaugcagaaucaugcugccguguuuagagucggaagcguguugcaagagggcugcgguaagauuuccaaacucuacggggaucugaagcacuuaaaaaccuucgacaggggcaugguuuggaacacagaucugguggagacucuagaacuccagaaucugaugcuuugugcauugcagaccauauauggagccgaggcucgcaaggaaucucggggcgcccaugcaagagaggacuacaaaguaaggaucgaugaauacgacuauagcaagcccauucaggggcaacagaagaaaccguuugaggagcacuggcgcaagcacacacugucauacgucgaugugggaacuggcaaaguuacccucgaauaucgaccugugaucgacaagacacugaacgaggcugacugcgccaccgugcccccagcgauacggaguuacuga

SEQ ID NO: 62268 - RNA, 453 nt, Artificial Sequence
  derived and/or modified sequence opt3 from SDHC__Homo_sapiens__NP_001030588
auggccgcucugcuccuuagacacgugggcaggcauugccugcgggcacacuucagcccccaguuguguauccgcaacgccgucccuuuagggaccacagcgaaggaggaaauggagcgauuuuggaauaaaaacauuggauccaaucguccacugucuccgcauauaacuaucuacucauggagucuacccauggcuaugagcauuugccacagagguacgggcaucgcccucuccgcagacguugggccuaggaagcggccagaagauucucccgccauuccuguguggucgggauguccaggcucauauugcguagugcuguacggugcugggagccaugucaaaaagggaggcagucaacaccaccuucccacccauuauuacauccacccuuccuucugucugagcuuuuugucuccagcaugggagaaauucucccucuuuguguga

SEQ ID NO: 62269 - RNA, 480 nt, Artificial Sequence
  derived and/or modified sequence opt3 from SDHD__Homo_sapiens__NP_002993
auggccgugcuguggagacucagcgcugucugcggcgcacuugggggaagggcccuguuguuacggacccccguugugcgcccugcgcacaucuccgcuuuccugcaggaccgaccaauuccggaguggugugguguacaacauauacaccuaucucccucacaucacaguggcagcaaggccgcaucccuccauuggacaucugaacguguggucucggugcugcuucugggguugcucccugccgcuuaccugaacccaugcucagcaauggauuauagccuggccgcugcccucacuuuacacggacacuggggccugggucagguugugacggacuacguccauggggaugcgcuucagaaagcagccaaggcuggauugcuggcccuaagugcacucaccuuugcuggccuguguuauuucaauuaccacgacgugggcaucugcaaagccguagcgaugcuuuggaagcuguga

SEQ ID NO: 62270 - RNA, 6642 nt, Artificial Sequence
  derived and/or modified sequence opt3 from SDK1__Homo_sapiens__NP_689957
auggccagaggcgcuaggcccagcgcagccgggggugggggcgggggagcggagccuccagaacgggcuggcccgggucgcccccgaggguccccuccaggacgugccagacccucucuggcaccuaggccaggccccgaaccuucacggccacgcgccgcuccggaaaccaguggcggggacaccgcaggagccgguagaugcggcgggaggcgggcugccaagcucggacccggccgccgagguuggugggcgcuucuggcauugcaguuacaucugcuaagagcccucgcucaggaugacguggccccuuacuucaagacugagccagggcugccccagauccaccuugaaggaaacaggcuggucuugacgugucucgcagagggcagcuggccucuggaguuuaaguggaugcgggaugacuccgaacugaccacauauucuucggaguacaaguauauuauaccaucacuccagaaguuagaugcuggcuucuaccguugcguugugcgcaacagaaugggggcccugcuucagaggaaaagcgaaguacaaguggcguauaugggaaguuuuauggacacugaucagcggaagaccgucucccagggucgagccgcaaucuugaaccugcuacccauuacaucuuacccgcgcccucaggugaccugguucagagagggccacaagaucauucccagcaauaggaucgcuauaacucucgagaaccaacugguuauccuugccacaaccacguccgacgcuggggccuauuacgugcaggcagucaaugagaaaaacggagagaauaagacuucaccauuuauucaucugaguaucgcccgggaugugggcaccccugaaacaauggcucccacuauuguaguuccacccgguaaccgcagcguggucgcggggucuuccgagaccacauuggaauguaucgcaucagccagaccuguggaggaccucagcgugaccuggaaaaggaauggcguccguauaacgaguggacugcacucuuucggccggcgauuaacuauuuccaacccaacaagcgcugauaccgggccguacguuugcgaggccgcacugcccggaucggccuuugaaccugcuagagccacugcauuccucuuuaucauugagccacccuauuucacagcggaaccugagucuaggaucuccgcugaaguggaggagaccguagacaucgguugucaggccaugggcgugccacuucccacgcugcagugguacaaggaugcaauuucaauaagucgcuugcaaaauccgcgguauaaaguccuagccagcgggggacugagaauccagaagcucaggccugaagacuccggcauuuuucagugcuucgcuucuaacgaggguggggaaauccaaacccacacauaccuggacgugacuaauauagccccaguuuuuacccagcgccccguggauacaacugucaccgacggcaugacagcaauucuucgaugugaggugagcggagcuccuaagcccgccaucaccuggaaacgggaaaaccacauccuggcgucaggcaguguacguauuccaagauucauguugcucgaguccgggggacugcagaucgccccuguuuucauucaggaugcugguaauuauacuugcuacgcagccaacacggagggcagcuuaaacgcuucugccacacugaccguguggaauaggacuucaauaguccaucccccagaagaccauguggucaucaaggggaccacagcaacccuacacuguggagcgacucaugauccgcgcgugagucuccgguauguuuggaaaaaggacaacguggcccugacaccuagcuccacgucuagaauuguagucgagaaagauggcucgcuuuugaucagccaaaccugguccggugacaucggggauuacucaugcgaaauugugagugagggcggaaaugacucuaggauggcucgacuggagguuauagaacucccccacagcccacagaaccugcuugugucccccaauucaagccacucucaugccgucgugcuguccuggguacgcccuuuugauggcaacaguccaaucuuguacuauauuguggagcucagcgaaaauaacucucccuggaagguucaccuguccaaugucgggccugagaugacuggagugacagugucaggcuuaaccccggcacggacauaccaguucagagucugugcuguuaacgaaguggguagggggcaguauagugccgagacuagccgucugaugcuaccagaggaacccccuucggcaccacccaaaaauaucguggccuccggacgcaccaaccaaucuauuaugguacaguggcagccuccgcccgagacggaacauaauggcguccuccgggguuacauccugagauauaggcuugcuggcuugccaggggaguaccagcaacgaaacauaaccagcccugaagugaauuauugccugguuacagaccucaucauuuggacucaguacgagauccagguggcggccuacaacggagcaggccugggggucuuuucacgggcugugaccgaguauacauuacagggaguucccacugccccaccucaaaacgugcagaccgaagccguaaauaguacgacaauucaguuccuguggaaucccccaccgcaacaguuuaucaauggcauaaaccaggguuacaaacuuuuggcuuggccugcagacgcccccgaggcggucaccguggugacuauugcuccagauuuccacgggguccaucacggacacaucacaaaucucaagaaauuuaccgccuauuucacuuccguucugugcuuuaccacacccggcgacgguccuccaucuacgccccagcuaguguggacccaagaagauaagccuggcgcaguagggcaucugagcuucacugagauucucgacacaucccugaaagugucauggcaggaaccgcuugagaagaacggaaucauaaccggcuaccagaucagcugggaggucuaugggcgcaaugauaguagauugacacacacucugaacucuaccacgcaugaauacaaaauucagggauuauccagccucacaaccuauacuaucgacguggccgcuguuaccgcagugggcacaggucuggucacuucgucaaccauuucuaguggggugccacccgaucuuccuggagcccccuccaaucugguuaucagcaacauaucuccaaggagcgcgacauugcaauuucggccuggcuacgacgguaagacguccauuucacgauggaucguggagggccaggucggggcuaucggagaugaagaggaguggguaacccucuacgaagaggaaaaugagcccgacgcccagaugcuggaaauuccaaaccuaacuccuuauacacacuacagauuccgcaugaaacaggugaauaucguuggcccgagucccuauagcccaucuuccagggugauucaaacccugcaggcaccucccgaugucgccccaacuucagugacaguacguaccgcuagugagacgagccuccggcugagaugggugccucuucccgacucccaguacaacgggaauccggagucugucggauauaggauaaaauacuggcgcucggauuugcaaagcucagccguugcacaggugguguccgaccgacuggaaagagaguuuacuaucgaagaguuagaagaguggauggaguaugaacuccagaugcaggcuuucaacgccgucggcgcggguccauggagugaggugguucgggggaggacccgcgaaucuguaccuagcgccgcacccgagaacguguccgcugaagccgucucaucuacacaaauucugcuuaccuggacuagcgugccagagcaggaccagaauggacugauccuaggcuacaagauucucuuccgugcuaaagaucuggaccccgagccuagaagucacaucguucggggcaaccauacacaguccgcauugcuggccggguuaaggaaguuugugcucuacgaacugcaaguccuugccuucacccgcauaggaaauggugugccgagcacaccccugaucuuggagcgaacuaaagaugacgcuccaggcccucccguaagacucgucuuuccugaagugcggcugaccucuguuaggauuguguggcagccacccgaggagccuaacgggaucauucuaggauaucagaucgcguaccgccuggcaucauccaguccacacacguucacaaccgucgaagugggcgccacuguuagacaguuuaccgcuacagaucuugcccccgagagcgcauauauauucaggcucucggccaagacucggcaagguuggggagaaccgcuggaggcuaccgugauuacgacagaaaagcgugagcgcccugcgccaccccgagaguugcuggucccucaggccgaagugaccgcaagaucuuuaaggcuccaguggguaccaggauccgacggcgcuagccccauccgguacuuuacuaugcaagugcgcgagcugccgagaggcgaauggcaaacauauucaaguucuaucucccaugaggccaccgcauguguugucgauaggcuucggccuuucacuagcuacaaacugcgauugaaggccacaaaugacauuggggauucagacuuuaguagcgaaaccgaggcugugacgacucuccaggaugugcccggagagccaccugguuccgucucugccacaccccacacaaccagcuccguacugauacaguggcaaccacccagagacgaaucacuaaacggccugcuucagggguaucgcaucuacuacagggagcucgaauaugaggcgggaucuggcacagaagcaaaaacucugaagaauccuauugccuugcaugcugaguuaaccgcccagaguucguucaaaacggugaacagcuccucuacaucaacuaugugcgagcugacccaccucaagaaguaccggcguuaugaaguuaucaugacagcuuacaauauuaucggugagagcccagcauccgccccgguggaagucuuugugggggaggcugcccccgcaauggcgccucagaacguucaagugaccccacugacugccagucagcuugaggucaccugggaucccccuccacccgaaucucagaauggaaacauacagggcuauaaaaucuacuauugggaggcugacagccaaaaugaaacagagaagaugaaagugcuguucuugccugaaccgguagugagacuaaagaaccugacgucacacacuaaauaccucguuuccauuagugccuuuaaugcagcuggcgacgggccaaagagcgauccccagcagggaaggacccaucaggccgcaccuggugcccccucuuuccuggcuuucuccgagaucacaucaaccacucuuaacgucagcuggggcgagccagcggccgcaaacgggauuuuacaaggauaccgcgugguguaugaaccucuggcucccguccagggcguuucgaaagugguaacaguggagguccgggguaauuggcagcgauggcucaaggugagagacuugaccaaggggguuacguacuuuuucagggugcaagcccgcacuaucacauauggaccagaacugcaggccaacauaaccgcaggcccggcugagggcucuccugggaguccccgggauguccucguaaccaaauccgccagcgaacugacucuucaguggacagagggacacucaggugacaccccaacaacuggcuacgugauugaggcgagacccuccgaugaagggcugugggacauguuuguuaaggauaucccucguucugcuacgagcuauaccuugagucuagacaaacugaggcagggagugacauacgaguuccgggucguggccgucaaugaagcaggcuauggugagccauccaaccccagcacugccgugucugcucaaguugaagcaccuuuuuacgaggaguggugguuccucuuagugauggcccugucaagucuuaucguaauucugcucguggucuuugcguugguucugcaugggcagaauaagaaauacaagaacuguuccaccggaaagggcaucagcacaauggaagagucugugacccucgauaauggcggguucgcugcccuggaacuuucgucacgccaccuaaacgucaaaagcacuuuuuccaagaaaaauggaacgcgaaguccgccaagacccucuccugguggccugcauuauagcgacgaggauauaugcaacaaguacaauggggcaguguugaccgaguccguaucauuaaaagaaaagagugccgacgcuucugagagcgaagccacagacuccgauuaugaggacgcacugccaaagcacucauucgugaaccacuacaugagcgaucccacuuauuacaauucuuggaaaaggcgggcucagggacgcgccccugcgccccauagauaugaagccguugcaggcuccgaggcuggugcccagcuccacccagugauuaccacacaaagugcagggggcgucuacaccccggcuggaccuggcgccaggacuccccugacaggguuuagcucguucguguga

SEQ ID NO: 62271 - RNA, 6519 nt, Artificial Sequence
  derived and/or modified sequence opt3 from SDK2__Homo_sapiens__NP_001138424
auguggggccugcucaucuggacccuucuggccuugcaccagauuagagcugcaagggcccaagacgaugugagccccuacuucaagacagagccuguccggacucagguucauuuagaagggaaccgccuggugcuaacgugcauggcggagggauccuggccacucgaauuuaaauggcugcacaauaaccgagagcuuaccaaguucucucuggaauaucguuacaugauaacaucauuggacagaacucaugcugguuuuuauagguguaucguacggaaucgcaugggcgcccuccugcagagacagaccgaggugcaagucgcauacauggggaguuucgaggaaggagagaaacaccagagcgugucccauggcgaagccgcuguuauuagggcaccgcggaucgccucuuuuccccagccucaggugacaugguuccgcgauggucgaaagauuccacccucgucaagaaucgcuauaacccuggagaacacucucgucaucuuaagcacaguggccccugacgcggggagguauuacguacaagcaguuaaugauaaaaacggagacaauaagaccagucagccaauuacgcugacuguggagaacgucggcggccccgccgauccuaucgcuccaaccauuaucauaccgcccaagaauacauccgugguggccgggacuucugaagucacccuugagugcguugcaaacgcucggccuuugauuaaacugcacaucauuuggaagaaagacggagugcuacucagcgguggcaucuccgaucacaaucgucgccugacaaucccaaaccccaccgggucagacgccggauauuacgaaugugaggcgguacuuagaaguagcucugugccuuccgucgugaggggcgccuaccugucaguuuuggaaccaccccaguuugugaaggagccggagcggcauauuacggcagaaauggagaaagucguggauauaccuugccaggcuaaggguguacccccaccuagcaucacuugguauaaggacgccgcuguuguggaagucgagaaacucacacgauuccgccaaagaaaugaugggggacugcagauuaguggcuuagugcccgacgacaccggcauguuucaguguuucgccaggaacgcagccggggaaguccaaacuucuacauaccuggcugugaccuccaucgcgccaaauauaacgcggggaccccucgauagcaccguuauugacgguaugucggugguacuugcaugcgagacaucuggcgccccucgcccagcuaucacuuggcagaagggggagagaauccuggccuccggaucaguccaguugccgagguuuaccccccuagaaaguggcagccugcucauuuccccuacacacaucucugaugcagguacuuauaccugucuggccacaaacagccgugggguggacgaggcuucagccgaucuuguugugugggcacggacccgaauuacuaaaccaccccaggaccaaagugucauaaagggcacgcaggcguccauggugugcggaguaacacaugauccuagagugaccaucagguacauuugggaaaaagacggcgcuacucuggggaccgagagccacccacgcauccgguuggauagaaacggaucucuccacaucucacagacauggaguggugacauuggcaccuauacuuguaggguuauaagcgccgggggaaaugauucccgcucugcacaucugcgaguccggcaguuaccccacgccccggaacauccuguggcuacacugucgacgguggagcguagagccaucaaccuaaccuggacuaagccauucgacggcaauagcccccucauuagguacauccuggagauguccgaaaacaaugcaccuuggacaguccuuuuggcuucaguugaccccaaagccaccagugugacagugaagggucugguaccagcgcgcucuuaucaauuucggcucugcgccgucaacgauguggggaagggccaguucagcaaagacacugagagaguuucccugccugaagagcccccaaccgcuccgccucagaaugugauugcaucaggaaggacgaaccagagcaucaugauacaauggcagcccccacccgagucucaccagaauggcauccuuaagggguacauuauccgauacugucuggccggauugccugucgguuaucaguucaaaaacauuaccgaugcugacgugaauaaccuccuguuagaagaucugaucauauggacaaauuacgagauugaaguugccgcauauaacuccgcgggccuagggguguacaguagcaagguaacugaguggacccuccaaggagucccaacagugcccccuggcaaugugcaugccgaagcuacuaacucuaccacgauccgcuuuacauggaacgccccguccccacaguucauuaaugguaucaaccagggguauaaacugauagcaugggagcccgagcaagaagaggaagucaccaugguuacugcucggccuaauuuucaggacucaauccacgugggcuucguaaguggacuuaagaaguuuacagaguacuucaccagcguguugugcuuuacuaccccaggcgaugggcccagaucgacaccucagcuggucaggacgcacgaagacgugccgggacccguuggccaucucuccuucucugagauucuggauaccagcuuaaaagugucauggcaggagccaggugaaaagaacgggauccugacuggauaucguauuaguugggaggaauacaaucgcacaaacacccgggucacacacuaccuuccuaaugugacuuuggaguauagaguuaccggccucacggcccugacaaccuacacuaucgaaguggcagccaugaccuccaaaggucaaggccaggucucugcuagcacaauauccucagggguacccccagagcuaccuggacccccaacuaaccugggcauuagcaauaucgggccgaggagugugacccuccaguuucgaccuggauaugacggcaagacaucuaucucccgguggcugguugaggcgcaggugggugucgugggggaaggagaggaauggcuuuugauucaucaacugagcaacgagcccgaugcccgcucgauggagguaccagacuuaaaucccuucacgugcuacucauuuagaaugaggcaggugaacaucgucggcaccucuccuccaagucagcccucccggaaaauucagacucuccaagcaccuccggauauggcuccagccaauguuagccugcgaacagccucugaaaccagccuuuggcugagauggaugcccuugccugagauggaauauaacgguaaucccgaguccgugggcuacaagauaaaguauucacgcagugacgggcacggaaaaacucucagccacgugguccaggacaggguggaacgugauuacacaaucgaggaccuggaggaauggaccgaguaccggguucagguacaagcuuucaacgcaauuggcucugggccauggucccagacgguggucggaagaacuagggaaucagugccuaguagcggccccaccaacguuuccgcccuagcgacaaccucuucgagcaugcuggugcgcuggucagaggucccagaagcugaucgaaauggucucgugcugggguauaagguaauguacaaagagaaggacuccgauacucagccuagauuuuggcuugucgagggaaacaguucucggagcgcccaguugacaggccuggguaaauauguguuauacgaaguucaagugcucgcauucaccaggaucggcgacggguccccgucacaucccccaauucuggagcgcacacuugaugacgucccuggacccccaaugggcauccuguucccugaagugcguacuaccucuguuagacuaauauggcagcccccggccgcuccaaaugggaucauucucgcauaucagaucacgcaccggcugaacacaaccacugccaauaccgcgacaguggaggucuuggcuccuagcgccaggcaguacacugcaaccggacugaagcccgaaaguguguauuuauuucgcauuacggcccaaacacgaaagggcuggggugaggcugccgaggcacucguagugaccacugaaaaaagagaucggccacagcccccuuccaggccgaugguucagcaggaggacguccgcgcuagaagcgugcugcuuucuugggaacccgggucagauggacuguccccagugagguacuacacaauccaaacccgggaguugccuaguggccguugggcccuccauagcgcgucggucucucacaacgccuccagcuucauaguagaccgccugaagcccuuuacuucauauaaauuccgagugaaggcaacaaaugauauuggcgacagugaguuuucugaagaguccgaaagccuaaccacgcugcaggcugccccugacgaggcuccaacuauccuuucaguuaccccccauacaaccacaagugugcucaucagauggcagccuccagcagaagauaaaauuaacgggauacuguugggauucaggauccgguaccgcgagcuguuauaugagggucucagaggcuuuacucugagggggauuaauaaccccggagccaccugggccgaacuuacgagcauguacuccaugcggaaucugucucgaccgagcuugacacaguaugagcucgacaaccugaauaagcacagacgcuacgaaaucaggauguccgucuauaacgcugugggcgaggguccuucaucuccaccccaagaaguuuucgugggggaggcggucccuacugcagccccacggaaugugguagugcacggagcuaccgccacacagcuagauguuaccugggagcccccgccucuggacagucagaacggcgauauucaaggcuacaaaaucuacuuuugggaagcacagcgugggaaccuuacugagagagucaagacccucuuccuggccgaaaauucggugaaguugaaaaacuuaacaggauauacggcuuacauggugagcgucgcggccuuuaaugcagcuggugacggccccagguccacuccaacccaggggcagacacaacaggccgcaccuucugcccccucaagcguuaaguucuccgagcugaccacuacaagugugaacguaucuugggaagcuccacaguuucccaauggaauacucgagggcuaucgccugguguacgagccuuguagcccagucgauggugugucaaaaaucguuaccguggacgucaaggggaacuccccgcuuuggcugaaaguaaaggauuuggccgaaggagugacguaucgguuccgaauuagagcgaagacuuucacauacggccccgagaucgaagcaaauguuaccaccggcccuggggagggagccccaggucccccuggcgugccaauuaucgucagguauaguagcgcuauagccauucauuggucuuccggggaccccggaaaaggcccuaucacucgcuacgugaucgaggcucggccgucagaugaaggucuaugggacauucugaucaaggacauaccaaaagaggucagcucguacacauuuucuauggauauucucaagcccggggugaguuaugacuucagaguuaucgcagugaacgauuacggauuuggcaccccuuccagccccucacaguccguaccagcccaaaaagcuaauccuuucuaugaagaguggugguuucugguggucauugcccuuguuggcuuaaucuucauacugcucuugguguuuguccugauuauccgugggcagucuaagaaguacgcaaaaaagacagacagcggaaacagugcgaaauccggugcccucggccacagcgaaaugaugucucuggaugagucaaguuuccccgcucuugagcugaauaacaggcgguuguccgugaagaauagcuuuugccgcaaaaacgggcuauauacucgaucuccaccgagaccuucgcccggaucacugcauuacagcgacgaagauguaacgaaguauaaugaccucaucccagccgaguccaguucuuuaaccgaaaagcccagcgagauuuccgauucacagggcagugacucugaauacgagguggauagcaaccaccagaaagcacauuccuucguuaaucacuacaucucagacccuacauauuacaacagcuggaggcggcaacagaaggguauuucucgcgcucaggccuauuccuacacugagagugauagcggggaaccagaccacaccacagugaccaacucgacuuccacgcaacagggaucucuguuuagacccaaagcaucaaggaccccuacaccgcagaauccacccaacccuccaagccagcaaaguacucuuuaucgacccccuuccucucuggcccccggcagccgggcuccaauagcgggcuucucauccuucgucuga

SEQ ID NO: 62272 - RNA, 1278 nt, Artificial Sequence
  derived and/or modified sequence opt3 from SDPR__Homo_sapiens__NP_004648
augggcgaggacgccgcucaggcagaaaaguuccaacaccccgggagcgauaugagacaggagaaaccuuccucuccaucaccgaugcccaguagcaccccuuccccaucucugaaccucggaaauacagaagaggccaucagggacaacucacaggugaaugcggucacuguucuuacgcuguuggauaaguuagugaacaugcuggacgcuguacaggaaaaucaacauaaaauggagcagcggcagauuucgcuagaggguagcgugaagggcauacagaacgaucucaccaaacugaguaaguaccaagccuccacaucuaauacugucagcaaacuucuggaaaaaucccgcaaggugucagcacacacccgagccguuaaagagcguauggacagacagugcgcucaggugaagagguuggaaaacaaucaugcacagcuccugcggcgcaaccacuuuaaaguccugaucuuccaagaggagaaugaaauucccgccaguguguuuguaaagcagccuguuagcggggcuguggagggaaaggaagaacucccagaugaaaacaaaucuuuagaggagacacugcauaccgucgaccuuuccucagaugacgauuugccccacgacgaagaggcccuggaagauagcgcggaggaaaagguggaggagaguagagcagagaaaaucaagaggucuucccuaaagaagguggacagccucaaaaaggccuucucgcggcagaauauugagaagaaaaugaacaagcugggcacuaaaaucgucucuguugaacgccgagagaagaucaaaaagucccuuacaucaaaucaccaaaagauaaguagcgguaaauccucuccuuuuaaggugagcccacugaccuucgggaggaaaaagguaagagaaggagagucacaugcugagaacgaaacgaaaagugaggacuugccguccagcgaacagaugcccaacgaucaggaggaggaaucuuuugccgagggccacucagaagcaagucucgcuagcgcccugguggagggcgaaauugcggaggaggccgcagaaaaggcuacuucccgggggucuaauucgggaauggacagcaacaucgauuuaaccauugucgaggacgaagaggaagaguccguggcccuggagcaggcucaaaagguucguuaugaagguucauacgcccucacaagugaggaagcagagcgcucugauggcgacccugugcagccagccguccuucaggugcaucagacuagcuga

SEQ ID NO: 62273 - RNA, 1182 nt, Artificial Sequence
  derived and/or modified sequence opt3 from SDR42E1__Homo_sapiens__XP_011521772
auggaccccaagagaagccagaaagaguccgugcugaucaccggcgggucuggauacuucgguuuuaggcucggcugcgcccuuaaccaaaaugggguccacguuauucuguucgauauaucaaguccugcucagacaaucccagaaggaauuaaguuuauccagggcgacauucggcauuugagcgauguggagaaagcauuccaggacgccgauguaacuuguguguuucacaucgcguccuaugguaugucugggcgcgaacaauuaaaccgaaaucugauaaaggaggucaacgugcguggaacggacaauauccuacagguuugccagagaaggcgggugccgcgccucgucuacaccucgacauucaacgugauuuuuggcggccagguaaucagaaauggggaugaaucacugcccuaucuuccucugcauuugcacccagaccauuacagcaggacuaaaaguauugcugagcaaaagguucucgaggccaacgcaacaccccuggaucggggagacggugugcugcgcaccugugcccuccgaccugcuggcaucuaugggccaggagaacagagacacuuacccaggauagucuccuacauugagaagggccuguucaaauuuguguauggugauccucggucucuuguggaguucguccacguugacaauuuggugcaggcacauauccuggccagcgaagcucuacgugccgauaaggggcacauugcguccggacagccauacuuuaucucagacggccgcccgguaaacaauuucgaguuuuucagaccccucguggaaggccugggguacaccuucccuaguacuaggcuuccacugacauuggucuauugcuuugcauuccucaccgagauggugcauuuuauccugggacgguuauacaacuuccaacccuuucugacgcgaacugaaguuuauaaaaccggugugacacacuacuucagccucgagaaggccaaaaaggaacuuggcuauaaggcucagccuuuugaccugcaggaggccgucgagugguucaaagcacacgggcauggaagaucuuccggcucacgcgauagcgaauguuuugugugggacgguuugcuaguauuccugcucauuauagcuguucugauguggcuuccaaguucugugauccuguccuuguga

SEQ ID NO: 62274 - RNA, 942 nt, Artificial Sequence
  derived and/or modified sequence opt3 from SDR9C7__Homo_sapiens__NP_683695
auggccgcucugaccgaccucagcuucauguacagaugguuuaagaacugcaaucuugugggcaaccuguccgagaaauaugucuucaucacagggugugauucuggauuugguaauuuguuagcaaagcagcugguugacaggggcaugcaagugcuagccgcgugcuucacugaagaggggucacagaaacuccagcgggauacgaguuaccgccugcagaccacacuucuggacguaacuaagagcgaauccauuaaagcugccgcacaaugggugcgagauaaggucggagagcagggcuugugggcccucgugaacaaugcugguguugggcugcccucuggaccuaacgaauggcugaccaaggacgauuuugugaaagucauaaaugugaaccucguaggcuuaaucgagguuacacugcacaugcuuccaauggugaagcgugcaagaggcagggucgugaauaugucgucaagcgggggacggguggccgucauugguggcggguauuguguuaguaaauucggaguggaggcuuuuuccgacucuauccgcagagaauuguacuauuucggcguaaaggugugcauuaucgagccggguaacuacaggaccgccauacuggggaaagaaaaucuagagagccggaugcgcaagcucugggagcgacugccccaggaaacuagagauuccuauggagaggacuacuuuaggaucuacacagauaaacuuaagaacauuaugcaggucgcggaaccucgggugcgugacguuaucaauucaauggagcaugcaauugugagucgcagcccaagaaucagguauaaccccggccuggaugccaaguugcucuacauaccucuggcuaaauuaccaacccccgucacggacuucauucugucucgguaucucccucgaccagccgacuccguguga

SEQ ID NO: 62275 - RNA, 987 nt, Artificial Sequence
  derived and/or modified sequence opt3 from SDS__Homo_sapiens__NP_006834
augaugagcggcgagccccugcacgugaagaccccuaucagagacuccauggcccucucuaaaauggcugggacaucagucuaccuuaagauggauagugcacagccaagcggauccuucaaaauuagggguauaggccauuuuugcaagcggugggccaaacaagggugugcgcacuucguuuguucuucggcuggaaacgccggcauggcagccgcuuaugcagcccgccagcugggugugccggcuacuaucguagugcccucaacgaccccugccuugacaauugaacgauuaaagaaugagggggcgacugucaaggugguuggagaacugcuagacgaggcauuugaacucgccaaagcucuggccaagaacaauccaggcuggguguacauacccccuuucgaugacccacuuauuugggagggccaugcaagcaucgucaaagagcugaaggaaaccuugugggagaaacccggggcuauagcccucagugugggagguggcgggcugcugugcggaguaguucagggccuccaggaaguggguuggggagaugucccugugaucgcgauggagacauuuggggcccacuccuuccaugcagcuaccacugccggcaaguuagugucucugccaaagauuacaagcgucgcuaaagcccuuggcguuaagaccgugggggcacaagccuugaaacuguuucaggagcacccgaucuucuccgaaguaauuucagaccaggaggcuguggcggcaaucgaaaaguuugucgaugacgagaaaauccuaguggaacccgccugcggagcugcccucgcagccguuuauagucacgugauucagaagcugcaacuugaggguaaccugcguacgccuuugccaagccucgucgugaucguauguggcgggucuaauauuucccuggcucaguuaagagcccugaaagagcagcucggaaugacuaacaggcuucccaaguga

SEQ ID NO: 62276 - RNA, 462 nt, Artificial Sequence
  derived and/or modified sequence opt3 from SEC11A__Homo_sapiens__NP_001258847
augaucgugagcuccgcccugaugauuuggaagggccucauggucauaaccgggucugagucacccaucguugugguacuuaguggaagcauggaaccugcuuuccacagaggugaccuguuguuuuuaacaaacaggguggaggauccaauucgggucggcgaaaucgugguuuuccgcauugaggggcgagaaaucccgauagugcaucguguccugaaaauccacgagaagcagaauggacauauuaaauuucuaacuaagggcgacaacaaugcaguggaugacagaggucucuacaaacaagggcagcacuggcuggagaagaaggauguaguuggaagggcccggggcuucgugcccuauaucggcauugucacgauccuuaugaacgacuacccuaaauuuaaguaugcggugcuguucuugcucgggcuguuugugcugguccaucgcgaauga

SEQ ID NO: 62277 - RNA, 579 nt, Artificial Sequence
  derived and/or modified sequence opt3 from SEC11C__Homo_sapiens__NP_150596
auggugagagccggcgcugucggggcacaucugcccgccagcggacucgacaucuucggugaucuuaagaaaaugaacaagaggcagcuguacuaucaaguuuugaauuuugcgaugauuguguccucugcuuuaaugauauggaaaggccugaucguacuaaccgggucagagaguccuauuguggucgugcucagcggauccauggaaccagccuuccaccggggcgaccugcuuuuucugacaaacuuccgcgaggauccgauccgagccggugaaauuguuguguuuaaggucgaggggcgugacauccccauagugcacagaguaaucaaaguucaugaaaaggauaauggagacauuaaguucuugacuaaaggcgauaacaaugagguggacgauaggggccucuacaaggaggggcagaacuggcuggagaaaaaggacgucgugggacgggcacgcgguuuucugccuuaugugggcauggucacgaucauuaugaaugauuacccaaaauucaaguaugcucucuuagcaguuaugggggccuacgugcugcuuaagagagaaucuuga

SEQ ID NO: 62278 - RNA, 1107 nt, Artificial Sequence
  derived and/or modified sequence opt3 from SEC13__Homo_sapiens__NP_001129498
augagagagcccgugcugaccuggugcgucccucucgaacuucuguguagccacccauugccguuauccgccuuccugaagucucagguuaaacuauacacauauagggcuugcgcaggcaaggacgagauggggaaaauggugucaguaaucaacacuguggauacgagucaugaagacaugauucacgaugcccaaauggacuacuauggaacccggcucgcgacauguagcuccgaucgcucugucaagauauuugacgugcgaaaugguggccagauccugauugcugaucuucgugggcaugagggacccguuuggcaaguggccugggcacacccuauguacggcaacauccuggccucgugcucauaugacagaaaagucauuaucuggagggaagagaaugguacuugggagaagagucaugaacacgcugggcacgauaguuccgugaacucuguauguugggcaccacaugacuacggauugauacucgccugcggcagcuccgauggcgcuaucucacugcugaccuauacaggggagggacagugggaaguuaagaaaauuaauaacgcccacaccaucgguuguaaugcggugaguugggcacccgccgucgugccuggcagccucauugaccauccaucugggcagaagcccaacuacaucaaacgguucgcuuccggaggcugcgauaauuuaauaaagcuguggaaagaggaggaagacggucaguggaaggaggaacagaaacuugaggcccacucagacugggugcgcgaugucgcaugggcuccuagcauuggguugccaacuagcacaaucgccucuuguucccaggacggaagaguuuuuauuuggaccugcgaugacgcgagcucgaacacguggucuccgaagcugcuacacaaguucaaugaugugguauggcauguguccuggucaaucacugccaacauccucgcagucaguggcggcgacaauaaagugacccuguggaaggaaagcguugaugggcaauggguguguauuuccgacgucaacaaaggacaggguucugugagcgcuucaguaacagagggccagcagaaugagcaauga

SEQ ID NO: 62279 - RNA, 2148 nt, Artificial Sequence
  derived and/or modified sequence opt3 from SEC14L1__Homo_sapiens__NP_001137470
auggugcagaaguaccaaagccccgucagaguuuauaaauacccuuucgagcugaucauggccgcuuaugaaaggcgguuuccaaccugcccgcucauucccauguucgugggcuccgacacaguaaacgaguuuaagucugaagauggggcaauacacgugaucgagcgccgauguaaacuugacgucgaugccccucgucuguugaagaaaauugcgggaguggacuacguuuauuucgugcagaaaaauucauuaaacaguagagaaaggacucugcauaucgaggcuuacaaugagacguuuagcaaccgggucauuaucaaugaacacugcuguuauaccgugcauccagagaacgaagauuggacaugcuucgagcaguccgccucucuagacauaaagucguuuuucgguuuugagucaacuguagaaaagaucgcaaugaagcaguacaccagcaauauuaaaaagggcaaagagaucauugaauacuaucuccgccaacuggaggaagaggggaucacauucguucccagauggaguccuccauccauaacccccucuagcgagacuuccucaaguagcucuaagaagcaggccgcuuccauggcaguggucauuccugaagccgcucuuaaagagggacugucaggcgaugccuugagcaguccaucugcgccggaacccgugguggguacaccugacgauaagcucgacgcagauuacaucaaaagguaucugggggaccugaccccacuccaggaguccuguuuaauucggcugcgccaguggcuucaagaaacgcacaagggaaaaauccccaaggaugagcauaucuugcgauuucugagagccagggacuucaacauugacaaagcucgggagauaaugugccagagccuaacuuggcguaagcagcaccaggucgauuacauccucgaaaccuggacaccuccacaaguucugcaggacuauuacgccggcggcuggcaccaucacgauaaggacgggcgcccccuuuaugugcugagauugggacagauggauacuaaaggucucguaagggcacugggcgaggaggcuuuacugcgguacgugcucucgauuaaugaagaagggcuucgacgcugugaggagaacaccaaggucuuuggaagaccgaucucuuccuggacaugccugguggacuuggaaggccuaaauaugaggcaucuguggcggccugguguuaaagcccuccugcgcauaauugagguggucgaagcgaacuaccccgagacccuugggagacuguugauccucagggccccacguguguucccuguacuguggacguuaguuucacccuucaucgaugacaauacucggcgaaaguuucugauuuaugcaggaaacgauuaccaaggcccaggcgggcuacucgacuauaucgauaaagagauuauacccgacuuccugaguggagaauguaugugcgaggugccugaagguggccuugucccaaagagcuuguacagaacagcugaggaacuggagaaugaggaccucaagcuguggaccgaaacuaucuaucaguccgccucuguguuuaaaggggcuccgcacgagauucuuauccagaucgucgaugccagcucagugauuacaugggacuucgauguuuguaagggagacauaguguuuaacaucuaccacaguaaaaggagcccccagccuccaaagaaagauucccugggcgcacauucuauuaccucacccggugggaacaauguacaauugaucgacaaggucuggcagcucggccgcgauuauaguaugguggaaagcccucugauuugcaaggagggagaauccguucagggcucucacgugacgcgguggccaggguucuacaucuuacaguggaaauuucauucgaugcccgccugcgcugcgagcucccugccgagagucgacgaugugcuagcaucacuccaaguaaguucucacaaguguaaagugauguacuauaccgagguuauaggaagcgaggacuucagggguuccaugacaucacuggaaagcucucauuccggcuuuagucagcuuagcgccgcuacuaccucuuccucacagagucacagcucguccaugaucucucgcuga

SEQ ID NO: 62280 - RNA, 963 nt, Artificial Sequence
  derived and/or modified sequence opt3 from SEC14L2__Homo_sapiens__NP_001191133
augagcggcagagugggggaccugucccccaggcagaaggaggcccucgcuaaauuccgggaaaacguccaagauguucuuccugcacugccaaauccggacgauuacuuuuuguuacgcuggcugcgagcccguucuuucgaccuacagaagucagaggcgaugcucagaaaacugggaaggaagguggaaaccaucacaauuauauaugauugcgagggucuuggccugaaacacuuguggaagcccgcuguagaagccuacggggaguuucucuguauguucgaggaaaacuauccugagacucugaagcggcuguuuguggucaaagcaccaaaacucuuccccguggccuacaauuuaaucaagccuuuucugagugaagacacgcgcaagaaaauuaugguucuuggagcuaacuggaaggagguguugcugaagcauaucagcccagaucagguccccguggaguauggcgguaccaugacagacccugaugggaauccaaaaugcaaguccaaaauuaacuacggaggcgacaucccgagaaaguauuacguaagggaucagguuaaacaacaguacgaacacucugugcagauaucgcggggcucaagccaucaggucgaguaugaaauccuauuccccgggugugugcuccgcuggcaauuuaugagugacggagcagauguggguuucggcauuuuucugaagacuaaaaugggggagcgacagagagccggagaaaugaccgagguccuuccuaaucagagguacaacucccaccugguuccagaggacggcacauugaccugcucugaccccgguaucuaugugcuccgguucgauaauacuuacagcuuuauucaugcuaagaagguaaacuucacaguggaaguccuguuaccugacaaagccuccgaggaaaagaugaaacagcugggggcgggaaccccaaaguga

SEQ ID NO: 62281 - RNA, 972 nt, Artificial Sequence
  derived and/or modified sequence opt3 from SEC14L3__Homo_sapiens__NP_001244307
auggugauccagaaguacaugcccggcgggcugugcggauaugacagagaugguuguccugucugguacgacauuauaggcccacucgauccgaaagggcuucuguucagcguuaccaagcaagacuuguuaaaaacaaagaugagggauugcgagcggauccugcacgaaugugaccuacagacugagcgccucggaaagaagauugaaacgaucgugaugauuuuugauugcgagggccugggucuuaagcauuucuggaaaccccugguagaaguguaucaggaguuuuucggguugcucgaggaaaacuacccugagacccugaaguuuaugcugaucgucaaagccacaaaacucuucccagugggauauaauuuaaugaaacccuuucuguccgaagacacucgacguaagauaaucguucuuggcaacaauuggaaggagggcuugcugaaacuaauuucuccugaggaacucccagcucaguucgggggaacccugacagaucccgacgguaacccuaagugucuuaccaaaaucaauuacggcggggagauuccaaagucaauguaugugagagaucaagucaaaacucaguacgaacacagugugcagaucaacaggggaagcucccaucagguagaguacgaaauacuguuuccgggcugcguuuugcgguggcaauucucuucggacggugcagauauuggguuuggaguguuccucaagacaaaaaugggcgagcgccagagagccggcgagaugaccgacguccugcccucacagagguauaaugcgcacauggugccugaagacgggaacuuaacguguagcgaggcuggaguguacguccugcgguuugauaauacuuauaguuucguucaugccaagaagguguccuucaccguagaagugcuccuuccagacgaggguaugcagaaauacgauaaggaacugacacccgucuga

SEQ ID NO: 62282 - RNA, 3183 nt, Artificial Sequence
  derived and/or modified sequence opt3 from SEC16B__Homo_sapiens__NP_149118
auggagcugugggccccucagagacucccucaaaccaggggcaaggcuacagcaccaagcaaagacccggaucggggguuccgccgagacggacaccaucgucccgugccucacuccuggcauaacggugaaagauuucaccaguggcaggauaauaggggcucuccacagccccaacaggagccucgggccgaccaucagcagcaaccacacuacgcgucacgccccggggauuggcaccagccugucaguggaguugacuauuacgaaggcgguuauagaaaccagcuuuacagcaggccaggguaugaaaauuccuaccagucuuaucaaucgccgacuaugcgggaggaguacgcuuacggaucauauuacuaucauggccacccccaguggcugcaggaggaacgcgugccucgacaaagaagcccauacaucuggcaugaggauuauagggaacagaaguacuuggacgagcaccacuaugagaaccagcauagucccuucggcaccaauuccgaaacccacuuucagucuaacagccggaauccuugcaaagauuccccagccucaaacagugggcaagaguggcccggagaauuauucccggguagccugcuagcagaggcccagaagaauaaaccuucucucgcuuccgaaucaaaccugcuucagcagcgugagagcggccugaguucuuccagcuacgaguugucgcaauacauucgcgacgcacccgaaagagaugacccacccgccucugcugccuggucccccguacaggcggaugugucaagugcagggccaaaggcccccaugaaguuuuauauaccucaugucccagugagcuucggaccgggcggucagcucguucacguggggcccuccucuccuacagacggacaggcugcccuggucgagcugcauagcauggaagugauccucaaugacucagaggaacaagaggagaugaggaguuuuuccggcccauuaauucgggaagauguacacaaaguugacaucaugacuuucugucagcagaaggcagcucagagcugcaaaucugagacccugggcucacgagauagugcccuuuuguggcaacugcuagugcuccugugucgccagaacgggagcauggucggauccgacauugcggaacuucugaugcaggauugcaagaaauuggagaaguacaagagacaacccccuguggccaaucucaucaaccugacagacgaagauuggccaguguuaucuucggguacccccaaucugcucacuggcgagauaccgccuagcgucgagacaccagcacagaucguugaaaaauuuaccaggcuucuguauuacgggcggaagaaagaggcuuuggaaugggccaugaagaaccaccuauggggacaugcucuguuccucuccucaaaaauggacccccagacguauaguugggugaugucuggcuuuacuagcacccuggcccuuaacgauccucugcagacauuguuccaacucauguccggucgcauuccccaggcagccacuuguugcggggagaagcaguggggcgacuggagaccacaccuggcuguaaucuuaucaaaucaggcgggagauccugagcuguaccaaagggcaauuguggccaucggcgacacccuagcugggaaaggacucgucgaagccgcacauuuuuguuaucugauggcccacgugcccuucggucacuacacaguuaagaccgaccaucuuguguugcugggcagcucucacucccaggaguuccucaaguuugcuacgacugaagccauacagcguacagagauuuucgaauacugccagaugcuggggcggccaaaaaguuuuaucccgagcuuccaagucuauaaacuucuguacgcaucucgauuggcggauuauggacucgugucccaggcucugcauuacugugaggccauuggcgcagccguauuaucacagggugagaguagccacccuguucugcuaguggaacucaucaaacuggcugagaaacuuaaguugucggacccccugguccucgaaagaagguccggggaucgcgaccuggagccagauugguuagcccaacugcggagacagcuugaacagaagguggcaggcgacaucggagauccccauccuaccaggucugacauuagcggcgcugggggaacuacaaccgagaacacguuuuaucaggauuucucagguugccaaggcuacagugaggccccaggguaucgcuccgcguuguggcucacccccgaacagacaugucugcuacagccuucuccgcagcaaccauuuccccugcagccuggaagcuacccagccggcgguggggcuggccagacuggaacgccccgaccuuucuacuccgucccggagacacaccuccccggcacugggucaagcguggcaguuaccgaagccacaggaggcaccgugugggaggaaaugcugcagacucaccuugguccaggggagaauacgguaagucaagagacaucucagccucccgacggacaggaagucauauccaagccacagaccccuuuggcugcccggccccguagcaucucggagucaucugcaaguuccgcgaaagaagaugagaaggagagcucugacgaagccgauaaaaacagcccaagaaauacugcucaaaggggcaagcugggugacggcaaagagcauaccaaguccucaggguuuggaugguucaguugguuucgcagcaagccgacaaagaacgccucuccugcaggcgacgaagauuccucagacagucccgauagcgaggaaaccccacgggcuuccucuccccaccaggccggguuaggacucucgcugacuccuagcccagagucacccccucuuccggacguguccgcauucaguagaggcaggggugggggagagggccgagguucugccagcuccggcggggcugcggccggagcaggcguugggggacugucaggcccagaaucugugagcuuugaguugugcaguaaucccgguguccuccugccucccccagcucuaaagggggccgugccucuguauaaccccucccagguaccacaacucccuacagccacgagccugaaucgcccgaaccggcuugcucagagaagguaccccacccagccaugcuga

SEQ ID NO: 62283 - RNA, 2298 nt, Artificial Sequence
  derived and/or modified sequence opt3 from SEC23A__Homo_sapiens__NP_006355
augaccacauaccuggaguucauccagcaaaacgaagagagagacggcgugagguuuagcuggaaugucuggcccuccucucggcucgaagccacucgcaugguugugccuguagcugcacuuuucacgccacugaaggagcgaccggauuugcccccuauucaguaugaaccaguguuaugcucacguaccacauguagagccguccugaacccccuaugccagguggacuacagggcgaaacucugggcuuguaauuuuugcuaucagcggaaccaauucccuccaaguuacgccgggauaagcgagcugaaucagcccgcagagcuucugccucaguuuuccucuaucgaauauguuguguugcgcggaccacagaugccgcucauuuuccuguacgucguggauacuuguauggaggacgaagaucugcaagcccucaaggagucgaugcagaugucauuaagccugcuucccccuaccgcuuugguaggucugaucacauuuggcagaaugguucaggugcacgagcuagggugcgaaggaauuaguaaauccuaugucuucaggggcaccaaggaccucucugcaaaacagcugcaagagaugcuuggucugagcaaggugccauugacucaggccacacgggggccccaggugcaacagccuccacccuccaaccgcuuucuccagccgguccagaagaucgauaugaaucugaccgacuuacugggagaacuccaacgagauccuuggcccguuccacagggcaaaagaccucuuaggucaaguggcguggcucugagcauagccguaggguugcuagaguguacguuccccaacacuggagcgcggaucaugauguuuauugguggcccagcaacccaggggcccggaaugguggucggcgacgaacugaagacaccuauccguucuuggcaugauauugacaaagauaaugccaaguacgugaaaaaggguacuaagcacuucgaggcucucgccaaccgcgcagcuaccacagggcauguuaucgacauauacgccugcgcgcuggaccagaccggacuucuggagaugaaauguugcccaaauuugacgggcggcuauauggugaugggggauuccuuuaacacuucacucuucaagcaaacauuccagagagucuuuaccaaagacaugcacggacaguucaagauggguuuuggcgggacucuggaaauuaaaacaagcagggagaucaagauuaguggagccaucggcccgugugugucuuuaaauuccaaaggucccugcguaagcgaaaacgagaucgggaccggcggaacgugccaguggaagauuuguggccugucgccuaccacaacucuagcaauauacuucgaaguugugaaucaacauaacgcuccaaucccccaagggggacggggugccauucaguuugucacccaguaucagcacucuuccggccagcgacgcaucagagugacaacuauagcuaggaacugggccgaugcacagacccaaauucagaauaucgccgcuucauucgaccaggaggcggcagccauccucauggcucggcuggccauuuaccgcgcagagacagaagaggggccugauguccuuagaugguuggacaggcagcugauccgucucugccaaaaguuuggagaauaucacaaagaugacccaaguagcuuccgguuuuccgagaccuucucucuguacccccaguuuauguuccaucuucgaagaagcucauuucugcaaguguucaacaauaguccggaugaauccagcuauuacaggcaccauuucaugcgccaggacuugacucagucucucauuaugauacagccuauccuguacgccuauucauuuaguggcccacccgagccuguuuuacuggauagcuccucuauucuagcugaccggauccuccugauggacacguucuuucagauccuuauuuaccacggugagacaauagcccaguggagaaagucgggguaucaagauaugcccgaauacgagaacuucaggcacuugcugcaggcaccaguggacgaugcgcaggaaauccuccauagccgcuuuccuaugccccgauauauugacaccgagcacggcggaucccaagcucgguuccuguuaucaaaaguaaauccaagucagacucauaacaauauguacgccuggggccaggagucuggggcaccgauccugaccgaugacgucagccuucagguguuuauggaucacuugaagaaacucgccguuuccucagcugccuga

SEQ ID NO: 62284 - RNA, 2250 nt, Artificial Sequence
  derived and/or modified sequence opt3 from SEC23B__Homo_sapiens__NP_001166217
auggccaccuaccuggaguucauccagcaaaacgaagagagagacggcgugagguuuagcuggaaugucuggcccuccucucggcucgaagcuacacgcaugguugugccucuugcaugccuguugacuccauuaaaggagcgaccggaucugcccccuguacaguaugaaccagugcuauguucacgucccacgugcaaagccguccucaacccucugugucagguggacuacagagcgaagcugugggcuugcaauuucuguuuucagaggaaccaauucccacccgccuaugggggaauuagugagguuaaucagccugcagagcugaugccacaguuuagcaccauagaauacgugauccaggaggaugacuugcaagcccucaaagaaucccugcagaugucucugucgcucuuaccgcccgaugcucuggucggucuuauuacauucggccggauggugcagguacacgaguugucaugcgaggggaucagcaagaguuauguuuuucgcggaacuaaagaccugaccgcaaagcagauucaagauaugcuaggccucacaaagccugccaugccaaugcagcaggcuagacccgcccaaccucaggaacauccauucgcguccucuagguuucugcagcccgugcacaaaaucgacaugaaccuuaccgaucuguugggugagcuccagcgggacccguggccugucacucaagggaagcgcccccugcgaagcacaggaguggcauuauccauagccgugggccugcucgaaggcaccuucccaaauacgggggcuagaaucaugcuuuuuacuggagguccucccacccagggcccagggauggucguuggagaugagcugaaaauucccaucaggucauggcaugacauugaaaaggauaacgcccgguucaugaaaaaggcaacaaagcacuacgagauguuggcuaaucguacugccgcgaacggccauuguaucgacauauaugccugcgcacuagaccagaccggucugcucgagaugaaauguugcgcuaaucugacagggggauacauggugaugggcgauaguuuuaacaccagccuuuucaagcagacguuccaacgcauuuuuacuaaagacuucaauggcgauuuuagaauggccuucggggcuacacuggacguaaagaccucuagggaauugaaaaucgccggagcaauugguccuugugugucccucaacgucaagggcccaugcgugucagagaaugaacuggggguuggaggcacuagccaguggaaaaucugcgguuuagauccgacaaguacccuggggaucuacuuugagguggucaaccagcacaacacgcccauuccucagggcggacggggcgccauacaauucgugacccacuaucagcauucuuccacacagcgacgcaucagaguaacuaccauugcuaggaauugggcggacguucagagccaacuacggcacaucgaagcagccuuugaucaggaggcugccgcagugcucauggcccgccugggggucuucagagcugagucggaagagggaccagacgugcuuaggugguuggaucgucagcugauacggcucugucaaaaguuuggucaguacaacaaggaagaccccacaucuuuccgacuguccgauucauuuagucuuuauccucaguucauguuucaucugagaaggagcccauucuugcaggucuucaauaacucccccgacgagucuagcuacuaucgccaccacuuugcccggcaagaccucacucagucacugauuaugauccagccgaucuuauacaguuauuccuuccauggcccuccagaacccgugcugcuagauucuagcucaauucucgcagacagaauccugcuuauggauaccuuuuuccagauuguuauauacuugggggagacaaucgcgcaauggaggaaagcuggauaccaggacaugccugaguaugaaaauuuuaagcaccuucuccaggcaccccuggaugacgcccaggagauuuuacaagcccgcuucccaaugccucgauacaucaacaccgaacauggcgguagucaggcucgguuucugcuuagcaaagugaaucccucccagacucacaacaauuuguaugccugggggcaagagacgggcgcaccaauccucacagaugacguaucucugcaggucuucauggaucaucuaaagaaacuggcugugucgagcgccugcuga

SEQ ID NO: 62285 - RNA, 3003 nt, Artificial Sequence
  derived and/or modified sequence opt3 from SEC23IP__Homo_sapiens__NP_009121
auggccgagagaaagcccaacggcgggagcggaggugcuuccaccucuucaaguggcacaaaucugcuguucagcuccucugcaacugaauuuucguucaacgugccuuuuaucccagucacgcaggccucagcgagcccggcuagucuucuguugcccggggaggacuccaccgauguuggagaagaggacucuuucuuaggccaaacaagcauucacacuuccgccccucagaccuuuucauacuucagucaggugaguucuuccucagauccauuugguaauauagggcagagcccccugacaaccgcagccacuagcguaggacaaucuggcuucccuaaaccacuaacagcucuccccuuuaccacgggcucccaggacgugagcaacgcauucucgccuucuaucuccaaggcccagccaggggcuccgcccucaagucugaugggaauuaauagcuaucuuccuucccagccaucuagccugcccccuucauacuuugguaaccaaccacagggcaucccccagccgggguauaauccuuacaggcauacucccggaaguucccgggccaacccauauauugcgccuccccaguugcaacagugccagaccccagggcccccugcacacccaccgcccagcgguccuccaguccaaauguaccagaugcccccugggucucucccacccgugccgucaaguguucagagcccugcccagcaacaggugccagcucgccccggagccccuuccguccaggugcccucuccauuccugcugcagaaucaauaugaaccuguacagccccauugguuuuacuguaaagagguugaguacaagcagcucuggaugccauucucgguguucgauagcuuaaaccuggaagagaucuauaauuccguccagccggacccugaaucaguggugcuuggcacagauggcgggcgauacgacgucuauuuguacgaucguauaagaaaagcagcuuauugggaggaggaacccgccgagguuaggcggugcacuugguuuuacaagggagacaccgauagucgcuucaucccauauacagaagaguuuucugaaaagcuggaggcggaguacaaaaaggccgugaccacgaaccaauggcacagaaggcuagaguuccccagcggugagacuauuguaaugcauaauccuaaagugaucguccaguuucagccauccucagugcccgacgaauggggcacaacccaggaugggcaaacucggccucgcguugugaagcgaggaauugacgacaaccucgaugagaucccggacggcgaaaugccacaggucgaucaccugguguucguaguucacgguauagggcccgugugugaccuuagauuuaggagcauuaucgagugcgucgaugacuuccggguggucucucugaaauugcuccguacacauuuuaagaagucccuggaugacggcaaagugagucgcguugaguucuuaccugugcacuggcauagcucucugggaggcgaugcaaccgggguagacagaaauauuaagaaaaucacgcucccauccaucggaagguuucggcacuucaccaacgaaacacuucuggauauuuuguuuuacaacucacccacuuauugucagaccauagucgagaagguggguauggaaaucaaucaccuacaugcucuguucaugagucgaaacccugacuucaaaggcgggguuagcguggccggacacucgcucggcucccugauucuuuuugacauccugucuaaucaaaaggauuugaaccucagcaaaugcccggguccccuggcugucgccaauggggugguaaagcaguuacauuuccaggagaagcagaugccagaagaaccuaaacugacacuagacgagucauacgaucucgugguugaaaacaaggagguccugacucuucaagaaaccuuggaggcacugagucucuccgaguauuuuucuacauucgaaaaagagaagauagacauggaaagccugcuuauguguaccguggaugaccugaaagagaugggcauucccuugggaccacgcaagaagaucgccaauuuuguggaacacaaagcugcgaagcucaaaaaggcagccuccgagaaaaaggcugucgccgcaacuucaacgaagggccaggagcagagcgcccagaaaacaaaggauauggcuagucugccuucugaauccaacgagcccaaaagaaaguuaccaguuggggccugcgugagcucgguguguguaaauuacgaaucauucgaggucggagcaggucaagugucuguugcguauaacagucuggacuuugaaccggagaucuucuuugcucuaggcuccccuauugccauguuccucaccaucaggggcguggaucggauugacgagaauuacagccugcccacuugcaaaggauuuuucaacauauaucauccacuugaucccgucgcauaccgcuuggaaccuaugaucgugccagaccuggaucucaaggccguucugauuccccaccacaagggcagaaaaagguuacaucuggagcuuaaggaaucuuugagccguauggguuccgaccucaaacagggguuuaucucaagucucaagagcgcuuggcagacccuaaaugaguucgcccgggcacacacaucuuccacccagcugcaagaggaacucgagaaaguggcuaaccagaucaaggaagaggaagagaaacagguagucgaggccgaaaaggugguggagucaccugacuucaguaaggaugaagacuaccugggcaaagucggaaugcuuaauggcgggcgaagaauugauuauguuuugcaagagaagccgauagagagcuuuaacgaauaccuguucgcguuacagucccaucucuguuauugggagucugaagacacugcccugcuucuguugaaagagaucuacaggacaaugaacauuucgccagaacagccccagcacuga

SEQ ID NO: 62286 - RNA, 1842 nt, Artificial Sequence
  derived and/or modified sequence opt3 from SEC24A__Homo_sapiens__NP_001239160
augagccagcccggcaucccugccuccgggggagcuccagcaucucugcaagcccagaacggugcggcucucgccucaggcaguccguacaccaaugggcccgugcagaacgcacuucugagcucccaggagucugucucgcaaggauauaauuuccaguugccuggcucauacccacaccccauuccugccaagacauuaaacccaguuagcggucagaguaauuaugggggaucccagggcucuggccaaacucugaacagacccccuguggcuagcaauccaguaacgccgucccuacauucagggcccgcaccuaggaugccacuccccgccagucagaacccugcuaccacaccaaugcccucuagcuccuuucugccggaagccaaucuuccucccccacugaacuggcaguacaauuauccuucaacugcgagccagaccaaccacugcccccgggcaaguucucaaccaacaguguccggaaauaccagcuugacuacaaaccaucaguacgucucgucugguuaucccucccuccagaacucauucauaaaaaguggcccuagcgugccaccgcugguuaaucccccucugccaaccacguuucaacccggggccccucacggaccacccccggcuggcgguccuccacccgugcgcgcccucacuccuuuaaccuccucuuaccgagacgucccccagccacuguucaacagcgcagugaaucaggaggggaucacaucaaacacuaauaacggaaguaugguaguucauuccagcuacgaugaaauugagggcggcgggcuuuuggcuaccccucagcugacaaauaagaaccccaaaaugucucguucagugggauauaguuacccaagccuaccgccugguuaucaaaauaccacgcccccaggcgccacuggggugcccccuuccucucucaacuacccaucgggaccccaggcguuuacacagaccccucugggcgccaaucaccuuacuacaagcauguccggucugucauugcagccggaagggcucagagucgugaaccuguuacaagagaggaauaugcugccaaguacgccccucaagccuccaguccccaaccuucacgaggacauccagaaacugaauuguaacccugaauuguuccggugcacccuaaccucuauuccgcagacacaggcacugcucaauaaggcuaagcugccccuuggccuguugcuccauccauuuaaagaucugguucaauuaccugugguaacuagcuccaccaucgugcgcuguagaucaugcaggacauauauaaaccccuucgucagcuuucuggaccagcggcgcuggaaguguaaccuaugcuaccgagugaaugauguuccagaggaguuccucuauaacccucugacuagaguguacggagaaccccacaggcggccagagguccagaaugccaccaucgaauuuauggcuccgucugaguacaugcuucguccuccccagccacccguguauuuguucguauuugacguuucccauaacgccguggaaacaggcuaccugaauagugucugucaaagccuccuggauaaccuugaccuguugccugggaauacccgcacuaaaauuggauucaucacguucgauucuacaauucacuuuuauggucuccaggagucccugucacagccacaaauguuaaucgugagugacauagaagaugucuucauucccaugccugagaaccugcuagugaaucucaacgagagcaaggaaucgguuaucggcguguccucugaggaaacccugauuacuugccuugagaucgcaaugagauga

SEQ ID NO: 62287 - RNA, 3702 nt, Artificial Sequence
  derived and/or modified sequence opt3 from SEC24B__Homo_sapiens__NP_001036199
augagcgcccccgcuggcuccucucacccugcagccucagcgagaaucccaccgaaguucgggggagcugccgugaguggugcagccgcucccgcaggcccuggggccggaccagcuccccaucagcaaaacggcccugcccagaaucagaugcaggucccaagcgguuacgggcugcaccaucaaaacuauauugcgcccuccggacacuacucucagggcccuggcaaaaugaccucgcucccacuugacacacagugcggggauuauuacucagcacuguauacuguuccgacgcagaaugugacccccaacacaguaaaucaacagccuggagcccagcaguuguacagcagggguccacccgcuccucauauagugggcaguacuuuaggguccuuucaaggagccgcaucuagcgcuucccaucugcacaccucagccagucagccauauagcucuuucgucaaccacuacaauucccccgcgauguacucagccagcaguucuguggcaucccagggcuuuccgagcacauguggucacuaugcuaugucgaccguuucuaacgccgcuuacccuuccgugucauaucccagucuaccagccggggacacuuacggacaaauguucacaagccagaaugcaccuaccguccggcccgugaaggauaacuccuuuucuggccagaauacggccaucagccauccaucaccccucccuccacugccgagucagcaacaccaccagcagcagucccuuagcggcuauucuacucugaccuggucaagucccggguugccuagcacacaagacaaccucauucgcaaucauacuggaucccuggcuguagcgaacaauaacccaaccaucacaguugcagauucucugucgugccccgugaugcagaacguccagccuccaaaaagcucccccguggugucaaccguccucagugguucuagcggcuccucaagcacgcgaacuccgccuacagccaaucacccaguugagcccgugaccucuguaacucagccuuccgaauuacugcaacagaaggggguggacaguagcucuacaaccuccucagcuagucccaugccaaacagcuacgaugcccuugagggaggcucguauccugacauguuguccucuagcgcaucaagucccgccccagauccggcuccugaacccgacccagccuccgcacccgcgccugcuucugccccagcacccgucgugccucagccgagcaaaauggccaagccauucgguuacggguaccccacgcugcagccuggcuaucaaaaugcuaccgccccacuaauuuccggaguucagcccucaaacccuguguacagcggcuuucagcaauauccgcagcaguaccccggggucaaucagcucaguucuuccaucggaggucugagccuucaaucgucaccacagccugagucucugcgucccgugaacuugacacaggaaagaaauauacucccaaugacuccuguaugggcacccguuccaaaccugaaugcugauuuaaagaaacugaacuguaguccggacuccuucaggugcacccucacaaauaucccucagacucaagcccuucugaacaaggcgaaauugccccuaggccugcuccugcauccauuucgggaucuuacccagcugcccgugauuacaagcaauaccaucguccgcuguagaucuugcaggacuuauauuaacccuuucgugagcuuuaucgaccagcggcgcuggaaguguaauuugugcuaccgagucaacgacgugccagaggaguucauguauaacccccucacgagauccuacggggaaccucacaaaaggccggagguucaaaauucaacaguggaauuuauagccaguagcgauuacaugcugcggccaccccagccugcuguauauuuauucguccuggacgugucucauaacgcaguugaggccggauaccuaaccauucucugucagucccugcuugagaauuuggauaagcugcccggcgacucacguacucgcaucgguuucaugaccuuugauaguacaauucacuucuauaaccuccaggaagggcugagccaaccacagaugcuuaucguguccgacaucgaugacgucuuucugccuacccccgauucuuugcucgugaaucuguacgagucgaaggaauuaauuaaagaccugcuaaacgcucucccaaauauguucacuaacacaagagagacgcacagcgcccugggcccugcacuucaggcggccuuuaaguugaugucaccgaccggaggcaggguauccguguuccagacucaacugcccagucucggggcuggacuguuacagucucgggaagauccaaaucagcgaagcuccacaaaaguuguccagcaucuggguccugccaccgacuuuuauaagaaacuugcauuggacugcucaggccaacagacagcuguggaucucuuccugcuaucuagccaguacagugaccuggccucccucgcauguaugagcaaguauucugccgggugcauauacuacuaucccucauuucacuacacucauaacccaucccaggcugagaaacugcaaaaggaucuuaagcgcuauuugaccagaaaaaucggauucgaggcggugaugaggauucggugcacgaagggccugaguaugcacaccuuucacgguaauuucuuuguccgcagcacagacuuacucucgcuggccaacaucaauccugaugcaggguucgcuguucagcuuucuauagaagagucccugacugacaccagcuugguguguuuccagacagcccuccuguacacuucaaguaaaggcgaaagaaggauucgugugcauacccuaugccugcccguagucucuucccucgccgauguguaugcuggaguugacgugcaggcagccaucugucugcuugcgaacauggcugucgaucggagcgugucaaguagcuuguccgacgcccgagaugcacugguuaaugccgugguagacucuuuaagcgcuuacggcuccacggucucaaaccuccaacacucugcacugauggccccgaguucgcuuaagcuguuuccacuauaugugcucgcgcuguugaaacagaaggcuuucagaacagggaccagcacuaggcuggaugaccgcguguacgccaugugccagaucaagucccaaccuuuaguccaucucaugaaaaugauucaccccaaccuguaccggaucgacagacuuacagaugagggagcaguucaugugaaugacaggauuguaccacagcccccucugcagaaguugucugccgaaaaacucacccgcgagggcgcuuuucugauggauugugguucaguguucuauauaugggucgggaagggaugcgacaacaauuuuaucgaggaugugcuaggcuacacuaacuucgccagcauuccgcagaaaaugacccaucugcccgaacuugacacacucuccagugagcgagcacggucuuuuaucacguggcugcgugauagcagaccauugucaccuauccugcacauuguuaaggacgaaucccccgcuaaggccgaguucuuucaacacuuaauagaagauaggaccgaggcggccuucaguuauuacgaguuucuccugcacgugcagcagcagaucuguaaauga

SEQ ID NO: 62288 - RNA, 3285 nt, Artificial Sequence
  derived and/or modified sequence opt3 from SEC24C__Homo_sapiens__NP_940999
augaacgugaaucagagcgucccaccuguuccaccguucggccaaccccagccuaucuacccaggguaucaccaguccucuuacggaggucagucaggcaguaccgcccccgcuauuccuuauggggcauacaacggaccagugcccggcuaucaacagacaccuccacaggguaugagcagagccccgcccuccucuggggcgccuccagcuucgacugcccaggcacccugcggacaagccgcuuacggccaguuuggccagggggacguacagaauggaccuucaagcacggugcaaaugcagaggcugccagguagucagcccuucggcuccccgcucgcaccugucgggaaccaacccccagugcuucagccuuauggacccccacccaccucugcccagguugcuacacagcugagcggcaugcaaauauccggugccguggcgccugcaccaccgucaaguggguugggauuugggcccccuacuagcuuagccucugcuuccggcucauucccaaauagcggccuguacggaaguuacccccagggucaggccccuccacuaucucaggcacaaggccaucccgggauccagaccccgcagcgguccgcuccuagccaggccucgucuuuuacaccacccgcguccggaggcccucgccuccccucaaugaccgguccacugcuuccugggcaaaguuucggcggacccagcgucucccagccaaaccacgugucuagcccgccucaggcccugcccccaggcacucagaugacagggcccuugggaccucucccacccaugcauucaccucaacagccggguuaucagccacaacagaauggcaguuuugggcccgcacgaggaccucaguccaacuacggcgguccauaucccgcugccccuaccuucgggagccagccgggacccccacaaccucugcccccaaagcgucuggauccugacgcuauucccucuccaauccagguaauugaggaugacagaaauaacaggggcacggaaccguuuguuacuggcgugcgggggcaggucccuccccucgugaccacaaauuucuuagugaaagaucagggaaacgccucaccacgcuacaucagauguaccaguuauaauauacccugcacuagcgacauggcaaagcaagcccaggucccucuggcugcgguuaucaaaccacuugcaagguugcccccugaggaagccuccccguacgugguagaucacggugagucuggcccacugcgguguaaccgcugcaaggcuuauaugugucccuuuaugcaguucauugaagggggacgaagauuucagugcuguuucugcucguguaucaaugacgugccuccccaauacuuccagcaucuagaucacacaggcaaaagggucgacgccuacgaucggccagagcucagccuggguuccuaugaguuucuugcaaccguggacuacugcaagaacaacaaguucccuucacccccagccuuuauuuucaugaucgauguuaguuauaaugcuauacguacggggcuggugcgcuugcucugugaagaacugaaaucuuuacuggacuuucucccuagagaaggcggagccgaggagagcgcaauuagggucggcuucgugacuuacaacaagguacuucacuuuuauaauguuaaauccucacuggcgcagccgcaaaugaugguggucagcgacguggcugauauguucguccccuugcuagacggguuucuggugaacguuaaugaaucucgggccgugaucacaucccuccuggaucagauuccagagauguucgcagacacccgagaaacugagacaguauuugucccugugauccaggccggaauggaagcucuuaaggccgcagagugcgcuggcaaacuguucuuguuucauaccagucuccccaucgccgaggcgccagguaagcugaagaaccgcgaugacagaaaauuaauuaauacggauaaggagaaaacccuguuccagccucaaacaggggccuaccagacucuagcuaaggagugcguugcacagggauguugcguggaccucuuccuguuucccaaccaguaugucgauguggccacccuuagcguagugccgcaauugacaggcgguucuguuuacaaauacgcuuccuuccaggucgaaaaugaccaggagagguuucugucagaucuccggcgcgacgugcagaagguggucggcuucgacgccguuaugagagugaggaccaguacugggauacgugcaguggacuuuuucggagcguuuuauaugagcaacacaaccgauguagaacuggccggccuugauggggacaaaacugucacgguggaguucaagcacgaugaccggcugaaugaggaaucgggagcuuugcuccaaugugcccuguuauacacauccugcgcaggccagcgaagacugaggauccauaaccuagcucucaauuguugcacccagcuggccgaucuuuaucgcaacugugagacugacaccuugauuaauuacauggcaaaguuugccuaucgggguguucugaacucuccagugaaagcugucagagauacacucaucacccagugcgcgcaaauacuggccuguuacaggaagaacugcgcaagcccuucaagugcugggcaguuaauucugcccgaauguaugaaacuuuugccaguguaucucaauugcguucugaaguccgacgugcuacagcccggagccgagguaacuacagaugaccgcgccuacguccgacaacuggugacgucuauggaugugaccgaaacuaacgucuucuuuuacccucggcuccugccgcuuacaaaaagccccguugaguccaccacagagcccccugcugugcgugcaucagaagagagauugagcaauggcgacaucuaucuguuagaaaacggucucaaucuguuccuuuggguaggcgccagugugcagcagggggucgugcagucucuguuuuccguuagcucguucucacaaaucacuucuggauugagugugcuccccguccuggacaacccucuauccaagaaggugaggggccugauugauagccuccgcgcgcagcggucuagauacaugaaacugaccguugugaagcaggaggacaaaauggagaugcuuuucaagcacuuuuuggucgaagauaaaagccuguccgggggagcuucauauguagacuucuuaugccacaugcauaaggagaucaggcagcuccugaguuga

SEQ ID NO: 62289 - RNA, 3321 nt, Artificial Sequence
  derived and/or modified sequence opt3 from SEC31A__Homo_sapiens__NP_001070674
augaagcugaaagagguggacagaaccgccaugcaggcuuggagccccgcacaaaaccacccuaucuaccucgccacaggcacuuccgcgcagcagcuugaugcuacguucucuaccaaugccucacuggaaauuuuugaguuggacuuaagugauccaagccuggacaugaaguccugcgcaacauucucuucgucacauagguaucacaaacuaauaugggggccguacaagauggauagcaaaggagacgucagugguguucucaucgccggcggggaaaacggaaauauuauccuguaugaucccuccaagauuaucgcuggcgacaaggaggugguaauagcacagaacgauaaacauacugguccugugcgggcccuugacgucaauaucuuucaaaccaaccugguggcuucuggggccaaugaaagcgagauuuacaucugggauuugaacaauuucgcgacaccaaugacccccggagcaaagacucagccuccagaggacauuuccuguaucgccuggaaccgccagguucagcacauacucgcuucagccagucccagcggccgagcaacagugugggaucugcguaaaaaugaaccuauuaucaaggucucugaccauuccaacagaaugcacugcucaggccuggcuuggcacccagacguggccacccaaaugguacucgcgagcgaggaugacagguuaccgguuauucagaugugggaucugcgguuugccaguucuccccuucgcguguuggaaaaucaugcaagagggauccuggcuaucgccugguccauggcugacccugagcuacuccugagcuguggaaaagaugccaagauucuuugcucgaacccaaauacgggugagguccuguaugaauugcccacuaacacccagugguguuucgacauacaguggugcccuaggaacccagcagugcucucugccgcuuccuuugauggccggaucucaguguacaguauuaugggagggagcacagacggccugcgccaaaagcaggucgauaaauuauccucuagcuucgguaaucuggaccccuuugggacuggacagccgcucccuccccuucaaaucccacagcagaccgcgcagcacucaauaguucugccuuugaagaaacccccaaaguggauucgaagacccgugggcgcaaguuucuccuuuggcgggaagcuaguaacauucgagaacgugaggaugccuagccaucaaggagccgaacagcagcagcaacagcaccacgucuuuaucucucaggugguuaccgagaaagaguuccugucacggagugaucagcuccaacaggcugugcagagccaggguuucaucaauuauugucagaaaaagauugacgccucccaaacggaauuugagaagaacgucuggucuuuccugaaagugaauuuugaagacgauucgcguggcaaguaccuugagcuguugggguaccgcaaagaagaccucggaaagaaaaucgcacuggccuuaaacaagguagauggcgcuaauguugcccugaaggacagcgaucagguggcacaauccgacggugaggaaucaccagcggcugaggagcagcuacucggggaacauauuaaagaggaaaaggaggaaagugaguuccugccgucuagcggcggaacuuuuaacauauccgucucaggcgauaucgacgggcuuauuacacaggccuugcugaccggaaauuucgagagcgcaguggaucucugccugcacgacaacagaauggccgaugcuaucauccuugccauugcugguggccaggaacuguuggcaaggacucagaaaaaguauuuugccaaaucucaauccaagauaacacggcucaucaccgcggucgugaugaagaauuggaaagagauuguugaaaguugugaccugaagaacuggcgagaggccuuagcugcagugcugacguacgccaaacccgaugaguucagcgcucuaugcgaccuccuggggacccgccuugaaaaugagggagacucuuugcugcagacacaggccugucucugcuauaucugcgcaggcaacguagaaaagcuggucgcguguuggacuaaagcccaagaugguucccauccuuuaucacugcaggaccuuauugagaaggugguuaucuugagaaaggcugugcagcucacccaggccauggauacaaguacugucggggugcugcuagcagcuaaaaugagccaauacgccaaucugcucgcagcccagggcucgauagcugcggcccuggcauuucuuccagacaacaccaaccagcccaauaucaugcaauugagggaucggcugugccgcgcucagggagaaccuguagccggccacgaguccccaaagauucccuaugagaaacagcaguuaccgaaggggagaccuggaccaguggccggucaucaccaaaugcccaggguucagacacagcaguacuauccucacggcgaaaaucccccaccucccggguucaucaugcauggaaacgucaacccaaaugcugcaggccaacucccgaccucuccuggucacaugcauacucaggugcccccauacccccagccucagcguccacaaaacggguggaaugaucccccugcccugaaccgggugccgaaaaagaaaaagaugccagagaauuuuaugcccccugucccaauuacgagccccaucaugaacccucuuggcgacccgcagucacagaugcugcagcaacagcccagugcgccaguuccuuuguccucucagagcuccuucccccaaccacaccucccuggaggccagcccuuucacggggugcagcagccacugggacaaacaggcaugccgccuucauucagcaagcccaauauagaaggugcuccaggggcccccauuggaaacaccuuccagcaugugcagagucuaccuacuaaaaagaucaccaaaaagccaauucccgacgagcaccugauccucaaaacaaccuuugaagaucugauacagcgaugucuuucuuccgcaacugacccucaaacaaagagaaaguuggaugacgccagcaaaaggcuggaguucuuauacgauaagcuccgcgagcagacgcugucgccgaccaucacuucaggccuucauaauauugcucggucuaucgaaacaagaaacuauagugagggucugaccaugcacacacauauuguauccacuagcaauuuuucugaaaccagcgcauucaugccaguccuaaaagugguucucacgcaggccaacaagcugggcguguga

SEQ ID NO: 62290 - RNA, 1431 nt, Artificial Sequence
  derived and/or modified sequence opt3 from SEC61A1__Homo_sapiens__NP_037468
auggccaucaaguuccuggaggugauuaaacccuuuugcgucauacucccugaaauccagaagccagagagaaaaauucaauucaaggaaaaaguucuuuggaccgcuaucacacuguuuauuuucuugguguguugccagaucccguuauuuggcauaaugagcuccgacucugcagaucccuucuacuggaugaggguaauccuggccucaaaccgggggacucuaauggagcucggaauuaguccuaucgugacgagcggucugauuaugcagcuucuggcgggcgcuaagaucauagaagucggggacaccccaaaggaucgcgccuuguuuaauggagcacagaaacucuucggcaugauuaucacaauuggucaauccaucguguauguuaugacugggauguacggagaccccucugagaugggcgccggcaucugucugcugauuaccauacagcucuuuguggcuggguuaaucguccugcuuuuggaugagcugcuacagaagggauauggucucggcucggggauuucacuguucaucgcaacaaacauaugcgaaaccauuguguggaaagccuuuagcccuacuacaguaaauaccggacgaggcauggaguucgaaggugcuaucaucgcccuuuuucaccuguuggcgacgcguacugacaagguuagagcacucagggaggccuucuaccggcagaaccugccaaauuuaaugaaccugauugcuaccaucuucguguuugccgucgugauuuauuuccaaggguuucgcguggaucuccccauaaaaagugcaagauacaggggacaguauaauacauacccuaucaaguuguucuacacuuccaacauuccaaucauccugcagucugcuuuggucagcaaucuauauguuauuucccagaugcugucagcccgguuuaguggcaaccuccuggugagccuucugggcaccuggucugacacauccucagggggaccggcgcgcgccuaccccguagguggcuuguguuauuaccucagcccuccagagaguuucgggucugugcuggaagaucccguccaugcagugguuuauauaguguuuauguuaggauccugcgcuuucuuuagcaagaccuggaucgaggucucggguucuuccgccaaagacguggcuaagcaacugaaagaacagcagaugguaaugcgaggccacagagagacgucaaugguucaugaacuaaauagguacauuccuacugccgcagccuucgggggccucuguaucggagcucugagugugcuugcggauuuucuuggcgcaauugggagcggaacagguauccugcucgccgucaccauaaucuaucaauacuucgagauuuuugugaaggagcaguccgaagucggcucuaugggggcucugcuuuucuga

SEQ ID NO: 62291 - RNA, 207 nt, Artificial Sequence
  derived and/or modified sequence opt3 from SEC61G__Homo_sapiens__NP_055117
auggaccaggugaugcaauucgucgaacccagcagacaguuuguuaaggauuccaucaggcuggugaaacggugcaccaagccugaccgcaaagaguuccagaagauugccauggcuacagcaauaggcuuugccaucaugggguucauuggauuuuucguaaaacucauccacauuccaaucaacaauauaaucguggguggcuga

SEQ ID NO: 62292 - RNA, 1200 nt, Artificial Sequence
  derived and/or modified sequence opt3 from SEC62__Homo_sapiens__NP_003253
auggccgagagaaggcggcacaagaaacgcauccaggaagugggcgagcccagcaaggaagagaaagcugucgcaaaguaccugcgauucaacugcccuaccaaauccacaaauaugauggggcaucguguugacuauuuuauugccucuaaggcgguggauugucuccuugacucaaagugggcuaaagccaagaaaggagaagaggcacuguucacuacgagagagaguguaguggauuacugcaacagguuguuaaagaaacaauuuuuccaccgggcccugaaggucaugaagaugaaauaugacaaggauaucaaaaaggaaaaagacaaggguaaagcugagagcggcaaggaagaggauaagaaauccaagaaagagaauauaaaggacgagaaaaccaagaaggaaaaagaaaagaaaaaggauggggagaaagaagagucuaagaaggaggaaacaccaggaacuccgaaaaagaaagagaccaagaaaaaguuuaagcuagaaccccaugacgaucagguguuccucgacggcaacgagguuuacguguggauuuaugauccuguccacuuuaaaacauucgugaugggucugauccuuguaauugcaguuaucgccgcuacccuguuuccauuguggcccgccgaaaugcgcgugggggucuacuaucucucggugggagcgggcuguuucguggcaucaauacugcugcucgccgucgcuagaugcaucuuauuucugauuaucuggcuuauuacuggcgggaggcaucacuucugguuuuugccuaaucugacagccgacguuggauucaucgacagcuuccggccacuauacacccacgaguacaagggucccaaagcagaucucaagaaagacgagaagagugaaacgaaaaagcagcagaaguccgauucugaggagaaaagcgacuccgaaaagaaagaagaugaggagggcaagguggggccuggaaaccauggcacugaagguucagggggagagcgccacagugacaccgauagcgaccgaagagaagaugacaggucucaacauuccucaggcaauggcaacgauuuugagaugauaacaaaagaggaacuggagcagcagacugacggggacugugaagaggaugaagaggaggaaaaugacggagagaccccaaagagcagucacgaaaagucuuga

SEQ ID NO: 62293 - RNA, 2283 nt, Artificial Sequence
  derived and/or modified sequence opt3 from SEC63__Homo_sapiens__NP_009145
auggccggccagcaauuccaguacgacgauagcgggaacaccuuuuucuauuuucugacauccuucgugggacucaucgucauucccgcuacuuacuaucuuuggccuagagaccagaaugcagagcagauaaggcugaagaacauccggaaaguuuacggucgcugcaugugguaucgauugcguuuacugaagccacaaccgaauauuauccccacggugaaaaagauuguacuacucgccggcugggcgcuguuucuuuuccuggcuuacaaagugucuaagaccgauagagaauaucaggaguacaacccuuacgaagucuugaaucucgacccaggggccacaguggcagagaucaagaaacaguauaggcugcugucacucaaguaccaccccgauaaaggaggcgacgaaguuauguuuaugcggauagccaaggcuuaugcagccuuaacugaugaggagagucgcaaaaacugggaagaguucgguaauccugacgggccacaggcuaccagcuuuggaaucgcccugcccgcguggauuguggaucaaaagaacuccauccuugucuugcugguguacggccuagcauucaugguaauucucccuguuguggucggcucuuggugguauagaucgaucagguacucaggggaccagauacugauucggacaacccagaucuauacuuacuuuguguacaagacacgcaauauggauaugaaacgacuuauuauggugcuggccggagcuagcgaguucgacccacaguauaacaaggaugccaccaguagaccgacggacaauaucuugaucccccaacucauuagggaaauagguuccaucaaccugaaaaagaaugagccuccauuaacuugucccuacucucugaaagcacggguccuccuucugagccauuuggcucguaugaagauuccugaaacccuagaggaagaccagcaguuuaugcugaaaaagugcccagcccuccugcaagagaugguuaacgugaucugucagcuuauaguaauggcgcgcaauagagaagagagggaguuccgggcccccacacuggcauccuuggaaaacugcaugaagcucucacagauggcugugcagggccugcaacaguucaaaaguccguuacugcagcuaccucacauugaggaagauaaccuccgacgcgucagcaaucauaagaaauauaagaucaaaacuauccaggaccuggugucucuuaaggaguccgauagacacaccuugcugcauuuucucgaagacgagaaguacgaggaaguuauggccgugcuggggucauuccccuaugucacaauggauauuaaaagccaagugcuugacgaugaggacaguaacaauaucaccguaggaucucugguuacgguguuggucaagcucacuaggcagacaauggcugaaguguuugagaaagaacaguccauuugugccgcagaggagcagccagccgaagauggccaaggugagaccaacaagaaucggacuaaagggggauggcagcaaaagagcaagggcccuaaaaagacagcuaaaucgaagaaaaagaagccccugaaaaagaaaccaacccccgucuuacugccucagucuaagcagcagaaacagaagcaagcgaacggcgugguugggaaugaagcagccgugaaagaggacgaggaagagguauccgauaagggaucagacagugaagaggaagagacgaaccgcgacagccaguccgagaaggaugacgguucugauagagacagcgauagggaacaggacgagaaacagaauaaggaugacgaagcugaguggcaagaacuacagcagucaauacagcguaaagagcgggcccuccuggagaccaagaguaaaaucacacacccagucuacucccuuuauuucccggaagagaagcaagaaugguggugguuguacauugcagaucgaaaggagcagacucugaucagcaugcccuaccacgugugcacccucaaagacacagaagagguugagcugaaguuuccugccccaggcaaacccgggaacuaucaguacacuguguucuuaagaucugauucauauaugggacuggaccagaucaagccucuuaaauuggaaguccaugaggcuaagccagugcccgaaaaucacccgcaaugggauaccgccauugagggcgacgaggaccaggaagauagugaggguuuugaagacagcuucgaggaagaggaggaagaggaagaggaugacgauuga

SEQ ID NO: 62294 - RNA, 2565 nt, Artificial Sequence
  derived and/or modified sequence opt3 from SECISBP2__Homo_sapiens__NP_076982
auggccagcgagggccccagagaaccugaguccgaagggaucaagcugucugcugacgugaaaccauucgucccgagguuugcaggacucaacguugccuggcuugagucaagugaagcgugcguguuccccagcuccgcugccaccuacuauccuuuuguacaggagccacccgugacagagcaaaagauuuacacugaagauauggcauucggugccucuacguuuccuccacaguaucugucgucagagauaaccuugcaccccuacgcuuauagcccuuacacauuagacaguacucagaaugucuauuccgugccaggcucucaguaccuguacaaccaaccgagcuguuaucggggguuccagaccguuaaacaucgcaaugaaaacacaugcccccuaccucaggagaugaaggcacucuuuaaaaagaagaccuacgaugagaaaaagacuuaugaccagcaaaaauucgauuccgaacgagccgacggaacaaucucaagugagauuaagagcgcucguggcucucaccaucuguccaucuacgccgaaaauucacuuaaaagcgaugguuaucacaagagaaccgacaggaagagucggauuaucgcgaaaaacgugucuacguccaagccagaguuugaguucacuacccuggauuuucccgaauugcagggggcagagaauaacaugagcgaaauacagaaacagccuaaguggggaccaguccauucggugucuacagacaucucccuccugcgcgagguaguuaaacccgccgcugugcugucaaagggcgaaauugucgugaaaaauaacccgaaugagagugugacugccaacgcagcuaccaauagcccuuccuguacaagagaacucucuuggacccccaugggcuacgucguuaggcaaacguuaagcacugagcugucagccgcgccaaagaacgugacaaguaugaucaaucuuaagaccauugccuccagcgcagauccuaaaaacguaucuauccccucaagugaggcuuugagcuccgacccaucuuauaacaaggaaaaacacauaauucaccccacucagaagucgaaagccagccagggguccgaucuggagcaaaaugaggcuucacggaagaacaagaaaaagaaagaaaagaguacaucuaaauacgaagugcuaaccguccaggagccuccacgcaucgaggacgccgaagaguucccgaaucucgcaguggccagcgaacgaagagacaggauugagacgcccaaguuucaguccaagcagcaaccucaggauaacuucaaaaauaacguuaagaaaucacagcugccagugcagcuugaccugggagguauguugaccgcucucgagaagaaacaacauagccagcacgcgaagcagucuuccaagcccgucgugguaaguguuggcgcagugccuguccugagcaaagaaugcgccucuggggagcggggacgucgcaugucccagaugaagacaccacauaaucccuuagauucaagugcuccgcugaugaaaaagggcaaacaaagagaaaucccuaaggccaaaaagccaacuagccucaagaaaaucauucuuaaggagaggcaggaacggaaacagcgacugcaggagaacgcagugucgcccgccuucaccuccgacgauacacaagacggugagucugggggagaugaccaguuuccugaacaggcugaguugagcggccccgaaggcauggaugagcuaauaucaacuccaagugucgaagacaaguccgaggagccucccgggaccgaacugcaacgcgauacagaggccucucaccucgcaccaaaucacaccacuuucccgaaaauccauagcagaagguuucgggacuacuguucccagaugcugucaaaggaaguggacgcgugcguuacggaucuucugaaggaguuggugcgcuuccaggacagaauguaucagaaagauccuguaaaggcuaaaacaaagaggcgucucguccugggauuacgggaagugcugaaacaccuaaagcucaagaaacugaaguguguuauuaucagccccaacugcgagaaaauacaaaguaaggguggccuugacgauaccuugcauacuauuaucgacuacgccugugagcagaauaucccauuuguguucgcacugaaccgaaaagcccucgggagaucucugaauaaggcuguccccguguccguagugggaauuuuuagcuaugauggcgcccaggaccaguuccacaagaugguugaacuuaccgucgcagcuaggcaagccuacaaaacaaugcuggagaacgugcagcaggaauuggugggugagccucgcccacaggcgcccccuucgcucccgacccaagggccaucaugccccgccgaggauggcccuccagcucugaaggaaaaagaggaaccccauuauaucgagauuuggaagaaacacuuagaagcauacucuggauguacucuggagcuagaggaaagucucgaggccuccacaagccagaugaugaaucugaaccuuuga

SEQ ID NO: 62295 - RNA, 3306 nt, Artificial Sequence
  derived and/or modified sequence opt3 from SECISBP2L__Homo_sapiens__NP_001180418
auggacagagcccccaccgagcagaacgugaagcugagcgcugaagucgagccuuucaucccacaaaagaaguccccggauacauuuaugauucccauggcacucccuaaugacaacggcucuguuucagggguggaaccaacucccauaccuaguuaccuuaucacgugcuauccauucguacaggagaaucagagcaacaggcaguuuccccuguacaauaacgauauucgguggcaacagccuaauccaaacccgaccggacccuauuucgccuacccuaucauuuccgcgcagccacccgugucuacagaauauacuuacuaucaguugaugccugcuccaugugcccaagucauggguuuuuaccaccccuucccgaccccuuacucgaauacauuucaggcagccaacaccgugaaugcuaucacuacagagugcaccgagcgccccucacaguuaggccagguuuucccacugagcagucaucgaucccguaacucuaauagagggagcguggucccuaaacaacagcuacuccagcaacacauaaaguccaaaaggccccuggugaagaacguagcaacgcagaaggaaacuaaugccgcuggaccagacucacggaguaaaaucguucuucugguggaugccagccagcagaccgacuuucccucugauauugcgaacaaguccuugucagagacaacugcaaccaugcucuggaaaagcaagggccgcagaaggcgggccagucauccuacagcugaaucuuccagcgagcaaggugccucggaggcagacaucgauucugacuccggguauuguucaccaaaacacaguaacaaucagccggcugccggagcgcugcgcaaccccgauagcggcaccaugaaucaugucgaauccucuaugugcgccggcggggugaacuggagcaaugugacgugucaggcaacucagaagaagccuuggauggagaaaaaccaaacauucucacgaggagguagacagaccgaacagaggaauaacagucaggucggcuuucggugccgugggcacuccacuagcucugagcgcagacaaaaucugcagaagaggccagacaacaaacaccucucaaguagccagucccaucggucugaucccaauucggaaucauuauacuucgaggacgaggacggauuucaggaacugaacgagaauggcaacgcuaaggaugaaaauauucaacagaaacuuuccucaaagguuuuggacgaucugccugagaacaguccaaucaacauagugcagacacccauuccgaucaccacgucuguaccuaaacgagccaagagccaaaagaaaaaggcucuagccgcagcccucgcuaccgcgcaggaauauuccgagauuucaauggagcagaaaaagcugcaggaagcacuuagcaaagccgcugguaagaagaauaaaacaccagugcaacuggacuugggggauaugcucgccgcacuggagaagcagcagcaggccaugaaagcucgccaaaucacuaacaccagacccuuaucuuacacagucgugacugccgcauccuuccacaccaaggacaguacaaauaggaaaccucugaccaagagccagcccugucucacuucuuucaacuccguugauaucgcgucaaguaaggcuaaaaagggaaaagaaaaggagauugccaaacuuaagcggccaacggcacugaagaaagugauauugaaggaacgcgaggagaaaaagggcagacuaacagucgaccauaaucugcucggcagcgaggaaccuaccgaaaugcaccuggauuuuaucgacgaucuuccccaggagauugugucgcaggaggacacugggcuguccaugccaucugacaccagcuugucaccggccagucaaaacuccccuuauugcaugacacccguaucucagggaagcccagcuuccucagguaucggcagccccauggccaguucuaccauaacuaaaauucacuccaagagguuccgugaauacuguaaucagguucucugcaaagagaucgaugaaugugugacacuguuacugcaagagcuagucagcuuucaggaacggaucuaucagaaggacccugugcgagcaaaggcuagaaggcgccucgucauggggcugcgggaggugacgaaacauaugaaacuuaacaaaauuaagugcguuaucauuucgccaaauugcgagaaaauacagucaaagggaggcuuggaugaagcccuguacaacgugaucgcgauggccagagagcaagaaauucccuucguauuugcucucgguaggaaggcacuggggcgcugugucaauaaacuugugccuguuucuguggucggcaucuucaacuacuuuggagccgagagucuguucaauaaguugguggaacucaccgaggaggcucgaaaagccuauaaggacaugguagcagcgauggaacaggagcaggccgaagaggcucugaaaaacgugaagaagguuccgcaccauaugggccacucccggaauccaagcgccgcaucugcuaucagcuuuugcuccgucauuucagaacccauaagugaggugaacgagaaagaauacgagacuaacuggcguaauaugguggaaacaagcgauggguuagaggccucugagaacgaaaaggaggucuccuguaaacauucaaccagugaaaagccuagcaaacugccauucgacacacccccuaucggaaagcagccgucccuaguugcaacugguucuaccacgucggccaccagcgcuggcaagucaacagcguccgauaaagaggaagugaagcccgacgaucucgagugggccagucaacagucuacugagaccgggagccuggacggauccugcagagaucuuuugaauagcucuauuacaagcacuaccaguacgcuggugccaggcaugcucgaagaggaagaggacgaagaugaggaggaagaggaagacuauacacacgagccuaucuccguagaaguccagcugaacagcaggauugagucuugggugucagagacccagcgcacuauggaaacauuacaacuggguaaaacccuuaauggguccgaggaagacaacguugagcagaguggcgaggaagaggcagaagcucccgagguguuggaaccaggaauggauagcgaggccuggacugccgaccagcaggcuucgccuggccaacagaagucuuccaauuguagcucacucaacaaagagcacagugauucuaauuacaccacacagacgaccuga

SEQ ID NO: 62296 - RNA, 747 nt, Artificial Sequence
  derived and/or modified sequence opt3 from SECTM1__Homo_sapiens__NP_002995
augcagaccugcccccuggccuucccuggccacgugagccaagcucucgggacacuucuguuuuuggcagccuccuuaucugcgcagaacgagggaugggacucaccaaucuguacugaaggugucguuagugugagcuggggcgagaauacgguaauguccugcaacauuucuaaugcuuucucgcaugugaacauaaagcugagagcccacgggcaggaaucagcaaucuuuaaugaggucgccccgggauacuucagcagggauggcuggcagcuacaagugcagggugggguugcucagcucgugauuaaaggagcacgggacagucaugccggccuguauauguggcaccuugucggccaucagcgcaacaaucgacaagugacccuggaaguauccggggcugagccccagucugccccugauacaggauuuuggccaguucccgcgguggucacugcaguguucaucuugcucguggcccuggucauguuugcuugguaccguuguagaugcagccagcagaggcgggagaagaaauucuuucugcucgaaccucaaaugaagguugccgcauuacgcgcuggugcccagcagggccuguccagagcgucagccgagcuuuggaccccagacagugaacccacaccuaggccauuggcacugguguucaaaccgagcccccuaggggcucucgagcugcuuucuccucaaccacuguuucccuaugccgcugauccuuga

SEQ ID NO: 62297 - RNA, 906 nt, Artificial Sequence
  derived and/or modified sequence opt3 from SEL1L__Homo_sapiens__NP_001231913
augagagugaggaucggccugacccuccuucugugcgccgucuuguuaagccuggcuuccgcaucuucagacgaggaagggagucaggaugagagccuagacuccaagacaacucucacgucugaugaaucgguuaaagaccacaccacagccggacgggugguagcgggucaaauuuuccuggauucagaggaaagcgagcuugagaguuccauacaggaagaggaagacucucugaaaagccaggagggcgaguccgugacugaagauaucucauuuuuggagagucccaacccugaaaauaaggacuacgaggaaccaaagaaaguccgcaagccggcucucaccgccauugaggggacagcacauggagagcccugucacuucccuuuucuguuccuggauaaggaauaugacgagugcaccagcgauggccgagaagacggucgucucuggugugccacuacauacgauuauaaagcugacgagaaguggggguuuugcgaaaccgaggaggaagcagccaaaagaaggcagaugcaagaggcugaaaugauguaccagacgggaaugaagaucuuaaacggcucuaauaaaaagucccagaagcgggaggccuaucgcuaccugcagaaagcggcaucaaugaaccauacuaaggcccuugaaagagugagcuaugcuuugcuguucggcgacuaccuaccacaaaauauucaggccgcaagggagauguuugagaaacucaccgaagaggggagucccaagggacagacagcucuggguuuccuuuacgccucuggccuggggguuaacuccagccaggcgaaagccuugguguauuacacuuuuggagcacucggcgguaaucugaucgcucacauggucuuagugucgcggcuguga

SEQ ID NO: 62298 - RNA, 1833 nt, Artificial Sequence
  derived and/or modified sequence opt3 from SELE__Homo_sapiens__NP_000441
augaucgccagccaguuccuguccgcucucacccuugugcuguugauuaaggagucuggcgcauggucauacaacacaaguacugaagccaugacguaugacgaggcgagcgcuuacugccaacagagauauacccacuuagucgccauacagaauaaagaagagaucgaauaccugaacuccauucuaucuuauucgcccucauacuauuggaucgggauuaggaagguuaauaacguguggguaugggugggaacacagaaaccucucacugaggaggcaaagaauugggccccaggugaaccgaacaaucggcaaaaagaugaggacugugucgaaaucuacauaaagcgcgagaaggaugugggcauguggaacgacgagcgaugcagcaaaaagaaacuggcucuuuguuacaccgcagccugcacaaauaccaguuguuccgggcauggagaaugcguugagacuaucaacaauuauacauguaagugcgaucccggcuuuucuggucugaaaugugaacagauugugaacugcaccgcuuuggagagcccugaacacgggucccucgucuguucacauccacugggaaauuucaguuacaacagcucuugcuccaucucaugcgaccguggcuaucugcccagcaguauggagacgaugcaguguaugucuuccggcgaguggagcgccccuauuccagcgugcaaugugguagaaugugaugcaguuacuaaccccgccaacggguuuguggagugcuuccagaauccuggaucguuuccauggaacaccacauguacuuucgacugcgaagaggguuuugaacucaugggcgcucaaucuuuacaguguaccuccucagggaauugggauaacgagaagccgacaugcaaggccgucaccuguagagcagugaggcagccccagaauggaagugugcggugcagccacuccccugcuggcgaguucacguuuaaaucuagcuguaacuucacuugcgaagaggguuuuaugcugcaagggccagcccaggucgaaugcacaacccagggacaauggacucagcagauccccguuugugaggcguuccagugcacagcccuuucaaauccugaacgcggcuacaugaacuguuugccaagugcauccggcagcuuuagauaugggucuucaugcgaguucaguugugagcaaggauucgugcugaaggguagcaaaaggcuacagugcggccccaccggggaaugggacaaugagaagccgacgugugaagcuguacggugcgaugccgugcaucagccucccaaaggacucguccgcugugcucacuccccaauaggcgaguuuaccuacaagucuucgugcgccuucagcugugaggaagguuuugagcugcacggguccacacagcuugaaugcacuucacaaggccaguggaccgaggaagugccuaguugccagguugugaaauguucuagccuggcaguccccggaaagauuaacauguccugcucaggcgagccaguguucgggacaguauguaaguuugccugccccgagggauggacuuugaaugguagcgcugcgcgaaccuguggcgcaacagggcauuggucuggacuccugccuaccugcgaagccccaacugaguccaacaucccguuaguugcuggccugagugccgcaggucucagccuucugacguuggcccccuuccuacuguggcucagaaaaugucugaggaaggcuaaaaaguuugugccugccucuuccugccagucacuugaaagugacgggagcuaucaaaaaccaucguacauucuguga

SEQ ID NO: 62299 - RNA, 1233 nt, Artificial Sequence
  derived and/or modified sequence opt3 from SELENBP1__Homo_sapiens__NP_001245217
auggccaccaagugcggcaacugugggcccggauacagcacaccucuggaggcuaugaaagguccaagagaagagaucguguaucucccgugcauuuacaggaauacuggcacggaagcacccgacuaucuugccaccgucgauguugacccuaaguccccacaguacugucaagugauagagcccaaagauauccacgcgaagugcgaacuggcuuucuugcauacaucucacuguuuagccucaggggagguaaugauuaguagccugggagacgugaaaggcaacgguaaagggggauuuguccuacucgauggcgagacuuucgaagugaagggcaccugggagcggccugggggagcagccccacuggguuaugacuuuugguaccagccccgccauaauguuaugaucuccacagaaugggcugcaccuaacgugcuucgagauggcuucaauccagccgacgucgaggcugggcuguauggaucucacuuguacgugugggauuggcagcgucaugagauuguacagacccucucgcugaaggacggccugaucccgcucgaaauaagauuuuuacacaaccccgaugccgcgcaagguuucguugggugcgcacugucaagcacuauccagagguuuuacaagaaugagggaggcacauggaguguggaaaaagucauucaggugccuccaaagaaagugaagggcuggcuuuugcccgagaugccugggcugaucaccgacauucuacucucccuggaugaccgguuccuuuauuuuucuaacuggcugcacggagacuugcgccaguacgauaucagcgacccacaaagacccaggcucacgggucagcuguucuuaggcggguccauagucaagggaggcccgguucaggugcuggaagaugaggagcucaaaucacagccugaaccccuuguagugaaggguaaacgggucgccgggggcccacaaaugauucagcugaguuuggacggaaagcgccuauauaucacuaccagccuguacucugcuugggauaaacaguuuuauccugaccucauucgagagggcuccgugaugcugcaaguugauguggacacagucaaagggggacuuaagcugaaucccaacuucuugguggauuuugguaaggaaccacucggccccgcccuggcacaugaguuaagauacccugggggagacuguucaagcgauaucuggaucuga

SEQ ID NO: 62300 - RNA, 1158 nt, Artificial Sequence
  derived and/or modified sequence opt3 from SELL__Homo_sapiens__NP_000646
augggcugcagaaggacccgggaggggcccagcaaggccaugaucuucccuuggaaaugucaguccacacaacgcgaccuguggaacauuuuuaagcucuggggauggacuaugcuuugcugugauuuccuggcucaccaugguacggacugcuggaccuaccacuauucugaaaaaccaaugaauuggcagcgagcacguagauuuuguagggauaacuacacagacuugguggccauacagaauaaggcggagaucgaauauuuagagaaaacucugccguucucacggaguuacuauuggauuggcauccgcaagauugggggaaucuggaccugggucggcacaaacaagagccuaaccgaagaggcugagaauuggggugauggggaacccaacaauaaaaagaacaaagaggacugcguugaaauauacaucaagagaaauaaagaugccggaaaguggaacgacgaugcaugucauaagcucaaagccgcucugugcuauacugcauccugucagccuuggucuugcucgggccacggcgaguguguggagauuaucaauaacuacacaugcaauugcgacguaggguacuauggaccacaaugucaguuugugauucagugcgaaccccuugaggccccugaacuggguaccauggauuguacgcauccauugggcaacuucucauuuagcagucagugcgcuuucuccuguucugaggggacuaaucucaccggaaucgaagagacaacuugcggccccuuugguaacuggagcuccccugagccaaccugucaagucauacagugcgaaccgcugucagcccccgaccuggggauuaugaacuguagucacccucucgcgagcuucucuuuuacauccgcaugcaccuucaucuguucagagggaacggaauuaauuggcaagaaaaagacuaucugcgagagcaguggcaucuggucuaauccaucccccauuugccagaaacuggauaagagcuuuucgaugauaaaagaaggggacuacaacccucuuuucaucccaguggccguuauggugacagcuuucucuggauuggccuuuauuaucuggcuggcaaggcggcuaaagaaggguaaaaaguccaaacgcucaaugaaugaccccuauuga

SEQ ID NO: 62301 - RNA, 2493 nt, Artificial Sequence
  derived and/or modified sequence opt3 from SELP__Homo_sapiens__NP_002996
auggccaacugccagaucgcuauucuguaccaaagauuccagaggguggucuuuggcauaagccagcuccuuuguuucuccgcacugaucucugaguugaccaaucagaaggaaguugccgcguggacauaucacuacucaacuaaagccuauaguuggaacauuagccggaaguacugccaaaaucgcuauacggacuuaguggccauccagaacaaaaaugagauugauuaccugaacaagguacuacccuauuacuccucuuacuauuggaucgggauaaggaaaaauaacaagaccuggacaugggugggaacuaagaaagcacucaccaaugaagccgagaacugggcugacaaugaaccuaacaauaagcguaacaaugaggauugugucgagaucuacauuaaaucgccaucagcaccggguaaguggaacgacgaacauugccugaaaaagaagcacgcccuuuguuauacagcuagcugccaggauaugaguuguuccaaacagggcgagugccuggaaaccaucgggaacuacacuuguucuugcuaucccggauuuuacggcccugagugugaguaugugagagaaugcggugaguuggaacucccacaacauguucugaugaauugcagccacccccuggggaacuucuccuuuaauucacaguguaguuuccauugcacagacggauaccaggugaacggcccuagcaagcucgaguguuuagccucuggcauuuggaccaauaaaccaccccagugccuggcggcacaauguccuccacuuaagaucccggaaagggggaacaugacgugcuugcacuccgccaaggcuuuucagcaccagucaagcuguaguuucucuugcgaggagggauuugcccuggucggucccgaagugguacaauguacugcauccggcguuuggaccgcuccugccccagugugcaaagcgguccagugucagcaucuagaggcccccagcgaagggacaauggauugcgugcacccucucacugcauucgcuuacggaucgucuugcaaauuugagugucagccaggcuaucgggugcgcggucuggacaugcuuagaugcauagauuccgggcauuggucagcuccccugccgaccugugaagcuauuaguugcgagccuuuggagagccccguccacggauccauggacuguucuccaagccucagggccuuccaauacgauacaaauugcucauuucggugugcagaaggcuucaugcugcgcggcgccgacaucguucgaugcgauaacuuagggcaguggaccgcuccugcgcccgugugucaggcacugcagugccaagaccucccaguacccaaugaggccagagugaacuguagucacccuuucggagcuuuuagguaucaguccgucugcagcuucacgugcaaugaaggucuucuguuggugggcgccucuguucuacagugucuggcaacugggaacuggaacucagugccaccggagugccaggccauucccuguacaccucuccugaguccacaaaauggaaccaugacuugcguccagccccuuggcagcuccucuuacaagucgacaugucaguuuaucugcgacgaagguuauagccuguccgggccugagcgguuggauuguacccguucaggccgcuggacggacaguccacccaugugcgaggcuaucaaguguccggaacucuucgccccugagcagggaucucuggauugcagcgacaccagaggcgaauuuaaugugggguccacaugucauuucucaugcgauaacggauuuaaauuagaggguccaaacaauguagagugcacuaccagcggccgauggucugcaacacccccuacuuguaaggggauugcgucccugcccaccccaggaguucaaugcccugcucuaacaacccccggccaggguacuauguacugucggcaccauccagggacguucggcuuuaacacaaccugcuauuucggauguaaugccggcuuuacucucauaggggacaguacccugagcugccgaccgucuggacaguggacagcagugaccccugccugucgcgcugucaaaugcuccgaacuucacgugaacaagcccaucgccaugaauuguucaaacuugugggguaauuucaguuacggcagcauuugcucguuucauugucuggaggggcaacuccugaacggauccgcacagacugcuugccaggaaaauggccacuggucuacaacggucccaaccugccaggccgguccccuuacuauccaagaggcgcugacauacuucgggggcgccguggcuagcaccauaggauugauuaugggcgggacacuccuggcauuacugagaaaaagguuccggcagaaggaugacggaaaguguccucuaaacccacacucacaucucggcacuuaugguguuuuuaccaaugccgcuuucgaucccaguccuuga

SEQ ID NO: 62302 - RNA, 1287 nt, Artificial Sequence
  derived and/or modified sequence opt3 from SELPLG__Homo_sapiens__NP_001193538
auggccgugggcgcuagcgggcuggagggagacaagauggccggugcaaugccccuccagcuucuguuguuacugauccuacucggcccugggaacucccugcaacuuugggauaccugggcggacgaagcugagaaagcccugggaccauugcucgcaagagauaggcggcaggccacagaauacgaguaucuggacuacgauuuccugccggaaacugagcccccugagaugcuccgcaauucuacggacaccacaccauuaacuggccccgguaccccugaaucaacaaccgucgagccagcugcacgacguaguacugggcuggaugccggaggcgcuguuacagaacuuaccacggaguuggccaacaugggcaaucugagcacugacuccgcggcaauggagauucagaccacacagcccgccgcuacugaagcccaaaccacacagccugugccaaccgaggcacagacgacuccgcuagcugccacagaagcgcagaccacuagacucacagccaccgaggcacaaacgacaccccuggcugccaccgaagcucagacuaccccuccagccgcaacagaggcccagacuacccagcccacagggcuugaggcucaaaccacugcgccugcagccauggaagcucagacgacagccccagcagccauggaggcucagaccacucccccggccgcaauggaagcgcaaaccacacagaccacugcuauggaggcccagacaacggcaccugaagccaccgaggcucagacuacacaacccaccgccacagaggcacagacuaccccacuggcugccauggaagcguugucuacggagccuucggccaccgaagcucucucaauggagcccacaacuaagaggggacuguuuauaccauucagcguaaguuccgugacccacaaagguauccccauggcagccucuaacuuaagcgucaauuauccugugggcgcuccagaucauauuuccguuaagcagugccugcucgccauccuuauucuggcauugguggcgacaaucuuuuucgucuguacugugguacuagccguucggcugucacgcaaagggcacauguacccggugagaaacuauagucccaccgaaauggucugcauaagcucucuccugccugacggaggcgaggguccauccgcuacggccaaugggggacuuucaaaggcaaagagccccggccugacaccugagccaagggaagaucgggagggcgacgauuugacccuccauaguuuucugcccuga

SEQ ID NO: 62303 - RNA, 2316 nt, Artificial Sequence
  derived and/or modified sequence opt3 from SEMA3A__Homo_sapiens__XP_006715902
augggcuggcugaccagaaucgugugccucuucuggggaguccuucugacagccagggcuaacuaccagaaugggaagaacaauguuccccgguugaaauuaagcuauaaggagaugcuggaauccaacaaugugauuacuuuuaacggucuagcaaauucuucaaguuaccacacguuccuccuggacgaggaacgcagccgacuuuauguaggcgccaaagaucauauauuuuccuucgaccuggugaacaucaaggauuuucagaaaauugucuggccugugucuuacacccguagagacgaguguaagugggcggggaaggauaucuugaaagaaugcgcuaauuucauuaagguucucaaagccuauaaccaaacacaccuguacgcauguggaacuggcgccuuucauccaaucugcaccuauauagagaucggucaccauccggaggacaauauuuucaagcuggaaaacucgcacuuugagaaugggaggggaaaaucacccuacgauccuaagcucuuaacagcuagccugcuuaucgacggcgaauuguacaguggcaccgcagccgauuucauggggcgggacuuugcuauuuuccgcacucugggacaccaucacccaaucagaacagagcagcaugauuccagguggcuaaacgaccccaaguuuauaucugcccaccucauuagcgaguccgauaauccugaagacgacaaaguguauuucuucuuucgggagaacgcgaucgauggugaacacucaggcaaggcaacccaugcccgcauugggcagaucuguaaaaacgacuucggaggccaccgaagucuggucaauaaguggacgacuuuucuuaaagcuagacugaucugcagcgugccaggucccaacgggauugauacccauuucgacgaguugcaagauguauuucucaugaauuucaaggacccuaaaaacccaguuguguacggagucuuuacaacuucuuccaauauauucaagggcucagccguguguauguauagcaugagugaugugaggcgggucuuucugggcccguacgcacaccgugacgggcccaacuaucaguggguuccuuaccagggacgcgugccauaucccagaccugguaccugcccaucuaagacauucggcggguuugauuccaccaaagacuuacccgaugacguaaucacguucgcuaggagccauccggccauguacaauccuguguuucccaugaacaaucggccaauugucaucaagacugacgugaacuaccaguucacacaaauaguuguggaucgagucgacgcggaagauggacaguaugacgugauguucauuggcaccgauguagguacuguucugaaaguggucucgaucccuaaggagacaugguacgaccucgaggaagugcuucuggaggaaaugaccgucuuucgcgagcccacggccaucucugcaauggaauuguccaccaaacagcagcaacuauauauugggucaacagcuggcguggcccagcugccacuccacagaugugauaucuacggaaaggcuugcgccgaguguugccuggcaagggaccccuauugcgccugggauggcagugcuuguagccgguacuucccuacugcgaagcgcagaaccaggcgucaggacauucggaauggggauccacuuacacacugcuccgaccugcaucacgauaaccaucacggacacucuccggaggaacgaauaaucuaugguguugagaauagcucaacuuucuuggaauguagucccaaaucccaaagagcacucguguacuggcaguuccagaggcgcaacgaggaacggaaggaggagauuagaguagacgaccauaucaucaggaccgaucagggccuguuacugcgcagccuacaacagaaagacucugggaauuaccucugccacgccgucgaacauggauuuauucagacacugcuuaaggugaccuuggagguuauagauacugaacaccuggaggagcuccugcauaaagacgaugacggcgaugguucaaagacgaaggaaaugaguaacagcaugacaccuucccagaaagugugguaucgagacuucaugcaacuuaucaaccacccaaaucugaacaccauggaugaguuuugugaacaggucuggaagcgggaccguaaacagagaaggcagcgccccgggcacacuccuggcaauucuaacaaguggaaacauuugcaagagaauaagaagggacggaacagaaggacccacgaauuugagcgagcuccacgcucgguguga

SEQ ID NO: 62304 - RNA, 2250 nt, Artificial Sequence
  derived and/or modified sequence opt3 from SEMA3B__Homo_sapiens__NP_001276989
augggcagagccggggcugcagccgugauccccggacuggcgcuccuuugggcugucggucugggcagcgccgcaccuuccccaccgagguugcgguuaucuuuccaggagcugcaagccuggcacgggcuacagaccuuuucacucgaacgcacaugcuguuaccaggcucugcuuguugacgaggaacgaggacgucuguucgugggcgcagagaaccauguagccaguuugaaucucgauaacauuagcaagagagcuaaaaagcuggccuggcccgcgccuguggaauggagggaggagugcaauugggcagguaaagacauagggacugaauguaugaacuuugucaagcugcuccacgccuauaaucggacgcauuuacuggcuugcggaaccggcgccuuccacccaacaugugcauuuguggagguuggccaucgcgcugaagaacccgugcuuagauuggauccugggaggaucgaggacggaaaagguaaguccccauacgauccccggcaccgcgccgcgucuguccuggugggcgaggagcuauauucggggguagccgcagaccucaugggacgagauuucacuauuuuuagaucacugggccagaggccuagccuucggaccgaaccacacgacagucguuggcugaacgagccgaaguucguuaaaguguuuuggauccccgaauccgagaauccugaugacgauaagauuuacuucuuuuuccgcgagacagcugucgaagccgcuccagccuuggguagacucucugugagcaggguggggcaaaucugccggaacgacgucggaggccagcgaucccugguuaauaaauggaccacguuuuuaaaggcacgccugguguguucaguacccggcguggagggggauacacauuucgaccagcuccaggacgucuuccuucugaguagcagagaucacaggaccccuuugcuauaugccguguuuucuacguccucaagcauauuccaaggaagugcuguuugcguguacucuaugaacgacguccggcgcgcguuucuggguccauucgcacauaaagaaggccccaugcaccaguggguguccuaucaggggagaguaccguacccuaggcccggaauguguccaagcaagacuuuuggcaccuucucgucuacaaaggauuuuccugacgauguuauccaguucgcccguaaucacccccucauguacaacuccgugcugccaacuggugggcggccccuuuuucugcaagucggcgcuaauuauaccuucacacagauugccgcagaccgaguggccgcugccgauggacauuacgacgucuuguuuaucggcaccgauguggggacgguucucaaagugauuucaguaccuaagggaaguagaccaagcgcagagggucuguuacuggaggaacuacacgucuucgaggacuccgcggcugugacuucuaugcagaucagcucaaaaaggcaucaacucuauguugccagucgcuccgcaguggcccagauagcucugcaccggugcgccgcacauggcagagucuguacagaaugcugccuugcuagggauccguacugugccugggacgggguggcgugcacccgcuuucagcccagcgccaagcgacgguuccguagacaggacguaaggaacggagauccuucuacuuuguguucaggcgacaguagccgcccagcucugcucgagcacaaaguguucgguguugaaggguccucugcauuucuggagugcgaaccccggucgcuucaagccagagucgaguggacauuccagagggcuggcgugaccgcccacacucaggugcuggcagaggaacgaaccgagcgcacagcgcggggauugcuccugagaagguuacgucgccgggauagcggcgucuaucugugugccgcuguugaacagggguuuacucaaccucuaagaaggcucucccugcaugugcuuucagccacccaggcagagcgauuggcucgggccgaggaagcagccccagcugcgcccccgggaccuaagcugugguaccgcgacuuccuccagcugguggagccagguggcgggggaagugccaauucuuuaagaaugugcaggccccagccugcacugcaaagccuucccuuggaaucccggcgaaaaggcagaaaccgcaggacacacgcuccagagccucgugccgaacggggucccagaucagccacucauugguga

SEQ ID NO: 62305 - RNA, 2256 nt, Artificial Sequence
  derived and/or modified sequence opt3 from SEMA3C__Homo_sapiens__NP_006370
auggccuucagaaccaucugcgugcuggucggcguuuuuauuuguagcauaugcgugaagggguccucucagccccaagcuaggguauaccucacauucgacgagcuucgggaaacuaaaacgucagaguauuuuagucugagccaccauccuuuggauuaccgcaucuuacugauggacgaagaucaggaccgaauuuaugugggauccaaggaucacauccuaucucucaacauuaauaacaucucgcaggaggcacugucagucuucuggccagccagcaccauaaaaguggaagaguguaagauggcggguaaagacccgacacauggcugcgggaauuuuguucgugugauccagacuuucaacagaacccaccuuuacgucuguggaaguggcgcuuuuucccccgugugcacauaucugaauaggggucggcgcucugaggaucaaguauucaugauugacagcaagugugaauccgggaagggaagaugcucauuuaacccuaauguuaacaccgugagugucaugaucaaugaggaauuguucagcggcauguacauugauuuuaugggcacugacgccgcaaucuucaggucucucacaaaacggaacgccgugcgcaccgaucagcauaauuccaaguggcugucagagccaauguuuguggacgcucacgucauacccgaugggacggacccuaacgacgcaaaaguuuauuucuucuuuaaggagaaacugacugauaauaaccgaagcaccaagcagauucacaguaugaucgccagaauuuguccaaaugacacaggaggucucaggucuuuagugaacaaguggacuaccuuccugaaagcucggcuuguaugcuccgugacagaugaagacggccccgagacccauuuugaugaauuggaggacgucuuccugcuagaaacggauaacccucguacuacacucguguacgggaucuuuaccacuagcucgucuguuuucaagggauccgccgugugugucuaccaccugucagacauccagacaguguuuaauggcccauucgcgcauaaagaggguccgaaccaccaacuuauuaguuaucaggggcgcauacccuacccuagaccaggaaccugccccggcggcgcauuuacgccuaauaugaggaccacaaaggaguucccagaugacguaguuacuuuuauccggaaccacccccugauguauaauagcauuuacccgauccauaaacgaccuuugauagugcgcauugggaccgauuauaaguacacaaaaaucgccgucgacagagugaacgcugccgacggaagguaucacguccucuuccuggguacugaucggggcaccgugcagaagguugugguauuacccacaaauaacuccgucucuggggaacugauccucgaggaacuugagguguuuaagaaucaugcaccaauuaccacuaugaaaaucagcucaaagaaacagcaacuguacguuaguuccaacgaaggagugagccaggucucuuugcaccgcugccauauuuacggcacggcuugugccgacugcugucuagcgagagauccuuauugcgccugggacggucacucauguaguagguucuaccccacagggaagcgucggagccgaagacaggaugugaggcacggcaauccacugacccaaugccgcggauucaaccucaaagcauaucggaaugcugccgagauaguacaguacggcgugaagaacaauacuaccuuucuggagugugcucccaaguccccucaggccucuaucaaauggcuucugcagaaggacaaagauagaaggaaggaaguuaaauugaacgagcgcauuaucgcaacaucgcaagggcuccugauccgaagcguccagggauccgaccaggguuuauaucauugcauugccaccgaaaacucauucaagcagacuauagcuaagaucaauuuuaaagugcuggauagugagaugguggcggucguuacagacaaguggucuccauggacgugggcaagcuccgugcgggcccuaccguuccaccccaaagauauuaugggcgcuuuuucacauagcgaaaugcaaaugaucaaccaguacuguaaggacacccgucagcagcaccaacagggggaugagucucagaaaaugagaggagacuauggcaagcucaaggcccugauuaauuccaggaaaagucgcaaccggagaaaucagcuuccugagagcuga

SEQ ID NO: 62306 - RNA, 2334 nt, Artificial Sequence
  derived and/or modified sequence opt3 from SEMA3D__Homo_sapiens__NP_689967
augaacgccaauaaggacgagagacugaaagcuaggagccaggauuuccaccucuuucccgcacuuaugaugcuguccaugaccauguuguucuuaccugugacaggcacucugaagcaaaacaucccacggcuaaaacucacguacaaggaccugcuucugucuaauucaugcauuccguuuuuggggaguagcgaaggacucgauuuccagacccugcugcucgacgaggaacgcggucgauuacugcuuggcgccaaagaucauauauuuuugcugucccuagucgaccucaacaagaauuucaagaaaaucuauuggcccgcggcuaaggagcguguugaacuguguaaacuugccgggaaggaugcaaacacagagugcgccaauuuuauuagagugcugcagccuuacaacaaaacucacaucuauguauguggaaccggcgcuuuccauccaauuugcgguuacaucgacuuggggguguauaaggaggauauaaucuuuaagcucgacacacacaaucuggaaucuggaagguuaaaaugucccuucgauccucagcaaccauuugcaucggucaugaccgacgaguaccuguauucaggcacugccagcgauuuccucggcaaggacacagcuuuuacccggagucuugggcccacgcaugaccaccacuacauucgcacugauaucuccgaacauuacuggcugaacggagccaaauucauugguaccuucuuuaucccugacacauauaauccagaugacgauaagauauacuucuuuuucagagagucuagccaggagggcuccacuucagacaaaaccauuuugaguaggguggggcggguuugcaagaacgaugugggaggccagcgcagccuaaucaauaaauggacaaccuuucugaaggcgcgacucauuuguucuaucccggguuccgacggggcagauacguauuucgacgaacugcaggauaucuaccuucugcccacuagagacgagaggaacccugucguguauggaguauuuacaaccacuucaagcauuuucaagggcagugccguuugcguguacucuauggcugacauacgggccgucuuuaauggcccauaugcacacaaagaauccgcugaucaucguugggugcaauacgacgggcgcauccccuacccuagaccaggaacaugucccagcaagaccuaugauccguugauuaaaucgacgagggacuucccugaugacgugaucucuuuuauaaagcggcacuccgucauguacaaaucaguuuaucccguggccgguggcccaaccuucaagcgaauuaacguagauuaccgccucacacagaucguggucgaccacgugaucgcggaggaugggcaguaugacguuauguuucugggaacugauauuggcaccguguuaaaggucgugaguaucagcaaagaaaaguggaacauggaggagguaguucuggaggaacuacagauuuucaaacauuccucuauaauccucaauauggaacugagccuuaagcaacagcaguuguacauugguucaagagacgggcuggugcaacucagucugcacaggugcgauacauauggcaaagccugugcagacugcugccuugcucgggacccuuacugugccugggauggaaacgcuugcucccgcuacgcccccacuagcaagagaagggcacgucggcaggacgucaaguauggcgauccaaucacccaguguugggacaucgaggauucuauuucacaugaaacagccgacgagaaagugauauucgggaucgaguuuaauaguaccuuccuggaaugcauucccaagagccagcaagcuacuaucaaaugguacauucagcgauccggagaugagcacagagaagaguugaagccugacgaaaggaucauaaaaacggaguauggucuccugauccgcucuuuacagaagaaggauucgggcauguacuauuguaaagcgcaggagcauacauuuauucacaccaucgucaagcugacucuaaacgugauugaaaaugagcaaauggaaaacacccagcgggcagagcacgaggaagggaaaguuaaggaccuccuggccgagagcagacuuagguacaaagauuauauccagauauuguccucaccaaauuucagucuggaccaguacugcgaacaaauguggcaucgcgagaagcgacggcagcguaacaaaggaggcccgaaguggaagcacaugcaggaaaugaaaaagaaaagaaauaggcgccaucaccgggaucucgacgagcugcccagagcuguggccacauga

SEQ ID NO: 62307 - RNA, 2148 nt, Artificial Sequence
  derived and/or modified sequence opt3 from SEMA3E__Homo_sapiens__NP_001171600
augcugcucgacgaguaccaggaaagacuuuucgugggcgggagggaucuggucuauagcuuguccuuagagcggaucucugacggauacaaggaaauucacuggcccucaaccgcccugaaaauggaggaaugcauaaugaaggguaaagaugcuggcgagugugcaaacuauguucgcgugcuacaucacuacaaucgaacacaucuccugacuugcgggacgggagccuuugacccuguaugugcguucauccgugugggcuaucaccuugaggauccacuguuucauuuggaaaguccgagaagcgagaggggucgggggcgcugccccuucgacccuuccucuucguuuauuucaacccucaucggaagcgaacuguucgcuggccuguacagugauuauugguccagagacgccgcaauuuuuaggucuaugggccggcucgcccacauccgcacagagcacgaugacgagcgauuacugaaggaaccaaaauucgucgggagcuacaugauacccgauaacgaggacagagaugacaauaagguguacuuuuucuuuacugaaaaggcucuugaggcagaaaacaaugcccaugcuaucuauaccaggguuggacgguugugugugaacgacgucgguggccaacguauucuggugaauaaaugguccacauuccuaaaggcccgccucguaugcucaguuccugggaugaacggaaucgauaccuacuuugacgagcuggaggauguguuccuucugccaacuagagaccacaaaaaucccgucauuuucggcuuguuuaacacaaccaguaauaucuucaggggucaugcgauauguguguaucacaugagcucuauucgggcagccuuuaacgggccuuacgcucacaaggaaggaccagaguaucauugguccguguacgaaggcaaagucccguauccccgaccuggcucaugcgccagcaagguuaaugggggacgcuacgguacgacuaaggauuacccagacgaugcaaucagauucgcuaggagucacccccucauguaucaggccauuaaaccugcgcauaagaaaccaauccuggugaagaccgacggcaaauacaacuuaaagcagaucgccguagaucggguggaggcagaagacgggcaguaugauguccuguuuauuggaacagacaauggcauagugcucaaaguuaucacuauuuacaaccaagagauggagucuauggaagaggugauccuugaggaacugcagauauucaaggaccccgucccgauuaucuccauggaaaucagcucgaagcgccagcaguuguauauugguucugcuuccgccguggcucaaguaagauuucaccauugugauauguacgggucagccugcgcagacuguugccuagccagggauccuuauugcgcuugggacggcaucaguuguagccguuacuaccccaccggaacacacgcgaaacggcgauucagaaggcaggauguucgccacggcaacgcagcccagcagugcuuugggcaacaguucgugggagacgcucuggauaagaccgaggagcaucucgccuaugguauugaaaauaacuccacgcugcuugaguguacuccacggucucugcaggcaaaagucauaugguuugugcaaaagggcagagaaacaaggaaagaggaggucaagaccgacgaucgcgugguuaagauggacuuggggcuccuguucuuacgacugcacaaaagcgaugccggaacuuacuuuugccagacaguggaacauucauucguacacaccguccggaagaucacgcuagaggugguugaagaggaaaaaguggaggacauguucaauaaggaugacgaggaagaccgucaccauagaaugccuugucccgcucagaguuccauuagccagggcgccaaaccaugguauaaggaguuucuccaacugaucgguuacucuaacuuccagagggucgaagaguauugcgaaaaggugugguguaccgaucgcaaacggaagaaacuuaagaugucacccaguaaauggaaguacgcaaauccucaggagaagaaauugagaagcaagccagagcacuauaggcugccgcgacauacacucgacuccuga

SEQ ID NO: 62308 - RNA, 2358 nt, Artificial Sequence
  derived and/or modified sequence opt3 from SEMA3F__Homo_sapiens__NP_004177
augcuggucgccggccuccuucugugggcuagcuuguuaaccggggcauggcccuccuucccuacacaggaccaucugccagccacuccgagagucaggcuaucuuucaaggagcucaaagcgacgggaaccgcucacuucuuuaacuuccugcuuaauacaacugauuaccggauccuguugaaggacgaagaucacgaccgcauguauguugguucaaaagauuacgugcucagucuggaccugcaugauauuaaccgagagccccucauaauccacugggccgcaagcccucaacguauugaagagugcguauuauccggcaaggacgugaauggggaauguggaaacuuugucagacugauccagccauggaauaggacccaucuuuaugugugcggcacaggugccuacaaccccauguguaccuauguuaaucgggggcgcagagcucaggcaacuccuuggacacagacccaagccgugaggggacggggcucucgcgcuacggauggcgccuugcgaccaaugcccacugcgccuagacaggacuacauuuucuaucuggagccagagaggcuagaaucggggaaaggaaagugcccguacgaucccaagcucgacaccgcaucagcccugaucaacgaggaacuuuacgcuggugucuauauagauuuuaugggcacagacgccgcaaucuuccggacucuggggaaacagaccgcuaugcguacagaccaguacaauagccgcugguugaacgauccuaguuuuauucacgccgagcucaucccagacuccgcggagagaaaugaugacaagcuguauuucuuuuucagggaacggucugccgaggcaccccaaagcccugcuguguacgcccgaauuggacgcaucuguuuaaacgaugacggcggucacugcugucugguaaauaaaugguccaccuuucucaaggcuagacuuguuugcucagugccaggggaagauggaauagagacgcauuucgacgaacugcaggaugucuucgugcagcagacucaagacgugaggaaccccgucauuuaugccguuuuuacaaguagcggcucuguguuccggggcuccgcaguauguguguacucaauggccgauauccgcauggucuuuaaugggccguucgcucacaaagagggaccuaacuaucaguggaugcccuuuagcgguaagaugccauacccuagacccgggaccugcccaggcggaacuuucacacccaguaugaagucuaccaaagacuacccugacgaggugauuaacuuuaugaggucccauccauugauguaucaggcgguuuacccgcuacaacgucggccccuggugguccgaacgggcgcaccuuauagacucaccacaaucgccguggaucagguagacgcugccgaugguagguacgaaguucuguuccuugggacugaccgcggcaccgugcagaaggucaucgugcugccaaaagaugaccaggaguuggaggaacucaugcuggaagaggucgagguguuuaaggaucccgcaccuguuaaaacaaugacuauuagcucgaagcggcaacaguuauauguggccucugcuguaggagucacccaccugucccuacacagaugucaggccuacggcgcagcgugcgcugacugcugucucgccagggauccauauugcgcaugggacgggcaggccuguucacgcuacacagcuaguagcaaacgacggucccguagacaagaugugaggcauggaaaucccauacgccagugccgggguuucaacucuaaugccaacaagaaugcaguugaaagcgugcaguacggcgucgcugggucagccgcguuucuggagugucagccgagaaguccucaagccaccgugaaguggcuuuuccagagggacccaggagaucgacgccgggaaaucagagcugaggacagguuuuugcguacugaacagggccugcuccugcgcgcacuucagcuguccgaccgggguuuguauagcugcacggccacagagaacaauuucaaacacguagugaccagaguucaacuccauguccuggggagggaugcugugcacgccgcauuauuucccccucugucuaugucagcgcccccaccucccggcgccggaccaccgacuccucccuaccaggagcuagcucagcuccuggcccaaccagaagugggccuuauucaucaguauugucagggguacuggcgacacgugcccccuaguccacgggaggcacccggagcuccucgcagcccggaaccacaggaccaaaagaaacccagaaacaggcggcaccauccuccagauaccuga

SEQ ID NO: 62309 - RNA, 2349 nt, Artificial Sequence
  derived and/or modified sequence opt3 from SEMA3G__Homo_sapiens__NP_064548
auggcccccagcgcuugggcaaucugcuggcugcucggcgggcuucuguugcacggagguuccucuggcccuucaccagggccgagugugcccagauuaaggcugagcuaccgggaccuacucuccgccaaccgcucugcgauuuuccugggaccucagggcucgcuuaaucugcaagcuauguauuuggaugaguaccgagaccgucucuuucugggugggcuggaugcccucuauucauuaagacuggaccaggcauggccagaucccagggaaguccuuuggccuccacagcccggacagcgggaggaauguguucgcaagggcagagacccuuugaccgagugcgccaacuucgugaggguacugcaaccacauaaucggacacaccuacucgcuuguggcacuggggcauuucagccgacgugcgcccugauaaccgugggacaucgcggugaacacguccuucaucuggagcccggcagcguggagagugggcgaggaagauguccucacgaaccauccaggcccuucgcuucuacauuuaucgauggcgaguuguacacuggucucaccgccgacuuccuggggcgggaagcgaugauuuuucguagcggaggcccucgcccagcauuaagauccgauucagaccagagucugcuccacgaucccagguucguuauggccgcucggaucccggagaacagcgaccaggauaaugacaaaguguacuuuuucuuuucugagacagucccuucccccgacggcgggucaaaccaugugaccguaagccgaguuggacgcgugugcgucaaugaugccgguggccaaagagugcuugugaacaaguggaguacuuuccugaaagcaagguuggucuguucuguuccagggccuggaggcgcugaaacacacuuugaccagcuagaggauguguuccugcucuggcccaaggccgguaaaucccuggaaguauaugcgcuuuucagcaccgugucggccgucuuucagggguucgcagugugcguuuaucauauggcugacauuugggagguguuuaauggcccauucgcccaccgggauggaccccagcaccaauggggcccuuacgggggaaaggucccauuuccgcgccccgguguguguccuucuaagaugacggcucagccaggcagacccuucggguccacuaaagacuacccugaugaaguacugcaguuugccagggcacauccauugauguucuggcccguucguccgcggcacggacgaccugugcucgucaagacccaucuggcccaacaguuacaccagaucguggucgacagaguggaggcugaggauggcacauaugacguuauauuucuggguacugauucagggagugugcuaaaaguaaucgcgcuccaggcaggcggaagcgccgaaccagaggaagucgugcuggaggaacuucaaguuuucaaggugcccaccccuauuacagagauggagaucuccgucaaaaggcagauguuguacgugggcucucgccuggggguagcucagcuccggcugcaucagugcgaaaccuauggaacggccugugcagagugcugccuugccagagaccccuacugugcuugggacggugccagcugcacucacuauaggccaucacugggcaagcgccgauuucggcgucaagauauuagacacgggaacccugcauugcagugucucggacagagucaggaagaggaagcggugggccugguugcugccacaauggucuacgguaccgagcauaauuccacuuucuuagagugccugcccaagagcccacaagcagccgugagguggcuacuccagcgcccgggggacgaaggcccugaucaggugaaaacagacgagcggguccugcacaccgaaagaggacuuuuguuuaggcgacugucucgcuucgaugcuggcacguauaccuguacaacucucgagcauggguucucacagaccguugugcggcuggccuuagugguaaucgucgcaagucaacuggacaaccuuuuucccccagagcccaagccugaggaaccacccgcuagaggaggcuuggccagcacaccuccgaaagcgugguacaaggauauacuccagcugauugguuucgccaaucuaccaaggguggacgaauacugcgagcguguuuggugucgcgggacuaccgaaugcuccggauguuuucggucuagaucgaggggcaaacaggcucgagguaagagcugggcaggccuggagcucgggaaaaagaugaagucccgggugcacgccgagcacaaccgcacacccagagaagucgaggcuaccuga

SEQ ID NO: 62310 - RNA, 1890 nt, Artificial Sequence
  derived and/or modified sequence opt3 from SEMA4A__Homo_sapiens__NP_001180231
augauccccuggccugccagcgacagaaagaaauccgagugcgcuuucaagaaaaagucuaacgaggaacugcaggauucauaccuccuuccaauuagugaagacaaagugauggagggcaaggggcaaagcccguuugaucccgcacacaagcauaccgccguccugguugacggaauguuguauuccgguacaaugaauaacuucuuaggcucugaaccuauacugaugaggacucuagggucgcagccagugcucaaaacggauaauuuucugcgguggcuucaccaugacgcgucauucguagcugccauccccagcacccagguggucuacuuuuucuuugaggagacagcaagugaauuugauuucuucgagcgccugcacacuucccgaguggcccguguuuguaagaacgacgugggaggcgaaaaauugcuccagaagaaauggaccacauuucugaaggcucaacugcucugcacccagccuggucaguuaccauucaaugucauuagacaugcagugcugcuucccgccgauucuccuacugcuccacacaucuaugccguauuuacaagccaguggcaaguugggggaaccagguccucagcggugugugcauucaguuugcuggacauugagcgggucuucaagggcaaauacaaggagcuaaacaaagaaacgagccgcuggacuaccuauagaggcccggagacaaaucccaggccugggucuugcuccgugggaccaucaagcgauaaggcccucacuuuuaugaaagaccacuuccugauggaugaacagguggucgguacaccccuucugguuaagaguggcguggaguacacccgguuggcuguagaaaccgcccaggggcucgacggacauucucaccuggugauguauuuaggcacgacuacagguucccugcauaaagcagucgugagcggggacucgucugcucaccucguugaggagauccagcuuuuuccugauccagaacccgugcgcaaccugcaauuggccccgacccagggagcggucuucgugggcuuuuccggcgggguauggcgaguuccuagagccaauuguucaguguacgagaguugcgucgacugugugcuagcaagggauccccacugcgcuugggacccagaaagccggacuuguugccugcucuccgccccuaaccuuaauucuuggaagcaggauauggagcguggaaaccccgaaugggcuugugccagcgguccaaugucacgcagucugagaccccaauccaggccucagauaaucaaggagguccuggcagugccaaauagcauuuuggagcucccgugcccccaucugucugccuuagcuucauacuauuggagucacggcccugcggcaguuccagaagccagcuccacaguguacaacgggucucugcuacucaucguacaggacggagucggcggucuguaucagugcugggcuaccgagaauggguucucguaccccgugauuagcuauuggguugauucccaagaccagacgcuugccuuggauccugaacuggcaggcaucccacgggagcaugugaaagucccccucacccgagugucaggaggcgccgcucuggccgcacagcagaguuacuggccgcacuuuguaacagugacuguucuuuucgcgcuggucuugucuggggcucucauaauucugguggccagcccuuuacgcgcacugagagccaggggaaaggugcaagguugugaaacccuacggccaggcgagaaagcuccccucucccgcgagcagcaucugcagucaccuaaggaaugcagaacaagcgccucugacgucgaugcagacaacaacugucuugggacugagguugcuuga

SEQ ID NO: 62311 - RNA, 2514 nt, Artificial Sequence
  derived and/or modified sequence opt3 from SEMA4B__Homo_sapiens__NP_064595
augcugagaaccgccaugggccucaggagcuggcuugcugcacccuggggagcccugccuccacggccgcccuuguuacugcuacuccugcuucuguugcuccugcagccuccacccccuacaugggcgcuguccccacgcaucucucuccccuuagggucagaggaacgaccuuuccugcguuuugaggcugaacacauuaguaacuacacugcccuuuugcugagcagagacgguaggacgcuauaugugggcgcacgggaggcccucuucgcucuguccucuaaucuuucguuucugccagggggagaauaccaagaguugcucuggggcgcagaugccgagaagaaacagcagugcucauucaaggguaaagacccgcagcgcgauugucaaaacuauauaaagauccuguuaccccugagcgggagucaucucuuuaccugcggaacagcugccuucuccccuauguguacuuacauuaauauggaaaacuuuacccuugcgagagacgagaaaggcaauguccuguuggaagauggcaaggggaggugcccauucgaccccaacuuuaagucuacagcacucguuguggauggagagcuguauaccgguacuguaagcuccuuccagggcaaugacccugccaucucacggagucagagccuccgcccaacaaaaaccgagucuucccugaacuggcuucaggaucccgcuuuuguggccucagcauacauuccggaaagccuggggaguuugcaaggagacgaugacaagaucuauuucuuuuucucugagacgggccaggaguucgaguuuuucgaaaauacuauagucucccgaaucgcuagaauuuguaaaggugaugaagggggagagagggugcuccagcagcgguggaccagcuuucugaaggcccaauuacugugcucgcguccugacgacggcuuccccuuuaacguucuacaggauguguucacacucucuccauccccucaggacuggcgcgauacucuguuuuacggcgucuucaccucacaauggcacagagggacaaccgaaggaagugcgguguguguauuuacgaugaaagacguucagaggguguucagcggucuuuacaaggaggucaaucgggaaacucagcagugguauacagugacccaucccgugccaacuccccgaccuggcgccugcaucacaaacuccgcacgcgagagaaagauuaauucuagcuugcaacugccagauaggguccucaacuuucugaaagaccacuuccuuauggaugggcagguucggucacgcaugcuguugcuccagccgcaggcuagauaccaaaggguggccguacaucgugugcccggacugcaccacaccuaugacgucuuauuucugggcacgggugaugggcggcuacauaaggcugugaguguuggcccucgagugcacaucauagaagaacuccagauuuucuccagcggacagccaguccagaaucugcuuuuggacacccauagaggccugcucuacgccgcaucucacucaggggugguacaaguucccauggccaacuguagucuguauaggagcugcggagauuguuuacuggcucgcgacccuuacugcgcgugguccgguucuucgugcaaacacgugagccuuuaucagccacaguuggcaacacggcccuggauccaggacauugagggcgccuccgcuaaggaucucuguucagccaguucugucgugagcccguccuucgucccuacuggggaaaaaccaugcgagcaagugcaguuucagcccaacaccguuaauacacuggcauguccucuacugucaaaccucgccacuagacuguggcuuaggaauggagcucccgugaacgccagcgcaucuugccauguauugccaaccggcgaccuguuacucgucgguacacaacagcugggggaguuccaguguuggucccuugaggaaggcuuucagcaacugguggcgaguuacugcccugagguuguggaggauggagucgcugaccagaccgaugaaggcgggagcgugcccguaaucaucucuacuucccgcgugucagccccagcaggagguaaggccaguuggggcgcugaccgaagcuacuggaaagaguucuugguuauguguacgcucuuuguccuggccgugcuacugccggugcuauuccugcuuuaucggcaccguaauucgaugaaggucuuuuugaagcagggggaaugcgcauccguucauccuaaaacaugucccguggugcugccacccgagaccagaccuuuaaacggacucggcccacccucuacuccucuggaucacagggguuaccagagccuuucagacaguccgccagggucccgcguauucaccgagucugaaaagcggccccugagcauucaagauuccuuugucgaggugucaccuguuugcccaagacccagggugcgacuaggcagcgaaauacgcgacagugucguguga

SEQ ID NO: 62312 - RNA, 2589 nt, Artificial Sequence
  derived and/or modified sequence opt3 from SEMA4D__Homo_sapiens__XP_005251711
augagaaugugcacccccaucaggggccugcucauggcccuugcugugauguucgggacagcaauggccuuugcgccuauuccacggauaacuugggagcaccgcgaaguccaucugguucaguuccacgagccggacaucuacaacuauagcgcuuuguuacuguccgaagauaaggacacgcuauacauuggagcccgagaggcaguguuugccguaaaugcucucaacaucucugaaaaacaacaugagguguauuggaaggucucagaggauaaaaaggcaaaaugugccgaaaaggguaagaguaaacagaccgagugccugaauuacauucgugugcuucagccccugagcgcuacauccuuguauguuuguggcacuaacgccuuccagccugcgugcgaccaccucaaucugaccucuuuuaaguuccuggggaaaaacgaagauggaaagggcagauguccauuugaccccgcacauucguacacaucagugauggucgauggugagcucuauagcgggaccaguuacaauuucuuaggauccgagccuaucauaucuaggaacagcucccacucaccacugcggacugaauacgccauccccuggcuuaaugagccuaguuuuguguucgcugacguaauucgcaaaagcccagauucuccggacggcgaagaugacagaguuuacuuuuucuuuacagagguguccgucgaauaugaguucguguucaggguguugaucccccggauugcccgcgucugcaagggcgaucaagggggacugcgaacccuacagaagaaauggacgucauuucucaaggcaagacugaucuguagcaggccugacaguggucuuguuuucaacgugcugcgggacguauuuguguugcguucuccaggccucaaaguccccguguucuaugcucuguuuacuccucaguuaaauaacguugggcuguccgccgugugcgcguacaaucucagcaccgccgaggaagucuucucgcacggaaaguauaugcagucuacaacuguggagcaaucccauaccaaauggguacgcuacaacggcccaguucccaagccgagaccuggugcauguauagauucagaagcuagggccgcuaauuauacaaguagccuuaaccugcccgacaaaaccuugcaguuugugaaggaucacccacuaauggacgauuccgucacgccuauugacaaccggccccgacugaucaagaaagaugugaauuacacucagauugucguggaccgcacacaggcccucgaugggaccguuuacgacgugauguucguaucuacugauagaggagcacugcauaaggccaucagccuugagcacgcuguccacaucauugaagagacacaacuguuucaggacuucgagccagugcagaccuugcuccugucaaguaaaaagggcaacagguuuguuuaugcgggcuccaauagcggggugguccaagcacccuuagccuucugcggaaaacaugguacgugugaagacugcgugcuggcucgggauccuuacugcgccuggucuccaccgaccgcaacauguguagcccuacaccagacugagucacccagucgcggccucauacaggaaaugagcggggacgcuuccgugugcccugauaagucuaagggaucguauagacagcacuuuuucaaacauggcgguaccgccgagcugaaguguagccaaaaauccaaccuugcaaggguuuucuggaaguuucagaauggggucuugaaagcggaaucaccaaaguacggccugaugggacguaagaaccuccugaucuucaaucuuagugagggcgacucugggguguaucagugccugagcgaggaacgggugaaaaacaagacagucuuucagguuguggcuaaacauguguuggagguaaaggucgugcccaaaccuguuguggccccaacucucuccgucgugcaaaccgaaggaucacgaauugcaacaaagguucugguggccagcacccaggguucuagucccccgacuccugcuguacaggccacguccagcggcgcaaucacauuaccacccaagccugcucccaccgggacuucuugugagccaaaaauagucauuaauaccgugccucagcugcacuccgagaagacaauguaccuaaaaucaagugauaacagacuccugaugagccuuuucuuguuuuucuuugugcuguuccucugccuguuuuucuauaauuguuacaagggauacuuacccaggcaaugccugaaauuucgcucggcccuuuugaucggcaagaaaaagccaaaguccgacuucugugaucgggaacagucucucaaagagacccuggucgaaccggguagcuuuucacagcagaacggggagcacccuaagcccgcgcuagacacuggcuaugaaacagagcaagauacgaucaccaguaaaguuccaacugacagagaggauucccagaggauugacgaucugucugcccgcgacaagcccuucgacgugaaaugcgaacucaaguucgcugauagcgacgcagauggagacuga

SEQ ID NO: 62313 - RNA, 1848 nt, Artificial Sequence
  derived and/or modified sequence opt3 from SEMA4F__Homo_sapiens__NP_001258590
augcccgccagcgcugcaagaccuaggccaggcccggggcagcccaccgccuccccuuucccacugcuccuucuggcgguguugucuggacccgucucaggucggguuccucgcagugugccacgaacaagccugcccaucuccgaggcugacucuugccugacucguuuugccguaccucacacguacaacuauucggugcuacucgucgauccagcaucacauacccuguacgugggcgccagagacacaauuuucgcucuuagccugccguuuaguggggaaaggccccggcgcauagauuggaugguuccugaggcacacagacaaaauuguaggaagaaaggaaagaaagaaggcgacuugggugggcggaagacucuccagcagcgcuggaccacauuccugaaagccgaucugcucugcccaggacccgagcauggccgagcuuccucuguguuacaggacgucgccgugcugagaccugaacuuggcgcggggaccccaaucuuuuauggaauuuucagcucccaaugggagggugcaacuaucucagccguaugugcuuuuaggccccaggauauucggacaguuuugaacggcccguuccgugagcugaagcacgacugcaaucgcgggcuaccuguggucgauaacgacgugccccagccaagaccuggagaauguaucaccaauaacaugaagcucaggcauuuuggcaguagccugucucuucccgaucgggugcugacguucauacgagaccacccauugauggaucgccccgucuuuccugccgacggucacccacuccugguuacuaccgacacagcauacuuaagagugguagcucauagggugacuucccugucagggaaagaguaugauguccucuaccuuggaaccgaagacggccacuuacaucgggccgugcgcaucggcgcgcaguugagcguucuagaggaucuggcccucuucccggagccccaaccuguggaaaauaugaagcuguaucacaguuggcuucuggucgggucuagaacagaggugacccagguaaacacgacuaauugcggaagguugcaguccuguagcgaaugcauucucgcacaggacccaguuugugcuuggucguuucgucuggaugagugcguggcccacgcuggugaacaucggggcuuaguccaagacaucgagucugccgauguguccucacugugucccaaagagccuggggaacgaccagucguguucgagguucccguggcaacagccgcucacguaguccuaccgugcaguccuagcuccgcgugggcaucuugcguguggcaucagccaagcggaguuaccgcccucacucccagaagggacggccuggaaguggucgugacaccuggugcuaugggggccuacgcaugugagugccaggaaggcggagccgcucacguaguggccgcauacucacuuguuuggggcagucaacgcgaugcgcccucccgggcucauaccgucggggccggauuggcagguuucuuucugggcauucucgccgcuagccugacgcuuauccugauagggagaaggcagcagcgccgacggcagcgugaguugcucgccagagacaaggugggacuggauuuaggcgcaccaccuucugguaccacaucauauagucaagaucccccaagcccguccccugaggacgaaaggcugccccuagcucucgccaaacgcgggucuggcuucggaggcuuuucgccacccuuccugcuugacccuuguccaagccccgcgcacauucgguugacuggggccccucuggcuaccugcgacgagacauccaucuga

SEQ ID NO: 62314 - RNA, 2109 nt, Artificial Sequence
  derived and/or modified sequence opt3 from SEMA4G__Homo_sapiens__NP_001190173
auguggggcagacuguggccccuccuucugagcaucuugaccgccacagcugugccugggccauccuuaaggcggccgucucgcgagcuggacgcaacuccccgaaugacgauuccuuacgaggagcuaucaggaacccgucacuucaagggucaggcccaaaacuauaguacacuccugcuugaagaggcgagcgcuagacuguuggucggcgccaggggagcacucuuuucccugucugccaaugauauaggggacggcgcucauaaagaaauccacugggaggcaucgccagagaugcagucaaagugccaucagaaagguaagaacaaucagacugaauguuucaaccacguucgguuucugcaacgccucaauagcacccauuuauacgccugcgggacacacgcuuuccagccccugugugccgcgauugaugcagaggccuuuacccuuccuacaaguuucgaagagggaaaagagaagugcccauaugaccccgcuagaggcuuuacuggcuugaucauugaugggggacuguacaccgccacgagguaugaauuucgguccaucccugacauacgccgaucuagacacccacauagccuaaggacugaggaaaccccgaugcacuggcucaacgaugcagaguuuguguucuccguacuggugcgggaaucaaaggcuagugccgucggugacgaugacaaaguguacuauuucuucacagagcgugcgacugaggaaggcagcgggucuuuuacccagucccgcucaagccauagaguugccaggguggcacgggucuguaagggagaucuuggcgguaaaaagauccugcagaaaaaguggacaaguuucuugaaggcucgacucauuugccacaucccccuguacgagaccuuacgcgggguguguucucuggacgccgaaacguccagcagaacucacuucuacgcugccuuuacacucucgacccaauggaaaacucuugaggcaucugccauuugcagguaugaucuggcugaaauccaggcgguauucgcaggaccuuacauggaguaucaggacggcucccggcgcuggggcagauacgaagggggaguuccagaacccaggccugguucauguauaacagacaguuugcguagccagggcuauaauuccucucaagaucuaccaagccuggugcucgacuuugucaagcugcauccccuuauggcccggccgguggugccuacccgagggagaccccuguugcucaaaaggaacauucgcuacacgcaccugaccggaacaccagucacuaccccugcuggccccacauaugauuuacuguuccuagguacugccgacggguggauccauaaggcaguugugcucggcucaggaaugcacauuaucgaggaaacccagguauuucgggagagucaguccguggaaaaucuggucaucagccuuuugcaacauucucuguacgugggcgccccaucagggguuauucagcucccccugaguagcugcuccagauacaggucuuguuaugauugcauacuugcucgcgacccuuacugcggaugggauccagguacacacgccugugcagcggcuaccacuaucgccaaccgaucgcagggcagccggacggcacugauucaggacaucgagcgugggaauagaggaugcgaguccucaagggauacaggccgcgccuugcaagugcacauggguaguaugucuccgcccagcgcuuggccuuguguccucgacgggccagaaacccggcaggaucugugccagcccccuaaaccaugugugcauucccacgcccauauggaggaaugcuuaucagcaggccugcaguguccccacccgcaccuacuccugguacauagcugcuucauaccugcuucuggacuuggcguuccaucccaauugccccacccuauuuggaguagcucucccgccccauguggggaccuguuugugaagucccucggaacuggucagccuggcgaggucagacugcaucacucacccccauuaccgaguugcguggcgcuggucaaccagccuccccauagcccauggucguucuccaggguguga

SEQ ID NO: 62315 - RNA, 3225 nt, Artificial Sequence
  derived and/or modified sequence opt3 from SEMA5A__Homo_sapiens__NP_003957
augaaggggaccugcgugaucgccuggcuguucagcucccucggccuuuggagacuggcucaccccgaggcacagggaacaacucaaugucagaggacggaacauccugucauuucuuacaaagagauagguccaugguugcgggaauuucgcgccaagaacgcgguugacuucucacaguuaaccuuugauccgggccagaaagagcuggugguaggggcucgaaauuaucuauuccgucuccaacuggaagaccuuagucugauccaggccguggagugggagugcgaugaagcaacaaagaaagccuguuacagcaagggaaaguccaaagaggaaugccagaacuauauuagagucuugcucgugggcggugacaggcuguuuacuugugggaccaaugcuuucacacccguuugcaccaaccggucucugucgaaucucacugagauccacgaucagauuucaggaauggcacgcuguccuuacagcccacaacauaacaguacagccuuacugaccgcuggcggcgagcuuuaugccgcgacggcaauggacuuucccgggagagauccugccaucuacagguccuugggaauacugccaccccuacggacugcucaguauaauucuaaguggcucaacgaaccuaauuucgugagcuccuacgacaucgguaacuuuaccuacuucuuuuuccgcgagaaugccgucgaacacgauugcggcaaaacaguguuuucacgagcagcuagaguauguaagaacgacauugggggaagguuccugcuugaggauacuuggaccacauucaugaaagcccggcugaauugcagucguccaggcgaaguuccguuuuauuacaacgaguugcagagcaccuucuuucuccccgagcuggacuuaaucuaugguauuuucacgacuaaugugaacucuaucgcggccuccgcagucuguguguuuaaccugucagcuauagcccaggcuuucagcgggccuuuuaaguaccaagaaaauagucgcucugccuggcucccauaucccaacccuaauccacauuuccagugcggaacaguggaucagggccuuuacgucaaccugaccgagagaaauuugcaagacgcacagaaguuuauucuaaugcacgaaguugugcagcccguaacuacagugccguccuucauggaggacaacagcagguuuucgcacgucgccguggauguugugcagggccgggaagcucugguccauaucauuuaucucgcgaccgacuacgggacgaucaaaaaggugcgaguaccucugaaucaaaccucuuccucaugccuucuggaggagaucgaauuguuccccgagcgcagaagggaaccaauucggagucuccagauacugcacagccaguccguuuuauuugugggacugcgcgagcaugucgugaaaaucccucuaaagagaugucaguucuacaggacacguucuacuugcauuggugcacaagaucccuauuguggcugggacgucgugaugaaaaagugcaccagccucgaagagucacugaguaugacacagugggagcaguccaucagcgccuguccaacucggaaccuuaccguugaugggcacuucggaguguggucucccuggacaccuugcacccacacugacggcucagcuguagguaguuguuugugccgaacgagaagcugugauuccccagccccgcagugcgggggcuggcaaugugaaggacccggcauggagauagcaaauugcucuaggaacgggggauggacaccuuggaccucguggagcccaugcuccacuaccugugguauuggcuuucagguccgccagcggucaugcaguaaucccacaccuagacaugggggaaggguguguguuggccagaaccgcgaggaacgauacugcaaugagcaucugcucuguccaccccacauguucuggaccgguugggggccgugggaacggugcacugcccaauguggcggaggcauccaggcucguagaaggaucugcgagaacgggccugacugugccggaugcaauguggaauaucagucuuguaacacaaacccaugccccgagcugaaaaagacgaccccuuggacucccuggacaccagucaauauuagcgauaacgguggccacuacgaacaacgcuuucgguauaccugcaaggcaagacuugcggacccuaaucuguuggagguggggaggcagcgaaucgagaugcgcuacuguuccucagauggaacaagcggcugcucuacugacggucucuccggggacuuccugcgggcuggcagauauagugcccauaccguaaacggagcauggagcgccuggacgucuuggucccaguguucaagggauugcagucguggcauucgcaaucggaaaagaguguguaacaaucccgaaccaaaguacgggggaaugccgugcuuaggcccuagccuggaguaccaggaauguaacauacuacccugcccaguugacggugucuggucguguuggucccccuggaccaaaugcucugcuacaugugggggaggccacuauaugaggacucgaagcugcucaaauccugccccagcauacgguggcgauaucugccucgggcugcacaccgaggaagcucuuuguaacacacaacccugcccugagaguugguccgaguggucugacuggagcgaaugugaggccuccggaguccaggugcgggcgcgccagugcauuuugcuguuuccgaugggcucacaguguagcgggaauacuaccgaaaguagaccaugcguguucgauucuaacuuuauccccgagguuuccguggccaggagcucgucaguggaagagaagcgguguggagaguucaauauguuucauaugaucgcuguaggccucucuaguuccauucuggguugcuuacugacgcuuuuggucuauacauacugucaacgauaucagcagcagagccacgacgcaaccgugauacauccuguuucuccagcuccccucaacacuagcaucacaaaucacauuaacaaacuggauaaguacgacuccguggaagccaucaaggccuucaacaaaaauaaccuaauucuggaggaaagaaauaaguauuuuaacccucaccucaccgggaaaacuuacucaaaugcauacuucaccgaucugaacaauuaugacgaguacuga

SEQ ID NO: 62316 - RNA, 3456 nt, Artificial Sequence
  derived and/or modified sequence opt3 from SEMA5B__Homo_sapiens__NP_001026872
augcccugcggcuucagcccuuccccaguggcccaccaucuggucccggggcccccugacaccccagcucagcaacucagauguggauggacaguugguggcuggcuucugucuuuggugaggggguuacugcccugccuaccuccaggagcacggacugccgaaggccccaucaugguacucgcggguccucuggcugugucacuucuguugccaagucucacgcugcuggucagccaccucuccucuucgcaggaugugucaagcgaaccgaguuccgagcagcaguuaugugcccugucuaagcaucccaccguugcauuugaagaccuucaaccuugggugagcaacuucacauacccaggggcccgcgauuuuucccaguuggcucuggaccccucaggaaaucagcuaauugucggcgcacgaaacuaucucuuccgucugagucuugccaaugugagccuguugcaggcuacugagugggccucuuccgaagauaccagaaggucaugccaaagcaaaggcaagacagaggaggaaugucagaacuacguacggguucucauaguggcggggcgcaaagucuuuaugugcggaaccaaugcauucaguccuauguguacuucuagacagguggguaaccuguccaggacaaucgagaagauuaauggcguggcccggugcccauaugacccccgccacaacagcaccgcugucaucucgucucagggggaauuauacgccgcaacgguuauugauuuuuccggacgagacccggcuaucuauagaucacugggcagugguccuccccucaggacugcccaauacaauagcaaauggcuuaacgagccaaauuucguggcggccuaugauauagggcuguuugcauacuucuuuuugcgggagaacgcuguagaacaugacuguggacguaccguguacucccgcgucgccagagugugcaagaaugauguuggcggcagguuccuacuggaggacacauggacuaccuuuaugaaggcucggcucaacuguucucgaccuggggaagugcccuucuauuacaaugagcugcagagcgccuuccaccuuccagaacaggaucugaucuauggagucuuuacaaccaacgugaacucaauugcagccagugcuguaugcgcguucaauuuguccgcaaucagccaagccuuuaacggucccuuccgcuaccaggagaauccuagagcugccuggcucccaauugcaaacccgauccccaauuuucagugcggcacgcugccugagacugggccaaacgaaaauuuaacagagaggucucugcaggacgcccaacggcuauuccucaugucagaagcuguucagcccgugaccccugagccaugugucacucaggacagugugcgcuuuagccaccuggucguggaucuuguucaggccaaagacacauuguaucaugugcuguacauaggaaccgaauccggcacgauucucaaggcacugucuaccgcgucgagaagccuucacgguugcuaucuggaggaguugcauguacucccaccggggaggcgugaaccucugcgguccuuacgaauccugcacucagcuagagcccuauucgucggccucagggauggagugcugcgcguuccacuugagcggugugcagccuacagaagucaaggcgcuugcuugggggccagggaccccuacuguggaugggaugguaaacagcagcgcugcucuacacuggaagacagcuccaacaugucacucuggacucagaauauuaccgcauguccugugcgaaacgucacacgggauggcggguuuggacccuggagcccauggcaaccuugcgagcaccuggacggcgauaauucugguuccuguuuaugccgugcuagaaguugugacagccccaggccacgcugcgggggccuggauugccuuggaccggccauccauaucgcgaacuguucucggaauggcgccuggacuccuugguccucaugggcuuugugcaguaccagcugugggauuggauuccaggugagacagaggucgugcuccaaccccgcaccacgacacgguggccgcauauguguagggaagucucgggaagagagauuuugcaaugagaacacacccuguccugugccaaucuucugggccagcuggggaucauggaguaaaugcuccucuaacuguggcggugggaugcagagcaggcgucgcgcuugcgaaaauggcaacuccugucucggaugcggcguugaguuuaagaccugcaaucccgaaggguguccugagguccggagaaacacuccguggacgccauggcugcccgugaaugugacacaaggaggcgccaggcaggagcagcgauuccgguuuaccugccgcgcaccucuagcggacccacauggucugcaauucgggagaaggcggacugaaacccgaacaugucccgccgacggaucaggcagcugcgauaccgacgcucucgucgagguucugcuuagaagugguucuacuuccccucacacagugagcggcgggugggccgcauggggaccguggucgucauguucucgcgauugcgaauugggcuucagggugcguaagcggacguguaccaaccccgagccaagaaaugggggacugccuugcguaggcgacgcugccgaauaucaggauuguaacccccaggcaugcccagucaggggugccuggaguuguuggacuuccuggagcccuugcucugcuagcugcgggggaggccauuaccagcgcacacgauccuguaccucacccgcgccaaguccgggugaggacauuugcuuaggccuccacacagaggaagcccugugugcaacucaggcuugcccugagggguggagccccuggucugaaugguccaaauguaccgaugacggagcccaaucaagaagucggcacugcgaggaacuucugccaggcagcuccgccugugcuggaaauucuucgcagagcaggcccugcccuuauucagagaucccagugauauugcccgcauccaguauggaggaagccacggauugugcgggguuuaaccucauucaucugguugcuaccggcaucucuugcuuccuagguagcgggcugcucacacuggccguguaccuuuccugucagcacugccaacgccagucacaggagucuacuuugguccauccugcaaccccgaaucaucugcacuauaagggaggcgguacacccaaaaacgaaaaguacacucccauggaguuuaaaaccuuaaauaagaacaaucucaucccugacgaucgugccaacuucuauccccugcagcaaacgaacguguacacaaccacuuacuauccaagcccucuuaauaaacacaguuuuagacccgaggcuuccccaggccagcggugcuucccuaacagcuga

SEQ ID NO: 62317 - RNA, 3144 nt, Artificial Sequence
  derived and/or modified sequence opt3 from SEMA6A__Homo_sapiens__NP_001287709
augagaagcgaggcccugcuccuuuacuucacccuguugcacuuugcuggcgcaggguuccccgaagacuccgagccuaucucuauuucacauggaaacuauacaaagcaguacccaguguuugucggucacaaaccgggcaggaauacuacgcaacggcaucgcuuagauauacagaugaucaugauuaugaacgggacccuguauaucgccgcgcgagaccacauuuacacaguugauaucgacaccagucauacugaagagauauauugcagcaagaaacuaacauggaagucccgucaggcugauguggacaccuguagaaugaaaggaaagcacaaggaugaaugccacaauuucaucaaaguacuccugaagaaaaacgacgaugcccuuuuuguguguggcacuaaugcauucaaccccucuugcaggaauuacaagauggacacacuggagccuuuuggugaugaguucucggggauggcccgguguccauaugacgcuaaacaugcaaacgucgccuuguuugcugauggaaagcucuacucagccaccgugacggacuuccuggcgauugacgcaguuaucuaccgcagccugggcgaaagucccacucucagaaccgugaagcacgauuccaaaugguuaaaggagccuuauuuuguccaggccguggacuacggcgauuauauuuacuucuuuuucagggaaaucgcuguagaguauaauacaauggggaaaguuguguucccacgggucgcccaagugugcaagaacgacaugggagguucucagcgcgugcuggagaaacaguggacuagcuuucuuaaggcacgauugaauuguuccguccccggcgauucacauuucuacuuuaacauacugcaggcuguuaccgacgugauuagaaucaaugggagggauguagugcuagccacauucaguaccccuuauaacagcauuccaggaucugcggucugcgccuacgacaugcucgauaucgcauccguguuuacgggccgguucaaagaacaaaagucaccggacagcacuuggacacccguuccugaugagcgugugccaaagccccgcccugguuguugcgcugggaguucuucccuggaaagauacgccaccagcaaugaguuuccagacgacacucuuaacuucaucaaaacacacccccugauggaugaagcugucccgucgauuuuuaacaggccuugguucuugcggaccauggugcgauaucgccucacgaagauagccguagacaccgcagccggacccuaccagaaucacacaguuguguuucugggcucugagaaaggcaucauuuuaaaguuccuggcuagaaucgggaacuccggauuucucaaugauucacuuuuccuggaggaaaugagugucuauaacagcgagaaauguuccuacgacgguguggaagauaagaggauaaugggcaugcaguuggaccgggcgucuagcucacuauaugucgcauucaguacuugcgugauuaagguuccacuggggcgcugcgagagacauggaaaauguaagaaaaccugcaucgccuccagggauccuuacuguggcuggaucaaggaagguggggcuugcagccaccucucucccaauucacgucugacauuugagcaggacauugagcggggcaacacugauggacuuggcgacugucauaauaguuucguggcccugaacgauaucagcaccccauugcccgacaaugaaauguccuauaacacaguauacgggcacucuucgagccuccugccuuccaccacuacgucagauaguacagcacaagagggauacgaaucucgagguggcauguuagacuggaaacaucugcuagacagcccagauuccaccgacccgcucggggccgucucaagccacaaucaccaggauaagaagggagugauuagagagucuuaucugaaaggccaugaccagcuuguucccgugacuuugcuggcuauagccgucauccucgcauuugugaugggugcgguauucuccgggauuaccguguacugcguuugugaucacaggcgcaaggacgucgcuguggugcaacggaaagaaaaggagcugacacauaguagaaggggcagcaugucuuccgucaccaaacuuucaggacuguuuggcgauacucagaguaaggacccuaagccagaggccaucuugacaccccucaugcacaacgggaaacuggcaacgccuggaaauaccgccaagauguuaaucaaagcugaucagcaccaucuggaccuaacugcccucccaacacccgaaagcaccccgacacugcagcaaaagcgcaaaccuucgcgagguucccgggagugggaacguaaccagaaucuuauuaacgcaugcacuaaggauaugccacccaugggcucuccuguuauacccaccgacuugccacugagagcuagcccuucacacauccccaguguggugguacucccaauuacgcagcagggguaucaacaugaguacgucgaucagccgaaaauguccgagguggcccagauggcgcuggaagaccaggccgcuaccuuagaguauaagacaaucaaggaacaccugucuagcaaauccccuaaccauggaguuaaucuuguggagaacuuggacucacucccaccaaaggucccccaaagggaagcaagccugggcccuccaggugccagucuaucucagacugggcuguccaaacgccucgagaugcaccacagcucgucauacggcguggauuauaagcggucuuaccccaccaauagucugacaagaucccaucaggcuacuacccuuaaaaggaacaauacgaacagcucuaauagcucccacuugucacgaaaccagaguuucggacgcggcgacaauccuccgccagcaccccaacggguugauagcauucaggugcauucuucccagccuucagggcaagccguaacagucaguagacagccaagccugaacgcguacaauuccuuaaccaggucuggacucaagcguacucccucgcugaagccugacgugccgcccaaacccagcuuugccccucuuucaacauccaugaagcccaacgaugcuuguaccuga

SEQ ID NO: 62318 - RNA, 2667 nt, Artificial Sequence
  derived and/or modified sequence opt3 from SEMA6B__Homo_sapiens__NP_115484
augcagacccccagagccagcccuccaaggccggcucugcuccuucuguuguuacugcuaggcggggcacacggacucuuccccgaggaaccuccaccccuguccguggccccucgggacuaccuuaaccauuauccagucuuuguugguucuggccccgggcgccugacacccgcggagggagcugaugacuugaauauccaacgagugcuccguguaaacagaacucuguucauuggcgauagggacaaucuguaccggguggaacucgagccaccgacgucaaccgaauuacgcuaucagagaaagcugacauggaggaguaaccccagcgauauaaaugucugccggaugaaagguaagcaggagggggagugucgcaacuuugugaaaguucuuuugcugcgagacgaauccacucuauucgugugcggaucuaaugccuuuaacccugucugugcaaauuacucgaucgauacccuccagccagugggcgacaacauuucaggcauggccagaugccccuaugauccuaagcacgcuaauguagcacuguucagcgacgggaugcuuuuuacagccaccguuacugauuuccuggcuaucgacgccgugauuuacaggaguuugggagaucggccaacacuccguaccgucaaacaugacuccaagugguuuaaggagcccuauuucgugcacgcgguggaaugggguucucaugucuacuuuuucuuucgcgagaucgcaauggaguucaacuaccuggaaaaaguugugguaagcagaguggccagggucuguaagaaugacgugggcggguccccgcggguuuuagagaaacaauggacgucauuccugaaggcucgacucaacugcagugugccuggagauagccacuuuuauuucaauguccuucaggccgugacuggcguaguuucucugggugggcgccccguggucuuggcaguguuuuccaccccaucaaacagcauaccuggaagugcugucugugccuucgaccuaacacagguggcggccguuuuugaaggcagauucagggagcagaaaucucccgaauccaucuggacuccagugcccgaggaucaaguaccucggccacgcccgggcugcugugcagcucccgggaugcaguacaacgccagcucggcucugccugacgauauucucaauuuugucaagacccacccacugauggacgaggccgugcccucucuuggacaugcaccuuggauccugagaacauugaugaggcaccagcucacccguguugccguggaugucggugcuggcccaugggggaaccagacggugguauuccugggauccgaagcgggcacuguguuaaaguuucugguucggcccaaugcaucaacaagugguaccagcgggcuauccgucuuccucgaggaauuugagacuuaucgaccggacagaugcggcaggccuggaggcggggaaacaggacaacgccugcuuucuuuggagcuggaugccgcuagcgguggccuccuggccgcauucccacgguguguggugagaguccccguugccaggugccagcaguacucagggugcaugaaaaacuguauuggaagucaagacccuuauugcggcugggcucccgaugguuccuguaucuuucuuagcccagggacccgcgccgcauucgagcaggacgugucuggcgcgucaacgaguggacugggcgacugcaccggguugcuccgagcuagccuguccgaagaucgggccggauuagugucuguaaaucugcuagucacaucgagcguggcagccuucguugugggugcugucguguccggcuuuucaguugggugguucgugggacuccgugagagaagggaacuggcccgccggaaggacaaagaggcaauacuugcucauggcgccggugaagcgguauugagugucucuagacugggggagaggcgagcccagggcccuggaggccgcgggggaggcggugggggaggcgcuggugugcccccagaggcacuccuggccccguuaaugcagaacggcugggcuaaggccacucugcuucaagggggaccucacgauuuggacagcggccuccugcccaccccagaacagacaccccuaccucagaaacggcugccaacuccccacccucauccgcacgcacucgggccaagagcgugggaucauggacacccccugcuuccugccuccgcuucaagcucuuugcuguuacucgccccagcaagggcucccgagcagccuccggcccccggcgaaccaaccccugacggucgucuguacgcagcccgccccgggcgggcuucccauggagauuuuccacuuacaccucacgcgagucccgacagaaggcgaguggucagcgccccaaccggcccgcuggauccugcaucugcugccgacgguuugccccggccaugguccccuccuccaacuggcucacuccgcagaccccuggggccucacgccccgccagcugcaacgcuaaggcggacacauaccuucaauaguggagaggcccgacccggcgauagacaccgcgggugucaugcgaggccuggaacugaccuggcucaccuccugcccuauggcggugccgaucguaccgcaccaccuguucccuga

SEQ ID NO: 62319 - RNA, 3036 nt, Artificial Sequence
  derived and/or modified sequence opt3 from SEMA6D__Homo_sapiens__NP_001185928
augagaguguuccugcucugcgccuacauccuucuguugauggucagccaguuaagggcuguuuccuuucccgaggacgaugaaccucugaacaccguggacuaucacuacucucggcaauauccaguauuccgcggccgaccgucagggaaugagagucagcaucgucuagauuuucagcucaugcugaagauuagagacacacuuuacauagcaggaagggaucagguguauacugucaaccugaaugaaaugcccaaaacggaggugaucccuaacaagaaauugaccuggcggagccgccaacaggacagagaaaauugugccaugaaggguaaacacaaggaugagugccauaacuucauuaagguuuuugugccaaggaaugacgagauggucuucguguguggcacaaacgcguuuaaucccaugugccgguacuaucgccucuccacucuggaauacgauggggaggaaaucucuggacuggcucgauguccuuucgacgccagacagaccaacguagcacucuuugccgauggcaaauuauacucggcuacaguugcagacuuccuggccucagaugcugugauuuauaggagcaugggugacgggagugcccuucggaccaucaaguacgacuccaaauggauaaaggagccacacuuuuugcaugcgaucgaguauggaaauuacgucuauuucuuuuuccgugaaauugcaguggagcacaacaaucugggcaaagccguguacucucgcgucgcuagaaucugcaagaacgauaugggcgggagccagaggguucuagaaaagcacuggacuuccuuccucaaagcccggcugaauuguucagugcccggagacaguuucuucuauuuugauguacuucaaagcauuacagacaucauacagauuaacgguaucccuaccguggucggcguguucacgacucagcugaacucuauuccaggguccgcaguuugcgcuuuuucaauggaugacaucgagaagguguucaaaggacgauuuaaggaacagaaaaccccggauagcgucuggacagccgugcccgaggacaagguaccuaaaccacgccccggcuguugcgcgaagcaugguuuggccgaggcauacaagacuuccaucgauuucccugacgaaacccucucuuuuauuaaaucccacccacugauggauagcgcuguucccccgauagccgacgagccuugguucacaaagaccagagugagguaccgguuaacggcuaucucggucgaccauucugccgggcccuaucaaaauuacacugugauuuuugucggauccgaagcaggcauggugcugaaaguucucgccaagacaucaccauucagucuuaacgauagcgugcuguuggaggaaaucgaggcuuauaaucacgcgaaauguuccgcagagaacgaagaggacaagaagguaauaucucuacagcuggauaaagaccaccaugcccucuacgucgcuuuuagcucaugcauuauccgcaucccucugaguagaugcgaaagguauggcuccuguaagaaaagcugcauugccucucgugaucccuacuguggguggcuuucacagggaaguugcggucgggugaccccaggcaugcuguugcucacugaggacuucuucgcauuucacaaucauagcgccgaaggguaugagcaagauacagaguucggaaacaccgcucaccugggcgacugucaugguguucgaugggaagugcaguccggggagucuaaucagaugguccacaugaacguguuaaucacgugcguauuugccgcauucgugcugggcgcguuuauugcuggaguugccgucuacuguuacagagauauguucgugaggaagaaucgcaaaauacacaaggacgcagaaucggcccagagcugcaccgauuccucaggcaguuuugcuaagcuaaacgggcucuuugacucucccgugaaagaguaucaacagaauaucgauagcccuaagcuguacuccaaccuuuugacaucacggaaagagcugccaccgaauggagacacuaagagcauggucauggaccauagaggucagcccccugaacucgccgcacugccaacccccgagucuacaccuguucuucaccagaaaacucugcaagcuaugaagucccauagugaaaaggcccacggccacggggcgagcaggaaagagaccccacaguuuuuccccucuuccccgccuccacauucacccuugagucacggacauauuccuagcgccaucgugcuccccaacgcuacacacgauuauaauaccucguuuuccaacucuaacgcacauaaggccgagaaaaagcugcagaauaucgaccacccauuaacuaaaagcucaaguaagcgcgaucaccgacgguccguggacucucguaacacgcugaaugaucuacucaaacaucugaacgacccuaauagcaaccccaaggcuauuaugggcgauauacagauggcccaccaaaaucuuauguuggacccaauggguuccaugucagaaguaccgccuaagguccccaacagagaggcaagccuguacaguccacccucuacacucccuaggaauaguccaaccaaacgcguggauguucccacuaccccuggggugccgaugacaagccuggaacggcagagaggcuaucauaagaacucgucacagaggcacucuaucagugcgaugcccaaaaauuuaaacuccccaaauggaguccugcuuagccgacagccuucuaugaaccgcggcggguacaugccaacccccacuggagccaagguggacuauauucaagguacaccuguuagcgugcauuugcagccgucccucucacggcagaguagcuacacgucuaauggcacccugcccagaacugggcuaaaaaggacaccaucccugaagccugauguacccccaaagccuucauucgucccccaaaccccaagugugcguccgcucaacaaauacacauauuga

SEQ ID NO: 62320 - RNA, 1959 nt, Artificial Sequence
  derived and/or modified sequence opt3 from SEMA7A__Homo_sapiens__NP_001139501
augacacccccuccaccgggcagagccgcucccagcgcaccuagggcccgggugccagggcccccugcgcgccugggacucccacuucgacugcguuuguuacugcuacucugggcugccgcagccuccgcucagggucaccugagaucuggccccaggaucuucgcagucuggaaggggcauguuggacaagaccggguggauuuuggccagaccgagccucacacuguacuuuuccaugaaccagguucaaguagcgugugggucgggggacgcggcaaaguguaccuguuugacuucccggagggcaagaacgccuccguuagaacggauugcgaaaauuauauuaccuugcucgagaggcggucugaagggcugcuggcuuguggaacaaacgcccgccaccccucgugcuggaaucucgugaacgguacugucgugccuuuaggcgagaugcgaggguacgcgccauuuucacccgacgagaauagccugguacuuuucgaaggagaugagguuuauaguaccauaagaaaacaggaauacaacggcaagaucccuagguuucggcguauucgcggugaguccgaguuguauacaucugacaccgugaugcagaauccacaauucaucaaagcaacuauuguccaucaggaucaggccuacgacgauaagaucuauuacuuuuucagagaagacaaccccgauaagaauccggaggcuccucugaacgugagcaggguggcccagcuaugucgaggggaccaaggaggcgaauccucacucagugucagcaaauggaauacauuucugaaggcaaugcuuguuugcucugaugcugccaccaacaaaaauuucaaccggcugcaggacguguuuuugcuccccgacccauccggccaguggcgcgauacgagaguauacgggguguucucaaauccuuggaacuauagcgcggucuguguguacagucugggagacauagauaagguuuucaggacuucuuccuuaaaagguuaucacagcucgcugcccaacccacggcccggcaagugccucccugaccagcaaccaaucccgaccgagacauuucagguggccgaucgccaccccgaagucgcacagagaguggagccuauggggccacuuaagacuccccuguuccauucuaaauaccacuaucaaaagguagcuguucauaggaugcaggccucccacggagagaccuuucacguguuguaccuaacaaccgaccguggcacgauucauaaagucguggaaccuggugagcaggaacacucauucgcuuuuaauaucauggagauucagccauuccggcgagccgcagccauccaaacuaugagucuggaugcugaaagaaggaagcucuaugucagcucccagugggaggugucucagguuccccuggaccuuugugagguguacgggggcggaugccauggcugucugaugagccgcgauccguacugcgggugggaccagggacgguguauaucaauuuauaguuccgaaagaagcguauugcaaucuaucaacccugcggagccacacaaagaaugccccaauccuaagcccgauaaagcaccacuccagaaggucucacuggccccuaacaguagguacuauuuaagcugccccauggagucccgccaugcuacauacucuuggcgacacaaggaaaauguggagcagucgugugagccaggucaccagagcccgaacugcauucuguuuaucgaaaaucuaaccgcccaacaguauggccauuacuucugugaggcacaggaaggguccuauuuucgggaggcccagcacuggcaacuccugccugaggacggaaucauggcugaacaucuuuugggccacgccugcgcacuggcggcuucacucuggcuggguguucuucccacucugacauuggggcuccuggugcacuga

SEQ ID NO: 62321 - RNA, 1389 nt, Artificial Sequence
  derived and/or modified sequence opt3 from SEMG1__Homo_sapiens__NP_002998
augaagcccaacaucauuuucgugcugagccuccuucugauauuggagaaacaggccgcugucaugggccaaaaagggggauccaaagguagauuaccuucugaauuuucacaguucccacacggccagaaggggcagcauuacaguggacaaaaaggcaagcagcagaccgagagcaaggguuccuuuucuauccaguauacauaccacguugacgcaaaugaucaugaccaaucgaggaaaucacagcaguaugaucugaacgcccuacacaagacuacgaaaagccagcggcaucucgggggaagucaacagcugcuucacaauaagcaggaaggccgcgaccacgauaaauccaagggccauuuccaccgagugguaauucaucacaaagggggaaaggcgcaccgugguacccaaaacccgucucaggaccagggcaauagccccuccgggaagggaaucucaagucaguacagcaacacagaggaaagacugugggugcauggcuugucuaaagagcaaacuuccgucucaggugcucagaaggggaggaaacagggaggcagccagaguucuuaugugcuccaaaccgaggaacugguugccaauaagcagcagcgggagacaaagaacucccaccagaauaagggccauuaccaaaacguggucgaagugcgcgaggagcacagcucgaagguacagaccucucugugcccugcacaucaggauaaacuccagcacggguccaaggacauuuuuagcacucaagaugaauuacugguuuauaauaaaaaccagcaccagacaaagaaucuuaaccaagaccagcagcauggaagaaaagccaauaagaucaguuaccagagcuccucuaccgaggaaaggcgguugcacuacggugagaacggcgugcaaaaggaugucagccagucaaguauauauucccagacggaagagaaagcucaggggaagucacaaaaacagaucacuauuccaucucaggagcaggaacauucacaaaaggcaaacaaaaucaguuaccagagcuccucuaccgaggaacgccgacugcacuauggagagaauggcgugcagaaggacgugucgcaaagaagcauuuacucccagacagaaaagcuagucgccgguaaaucacagauccaggcucccaacccuaagcaagagccauggcacggggagaaugccaaaggcgaaaguggacagucuacuaacagggagcaggaucuccugagccaugaacagaagggccggcaccaacaugggucccacggaggucuugacauaguuauuaucgagcaggaagacgauucagaccgucaucuggcgcagcacuugaauaacgaucgcaauccccucuucaccuga

SEQ ID NO: 62322 - RNA, 1749 nt, Artificial Sequence
  derived and/or modified sequence opt3 from SEMG2__Homo_sapiens__NP_002999
augaagucuaucauucuguucgugcucucccuucuguugauauuagagaaacaggccgcugucaugggccaaaaagggggaucuaaaggucagcugcccucaggcaguagccaguuuccucacgggcagaagggacaacauuacuucggccagaaagaccagcagcacaccaaguccaaggguucuuuuucgauccaacauacauaucacguugauauuaacgaccaugauuggacuagaaaaucacagcaguacgaccuaaaugcacuccacaaggccacgaaaagcaagcagcaccuugggggaagucaacagcugcugaacuauaaacaggaaggcagggaucaugacaaguccaagggccacuuccauaugaucgugauucaccacaaagggggacaagcgcaucacgguacccagaauccaucucaggaucagggcaacagcccguccgggaagggauugucaagucaaugcagcaauacagagaaacggcucuggguacauggccugucuaaggaacaggcuuccgccucaggugcacagaaagggcgcacucagggaggcagccaaaguucuuacgugcugcagaccgaggaacucgucgugaacaagcagcagcgagagaccaaaaauucccaccaaaacaagggccauuaucagaauguuguggacguccgugaggaacacagcucgaaguuacagacaucucugcaccccgcccaucaggauagacuucaacacgggccuaaagacaucuuuacuacacaggaugaguugcugguguacaacaagaaucagcaucaaaccaaaaaccuaucccaggaccaggaacacggaaggaaggcucacaaaauaucauauccaaguagccggacggaggagcgccagcuccaucacggugaaaaguccguacaaaaggauguuucuaaaggcagcaucucaauucagacugaggaaaagauccaugggaaaagucagaaucaggugaccauucacucccaagaccaggagcauggacacaaggaaaacaaaaucagcuaccagucuucaaguacagaggagagacaccugaauuguggcgaaaaggguauacagaagggggucagcaaaggcuccauuucuauccaaacugaggaacagauucauggaaagucgcagaaccaagugaggauccccagccaggcacaggaguacggccacaaagaaaacaagaucuccuaucagucaaguucuaccgaggagcggcgccuuaauagcggggaaaaagacgugcaaaagggagucuccaaggguucaauuagcauacagacagaggaaaagauccauggcaagucucagaaccagguuaccauuccuucccaagaucaggagcacgggcauaaagaaaauaagaugaguuaccagagcagcuccacggaggagcgaagacugaacuauggaggcaaaucaacucagaaggacgugagucaaagcucgaucuccuuccagauagaaaaauugguagaggguaagucucagauucagacaccaaaucccaaccaagaucaguggagcgggcagaaugccaagggcaaaucaggacaaagugcugacuccaagcaggaucuccugucucacgaacagaaaggcagguacaagcaggagagcuccgagucacacaacaucgugaucaccgaacaugaggucgcccaagacgaucacuuaacucagcaguauaaugaagaccggaacccuauuagcacauga

SEQ ID NO: 62323 - RNA, 1935 nt, Artificial Sequence
  derived and/or modified sequence opt3 from SENP1__Homo_sapiens__NP_001254524
auggacgauaucgccgacagaaugaggauggaugcuggcgaggugacccuggucaaccacaauagcguuuucaagacacaucuccuuccccagacuggguuuccugaagaccaacuguccuugucugaucagcagauuuuaucaagucggcagggacaccuggaccgcagcuucacgugcuccacccgaucugcagccuacaacccaucguauuacucagauaauccgagcagugacuccuuucuagguucuggcgaucuccguacauucgggcaaagcgcgaacggacaguggagaaauuccacucccucaaguucaucuucccugcagaaaucaaggaacagccggagucuuuaucuggagacccgcaagacaucuuccggcuugagcaauucguuugcugguaaaucuaaccaucacugucauguguccgccuacgaaaagucauucccuauaaaaccaguacccaguccuagcugguccgggucuugcagaaggagccuccugucaccaaagaagacccagcggcgccacgugaguacugcagaggaaacaguccaagaggaggaacgagagaucuauagacagcugcuccagauggugaccggaaaacaguuuacgauugccaagcccacuacccacuucccuuuacaucuguccaggugucuuagcucuagcaaaaauacauugaaggacagucuguuuaaaaacggcaauagcugcgcuucccaaaucauuggcucugauacuucgagcuccgggucagcaaguauccuaaccaaccaggaacagcucucucacagcguuuacucccugucaagcuauacaccagacguggccuucggaucuaaggauuccgguacccuucaucacccgcaccaucaccauagugucccccaccaaccugacaaucuggcugccagcaacacgcagucugagggcuccgacucagugauauugcucaagguaaaagauagucagacuccaacacccagcucgaccuuuuuccaggcggagcuguggaucaaggaauuaacuuccguuuacgacucucgggcacgugagcgccugagacaaauugaggaacagaaagcccucgcucugcagcugcagaaucaaagguugcaggaacgggagcauagcgugcacgauucagucgagcuacaccuucgagugccucucgaaaaggagaucccagugacagucguucaggaaacccagaaaaaggggcauaaacugacggacagugaggaugaauuucccgagauuaccgaggaaauggagaaggaaaucaagaacguguuccgcaacggaaaucaagacgagguacuuuccgaagccuucagacugacaauaacuaggaaagauauucagaccuugaaccaccucaauuggcugaacgacgagaucauuaauuuuuacaugaacauguuaauggagcggucuaaggaaaaaggccugccgagcgugcaugcauucaauacauuuuucuuuacuaagcuaaaaaccgcugguuaucaggccgucaagcgcuggacaaagaaaguggauguuuucuccguggacauccuccuggucccuauccaccuuggggugcacugguguuuggcgguaguugauuuuagaaagaaaaacauuaccuacuaugacucaaugggaggcauaaauaacgaggccugcaggauccugcuccaguaccugaagcaagaaagcauugacaaaaagcguaaggaguucgauacuaauggcuggcagcuuuuuaguaaaaagucucaggagaucccccaacagaugaacggguccgacuguggaauguucgcaugcaaauaugcugauuguauaacgaaggaccggccaauuaauuuuacacagcagcauaugccuuacuuccgaaaaagaauggugugggaaauccugcacaggaaguugcucuga

SEQ ID NO: 62324 - RNA, 1770 nt, Artificial Sequence
  derived and/or modified sequence opt3 from SENP2__Homo_sapiens__NP_067640
auguacagauggcuggugaggauccucggcaccauuuuccgguuuugcgaccgcagcguucccccugcccgagcacuucugaagcguagaagguccgauucuacauuguucucaacugucgacacggaugagauaccagcuaaacggccgcgcuuagacuguuuuauccaccaggugaagaacagucuguauaaugccgcgagccuauucggguuucccuuccaacucaccacaaaaccuaugguaacuuccgcuugcaacggaaccagaaauguggccccaucuggugaagucuuuucgaacucaagcaguugugagcugacaggcuccgggucuuggaauaacaugcuuaagcugggaaauaaaagccccaacggcauuuccgauuacccuaagaucagggugaccguuacucgggaccagccacgccgaguguugcccucauucgguuuuacacucaauagugaagggugcaacagaaggccuggaggccggcgucauagcaagggcaauccagagucuucccugauguggaaaccgcaggaacaggcagucaccgagaugauuucagaggaaagcgggaagggacugcgcagaccccacuguacgguggaggaagguguacaaaaagaggagagggaaaaguaucggaaacucuuagagcgacugaaggaaaguggccaugggaacucuguuugcccugugacuuccaauuaccacagcucgcagcgcucucagauggauacccuuaagacaaaaggauggggcgaggaacagaaccauggugucaagacuacccaauucgugccaaaacaguauagauugguggagacaagggggccccuguguucccuacggucagagaagcgcugcaguaaaggaaagaucaccgacacggaaacuauggucggcauaagauuugagaaugaaagcaggcguggcuaccagcucgagccugaucuguccgaagagguuucugcccggcuucgacuggggagcggaucaaacgguuugcucagaaggaaagugaguaucauugagacaaaggaaaagaacuguuccggcaaagagcgcgaccggagaaccgaugaccuguuagaacugacugaggauauggaaaaggagaucagcaaugcucucgggcacggaccacaggacgagauucuuucuucagcauucaaacugaggaucacacgcggcgacauacaaaccuugaagaacuaucacuggcuaaaugaugaaguaauuaacuuuuacaugaaucugcucguggagcgaaacaaaaagcaggguuaccccgcccugcaugucuucaguacguucuuuuauccgaaacuuaaaagcgggggcuaccaggcugugaagcgguggaccaaaggaguuaaucuguucgaacaagagaucauuuuggugccuauccaccguaagguccauuggucccucgugguaaucgaccugagaaagaagugcuuaaaguaucuggauucuaugggccagaaagggcacaggauuugugagauacuacuccaguaccugcaggacgaaucgaagacaaaacgcaacagcgaucuuaauuugcuggaguggacucaccauuccaugaagccccacgaaaucccacaacagcucaacggaucagacugcgguauguuuaccugcaaauaugccgauuacauuagucgggacaagccuaucacauucacucagcaucagaugccccuguuuagaaagaaaaugguuugggagauacuucaccaacagcuguuguga

SEQ ID NO: 62325 - RNA, 1725 nt, Artificial Sequence
  derived and/or modified sequence opt3 from SENP3__Homo_sapiens__NP_056485
augaaggagaccauccagggcacagggagcuggggacccgaaccuccagguccgggcauucccccugccuacuccucuccaagaagggagcggcugcgcuggcccccuccacccaaaccucgacucaagucagggggaggcuucgguccagacccggggaguggaacuacggugcccgcucguagacuuccugucccaaggcccagcuuugaugcauccgccucugaagaggaagaggaggaagaggaagaggaggacgaagaugaggaagaggaaguugcggcuuggcggcugccuccacgcuggucgcaauugggcaccucacagagacccaggccgagccggccuacacaccgcaaaacuugcagucagcgaagaaggcgggccaugcgugcauuccgcauguuacuguauuccaagucuaccagccuaacauuucauuggaaacucuggggcagacacagggggcggcgacgcggacuggcccaucccaagaaccaccuuuccccacagcaagguggcgcuaccccucaggugcccucaccauguugcagauucgacagucccagggggccuccaccgccccggcugggauugcucggcgcacugauggccgaggaugguguacgcgggagcccuccagugcccucuggaccuccaauggaggaagacggccugagauggacucccaaguccccgcucgauccugacucaggcuuacugagcuguacacuuccaaauggguuuggaggucagaguggccccgagggggaaaggucuuuggcuccucccgaugccuccauacugaucagcaacgucugcucgauuggagaccauguggcgcaggagcuauuccaaggcucugaucucgguauggcagaagaggccgagcguccaggggaaaaagcuggccagcacuccccucugcgggaggaacacguuaccugugugcagucaauccuugacgaguuucugcagacguacggaaguuugauuccccucagcacugaugaagucguggagaagcuggaggacaucuuccaacaggaauuuuccaccccaucucgaaaaggcuuaguacugcagcucauacaaagcuaucagagaaugccggggaaugccaugguuaggggauuccgcguggcauacaagcggcauguccuuacaauggacgaucuggguacuuuguauggccagaacuggcuaaaugaccaggugaugaacauguacggggaucuggugauggacaccgucccugagaaaguucacuuuuucaauucauuuuucuaugauaagcucagaacaaagggauacgacggcgugaaaagguggaccaagaacguagauaucuucaauaaagaacugcuucugauucccauccauuuggaggugcacuggagucucauuuccgucgacgugcgccgacggacgaucacuuacuuugauagccaacguacacugaacagaaggugcccaaagcacauagcuaaauauuuacaggccgaggcgguuaagaaagaccgccuggauuuccaucaggguuggaagggguacuuuaagaugaauguggcccggcagaacaaugacucugacuguggcgcauucguccuacaauauugcaaacaccucgcucugucacagcccuuuaguuucacccagcaggauaugccuaaacuuagaaggcaaauuuacaaggaauugugucauugcaagcugacuguguga

SEQ ID NO: 62326 - RNA, 2268 nt, Artificial Sequence
  derived and/or modified sequence opt3 from SENP5__Homo_sapiens__NP_689912
augaagaaacagagaaagauccuguggaggaaaggcauucaccucgccuucagcgagaaguggaacaccggguuuggagguuucaaaaaguuuuacuuccaucaacaccuuugcauacugaaggcuaaauugggccggcccgugacauggaaucgccaguuacgacauuuucaggggcguaagaaagcacugcagauccaaaagacuuggauuaaagacgaaccucuaugugccaagacgaaguucaacgucgcgacccagaauguuuccacacucucuucaaaagugaagagaaaagaugcuaagcacuuuaucaguagcuccaaaacucugcuuaggcugcaggccgagaaguugcucucuucggcaaagaacucagaccaugaauauugccgggagaagaaucugcugaaggccguaaccgauuucccaagcaacagugcucucggacaggcaaauggccaccgcccgagaacagacccccaaccuuccgauuuuccaaugaaauucaacggugaaucucagagccccggggaguccggaaccauuguggucacuuuaaauaaccacaagaggaaaggcuuuuguuacggcugcugucaggggccugagcaucaccggaauggagguccacugauccccaagaaauuccagcuuaaccaacaucgccgaauaaaguugucaccucugaugauguaugaaaagcuaaguaugaucagauuuagguaccggauucuccguagccagcacuuccgcacaaaaucuaaggugugcaaacugagaaaggcccagagguccuggguucaaaaagugaccggcgaccaccaggagacgcggcgagaaaauggggagggaggcucauguagcccauucccgagucccgagccuaaggauccaucuugccgccaucagcccuauuuuccugacauggauuccagcgcugucgugaaggguacuaacucgcacguaccagacugucauaccaaagggucuuccuuccuuggaaaggaacugucauuggaugaggccuuucccgaccagcaaaauggcagugcgacaaacgcaugggaucagagcuccugcucuagcccgaaaugggaauguacugagcucauccacgacauuccucugcccgaacauagaucaaacaccauguucaucagugagacagagagggaaauaaugaccuuaggccaggagaaucagacguccagcguuucugacgaucgggugaagcugucagucaguggggccgacacuagcguguccucuguggauggaccagucucgcaaaaagcuguucagaacgaaaauagcuaccagauggaggaagacgguucccucaagcagucaauucuuaguucugagcuguuggaucacccuuauugcaagagcccccuagaggccccacuggugugcuccggccucaaacuggaaaaccaaguagggggaggcaaaaauucacagaaagcaagccccguggacgaugagcagcuuucugucugucuguccgguuucuuggacgaagugaugaagaaauacgggagucucguuccucugagcgagaaggaaguguuaggccgccugaaagaugucuucaacgaggacuuuucuaauagaaagccauucaucaacagggagauuacaaauuaccgugcucggcaccagaagugcaacuuucgaaucuucuauaauaaacauaugcuagauauggacgaccucgccacccuggauggacaaaacuggcuuaaugaccaggugaucaacauguacggcgaauugauuauggaugcgguaccggacaagguucacuuuuucaauuccuuuuuccauagacagcuggugacuaaaggguauaacggagucaagagguggaccaaaaagguggaucucuucaagaaaucacugcuucugauacccauccacuuggagguccacuggagucucauuacagugacgcugagcaaccgcaucauaucguuuuacgacucccaagguauucauuucaaguuuuguguugaaaauauccggaaauauuuacugaccgaggccagagagaagaacaggccugaauuucuacagggcuggcagacagcagugacuaaaugcaucccacagcaaaagaaugauucugacugugggguauuuguccuccaguacugcaagugucuggcucuugagcagcccuuccaguuuagccaagaagauaugccucgcgugcgaaaacggauuuauaaggaguugugcgaaugucgucugauggacuga

SEQ ID NO: 62327 - RNA, 3318 nt, Artificial Sequence
  derived and/or modified sequence opt3 from SENP6__Homo_sapiens__NP_001093879
auggccgcuggcaagagcgggggauccgccggugagaucaccuuccuggaagcacucgcgagaucugagucaaaaagggacggcggguucaagaacaauuggaguuucgaucacgaagaggaaagcgagggagacacagauaaagacggcacuaaccuucuguccguggaugaggacgaagauucugagacgucgaaggguaaaaaguugaaucggcgcucagaaauugucgcuaacagcaguggggaguuuauauuaaagaccuacguucgacguaauaaauccgagucuuucaagacacugaaaggaaaccccaucggccuaaauaugcucagcaacaauaagaaacuguccgaaaacacucagaauaccucacuuugcaguggcacagugguacaugggagaagguuucaccaugcccacgcacaaauuccuguggucaagaccgccgcucagcggaaggaguauccaccgcaugugcagaaaguugaaaucaaccccgugcgccugagcagauugcagggagucgagaggauuaugaagaaaacugaagagucugagucccaaguggaaccugagaucaagcggaaaguacagcagaagcgccacuguucaacauaccagccaacucccccucucagcccagcaaguaaaaagugccugacgcaccuggaagaccuccaacgaaauuguagacaggccauaacuuuaaacgagucuaccgguccccugcuuaggacauccauccaucagaauagcggcgggcagaagucgcaaaacacuggauugaccacaaagaaguucuauggcaacaauguugaaaaagugccuauugauaucauugucaacugcgacgauucuaagcacaccuaccugcagacgaaugguaaagugauccuaccaggggcuaagauaccgaagauuacuaaccucaaagagcggaagacaucccugucagaccuuaaugaucccaucauucugaguagcgacgacgaugacgauaacgaccguaccaaucgcagagaguccaucucuccucagccagccgauagcgcguguucaagucccgcaccuuccacuggaaaaguggaagccgcuuugaacgagaauacaugcagggccgaacgggagcuccgaagcaucccagaagacucugagcugaacaccgucacguuaccccgcaaggcaagaaugaaagaucaauuuggcaauucaauuauaaacaccccgcugaagaggcggaagguuuucagucaggagccucccgacgcucucgcccuuagcugucaguccucuuuugauucggugauccugaauugccgcagcauuagaguaggcacauuguucaggcuacugaucgaaccagugauauuuugucucgacuucauuaaaauccagcuggaugagccugaccaugaccccgucgaaaucauucuuaacacuuccgaucugaccaagugcgagugguguaaugugcguaaauugccaguuguguuucuccaagcgauccccgccgucuaucagaagcugucaauucaguuacagaugaacaaagaggacaagguguggaacgauugcaaggggguaaauaaacugacaaaccuagaggaacaauacauaauccucauuuuccagaauggacuggacccuccagcaaacaugguuuucgaaaguaucaucaaugagauugguauaaagaacaauaucucuaacuuuuucgcuaaaauuccguuugaagaggccaauggccggcuuguggcuugcacucgaaccuaugaggaaagcaucaagggguccuguggacagaaagagaacaagauuaaaacagucucauucgaaagcaagauccaguugagaucuaagcaagaguuucaguucuuugaugaagaggaggaaaccggcgagaaucacacuauauucaucggucccguggaaaaacugauugucuacccuccacccccugccaaagggggcaucuccgugacgaacgaggaccuccacugccugaaugaaggagaguuucuuaacgauguuauuaucgacuucuaccugaaauauuuggugcucgagaagcugaaaaaggaagaugcagacaggauacauauuuuuaguagcuucuuuuacaagcgcuuaaaucagcgggagagaaggaaccacgaaacaaccaaccugucuauccagcaaaaacgccauggccgaguaaagacuuggacccggcacgucgauauuuucgagaaagacuucaucuuugugccacuaaaugaggccgcucauugguuccucgcgguuguguguuuucccgggcuggaaaagccgaaauaugagccuaacccacacuaccacgaaaaugcagucauacagaagugcuccacaguggaggauucauguaucaguagcucggccuccgaaauggagucuugcagccagaacucaagugcuaagcccguaauuaaaaagaugcuuaauaaaaagcauuguaucgccgugauugacuccaacccuggacaagaggaaucugacccccguuauaaaagaaauaucugcagcguuaaguacuccgucaagaaaauaaaccacaccgcaucagagaaugaagaguucaacaagggugaaagcaccagucagaaaguggccgauaggacaaagucugagaauggcuugcagaacgagucccugagcucgacgcaucacaccgacgggcucucaaaaauucgccugaauuauucugaugaaaguccagaggcuggaaagauguuagaagacgagcugguggauuuuuccgaagaccaggauaaccaagacgauagcucugacgauggcuuccuugccgacgauaauuguagcuccgagaucggucaguggcacuugaaaccuacuaucugcaagcagcccuguauucuccugauggacucacuacgggggccaaguagaagcaacgucguuaagauccugagggaguaccucgaaguggagugggaagugaaaaagggcucuaaacgauccuuuucaaaggacguaaugaaaggaaguaacccgaaggucccucagcaaaauaacuucagcgauugcggcguguacguucugcaguauguggaguccuuuuucgagaaucccauucuuucuuuugaauugccaaugaaccuggcaaauugguuucccccuccacgcaugcggacaaagagagaggaaauaaggaacaucauuuuaaaacuccaggaggaccagucgaaggaaaaacguaagcauaaagauaccuacagcacagaggcgccccugggggagggaacugaacaauaugucaauucaaucuccgacuga

SEQ ID NO: 62328 - RNA, 639 nt, Artificial Sequence
  derived and/or modified sequence opt3 from SENP8__Homo_sapiens__NP_001165580
auggacccugugguccugagcuacauggauucccuccuuagacagucugacguuucacuguuggauccuccaaguugguuaaacgaccacaucauuggcuucgccuuugaguauuucgcuaauagccaauuucaugauugcuccgaccacgugucuuucauaucgccggaaguaacccaguuuaucaaguguacaucaaaccccgcagagauugccauguuccuggaaccucuagaucucccaaauaaaaggguggucuuucuggcgaucaacgacaauagcaaccaggcugccgggggaacucauuggagucuucugguguacuugcaggauaaaaauuccuucuuucacuaugacucucauagccgguccaacucaguucacgcaaagcaaguggccgagaagcucgaggcuuuccugggucgcaaaggcgauaagcuggcauuugucgaagagaaggcccccgcucagcagaauaguuacgacugcgggauguaugugauuuguaacacggaagcccucugccagaauuucuuucgacaacagaccgagagcuuacugcagcuuuugacacccgcguacaucacuaaaaagcguggagaauggaaagaucugauaaccacacuagcaaagaaauga

SEQ ID NO: 62329 - RNA, 978 nt, Artificial Sequence
  derived and/or modified sequence opt3 from SEPHS1__Homo_sapiens__NP_001182531
auggauaccugcgugaucccccugagacacggcgggcucagccuuguccagacaacugacuacauuuauccuauaguugacgauccauacaugaugggaaggaucgccugugcuaacgugcuguccgacuuguaugcaauggguguaacggagugcgauaauauguuaaugcugcuaggcgugucuaacaagaugaccgaccgggaacgcgauaaagucaugccgcucauuauccaaggguucaaggacgccgcggaggaagcuggaacaucagugacuggcggucagaccguucugaaucccuggauugugcuugggggagucgccacaaccgugugucagccuaacgaguuuaucaugccagauaaugcaguacccggcgacguucugguguugacuaaaccucucggcacacaggucgccguggcugugcaucaauggcuggauauaccagaaaaguggaacaaaaucaagcuggucguuacccaggaggacguggagcucgcauaccaggaagccaugaugaauauggcucgauuaaaccguacggccgcggggcugaugcacacuuucaaugcacaugccgcuaccgauauuacaggauuugguauccuuggccacgcccagaacuuggcaaagcaacagagaaaugagguaaguuucgugauucauaaccugcccguccuagcuaaaauggccgcggugagcaaggccugcgggaauauguuuggacucaugcacggcacuuguccugaaaccuccggugggcugcuuaucugccugccaagggagcaggcagcucgguucugugccgagauaaaaucuccgaaguauggagaaggccaccaggcuuggauuaucggcauuguugagaaagggaaccgcacagccagaaucaucgacaagcccaggauuauagaaguggcaccucaagucgccacccagaaugugaacccaacgcccggagcuacuucguga

SEQ ID NO: 62330 - RNA, 1506 nt, Artificial Sequence
  derived and/or modified sequence opt3 from SEPSECS__Homo_sapiens__NP_058651
augaacagagagagcuucgccgcuggcgaaaggcuggugucccccgcauacguccggcaggggugcgaggcccgccgaucucacgaacaucucauccgucuucuguuggagaagggaaaauguccugaaaaugguugggacgagucaaccuuagagcuguuucuacacgaacucgcgauuauggauaguaacaauuuccugggcaacugcgggguuggagagagagaaggcaggguggcuagcgcccuuguagcacggcgccauuauagauuuauacacgguaucgggagguccggagacauuucugccgugcaaccaaaggcugcaggcucgucacuguugaauaaaaucacaaacagccucguccuggauauuaucaagcuggccggcgugcauacuguugcuaauuguuucguggucccgauggccacggggaugagucucaccuuaugcuuucugacacuucggcacaaacgccccaaggcgaaguacauaaucuggccucgaauugaccagaaauccuguuucaagucuaugaucacugcaggauuugagccagugguaauugagaacguuuuggaaggugaugagcugagaaccgaccuaaaagccguggaagcuaagguccaggagcucggccccgauugcauccuguguauacacagcacaaccuccugcuucgccccuagggugccagaccggcuugaggaacuggcagugauuugugcuaauuaugauaucccccauauugucaacaaugccuacgggguucagucaaguaaaugcaugcacuugauccaacagggagcgcgugugggccgcaucgacgccuuuguacagagccucgauaagaacuucauggugccugucgguggggcaauuauagcuggauuuaaugacucuuucauccaggagauuuccaagauguauccaggcagagccucagcuagcccgagucuggauguguuaaucacucugcucucucuuggcuccaacggguacaaaaagcuguugaaagaaaggaaggagauguuuagcuaucuaucgaaucaaauuaaaaagcugucugaagccuacaacgagcggcuccugcauacaccccacaacccuauaucccuugcaaugacccugaaaacguuggacgaacaccgagacaaggccguuacucagcucggaucaaugcuguucacccgccaggugaguggugcuagagucgugccauuaggcagcaugcagacaguauccggguacacuuucaggggauuuaugucucauaccaauaacuaucccugugcguaccugaaugcagccagcgcuaucggcaugaagaugcaagauguugaccuauucaucaaacggcucgaucgcugccugaaggccgugagaaaagagaggucaaaggagagugacgauaacuaugacaaaacagaagaugucgacauugaggaaauggcacuuaaguuggauaaugugcugcucgacaccuaccaggaugccuccagcuga

SEQ ID NO: 62331 - RNA, 1965 nt, Artificial Sequence
  derived and/or modified sequence opt3 from SERAC1__Homo_sapiens__NP_116250
augagccuggccgcuuacugcgugaucuguugcagaaggauuggcaccuccacaucucccccuaagucagggacucacuggcgggacauacgcaacaucauuaaauucacgggaagucucauccuugguggcagccuguuuuugaccuaugaggucuuagcacugaagaaagccguuacacuagauacucaggugguagaacgagagaagaugaaauccuacauuuaugugcauaccgucucucucgacaagggggaaaaucacggaaucgcguggcaagcucguaaggagcugcauaaagccgugagaaagguucuugcaacaucggccaaaauacugaggaacccauucgcugauccguuuucaaccguggacaucgaagaucacgagugugcagucugguugcuccugcgcaagagcaaaagugacgauaagacuacacggcuggaggccgugagagaaauguccgagacccaucacuggcacgacuaccaguauaggauuaucgcucaggccugcgaucccaagacgcucauuggcuuagcgcggucugaagagagcgaccugcgcuucuuucuuuugccuccaccccugccuucccuaaaagaggauucaaguacugaagaggaacuccgacagcugcuugcaagccugccacaaaccgaguuggacgaauguauccaguacuucacaucucucgcccuguccgagucaagccagaguuuagcugcccagaagggugggcuguggugcuuuggaggcaauggccuccccuaugcagagucuuucggggaaguaccuuccgcuacuguugagauguuuugucuugaagccauagugaaacauagcgagauuucgacccacugcgauaagaucgaagcgaacggaggucugcaauugcuacagagacuguacaggcuccauaaagacuguccaaagguccagcggaauauuaugcgugugaucggcaacauggcccugaaugagcaccuucacucuuccaucgugcgcucagggugggucaguauuauggcagaggcuaugaaaagcccgcauauaauggaauccucucacgccgcuagaauccuggccaacuuggacagggagacaguucaggaaaaguaccaagauggaguguauguacuccauccccaguaccggaccagccagccuauuaaggcagacgugcuguucauccacggcuuaaugggugccgcuuuuaaaacguggcgacaacaggauucagagcaggcggucauagaaaagccaauggaggacgaggaucgcuauacuacaugcuggcccaaaaccuggcuggcaaaggacuguccugcccuaagaauuaucaguguggaauacgauacuucccucagcgacuggagggcucggugcccaauggagcgcaaaucuaucgccuucagaucaaaugaacugcuuaggaaguugcgugcagccgggguuggagaucggcccguggucuggauuagucauagcaugggcggccugcucgugaagaaaaugcugcuugaggcuuccacaaagccggagaugucuaccguaaucaacaauacgcgagggauuauauuuuauucgguuccucaccacggaagcagacuggccgaauacuccgugaacaucagguaucucuuguuccccucacuggaggucaaagaauuaaguaaggacucuccagcacugaaaacccuacaggaugacuuccucgaguuugcgaaggacaagaauuuccaagugcugaacuuugucgaaacacuuccuacuuacauugguagcaugaucaaauugcaugugguucccguggaguccgcugaucugggcaucggggaccucauuccaguagaugucaaucaccugaacauaugcaagcccaaaaagaaagacgccuucuuauaccagcgcacccugcaguuuauccgggaggcacuugccaaggauuuggaaaacuga

SEQ ID NO: 62332 - RNA, 333 nt, Artificial Sequence
  derived and/or modified sequence opt3 from SERF1A__Homo_sapiens__NP_068802
auggccagaggcaaccagagggagcuggcucggcaaaagaauaugaaaaagacccaggaaaucagcaaagggaagcgcaaagaggacucccucacagcaucucagcgaaagcagucaaguggaggucaaaagagcgaauccaaaaugucugccggcccccaccuuccucugaaggcgccacgugagaacccgugcuuccccuugccugcugccgggggaucgagauacuauuuagcauacggcucaauuacuccaauaagcgccuuuguguucgucguuuucuuuaguguguuuuuccccuccuuuuaugaagauuucuguugcuggaucuga

SEQ ID NO: 62333 - RNA, 1377 nt, Artificial Sequence
  derived and/or modified sequence opt3 from SERGEF__Homo_sapiens__NP_036271
auggagagagaacccagcgccuccgaggcugccccugcagcggcugcccuguucgcauggggcgccaacucuuacgggcagcucggacuuggucacaaggaagacgugcuguugccacaacaguuaaaugauuuuugcaaaccgaggucaguccggcgcaucaccggcgggggaggccauagugcuguugugacagacgguggggaucuguucguauguggacuaaacaaggacggccagcucggccuggggcacacugaggauauucccuauuuuacgccuugcaaaagccuuuucggauguccaauacagcaaguggcaugcgguugggacuuuaccaucaugcugacagaaaauggccaggucuuguccugugggucuaacucguucggacagcucggcgugccccaugguccucgacguugcguugugccacaggccauugagcugcacaaggagaaagucguguguaucgcugccgggcugagacaugcgguagcagccacugcuucaggaauuguuuuucaauggggcaccggccucgccagcugcgggaggcgguuaugucccggacagacacugccucuuuucuuuaccgcaaaggaaccaagucgcgugacugguuuggaaaauuccaaggcuaugugcguccuggccggcucugaucacagcgcgucccuaacagacgccggggagguguacguguggggaucaaacaaacacggccagcucgcaaaugaggcugccuuccugccggucccccagaagaucgaggcucauuguuuucaaaacgaaaaaguuaccgccauauggagugguuggacgcaccuuguggcacagacugagaccgggaagauguucacauggggcagagccgauuauggacagcugggcaggaaauuggaaacuuacgagggguggaagcucgaaaagcaagacagcuuucugccuugcucucggccacccaauuccaugccuucaagcccacauugcuuaaccggagcuacagagguaaguugugguucugagcacaaccuggcgaucauuggcggggugugcuauuccuggggauggaaugaacacggcauguguggugaugggaccgaggcaaacgucugggcccccaaaccggugcaggcucuccuuagcucgucuggccuguugguuggaugcggcgccgggcauucccuagcacugugucagcucccugcccaccccgcucuggugcaggacccaaaggucacguaccuuucaccugaugccaucgaagacacugagagucaaaaagcaauggacaaggaacgcaauuggaaagagcgacagagcgagacauccacccagucucagagcgauuggucaagaaacggaggucuguga

SEQ ID NO: 62334 - RNA, 1362 nt, Artificial Sequence
  derived and/or modified sequence opt3 from SERINC1__Homo_sapiens__NP_065806
augggcagcgugcuggggcucugcuccauggccucuuggauccccugucuuugcggaucagcuccuugucuguugugcagauguugcccaagugguaacaauagcaccgucacaagguuaauuuacgcacuguuccuacucguuggcguguguguagccugcgugaugcugauaccggggauggaggaacagcuuaacaagauccccggauuuugugagaaugaaaaaggcgucgugccuugcaacauucugguugguuauaaggcgguguaccgguuguguuucgggcucgcuauguuuuaucugcugcucuccuuacugaugaucaaagucaagucuucgucagacccacgcgccgcagugcacaauggauucugguuuuucaaauuugccgcugcaauugccaucauaaucggcgcuuucuuuauucccgagggcacuuucacgaccguaugguuuuacguugggauggccggagcguucugcuuuauccuuauucaauuggugcugcuaaucgauuucgcacauagcuggaacgaaaguugggucgagaagauggaggaagguaauucccgaugcugguaugccgcucuccugucugccacagcacuuaacuaccuguugagccucguggcuauagugcuguucuuugucuauuacacucacccugccuccuguucagagaauaaggcguucauuaguguuaacauguuacugugcgugggcgccagcguaaugucuauccucccaaaaauucaggaaucccagccccguucagggcuucugcagagcagugugaucaccgucuacacaauguauuugaccuggucugcaaugacuaaugagccugagacaaacuguaauccaucccuacugagcaucauuggauacaacaccacgucgacugugccgaaggaaggccaaucuguucagugguggcaugcucaggguauaaucgggcucauucuguuucuucugugcguguucuauuccucaaucagaaccaguaauaacagccaggucaacaaauugacacucacuuccgacgagucuacccugauagaagauggaggcgccaggagcgacggcucauuagaggauggggacgaugugcaccgggcuguagacaaugaacgcgauggaguuacauacaguuauuccuuuuuccauuuuaugcuguuccuagccagccucuacauuaugaugacccugacgaacugguauagauacgagcccucuagggagaugaagucacaauggacugcagugugggucaaaaucaguagcuccuggaucgguauugugcuuuacgucuggacauugguggccccucugguucucaccaaucgggacuuugauuga

SEQ ID NO: 62335 - RNA, 1422 nt, Artificial Sequence
  derived and/or modified sequence opt3 from SERINC3__Homo_sapiens__NP_006802
augggcgccgugcugggggucuucagccucgcuuccuggguucccugccuuuguucuggagcaucaugccuguuguguaguugcuguccuaacagcaaaaauuccaccgugacaagauuaaucuacgccuuuauucugcuacucucuacuguagugucguauauaaugcagaggaaggagauggaaacguaccugaagaaaaucccagguuucugcgagggcggguuuaagauucacgaagcggacaucaacgcugauaaagacugugauguccuugugggauauaaggccguuuaccggauuucauucgcaauggccaucuuuuucuuuguguucagccuguugauguuuaaggucaaaaccaguaaggaccuccgcgcugcagugcauaauggcuucugguuuuucaaaauagccgcucugaucgguauuaugguaggguccuuuuauaucccgggaggcuacuucucuagcguuugguucguggucggcaugauuggggccgcgcuguuuauccucauacaauuagugcugcuuguggauuucgcacacuccuggaacgagucaugggucaaucgaauggaagagggaaacccccguuugugguaugccgcucugcuaaguuuuacaagcgccuucuacauucucucuaucauuugcguuggucugcuuuacacuuauuacaccaagccugacggcuguacagagaauaaauuuuucaucuccaucaaccugauuuugugcgugguagcaucaauaaucagcauucauccaaagauccaggaacaccagcccagaagugggcuccugcagucuuccuuaauaacccuguauacuauguaccucacauggagcgcuaugucgaaugagccugauaggucuuguaacccaaaucuuauguccuuuauuacccggaucacggcccccacucuggcgccuggaaacucaaccgccguggucccaacaccgacucccccuaguaagagcggcuccuugcuagacucugauaauuucaucggucuguuuguguucguucucugccugcuuuauagcucaauucgcaccaguacaaacucccaaguggacaaacugaccuugagcgggucugauucagucauccucggagacacgacuacaaguggcgcaagcgaugaagaggacggccagccaagaagggcuguggacaaugagaaggaagggguacaguacuccuauucucuguuucauuuaaugcugugccuagccucgcucuacauuaugaugacccugacuagcugguacucccccgaugcuaaauuccagucaaugacaaguaaguggccugccguuugggugaaaauaucuagcuccugggucugucuuuugcuguauguguggacccucgucgcaccacuggugcuuacgucacgggacuuuagcuga

SEQ ID NO: 62336 - RNA, 1263 nt, Artificial Sequence
  derived and/or modified sequence opt3 from SERINC5__Homo_sapiens__NP_001167542
augagcgcccagugcugugcuggccaacuggcaugcuguugcggguccgccggauguucucucugcugugacugcugucccagaaucaggcagucacuuaguacccgguucauguacgcgcuguauuuuauuuugguggucguuuuaugcuguauaaugaugagcacaacuguggcucacaagaugaaagagcauaucccuuucuuugaagauaugugcaaggguauuaaagccggcgacacgugcgagaagcugguaggguacuccgcaguguaucgcgucuguuucggaauggccugcuuuuucuuuaucuucugucuacucacccugaaaauuaacaauucuaagucgugccgagcucacauccauaacggcuuuugguucuuuaaacuucuguugcucggugcaauguguucaggggccuucuuuauaccagaucaggacacauuccugaaugcuuggcguuacgugggagccguuggcggcuuccuguuuaucgggauucagcucuuacugcuuguggaguucgcgcacaaguggaacaagaauuggacugcaggaaccgccagcaacaaauugugguaugcuagucuggcccuagucacacucaucauguacuccauugcaaccgguggccuggugcuuauggcuguauuuuauacucaaaaggauucuugcauggaaaauaaaauccuguuggggguuaacggaggccucugucuguuaauaagccugguggccauuuccccguggguccagaauagacagccccauucaggucuccuucagaguggggugaucagcugcuacgugacauaccugaccuucucugcguuguccucaaagccugccgaagucguucuagacgagcacggaaagaacgugacgauuuguguaccagauuuuggccaagaccuguauagggaugagaaucucgugacuauccugggcaccagccuucugaucgggugcauuuuguacaguugucucacaucuacuacccgguccagcucggacgcacugcagggacgcuaugcugcccccgaauuagagauagcuagaugcugcuucuguuuuucuccugguggcgaagauacagaggagcagcagccagggaaagaaggacccagggucaucuacgacgagaagaaaggcaccguguauauuuacuccuauuuccacuuuguuuucuuucuggccucacuauacgugaugaugacggucacuaacugguucaagagugcauuucaucuccugccuuga

SEQ ID NO: 62337 - RNA, 201 nt, Artificial Sequence
  derived and/or modified sequence opt3 from SERP1__Homo_sapiens__NP_055260
augguggccaagcagagaaucaggauggcuaacgagaaacacagcaagaauauuacccaacggggcaacgucgcaaaaacaucccgcaaugcccccgaagagaaggcgucuguugggccuuggcugcucgcucuuuucauauuugugguaugcggaucagccaucuuccagauuauccagaguauucgaauggguauguga

SEQ ID NO: 62338 - RNA, 198 nt, Artificial Sequence
  derived and/or modified sequence opt3 from SERP2__Homo_sapiens__NP_001010897
augguggccaagcagagaaucaggauggcuaacgagaaacacagcaagaauauuacccaacggggcaacgucgcaaaaacacugcgcccccaggaagagaaguacccuguugggccauggcuccuugcccuguucguguuuguagugugcggauccgcgauauuccagaucauucagucuauccgaauggguauguga

SEQ ID NO: 62339 - RNA, 1335 nt, Artificial Sequence
  derived and/or modified sequence opt3 from SERPINA10__Homo_sapiens__NP_001094077
augaaggugguccccagccugcuccuuuccguucuguuggcccaggugugguuaguaccuggccuggcuccaucuccgcaaucacccgagaccccugcaccacagaaccagacaaguagagugguccaggcccccaaagaagaggaagaggacgaacaagaggcgagcgaggaaaaggcuuccgaggaagagaaagccuggcuaauggcaucuaggcagcagcucgccaaggagacuucgaauuucggguuuucacugcuucggaaaaucagcaugcgccacgauggaaacaugguguucaguccuuuugguaugucccuggcuaugacgggcuugaugcucggggcaaccggaccaacagaaacucagauuaagcgaggccugcaucugcaagcccucaagcccaccaaaccugguuuacugccaucucuuuucaagggguugcgugagacacugagcagaaaucuagaacucggacugacccagggcuccuuugcuuucauacacaaagacuuugauguuaaggagacuuucuuuaaccuuucaaaaagguacuucgacacagaaugcgugccgaugaauuuucggaacgccagucaggcgaagcgccugaugaaucauuauaucaacaaggagaccagaggcaaaauucccaaguuguucgaugagaucaauccugaaacgaaacucauucuggucgacuacaucuuauuuaaggggaaauggcugacuccauucgaucccguguucaccgagguagacacauuucaccucgauaaguauaaaacuauaaagguuccuaugauguacggagcagguaaguucgccagcaccuuugacaaaaacuucaggugucaugugcuuaagcugccauaucagggcaaugcuacaauguuggucgugcuaauggagaaaaugggggaucaccuggcccucgaagacuaccugaccacggaucuuguggaaacuuggcugcggaacaugaagacacgcaauauggaggucuuuuuccccaaauuuaaguuggaccaaaaguaugagaugcacgaacuccugcgacagaugggaaucagaaggauuuucucuccguuugcagacuuauccgagcugucagcuaccggccggaaccuacagguuagccgugugcuccaacgcacuguaaucgaaguggaugagagagguacagaagccgucgcggggauucugagugagaucaccgccuacucuaugccucccgugauaaaaguugacaggccauuccauuuuaugauuuacgaggaaacguccggaaugcuuuuguuccugggccggguggucaauccuacccuccuguga

SEQ ID NO: 62340 - RNA, 1269 nt, Artificial Sequence
  derived and/or modified sequence opt3 from SERPINA11__Homo_sapiens__NP_001073920
augggccccgccuggcuguggcuccuugggaccggaauccuggcuagcgugcacugccagccuuuguuagcacauggugacaagucccugcaaggcccacagccgcccagacaccagcuaucugagccugccccagcguaccauaggauuacacccacuauaacgaacuucgcucuccggcuguauaaagaacuugccgcagaugccccugggaauaucuuuuucucaccagucaguauuagcaccacacuggcuuugcucucccugggagcacaggccaacacuucugcucugauccucgagggcuuagguuuuaaucugaccgaaacacccgaggccgacauucaccaaggguuccgcucgcuuuugcauacccuggcgcuaccuucaccaaagcucgaacugaaaguuggaaacagccuuuuucuggauaagcgauugaaaccgcgucagcacuaccucgacaguaucaaggagcuguauggcgcauucgccuuuuccgcuaauuucacugauucugugacaaccggcagacagauaaacgacuacuuaaggcggcagacguaugggcaaguaguggauugucugcccgaguuuagccaggacacuuucaugguccucgccaauuacaucuuuuucaaggcaaaauggaagcacccuuuuucccgcuaucagacccagaaacaagaaucauucuucguggaugagagaacaagucuucagguuccaaugaugcaucagaaggaaaugcacagguuucuguacgaccaagauuuggcuugcacugugcuacagauugaguaccggggaaacgcccuggcgcuccugguccuucccgacccugguaaaaugaaacagguggaggccgcacugcagccacaaaccuugcgcaaguggggccagcuccuguuacccagccugcuagaucuccaucugccgcgauucucuaucuccgggacauauaaucuugaagacauuuugccucagaucggacugaccaacauacucaaucuggaggcugacuuuucaggcguaacgggucagcuuaacaagacuauuagcaagguuagucacaaagccaugguggauaugucugaaaaggggacagaggcuggagccgcauccggccuguugagccaacccccaucgcucaauaccaugucugacccucacgcccauuucaacagacccuuucuguuacugcuaugggaagucacuacacagucccuccuguuccuuggcaaaguggugaauccagucgcuggguga

SEQ ID NO: 62341 - RNA, 1245 nt, Artificial Sequence
  derived and/or modified sequence opt3 from SERPINA12__Homo_sapiens__NP_001291390
augaaccccacccugggccucgccaucuuccuugcugugcuguugacagucaagggguuacugaaaccuagcuuuuccccaagaaauuacaaggcacuaucugagguucagggauggaaacaaaggauggccgcgaaggaacucgcucggcagaacauggaccuggguuucaaacuucugaagaaguuggccuuuuauaauccgggccgcaacauuuuccucucaccccugaguauaagcacugcauuuuccaugcugugccucggggcccaggauucuacguuagacgagaucaaacagggauucaauuuucgaaagaugccugaaaaagaucugcacgagggcuuccauuacauuauccacgaacuuacccaaaagacacaggacuugaaacugucgauugguaacacucuauuuaucgaucagcgucuccagccacaaagaaaguuccuggaggacgcuaagaauuuuuauucagcagagaccauacuuacaaacuuccagaaucuggaaauggcccagaaacagaucaacgauuuuauuagccaaaagacccaugggaaaaucaauaacuugauugagaauaucgaccccggaacugugaugcuccuggcuaacuacauauucuucagggcccgguggaagcacgaauuugauccuaauguaacaaaagaggaggacuucuuuuuagaaaagaacaguuccgugaaagucccaaugauguuccgcucuggcauuuaucaggugggcuacgaugacaagcugagcuguaccauccucgagauucccuaucagaagaacaucacggcgaucuuuauucuuccugaugaagggaaacugaagcauuuggagaaaggacuacaaguugacacuuucuccagauggaagacccugcucucaaggcggguggucgacgugaguguaccacgccugcacaugacagguacuuuugaucuuaaaaagacccugagcuacauaggcguuucuaagaucuucgaggaacacggggacuugacaaaaauugcaccgcaucgaucccucaaggugggagaggccguccacaaagcugaacugaagauggaugagagaggcaccgaaggugccgcagggacgggagcucagacuuuacccauggagacaccucugguggugaaaaucgacaagccauaccuacuccugauauauucagaaaagauucccagcgucuuguuucuuggcaaaaucguuaauccuaucggcaaguga

SEQ ID NO: 62342 - RNA, 1257 nt, Artificial Sequence
  derived and/or modified sequence opt3 from SERPINA1__Homo_sapiens__NP_001121179
augcccagcuccgugucuuggggcauccugcuccuugccgggcugugcuguuuggucccuguuucauuagcugaggacccacagggagaugcagcccaaaagaccgacacaagucaccacgaucaggaccacccgacuuucaacaaaaucacgcccaaucuggcggaauuugcuuucagccuauacagacagcucgcccaucaguccaacucuaccaauauauuuuucucgccugugucaaucgcaacagccuuugcuaugcugagccuugguacuaaggcagauacccacgacgagauucuggaaggcuugaacuucaaucucacagagaucccagaagcccaaauucaugagggguuucaggagcugcugaggacccucaaccagcccgauagucaguuacaacugacuacaggaaauggccuuuucuuguccgaaggucugaagcuaguagacaaguuucucgaggaugugaaaaagcuguaucacucugaggcuuucaccgucaacuuuggggacacggaagaggccaagaaacagaucaaugauuacguggaaaagggaacucagggcaaaauaguugaccuugugaaggagcuggaucgggacaccgucuucgcguuggugaacuauaucuuuuucaaaggcaagugggaacgcccuuucgagguaaaggacacagaagaggaggauuuucacguugaccaggugacuaccgucaaagugccaaugaugaagcgacucgggauguucaauauucaacauugcaaaaagcugagcuccuggguguuacugaugaaauaccucggaaacgcaacagccaucuuuuuccuucccgaugaagguaagcugcagcacuuggagaaugaacuaacccaugacauuaucacgaaauuucuggagaacgaagaucguagaucagcuagucuccaucugccuaaacuuagcauaacuggcacauaugaccugaagucugucuuggggcagcucggaauuaccaaaguuuucuccaauggcgccgaucugucaggugugacugaggaggcaccauuaaagcugagcaaagcuguacacaaggccgugcuaacaaucgacgaaaaagggaccgaggcggccggagcaauguuucucgaagcuauuccgaugaguauucccccugaggucaaguucaacaagccauuuguguuccugaugaucgaacaaaacacgaaaucuccccuuuuuaugggcaagguugugaauccuacccagaaauga

SEQ ID NO: 62343 - RNA, 1272 nt, Artificial Sequence
  derived and/or modified sequence opt3 from SERPINA3__Homo_sapiens__NP_001076
auggagagaaugcugccccuccuugcccugggcuuguuagcugcaggguucugcccugccgugcugugucacccaaacagcccgcuagacgaagagaaucucacccaggaaaaccaagauaggggaacacaugucgaccugggucuugcguccgcuaauguugauuuugccuucucucuguacaagcaguuggugcucaaagcacccgacaagaacguaaucuuuucaccucugaguauuagcacugcccuggcuuuccucuccuuaggcgcacacaauacgacccugacagagauacuuaaaggguugaaguuuaaccugacugaaaccucugaggccgagauccaucagucguuccagcaccuacuccggacacugaaucaaucaagcgaugaacuucagcugaguaugggaaacgcuauguuugugaaagagcaguugucccuccuggaccgcuucaccgaagaugccaagcgauuauauggcucugaggcguuugcaacugacuuccaggauagcgccgcugccaagaaacugauuaaugacuacgucaagaacgguacacgugggaaaaucaccgaucucauuaaggaccuugauucccaaacgaugauggugcugguuaauuauaucuuuuucaaagcaaagugggagaugccauuugacccccaggacacucaucagucaagauucuacuugaguaagaaaaagugggugauggucccuaugaugagccuacaccaccugaccauaccauauuucagggaugaagaacucucuugcacagugguagaacugaaauacacuggaaacgcuuccgcccuuuuuauccugcccgaccaggauaagauggaggaaguugaggcgauguugcucccugagacccugaaacgguggcgcgacucauuagaguucagagagauuggcgaacuguaucuaccaaaguuuagcaucaguagggauuacaaucucaacgacauucugcuucaauugggcaucgaggaagccuucacaucuaaagcagaucuguccgggauaaccggagcucggaaucucgccgugagccaggucgugcauaaggcugugcuggacgucuuugaggaggguacggaagccucggcagccacugcuguuaagauuacacuucugucugcguugguggagacccgcacuaucguacgauucaacagaccguuucucaugauuaucgugcccacagauacccagaacaucuucuuuauguccaaagucacgaauccuaagcaagcauga

SEQ ID NO: 62344 - RNA, 1395 nt, Artificial Sequence
  derived and/or modified sequence opt3 from SERPINA4__Homo_sapiens__NP_001275961
augcccggcgacccugagaagccaccgcccgggacccacagcugguacagagccgcucugacagaaggacagggucuccuugcagccaacccuggccugagggugcaacggaugcauuugaucgauuauuuacugcuacuccuggucgggcuucuggcguugucccacggacagcuccauguugagcacgacggcgaaucuugcucaaauaguagccaucagcagauucuggagacuggugaaggguccccaucucugaaaauagcucccgccaacgcagauuucgccuuucgcuucuacuaucucaucgcuucggagacgccuggaaagaauaucuuuuucucaccauuaagcauuagugcagccuacgcuaugcugucccuuggcgccuguucucacagccgaucccaaauuuuggagggccugggguuuaaccuaaccgaacucucagagagugacgugcaccguggauuccagcaucugcuucacacacugaauuugcccggucauggccucgaaacuagaguagggagcgcgcuguuuuuaucucacaaccugaaauuccucgcaaaguuucuuaaugauaccauggccguguaugaggcuaaacuguuccacacaaacuuuuacgacaccgucggaacuauccaguugauaaaugaucaugugaagaaggagacaaggggcaaaaucguugaccuaguguccgaacugaagaaagauguccucauggugcugguaaacuauauuuacuucaaggcccuuugggagaaaccuuuuaucucaagccggaccacgccaaaggacuucuacguugaugaaaauacuaccgugcgcgucccgaugaugcugcaggaccaagagcaccauugguauuugcacgauagauaccuccccugcagugugcugaggauggacuauaagggugacgcaacaguguucuuuauuuuaccuaaccaggggaaaaugcgggaaaucgaggagguccugacuccagaaaugcuaaugcgcuggaauaaccuccugcgaaagagaaauuucuacaaaaaguuggagcuucaucugcccaaauuuucuauauccggaagcuauguucucgaucagauucugccuaggcuuggcuucaccgaccuguuuucgaagugggcugauuugucuggcaucacaaaacagcaaaagcucgaagccuccaagucauuccacaaagcgacccuggacguggaugaggccgggacggaagcagcugccgcuacaaguuuugccauuaaguucuuuagcgcacagacuaaccggcacaucuuacguuucaaccgcccauuucugguagugaucuucuccaccucuacucagagcguccuauuucucggaaaagugguugaccccacaaagccguga

SEQ ID NO: 62345 - RNA, 1221 nt, Artificial Sequence
  derived and/or modified sequence opt3 from SERPINA5__Homo_sapiens__NP_000615
augcagcuguuccuccuucugugcuugguguuacugagcccccaaggcgccucccuacacagacaucacccuagggagaugaagaaacgggucgaagaccuccauguuggggcuaccguggcaccaucuucacgccgagauuuuacauucgaccuguaccgugcccuugcgagugcugccccgagccaguccaucuuuuucucucccguaucgauuucaaugagccuggcaauguugagucucggagccgguuccucuacuaagaugcagauacuggagggccuggggcucaacuuacagaaaagcuccgaaaaggagcugcacagaggauuucaacagcuuuugcaggaacugaaucagccuagggauggcuuccaacuaucacucgguaacgcucuguuuacggaccuuguggucgaucugcaggacaccuucgugagugcaaugaaaacauuguaucucgccgauacuuuuccaaccaauuuccgggacagcgcuggggccaugaagcagaucaacgauuacguugcgaagcagacaaaaggaaagauuguggaccugcuuaaaaaucuggauucuaacgcagucgugaucaugguaaauuauaucuuuuucaaggccaaaugggagaccuccuuuaaccauaagggcacucaagagcaggacuucuacguuacaucagaaaccgugguccgcgugcccaugaugagcagagaggaucaguaucacuaccuccuugacaggaaucugaguugucggguggucggcguuccuuaucaagggaacgcuacggccuuguucauucuaccaucugaaggaaagaugcaacagguggagaauggucuguccgagaaaacucuccgcaaguggcugaaaauguuuaagaaacgacagcuugaacuguacuugcccaaguucagcauagagggcucguaccagcucgaaaaaguacugccuucuuuagggaucuccaacguguuuaccucacacgcagaccugaguggaauuagcaaucauuccaacauccaggucucugagauggugcacaaggcuguuguggaagucgaugagagcggcacaagagccgcggccgcaacugguaccauuuucacauuuaggucagcucggcuaaauagucagcgucucguguucaaccgcccauuucugauguucaucguagacaacaauauauuauuuuuggggaagguuaacagaccguga

SEQ ID NO: 62346 - RNA, 1218 nt, Artificial Sequence
  derived and/or modified sequence opt3 from SERPINA6__Homo_sapiens__NP_001747
augccccugcuccuuuauaccugccuguugugguuaccuacaagcggccuguggacugugcaggccauggacccaaacgcugcauacgucaauauguccaaccaccauagagggcuagccucugcgaauguugauuucgcuuuuucacucuacaagcaccugguggcccuuaguccgaaaaagaacaucuucauuagccccguauccauaucuauggcacuggccauguugucgcucggaacguguggucauaccagggcucaacugcugcagggccucggguuuaauuuaacagagcggucagaaacugagauccaccagggauuccagcaucugcaccaacuuuuugcaaaaagcgacaccaguuuggaaaugacaaugggcaacgcccuguuccuagaugguucccucgagcugcuugaaucuuuuagcgcugacauuaagcacuauuacgaguccgaggugcuggccaugaauuuccaggauugggcgaccgcaucacgccagaucaacaguuaugucaaaaauaagacucaggggaagauuguggacuuguuuagcggacucgauucuccugccauccugguuuuagugaacuacauauucuuuaaaggcacauggacccaaccauucgaccuggcuuccacgcgagaagagaauuuuuaugucgaugaaacuaccgugguaaagguucccaugaugcuccagucaagcacaaucaguuaccuucaugacgccgagcugccuugccaguuggugcagaugaacuacgucggcaaugggacuguguucuucauucuaccagauaaaggaaagaugaacaccgugaucgcagcucugucucgugacacaauuaauagaugguccgccggucucaccagcucgcaagucgaucuguauauccccaaaguuacgauaucuggcguguacgaccuuggggacguacuggaggaaaugggaauugcggauuuguuuacuaaccaggccaacuucuccaggaucacacaggacgcacaacucaagucaaguaaggugguccacaaagcugugcugcaguuaaaugaggaaggcguugauaccgccgguagcacuggggugacacugaaccuaaccuccaagccuauuauccuccgguuuaaucagccauucaucauuaugauauuugaccauuucacguggucuagccuguuucuugcucgcgucaugaacccgguguga

SEQ ID NO: 62347 - RNA, 1248 nt, Artificial Sequence
  derived and/or modified sequence opt3 from SERPINA7__Homo_sapiens__NP_000345
augagccccuuccuguaccucgugcuucuggucuugggcuuacacgccaccauccauugcgcuuccccugaggggaagguuacagcaugucacucuucacagccaaacgccacucuguauaaaaugaguagcauuaaugcggacuuugcuuucaaccuauacagaagguuuacgguggaaaccccggauaagaauauauucuuuucccccguaucuaucucggccgcacucgugaugcugucauucggagccugcuguagcacacaaacugagauugucgaaacccuugguuuuaaccugacagacaccccuaugguggagauccagcauggcuuccagcacuugauuugcagucucaauuuucccaaaaaggaacuggagcugcagaucgggaacgcucucuucauaggaaaacauuuaaagccacuggcaaaguuucuuaaugauguuaaaacuuuguaugagacagaaguguucuccaccgacuuuucuaacaucagcgccgcuaagcaagagauuaauucccacgucgaaaugcagacgaaaggcaaggugguaggucugauccaggaucuaaaaccuaacacuauuaugguucucgugaauuacauccacuucaaggcccagugggcgaacccauucgaccccucaaagaccgaggauaguagcucuuuucugauagacaaaacaacuaccguccaagugccuaugaugcaucagauggagcaguauuaccaccuuguggauauggaacugaauuguacagucuugcagauggacuauuccaagaacgcacucgcccuguucguuuuaccaaaagaggggcaaauggaaucaguggaggcugccaugagcaguaagacccugaaaaaguggaaucggcuccuucagaaaggauggguagaucuguuugugccgaaguucucuauuuccgcaacguacgacuugggcgcuacucuacugaagaugggcauccagcaugccuacagcgaaaacgcggauuuuucggggcucacagaggacaacggacugaaacuuucuaaugccgcacacaaggcuguccugcacauuggugagaaaggcaccgaagccgcugccgugcccgagguugaauuguccgaccaaccugagaacacuuuccuccauccaaucauccagauugaucgcucauuuaugcuguuaauacuggaacgaaguacacguagcauccuauuccucgggaagguggucaaucccaccgaggcauga

SEQ ID NO: 62348 - RNA, 1008 nt, Artificial Sequence
  derived and/or modified sequence opt3 from SERPINA9__Homo_sapiens__NP_001035983
augcagggccaagggagaaggcggggaaccugcaaggacaucuucuguagcaaaauggccuccuaccuguauggugugcucuuugcugucggccuuugcgcacccauuuacuguguuucuccugccaacgcgccaucagcuuauccgcgccccaguagcacaaaguccacuccugccucucagguguacucgcugaauacggauuucgcauuucgauuguaucguagauuaguacuggagaccccaucacagaacauauucuuuagccccgccaggaucaauagucacgugaaaaagaaaacacaggggaaggucguggacauuauccaaggacuagaucuccugacugcuaugguucuugugaaccauauuuucuuuaaggcaaaaugggaaaagccuuuccacccagaguacacccggaaaaauuuucccuuccuggucggcgaacaggugacaguacauguuccuaugaugcaccagaaggagcaguuugccuucgguguggacaccgaauugaacugcuuuguccuccaaauggauuauaaaggggacgcuguggccuucuucgugcugccauccaagggaaagaugcgccagcuggagcaggcgcucucugcaagaacuuuaaggaaauggagccauucccugcagaagcgguggaucgaggucuuuauaccgcgcuucucaaucagugccagcuacaaucuugaaacaauuuugcccaaaaugggcauccaaaacguuuuugauaagaaugcugacuucucuggcauugccaaacgagauucccuacaggugucaaaggcaacccacaaagcuguacuggacgugagcgaggaagggacggaggccacugcggccaccacaacuaaguuuaucgucagaaguaaggauggaccuucuuacuucaccguguccuuuaacaggacauuccucaugaugauaaccaauaaagcaacggacgguauucuguuucuuggcaagguugagaacccaacuaaaagcuga

SEQ ID NO: 62349 - RNA, 1194 nt, Artificial Sequence
  derived and/or modified sequence opt3 from SERPINB10__Homo_sapiens__NP_005015
auggacagccuggccaccuccaucaaccaguucgcucucgagcuuucuaagaaacuggcagaaucagcccaaggcaagaauauauuuuucaguagcugguccauuucuacaucguugacuaucguguacuuaggggcgaaaggaacgaccgcugcccagauggcacagguccugcaguuuaacagagaucaagguguuaagugcgaccccgagucagaaaagaaaaggaagauggaguucaaucuaagcaacagugaagagauucacuccgauuuucagacacucaucucugagauucugaaaccuaaugacgauuaucuucugaagacugccaacgcuaucuacggcgagaaaaccuaugcauuccauaauaaguacuuggaagacaugaaaacauauuuuggggccgaaccacagccggugaacuucguagaggcuagcgaucagauacggaaggacaucaauuccuggguggagcgccaaaccgaaggaaagauucagaaccuccugcccgaugacucagucgauaguacuacacgaaugauccuggugaaugcccucuacuuuaaaggcauuugggagcaccaguucuuaguucagaacaccacggaaaagccuuuucguaucaaugagacuaccagcaaaccagugcaaaugauguucaugaagaaaaagcugcauauauuucacauugaaaaacccaaggcggucggucuucaguuguauuacaagucuagagaccugucccuacucauccugcuuccugaggauauuaacgggcuggagcaguuggaaaaagcaaucacauacgagaagcucaaugaauggacuucagccgacaugauggagcuguaugaagugcaauuacaucugccaaaauucaagcucgaggacagcuacgaucuuaaaaguacccugucuuccaugggaaugagcgacgcuuucucgcagucuaaggccgauuuuuccggcaugucaagugcaaggaacuuguuccuaagcaacguauuucacaaggcuuucguugagaucaaugaacagggcacagaggccgcggccggguccggaucugaaauugacauacggauccgcgugcccagcauugaguuuaacgcaaaucacccuuuccuguuuuucaucagacauaacaaaaccaauacgauacucuuuuaugguaggcuguguucaccauga

SEQ ID NO: 62350 - RNA, 1176 nt, Artificial Sequence
  derived and/or modified sequence opt3 from SERPINB13__Homo_sapiens__NP_036529
auggacagccugggcgccguguccaccagacucggguucgaucuuuuuaaggagcugaaaaagacaaacgacggaaauaucuucuuuucucccgucgguauuuugacugcuauaggcaugguuuuacuggggacgaggggagcaaccgccucacagcuagaagagguguuccacagugaaaaagagacaaagagcucccggaucaaagcggaagagaaggagguaauugaaaacacugaggcugugcaucaacaguuucagaaguuccucaccgaaaucucuaaacugacaaaugauuacgagcuuaacauuaccaaucgccuguuuggcgagaagacuuauuuguuccuccagaaauaccuggacuaugucgaaaaguacuaucacgccucgcuggagccuguggauuuuguuaacgcagccgacgaaucacguaaaaagaucaauagcuggguggagaguaagacaaacgaaaagauaaaagaucucuucccagacgguuccaucucuagcuccaccaaauuaguccuggugaauaugguauacuuuaaggggcaaugggaucgagaguucaaaaaggagaacacgaaagaagagaaguuuuggaugaauaagucaaccaguaaaagcguucagaugaugacucagucucauuccuucucauucacauuucuugaagacuugcaggcuaagauucugggaaucccguauaaaaacaaugaucuaagcauguucgugcuccugcccaacgacauugauggccuugagaagaucauagacaaaauuaguccugaaaagcuggucgaguggacuucuccaggccacauggaggaaagaaaggugaauuugcaucuccccagguuugagguggaagacggguacgaucuggaggcagucuuagccgcuaugggaaugggugacgccuucuccgaacacaaagcggauuacagcggcaugucgucuggguccggacuguaugcacaaaaguuucuccacucaaguuucguugccgugaccgaggagggcacagaagcugccgcagcuaccgguaucggguuuacgguaacuagcgccccuggacaugagaacgugcacugcaaccauccauuccuuuucuuuauucggcacaaugaauccaacucuauccuguuuuucggccgcuuuagcucacccuga

SEQ ID NO: 62351 - RNA, 1140 nt, Artificial Sequence
  derived and/or modified sequence opt3 from SERPINB1__Homo_sapiens__NP_109591
auggagcagcugagcuccgccaacaccagauucgcucucgaccuuuuucuggcauugucugaaaauaaccccgccggcaauaucuucauuucaccuuuuaguauaagcuccgcgauggcuaugguguucuuagggacaaggggaaacacugccgcacaacugucuaagacguuucacuucaauaccgucgaggaaguucauucgcgguuucagucacuaaacgccgauaucaauaaacgcggugcuagcuacauucucaagcuggcaaaccgacuuuauggcgagaaaacauacaauuuccugccagaauuuuuggugaguacucagaagaccuauggggccgaccucgcuuccguagauuuccagcacgccucugaggacgcgcguaaaacaaucaaccaaugggugaagggacagaccgagggcaagauuccggaacugcuggcaagcgguauggucgauaauaugacuaaacucguguuaguuaacgccaucuacuuuaaggggaauuggaaagacaaguucaugaaagaggcuacaaccaacgcccccuuuagacugaauaagaaggauaggaaaacggugaagaugauguaucagaaaaagaaauucgcauacggauauauagaagaccuuaagugccgggucuuggagcugccuuaccagggcgaggaacuauccauggugauccuccugccagaugacauugaggaugaaucaacuggccuuaaaaagaucgaggaacaacugaccuuggagaagcuccaugaguggacaaaacccgaaaaccuggacuucauugagguaaacguuaguuuaccucgcuuuaagcuggaagagagcuacacucucaauucugaucuugcuagacugggggugcaggacuuguucaacuccucaaaagccgaccuaagcggaaugaguggugcgagggauaucuuuauaucuaagauuguccacaaauccuucguggaagugaaugaggagggcaccgaagccgcagcugccacagcugggaucgccaccuuuuguaugcugaugccagaggaaaacuucacggcagaccaucccuuucucuucuuuauucggcacaauagcucgggaucuauccuguuccuuggccgcuuuuccucaccuuga

SEQ ID NO: 62352 - RNA, 1248 nt, Artificial Sequence
  derived and/or modified sequence opt3 from SERPINB2__Homo_sapiens__NP_001137290
auggaggaccugugcguggccaacacccucuucgcucuuaaucuguuuaagcacuuggcaaaagccagccccacacagaacuuauuccuguccccuuggucuaucucaaguacuauggcgauggucuacaugggcagcagaggguccacggaagaucaaauggcuaagguucuacaguuuaaugaggugggagccaacgcaguaaccccaaugacaccggaaaauuucacuucuugugguuuuaugcagcagauucaaaaaggcucguaucccgacgccauacuccaggcucaggcagccgauaagauccauagcucauucaggagucuguccucugcuauuaacgccagcaccgggaauuaccuucuggaguccgugaacaaauuguuuggagaaaagucagcgaguuuccgggaggaguauauccgccucugccagaaguacuauagcucugaaccucaagcagucgacuuucuggagugugccgaagaggcucguaaaaagauuaauuccugggugaaaacacagaccaagggcaaaaucccaaaccugcuccccgaggguucaguugauggggacacucgaaugguguuagucaaugccguguacuucaagggaaaguggaaaacaccuuuugaaaagaaacugaacggccuuuauccauucagaguaaauagcgcacagaggacccccguucagaugauguacuugcgggagaagcugaacauaggcuacaucgaagaucuaaaagcucaaauucucgagcugccuuaugccggggacgugaguauguuucuucuguugccagaugaaaucgcggacgucucuacgggacucgagcuguuagaguccgaaauuacuuacgauaagcugaauaaauggaccagcaaggacaagauggccgaggaugaaguggagguguauaucccgcaguucaaacucgaggaacacuacgagcuucgcucgauacugagaucuauggguauggaagacgcauucaacaagggcagggcuaacuuuuccgggaugucagagcggaaugacuuguuccuaagugaagucuuucaucaggccaugguugaugugaacgaggaaggaacagaggcugccgcaggcacuggugggguaaugaccggacgcacaggccacggcgggccccaauucguggccgaccauccuuuucuguuccucauuaugcacaaaaucaccaauugcauucuguuuuucggacgauuuagcuccccauga

SEQ ID NO: 62353 - RNA, 1173 nt, Artificial Sequence
  derived and/or modified sequence opt3 from SERPINB3__Homo_sapiens__NP_008850
augaacagccuguccgaggccaauaccaaguucauguuugaccucuuccagcaauuuagaaaaucuaaggaaaacaauaucuucuacucacccauuaguauaacaagcgcucuuggcauggugcuguugggggcaaaagauaacacugcccagcagaucaagaaagucuuacacuuugaccagguuacggagaauaccacaggaaaggcggcuacuuaucauguggauagguccgguaacguacaccaucaauuccagaagcugcuaaccgaauuuaauaaaucuacagacgccuacgagcucaagauugcaaacaaacuguucggcgaaaagaccuaucuuuuucugcaggaguacuuggaugccaucaaaaaguucuaucagacuucgguggagucagucgacuuugcuaaugcaccugaagagagccggaagaaaauuaacaguuggguggaaucccaaacaaaugagaagaucaaaaaccucauaccagaggggaauaucggaucuaacaccacgcugguucuggugaaugccauuuacuucaagggccagugggagaaaaaguuuaacaaagaagauacuaaggaagagaaguucuggccgaacaaaaauaccuauaagagcauccagaugaugcgccaguacacauccuuccacuuugcuucacucgaagacguccaagccaaaguguuagagauucccuacaaggguaaagaucugaguaugaucguacuuuugccuaacgagauagacgggcugcagaagcuagaagagaagcucacugcggaaaaacugauggaguggaccagccuucagaauaugcgagaaacacguguugaucugcauuugccaagauucaagguggaggagucuuaugaccucaaagauacccugaggacgaugggaauggucgacauuuuuaacggcgacgcagauuuauccggcaugacugggucacggggacuggugcucagcggugugcuucacaaggccuucgucgaaguuacagaggaaggcgcugaggccgcagcugccaccgcggugguaggguuuggaaguucucccacuuccacaaaugaagaguuccacugcaaccauccuuuucuguucuuuauccgccaaaauaaaaccaacagcauuuuguucuacggcagauuuucgucuccauga

SEQ ID NO: 62354 - RNA, 1110 nt, Artificial Sequence
  derived and/or modified sequence opt3 from SERPINB4__Homo_sapiens__NP_778206
augaacagccuguccgaggccaauaccaaguucauguuugaccucuuccagcaauuuagaaaaucuaaggaaaacaauaucuucuacucacccauuaguauaacaagcgcucuuggcauggugcuguugggggcaaaagauaacacugcccagcagaucuccaaggucuuacacuuugaccagguuacggagaauaccacagaaaaagcggcuacuuaucauguggauaggucuggaaacguacaccaucaauuccagaagcugcuaaccgaguuuaauaagucgacagacgccuacgaacucaaaauugcaaacaagcuguucggugagaaaaccuaucaguuucuucaggaguaccuggaugccaucaagaaauucuaucaaacuucaguggaaagcacagacuuugcuaaugcaccugaggaaagucggaagaagauuaacuccugggucgagucucagaccaaugagaaaaucaagaacuuguucccagauggcacgauagggaaugacacuacccucgugcugguuaacgccaucuacuuuaaaggacagugggaaaauaaguucaaaaaggagaacacaaaagaagagaaguucuggccgaacaaggaugugcaggcuaaaguccuggaaauucccuauaagggcaaagaccucagcaugaucguguuacugccuaaugagauugauggucuucaaaaguuggaggaaaaacugacugccgagaagcuaauggaauggaccucccuccagaacaugcgcgagacaugcguagaccugcaccuuccacgauuuaagauggaagagucauacgaucugaaagacaccuugcguacgauggggaugguuaauaucuucaacggagacgcggaucucaguggcaugacuuggagccauggccugucuguguccaaggucuuacacaaagcauuuguggaggugacagaagagggggucgaagccgcugccgcaaccgcuguugugguaguggagcugucaagccccaguacuaaugaagaguucuguugcaaccacccuuuucucuucuuuauaagacagaauaagacaaacucuauucuuuucuacggaagguuuuccagcccauga

SEQ ID NO: 62355 - RNA, 1128 nt, Artificial Sequence
  derived and/or modified sequence opt3 from SERPINB5__Homo_sapiens__NP_002630
auggacgcccugcagcucgcuaacagcgcauucgccguggaucuuuuuaagcaacugugcgagaaagaacccuugggcaaugucuuauucuccccuaucugucugucuaccucacuaagucucgcgcagguuggggcuaagggagacacagccaacgagauuggucaggugcugcacuuugaaaauguaaaagaugugccauucggcuuucagacugucacgagcgacgugaacaaacuuuccucuuucuacucgcugaaauugauaaagagacucuauguugauaagucacugaaucugagcaccgaguuuaucaguuccacaaaaaggccguacgcaaaggaacucgagacuguggacuucaaagauaaguuagaggaaaccaaagggcaaauuaacaauucuaucaaggaccugacagauggacauuuugagaacauucuugccgacaauagcgucaacgaucagaccaagaucuuggugguaaaugcugcauauuucguuggcaaauggaugaagaaauuuuccgaaucagagacuaaggagugccccuuccgggugaacaaaacagacaccaagccuguccagaugaugaauauggaagccacguuuuguauggguaacauagauaguaucaauugcaaaauuaucgagcugccauuccagaacaagcaccuaagcauguucauucuccugcccaaggacguggaagacgagucuacugggcuugaaaagaucgagaagcaacugaacuccgagucauugagccaguggaccaauccuaguacaauggcuaacgccaaagugaagcucucuauaccaaaauuuaaggucgaaaagaugauugaucccaaagcgugucuggagaauuuaggacugaagcauaucuucuccgaagacacuagcgauuuuucgggcaugucugagaccaaaggcguugcacucuccaacgugauucacaagguaugccuugaaaucacagaggacgggggagauucaaucgaggugccuggugcccgcauucugcagcauaaagacgaauugaaugcugaucacccauucauauacaucauucgacacaacaagacccguaauaucauauuuuucggcaaguuuuguaguccguga

SEQ ID NO: 62356 - RNA, 1143 nt, Artificial Sequence
  derived and/or modified sequence opt3 from SERPINB6__Homo_sapiens__NP_001182220
augagcgccaucauggacgugcuggcugaggcaaacggcaccuucgcccucaaucuucugaagacauuggggaaagauaacuccaagaaugucuuuuucucucccaugucaaugaguugcgcguuagcuaugguuuacaugggagccaaagguaacacugcagcccagauggcucaaauucugagcuuuaauaaguccggcgggggaggcgacauacaccaggguuuccagucucuacucacggaagugaacaaaaccgggacacaguaucugcuuagaauggcaaauaggcuguuuggagagaagucgugugauuucuugagcucauuucgggacaguugccaaaaguucuaccaggccgaaauggaggaacucgauuuuaucuccgcuguagagaaaucucgcaagcauauuaacacuuggguggccgagaaaaccgaaggcaagaucgcggagcugcugagcccuggcuccgucgacccacucacacgauuagugcugguuaaugcaguguauuuccgugggaacugggaugaacaguuugacaaagagaauaccgaggaaagacuuuucaaggucucaaagaacgaggaaaaaccggugcagaugauguuuaagcaaaguacuuucaaaaagacauacauuggagagaucuucacccagauauugguacugcccuauguugguaaagaacuaaauaugaucauuaugcucccugaugagacgacugaccugaggaccguggagaaggaacuuacauacgagaaauuugucgaauggacucggcuggauaugauggacgaggaagagguggaggugagcuugccacgcuucaagcucgaagagucuuaugauauggaauccguccugagaaacuuaggcaugaccgacgccuuugagcuggggaaggcugacuucucaggaaugagccagacagaucucagucuuucuaaaguugugcacaaguccuuuguagaagugaaugaggagggcaccgaagccgcagcugccacggcggccaucaugaugaugaggugugcacgguucgucccccgcuuuugcgcugaccauccuuuccuguuuuucauucagcacagcaaaacuaacgguaucuuguuuugugggcgauucucgucuccauga

SEQ ID NO: 62357 - RNA, 1092 nt, Artificial Sequence
  derived and/or modified sequence opt3 from SERPINB7__Homo_sapiens__NP_001248760
auggccagccuggcugcagccaacgcggaguucugcuuuaaucucuucagagaaauggacgauaaccagggcaaugggaacguguuuuucuccucucuuucacuguuugcugccuuggcauuagucaggcugggagcccaagacgauagucuaagccagaucgacaaguccggucuccagucucagcugaaacggguuuucucggauauuaaugcuucacacaaggacuacgaucuuagcauagugaacggccuguuugcagagaaaguauauggguuccauaaggacuacaucgaaugugccgagaaauuguaugaugcuaagguggaacgcgucgacuuuaccaaucaccucgaggauacacgacguaacauuaauaaguggguggagaacgaaacucauggaaaaaucaagaauguuauuggcgagggugggaucaguuccucugccgugaugguccuggugaacgcgguauacuucaaaggaaaguggcaaagcgcauuuacgaaauccgaaaccauaaauugccacuucaagucacccaaguguaguggcaaagccguugcuaugaugcaucaggagagaaaguuuaaccugagcgugaucgaggacccuucuaugaaaauucucgaauuaagguauaauggcgggaucaacauguacguccugcuuccagagaacgauuuguccgaaauugagaauaagcugacauuccagaaccuaauggaauggacuaauccgcggcgcaugaccucaaaauauguggagguguucuuuccccaguucaagaucgagaaaaacuacgaaaugaagcaauaccucagagcccugggacuuaaggacauauuugacgagagcaaagcagaucugagugguauugcuucuggcgggagguuguauaucucccggaugaugcacaagagcuacauugaagucacagaggaaggaaccgaggccacugcggccacaggcucgaauaucguugagaaacagcucccucagucuacccuguuccgcgcagaccacccauuuuuauucgugauccgaaaggaugacauuauacuguuuuccgguaaaguaucaugccccuga

SEQ ID NO: 62358 - RNA, 729 nt, Artificial Sequence
  derived and/or modified sequence opt3 from SERPINB8__Homo_sapiens__NP_001027018
auggacgaucugugcgaggccaacggcaccuucgcuaucagccucuuuaagauucuuggggaagaggacaauuccagaaacguguucuuuucucccaugucaauaaguagcgcacuggccauggucuucaugggagcgaaagguuccacagcugcccagaugucucaagcauuguguuuauacaaggauggcgacauccacaggggguuucagucgcugcuaucagaaguuaaucggacuggaacgcaguaucuccugcgcaccgccaaccgacuuuucggcgagaaaacaugcgauuuucugccugacuucaaggaauacugucagaaauuuuaucaagcugaguuggaggaacucagcuucgcagaggauacugaagagugccguaagcauauuaaugacuggguggccgagaagaccgaagguaaaaucagugagguacuggaugcugggacaguggacccacugaccaagcucgucuuagugaacgccauuuacuuuaaaggaaaguggaaugaacaguucgauagaaaauauacuaggggcaugcuguuuaagacaaacgaggaaaagaaaaccguucagaugauguucaaggaggcgaaauucaagaugggcuacgcagacgaggugcacacgcagguccuugaauugccguauguggaggaggaacuguccaugguaauccuacuccccgaugacaauacugaccuggccguuaaagaauga

SEQ ID NO: 62359 - RNA, 1131 nt, Artificial Sequence
  derived and/or modified sequence opt3 from SERPINB9__Homo_sapiens__XP_005249241
auggagacccugagcaacgccuccggcacauucgcuaucagacuccuuaagauucugugccaggacaaucccucucacaacguguuuuguucaccugucaguauaagcuccgcauuggccaugguuuuacugggggcgaaaggaaauacugcuacgcaaauggcccaggcacuaucucucaacaccgaagaggauauccauagggccuuccagucgcugcuuacagaagugaauaaggcugguacucaguaccuguugcggaccgcaaaccgccucuuuggcgagaaaacaugccaauuccugucaaccuuuaaggaaagcugucugcaguucuaucacgccgagcucaaagaguuaaguuuuauucgagcugccgaagagucccguaagcauaucaauacuuggguaucuaagaaaacagaagggaagauugaggagcugcuuccaggaagcuccaucgacgcggaaaccagauuggugcuggucaacgcaauauacuucaaaggcaaguggaaugagccguuugaugaaacguauacuagggagaugcccuucaaaaucaaccaggaggaacagcggccugugcaaaugauguaccaggaggccaccuuuaagcuagcucacguuggugaagugcgcgcccagcuccuggagcuuccauaugcaagaaaggaacugucauugcucguccuguuacccgacgaugggguggagcugaguacaguagaaaagagccucacuuucgagaaacuuaccgcuuggacaaaaccugacugcaugaagucuaccgagguugaagugcuguugccaaaauuuaagcuacaggaggauuacgacauggaauccguccugaggcaucucggaauuguggaugccuuccaacagggcaaagcggaccugucagccaugagcgcagagcgggaucuuugucugaguaaguucgugcacaagucuuuugucgaaguuaaugaggagggcacggaagcugccgcugccuccagcugcuucgugguagcagaguguugcauggaaucggggccccgcuuuugugccgaccacccuuucuuguuuuucauccgacauaacagagcuaauucuauucucuuuugcggaagguucuccucaccauga

SEQ ID NO: 62360 - RNA, 1395 nt, Artificial Sequence
  derived and/or modified sequence opt3 from SERPINC1__Homo_sapiens__NP_000479
auguacagcaacgugaucggcaccgucacauccgggaagagaaaaguuuaucugcucucucuucuguugauuggauucugggacugcgugacuugucacgguucacccguagauauaugcacggccaagccuagggacaucccaaugaauccgauguguauuuaccggagucccgagaaaaaggcuaccgaagaugagggcagcgaacagaaaaucccugaggcaacaaaccgccgagugugggaauuauccaaggccaauucucguuuugcgacuaccuucuaucaacaucuggcugacucgaagaacgauaaugacaacauuuuucuaucaccacucagcaucaguacagccuucgcaaugaccaaacugggggccugcaaugauacucuucagcagcugauggaggucuuuaaguucgacacaauauccgagaaaaccucugaucagauccacuuuuucuuugcuaaguugaacuguagacucuacaggaaagcaaauaagagcuccaagcuggugucagccaaccggcuguucggagacaaaagucucacguuuaaugaaacuuaucaagauauuagcgaguuaguuuacggcgcuaagcugcagccccuugacuucaaagaaaacgccgagcagucucgcgcggcaaucaauaaguggguguccaacaaaaccgaggguagaauuacagaugucaucccuucagaagccauaaaugaguugacugugcugguucuaguaaacaccauuuauuuuaaggggcucuggaaaagcaaguucaguccagaaaacacaaggaaggagcuguucuacaaagcugacggagaaucuugcuccgccagcaugauguaccaggagggcaaguuucgguaucgccgaguggcagagggcacccaaguccuugaacugcccuucaaaggggacgauaucacgaugguguugauucucccuaagccagagaaaucgcuggcuaagguggaaaaggaguuaacuccggaaguccugcaggaguggcucgacgagcuugaagagaugaugcugguugugcauaugcccagauuuaggaucgaagauggauucucuuugaaagagcagcuacaggacaugggucugguagaucucuuuuccccugaaaagucaaaacugccaggcaucguggccgaggggcgggacgaucuuuacgucagugacgcguuccacaaggccuuucuggaggugaaugaagagggaagcgaagcagcugccuccacagcuguugugauugccggccguucuuugaaccccaaucgcgucaccuucaaagcaaacagaccuuuucucguguucauaagggagguaccacugaauacuaucauuuuuaugggucggguugccaaccccugugugaaguga

SEQ ID NO: 62361 - RNA, 1500 nt, Artificial Sequence
  derived and/or modified sequence opt3 from SERPIND1__Homo_sapiens__NP_000176
augaagcacagccugaacgcccuccuuaucuuccugauuauaaccuccgcuuggggcgggucuaaaggacccuuggaccaguuagagaaggguggcgaaacagcacaaucagccgauccucagugggagcagcugaauaacaaaaaucuaaguaugccacuccugccggcggacuuucauaaggaaaacacugugacgaaugauuggauccccgagggggaagaggacgaugacuaccuugaucuggagaaaauuuucagcgaagacgaugacuauaucgauauugucgacuccuugucuguuucgccuaccgauucagacgugagcgcuggaaacauccuccagcuguuucacggcaagaguagaauacaaaggcugaauauccucaacgccaaguucgcauuuaauuuauaccggguacugaaagaccaggugaacacauucgauaauauuuuuaucgccccagucgguauuuccacugcuauggggaugaucucucuuggauugaagggcgagacccaugaacaggugcacagcauacugcauuucaaagacuuuguuaacgcauccucaaaguaugagauuacaaccauccacaaucuauuccgcaaacucacucaccgacuguuucguagaaacuucggcuacacacuuaggagugugaaugaucuguauauucagaagcaauuucccaucuugcucgacuucaagaccaaaguccgggaguacuauuucgccgaagcucagaucgccgauuuuagcgacccugcguucauuucuaagacgaacaaccauauaaugaaacugacuaagggguuaaucaaagaugcacuggagaauauugacccagccacccagaugaugauccucaacugcauauacuuuaagggauccugggugaauaaauuccccguagaaaugacacacaaccauaauuuucgccuuaacgagagagaaguugugaaggucucaaugaugcagacuaaggguaauuuccuggcugccaacgaucaagaguuggacugugauauucuacagcuggaguacgugggcgggaucagcaugcucaucguggucccucacaaaaugaguggaaugaagacccuggaagcacagcuuacaccaaggguuguggagcgguggcaaaaaucuaugaccaaucgcacgcgagaaguacuguugccgaaguuuaaacucgagaagaacuauaaucugguggaauccuuaaagcugaugggcauuagaaugcuauucgacaaaaacgguaauauggcugggaucagcgaccagaggauugccauagaucucuuuaagcaccagggaacuaucacagucaacgaggagggcacccaggcgacuacagugaccacgguuggcuucaugccccugucgacccaagugcgguuuacagucgaccguccuuuccuguuuuugauuuacgaacaucgcacuucuugccuucucuucauggggagaguggccaauccauccaggucauga

SEQ ID NO: 62362 - RNA, 1209 nt, Artificial Sequence
  derived and/or modified sequence opt3 from SERPINE1__Homo_sapiens__NP_000593
augcagaugagccccgcccugaccugccucgugcuuggccuggcuuuggucuucggggagggauccgcaguucaccauccuccaucuuacguggcccacuuagcgucagacuuugguguaagaguguuccaacaggucgcucaggccaguaaggauaggaacgugguuuuuagcccguauggcguggcauccguccuggccaugcuacagcucacaacugggggagaaacgcaacagcagauccaggcugcaaugggcuucaaaauugacgauaaggguauggcccccgcucugcggcaucuuuacaaagagcugauggggccuuggaauaaggacgaaauaucuaccacagaugccaucuuugugcaacgcgacuugaaacucguacagggauucaugccacacuuuuuccgacuguuucguucgacuguuaaacagguggauuucucagaggucgaaagagcgagguuuauuaucaacgacugggugaagacccauacaaagggcaugauuagcaaucugcucggcaagggggcaguggaucaguuaacccggcugguccuuguuaacgccuuguauuucaauggacaauggaaaacucccuuuccugacaguuccacacaccgcagacuguuccacaagucugaugguagcaccguguccguaccaaugauggcucagacgaacaaauucaauuacacugaguuuaccacacccgacggccauuauuacgauauccuagagcucccuuaucacggggacacucugucaauguucauagccgcaccauacgaaaaggaggugccgcuuagugcucugaccaacaucuugagcgcccagcucauuucucauuggaagggaaauaugacaaggcugccccgguuacugguccucccuaaauuuucccuugaaaccgagguggaccugcgcaagccauuggagaaccuaggcaugacggauauguuccgacaauuucaggcggacuucacuucacugagcgaucaggaaccccuccacguugcccaggcacugcaaaaagugaagaucgaggucaaugaaagugguacaguggcuucuuccagcaccgccguaauuguuucggcuagaauggccccugaggaaaucauaauggacaggccauuucuuuucgugguccggcacaaccccacugggacagugcuguuuaugggacaggucauggagccguga

SEQ ID NO: 62363 - RNA, 1194 nt, Artificial Sequence
  derived and/or modified sequence opt3 from SERPINE2__Homo_sapiens__NP_001130000
augaacuggcaucugccccucuuccuucuggccagcgugaccuugccuuccaucugcucucacuuuaauccauuaucacuggaggaacuaggcaguaacacagggauucaggucuucaaucaaauaguuaagagcagaccgcacgacaacaucgugauuucuccccauggaaucgcuuccguacucgguaugcugcagcuuggcgcagaugggaggacuaaaaagcagcuggccauggugaugcgguacggagucaauggcguggguaaaauuuugaagaaaaucaacaaggcgauaguuucgaagaaaaauaaggacaucgugacggucgcuaacgccguguuuguuaaaaaugcaucagagauugaaguaccuuucgugacccgcaacaaggaugucuuucagugugaggugcgaaaugugaacuucgaagacccagccagcgcuugcgauaguaucaaugcaugggucaaaaacgagacacgugacaugauugauaaucuccugucccccgaccugaucgaugggguucucacuagauuagugcugguaaacgccguguauuuuaagggacuuuggaagucuagguuccaaccugagaacaccaaaaagcggacauuugucgcugccgacggcaaaagcuaccaggugccaauguuggcgcagcuguccguuuuccgcuguggcucaaccagugcacccaaugaucuaugguauaacuuuauagaacucccuuaccacggggagagcauuucuaugcugaucgcccuuccaacugaauccucaacaccgcugagcgcuauuaucccccauaucaguaccaagacgauugacucuuggauguccauaauggugccuaaaagaguccaggugaucuugccaaaguucacugccguagcacaaaccgaucucaaagagccccugaagguuuuaggaauuacagacauguuugacagcucgaaggcuaauuucgccaaaaucacuaggucugagaaccugcacgugucccacauacuccagaaggcgaaaauugaagucucagaggaugguaccaaggccagugcagcuacaaccgccauccuuaucgcucggagcuccccuccaugguucauuguggaccgccccuuucuguucuuuauccgacauaauccgacgggcgccgucuuguucauggggcagauuaacaaaccuuga

SEQ ID NO: 62364 - RNA, 1275 nt, Artificial Sequence
  derived and/or modified sequence opt3 from SERPINE3__Homo_sapiens__NP_001094790
augcccccuuuccugaucacccucuuucuuuuccacagcugcugucugagagccaacggccauuugagggaggggaugacauuacugaagacugaauuugcucuacaccucuaccaguccguggcagccugccggaaugagacgaacuucgucauuucuccagcgggaguuucacugccgcuugaaauacugcaauuuggugcugagggcaguaccgggcagcaguuggccgacgcacucggauauacagugcaugauaaacgcguaaaggacuuccugcacgccguguacgcuacucugcccaccagcucccagggcacagaaauggagcucgcauguucuuuauuuguccaaguggguaccccucugucgccaugcuucguugagcaugugucauggugggccaauagcagucuugaacccgcugauuuguccgagccuaacucuacugccauccagacaagcgaaggggcgucccgagagaccgcaggaggcggcccaucagaggggcccggagguuggccuugggaacaggucagugccgcuuuugcccagcuggugcuaguaagcacgaugucuuuccaaggcacuuggcguaaaagauuuuccucaaccgacacacagauucucccauucacuugugcauaugggcugguucuucaggugccgaugaugcaccagaccacagaggucaauuacggacaauuucaggauaccgcuggccaccaggugggugugcuggaauugcccuaucucgggagcgccgucagucuguucuuaguucugccuagggacaaggauacgccacucucucauaucgagccccaccuuacugcguccacaauucaucuguggaccacuagcuugcggcgcgccagaauggacguguuccuaccuagguuucggauccaaaaccaguucaaucugaaaucgauacucaacucuuggggaguaacagaucuguuugacccacuuaaggcaaaucugaagggcaucuccggccaggauggguucuacgugucagaagcuauucacaaagccaagaucgaggucuuggaggaaggaaccaaagcuaguggugccacggcacuccuguuacugaagcgcagccgaauccccauuuuuaaagccgacagaccguucauauauuuucuaagggagccuaacaccggcauuacaguguucuuugaucggauccagauuaucuaccaaugccucuccucuaauaaggggagcuucguucacuacccccugaagaacaaacauucauuuuga

SEQ ID NO: 62365 - RNA, 1257 nt, Artificial Sequence
  derived and/or modified sequence opt3 from SERPINF1__Homo_sapiens__NP_002606
augcaggcccuggugcuccuucugugcaucggcgcuuuguuagggcacagcuccugucaaaaccccgcaucuccuccagaggaaggaucaccggaccccgauaguaccggugcccuggucgaggaagaggacccuuucuuuaagguuccagugaauaaacuagcggcugccguaagcaacuucggcuacgaucucuauagagugagguccucuacaucgcccacuacgaauguccugcuuucaccucugagcguggcaaccgccuugagugcucucucccugggggcagaacagcggacagagucuauuauacaucgcgcccuguacuaugaccucaucagcuccccagauauucacggaacuuacaaggaguuacuggacaccguuacagcuccccagaaaaaccuuaagucagccagucgaaucguguuugagaaaaaguugcguauuaagagcucuuucgucgcgccucuggaaaaauccuauggcaccagaccaagggugcuaacugguaauccgcggcucgaucugcaggaaaucaacaauuggguacaagcacagaugaaggggaaacuugcccgcucaacaaaggagauacccgacgagaucagcauucuguugcucggaguugcucauuuuaaaggccagugggugaccaaguucgauaguagaaagacgucucuggaagacuuuuacuuagaugaggaaaggacuguccgggugccuaugauguccgacccaaaagccgugcugcgcuauggccucgauagcgaccuuucgugcaagaucgcacagcugcccuugaccgggucuauguccauuaucuucuuucuaccucugaaagucacacaaaaccucacucugauagaggaaucacuuaccagugaguucauucacgacaucgaucgagagcugaagacaguucaggcuguguugaccguaccaaaacucaagcugagcuacgaaggagaggugacgaaauccuuacaggaaaugaagcugcagucucuauuugacagccccgauuucucaaagauuacugguaaaccgaucaagcucacacaagucgagcauagagccggcuuugaauggaaugaggacggggcgggaaccacuccuagucccggccugcagccagcccaccuuacauucccuuuggauuaccaccugaaccagcccuucaucuuugugcucagggacaccgauacgggugcacugcuuuucauugggaaaauacuggacccacggggacccuga

SEQ ID NO: 62366 - RNA, 1476 nt, Artificial Sequence
  derived and/or modified sequence opt3 from SERPINF2__Homo_sapiens__NP_001159392
auggcccugcucuggggccuucugguguugagcugguccugcuuacaggggcccuguucugucuucucaccuguuagugcuauggagccacugggaagacaacuaaccagcgguccgaaccaggaacagguguccccucucacacugcuuaagcugggcaaucaggagccugggggacaaacugcauugaaaucuccacccggcguaugcucgagggacccuacgccagaacagacccaccggcucgcccgcgcgaugauggcuuuuacagccgaucuguucucacugguggcacagacuagcaccugucccaaccucaucuuaaguccucuguccgucgcccuugcuuugucucaucuggcacuaggugcccagaaucacacacuccaacgacugcaacaggugcuucaugcugggagcggaccaugccugccgcacuugcucucccgucugugucaggacuuaggccccggcgccuuuagacuggcggcaaggauguaccuccagaagggguucccuauuaaagaggauuuucuugaacagucagagcagcuguucggagccaagccaguuaguuugaccgguaaacaagaggacgaucuagcuaacauaaaucagugggugaaggaagccacugagggcaagauccaggaauuucugagcgggcuccccgaggacacaguccugcuucuguugaacgcaauucauuuccagggauuuuggcggaauaaauucgauccuucucucacccaacgcgacuccuuucaccuggaugagcaguucacggugccaguagaaaugaugcaggcuagaacuuaucccuuaaggugguuucugcuagagcagccggaaauccaaguugcccacuucccuuucaagaacaauaugucauuugugguccucgugcccacccauuucgaguggaacgugagccagguccuggcgaaucuuaguugggacacauugcacccaccucugguuugggaacggcccacuaaagugcgccucccaaagcuguaccuuaaacaucagauggaucugguagccaccuugucucagcucggccugcaagaguuauuucaggcacccgaccugcgagguauuuccgagcagagccuaguggucucgggggugcagcaccaaucuacacucgaacuguccgagguuggaguggaagcugccgcugccaccucaaucgcaaugaguagaaugagccuuuccucuuucagcgucaacaggcccuuuuuguucuuuauauucgaggauacgacuggccugccacucuuugugggcucaguacggaauccgaaccccagugccccucgugaacugaaggagcagcaggacuccccagggaauaaggacuucuuacaaagccugaaaggauuuccccgcggugauaaacuuuucggcccugacuugaagcucguuccacccauggaggaagauuauccgcaguuugggucuccuaaguga

SEQ ID NO: 62367 - RNA, 1503 nt, Artificial Sequence
  derived and/or modified sequence opt3 from SERPING1__Homo_sapiens__NP_000053
auggccagcagacugacccuccuuacacuguuguuacugcuacucgcuggcgacagggcauccucuaaccccaaugccacuucaaguagcucccaggauccugagucucugcaagaccgcggggaaggaaagguggcgacgaccgucaucucgaaaaugcuuuucguugagccaauucuggaagugagcucauugccgacaacuaacaguaccacaaauuccgcuaccaagauaacugccaacacaaccgaugagcccacgacucagccuaccacagaaccaacuacccagcccacaauccagccuacccaaccaacgacucagcuccccacagacucuccuacccagccaacuacagguagcuuuugcccgggccccguaacccuguguuccgaucuggagucacacaguacggaggcagugcucggggacgccuuagucgauuucagccugaaacuuuaccaugcuuuuucugcaaugaagaaaguggaaaccaauauggccuucuccccuuuuucaauugcuagcuugcugacacagguucuacucggagccggcgagaacacuaagaccaaucuggaaaguauccuuucuuauccaaaggacuucacaugcgugcaccaagcgcugaaagguuuuacuaccaagggggucacauccgugagccagauuuuccauucgcccgauuuggcaauccgggacaccuuuguaaacgccucucgaacucucuacuccucaaguccucguguucugagcaauaacuccgaugcuaauuuagagcugauaaacacguggguggccaaaaauacaaacaauaagaucucuagacuccuugacagccugccaucagauaccagguugguccuacugaacgcaauuuaucucagugcuaaauggaagacuaccuucgaccccaagaaaacacggauggagccguuucacuucaagaacuccgugaucaaagugccuaugaugaauagcaagaaauaccccgucgcccauuuuauugaccagacccugaaggcgaaaguuggacagcuucaacugucucacaacuugucacucgugauccugguaccacagaauuuaaagcaccgccuggaagauauggagcaggcccuaaguccuagcguguucaaggcaauaauggaaaaacucgagauguccaaguuccaacccacucugcuuacauugccaagaauuaaagucacgaccucucaggacaugcugucgaucauggaaaagcucgaguuuuucgauuuuagcuaugaccugaaccuuuguggccugacugaggaucccgaccuccagguguccgcuaugcagcaucaaacaguuuuggaacugaccgagacaggcguggaagccgcugccgcaucagccauuagugucgcuaggacuuuacugguguucgagguacagcagccuuuucuauucguucucugggaucagcaacacaaauuuccaguguucauggggcgggucuacgacccgcgcgcguga

SEQ ID NO: 62368 - RNA, 1257 nt, Artificial Sequence
  derived and/or modified sequence opt3 from SERPINH1__Homo_sapiens__XP_011543629
augagaagccugcuccuucuguccgccuucugcuuguuagaggcugcacuggccgcggaagugaagaaacccgcugccgcagccgcuccuggcaccgcagagaagcuaucuccaaaagccgcuacacucgccgaaaggucagcggggcuggcauuuagucuuuaccaggccauggcuaaggaccaagccgucgagaacauccugguuagcccggugguaguggcauccucuuugggacucgucucgcuggguggcaaagcuacuacggccucacaggcgaaggccgugcugagcgcagaacagcuccgggaugaggagguucacgcuggguuaggagaacugcuucgcaguuuguccaauucuaccgcccgaaacgugacauggaagcugggcagccgucuauauggucccuccucagucaguuucgcugacgauuuugugagaagcucuaaacagcauuacaauugugagcacuccaagauuaacuucagggacaaacggucagcccuccaaagcauaaaugaaugggcagcccagacuaccgaugggaagcugccugagguaacaaaagacguugagcgcaccgauggagcgcuucuggugaacgcuauguuuuucaagccacauugggacgaaaaguuucaccauaaaauggucgauaauagaggcuucauggugacuaggaguuauacagugggcgucaugaugaugcaccggaccggguuguacaacuauuacgacgaugagaaggaaaaacuccagaucguugagaugccccuggcacacaaguuaucuucccugauuauccucaugccucaucacguggaaccacuugagcgccuggagaaauugcuaacgaaggaacagcugaaaauuuggaugggaaagaugcaaaagaaagccguagcuaucagccuccccaaggguguggucgaggugacucaugaccugcagaaacaccuugccggccugggguugaccgaagcaauagauaagaauaaagccgaccucucgcgaaugucuggaaagaaggaccuguauuuagcuuccguuuuucacgccacagcauucgagcuggauacugacggcaacccuuuugaucaggacaucuacgguagagaggaacuaaggucaccaaaacucuucuacgcggaucauccguuuauuuuccuggugcgggacacccagagugggagccuuuuguucaucggacgucugguccgccccaagggcgauaaaaugagagacgagcucuga

SEQ ID NO: 62369 - RNA, 1233 nt, Artificial Sequence
  derived and/or modified sequence opt3 from SERPINI1__Homo_sapiens__NP_005016
auggccuuccugggccucuuuagccuucugguguugcaguccauggcuaccggggcaacauuccccgaggaagccaucgcggacuuaucugucaacauguacaauagacugagggcuacuggagaggaugaaaacauucuauuuucaccucucaguauagcccuggcaauggguaugauggagcuuggcgcccaagggagcacgcagaaggaaauccggcacuccaugggauaugacucucugaaaaauggcgaggaguucucguuuuugaaggaguucucaaacaugguuaccgcuaaagagagccaguacgugaugaagauugcaaauagucucuuuguacagaacgguuuccaugugaaugaagaguuucugcaaaugaugaaaaaguauuucaacgccgcugucaaucacguggauuuuucccagaacguugccguggcgaauuacaucaacaagugggucgagaauaacacaaauaaccuggugaaagaccucguaucuccacgcgauuucgacgcagccacuuauuuagcucugauuaacgccguuuacuuuaaggggaauuggaaaagccaguuccgaccggaaaacacccguacauucuccuuuaccaaggaugacgagucagaagugcagauccccaugauguaucaacagggagaguucuacuacggcgaauuuagugauggcagcaaugaggcagggggaauauaucagguccuugagaucccuuacgaaggugacgagauuucuaugauguuggugcuguccagacaggaagugccacuagcuacucucgagccccuggucaaagcccaacuuguugaagagugggcgaacucagugaagaagcagaaaguagagguguaucugccuagguucacagucgaacaggagaucgauuugaaggacgugcucaaagcccugggcauuaccgaaaucuuuauaaaggaugcaaauuuaacggggcugagcgacaacaaagagauuuuccucaguaaggcuauccauaaaucuuuucuugaaguuaaugaggagggauccgaagccgcugccgugagcggcaugauugcaaucucgcggauggccguccuguacccacaagugaucguagaccaccccuucuuuuucuugauucgcaacagaaggacugguaccauacuauuuauggggcggguuaugcauccugagacaaugaauacuucuggacacgauuucgaagaacuguga

SEQ ID NO: 62370 - RNA, 1248 nt, Artificial Sequence
  derived and/or modified sequence opt3 from SERPINI2__Homo_sapiens__NP_001012303
augauccagaaccugaugagagaggugaagauggacaccauuuuccucuggagccuucuguuguuauuuuucggcucccaagccucuaggugcucagcucagaaaaauacagaauuugcagucgaucuguaccaggagguuagucuaagccacaaggacaacauaaucuucucgccccucgggauuacucuggugcuugaaaugguacagcugggagccaaagguaaggcgcaacagcagauccggcagacguugaaacaacaggagaccucugcuggcgaagaguuuuucgugcucaagucguuuuucucagccauuagcgagaagaaacaggaauuuacauucaaucuggcaaacgcccuguaucuccaggagggguuuacugucaaggaacaauacuuacauggaaauaaagaguucuuucagagugcuaucaagcugguggauuuccaggacgcaaaagccugugcugagaugauauccaccuggguugaacgcaagacagauggcaagaucaaagacauguucucuggugaggaauuugggccucuuacccgauuggugcuggucaacgccauuuauuucaagggagauuggaaacaaaaguuucguaaagaggacacucagcuaaucaauuucacaaagaaaaacggcagcaccgugaagauuccaaugaugaaggcgcuccugagaacgaaauacggcuauuuuuccgaaucaagucuuaauuaccagguacuggaguugagcuauaagggggaugaguucucucucaucauaauucugccggcagaaggaauggacaucgaggaaguugagaaauuaauuacugcccagcaaauccugaaguggcucuccgaaaugcaggaggaggaaguggagaucucacuucccagguuuaaagucgaacagaagguggauuucaaggacgugcuguacagcuugaacauuaccgagauauuuagugguggcugcgaucuaucugggaucacagacuccagcgaagucuacguuucccaggugacucaaaaaguauucuuugagauuaaugaggacggaucugaagcugccaccuccacaggcauccacauaccugugauuaugucacuggcacagagucaguucaucgcuaaccauccauuucucuucaucaugaagcacaaucccaccgagagcauucuguucaugggucgggucacgaacccugauacucaggaaaucaaagggcgcgaccuugauucccuguga

SEQ ID NO: 62371 - RNA, 711 nt, Artificial Sequence
  derived and/or modified sequence opt3 from SERTAD1__Homo_sapiens__NP_037508
augcugagcaagggccucaaaagaaagagggaggaagaggaagagaaagaaccccuugccguggacuccugguggcuggauccugggcacaccgcugucgcacaggccccaccggcgguugcuucuucaaguuuguucgacuuaagcgugcugaagcuacaucacucccuccaacagucugagcccgaucugcggcaucuuguacugguggucaacacauugcgccgaauccaggccucgauggccccugcagcugcacucccacccgugccuucaccacccgccgcuccuagcguugccgacaaucugcuggcgaguuccgaugcagcccucucugcuagcauggccuccuuacuggaggaccuuucacacauugaaggauugagucaggcaccacaaccgcuggcugaugagggucccccuggccguagcauagggggagccgcgccaucucuaggcgcccucgaccugcuuggucccgcaacugggugccuguuggaugacggacucgaaggccuguuugaggauaucgacacguccauguacgauaacgaguuaugggcuccugccucagaaggccugaaaccagggcccgaggacggaccggguaaggaagaggcuccugaacucgacgaggccgagcuugauuaucugauggacguguuggucggcacccaggcacuagaaagacccccagggccuggaagguga

SEQ ID NO: 62372 - RNA, 966 nt, Artificial Sequence
  derived and/or modified sequence opt3 from SERTAD2__Homo_sapiens__XP_011531506
augcugcccgugauccaguacaugcucggcaaagggggaaagagaaaguucgacgagcacgaagauggucuugagggcaaaauugucagcccuugcgacgggccauccaagguuucuuauacccugcaaaggcagacaauauuuaacaucucauugaugaaauuauacaaucaucggccgcugacugaacccagucuacagaagacggugcucauuaacaauaugcugcgccgaauccaggaggaacuuaagcaagagggaagccugcguccuauguucaccccauccucucagcccacaacugagccuucggauucauauagagaagccccacccgcuuuuagccacuuggcaaguccuuccucucauccaugugaccucggcagcaccacaccgcuggaggccugccugacccccgcgucccucuuagaagaugacgaugacacuuucuguacaucacaggcuaugcagccuaccgccccaacgaaacugagucccccugcacuuuugccagagaaggauagcuuuucuuccgcccuggacgagauugaggaacuaugccccacuucaaccagcacagaagcugcaacugccgcuaccgauaguguaaaagguacaucuuccgaggccgggacccaaaagcucgacggaccgcaggaaagcagggcggaugacucgaaacugauggacucucuuccuggcaacuucgagaucacgacuuccacaggcuuucugaccgauuugacucucgacgauauacuguucgcagacaucgauacaucaauguacgacuuugaucccuguaccaguagcuccgggacggccucuaagauggcuccagugagcgccgacgauuuacugaagacccucgcaccuuauucaagucagcccgucacaccaucccagcccuucaaaauggaccuuacugagcuggaucacauuauggaaguguugguuggaagcuga

SEQ ID NO: 62373 - RNA, 1479 nt, Artificial Sequence
  derived and/or modified sequence opt3 from SESN1__Homo_sapiens__NP_001186862
augagacuggccgcugcagccaacgaggcguacaccgcuccccucgccgugagcggccuucuggggugcaagcaguguggagguggcagggaccaagaugaagaguuggggauccggauuccucgcccauuaggacagggcccgucccgauucauacccgaaaaagagauccugcaggucgguucugaagacgcacagaugcacgcccuauuugcugauucauucgcagcccucgggcgucuggacaauauuacacuuguuaugguguuucauccucaauaucuggagaguuucuugaagacucagcacuaccuccugcagauggauggaccacugccccuccauuauagacacuacaucggcauuauggcugccgcgaggcaucagugcagcuauuuaguaaaccugcacgugaaugacuuucuucacgucggcggggauccuaaaugguugaacggacuggagaaugcaccacaaaagcuacagaaccucggugaacugaauaaagugcuugcccaucggcccuggcugaucacgaaggagcacauagaaggcuugcucaaggcugaggagcauuccuggucucuggccgaauuaguucacgcagugguccugcucacccacuaccauucgcuugcuucauucacauuuggguguggaaucagcccugagauucacugcgacggcggucauacuuuccgcccaccgaguguguccaacuauuguaucugcgauauuaccaaugggaaccacucuguagacgaaaugcccguuaauagcgccgagaacguguccgucucagauagcuuuuucgaaguggaggcgcugauggagaaaaugagacaguugcaggaauguagggacgaggaagaggccagucaagaagagauggcaucucgguuugagaucgaaaagcgcgaguccauguucguguuuucaagcgaugacgaagaggucaccccugcucgagccguuaguagacauuucgaagacacaucuuacggauacaaagauuucuccaggcacggcaugcacgugccaacuuuucggguacaggacuauugcugggaggaucauggcuacagccuagugaaucgucuguaucccgacgucgggcagcucauagaugagaaguuccacauugcuuacaaccugacauauaauaccauggccaugcauaaagacguggauacgucgaugcuucgcagagcaaucuggaacuacauucacuguauguuuggaaucagguaugacgauuacgacuacggugaaaucaaccaacuguuggaucggucuuucaagguuuauauuaagacuguggucugcaccccugagaaagugacaaagcgaauguacgacuccuuuuggcgccaguucaaacacucagaaaagguacauguuaaucuccuguuaauagaggccagaaugcaggcugagcugcuauaugcgcucagggcaaucacucgguacaugaccuga

SEQ ID NO: 62374 - RNA, 1062 nt, Artificial Sequence
  derived and/or modified sequence opt3 from SESN3__Homo_sapiens__NP_001258523
augagccugcacacccaguaccucgaguccuuccuuagaucucaauuuuauaugcugaggauggacggccccuugccuuuaccauaccggcauuauaucgccauuaugaagcuggugaaaacaggggaaaacaauuggucacuaccggagcucguccacgcuguugugcugcuugcacauuaccacgcccuggcgaguuucguauuuggaagcgguauaaaccccgaacgcgauccugagaucuccaauggcuuccgauugauuucugugaacaauuuuugcgucugugaccucgcuaacgauaauaacaucgaaaaugccucgcugucagggagcaacuucggaauuguggacagucuguccgagcucgaggcauuaauggaacguaugaagagacugcaggaggaaagggaggaugaggaagccucucaggaggaaaugagcacucgguuugagaaagaaaagaaagagucccuuuucguugugucaggcgacacguuucauaguuucccacacagcgauuuugaggacgauaugaucauaaccucugacgucucccgcuauaucgaagaucccgguuucggguacgaggacuuugcuagaaggggagaggaacacuugccuacauuccgggcacaggauuauacuugggaaaaucauggcuucucacuggugaaccgccuauacagcgacauuggccaccuccuggacgagaaguuucgaaugguauacaaucuuaccuauaacacaauggccacccaugaggauguugacacuacaaugcugagaagggcuuuguucaauuacgugcacugcauguuugggauccgguaugaugacuacgauuauggagaagucaaccaacuccuggagcguaguuuaaagguguacauuaaaaccgugacguguuauccagaacgcacuaccaagagaauguacgacucuuacuggaggcaguucaaacacuccgagaagguccauguuaaccugcuccuuauggaagcccggaugcaggcggagcuguuguaugcacuacgagccaucacacgccaccugacuuga

SEQ ID NO: 62375 - RNA, 729 nt, Artificial Sequence
  derived and/or modified sequence opt3 from SETBP1__Homo_sapiens__NP_001123582
auggagagcagagaaacccuguccucuucaaggcagcggggcggggagagugacuuccuccccgugagcuccgccaagccuccagcugcaccgggaugcgccggugaaccccuucugucuacaccuggcccagggaaaggaauccccgucggcggugagcgcauggaaccugaggaggaagaugaguuggggucgggacgagacguugauucaaacagcaaugcggacagugaaaaguggguggcuggcgauggcuuagaggagcaagaauuuuccauuaaagaggccaacuucacugaagggucucugaagcuaaaaauacagacgaccaagcgugcaaagaaaccacccaagaaucucgagaacuacaucuguccuccagaaauuaaaaucacaauuaagcagagcggagaccagaaaguauccagagccgguaaaaauucaaaggcuacuaaggaggaggaaaggagucacagcaagaaaaagcugcuuaccgcaucugaucuggccgcuuccgacuugaaaggcuuucaaccgcagaucaaggauucaagcaaagaggaaguguggaagcggcgcgggggacagggcauacccuucaagaaacaguuucucagucaagagagagccaugugcuucucuuguccuaggaacccauuucccgcgaagccugguucccugacacugccauuccauagcgaacccgcagucugggcccaggagguguga

SEQ ID NO: 62376 - RNA, 5124 nt, Artificial Sequence
  derived and/or modified sequence opt3 from SETD1A__Homo_sapiens__NP_055527
auggaccaggagggcgggggcgauggucaaaaggcccccuccuuccaguggagaaacuacaaacugaucguggacccugcucucgauccagcacuuaggcggccgucccagaagguauaucgcuacgacggcguucacuucucugugaaugauucaaaauauauucccguggaagaccugcaggauccucgaugccaugugcguaguaagaacagagacuucagcuugccaguccccaaauuuaaguuagaugaguucuacauagggcaaaucccucugaaggaagugaccuuugccaggcuaaaugacaacguucgggagacauuccucaaagauaugugucgcaaguauggagaaguggaggaggucgaaauucugcuucacccaagaacuaggaaacaucugggcuuggcgcgggugcucuuuacguccacccgcggugcuaaggagacagucaagaaucugcaccugacuucuguuauggggaacaucauucaugcccagcucgacaucaagggacagcagcgaaugaaguacuaugaauuaauagugaauggcucguacacaccacaaacagucccuaccggcgggaaagcacugucagagaaguuccagggaagcggugccgcuacugagacagcagaaaguagaaggcgguccucuagcgauaccgccgcuuacccagccggcacgacugcgguggggaccccgggaaacggcacacccugcucccaggacacuucauuuaguagcucucgucaggacaccccuuccucauucggucaauuuacaccacagagcagucaggggacccccuauacgucucgcggauccacuccuuacagccaagauucggcauauucuuccucaacaaccaguacuagcuucaaaccaagaagguccgaaaauucuuaccaggacgccuuuagccggcgacacuucucagcuaguuccgccagcacaaccgcaucuacggcuaucgccgcgaccacagccgcaacugcuucaaguagcgccuccucuucgagccuuuccucaaguucuagcuccucaagcagcuccaguagcucucaguuccgcuccucagaugcuaacuaucccgccuacuaugaaaguuggaauagauaccagaggcacaccagcuacccgccucggcgcgcaacaagagaggaacccccaggcgccccuuuugcugagaacacugcggagagguuucccccaucguauaccuccuacuugcccccugaaccaucucguccgacagaccaagauuaucggcccccugcaagcgaggccccacccccugaaccacccgagccgggcgggggagguggcgggggaggcccuucaccagaacgagaggaggugagaaccagucccaggccugcuucccccgcccgcucugguagcccagcaccugaaacuacgaaugaguccguccccuuugcccagcauucaagccuggacagucggauugaaaugcuacucaaggagcagagaucuaaauucuccuuucuggcuagcgauacagaagaggaggaagagaacucgucaaugguucuuggggccagggacaccggcucugaagugccaaguggauccggccacgggccguguacuccucccccagcacccgcgaauuucgaggauguagcuccuaccggaagcggugagccaggcgccacacgcgaaucucccaaggcaaacgggcagaaccaagccagcccuugcuccucaggagacgauauggagaucagugacgacgaucgaggcgguagcccgccacccgcuccuaccccaccccagcagccuccgcccccaccucccccaccucccccaccgccucccuaccuggccucuuugccacucggguaucccccucaucagccagcauaccuguuacccccucggccggacggcccacccccucccgaauauccaccucccccaccuccgcccccacacauuuacgauuuuguaaauucccuggagcucauggaccgucuuggagcucaauggggcgggaugccuaugucauuccagaugcagacucagaugcugacaagauugcaccaacuaaggcagggaaaaggucugaucgccgcgagugccggacccccagggggagcuuuuggcgaagcauuccucccuuuucccccgccacaggaggccgcuuacggucugccuuaugcccuuuacgcacaagggcaggagggccgcggagcguauagccgggaagccuaccaucugcccaugccaauggcugccgagcccuugccuuccucuucggucagcggcgaagaggcaagacucccgcccagggaagaggcugagcuggccgaagggaagacguuaccaaccgcaggaacugugggccgaguucuggccaugcuagugcaggagaugaagucaauaaugcagcgcgaucucaaccggaaaauggucgaaaauguggcuuucggugcguuugaccaauggugggaguccaaggaagagaaagccaagccuuuccagaacgcagcuaaacagcaggccaaggaggaagauaaggagaaaacaaagcugaaagaacccgggcuuuugagucugguagacugggccaagucuggaggcaccacagguauugaggcuuucgcauuuggcagcgggcucagaggagcccugaggcuuccuuccuucaaaguuaagcguaaggagccaucagaaaucucugaggcgagcgaagagaaacgcccccggccuaguacuccagcugaagaggaugaggacgaucccgaacaagagaaggaagccggcgagccggggagaccuggaaccaaaccacccaagagggacgaggagcgaggcaaaacgcaggguaagcaccggaaguccuuugcacuggauagcgagggggaagaggccucucaggaaucauccagugagaaagacgaagaggacgaugaggaagacgaggaagaugaggaccgcgaggaagcuguggauaccacaaagaaagagacugaagucagcgacggagaggaugaagagucggacucuuccagcaaguguucauuguaugcagauagugacggcgagaaugauucuaccuccgacagcgaaucaaguagcuccucuagcuccucaucuaguucgagcuccucuucaagcuccaguucuagcucauccaguagcgagucuuccucagaagaugaggaagaggaggaaagaccugccgcgcucccaagcgcuucgcccccgccuagggaggugcccgucccaaccccugcacccguggaaguuccagugcccgagcggguagcagguucuccugucacuccacugccggaacaggaggccagucccgcucgaccugccggcccaaccgaggaaucucccccuagcgcaccauuaagacccccugagccgccagcugggcccccugcccccgcgccacgcccugacgaaaggcccucauccccaauuccgcugcuaccuccucccaaaaagcgucggaaaacggugucuuucagcgccaucgagguugugcccgcacccgagccacccccugcuacaccgccacaagccaaguuucccggaccugcuaguagaaaggcaccaaggggcgucgaacgcaccauccgaaaccucccccuggaccaugccucccuugugaaaagcuggccugaggaaguaucuagagggggacggucaagggccggcggucgcgggcguuugacugaggaagaggaggcugaacccggaacagagguggaucuggcgguucucgcagaccuggccuuaaccccagcuagacggggccugccggcccuuccugcagucgaagauagugaggccacugaaaccuccgacgaggcugagaggccccgcccauugcucagccacauucugcuagaacauaauuacgcgcuggccgugaagccuacacccccagccccugcucuccgacccccggagccagugccugcccccgcagcccuguucucuucgccagcugaugaaguccuugaggcccccgaaguugugguggcggaggcagaggaaccuaaaccgcagcaguugcaacagcagagagaggaaggugaggaggaaggcgaggaagagggggaagaggaggaagaggaaucaagcgacuccaguucuagcuccgauggagagggcgcccugcggaggcgcucauuaagaagucacgcuaggcggcgucgcccacccccucccccaccucccccaccuccgcgagccuaugaacccagaucugaguuugagcagaugacgauacucuacgacaucuggaacagcgggcuggauuccgaagacaugucauaccuuaggcugaccuaugagcgguugcuccaacagacuagcggagcugauuggcugaaugacacacacuggguacaucacaccauuacaaaccuaacuaccccaaagcgcaaaagaaggccucaggacggcccccgggaacaucagacggguucugcacgauccgagggguacuauccaaucaguaagaaggaaaaagauaaguaccuggacgucugcccugugagcgccagacaacucgagggaguugauacacagggcaccaaucgcgugcugucggagaggcgguccgaacagcguagacuuuugucugcuauaggcacuucagccauuauggacagcgaucuguuaaaacucaaccagcugaaguucaggaaaaagaaacuucgcuuugggcggagucgaauccacgaguggggacuguucgcaauggaacccaucgcggccgacgagauggucauugaguaugugggucaaaauaucagacagaugguugcugauaugagggaaaaacgcuacgugcaggagggcauuggguccucuuaucuauuucggguagaccacgauaccauaaucgacgccacaaaguguggaaaccucgcaagauucauuaaucauugcuguacuccgaacugcuacgcuaaagucaucaccaucgaaagccagaagaaaauugugauauacucaaagcaaccaaucggcguggaugaggaaauuacauaugacuacaaguuuccucuggaggauaacaaaauccccuguuugugcgguacggaguccugccgugggagucugaauuga

SEQ ID NO: 62377 - RNA, 5772 nt, Artificial Sequence
  derived and/or modified sequence opt3 from SETD1B__Homo_sapiens__NP_055863
auggagaacagccaccccccucaucaccaucaccagcaaccaccgccccagccuggcccauccggggaaagaaggaaucaucacuggcggucuuacaagcugaugaucgaccccgcccucaaaaagggacaccauaaacuuuaucgcuacgauggucagcacuucucacuggcuaugaguagcaaccgaccuguggagauugucgaagacccacguguugugggcauauggaccaagaauaaagaguuggaauuauccguacccaaguuuaagaucgaugaguucuauguggggccugucccaccgaaacaggugacauuugcaaagcugaacgacaauauuagagagaacuuccuaagggauaugugcaaaaaguacggagaaguugaggaaguggagauccucuauaaucccaaaacuaagaagcaucugggcauugccaaagucguguuugcgacgguacggggugcuaaggacgccguucaacaccuucacucuaccucggugauggggaacaucauacaugucgagcuggauacaaaaggagaaacucgcaugagauucuacgaguugcucgugaccggcagguauacaccucagacccugccagugggcgaacuggacgcagucucacccaucguuaaugagacucuccaguuaagcgaugcccugaagcggcuuaaagacgggggauugagugcugguuguggcuccgggucuagcuccgugacaccuaacucaggaggcaccccauuuagucaggauacggcauacagcucuugccgccuggacacucccaauuccuacggucaagggaccccgcuaacaccucgacucggaacucccuucucacaggauagcaguuauucuuccagacagccaaccccuagcuaccuguuuucgcaggaccccgccguaacauucaaggcuaggcggcacgaaucuaaauuuaccgacgccuauaaccgucgccaugagcaccauuacgugcacaauuccccagcggucacggcaguggccggcgcuacugccgcauucagaggcucaagugaucuucccuuuggggcuguuggagguacaggcgggagcuccggaccuccauucaaggcccaaccgcaggacucugcgaccuucgcccacacucccccuccagcacaggcuacacccgccccuggcuuuaagagcgcuuucucaccauaucaaacccccguggcccauuuuccgccuccacccgaggaaccuacggcaaccgccgcuuucggugcgagggauaguggggaguuucggcgagcacccgccccaccuccccugccaccggcugaaccuuuggccaaagagaagcccggcacaccacccggaccuccacccccugacacuaacuccauggaacucggcgggcgcccgaccuucggauggagcccagagcccugugauucuccugguacaccaacucuggagucaagucccgcaggcccugaaaaaccgcacgacagcuuagauuccagaauugagaugcugcucaaggaacagaggaccaaacuucuguuuuugcgggagcccgacucugauacagaacuacagauggaggggucgccaaucagcuccucaaguucucagcugagcccucucgcccccuucggaaccaauucccaaccaggcuuucgcgguccuacucccccaucaagcagaccgucuuccacggggcuggaggacauuaguccuacaccccuuccagauagcgacgaagacgaggaacuggauuugggccucggacccaggccuccacccgagccuggcccgccagaccccgcugggcuguuaucucagaccgccgaggucgcacuggaucuagugggagaccguacuccuaccuccgaaaagauggaugagggucagcagucaaguggcgaagacauggagaucagcgaugacgaaaugcccucggcgccaauaacauccgcugauugcccuaagcccaugguaguuaccccaggggccgcagccguggcugccccuucuguccucgcaccgacucugccccuuccaccucccccaggauucccucccuugccgccaccucccccacccccuccgccccaaccaggcuuuccuaugcccccuccacugcccccuccacccccgccuccacccccugcucauccagccgugacaguccccccgccuccccucccagcgccucccggugugccacccccuccaauucugccgccccuuccuccauuccccccugggcuguuuccaguuaugcagguggacaugagccacguauugggcggacaguggggcgggaugcccaugucauuccagaugcaaacgcagguccucagucggcugaugaccggacagggcgccuguccuuacccgccauucauggcugcagccgcugccgcagcguccgccgguuuacaguuugugaaccugcccccuuaucgagggcccuucucucuaagcaacuccggaccaggcagaggucaacacuggccuccccucccaaaauuugauccgucaguuccucccccaggcuacaugcccaggcaggaggacccucauaaggcuacuguggaugggguccugcuugugguauugaaagagcugaaggccaucaugaaacgcgaccucaaucggaagaugguggaaguugucgcauucagagcuuuugacgaguggugggauaagaaagaaaggauggccaaggcaagccugacaccagugaaaaguggagagcacaaggacgaagaucgccccaaaccuaaggaccgaauugccucuugcuuacuggaguccuggggcaagggggagggacuuggcuacgaagguuuggggcucggaaucggccugcggggugcuauccgucuaccgagcuucaaagugaagagaaaagagccacccgauaccacaucgucaggcgaccagaagaggcugcgcccuucuacuagugucgaugaagaggacgaagaguccgagcgggaaagagauagggacauggcggauaccccaugugagcucgccaaacgagaccccaaggggguuggagugcgccggagaccugcaaggccccuggaacuugauagcggcggggaggaggacgaaaaagagucuuugagcgaagagcaagaauccacggaggaggaagaggaagcugaggaagaggaggaagaggaagacgaugacgaugacgauucagacgaucgugacgagagugaaaacgaugacgaggauaccgcccugagcgaggccucugaaaaggacgagggagacuccgaugaagaggagacagugucaauuguaacuaguaaggcugaagcaaccagcuccucugagucgagcgaaucauccgaguuugaaaguucuagcgaguccucaccaucuagcagugaggacgaagaggaagucguggcccgcgaggaagaggaggaagaggaagaggaagagaugguugcggaggaauccauggcuagcgccggcccggaggauuucgaacaggacggugaggaggcagccuuagcuccuggggcacccgccguggauucucucggaauggaagaggaagucgacauagagacagaagcgguggcuccagaggagcggccuucaaugcuggaugaacccccacuuccuguuggcguggaggaacccgccgacuccagagagccgccagaagagccuggucugagucaggagggcgcaauguugcucagccccgaaccacccgccaaagagguagaagcuaggccuccgcugucgccagagcgagcccccgaacaugaucuagaggucgagccugaacccccaaugaugcugccucucccccugcagccaccucuuccgcccccacggccuccccgcccaccuucucccccgccagagccugaaacuaccgacgcaucccaccccagcgugccacccgagccuuuggcugaggaucaucccccacacacgccugggcugugcggaucauuagccaagagucaaucuacagaaaccgugccggcgacucccggcggggagccaccucucuccggaggcagcucaggucugagucuuagcuccccccaggucccagggucuccuuuuagcuaucccgccccguccccuucacugucuaguggaggccuaccaagaacacccggcagggacuucucguuuaccccuacuuucagcgaaccauccgggccccuccuguugccuguuuguccacugcccaccggacggcgagaugagagaucugguccguuagcaucaccugugcuccuggaaacaggccuuccccugccauugccccucccucugccacuaccccuggcucuuccugccguacuccgcgcucaggcaagggccccaacgccgcugcccccuuugcugccagcccccuuagcuagcugcccuccacccaugaaacguaagccggggcggccuagaagguccccacccaguaugcucucucuggacggaccucuugugcgccccccagcgggcgcagcccugggucgagaguugcuccugcuaccggggcagccucaaacccccgucuuuccaagcacucacgaccccagaacagugacccuggauuuccggaaugcuggaaucccugccccacccccuccacuuccgccccagccuccacccccuccacccccuccgcccguugagccaacaaaacucccuuucaaggaacuggacaaccaguggcccucagaggcaauuccaccuggccccaggggccgcgaugaagugacugaggaauacauggaguuggccaagucccgugggccauggagacggccgccuaaaaagaggcaugaggacuuaguccccccagcuggaagucccgaacugagcccuccacagccccucuuucgcccucgaucugaguucgaagagaugaccauccuguaugauauauggaaugguggcauugacgaagaggauaucagauuucuuugugugacguacgagcggcuguugcaacaggacaacgggauggauuggcuaaaugacacacuguggguuuaucacccguccaccucacucagcucggcgaaaaagaaaaagagggaugacggaauccgcgaacaugugacuggcugcgccagaucugaggguuucuacaccauugauaagaaagacaagcugagguaucuuaacaguucccgggcaagcacagacgaacccccagcugauacucaggggaugucaaucccugcccaaccccacgcauccacccgugccggaucugagcgccgaagcgagcagagaagguuacugaguuccuuuacaggcagcugcgacucugaucucuugaaauucaaucagcugaaguuucggaaaaagaagcucaaauucuguaagucacauauucacgacuggggccuguuugcuauggaaccaauagccgcggaugagauggucaucgaauacguagggcagaacauucgccaagugaucgcagacaugagagagaaaagguacgaagaugagggaaucgguaguuccuauauguuccggguugaccacgauacgauuauagacgccaccaagugcggcaauuuugcucgauucaucaaccauagcuguaauccuaacugcuacgccaaagugauuacugucgagucucagaagaaaaucgugauuuauucgaagcagcacaucaauguaaacgaagagauaacauacgauuauaaguuccccaucgaagacgugaaaauuccaugucuuugcgggucagagaacuguagaggaacccugaauuga

SEQ ID NO: 62378 - RNA, 7695 nt, Artificial Sequence
  derived and/or modified sequence opt3 from SETD2__Homo_sapiens__NP_054878
augaagcagcugcaaccccagccuccaccgaaaaugggcgacuucuacgaccccgagcacccuaccccagaagaggaagagaacgaagccaagaucgagaaugugcagaaaacuggguuuauuaagggucccauguucaaaggugucgcuucaucccgguuucucccuaagggcacuaagacgaaaguuaaccuugaggaacaggggaggcaaaaggugucuuucucauuuagucugaccaaaaagacuuugcagaaucgguucuuaacugcacugggaaacgagaaacagagcgacaccccaaaucccccugccguaccacuacagguggauuccacaccgaagaugaagauggaaauaggcgacacccucucuacugcggaggagucgucacccccuaaaucccgcgucgaacuggguaagauccauuuuaaaaagcaccuucugcaugugacaagucgaccauugcucgcuaccacgacugccguugcaucucccccuacccacgccgcuccacugcccgcagugauugccgagagcacaacugucgauagcccgccuuccucacccccaccucccccacccccugcucaagccaccacacugaguagcccagcgccggugaccgaacccguagcacucccucauacgccaaucacuguuuuaauggccgcucccgugccucugccagucgacguggccgugcguucucuuaaagagcccccgauuaucauagucccugaauccuuggaggcagauacaaagcaggacaccaucucaaacagccuggaggaacacguuacucagauucuaaaugagcaggcugauaucaguucuaaaaaggaagacucccacauugggaaggaugaggaaaucccagacagcucgaaaauaucucucuccugcaagaaaacaggaucaaagaaaaagaguagccaauccgagggcauuuuccugggcucugagagcgaugaagacucagugagaaccaguuccagccagaggucucaugaccuuaaguuuucagccaguaucgagaaagaacgggauuucaagaaaagcuccgcgccccugaagucugaggacuuggggaaaccuucgcgcagcaagacggauagagacgauaaguauuuuuccuacucaaaacucgaaagggacacccgguauguaaguucucgcugucgaagcgagagagagaggcggcguucccgcucacacagcagaucugaaaggggaucccggacaaaccugaguuacagccgaucugagcgcucccauuauuacgauucagacagaagguaucaccggaguagccccuaccgcgaaagaacuagguacucgcguccauauaccgauaaucgggcccgagaguccucugacagcgaggaagaguacaagaaaacauauucaagaaggacaaguucccacucuagcuccuaccgcgauuuacggaccucaagcuauaguaagucugacagagacugcaaaacagaaaccuccuaccuggagauggaaaggcgcgguaaguauagcucgaagcucgagcgagagucaaaacggacuucugaaaacgaggcaauuaagcguuguugcaguccucccaaugaacuuggcuucagaaggggguccagcuacucuaaacaugauagcuccgcuucacgcuacaagaguacgcugagcaaaccaaucccgaagucugacaaauuuaagaacuccuucuguugcacagaguugaaugaagagaucaagcagucacacaguuucagccuacaaaccccuuguuccaaaggaucugagcugcggaugauuaacaagaaucccgaaagagagaaagccggcucgccagcucccagcaacaggcucaacgauucaccuacucugaagaaacuugacgaacugccaauauuuaaguccgaguucaucacccaugauagucacgacucuauuaaggaauuggauagccucuccaaagugaagaaugaccagcugcgaucauuuugccccaucgaguuaaacauaaaugguucuccuggggccgagagcgaucuggcaacauucuguaccaguaaaacugacgccguccuaaugacauccgaugacagcgugacgggaucugaacucucaccgcugguuaaggcuugcaugcuuuccaguaacggcuuucagaauauuagccgcuguaaagagaaggauuuggacgauaccugcaugcugcauaagaaaucggaaucuccauuccgggagacugagccccucguguccccucaccaggauaagcugaugagcaugccagucaugacaguggacuauucaaaaaccguaguuaaggaacccguggauacaagagucaguugcuguaaaacuaaggacucugauaucuacugcacccuuaacgacuccaauccuagccuguguaacucagaggcggaaaauaucgagccgagugugaugaagauuagcuccaacucuuuuaugaauguccacuuggaaagcaaacccgugaucugcgauuccaggaaccucacggaccauucaaaguucgcaugugaggaguauaaacaaucuauuggcaguaccucgagcgccuccguuaaucacuuugaugaccuguaccagccaauagggucuucaggaaucgcuagcuccuuacagagucugccucccgguauuaagguggauucucuaacacuccugaaaugcggcgaaaacacuagcccaguacuugacgccgucuugaaaagcaagaaguccagugaguuccugaagcaugcagggaaggaaaccaucguggagguuggaagcgaucucccugacucuggcaaggguuuugccucccgugaaaaucgccggaacaacgggcugucaggcaaauguuuacaggaggcucaagaggaaggaaauagcauccugcccgagagaaggggccgaccagaaauuucgcuugacgagagaggggaaggaggucacgugcacacaucugaugacagugaggucguguucuccagcugcgauuugaaccucacuauggaggacucagauggcguaaccuaugcccugaagugugacuccucugggcaugcaccggaaauagugagcacgguucacgaggauuacaguggauccagcgaaucuucaaaugacgagagugauuccgaggacacagauagcgacgacucuucgaucccucgcaacagacuacagucagucguggugguccccaaaaauagcacccugccaauggaagagacuucccccugcaguucuaggagcucccagucauaucggcauuacagugaucacugggaagacgagcgacucgaaucuagacgccaucuguacgaggagaaguuugaaagcauugcguccaaggcuuguccucagacagauaaauucuuccuucacaagggcaccgagaaaaacccagaaaucucauuuacucaaagcucuaggaagcagauugacaaucguuugcccgagcugucccacccucagagugaugguguugacagcaccucgcauacagaugugaaauccgacccguuagggcacccaaacucugaagagacggugaaggccaagauccccucacggcagcaagaggaacucccuauauauagcagugauuucgaggacguacccaauaaauccuggcagcagaccacuuuucaaaacagaccagauucuaggcugggcaagacagaacuuagcuucucauccaguugcgagaucccucaugucgacggacugcacagcucugaagaguugcgcaaucucggcugggauuuuucacaggagaaacccuccaccacauaccagcagccagacagcucuuauggggcaugcggaggucauaaguaccaacagaacgccgaacaguauggcgggacucgagacuacuggcagggaaauggcuauugggauccuagaaguggucggccgcccgggaccggcgugguuuacgacaggacgcaaggacaggugccagauucgcugacagacgaucgcgaggaagaggagaacugggaccagcaggauggcucccacuucagcgaccaaucagauaaauuucuacugucucuccagaaggacaaggggagcguccaggcuccugaaauuuccaguaauucaaucaaagauacccuggccgugaacgagaagaaagacuucucuaagaaccuugagaaaaaugauauuaaggaccguggacccuugaagaaaagacggcaagagaucgaaagcgacuccgagagugauggcgagcugcaggacaggaagaaaguucgcguggaaguagagcagggugaaacuagcgucccaccuggguccgcauuagugggacccucuugugugauggaugacuuucgagauccgcagagauggaaggagugcgcuaaacaaggcaagaugccauguuacuucgaccucauagaagagaacgucuaucugaccgagcggaaaaagaauaagucacacagggauauuaaacgcaugcagugcgaauguacaccucuuagcaaggacgagagagcccagggugaaaucgcgugcggcgaggauugucugaacaggcuacucaugauugaaugcucgucccggugucccaauggggacuacugcaguaaccgucgcuuucagcgaaaacaacaugccgauguugaggugauccugacugagaagaaaggauggggcuugagagcugcaaaggaccugccaucuaauaccuucguauuagaauauuguggggaggugcucgaccacaaggaauuuaaagccagggucaaggaguacgcucggaacaaaaauauacauuauuacuucauggcccugaagaacgaugagaucauugacgcaacacagaaaggaaauugcagccgcuucaugaaccacucaugcgaacccaauugugagacgcagaaguggaccgugaacggccagcuuagaguuggauuuuucacuacaaagcuggugccuuccgggucugaauugaccuuugauuaucaauuccagagguacggaaaagaggcgcagaagugcuuuuguggcagugccaauugccgggguuaccucggcggggaaaaccgagucagcaucagagcugccggaggcaaaaugaagaaagagcgcuccaggaagaaggacucaguggauggggagcuggaagcacuaauggagaacggagaaggccugagcgacaaaaaucagguucuuucucucagucggcugauggugcguauugagacuuuggaacaaaagcugacauguuuagagcucauccagaacacccacucccagagcugccugaaaucauuccuugagagacauggucugucuuugcucuggauauggauggcugaacugggggauggaagggaguccaaucaaaagcuacaggaagagauuaucaaaacgcuggaacaccuuccgauccccacuaagaacaugcucgaggagucgaaaguccugccaauuauccagcgcuggagccagaccaagacagccguaccucccuugagugaaggcgacgguuauucuuccgagaauaccagccgggcacauacuccuuuaaacacaccagaucccucaaccaagcugaguacagaagccgacacugauaccccuaaaaagcucauguuucgaagacugaaaauuauauccgagaauagcauggacucugcuaucucagaugcgacgagcgagcuugaaggcaaggacgggaaagaggaccuggaucaauuggaaaacgugccaguugaggaagaggaggaacuacagucccagcagcugcucccccaacagcugccggaguguaagguggacucugaaacaaauauugaggccaguaaacuuccuaccucggaaccagaggcagaugcugagaucgaacccaaagagagcaacggaacuaaguuagaggaaccuauuaaugaagagaccccaucccaggacgaggaagagggcgucucagauguggaaucugagaggagccaggagcaacccgacaaaacaguagauaucagugaccuggccacuaagcucuuggauuccuggaaagaccugaaggaaguguaccgcauaccgaagaaaucacagaccgagaaggaaaacacgacaaccgagcgggggagagaugccgucggauuccgugaccagacuccugcucccaaaacaccaaauaggucucgggaacgcgacccugauaagcaaacccagaacaaagagaagcgaaagagaaggagcucccucagucccccaagcucugcauaugagcggggcacuaaacgccccgacgauagauacgacacaccuaccucaaagaaaaagguuaggaucaaagaucgaaauaagcuguccacggaagaacggcguaaacuuuuugaacaggagguggcccagagagaagcgcaaaagcagcagcagcaaaugcagaaccuggguaugacuagcccauugccguaugacagucuaggguacaaugcuccccaccauccuuucgccggauauccacccggcuacccuaugcaggcauacguggauccaucuaaccccaacgccggcaagguccugcucccuaccccguccauggacccagugugcucgcccgcuccuuaugaucacgcacagcccuuaguugggcacagcacagagccacugucagccccucccccaguaccgguggucccucauguggcggcucccguugagguguccucuagucaauacgucgcccagagcgacggagugguacaccaggauucauccgucgcagugcuuccaguucccgccccugguccagugcagggccaaaauuauagcgucugggacucuaaccagcagaguguguccguucaacagcaguacagccccgcucagucacaagccaccauuuauuaccaggggcagacauguccuacuguguauggagucaccucuccguacucgcagacgacaccacccaucgugcaaagcuacgcacagccuucccugcaguauauucagggccaacagaucuuuacugcucauccacaggguguagugguucaacccgccgcggccgucaccacaauaguggcaccugggcagccccagccacuccagccgagugaaaugguggucaccaauaacuugcuggaucucccucccccaucuccucccaaaccaaagacuauuguacugccucccaauuggaaaaccgcucgcgacccggagggaaagaucuacuauuaccacgugaucacaaggcaaacgcagugggacccaccuacuugggaaucacccggcgaugacgccagccuugagcacgaagcugagauggaucuaggcaccccaacauaugacgagaaccccaugaaagcauccaagaagccuaaaaccgccgaagccgauacaaguucugagcuggcuaagaaaagcaaggaaguuuuccggaaagagaugucccaguucauugugcagugcuugaauccguacagaaagccagacuguaaggucgggcgcauaacaaccacggaggauuuuaaacauuuagcgaggaagcugacucacggagugaugaacaaagaacucaaguauugcaaaaaucccgaggaccuggaaugcaacgagaauguuaagcauaagacaaaagaauacaucaagaaauacaugcaaaaguucggugcaguguauaaaccuaaggaggauaccgagcuugaauga

SEQ ID NO: 62379 - RNA, 1950 nt, Artificial Sequence
  derived and/or modified sequence opt3 from SETD3__Homo_sapiens__XP_011535533
auggagugcagaggccccaccagcuccaggugugugcugcggcgccaccaggccacagggggagcugaacgagucgguugccucucuacuaacggcaagaaagcagagcuuucaaaggaagagagagccgcggcucuguugccugccagaccagcaguuaggaaaauggggaagaaaagucgggugaagacgcaaaagagcggaaccggcgccacagcuacuguauccccgaaagaaaucuuaaaucugaccucugagcuacuccagaaguguucgucacccgcaccugguccagggaaagagugggaagaguacgugcagauucgcacacuggucgaaaagauacguaaaaagcagaagggacuuagcgugaccuucgacggcaaaagggaggauuauuuucccgaccugaugaagugggccagugagaacggcgcuuccguugaaggguucgagauggugaauuuuaaagaagagggauucgguuugcgggccacucgcgauaucaaggcggaagaacucuuucugugggucccucgaaaacugcucaugacaguggagucugcaaagaacagcguauuaggcccacuguacucccaagacaggauucuucaggccauggggaauaucgcuuuggccuuccaucugcuaugcgaaagagcaucacccaacaguuuuuggcagccuuauauucagacccucccaagcgaguacgauacgccgcuguauuucgaagaggacgaaguucgguaccuucaaucuacucaggcuauccacgauguguuuucccaguauaaaaauaccgcccgucaguacgcguacuucuauaaggucauacaaacacauccccacgccaacaagcugccuuugaaagacucauuuacuuacgaggauuaucgcugggcagugagcagugugaugaccagacagaaucagaucccaacagaggacggaucuagggucacccucgcucugauucccuuaugggauauguguaaccauacgaauggccugaucacuacagguuacaaccucgaagacgaucggugcgaguguguugcccuucaagacuuccgagcuggggaacagauuuauaucuuuuacggaacccgcuccaaugccgaguucgugauacacagcggcuucuuuuucgacaacaauucgcacgauagaguaaagauuaaacugggcgugucuaaguccgacagguuguaugcaaugaaagccgaaguccuagcucgggcggggaucccuacuucaaguguguuugcacugcauuucacagagccacccauuagcgcccagcuccuggcuuuucuucgcguuuucugcaugaccgaggaggagcugaaggaacacuugcucggagauuccgccaucgacagaaucuuuacgcuggguaacucugaguucccggugagcugggauaacgaggucaaguuauggaccuuucuggaagacagggcaucacuacuccugaaaacauacaagacuaccauugaggaagauaaaagugugcuuaagaaucaugacuuguccguacgugccaaaauggcuauaaagcugcggcucggcgagaaggaaauccuggagaaagccguuaagagcgcagcggugaaccgagaguacuauagacagcaaauggaagagaaagcuccucuucccaaguacgaagagucuaaucugggguugcucgaaucaagugucggagauagcaggcugccauuagugcugcgcaaccuagaggaggaagccggcguccaggacgcacucaauauucgggaggccaucuccaaagcuaaggccacagaaaacggucuggugaauggggagaacucuauaccuaauggcacuagaucggaaaacgagagccuuaaucaggaguccaagagggcaguugaagaugcuaaaggaucaaguucugacagcaccgccggcgugaaggaguga

SEQ ID NO: 62380 - RNA, 4329 nt, Artificial Sequence
  derived and/or modified sequence opt3 from SETD5__Homo_sapiens__NP_001073986
augagcaucgccauuccccugggcgugaccacauccgacacuucuuacucagauauggcugcagggagugacccugagagcgucgaagccuccccagcgguuaacgagaagucuguguauucgacgcacaauuacggaaccacacagagacaugguugcaggggccucccguaugcuacuauaaucccccggucagaucuuaacgggcugccuagcccaguagaggagcgcuguggagacagucccaauuccgaaggcgagaccgugccuacauggugcccaugugguuugucucaagauggguucuuacugaacugcgacaaaugucgaggaaugagccguggcaaggucauuagacuacacaggcggaaacaggauaauaucuccggcggggacucaagugccaccgagagcugggaugaggaacucucucccuccacugugcuguacacagcaacccagcauacgccuacuucaauuacccuuacaguucgcagaacuaagcccaaaaagaggaagaaaagcccggaaaagggacgggccgcucccaaaaccaagaaaaucaagaacaguccuucugaggcacagaaucuggacgagaacacaaccgaagguugggagaaucgcauacgauuguggacggaucaauaugaagaggccuuuacuaaccaguacuccgcugacgugcagaaugcccucgaacagcaucugcacagcucgaaggaguucgucggcaaaccaacaauccuggauaccauuaacaagacugagcucgcgugcaauaacacagugaucgggucucaaaugcaguuacagcugggaagaguaaccaggguucagaaacaccggaagauucuucgugcagcccgcgacuuggcucuggacacgcuaaucauagaauauagaggcaaagugaugcucaggcaacaguuugaggucaauggucacuucuuuaagaaacccuacccuuucgugcuguuuuacuccaaguucaacgggguggaaaugugugucgaugcccggaccuuuggaaacgacgcacgauucauucgcagaucaugcacaccaaaugcugagguuaggcauaugaucgccgauggcaugauucaccuuuguaucuaugcggugagugccaucacuaaggacgcagaaguaaccauugcuuuugauuacgaguauagcaacugcaauuacaaaguggacugugccugccauaagggcaaccggaauugccccauacagaaacgcaacccgaaugcuacagagcugccuuugcuacccccaccucccucccugccaacuaucggggccgaaaccagaaggcguaaggcacggcgaaaagaguuagaaauggagcaacagaacgaagccucugaggagaauaacgaucagcagagccaagaaguccccgagaaggugacaguuucaagugaccacgaagagguggauaauccugaggaaaagccagaggaagagaaagaagaggucauugacgaucaggagaaccuggcucacuccagaaggacccgcgaagaccggaagguggaggcgaucaugcaugcauucgaaaaucucgagaaaagaaagaaaaggcgcgaccagccgcuugaacagagcaacucugauguagagauaacuacgacaaccucagagacucccguuggagaagagaccaagacagaagccccugagagugaagugagcaauuccgucucuaacgugaccauuccaucgacuccccaaagcgucggugugaacacacgacgguccucacaggcuggcgacaucgccgcagagaagcugguuccuaaaccacccccggccaagccuagucguccaagacccaaaucuaggaucagccgcuaucggacguccucagcucagagauugaagaggcagaaacaagccaaugcacagcaggcggagcuaagccaggcugcccuggaagaagggggaucuaacucccucgugaccccuacugaagcaggcagucuggauagcucuggugagaaucgaccccuuacaggguccgacccaaccguagucucaauuacaggcagucacgugaaccgcgccgcuagcaaguacccuaagacuaaaaaguaucugguuaccgagugguugaaugauaaagccgaaaagcaagagugucccguggaaugcccacuccggaucacgaccgacccgacaguccuggcaacuaccuuaaacaugcugccuggacuaauucauucgccccucauauguacaacuccaaaacacuacaucagauuuggcucccccuucauuccugagaggcgucgccggccacugcuucccgaugggaccuucucuagcugcaagaaaagauggaucaagcaggcuuuggaagagggaaugacgcagacaucaagugugccucaagagaccaggacucagcaucuguaccaguccaaugaaaacucuagcuccucaagcaucuguaaggacaaugccgaucuccugaguccgcuuaaaaaguggaaaucucgauaucugauggagcagaacguaacaaaguugcuccggccacugucccccgugaccccuccacccccuaauagcgguucgaaaucaccgcaauuagcgacucccggcucuagucacccaggggaagaggaaugccgcaacggauacucccugauguuuagcccuguuaccucucuaacaacggccagcagauguaauaccccacuccaguucgagcugugccacaggaaggaccuugauuuggcuaaggucggcuaucuggacuccaacacuaauucaugugcagaucggccaagucuccugaacagcggucauucugacuuagccccucaccccucccuggggccaacaucagagaccggcuuuccgagucgaagcggagacggccaucagacacuugugagaaacuccgaucaggcuuuccgcacugaauuuaauuugauguacgccuauucuccucucaacgcaaugcccagggcggacgggcuguaccguggaucgccacucgugggugaucggaaaccccugcaccucgacggcggguauugcagcccugccgagggauucucauccagauacgaacacggccugaugaaggaucuuaguagggguucuuugagcccagggggcgagcgcgcuugugaaggaguccccuccgccccucaaaauccgccacagcgaaagaaaguuucacuguuagaguacagaaaacggaagcaggaggcaaaggaaaacucugcuggcgggggaggcgacagcgcccagaguaaauccaagagcgccggugcagggcaaggaucuucaaauuccgugagugauaccggcgcucauggugugcagggcagcucggcgaggacgcccucuuccccucacaaaaaguuuagccccucacauaguucuaugucccaccucgaggccguaagcccaucagacagucgcgggacaagcuccucucauugccguccucaggaaaacauuagcuccagauggaugguccccaccucaguggagcggcugagggagggaggcucuauaccaaaaguucuucgcaguucggugcgagucgcacaaaagggggaaccuagcccgacuugggaguccaauaucaccgaaaaggauucugaccccgcugauggagagggcccagaaacacugucaagcgccuuguccaaaggugccacuguguauaguccuucuagauacagcuaucagcuccugcagugcgacucaccccggaccgagucccagagucuacugcaacagucaucuuccccauucagggggcacccuacacagucacccggauacagcuaucgcacgaccgcucucagaccgggcaacccaccuucgcacgguucuagugaguccagccugucauccacuucuuacagcagucccgcacauccaguuuccacagauagccuugcccccuuuaccggcacuccuggguauuucucuucacagccgcacaguggaaauuccacaggcagcaacuugcccaggcggucuuguccaucgucagcggcuagcccuacccugcaagggcccuccgacaguccuacgucugacagcgugucccagucaaguacuggaaccuuaucuagcacauccuuuccacagaauagccguagcucucuccccuccgaucugcgcaccauuagucuuccuagcgccggccagucggcaguauaccaagccucccgagucucugcugugucaaacagccagcauuacccacacagagguagugggggagugcaucaguauaggcugcagccccuacaaggcuccggugucaagacucagacaggccucucuuga

SEQ ID NO: 62381 - RNA, 1101 nt, Artificial Sequence
  derived and/or modified sequence opt3 from SETD7__Homo_sapiens__NP_085151
auggacagcgaugacgagaugguggaagaggccgucgaaggccaccuggaugacgaugggcucccccauggauucugcaccguuacauacuccucuacugacagauuugaggguaacuucgugcacggcgaaaagaaugggaggggaaaauuuuucuuuuucgauggcucaacgcuugaggguuauuacguagacgaugcucugcaggggcaaggaguguauaccuacgaggacggcggcgucuugcaggggacauauguggauggagaauuaaacgguccugcacaggaguacgacacugauggccggcugaucuuuaaggggcaguauaaagacaauauucgccauggaguuuguuggauauacuacccagacggcgguagucuagugggggaagucaacgaggauggagagaugaccggcgaaaagaucgccuauguguacccggacgagcgaacagcgcucuauggcaaauucauugauggggaaaugaucgagggaaagcuggcuacccuuaugagcacugaagagggucguccccacuuugagcugaugccuggcaauuccguauaccauuucgacaagucuacaucgucaugcauuagcaccaacgccuugcucccagaucccuaugaaagugagagaguuuacguggcagaaucccugaucucuagcgccggggagggacuguuuuccaaagucgcugugggcccuaauacggugaugucauucuauaacggugucaggauaacucaccaagaaguugacagucgggauugggcacucaaugggaacaccuuaagccuggacgaggagacagugaucgauguaccagaacccuacaaucacgugucuaaguacugugccucccuuggccauaaagcuaaccacucauuuacuccuaauugcauuuaugacauguucguccauccacgcuucggaccgaucaaguguauuagaaccuugagggccguggaggcggaugaggaacugacaguugcauacggcuaugaccacagucccccugggaaaagcggaccagaagcccccgagugguaccagguggagcuaaaggcuuuucaggccacccagcaaaaguga

SEQ ID NO: 62382 - RNA, 1059 nt, Artificial Sequence
  derived and/or modified sequence opt3 from SETD8__Homo_sapiens__NP_065115
auggccagaggcaggaagaugagcaaaccccgggcuguggaggcagccgcggcugccgcagccgucgcugcaaccgccccugggccagaaaugguugagcgccgaggaccgggucgucccagaacagacggcgaaaacguguucacugggcaguccaagaucuacucuuauaugucaccuaauaaaugcaguggaaugagguuuccacugcaagaggaaaacagcguaacgcaccaugaggugaagugucagggcaaaccccucgcugguauuuaccggaagcgcgaggaaaagagaaaugccgggaacgcggucagguccgcaaugaaaucugaggaacagaagauaaaagaugcccggaagggaccucuugugccauuccccaaucagaaaucggaggcugccgagccuccaaagaccccgcccucaagcugcgacaguacaaacgcagcuaucgccaagcaagcgcugaaaaagccuauuaaaggcaagcaggccccacgcaaaaaggcacagggcaaaacucagcaaaaucgaaaguugaccgauuuuuaucccguuagaagguccucucguaagagcaaagcugaauuacaguccgaggaacggaagcgcaucgacgagcugauugaaucagggaaagaggagggaaugaagaucgaucuaauagacgguaaaggcagaggggugaucgccacaaagcaguucaguaggggagauuuugucguggaauaccacggcgaccucauugagaucaccgaugcuaagaaacgggaagcccuguaugcacaggacccuagcacugguuguuacauguauuacuuccaauaccuuucuaagacauauugcguagaugccacccgagagacgaaccgccuggggagauugauuaaucauuccaaauguggaaacugccagacuaagcuccacgacaucgauggcguuccacaucugauacugauugcuucaagggacaucgcggcaggcgaggaacucuuauacgacuauggggaucggagcaaagccaguauugaggcucaccccuggcugaagcacuga

SEQ ID NO: 62383 - RNA, 2124 nt, Artificial Sequence
  derived and/or modified sequence opt3 from SETDB2__Homo_sapiens__NP_001153780
augggcgagaagaacggggacgccaaaaccuucuggauggaacuggaggaugacggaaagguggauuuuaucuucgaacagguccaaaauguucuccagagccuuaaacagaagauuaaagacgguuccgcuacaaacaaggaguacauacaggcaaugauccuggugaaugaagccacuauuaucaacucuucaacgaguauuaaggaucccaugccuguaacccaaaaagagcaggagaauaagagcaacgcguuuccauccacaucuugcgaaaauucguucccggaggacuguacuuuucuuaccacagaaaacaaagagaucuuaucacuggaggauaagguggucgacuucagagaaaaagauagcaguuccaaucuaucuuaucagagccacgacugcuccggcgcuugucucaugaagaugccccugaaccuuaagggggagaauccucugcaguugccaauaaaaugccauuuucaaaggcggcacgccaagaccaacucacauaguagcgcacuccacgugucuuacaaaacucccuguggacgcucccugcgaaauguugaagagguguuccguuaucugcucgaaacagagugcaacuuuuuauucaccgauaauuuuucauucaacacguacguccagcuggccagaaacuauccuaagcagaaagaggugguaagcgacguugauaucaguaauggcguggaaucugucccaauuuccuuuuguaacgagaucgacagcaggaaguugccccaguucaaauaccggaagacuguguggccucgcgcuuauaauuugaccaacuucucgucuauguuuacagacuccugcgauuguucagaagguugcauugacaucacuaagugugcaugccugcaacuaaccgccagaaaugcuaaaacaaguccacucagcuccgauaagauaaccacgggguacaaauacaagaggcugcagcggcagauuccgacuggaaucuaugagugcucucuucuguguaaaugcaaccgccaauugugucagaaucgagugguccagcauggcccccagguuagacuccaaguguucaagacagaacagaagggcuggggaguaaggugccuggacgauauugaccgggggaccuuuguguguaucuacagcggucguuuacugucacgcgccaacacugagaaaaguuauggcaucgaugagaaugggagagacgaaaacacaaugaagaauauuuucuccaaaaagaggaaacucgaggucgcgugcagcgauugugaaguggagguucuuccucugggauuggaaacccacccacggacggcaaagaccgagaagugucccccuaaauuuucuaacaauccaaaggagcuaacaguggaaacuaaauacgacaacauaucacgaauccaguaucacagugucauucgcgaucccgagagcaagaccgccaucuuccagcauaauggcaaaaagauggaauuuguguccucugagucgguaacaccggaggacaacgacgguuucaagccucccagagaacaccugaacagcaaaacuaagggggcucaaaaagauuccucaaguaaucauguugacgaguuugaagauaaccuccugauagagucugacgugauugauaucaccaaguacagggaagagacaccaccucggagccgcugcaaucaggccaccacucuugacaaccagaauaucaaaaaggcaauugagguccagauccaaaaaccccaggaaggaagauccacggcuugccagaggcagcaaguguucugugaugaggaacuguugucagagacaaagaacaccagcucugacucccucacuaaguuuaauaaaggcaacgucuuccuguuagaugccaccaaggaaggcaauguggggcguuuucugaaccacaguugcugcccaaaucuacucguucagaacguguucguagagacacacaaucggaacuucccccuggucgcguuuuucaccaaucgauaugugaaagccagaacugagcuuacaugggacuacggauacgaagcagguacgguuccugagaaggaaauauuuugucagugcggcgugaacaaauguaggaagaagauuuuguga

SEQ ID NO: 62384 - RNA, 807 nt, Artificial Sequence
  derived and/or modified sequence opt3 from SET__Homo_sapiens__NP_001234929
augggcugcagagaccugcuccccagccuuaagccuacccuguuggagaaagaacagcaagaggccaucgaacacauugaugaggugcagaacgaaauagacagguuaaaugagcaggcuuccgaggaaauccugaaggucgagcagaaauacaacaagcuacggcaaccauucuuucagaaacgcucugaacucauugcaaagaucccgaauuucuggguuacaacuuuugugaaccauccccagguaucagcccugcuuggggaggaggaugaagaggcgcugcacuauuugacgcgaguggaagucaccgaguucgaagacauuaagaguggauaccguaucgauuuuuauuucgacgagaauccuuacuuugagaacaaagugcucagcaaggaguuccaucugaaugaauccggugauccaucuucgaaaucaacagaaauaaaguggaaaagcggcaaggaccugacuaagagaaguucccagacccaaaacaaggcuucuaggaaacggcagcacgaggaacccgagagcuuuuucacaugguuuaccgaucauuccgacgccggggcagaugagcucggagaaguuaucaaagacgauauuuggccuaauccauuacaguauuaccuggugcccgacauggacgaugaggaaggcgagggugaagaggacgaugacgaugacgaggaagaggaagggcuugaggauaucgacgaggaaggagaugaggacgaaggcgaggaagaugaggacgacgaugagggcgaagagggggaagaggacgaaggagaggaugacuga

SEQ ID NO: 62385 - RNA, 1098 nt, Artificial Sequence
  derived and/or modified sequence opt3 from SETMAR__Homo_sapiens__NP_001263254
auguucgccgaggcugcaaagaccacaagacccugcggcauggccgaauuuaaagagaagccugaagcgccaacugagcagcuggacguggcuugugggcaagaaaaccucccggucggagccuggcccccuggugcagccccagcucccuuccaguacacgccugaucacguugugggcccaggggcagacaucgaucccacccagauuacauuuccuggaugcauauguguaaaaacuccaugccuuccgggcaccuguagcugccugaggcauggugagaauuaugacgauaacuccuguuugcgggacaucgggucuggaggcaaguacgccgagcccguguucgaaugcaaugucuuaugucgcugcucagaucacugucgaaaccgugugguucagaaaggccugcaauuucauuuccagguguuuaagacacacaagaaaggguggggacuaagaacccucgaguucauuccuaaggguagguuugucugcgaauaugcuggcgaggugcugggguucagugagguacagcggcgcauccaucuucagacuaaaagcgacuccaauuacauuaucgccauaagagaacacguuuauaacggacaagugauggagacauuugucgauccaaccuacaucggcaauauugguagguuccugaaccacucuugcgaacccaauuugcucaugaucccugugcggauugacucgauggugccaaagcuggcgcuguuugcagccaaagauaucguccccgaggaggaacucucauaugacuacagcgggcgcuacuuaaaccugacgguuagugaggauaaggaacgacuugaccauggaaaguugagaaaaccguguuauugcggcgcuaaguccuguacugccuuccugccuuucgacucuagccuauacugccccguggagaaauccaauauaucauguggcaacgaaaaggagccaaguaugugcgggagcgcaccuucuguauuucccuccuguaaaaggcucacccuggaagugucacuuuucagcgauaagcagcuggcuccacccuauaguggacggcagugguuggccucuuuuacauccgcguga

SEQ ID NO: 62386 - RNA, 8034 nt, Artificial Sequence
  derived and/or modified sequence opt3 from SETX__Homo_sapiens__NP_055861
augagcacaugcuguuggugcacccccggcggggccuccacuaucgacuuccugaagagauacgcuucuaacacgccuucaggagaauuucaaaccgcagaugaagaccucuguuauugccuugaguguguggccgaauaccacaaggcgagggaugagcugccauucuugcaugaagucuuaugggagcuggagacacuacggcucauuaaucacuuugaaaagagcaugaaagcugagauaggugacgaugacgaacuguauaucguugauaacaauggcgagaugccgcuuuucgacauuacugggcaagauuuugagaacaagcugcgcgugcccuugcucgaaauccugaaauacccuuaucugcucuuacaugagcgagucaaugaacugugcguggaggcccuuugucguauggaacaggcaaacugcagcuuccaggucuuugacaagcacccaggaauuuacuuguuccuggugcaucccaaugagaugguuagaaggugggccauccuaaccgcucggaaccucggcaagguggaucgcgacgauuauuacgaccugcaggagguccuucuguguuuguuuaaagugauagaacucggucuguuagaguccccugacaucuacacaucuucgguacuggaaaaggggaaacucauucuucugccaucacacauguaugauaccacuaauuacaagagcuauugguugggaaucugcaugcuacugacaauucucgaggaacaagcaauggacagucugcuucugggcuccgauaaacagaacgacuucaugcagucuaucuugcacaccauggagagagaggccgaugacgauagcguugaccccuuuuggccugcucuccauuguuucauggugauacuggauagguuaggcuccaaggucugggggcagcugauggacccaauuguggccuuucaaacgaucauuaauaacgcgucauacaaucgggaaauccgccacauccgaaacaguagcgugagaacuaagcuagagccggaaucuuaucucgaugacaugguaaccugcucccagauuguuuacaauuauaaccccgagaaaacaaagaaagacucaggauggaggacugcaauaugcccugauuacuguccaaacauguacgaagagauggagacccuggccagcgugcuucagagugacaucggucaggauaugcggguacauaauucuacauucuugugguucauucccuuugugcaaucccugauggaccucaaggaucugggcgucgcuuauaucgcccaggugguuaaccaccuuuacagcgaagugaaagagguccugaaucagaccgacgcagugugcgauaagguaacggaguucuuuuugcucauacugguuucggugauugaguuacaccguaacaaaaagugucugcaucuacucugggucucuucccaacaguggguggaggcugucgugaagugcgccaaacugccuacuacagcguucacccgcucaagugaaaagagcuccgggaauuguucuaaaggaacugccaugaucagcucacuuaguuugcacuccaugccaagcaacucuguucagcuggcauaugugcagcucaucagaucacuguuaaaggagggcuaccaacugggucagcagagucuuugcaaaagguuuugggacaaguugaaucucuuccugcgggggaaccuaagccugggauggcagcucacaucccaagaaacccaugagcugcagucuugucuuaagcagauuauccgaaauauuaaauuuaaggcucccccgugcaacacguucguagauuugaccucggccuguaaaauaagcccugcuuccuauaauaaggaagagucagagcagaugggcaaaacaagucgcaaggacaugcacugccuggaagccucuagccccacuuuuuccaaggagccaaugaaaguccaagauucaguguuaaucaaggcagacaacaccauugaaggcgauaauaacgagcagaauuacaucaaagacguuaagcucgaagaccaucugcuugccgggagcugucugaaacagucuuccaagaacaucuucacagagagagcugaggaucagauuaagauaaguacuaggaaacaaaagagcgugaaagaaaucucuuccuauaccccuaaggacugcacaucacggaacggacccgagcgcgguugcgauagaggcauuaucgucaguaccagguugcucacugacagcucgacggaugcgcuggaaaaaguguccacaucuaaugaggacuuuagccuaaaggaugacgcacuggccaaaaccucaaagcguaagacuaaaguacagaaggaugaaauuugugcuaaacucagucacgugaucaagaaacagcaccggaaguccacccugguugacaacacaauaaaucuugaugagaacuugaccgucucuaauaucgagagcuucuacucccgaaaggacacuggggugcaaaaaggagauggcuuuauucauaaccugucauuagacccaagcggugugcucgacgauaagaauggggaacagaaaagucagaacaauguccugcccaaggagaaacagcuuaagaacgaagaacugguuaucuucucuuuccacgagaauaacugcaagauucaagaauuucauguggacggcaaagagcuaaucccuuucacagaaaugacgaaugccuccgagaagaaaagcucgccauuuaaggaucucaugaccgugccggaaucaagagacgaggagaugucuaacaguacuuccguaauauacagcaaucugacaagggaacaggcacccgauauuucuccuaaaagcgacaccuugacagauucccagaucgaccgcgaucugcacaaguuaucacuccuggcccaggcuagugucauuacuuucccaagcgacucuccccaaaacuccucacagcuucagcggaaggugaaagaggauaagagauguuuuaccgccaaccagaauaacguuggagacacgaguaggggccaagugaucauaaucagcgacuccgaugacgaugacgaugaacgcauucugucuuuggagaaacucaccaagcaggacaaaaucugccuggaacgagagcacccugagcagcaugucucgacagugaauagcaaggaagagaaaaacccaguuaaggaagagaagacugaaacccuauuccaauuugaggagucagauucccaguguuucgaauuugagaguucuagcgaaguguucuccguauggcaggaccaccccgaugacaauaacucaguccaggauggggagaaaaagugccuggcaccgauugcgaauacaacuaacggacaagguuguaccgacuaugugucugagguggucaaaaagggcgcugaagggaucgaggaacauacgcggccucguagcauaaguguugaggaauuuugcgagauugaggugaaaaagccaaagagaaaaagguccgaaaagcccauggccgaggauccuguacgccccaguucuucagugcggaaugaaggacaguccgacacaaacaaaagagaccuugucggcaaugauuucaagaguaucgacaggcgaaccagcacuccaaacucgcgcauccagcgggcaacaaccgugucucagaaaaaguccagcaagcucuguacuugcaccgagccuauuagaaaaguucccgugucaaagacacccaagaagacgcacagugaugccaaaaagggucaaaauaggucuuccaacuaccugagcugucguaccacuccggcuaucgucccucccaagaaauuucgccagugcccagaacccacaucaaccgccgagaaguuggggcugaaaaagggcccucggaaagcauaugaguuaagucagagaagccucgacuacguggcucagcugagggaucauggaaagacaguuggcguggucgacacucgaaagaaaaccaaacuuauuuccccacaaaaucugucuguacggaacaacaaaaaguugcucacgagccaggaacugcagaugcagcgccaaauaagacccaaaucccagaagaauaggcggcgacuaucagauugcgagucuacagacgugaaaagagccgggagucacaccgcgcagaacucggauaucuucguuccugaaagcgaccgcuccgauuauaauuguacuggagguaccgaggugcuggccaacucuaauaggaagcaacuuauuaagugcaugccgucagaaccagagacaaucaaagcuaagcacggcagccccgcaacugacgaugccuguccucucaaccagugcgacuccgucgugcugaaugggaccguaccaacaaacgaggugauugucaguacgucugaagaccccuugggaggcggugauccuaccgcucgucauaucgagauggccgcauuaaaagaaggggagccggacagcucauccgaugcggaggaagacaaucuguuccucacucagaacgaucccgaggacauggaucuguguagucagauggaaaaugacaacuacaaacuuauagagcugauccacggcaaagauacaguugaaguggaggaggacagcgugucucggccacaauuggaaucccuaucaggaaccaagugcaaguauaaagauugucuggagacuacaaagaaucagggcgaauacugcccuaaacauagcgaggucaaggccgcugacgaagacguguuuagaaaacccgggcucccaccucccgccucgaagccacugaggccgaccacgaagauuuucucuaguaaauccacuagccgcaucgcaggacuuucaaaguccuuagagaccucuagcgcucugaguccuucccucaaaaacaagagcaaaggcauucagucuaucuugaagguuccccagccaguaccccugauagcccaaaagccugugggugagaugaaaaauucauguaacguccuccacccacagagucccaauaacuccaaccgacaggggugcaaggugccuuuuggagaaagcaaauacuucccgucuucgucaccaguuaauauucugcuuagcucccagagugugucugauacauuugucaaggaggugcugaaauggaaguaugaaauguucuugaacuuuggccaauguggucccccugcaagccuaugccaguccaucucaagacccguaccaguccgguuccauaauuacggcgacuauuuuaacguguucuuuccucugaugguucucaauaccuucgagacuguggcccaggaaugguuaaacagucccaauagggagaacuucuaccaacugcagguccgcaaauuuccagcugauuauaucaaguacugggaguucgcgguguaucuugaagagugcgaacuggccaagcagcucuacccuaaagagaaugacuugguuuuucuggcaccggagcguauuaacgaagagaagaaagauacagaaagaaaugacauacaggaucuccacgaguaccacucuggguaugugcauaaguuccggaggaccagcgucaugcgcaacggaaaaacagaauguuaccuguccauccaaacucaggagaauuuucccgcuaaccuuaaugagcuagugaacugcauuguaaucucaagccuggugaccacgcagcgaaaguugaaggccaugucuuuacugggcuccagaaaccagcucgcccgggcuguucugaauccaaacccuauggacuucuguacaaaagaucuucugaccacuaccagugaaaggauuaucgcauaucuccgcgacuuuaaugaggaucaaaagaaagccauagaaacagcguacgcuauggucaagcacagccccucgguggccaaaaucugcuugauucaugggccaccuggaacuggcaaguccaagaccaucgugggucugcuauauagacugcucacggagaaccagaggaaagggcacucugacgaaaauucaaacgcaaagauuaaacagaaucggguccuuguaugugcccccagcaacgcugcaguggaugagcugaugaagaaaaucauauuagaguucaaggaaaagugcaaagacaagaaaaauccguugggaaacuguggcgacauuaaucugguucgucucgguccagagaagaguaucaacuccgaagugcugaaauuuucucuugauagccaggucaaucaccgcaugaagaaagagcugccuucacaugugcaagccaugcacaagcgaaaggaguuccucgacuaccaguuggaugagcuguccagacagagggcguuaugccggggcgggcgcgagauccagagacaagaacuagacgagaacauuaguaaaguuagcaaggaaaggcaggagcuggcuucuaaaaucaaggaggugcagggacggccccagaagacacagucaauaauuauccucgaaucccauauuaucuguugcacccuuagcacuucuggcgggcuguugcuggagagugccuuucgaggacagggcggugucccauucucgugugugauaguagaugaagcagggcaguccugcgagauugaaacacucaccccacugauccacagaugcaauaaacuuauccucgugggagacccuaagcaacugccgcccacuguuauuagcaugaaagcccaggaguauggcuacgaucagucaaugauggcucgcuuuuguagguugcuggaggaaaacgucgagcauaacaugaucucucgguuaccaauucuacagcugacagugcaauaccguaugcacccugacauaugccucuuccccagcaauuauguguacaacagaaaucuuaagaccaacaggcagacggaagccauccgcuguuccagugauuggccuuuccagccauaucuggucuuugacguuggugauggcucagagcggcgagacaaugacucuuacauuaacgugcaggaaaucaaauugguaauggagaucauuaagcugauaaaagauaagagaaaggacgugagcuucaggaauaucgggauuaucacucacuauaaagcacaaaagaccaugauucagaaagaucucgacaaggaguuugaucgcaaaggacccgcugaagucgacacaguggaugccuuccagggccggcaaaaggacugcguuaucgugaccugugucagagcgaacuccauacaggggaguaucggauuucuggccagccuucagcguuuaaauguaacaauuacuagggcaaaguacucccuguucauccucggccauuugcggacccugauggagaaccagcacuggaaucaacuaauucaggaugcucagaaacgcggugccaucauaaagacgugcgacaaaaacuaucgacaugaugcugugaagauucugaaacucaagccuguucuucagagaucucugacacacccacccacuaucgcaccggaagggucaaggccucaaggaggcuugccaagcucgaagcuggacuccggcuuugccaaaaccaguguggccgcuucucucuaccacacacccagcgauucaaaggagauuacccugacugucaccuccaaagacccugaacggccacccgugcaugaccaguuacaggauccgcgccuucugaagagaauggggaucgaggucaaaggagguauauuccucugggacccucagcccucuaguccacaacacccuggcgcgacacccccaacgggggagcccggauuuccugugguucaucaggaucuaagccacauccagcaaccagcagccgugguagcugcccuguccucacauaagccgcccgugaggggcgaaccuccagcagccagccccgaggcuucuacuugucagaguaaaugcgacgauccugaagaggaguugugucaccgacgggaagcgcgugccuucuccgagggugaacaggagaagugcgggagcgaaacccaccauacaagacgcaauucaaggugggacaagcggacccuggagcaggaggauucuuccucgaaaaagagaaaacuccuuuga

SEQ ID NO: 62387 - RNA, 2982 nt, Artificial Sequence
  derived and/or modified sequence opt3 from SEZ6__Homo_sapiens__NP_001092105
augagacccguggcccugcuccuucugccuagcuuguuagcucugcuagcacacggccucucccuggaggccccaaccgucgggaagggacaggcgccggguaucgaagagacagacggcgaacuuacugcugcccccacgccugagcaaccagaaaggggaguucauuucgugaccacagcacccacucugaaauugcucaaccaccauccucugcuggaggaguuucuccaggaaggguuagagaagggcgaugaggaacugcggccagcccuucccuuccagccugacccaccggcucccuuuaccccuucuccauugccccgccuggcaaaucaggauucacgaccuguauucacaaguccaacccccgccauggcugccgugccgacucaaccucagagcaaagagggucccugguccccagaaucugagucgccuaugcuacguauuacagcgccccucccacccgggccuucaauggcagucccaacccugggaccgggcgaaauagccagcacgacucccccuaguagagcuuggaccccaacacaggagggccccggggacaugggaaggccuuggguggccgaaguugugucccagggugcaggcaucgggauucaaggaacuaucaccucuagcacagcuuccggcgaugacgaggagaccacgacuacaaccacuauuaucacaaccacgauaaccacaguccagacuccaggucccugcucauggaacuuuagugggccggaaggaagccuugauucuccuaccgaccuguccucaccaacagaugugggcuuggacuguuucuuuuacaucagcguauaucccggcuacgggguugagauuaaggugcagaauaucagucuccgggaaggagagacugucaccguggaaggucugggcgggccugaucccuuaccacuggccaaccagucuuuccuccuucgcggacaagugauuagauccccuacacaccaggcggcccugagguuucagagcuugcccccaccggcaggcccugguaccuuccauuuucacuaucaggcuuaccuacugucgugccacuucccccggcgcccagccuauggggacgucacuguuacgucucuccaucccggcggauccgcucgauuucacugugccacaggcuaccaacugaaaggggcaagacaucuuaccugccugaaugccacucagccuuucugggauucaaaggagccaguguguaucgcugcgugcggagguguaauaaggaacgcaaccacaggccggauugugagucccggguucccuggaaauuauagcaacaauuugaccugucacuggcuccuggaggccccggaaggccagcguuuacaucugcacuuugagaaggucucccuagcugaagacgacgaucgccucaucauuagaaacggugacaauguggaggccccacccguuuacgauucuuacgaaguggaguaucugccuaucgaggggcuuuugagcucaggcaaacacuucuuugucgaacugaguacugacuccagcggagcagccgcuggcauggcccucagguacgaggcauuccaacaggggcauugcuaugaaccauuugugaaguacggaaacuucucuucaaguacacccacguauccuguagguaccacuguugaguuuagcugugauccgggcuacacacuggagcagggguccaucauuauagaaugcguggacccccacgauccacaguggaaugagaccgaaccugcgugucgggcugucugcucuggagagaucacagacucggccggcgugguccuuagccccaacuggccagaaccuuauggucgagggcaagauugcauuuggggcgugcauguugaggaggacaaacgcaucaugcuggauauaagaguguugaggauuggacccggcgacguacucacuuucuacgacggggaugaccugaccgcacgggucuuaggacaguacuccggcccacgcucacacuuuaagcuguucacgaguauggccgaugugaccauccaguuucagucugacccggguacaagcguucuaggguaucaacagggauucgugauccacuuuuucgaagucccuagaaaugauacuugucccgagcucccagaaauucccaacggcuggaaauccccuucacagccagagcuggugcaugguaccguagugacauaccagugcuaucccggcuaccaaguugucgggagcucugugcuuaugugucagugggacuugacuugguccgaagaucugccuaguugccagagggugaccagcugucacgacccgggagaugucgagcauucucgucggcucaucuccucaccaaaguuccccguuggcgcuacggugcaauauauuugcgaccagggguuugugcugaugggaaguagcauauuaacaugucacgaucgacaggccggcucgccuaagugguccgacagagcacccaaaugccugcuugagcaguugaagccaugucacggucucucugcuccugaaaacggggccaggagccccgagaaacaacugcauccagcgggagccaccauccacuucucaugcgcuccuggcuacguacuaaagggucaggcaaguauuaaaugugucccgggccaucccucccacuggucugauccaccucccaucugccgcgccgcuagccuggacggguuuuauaauucccggucacucgacguggccaaggcaccagcggccagcaguacucuggaugcugcccauaucgcagcugccauuuuccuuccuuugguugcaauggugcuguuagucggaggcguguacuuuuacuucucuagacuccaggggaaauccagccugcagcuucccaggccgcgcccacgaccuuauaaccggauaacaaucgaaucggccuuugacaaucccaccuacgagacuggagaaacccgugaguaugagguuucaauuuga

SEQ ID NO: 62388 - RNA, 2430 nt, Artificial Sequence
  derived and/or modified sequence opt3 from SEZ6L2__Homo_sapiens__NP_001107572
augggcacccccagagcccagcacccuccaccgccccaacuccucuuccuuauccuguugagcugcccuuggauucagggguuaccacugaaggaggaagagauacuacccgaaccuggauccgagacaccaacuguggcuucugaagcacucgccgagcugcuucauggugcgcuguugaggcggggccccgagaugggguaccucccuggaucagaccgcgauccaacgcuggcuaccccgcccgccggccagacacuggcagucccuagucucccacgagccacugaacccgguaccgggccuuuaacaaccgcuguuacuccaaacggagugcguggcgcaggccccacagccccggagcugcuuaccccucccccagggacgacugcuccucccccacccagcccugccuccccaggaccgcccuuggguccugaaggcggggaggaggaaaccacaacuaccaucauuacaaccacgacuguaacaaccacugugacaucuccagcguaucugcuaucguguggauuucccccuagaccagcacacggcgacgucucagugaccgaucuccaucccggugggacggccaccuuccacugcgacagcggauaccagcugcaaggcgaggaaacacuuaucugucugaauggcacuaggccgaguuggaacggggagaccccuuccugcauggcuucuuguggagguacaauucauaaugccacuuugggccggaucguuagcccagaacccgggggagcagugggcccuaaccugaccugccgcugggucauagaggcugccgaggguagaaggcugcacuuacacuuugaacgggugucccuggaugaggacaaugaucgccucaugguacgaucagggggcaguccccuuagcccaguuaucuaugacucugauauggacgaugugccugaaagaggacugauuuccgacgcgcagucauuguacgucgagcuacugagcgaaacacccgccaacccacuccugcuuagucugagguucgaggcauuugaggaagaucgguguuucgcuccguuuuuggcccauggcaaugugaccacuacggacccugaguaucgucccggggcucucgccacauucucuugccugccaggauacgcauuagaacccccugguccacccaacgccaucgaguguguggacccuaccgaaccgcacuggaaugauacugagccagcuugcaaagcgauguguggcggggagcuguccgaacccgcaggagucguucuaagcccugacuggccacagucguauucucccggccaggauugcgugugggguguacaugugcaagaggaaaagcgcauucuccugcaggucgagauccuuaacgugagagagggggacauguugacccuguuugauggcgacggaccuuccgccaggguucucgcucagcugcggggcccgcagccccgacgcagacuucugucaagugggccagauuugacacuccaauuccaggccccucccggaccaccuaaucccggucugggccagggguuuguguuacacuucaaagaagucccaaggaacgauaccugcccggagcugccucccccagaauggggauggcggacugcaagccacggcgaccuaauacgcgguacagugcucacguaccaaugugagcccggguacgaacugcuuggcuccgacauuuugaccugccagugggaucugucuuggagcgccgcuccuccagccugucagaagaucaugacuugcgcagaccccggagagauugcgaauggccauagaacagcuucagacgccggguuuccuguaggaagucacguucaguauaggugucucccgggcuacucccuggagggugcagccauguuaaccugcuauagccgugauacagggacuccaaaauggucugaccgggugcccaagugugcucugaaguacgaaccuugccuuaaccccggagucccagagaauggcuaucaaaccuuguacaaacaucacuaucaggccggugaaucacuccgauucuucuguuacgagggcuuugaacugaucggggaggugacgauuaccugcgucccuggacaucccagucaguggacaagccagccaccucuauguaagguggcauacgaggaacugcucgauaacagaaaacuggagguuacucaaaccacagacccguccaggcagcuugaaggcgggaacuuggcucuggccaucuuacucccccugggacuugugauaguacugggcucuggugucuauaucuacuauacuaaguugcaggggaaaagccucuucggauuuucgggcucccacucauacaguccaauuaccguggagucugauuucagcaauccucuguaugaagcgggugacacgcgcgaguacgagguuuccaucuga

SEQ ID NO: 62389 - RNA, 3072 nt, Artificial Sequence
  derived and/or modified sequence opt3 from SEZ6L__Homo_sapiens__NP_001171702
augcccgccgcuagaccuccagcagccggccugagggggaucagccucuuccuugcgcuguuguuaggauccccggcugccgcacuggagcgggacgcccuacccgaaggugaugcuucuccucucggcccauaccugcuucccucaggggcaccugagcgcggaaguccaggcaaggaacaccccgaggaacgaguggucaccgccccuccaagcuccucucagucggcugagguucugggugaguuggugcucgacgggacagccccgucagcgcaucacgauauucccgcacugagcccucugcucccagaagaggcccgucccaaacaugcuuuaccuccaaagaaaaagcugcccagucuuaaacaaguaaacuccgccagaaagcaguugaggccgaaggcaacuucugcugccacggugcagcgggcgggaagccagccugccucccaaggccuggaccuacucucaaguagcaccgaaaaacccggcccaccuggggaucccgacccaauagucgcaucugaggaggcuuccgaagugccccuguggcuugaucgcaaggagucagccguuccuacaacuccagcuccgcugcagaucagccccuuuaccagucagccuuauguggcccacacauugccacagagacccgaaccuggagagccaggucccgacauggcacaagaagccccgcaggaggauaccucuccuauggcucucauggacaaaggcgagaaugaacugacuggguccgcgagcgaggaaucgcaggagacaaccacgucuacuauuaucaccacaacugucauuaccacagaacaggcaccagccuuaugcuccgugucauucaguaaccccgagggauacaucgauagcuccgacuauccucugcucccccuuaauaacuuucuggaguguaccuacaauguaacgguuuauacuggcuacgguguggaauugcaagucaagucugugaaccuaagcgauggggagcugcucucaauaaggggaguggacggcccaacacugaccguccuugcuaaucagacucuguugguugaaggccaggugauccggaguccuacaaacaccauuuccguauauuuccgcacguuucaagacgaugggcucggaaccuuccagcugcauuaccaggccuuuauguuaagcugcaauuucccccgaagaccagacucuggugaugugacagucauggaccugcacucaggcgggguggcacacuuucauugucaccuaggauacgagcuccagggcgccaaaaugcugacuugcaucaacgcuaguaagccgcauuggagcucccaagaaccuauuuguucugcccccugcgguggggcaguucacaaugcgaccaucggcagggugcuuucgccaagcuaucccgagaacacaaauggaucccaguucuguauauggacuauugaggcuccugaaggccagaaguugcaucugcacuuugagcggcuccugcuucacgauaaagaccguaugaccguccauucagggcagacaaacaagagugcccuguuguacgauucucuccaaaccgaaagcgugccauucgagggacuguuauccgaggguaauacuauccgcauugaauuuacgucagaccaggcaagagccgcuagcacauucaacaucagguucgaggccuuugaaaaaggccacugcuaugagcccuacauccagaacgggaauuucaccacuucugauccuaccuauaacauuggaacaauaguagaauuuaccugugacccgggccauucccuggagcaggguccagcaaucauugagugcaucaauguucgggaucccuacuggaacgacacugaaccucuaugucgagcuaugugcgggggcgagcucagugccguggcgggagucgugcugagcccaaauuggcccgaaccuuaugucgagggcgaagacugcauauggaagauucacgugggggaggagaaacgcaucuuccuugauauccaauuuuugaaccugucuaauuccgacauucucacaaucuacgauggagacgaaguuaugccgcacauucugggucaguacuuaggcaacucagggccccagaagcuguauaguagcacgccagaucuuaccauacaguuccauucggacccugccggauugaucuuuggcaaaggucaaggguucauuaugaauuacaucgagguguccagaaacgauucuuguagcgaccuccccgaaauccagaauggcuggaagacuacaucacacaccgagcugguaaggggagcucggauuacauaucagugcgauccaggcuacgacauagucgggagugauacucuaaccugucaaugggaccuguccuggucuagcgauccucccuuuugcgaaaagaucauguauuguacggacccaggagagguggaccauuccacccgccucauuucagauccgguucugcuugugggcacaacuauccaguauaccugcaacccugguuucgucuuggaggggagcagucuguuaacauguuacucuagagaaacuggaacccccauuuggacguccaggcucccacacugcgugagcgaggaaucgcuggcaugugacaaucccggccuuccugagaacgguuaccagauccuguacaaacguuuguaucucccaggcgagucacugacauuuaugugcuacgaaggguucgagcuaaugggagaaguaaccauacgguguauccugggccagcccucucacuggaaugggccucucccggugugcaagguuaaccaagauaguuuugagcaugcccuggaagcugaggccgcagcggagacuucccuugaaggaggcaacauggccuuggcuauuuucaucccaguccugauuaucagcuuacuccuggguggggccuauauauacauuacacgaugcagauauuacucuaaucuuaggcugccccuaauguauagccacccuuacucccagaucaccguggagacugaguucgacaaccccauuuacgaaaccggagaaacacgcgaguaugaggugucaaucuga

SEQ ID NO: 62390 - RNA, 2022 nt, Artificial Sequence
  derived and/or modified sequence opt3 from SF1__Homo_sapiens__NP_001171501
auggccaccggcgcuaacgcaacaccccuggggaagcucggaccuccaggucuuccgccccugccuggcccaaaagggggauucgagcccggcccuccacccgccccugguccaggggcgggauuguuagcuccggggcccccuccacccccuccagugggcagcaugggggcccugacugcagccuuucccuucgcugcacuaccgccucccccaccucccccacccccuccaccgccccagcaaccuccacccccuccacccccgccuuccccaggagccucuuacccuccuccccagccaccucccccaccgccucucuaucagagagucucacccccacagcccccuccaccccaaccuccgaggaaggaccagcagccaggucccgcuggcgggggaggcgauuuuccuaguaaaaagcggaaacgcagccgauggaaucaggacacgauggaacaaaagaccguuaucccagguaugcccacagugauuccuccggggcugacucgugagcaggaaagagccuacauaguacagcuucagaucgaggaucugaccaggaaguugcggacaggagaccucggcauucccccaaacccugaagaucgcucccccucuccagagccuaucuauaauucggagggcaaaagacugaacaccagggaguuccggacucgcaagaaacuggaggaagaacgacacaaucucauuacagagaugguggcguuaaaccccgacuuuaagccaccggcagauuacaaaccucccgccaccagagucucagacaaggugaugaucccacaagaugaauaucccgagauaaauuucguugggcugcuuaucggaccuagggguaacacguugaagaauauugaaaaagagugcaacgcuaagaucaugauucggggcaaagggagcgugaaggaaggaaaagucggccguaaggacggucagaugcugccaggggaggaugagccccuacaugcccucgugacugcaaauaccauggaaaacguuaaaaaggcuguagagcagauccgcaauauacugaagcaaggcauugaaacaccugaggaccagaacgaucuuagaaaaaugcagcugagggaauuggcccggcucaauggaacucugcgagaggacgacaaccgcaucuuaagaccguggcagaguuccgagaccaggucuauuacaaacaccacgguguguacuaagugcggcggggcgggacacaucgccagcgauuguaaauuucaacggccaggugacccccaguccgcacaggauaaggcucgcauggacaaagaauaccugucacucauggccgagcuuggcgaagcuccuguccccgccaguguggggagcacaucuggaccagcaaccacuccucuggccuccgcucccagaccagcggcacccgccaauaacccgcccccaccuucauugaugagcacaacccagaguaggcccccauggaugaacucuggcccuuccgagagccgucccuaucaugguaugcacgggggcggaccgggcgggccaggagguggcccucauucguucccccacccacuacccucucugacgggcggacacggcggucauccuaugcaacacaauccgaaugggcccccaccucccuggaugcagccuccacccccuccaaugaaccagggcccccauccgccuggacaccacggcccacccccuauggaucaguaccucggguccaccccagugggaucaggcgucuaccggcugcaucaagguaaggggaugaugcccccgccucccaugggaaugaugccaccucccccacccccuccaaguggccagccgcccccuccacccagcgguccucuuccacccuggcagcagcaacagcagcaaccuccgccacccccucccccauccucuagcauggcuucaaguacaccucugcccuggcagcagcgauccuugccagccgcagccauggcuagagccaugaggguucgcacuuuucgggcacacugguga

SEQ ID NO: 62391 - RNA, 2382 nt, Artificial Sequence
  derived and/or modified sequence opt3 from SF3A1__Homo_sapiens__NP_005868
augcccgccggcccugugcaggcugucccaccgcccccuccaguucccaccgagccuaagcaaccaacagaagaggaagcaagcuccaaagaggacucugcccccucaaagccugugguagggaucauuuacccaccgcccgaagugagaaacauagucgauaaaacugcgaguuucguggcuaggaauggaccugaguuugaggcccggauccgccagaacgaaauuaauaacccaaaguucaauuuucugaaccccaaugacccuuaucacgcauacuaucgacauaaaguuagcgaguucaaggaagguaaggcccaggagccauccgcugcaauccccaaagugaugcagcaacagcagcagacgacccaacagcagcucccgcagaagguccaagcccaggugauucaggagacaaucguaccuaaagaacccccaccugaguuugaguucauagcugaucccccaucuaucucggccuuugaccuugauguugugaagcugacugcgcaauucgucgcacguaacggcagacaguuuuugacccaguuaaugcagaaagaacaaaggaauuaccaguucgacuuucugcggccccagcacucacuauucaacuauuuuacaaagcucguggaacaguacaccaagauucugaucccuccaaaagggcuuuucagcaagcugaaaaaggaggccgagaauccgcgcgaaguguuggaucaagucugcuauagaguugagugggcuaaauuccaggaaagggagcggaagaaagaagaggaggaaaaggagaaggaacgcguggccuacgcacagauugacuggcaugauuuuguaguggucgagacuguggacuuccagcccaacgaacaaggaaauuuuccuccacccacaaccccugaggagcucggcgcucgaauccugauacaggaaagauacgagaaauucggugaaagugaggagguugaaauggagguggaauccgaugaggaagacgauaagcaggagaaagccgaggaaccacccucucagcuggaccaagacacgcagguccaggauauggacgaggggagcgaugacgaagaggaaggacaaaaggugccgccuccacccgagacuccuaugcccccaccuuuacccccaaccccggaucagguaauuguuaggaaagacuaugauccuaaggcguccaagccccucccacccgccccugcaccagacgaguaccuggugucacccaucacaggcgagaaaauuccugcuaguaagaugcaggaacacaugcggaucggccuuuuggauccgcguuggcuggaacagcgcgacagaagcaucagggagaaacaaucugaugacgaagucuaugccccagggcuagacauugaguccucacucaagcagcuggcugagcggcgaacugauauauuuggaguggaagagaccgccaucgguaaaaagauuggcgaagaggagauccagaagcccgaagagaaagucacaugggacgggcauagcggaaguauggcacgcacccagcaagccgcucaggcgaacauaacgcuucaggaacagauugaggcaauccacaaggccaaaggccuggugccugaagaugacacuaaggagaaaaucgguccaucuaagcccaaugagauuccucaacagccgcccccaccuuccagcgcuacaaacauccccucgucugccccaccuauuaccuccguucccagaccaccgacuaugccucccccagugaggacaaccguagucucagcagugcccguuaugccucggccacccauggccagugugguccgcuugccuccggggagcgugauagcuccaaugcccccuaucauucacgcccccagaaucaacguagugccaaugccucccuccgcaccaccuaucauggcgccgaggcccccaccuaugauuguucccacggcuuucgucccagccccucccguggcaccggugccagccccugcucccaugccacccguccauccuccgcccccaauggaagaugagccuaccucuaagaaacucaagacagaagacagccugaugcccgaggaagaguuuuuacgucggaauaaaggaccuguuucaauaaagguacaggugccaaacaugcaagauaaaacugaguggaagcugaauggccaggugcucgucuucacccuuccccugacagaccaggugaguguuaucaaagugaagauucacgaagccacuggcaugccugcagggaagcagaaauugcaauacgagggaaucuuuauuaaggauuccaacagccuagcuuauuacaauauggccaacggugcggucauccaucuggcccucaaagaacgaggcgggagaaagaaauga

SEQ ID NO: 62392 - RNA, 435 nt, Artificial Sequence
  derived and/or modified sequence opt3 from SF3B1__Homo_sapiens__NP_001005526
auggccaagaucgcuaaaacccacgaggacauugaagcacagauaagagagauccaaggcaagaaagccgcgcuggaugaagcucagggggugggacucgacagcacagguuacuaugaucaggagauuuacggcggguccgacucuagguucgccggauaugucacuucaaucgcagccacggaacuugaggaugacgaugacgauuacaguagcuccaccucucuguugggccagaagaaacccgguuaucaugcuccuguugcauuacugaacgacauuccacaaucgacagagcaguacgauccguuugccgaacaccggcccccuaagaucgcugaccgcgaggaugaauauaagaaacaucgacguacuaugauaaucucaccagagagacuagaccccuucgccgacggguuuuacagcgcggcauga

SEQ ID NO: 62393 - RNA, 2688 nt, Artificial Sequence
  derived and/or modified sequence opt3 from SF3B2__Homo_sapiens__NP_006833
auggccaccgagcaccccgaaccuccaaaggcugagcugcagcucccgcccccuccacccccuggccauuacggggcaugggccgcgcaagaacuucaggcuaaacuggccgagaucggagcaccaauucaggguaacagagaagaguugguggagagguuacagagcuauacacggcaaacuggcauaguccugaaucgccccguucuacgaggggaagacggagauaaggccgcuccuccaccgauguccgcacagcuccccggcaucccuaugccacccccuccacugggucuucccccgcugcagccucccccaccucccccacccccuccaccgggguugggacucggcuuccccauggcccacccuccaaaccuggggcccccuccaccccugcgugugggcgagccgguagcucucucugaagaggagagauuaaaacuggcccagcaacaggcggcacuuuugaugcagcaggaagagagggccaagcaacagggagaccauucacugaaagaacacgagcuacucgaacagcaaaagcgggcugccgugcugcuugagcaggagcgccagcaggaaauugcaaagauggguacgccugucccaagacccccucaagauaugggccagaucggggugaggacaccccugggaccacggguugcugccccugugggccccgucgguccaaccccgacuguguugccuaugggggcgcccguaccacgcccccgaggaccuccacccccuccgggcgacgagaauagagaaauggaugacccaaguguuggccccaaaauuccucaggcccucgagaagauccugcaguuaaaagaaagcaggcaagaggagaugaacucccagcaggaagaggaagagauggaaaccgaugcacggucuucgcuggggcagucagcuagcgagacagaggaagacaccgugagugucuccaagaaagagaagaaucguaagcgcagaaacaggaaaaagaaaaagaaaccacaacgggugcgaggagugucuagcgaauccucaggugaucgcgagaaggacaguacuagaagcaggggcucugauucccccgccgcugacgucgagauagaauacguuacagaggaaccugagaucuaugaaccgaauuuuauuuucuuuaaacggaucuucgaggccuuuaagcucaccgaugacgugaagaaagagaaggaaaaagagcccgaaaaacuugacaaacuggagaacucagcagccccaaagaagaaaggguucgaagaggagcauaaggauagcgacgaugacaguucugaugacgaacaggagaaaaagccugaagcucccaaauuguccaagaagaaacuacgcagaaugaauagguuuacgguagcggagcugaagcagcucguggcacguccagaugucguggaaaugcacgacguuacugcccaggauccuaaacugcuugugcaccugaaggcuacccggaacagcguccccgugccacgacauuggugcuucaaaagaaaguacuugcaaggaaagaggggcauugagaaaccgccuuuugagcuccccgacuucaucaagcgcacagguauacaggaaaugcgggaggcccugcaggaaaaagaggagcaaaagacuaugaaaucgaagaugagagaaaaaguaaggccaaagauggggaagauugauaucgacuaucagaaauuacacgacgcauuuuucaaguggcagaccaaacccaagcugacaauucauggcgaucuauacuaugagggaaaagaauuugagacccgccucaaggaaaagaaaccuggcgaccugucugaugagcuucgaaucuccuuggggaugccaguuggacccaaugcccacaaggugccuccgccauggcugaucgcuaugcagcgguacggucccccucccucauacccaaaccucaaaauuccuggccugaauagucccauaccagagagcuguuccuucggguaucacgccggaggcugggguaagccuccggucgacgaaacggggaaaccccuuuacggcgauguguucggaacuaacgcagcggaguuucaaacaaagaccgaagaggaagagaucgaccguacuccauggggcgagcuggaaccuucugaugaggaaagcucagaggaagaggaggaagaggaaagugacgaggauaagcccgacgagacaggguucauuaccccagcugauuccggauugaucacgccugguggcuuuagcucuguccccgccgggauggaaaccccggagcucauagaacugagaaagaagaaaauugaggaagcaauggacggaucagagacaccacaguuauucacugugcugccugagaagaggaccgccacaguuggcggugcuaugauggggaguacucauaucuaugauaugagcaccgugaugucccgcaaaggccccgccccagaacuacagggaguagaggucgcacucgcucccgaagaacuggaacuugacccuauggccaugacacagaaguacgaggagcacgugcgggaacaacaggcgcagguugagaaggaagacuuuucugauaugguggccgagcaugcugcaaaacagaagcagaaaaagagaaaagcccaaccgcaggacucgaggggcgggagcaagaaauauaaggaguucaaguuuuga

SEQ ID NO: 62394 - RNA, 378 nt, Artificial Sequence
  derived and/or modified sequence opt3 from SF3B6__Homo_sapiens__NP_057131
auggccaugcaggcugcaaagagagccaacaucaggcugcccccugaggugaaucggauucucuacauacgcaaccuuccauauaaaaucaccgcggaagagauguacgacauuuucggcaaguaugggccgauccgacaaauucgugucggaaauacacccgaaacuagagguacggcuuacguuguguaugaggauaucuuugacgccaaaaacgcaugcgaucaccugagcggcuucaauguauguaacagguacuugguggucuuauauuacaaugccaaccgggcuuuucagaagauggacaccaaaaagaaggaggaacagcugaaacuacucaaggagaaauacgggauaaauacagauccuccaaaguga

SEQ ID NO: 62395 - RNA, 3729 nt, Artificial Sequence
  derived and/or modified sequence opt3 from SFI1__Homo_sapiens__NP_001007468
augaagaaccugcucaccgagaaaugcaucagcucccacaauuuccaucagaaggugauuaaacaaagaauggaaaagaaagucgacucuagguacuuuaaggauggcgccguuaagaaacccuauucagcuaagacacuuaguaacaaaaagagcuccgcaucuuucgggauacggcgcgagcugccuucgacuucacacuuggugcaguaccgaggaacgcauaccuguacacgucaggguagauuaagggaacugcggauccgcugcguagccagaaaauuucuauaucucuggauuaggaugacuuucggccggguguuuccaagcaaggcgcgcuucuacuaugagcagcgacugcuuagaaaggucuuugaagaguggaaagaggaaugguggguguuccaacacgaguggaagcuguguguuagggcugacugccauuaccgguauuacuuguacaaucucauguuucagaccuggaaaacauaugugcgucagcagcaagaaaugcgcaacaaguacaucagagccgagguccacgaugcaaaacagaagaugaggcaggccuggaaaaguuggcugauuuaugugguaguucggcgaaccaagcugcagaugcaaacuacagcucucgaguuccgccagagaaucauauuaaggguguggugguccaccuggcggcagcgccuggggcaagucagagugucuagggcacuucacgccagcgcuuugaagcaucgugcccugucccuacaggugcaggcguggucacaguggcgggaacaacuccuguacguccagaaagagaagcagaaaguugugagugcaguaaagcaccaucagcacuggcaaaaacgaagauuucuuaaggccuggcuggaauauuuacaggugaggcgcgucaagcggcagcagaaugagauggcugaaagauuccaccaugugacgguucuccaaaucuacuuuugugacuggcagcaggccugggagaggcgcgagagccuguaugcacaccaugcucagguggaaaaauuagcccgaaagauggcgcugcggcgugccuucacucacuggaaacauuacaugcuccuuugcgcagaggaagcugcccaauucgagauggcugaagaacaccacagacauucucagcuguacuuuuguuucagggccuugaaggauaacgucacccacgcacaucuacagcaaauucgccggaaucuggcccaccagcagcacggagugacacuccugcauagauuuuggaaccuuuggaggucccagaucgagcagaaaaaggaacgagagcuguugccgcuccugcacgcugcgugggaccauuaucgcauugcauuacugugcaaguguaucgaacuauggcuccaauacacucagaaacggagauauaagcagcugcuucaagccagggcugauggccacuuccagcagcgugccuugcccgcagccuuucauaccuggaaucgccuguggcgguggagacaccaggagaacguacucucagcuagggccacacgauuccaccgggaaacccuggagaaacaaguuuuuagccuuuggcgccagaagauguuccagcauagagagaauaggcuggcagaacggauggcgauauugcacgcugagcgacaacuccuguacagaaguugguuuauguggcaucagcaggccgcagcccgccaccaggaacaagaguggcagacgguggcuugcgcccaucacaggcacggucguuugaaaaaggcauucugucuguggcgggagucugcucaggggcuaagaacugaaaggacaggacgcguccgagccgcggaguuucauauggcccagcuccugagaugggcuuggucccaauggcgggaaugccuugcauugaggggcgccgagcgccagaagcugaugcgugcugaccuccaccaucagcacagcgugcugcacagagccuuacaggcaugggucaccuaucaaggccgggugaggucgauucugcgcgaaguugcggcccgagagucucagcauaacagacagcuuuugcggggagcucucaggcgcuggaaagagaauacuauggccagaguggaugaagcaaagaaaacauuccaggcuuccacccacuacaggcggacgaucugcucaaagguacugguccaauggcgugaggccgugaguguucagauguauuaccgccagcaagaagacugugcaauuugggaggcccagaaagugcuagaucgagggugccugagaaccugguuucagagguggugggacuguagccggcgcuccgcucagcaaagacuccagcuggaaagggcgguccagcaucaccaucggcagcuuuugcuggaggguuuagcccgauggaagacacaccaccuccaaugcgugagaaaacgccugcuucauaggcagucuacucagcuguuggcacagcggcucagccguaccuguuucagacaauggaggcagcagcuggcugcccgccggcaagagcagcgagccacaguaagagcucuaugguucugggcauuuucacugcaggccaaggugugggcgacuuggcucgcuuucguucuggaaaggcgccggaagaaagccagacuucagugggcauugcaagccuaccagggccagcuguuacaggagggggcuacccgucuccugagguuugcagccaguaugaaggcgucccggcaacagcuucaggcucagcaacagguccaggccgcacacagccugcaucgcgccgugcgaagaugcgcuacacuauggaaacagaaggugcucggaaggggcgguaaaccucaaccacuggccgcaaucgcucccucucggaaggucaccuucgaagggccuuugcugaaccgcaucgccgcgggagccggcgauggcacuuuagagacgaagagaccacaggcaucaaggccccucggggcucugggacgacuugccgcugaggagccucacgcacuggaguugaauacagcccacagugcccggaaacagccacguagaccgcauuuucuccuggaacccgcucaaagccagcgcccucagaagccacaggagcacggucuaggcauggcgcaacccgcagccccuucccugaccaggccauuccuugcugaagcccccacugcacucguuccgcauucuccucugcccggggccuugucgagcgcuccaggaccuaaacagcccccaaccgcguccacaggccccgagcuguuacuccugccucuuucaaguuuuaugccauguggugccgcagcuccggcccgggugucugcacagagagccacuccccgcgacaagccuccagugcccagcucccuggcuucaguaccugacccacacuugcuccugcccggggauuucagcgccaccagggcgggcccgggacuaucuacagcaggcucccuggaccuugaggccgaacucgaggaaauucagcaacagcuguugcauuaucagacgaccaaacagaacuuauggaguugccgacggcaagcuagcucucugagaagguggcucgagcugaaccgcgaggaaccugggccagaggaucaggaagucgagcagcaagugcagaaggaacuugagcagguugaaaugcagauacaacuguuggccgaggagcuacaggcucagcgucagcccaucggagcauguguggcccggauucaagcucugagacaggcccucugcuga

SEQ ID NO: 62396 - RNA, 2601 nt, Artificial Sequence
  derived and/or modified sequence opt3 from SFMBT1__Homo_sapiens__NP_057413
augaacggcgagcagcaacuggacgccgaugcugggagcggaauggaagagguggaacucuccugggaggacuaccuugaagagaccgguucuacagcaguccccuauggcucauucaagcacguugauacuagacugcagaauggguuugccccuggaaugaaauuggagguggcgguaaggacggacccagaaaccuacuggguggcuacagucaucacuaccugcgagcaguuacugcuacuccgguaugauggcuacggugaagaccgccgagccgauuucuggugugacauucguaaggcagaucuguauccgauaggguggugcgagcagaacaaaaagacacuugaggcccccgaaggaaucagagacaaagugagugauugggacgaguuucugaggcaaaccuugauuggcgcuuguagcccuccaguuccccuccuggaaggccugcggaaugggcgcaacccucucgauuuaaucgcaccaggauccagacuggagugccaggccuuccaggacucucuuucgacuuggauugugacagucguggaaaauaucgguggcagguugaagcugcgguacgaggggcuagagucaagcgacaacuaugaacauuggcucuacuaccuggaucccuuucuucaccauguaggaugggcugcccagcaaggcuaugagcugcagccuccaagugcgauacgccacuugaagaaugaagcagaguggcaggaaauccucgccaaaguuaaggaggaggaagaggaaccgcugcccuccuacuuauucaaagacaaacaggugauugguauccauaccuuuucugucaacaugaagcuggaggcuguggauccuuggagcccauucgggauuucccccgccacgguggucaagguuuuugacgaaaaguauuuccucguggagauggaugaccuucgaccugagaaucacgcaagaaggucauuuguaugucacgcugauaguccaggaaucuuccccgugcaauggagccugaaaaacggcuugcauauaucuccgccucccggcuacccaucccaggacuuugauugggccgacuaucuaaagcagugcggggcggaagccgcaccucaacgguguuuucccccacugauuucagagcacgaguucaaagaaaauaugaagcucgaggcugucaaccccauccugccugaagaggugugcguugccacuauuaccgcugugcguggaagcuaccuuuggcugcaguuggaagguaguaaaaagccaaucccggaguguaucgucucuguggaauccauggauauuuucccccucggcuggugcgagacaaaugggcauccucugagcacuccacgcagagccaggguauauaaacagcggaagauagcaguugugcagcccgagaagcaagucccuucgucucgaaccgugcacgaaggauuacgcaaccaggagcuuaauuccacagaaucagucaugaucaacggcaaauacuguugcccaaagauuuacuucaaccacagaugcuuuaguggucccuaucuaaauaaagggaggaucgccgagcucccgcagugugugggcccuggaaacugcguucuggugcuucgggaaguauugacccugcucauaaaugcugcguacaagccaagccgcguccugagagagcuucagcuggacaaagacuccguguggcauggcuguggggagguuuugaaggcaaaguauaaaggaaagucuuacagggccacgguggaaauugucaaaacugcugaucgugugacagaguucugccggcaaaccuguaucaagcucgaaugcugucccaaccuguuugguccucgaaugguauuagacaaaugcagcgagaauuguucagugcugacuaagacaaaguauacccacuacuauggcaaaaagaaaaacaagagaaucgggaggcccccaggaggccauaguaaucuagccugcgcacucaaaaaggccuccaagcgccggaaaagaaggaagaacguuuucguccacaaaaagaaacgcagcucugcuucaguggauaauacgccugccgguaguccccaggggagcggcggagaagacgaggaugacccagaugagggcgacgaugacucccugucugaagggucgaccagcgagcagcaggaugaacuucaagaggaguccgaaaugucagagaagaaaaguuguucuagcuccccgacacagucagaaauuagcacuucuuugccucccgaccgacagcggcguaagagagagcugaggaccuuuuccuucagugaugacgaaaacaagccacccagcccuaaagagauccgcauugagguggcagaacggcuccaucuggacucuaauccauuaaagugguccgucgcggauguugugagauuuauaaggucaacagacugcgcuccccuggcccgaaucuuccuugaucaggagauugacggacaagcauugcuccugcuaacucugccuaccgugcaggaaugcauggaucucaaacuggguccggccaucaagcugugucaccacaucgagcgcauuaaauuugcuuucuacgaacaguuugccaacuga

SEQ ID NO: 62397 - RNA, 2685 nt, Artificial Sequence
  derived and/or modified sequence opt3 from SFMBT2__Homo_sapiens__NP_001018049
auggagagcacccuguccgccucuaacaugcaggaccccucaaguagcccucucgaaaagugccuuggcuccgcuaaugggaacggagaucuggacucugaggaagguucgucauuggaggaaacaggcuucaauuggggagaguacuuagaggaaacuggggcaagcgccgcgccacacacgaguuuuaaacauguggagaucuccauucaaucuaacuuccagccgggcaugaagcuggaagucgcuaauaaaaacaaucccgauaccuauuggguugccacaauaaucacuaccuguggucagcuacuccugcuuagauacugcggguauggagaggacaggcgggcagauuuuuggugugacgugguaauugccgaucugcacccugugggcuggugcacacagaacaauaaggucuugaugccacccgacgcuaucaaagagaaguacaccgauuggacugaguuccucauucgcgaccugacaggcagccgaaccgccccugcaaaccugcucgaagggccauuacguggaaagggucccaucgaucugauaacggugggcucccuuaucgaauugcaagacucacagaauccuuuucaguauuggauuguuagugugaucgagaacgucgggggaagacugaggcuacgguacgugggccucgaagauacugagagcuaugaccaguggcuguucuaccuugacuaccgccugagaccaguagguuggugucaagagaauaaauauaggauggauccgcccucugaaauuuacccuuugaagauggcuuccgaguggaaaugcacccucgaaaagucacugaucgacgccgcgaaauuuccauuacccauggagguuuucaaggaucaugcagaccugcggagccacuuuuucacaguggggaugaagcucgaaacugucaacaugugugagccuuuuuauauaaguccagccucugugaccaaaguguucaauaaccacuuuuuccaggucacaauugaugaccuucgccccgagccguccaagcugagcauguugugccaugcugauucgcuaggaauccugccuguucaguggugucucaaaaacggcgugucucugacgcccccaaagggcuacuccgggcaggacuucgauugggccgacuaucacaaacaacauggagcacaggaagcuccucccuuuugcuuccgaaauaccucauuuaguagagguuucacuaagaacaugaaacuugaggccguaaauccaaggaaccccggcgaacuguguguggcgagcgucguguccguuaaggggcgguugauguggcuccaccuggagggauuacagacaccugugccagaagucauuguggauguagagucuauggacaucuuuccgguuggcuggugcgaggccaauagcuacccccugaccgcaccucauaagacugugucacagaaaaagcguaaaaucgcugucgugcaaccagaaaagcagcuacccccuacagucccagugaaaaagauuccccacgaccucugccuguucccgcaccuugauaccacggguaccguuaacgggaaguauuguugcccucaguuguuuauaaaucaucgcuguuucaguggcccauaccugaacaaaggaagaaucgccgagcucccccaauccgugggcccugggaagugcguacugguccuuaaagaagugcugagcaugauuaucaaugcugccuacaagcccggaaggguuuugcgggagcuccagcugguggaggacccacacuggaacuuucaggaagagacauuaaaagcaaaguaucgagguaagacuuaccgcgccgucgugaaaauaguaagaaccucugaucagguggcuaauuucuguaggcggguuugcgcgaagcuggaauguugcccuaaccuauuuucacccguccucauuagugagaauuguccagaaaacugcagcauccauacaaaaacuaaguauaccuacuauuacggcaaacgcaagaagaucuccaaaccgccuauuggggagucuaaucccgacucgggacacccaaagcccgcaagaaggcguaaacggcgaaagagcaucuucgugcagaaaaagagaagguccucagccguggauuuuacagcuggcaguggugaggaaucugaggaagaggacgccgaugcaauggacgaugacaccgccagcgaagagacuggguccgagcugcgcgaugaccaaacggauacaucaagcgcugaagucccuucugcccggccaagaagggcaguuacccuucgcuccggcagugagcccgugcgacggccuccgccagaacguacuagaaggggacgcggcgcgcccgcugccagcucugcagaggaaggggagaaauguccuccaaccaagcccgagggaacagaagacaccaagcaggaggaagaggagcgguuggugcuggaauccaacccucucgaguggacuguaacagacgucgugagauucauuaaacugacggauugcgccccguuagcuaagauauuccaggaacaagacaucgauggucaggcccugcuuuugcucacccugcccacuguucaggagugcauggaacuaaaacugggcccagcaauuaagcucugucaucagaucgagagggugaaagucgcuuuuuaugcccaauacgcgaacuga

SEQ ID NO: 62398 - RNA, 738 nt, Artificial Sequence
  derived and/or modified sequence opt3 from SFR1__Homo_sapiens__NP_001002759
auggccgagggcgaaaagaaccaggacuucaccuuuaaaauggagagccccuccgauucugcugugguccugccuucaacaccacaagcaagugccaauccgagcucccccuacacuaacucuucgagaaagcagccuaugucagcgacgcucagggaacggcuucgcaaaacccgauucagcuuuaauaguuccuauaacguugugaagcgucugaaaguagagucugaagagaaugaccagacauucagcgagaagccagcuuccucaacugaagagaacugcuuggaauuucaggagaguuucaagcacaucgauagcgaguuugaagagaauaccaaccuuaaaaauacacugaagaaccuaaaugugugugaaucucaaucccucgacucagggagcugcagugcccugcagaacgaguucgucucugaaaaacuucccaagcagagacugaaugcagagaaagccaaguuggugaagcagguucaagagaaagaagaucuccugaggcggcugaagcucgugaaaauguaccgcuccaagaacgacuuaagccagcugcagcuuuugauuaaaaaguggagaucguguucucagcugcuacucuaugagcugcaauccgcugucucagaagagaauaaaaaguuaagucugacccaguugauagaucauuacggacucgacgauaagcuguuacacuauaacaggagcgaagaggaguuuaucgacguguga

SEQ ID NO: 62399 - RNA, 945 nt, Artificial Sequence
  derived and/or modified sequence opt3 from SFRP1__Homo_sapiens__NP_003003
augggcaucgggagaagcgagggagguaggcggggcgccgcucugggggugcuccuugcacugggagccgcguuguuagcugucggcuccgccucugaauacgacuauguuucauuccagagugauauuggucccuaccaaagcgggcgcuuuuauaccaagccuccacagugcguggacauaccggcagaucugcgacuaugucacaacguaggauacaaaaagauggugcuccccaaucugcuugagcaugaaacaauggccgaggucaaacagcaggcuuccucuugggugccucuguugaacaagaauugccacgcaggcacucaaguuuuccucuguucgcuguuugccccagugugccuggaccgucccaucuauccuuguagauggcucugcgaagcugucagggauucaugugagccagugaugcaguucuuuggcuucuacuggcccgagauguuaaaaugcgacaaguuuccugaaggggauguauguauugccaugacgccaccgaacgcgaccgaggcaagcaagccccagggaacaacuguuugcccuccaugugacaaugaacugaaaagugaggccaucauugagcaucuuugcgcuuccgaguucgccuugcggaugaagaucaaagaagugaagaaagaaaacggugauaagaagauaguccccaaaaagaaaaagccucugaaacuaggcccaaucaagaaaaaggaccucaagaaacuggugcuuuaucugaagaauggggcagauugccccugucaccaguuggacaaccucucucaucacuuucugauuaugggacgcaaagucaagagccaauacuuacugaccgcuauccacaaaugggauaagaagaauaaagaguucaagaacuuuaugaaaaagaugaaaaaucaugaaugcccgacauuccaguccguguuuaaguga

SEQ ID NO: 62400 - RNA, 888 nt, Artificial Sequence
  derived and/or modified sequence opt3 from SFRP2__Homo_sapiens__NP_003004
augcugcagggccccgggagccuccuucuguuguucuuagccucccacugcugucugggaucugcuagaggucuauuucucuucggccaaccugacuuuucauacaagaggaguaacugcaaaccaaucccggcaaaucugcagcuuugucaugggauugaguaucagaacaugcggcugcccaauuugcucggacacgaaaccaugaaggaggugcuggaacaggccggcgcguggauaccucuggucaugaaacaaugccauccagauacaaagaaauuccucuguagcuuauuugcucccguuugccuggacgaucuugacgagacuauccagccuugucacuccuugugcgugcagguaaaggaucgcugugccccagugaugucugcauucgguuuucccuggccugacaugcuggaaugcgaucgauucccacaggacaacgaucuauguauuccgcucgccucgucagaccaucugcuucccgcuacggaggaggcaccuaaggucugcgaagccugcaaaaauaagaacgaugacgauaaugacaucauggagacccuguguaaaaacgacuuugcuuugaagauuaaagugaaggaaaucacauacauaaaucgugauacuaagaucauucucgagaccaaaagcaagacaaucuauaaacugaacgggguuagugagagagacuuaaagaaauccgugcuguggcucaaggauucucuucaaugcaccugugaagagaugaaugacauuaacgccccauaccuggucaugggacagaaacagggcggcgaauuggugaucacuagcguaaagagguggcagaaggggcaacgggaguucaaacgcauauccagaucaauuaggaagcuacagugcuga

SEQ ID NO: 62401 - RNA, 1041 nt, Artificial Sequence
  derived and/or modified sequence opt3 from SFRP4__Homo_sapiens__NP_003005
auguuccugagcauccucguggcccuuugccugugguugcacuuagcucugggcgucagaggggcacccugugaggccguuaggauuccuaugugccggcauaugccauggaacauaacccgcaugccgaaucaccuacaucacuccacacaggaaaacgcgauccucgcuauugagcaauacgaagaacugguggacguaaauuguucugccgugcuucgauuuuuccugugcgcaauguaugcccccaucuguacuuuggaauuucuccaugauccuauuaagccaugcaaaucagucugucagcgugcuagagacgauugcgagccccugaugaagauguacaaccacaguuggccugagagccuggcaugugacgaacucccaguguaugauaggggaguuugcaucucccccgaggccauagugacggacuuaccugaagaugucaaauggaucgacauuaccccagauaugauggugcaggagcggccgcuggacguagauuguaagcgccuuucucccgacagaugcaaaugcaagaagguuaaaccuacauuggcuacuuaccugucgaagaauuauucauacgugauccacgccaaaauuaaggcgguccagaggagcgguuguaacgaggugaccacaguggucgauguuaaagaaaucuucaagaguuccucuccaauaccccggacccaagugccucuaauuacuaauagcuccugccaguguccacauauccucccccaccaggacguacugauuaugugcuaugaguggcgcucacgaaugaugcuucuggaaaacuguuugguggagaaguggagagaccagcucaguaaaaggagcauccaaugggaggagcggcugcaggagcagcgucgcacaguccaggauaagaaaaagaccgcaggcagaacgucuagguccaauccgccuaaacccaaggggaaaccuccagcccccaagccagcuucacccaagaaaaacaucaagacucggagcgcccaaaaacgaaccaauccuaagcgcguguga

SEQ ID NO: 62402 - RNA, 954 nt, Artificial Sequence
  derived and/or modified sequence opt3 from SFRP5__Homo_sapiens__NP_003006
augagagccgcugcagccggcgggggagugaggaccgcggcucuggcccuccuucugggugcauugcacugggcccccgcucggugcgaggaauacgacuauuacggcuggcaggcagagccuuuacaugggcgcagcuauuccaagccaccgcaaugucuggauauccccgccgaccuaccucucugccacacagucggauacaaacgaaugcgucugccaaaccuucuggaacaugagucuuuggcugaaguuaagcagcaggccucaaguuggcucccccugcuggcgaaaagaugucacagcgauacucagguguuccucugcuccuuauuugcaccuguaugucuggacaggccaauuuaucccugccggucucuuugugaggccgugcgcgcuggcugcgccccuuugauggaggcauacgguuucccauggccggaaaugcugcauugucacaaguuuccccuagauaaugaccucugcauagcuguccaauucgggcaucugccugccacggcgccacccgugaccaaaaucugugcccagugcgagauggaacacucggcagauggacuuauggagcagaugugcucaagcgacuuuguugugaagaugagaauuaaggagaucaaaauugaaaacggcgauaggaagcugaucggcgcucagaaaaagaaaaaguugcucaagccugggccacugaaacggaaggacacaaaacgcuuaguccugcacaugaagaauggagccgguugucccugcccgcaacucgauagucuugcuggcuccuuccuggugauggggcgaaaaguagacggacaguugcuacugauggccguuuauagaugggauaagaaaaacaaggagaugaaguuugcagugaaauucauguuuucuuacccuuguagccucuacuaucccuucuuuuacggcgccgcugaaccacauuga

SEQ ID NO: 62403 - RNA, 3012 nt, Artificial Sequence
  derived and/or modified sequence opt3 from SFSWAP__Homo_sapiens__NP_001248340
auguacggcgccagcggggguagagcuaagcccgagaggaaauccggugcaaaggaagaggccggcccugggggagcgggcggugggggaucucggguggaacugcucgucuucggcuaugcuugcaaacuuuuucgcgacgaugagcgagcccuggcacaggaacaaggccagcacuugaucccauggaugggggaccauaagauuuuaauagaucguuacgacggaagaggucaucugcacgaucuaucagaguaugacgccgaguacaguaccuggaacagggauuaucagcucagcgaagaggaagcucggaucgaggcacugugugacgaggaacgcuaccuugcccugcacacagauuugcucgaggaagaggcuagacaggaagaggaguauaaaaggcuguccgaagcccuggcggaggacggcucuuacaaugcaguuggguucacuuacggaucggauuauuacgacccgucagaacccacggaggaagaggagccuagcaagcaacgggaaaagaacgaggccgaaaaucucgaggaaaacgaggagccauuuguggcucccuuaggccugaguguaccuuccgauguggaacuuccacccaccgccaaaaugcaugcaauuaucgagcgcacagcuucuuucgucugccgacagggugcccaguuugaaauuauguugaaggcgaaacaggccagaaauagccaauucgacuuucugagguucgaccacuaucuaaacccuuacuauaaguuuauccagaaagcaaugaaggaggggcgguacacugugcucgcugagaauaaguccgaugagaaaaagaaaucaggaguuaguagcgacaacgaggaugacgaugacgaagaggauggcaauuaucugcacccaucucuuuucgccuccaagaaauguaaccgucuggaagaguugaugaagccgcucaaaguggucgaccccgaucauccucuggcugccuuagugcgcaaggcacaggccgacucaagcaccccaacaccccacaaugcugauggcgcgccuguacagccaagucaaguugaguacaccgcagacucuacuguggccgcuauguacuauuccuacuauaugcugcccgacgggacauacugccucgccccgccucccccaggaauagaugucaccacguauuacagcacucuuccugcaggagugaccgugucgaacucucccggcgucacaacuaccgccccacccccuccagggacaaccccgcugcccccuccaacgacugcugaaacauccucaggagccaccaguacuacaaccacgaccagcgcauuggcgcccguugcugccaucauuccuccacccccggacgugcagccuguaaucgauaagcuagcagaguauguggccagaaauggccugaaauuugaaacauccgucagggcuaagaacgaccagcgguucgaguuucuccaaccauggcaucaguacaaugccuacuaugaguucaaaaagcaguucuuucugcagaaagaagguggggauucuaugcaagcagugagcgcucccgaggaagccccuacugacucagcgcccgagaagccaagugaugccggcgaagacggagcuccugaggaugcagccgaaguuggcgcucgagccggguccggagguaagaaagaggcaucuagcucaaagaccgugcccgacggcaaacuugucaaggcgaguuucgccccaauuagcuuugcuaucaaagccaaggagaacgaucuguugccgcucgaaaagaaccgcgugaaacuggacgaugacuccgacgaugacgaggaaucuaaggaggggcaggagucgagcuccucagcagcuaauacaaacccugccguagcacccccauguguuguggucgaagagaaaaagccccaguuaacucaggaagaacuggaagccaaacaagcuaagcagaagcuagaggauagacucgcggccgcagcuagggagaaacuggcccaggccaguaaggaaucuaaagagaagcagcuucaagcugaacggaaacgcaaggcagccuuguuccugcagacccucaaaaauccucugccagaggcggaagcuggaaagauagaggagagccccuuuuccguggaagagucaagcacaaccccuugcccgcuucugacuggcgguagaccauugcccacgcucgaagucaagccuccagacaggcccucuuccaaaaguaaggauccuccgcgugaggaagagaaagagaagaaaaagaagaaacacaagaaacggagccgaacaagaucuaggucccccaaguaccacucaaguagcaaaucgcgcucccggucucauagcaaggccaagcacucacugccaagugcauauagaaccgugaggcgcucccgaguuacugccucuccugggaccuuacgggcugaacccugucagagcuccgcaucagugacagccgcggcugagccaggcagcuaccaggccgcaaguaccacuacacguuucgacucugccuccagcuuugaaggaaaaccuggcaagacgucgagaucaaggucucgcaguccccggagaagggcucauuccccagagcgacgccgggaggaaagaagcguaccgaccgccuauagggucucucguagcccuggggcaucccgcaaacggacuagaucaaggaguccccacgagaagaaaaagaagcgacggagccgcucuagaacaaaauccaaggcuaggucacaaagugugagcccauccaaacaggccgcgccccggccugccgcaccagcugcccauucugcucacucggcaagcguuucacccguggaaucccgaggaaguucucaggagagaagccgcggugucucccaagaaaaggaggcccagauuucaucugccaucgugagcaguguacaguccaaaauuacccaggaucugauggcuaaggugagggcgaugcuagcagccagcaaaaaccuccaaacaucugcuucauga

SEQ ID NO: 62404 - RNA, 483 nt, Artificial Sequence
  derived and/or modified sequence opt3 from SFT2D2__Homo_sapiens__NP_955376
auggacaagcugaaaaaggugcucagcggccaggauaccgaggacagauccgggcuuucugaagucguugaggccucaagucugagcugguccacaaggaucaaaggauucauugcuugcuuugcaauagguaucuuguguucuuuacugggcacugugcuacucuggguaccccggaaggggcugcaccuuuucgccguguuuuacacguucggaaacauugcgucgaucggcucaaccauuuuucugauggguccugucaaacaauugaagcgcauguucgaaccaacacgacucaucgcuacuauaauggugcugcugugcuuugcccucaccuuauguagcgcauucugguggcauaauaaggggcuggcccuuaucuuuugcauuuugcagagucuggcucuaacaugguauucccucucuuucaucccguuugcacgugaugccguuaaaaaguguuucgcugugugccuggccuga

SEQ ID NO: 62405 - RNA, 648 nt, Artificial Sequence
  derived and/or modified sequence opt3 from SFT2D3__Homo_sapiens__NP_116129
auggccgaccugcacagacagcuccaagaguaccuugcucagggcaaggcagggggacccgccgcggcugaaccucuguuggccgcagagaaagccgaggaaccaggugauaggccggcugaagagugguuaggccgggcagggcugcgcuggaccugggcccgaagccccgcugaguccgccgcggcaggacuaacaugccucccuucugugacucguggccagagacuggccgcuggugggggaugucuucuguuggccgcacucugcuucggccuggcugcccuguaugcgccaguccucuuacugagggcccggaaguuugcacuuuuguggucacugggcagugcucuagcccucgcugggagcgcccugcuucgcggaggugcagccuguggcagacuguugaggugcgaagaggcucccucccggccugcgcuccuguacauggcagccuuaggggcuacgcuguucgccgcacucggacuucgcucuacccuguugacaguucuaggcgccggugcucagguggccgcacugcucgcggcucugguagggcuucugccauggggaggcggcacugccuugcgacucgcacuggggagauuaggaaggggugccggccuggcuaaagugcuacccgucuga

SEQ ID NO: 62406 - RNA, 237 nt, Artificial Sequence
  derived and/or modified sequence opt3 from SFTA2__Homo_sapiens__NP_995326
augggcagcgggcugccccucgugcuucuguugaccuuacugggauccucucacgguacaggcccugggaugacucuacagcucaagcugaaagagucauuccuuacgaacaguagcuacgaauccucuuuucuggaguugcucgaaaagcugugccugcucuuacaucugccaucgggaaccucagucacacuucaccaugccagaagccaacaccauguuguguguaauacuuga

SEQ ID NO: 62407 - RNA, 285 nt, Artificial Sequence
  derived and/or modified sequence opt3 from SFTA3__Homo_sapiens__NP_001094811
augagagccggcuucagcgacuuucagcugaucagggaucaaguccucuuccuucaggaccaggcucagcggcugaccgagugguugcaauuauccggguuugaaaaccccgugucugagucaacaacucugugccuacgcgaacgagagaagcguauuccuacguguguugcagugugcguaccaaguccgggaaccgugcacacagcccuccugcaucccacuacccuuagccaguccagaucuucgucagaagcgaaaaugcugauaauccacacagcuuga

SEQ ID NO: 62408 - RNA, 645 nt, Artificial Sequence
  derived and/or modified sequence opt3 from SFTPA1__Homo_sapiens__NP_001158117
augagacccugccaggugccuggcgccgcuaccgggccaagggcaauguggcuguguccgcucgcccuuaaccugaucuugauggcggcuagcggagccgucugcgagguuaaggacguguguguagguacacccggcauuccuggggaaugcggagagaaaggcgaaccaggugagcgggggcccccuggauuaccagcacaccuggaugaggaacuacaagccacucuccaugacuuccgccaccagauacugcagacgcgaggcgcucuuucccugcagggcucuaucaugaccgugggggagaaggucuuuucaaguaauggacaaagcauuacauucgaugcaauccaggaagccugugcucgugccgguggcagaauugcggugcccaggaacccugaggaaaaugaggcaaucgccuccuuuguuaaaaaguacaacacuuaugcuuacgugggguugaccgagggaccaucuccgggcgacuuccgguauucggaugguacacccgucaauuacaccaacugguaucgcggggaaccugccggaagaggcaaagagcagugcguggaaauguacacugacggccaguggaaugauaggaacugucucuauucacggcugacaauaugcgaguuuuga

SEQ ID NO: 62409 - RNA, 798 nt, Artificial Sequence
  derived and/or modified sequence opt3 from SFTPA2__Homo_sapiens__XP_005270185
augagagacagguggagcgaguccgugcgggccgcuaccggcccccgcgcaauguggcugugcccucucgcccuuacacugaucuugauggcggcuucuggggccgcaugugaagucaaggauguuugcgugggaucaccagguauuccgggcacucccgggagucacggauuaccuggccgagacggucgugaugggguaaaaggagacccaggcccucccggcccaauggggcccccuggagagacgccauguccgcccgguaacaauggccugccuggggccccaggagugcccggcgaaagaggugagaagggggaagcuggagagaggggcccuccaggccuacccgcacaucucgaugaggaacugcaggccacccuucacgacuuccggcaucaaauacugcagacacgcggggcuuugagccuccagggauccaucaugacugucggugagaaaguguuuucuucgaacggccagucaauuaccuucgaugccauccaagaagcgugcgcaagagccgggggaaggauugcuguuccgcggaauccugaggagaacgaagccaucgcuagcuuugugaagaaauacaauacauaugcauacgucggccugaccgagggucccaguccaggggacuuccgcuauuccgauggcacuccugugaacuacacaaauugguaucgaggagaacccgccggcagagggaaggagcaguguguagaaauguacaccgacggacaguggaacgauaggaauugccuguauucucggcucacgauaugugaguuuuga

SEQ ID NO: 62410 - RNA, 1182 nt, Artificial Sequence
  derived and/or modified sequence opt3 from SFTPB__Homo_sapiens__XP_005264544
augcaccaggccggcuaccccgggugcagaggagcuauggcagagagccaucugcuccaauggcuucuguuguuacugccuacccuaugugguccaggcacagccgcguggacuacguccucucucgcuugcgcccaggggccggaguucuggugucagucacuggaacaggcacuucaaugcagggcccugggacacuguuugcaggaaguguggggccaugucggugcugacgaucucugccaggagugugaagacaucguucacauucugaacaagauggcaaaagaggccauauuucaggauaccaugcggaaguuccuggagcaagaaugcaaugugcuccccuuaaaacugcuuaugccucaguguaaccagguauuggacgauuauuuuccacuggugaucgacuacuuccagaaucaaacagauaguaacgggauuugcaugcaucuaggacucuguaagagccgccagcccgagccugaacaggagccaggcauguccgacccccugccuaaaccacuucgagauccgcugcccgacccuuugcucgauaagcuggucuuaccagugcugcccggcgcucuccaagcccguccugggccacacacucaggaccuuucugagcagcaguuucccaucccgcugccuuauugcugguugugcagagcgcuaauuaagaggauccaagcaaugauacccaaaggagcccuggcuguugccguggcacaggucugucgggugguaccacucguugcugguggcaucugccagugucuggccgaacgcuacucggugauucuucuggauaccuugcucgggagaaugcugccucaguuagucugcaggcuggugcuacgguguucaauggacgacagcgcgggaccccgcaguccaacaggcgaguggcucccccgagauuccgaaugccaccuguguaugucugugaccacucaagccgguaauagcuccgagcaggcaaucccucaggcuaugcuucaggccugcgucgggucaugguuggacagagaaaaguguaaacaauucguugagcagcauacaccacagcugcucacccuggugccgaggggaugggaugcucacacgacuugccaggcccuuggcguauguggcaccaugaguagcccccugcaaugcauucauucuccugacuuguga

SEQ ID NO: 62411 - RNA, 576 nt, Artificial Sequence
  derived and/or modified sequence opt3 from SFTPC__Homo_sapiens__NP_001165828
auggacgugggcagcaaggagguccugauggaaucucccccugauuacuccgccgcuccaagagggagguucggaaucccgugcugucccguucaccucaaacggcuucugauugugguaguggucgugguuuugauaguggucgugaucguaggugcauuacugaugggccuacauaugucacagaagcacaccgagaugguucucgaaaugaguauuggggccccugaggcgcaacagcgccuggcucuuagcgaacaucuggugacaacugccacguuuuccaucggaucuaccggcuuggucguguaugacuaccagcagcuccugauugcauauaaaccagcccccgguacaugcuguuacaucaugaagauagcuccugagucgaucccaucacuggaggcacucacucgaaaagugcacaacuuccaagccaagcccgcugucccuaccagcaaguuagggcaggccgaaggacgugaugcgggcagugcaccauccggcggggacccggccuuucugggaauggcuguuucuacacuuugcggugaggugcccuuguauuacauuuga

SEQ ID NO: 62412 - RNA, 1128 nt, Artificial Sequence
  derived and/or modified sequence opt3 from SFTPD__Homo_sapiens__NP_003010
augcuccuguuccuucugagcgccuugguguuacugacccagccccuaggcuaccucgaggcugaaaugaagacauauucccacagaacuaugccuucugcaugcacgcuggucauguguucaaguguugagagcgggcuuccaggaagggacggucgggauggccgcgaagggccgcgaggagagaaaggcgaccccggucugccuggggccgcgggacaagcuggcaugccaggccaggccgggcccgugggaccuaagggugauaacggcuccguaggggaaccaggacccaaaggcgacaccgguccuucugggccaccgggacccccuggcgugccaggccccgcagggcgugagggaccuuuggguaagcagggcaauaucgggccacagggaaaacccggcccgaagggugaggccgggccuaagggcgaagucggagcucccggcaugcaagggucggcaggagccagaggucucgcuggcccaaaaggggagaggggagugccuggcgaacgggguguucccgggaacacaggcgccgcgggaucagcaggcgccauggggccacagggaagccccggugcucgcggcccuccagggcugaagggagauaaaggcauuccgggugacaagggggccaaaggcgagaguggacugcccgauguggcaucccucagacagcaggucgaggcuuuacaaggccaggugcagcaucugcaggccgcguuuucucaauacaagaagguagaacuuuucccuaaugggcagagcguuggagagaaaauauuuaagacugccggcuucgugaaaccauuuaccgaagcacaguugcugugcacacaagcuggugggcagcuagccucccccaggucagcugccgagaacgcagcccuccagcagcuggucguggcuaagaaugaagcggcauuccuuaguaugaccgacagcaaaacugagggaaaguuuacauauccuaccggcgagucucugguguacuccaacugggccccaggugaacccaaugaugacggcgggucagaggauugugucgaaaucuucacgaacggaaaauggaaugaccgggcuugcggcgagaagcgcuugguugugugugaauuuuga

SEQ ID NO: 62413 - RNA, 969 nt, Artificial Sequence
  derived and/or modified sequence opt3 from SFXN1__Homo_sapiens__NP_073591
augagcggcgagcugcccccuaacaucaauauuaaggaaccaagaugggaccaguccaccuucauagggagggccaaccacuuuuucacagugacugauccgcggaauauccuccuuacgaacgagcaacuggaaucugcucgcaaaauuguccaugacuaccgacagggaaucguucccccugguuugaccgagaaugaauuauggcgugcaaaguauauuuacgauucagccuuucacccagacacaggcgagaaaaugauccugauagggagaaugagugcgcaagugcccaugaacaugacuaucaccggaugcaugaugacauucuauaggaccacuccugcuguacuauuuuggcaguggauuaaucagagcuucaacgccguggucaauuacacaaaccgguccggcgaugcaccacucaccgugaaugagcuggguacggccuauguuucugcuacuaccggggcaguggccacagcucuuggacugaacgccuugacuaagcaugucucgccccucaucggccgcuuugugccuuucgcggcaguagccgcugccaauuguauuaacaucccacugaugagacagagggaacugaaaguuggcauaccggugaccgacgagaaugggaaccggcucggagaaucagcaaacgcugccaagcaggcgauuacacaggucguggugagccgcaucuuaauggccgcacccgguauggcuauuccuccauuuaucaugaauacccuggagaagaaagccuuccuuaagcgauuucccuggaugagugcuccuauccaagucggcuugguuggguucugccugguguuugccacgccacuauguugcgcacucuucccccagaaauccucuaugagcguaacuucccuggaggccgaacuucaggcuaagauucaggagucacacccggaacugagaaggguguacuucaacaaaggauuguga

SEQ ID NO: 62414 - RNA, 969 nt, Artificial Sequence
  derived and/or modified sequence opt3 from SFXN2__Homo_sapiens__NP_849189
auggaggccgaccugagcggcuucaacaucgaugcucccagaugggaccagaggaccuuucucgggcgggugaagcacuuccuuaauauuacagauccucgcacugucuuuguuuccgaacgagagcuggacugggcaaaagugaugguagaaaagucucguaugggaguggucccaccggguacgcaaguggagcaguuguuauacgccaaaaagcuguaugauucagcguuccaucccgacaccggcgaaaagaugaacguuauagggagaaugaguuuucagcuaccuggaggcaugaucauuacagguuucaugcuccaguuuuacaggacuaugccagcugugaucuucuggcaaugggucaaucagagcuuuaacgcccuggugaauuauaccaaccggaaugcagccucccccacaucuguacgccagauggcucuuucguacuucaccgcaacuacaaccgccguugcuacggccguggggaugaacaugcugacuaagaaggcgccuccauuggucggaagaugggugcccuuugcagccguggcugccgcaaauugcgucaacauuccuaugaugaggcagcaagagcucaucaaaggcauauguguuaaggaucggaaugagaacgaaaucggccacucacgccgagcugccgcgauugggaucacccaggugguaauuagcagaaucacaaugagugccccaggaaugauacugcugccggugauuauggagaggcucgaaaaauuacauuucaugcagaaggucaaagugcugcacgcaccccuucagguuauguuguccgguugcuuucugaucuucauggugccugucgcuuguggccuauucccacaaaagugcgagcuccccgugucuuaucuggagccuaaacuucaggacacuauuaaagccaaguacggggaacuggagccauauguauacuuuaauaaaggauuguga

SEQ ID NO: 62415 - RNA, 1014 nt, Artificial Sequence
  derived and/or modified sequence opt3 from SFXN4__Homo_sapiens__NP_998814
augagccuggagcaggaagaggaaacccaacccggcagacuccuugggaggcgggacgccgugccugcuuucauugagccaaacguccgcuuuuggauuacagaacgacaguccuucauacguagauuucugcaguggacugaguuguuagauccgacgaauguuuucaucucuguggagucaauugaaaacaguaggcagcugcuaugcaccaaugaggacguaagcucccccgcaucugccgaucaacggauccaggaagcguggaagcgcucgcucgcuacagugcacccugacucaagcaaccugauuccaaaacuuuuuagacccgccgcauuccugccuuuuauggccccaacugucuucuugaguaugacaccccucaagggaaucaaauccgugauacugccucagguuuuucugugugcuuacauggcagccuucaauucuaucaacgguaauaggagcuauaccugcaagccacucgagcgguccuuacugauggcuggcgccguggcgucaaguaccuuucuuggggucauuccgcaguucgugcaaaugaaauacggauugacuggccccuggaucaagcgccugcuaccuguaauuuuucucguucaggcaagcgguaugaacguguauaugucucgaucccuggagucaaucaaggggauagccgucauggauaaagaaggaaaugugcuuggccauagcagaauugcuggcacaaaggccgugagggagacccuggcaagucggaucgucuuguucgggacgucugcucucauuccagaaguuuucacuuacuuuuucaaacguacccaguauuuucgcaagaaccccggaucccuguggaucuuaaaacugagcuguacagugcucgccaugggucuuaugguaccuuucucguuuucuaucuucccacagauuggccaaauacaguacugcucccuggaggaaaagauccagucacccacugaggagaccgaaaucuuuuaucacagagggguguga

SEQ ID NO: 62416 - RNA, 1164 nt, Artificial Sequence
  derived and/or modified sequence opt3 from SGCA__Homo_sapiens__NP_000014
auggccgagacccuguucuggacaccccuccuugugguccuguuggcuggcuuaggggacacugaagcacagcaaacgacccugcacccucuaguuggaagaguguuuguacauacacucgaucacgagacuuuccugagccuuccagaacauguggccgucccgcccgcggugcacaucaccuaccaugcucaccuccagggucacccugacuugccaagguggcuccgguauacacagcgcucuccccaucacccuggcuuucuguacggguccgccaccccagaggaucgaggacugcagguuauugaagugacugcauauaaccgugacucauucgauacaaccagacaaaggcucgucuuagagauaggcgaccccgaggguccucugcuuccauaccaggccgaauuuuuggugcggagucaugaugcugaggaaguacugccgagcacgcccgcaucccgcuuccuaucugcccucgggggacugugggagccuggcgagcuucagcuguugaauguuacuucggcucucgacagaggcgggagggugccacugcccaucgaaggacggaaggagggugucuauauuaaagugggcucagccagcccuuuuaguaccugcuuaaagaugguggcguccccagauucucacgcacgcugugcccaggggcaacccccgcugcucagcugcuacgacacacuugcuccucacuuccgagucgauugguguaacguuacucugguggacaaauccguacccgaaccagccgaugaggugccuacccccggagacggcaucuuggaacaugacccauuuuucugucccccuacagaggcaccagauagagacuuucuagucgaugcucuggugacccuccugguuccgcuucugguggccuugcuccugacguuacugcuagcguaugucaugugcugcaggcgggagggucgucucaagcgcgaccuggccacuucagauauucagauggugcaccauuguacaauccacgggaauaccgaggaacuuagacagauggcagcuaguagggaaguaccccggccuuugagcacucugccaauguucaacguucauacaggagagcgacugcccccucgcguggacucugcccaggucccacugauacuugaucaacacuga

SEQ ID NO: 62417 - RNA, 957 nt, Artificial Sequence
  derived and/or modified sequence opt3 from SGCB__Homo_sapiens__NP_000223
auggccgcugcagccgcggcugccgcagagcagcaaagcuccaacggccccgugaagaaaucuaugagagaaaaggccgucgagaggcggucaguuaauaaagaacacaacaguaauuucaaggcuggguacaucccuauugacgaggaucgccugcauaaaaccggacuccgaggucguaagggcaaccuugcaauaugcgugaucauucuguuguuuaucuuagccguaauuaaucugaucauaacucuagugaucugggcugucauuagaaucgggccaaacggaugugacagcauggaguuccacgaauccggccuccugagguuuaaacaggugucugauauggguguuauucauccgcuuuauaagucgacagucgggggacggcgcaaugagaaccuggugaucacgggcaauaaccagcccauaguguuccagcaaggcaccacaaaguugucaguagaaaauaacaaaacuagcauuaccagugacaucgggaugcaguuuuucgauccuagaacacagaauauucucuuuuccaccgacuacgagacucacgaguuccaucugccaucuggaguuaagagccugaacgugcagaaagccuccacagaaaggaucaccucaaaugcgacgagugaucucaacaucaaggucgacggucgggcaauugugcgcggcaacgaggggguguuuauaaugggaaagacuaucgaguuccacaugggcgguaauauggaauuaaaagccgaaaacagcauuauccugaaugggucugucaugguuuccaccacacgacuucccucaagcaguucuggagaucaauugggcuccggcgacugggugagauauaagcugugcaugugugcugaugggacucuauuuaaaguacaggugaccagccagaacaugggaugccagauaucggacaauccuugugguaacacacacuga

SEQ ID NO: 62418 - RNA, 771 nt, Artificial Sequence
  derived and/or modified sequence opt3 from SGCD__Homo_sapiens__NP_758447
augaugccccaggagcaauacacccaccauagaagcacaaugccuggcuccguggggccacaggucuauaagguuggaaucuacgguuggaggaaacggugccuguauuucuuugugcuccuucugaugauuuugauauuaguaaaccuggccaugacuaucuggauucuaaaggugaugaauuucacgaucgacggcauggggaaccuccgcauuaccgaaaaaggacugaaacuugagggcgauucugaauuucugcagccguuguacgcuaaggagauccagucacgacccgguaaugcacucuauuucaagagugcccguaacgucacagugaauauacugaacgaccaaacuaagguucugacccagcucaucacagggccuaaagcgguggaggcuuacggaaagaaauuugaagucaagaccgugagcggcaaauuacuguucuccgccgauaauaacgagguaguugugggcgcagaaagacuuagggucuugggggccgagggaacuguguuuccaaagucuauugaaacacccaaugugcgggcugacccuuucaaggagcugcgccuagagucgccaaccagaucacucgucauggaagcacccaaagguguugagaucaacgccgaagcuggcaauauggaggccacguguaggacugaacugcggcuugagagcaaggauggggaggugcgcgacgaaaaagaucgaaguuccaagucuuauagcuuuaacagaccuacccugccaauuacaggauga

SEQ ID NO: 62419 - RNA, 1356 nt, Artificial Sequence
  derived and/or modified sequence opt3 from SGCE__Homo_sapiens__NP_001092870
augcagcugcccagauggugggagcucggcgacccuugcgccuggaccgggcaaggaagggguacacggcgcaugagcccagcuacuacgggcaccuuccuucugacaguguacuccaucuuuucuaagguccacucagaucgaaacguuuauccgagugcagggguguuguucguacauguguuagaacgugaguacuuuaaaggagaauuucccccuuauccaaagcccggcgagauuagcaaugacccuauaacuuucaacaccaaucugauggguuacccagauagacccggguggcuaagguauauccagcggacaccuuacuccgacggaguccucuauggcucuccaaccgccgaaaacgugggcaaaccgacuauuaucgagauuacagcguacaaucgcagaaccuucgagacggcuaggcacaaccugaucauaaauaucaugucggccgaagauuuuccccuuccuuaccaggcagaguucuuuauuaagaacaugaauguugaagagaugcuggccucagagguguugggggacuuccucggagcugucaaaaacguguggcagccagaacggcugaaugcaaucaacauuacuagcgcccuggaucgcgguggccgaguaccccucccuaucaaugacuuaaaggaggggguuuaugugauggucggagcugaugugccauuuaguuccugucugagagaaguggagaacccccaaaaucagcuuaggugcucucaggaaauggagccggucauaaccugugacaagaaauuccggacacaguuuuacauugauuggugcaagaucagcuugguugacaaaacuaagcaaguguccaccuaucaggagguaauucguggcgaagguauccugccugaugggggagaguacaaacccccaucagacagucuaaagagccgcgacuauuacacagauuuccucaucacccuggccgugccuucugcggucgcacuugugcuguucuugauucucgccuauauaauguguugcagaagggaaggcguuauccagcuggugcaucacuccgcuauucagaagucaacgaaagaguuacgggacaugagcaagaaccgagaaaucgccuggccccugaguacucucccagucuuucaucccgugacaggcgagauaauuccuccacuucacaccgauaacuacgacucuacuaauaugccgcugaugcaaacacagcagaacuugccccaccaaacccagaucccucagcagcaaacgaccggggauuuccgccuaacaacuuuucagagauucgagguaaauggaaucccagaagagaggaaacugaccgaagcaaugaaccucuga

SEQ ID NO: 62420 - RNA, 876 nt, Artificial Sequence
  derived and/or modified sequence opt3 from SGCG__Homo_sapiens__XP_005266562
auggugagagagcaguacaccacagccacugaaggcaucugcauugagaggcccgaaaaccaauaugucuacaagauagggaucuauggauggcggaaacgcugucuguaccucuucguucuucuguuguuaauuauccuggugguaaaucuagcucucacgauuuggauccugaaggugaugugguuuagcccugcagguaugggccaccuuugcgucaccaaagacgggcugcgauuggagggagaauccgaguuccucuuuccacuguaugccaaggagauacauucucguguggauucaagucugcucuuacagagcacacagaacguuacugugaaugcgagaaacuccgaaggcgaggucaccgguaggcugaaaguggggccgaagaugguagaaguucagaaucaacaguuccagaucaacucuaaugacggaaagccccuuuuuacaguggaugagaaagaggucguggugggcaccgacaaguugcgggucacuggcccugaaggggcucuguucgagcacucgguugaaacaccccuagugcgcgccgauccauuucaggaccucagacuggagucaccuaccaggagccuuaguauggaugcaccacggggaguacauauucaagcccacgcugguaaaaucgaagcacugucccagauggacauuuuguuccauucuagcgauggcaugcucgugcuggacgccgagacggucuguuuacccaagcuggugcaggggacuuggggaccuuccggcucaagucagagccucuacgagaucugcguuuguccagaugguaaacuuuaucugucuguggcuggggucuccaccacaugccaagaacacaaccacauauguuuguga

SEQ ID NO: 62421 - RNA, 939 nt, Artificial Sequence
  derived and/or modified sequence opt3 from SGCZ__Homo_sapiens__NP_631906
auggacagaagcaccaaccuggauaucgaggaacucaagaugacaagggagcaguacauucuugccacucaacagaauaaccugccccggacggaaaaugcucaguuguauccugugggcauauacggguggcgcaaacgaugcuuauauuucuuuguccugcuacuccugguuaccaugaucgugaaccuugcaaugacaauuuggauccugaagguaaugaauuucacuguggacggaauggguaacuugcgugucaccaaaaagggcauuagacucgaggggaucuccgaauuucugcugccacucuacgugaaagagauacacucuaggaaggauucaccguuaguucugcagagugaccggaaugugacagucaacgcccgcaaucauaugggacaacuuaccggccaguugacuaucggugcggaugcuguggaggcccaguguaagagauucgaaguaagggcaagcgaggacgggcggguucuguuuuccgccgaugaagacgagauuacaaucggagcugagaaacuaaaggugaccggcacggaaggcgcagucuucgggcacucuguggagacuccccauauucgcgccgaaccuucgcaggaucuccgacuggagucaccaaccagaagccuuaucauggaagcucccaggggagugcaagucagugccgcggccggugacuuuaaagcaacaugccggaaggagcugcacuugcaguccacugagggcgaaauauuccucaacgcugagaccauuaaacuggggaauuuaccuacaggaucuuuuagcuccucaaguccaucuagcuccucaagccgucagaccguuuaugaacugugugugugccccaacggcaagcucuaccuuaguccugccgguguagggucuacgugucaguccagcucgaauaucugccuguggucuuga

SEQ ID NO: 62422 - RNA, 1830 nt, Artificial Sequence
  derived and/or modified sequence opt3 from SGIP1__Homo_sapiens__XP_011540595
augauggagggccugaagaaaagaaccaggaaggccuucgggauccggaaaaaggaaaaagacacagauagcacuggaucccccgaccgcgaugguauuaagaagucuaacggcgcuccuaauggguuuuacgcagagauagacugggaacgauauaacucaccagagcucgaugaagagggauacaguauccguccggaggaacccggcagcacgaaagguaagcacuucuauuccucuucggagucagaagaggaggaagagagccauaaaaaguuuaauauuaaaaucaagccucuucagaguaaggacauucugaaaaacgccgcgaccguggaugaauugaaggcuuccaucgggaauauagccuuaucuccaagccccgucggagcaaucaaaagaaaccuguccucagaggaaguugccaggccucggcgcaguacaccaacucccgagcuaauuagcaagaaaccuccagacgauaccacagcucucgcaccgcuguucgggcccccucuugagucugccuuugacgaacaaaagaccgaggugcuguuggaucagccagaaaucuggggcuccggccagcccauuaauccuucaauggagagcccaaaacucacuagacccuucccgacaggaaccccucccccacugccucccaagaacguaccagcuacgcccccuaggacugguaguccacugaccaucggcccgggggccucuucccccgcgcggccugcaacaccacucgugcccugccgcagcacuaccccuccacccccgccuccacgacccccuucgagacccaaguuaccaccuggaaaacccggcgucggugacgugucuaggccauuuuccccgccuauacacucaaguagcccaccacccauugccccucuggcucgggccgaauccacaucuagcaucucaaguaccaauucccuuagcgcagcuacgacuccaacaguugggucuucacguggacccaguccuuugaccaugggcgcccaggauacucugccgguggcggccgcauucacagagaccgucaacgcuuacuuuaagggcgccgacccaagcaaauguauugugaagaucacgggggagaugguacuauccuuccccgcuggaaucacccgccauuuugccaauaacccuucuccagcagcccucacauucagaguuauuaauuuuucgaggcuggaacacgugcuucccaacccucaacuguugugcugugacaauacucagaacgaugcuaacaccaaagaguucugggucaauaugccgaaccucaugacacaucugaagaaggugagcgaacagaaaccccaggcgacuuauuacaauguggacauguuaaaguaucaagucuccgcacaggguauacagucaaccccacugaaccucgccguuaauuggcggugcgagccuaguucuacagaucuucgaaucgacuacaaauacaacaccgaugcuaugacuacggccguggcacugaauaacguacaguucuuggugcccauugacggcggggucacaaagcuacaagccgugcugcccccugcuguuuggaaugccgaacagcagcgcauccucuggaaaauacccgauauuagccaaaaguccgagaacggaggcguggguucacugcuugcaagauuucagcugagcgaggggccaucuaagccguccccuuuggucgugcaguucaccagugaaggcagcacucucucuggaugugacaucgagcugguaggcgcgggguauagguuuuccuuaaucaaaaagcgguucgcugccggaaaauaccuggcagauaauuga

SEQ ID NO: 62423 - RNA, 1581 nt, Artificial Sequence
  derived and/or modified sequence opt3 from SGK1__Homo_sapiens__NP_001137148
auggugaacaaggacaugaauggcuuccccgucaaaaagugcagcgccuuucaguucuuuaaaaagagaguuaggcgguggaucaaauccccuauggugucuguagauaagcaccaaucaccaagucugaaguacaccgggagcuccauggugcauauuccgcccggagagccugacuucgaaucuucgcucugucagacaugccuuggugagcacgcuuuucagcgcggcguccugccacaggaaaacgagucauguagcugggaaacucaaagugggugcgaggugcgagagcccuguaaucaugcaaacauauugacgaaaccugauccacguaccuucuggacaaaugacgaucccgccuuuaugaagcagagaaggaugggauuaaacgacuucauccagaaaauugcgaauaacuccuaugcuugcaagcacccugaaguucagucuauccugaaaauuagccaaccacaggagccggaacuaaugaaugccaaccccuccccuccacccucaccuagucagcagaucaaucucggcccaagcucuaacccccaugcaaagccguccgauuuucacuuccugaaggugauagguaaagggucauuuggaaagguccuucuggcccggcacaaagcugaggagguguucuacgcaguaaagguuuugcagaaaaaggccauccucaaaaagaaggaagagaaacauauuaugagcgaacgcaaugugcugcugaagaacgucaaacacccuuuucucgugggcuuacauuucaguuuccaaacugcugacaagcuguauuuugugcuugauuacaucaauggcggggaguuguucuaucaucugcagagagaaagguguuuucuagagccccgggcccgcuucuacgcggcagagauugccucugcucucggauaucugcacucccuuaacaucgucuaccgagaccugaaaccagaaaacauauugcucgauagccaaggucacauuguucugaccgacuuuggcuuaugcaaggagaauaucgaacacaacucgacaaccucuacuuucugugggacaccugaguaccuggcccccgaagugcuccauaagcagccauaugauagaaccguagacugguggugccuuggagcagugcuguacgagauguuguauggccuacccccuuuuuacuccaggaauacggcugagauguaugacaacauucugaauaaaccacuccagcugaagccgaacaucacuaauucagcccggcaccuucuggaagguuugcuccagaaagaucguaccaagcgccugggggcgaaagacgauuucauggagaucaagagucaugucuuuuucagcuuaauuaacugggacgaucugauaaauaagaaaaucacacccccuuuuaacccaaauguguccggacccaacgaccuaagacacuucgauccugaauuuacugaggaaccaguucccaauucuauuggcaagagcccggacucagugcucgucaccgccagugugaaagaggcagcugaggccuuccugggcuucuccuacgcuccuccaacagauagcuuucuuuga

SEQ ID NO: 62424 - RNA, 4221 nt, Artificial Sequence
  derived and/or modified sequence opt3 from SGK223__Homo_sapiens__XP_005272427
augcaccagacccugugccucaaccccgagagccuuaagauguccgccuguucugacuucguggaacauaucuggaaaccuggcucaugcaagaauuguuuuugccugagaagugaucaccaauuggucgcugggccaccgcagcccagggcaggaagccuuccuccacccccucggcugccaccccgcccugagaacugucgacuagaagacgaggguguuaauuccucuccauacucgaaaccgacaauugccgugaagcccacuaugaugucaagcgaagcgagugauguauggacggaggcuaaccucuccgccgaggugucucaggucauauggcguagagcaccuggcaaacugccacuucccaagcaggaagacgccccugugguuuaucuggggagcuucaggggagugcaaaagccagcuggccccuccaccucaccggaugguaauagucggugcccucccgcauacacaauggucggguugcauaaccucgagccacgcggagaaagaaauaucgccuuucacccugugagcuuccccgaggagaaagcuguacauaaggaaaaaccaucuuuucccuaucaggacaggccuuccacucaggagucauuccggcagaagcuggccgcguuugcaggcaccacaagcggcugucaccaagggccaggaccgcugcgcgaaagucuccccucugaggaugacuccgaucagcgaugcagcccuucgggugacucugaaggcggggaguacuguuccauuuuagauugcuguccaggaucacccguugccaaagcugccagucagaccgcaggcagcagagguaggcacgggggacgggacugcuccccuacuugcugggagcagggcaaguguucuggcccagcugaacaagagaagcgugggcccagcuucccgaaagaaugcuguucacagggaccuacagcccauccaaguugccugggucccaagaaacuuuccuugaccagcgaggcggccaucucuucagauggccugaguugugggagcggauccggcucugguucgggggcaagcuccccuuuugugccccaccuagaaucagacuauugcagucucaugaaggagccagcuccugagaaacagcaagaccccggcuguccaggagucacgccgucucgcugccugggccuuacuggggaaccucagcccccagcccaucccagagaggcuacccagccugaaccaauuuacgccgagagcacaaagaggaaaaaggcagcccccgugccuuccaagucacaggcuaaaaucgaacacgcggcagccgcucaaggacagggucagguguguacuggcaacgccugggcacagaaggccgcuagcggguggggacgggauucuccggacccaacuccccaagucuccgccacaauaaccguuauggcagcgcacccugaggaggaucaucgaacgaucuaucugaguagcccagacucugcugugggcguacaguggccccgcgguccugugucccaaaauucagaagucggggaggaagagaccagugccggccagggauugagcucgagagagucccacgcacauucugccagcgaaucaaaaccgaaggagaggcccgcuauuccaccuaaacucaguaaguccucucccgugggcagcccaguuuccccuucagccgggggacccccagugagcccgcuggcagauuuaagugacgguucuuccggcgggagcucgaucggaccucaacccccaucacagggccccgcugauccugccccaucuugccggacaaacggugucgcgauuagugaccccucccgcuguccucagccggccgcuagcucugcaagcgaacagagaaggccacguuuccaagccgggaccuggucccggcagugccgaaucgaggaagaggaggaaguggagcaggaacugcucucacacaguuggggcagagagacuaagaauggacccacagaucauagcaacucuaccacguggcacaggcuucacccuaccgacggcuccucagggcaaaauaguaaaguaggaacaggcaugagcaaguccgcuucuuuugccuucgaauuucccaaagaucgcucggguauagagacuuucagcccaccucccccaccuccgaagucacggcaucuguugaaaaugaacaaguccaguucugaccuagagaagguuagccagggguccgcagaaucacugucucccagcuucagaggagugcacgucaguuuuaccacaggcuccacugacagccucgcgucugauucaaggaccugcuccgacgguggcccaaguagcgagcuggcccauucgccuacaaauucugggaaaaaguuauucgcucccgugccauuuccuuccggaagcaccgaagaugucucacccaguggcccgcagcagccaccuccccugccacagaaaaagauugugucucgcgccgcauccagccccgacggguucuuuuggacucagggaucaccuaaaccgggcacggcuagucccaaguugaaccucagccacuccgagacaaacguucacgaugaaucucauuucagcuacucccugucaccagguaaucgacaccauccuguguuuucuaguucggaccccuuagagaaggccuucaaagggagcggacacuggcugccugcagccggccuagcugguaaccggggcggguguggauccccaggccuccagugcaagggggcgcccucugccucaagcucccagcugaguguaucuagccaagcaucaaccggauccacucagcuucaguugcauggccugcucaguaauaucagcucuaaagaggguaccuacgcuaagcugggaggacuuuauacacagucccuggcccguuuggucgccaaaugugaagaucucuuuaugggcggucaaaagaaagagcugcacuucaacgaaaauaacuggucauuauuuaagcugaccugcaauaagccuuguugcgacagcggcgaugcuauuuacuauugugcaacuugcucggaggacccagggucuacauacgccgugaaaaucuguaaggcgcccgagccgaaaacgguuaguuauugcuccccuagcgugccaguccacuucaacauccagcaggauuguggacauuuuguggcuucaguacccuccucuaugcuaagcaguccugacgccccaaaggaucccgugccggcacucccuacccaucccccagcccaagaacaggacugcguugucgugauuacuagagaggugccucaccagacagcuuccgacuucgucagggauagcgcagccucucaccaggcggaacccgaggcuuacgaacgccggguuugcuuccugcuuuugcaacuguguaauggccucgagcaucugaaagagcacgggauaauccacagagacuuaugccuggaaaaccuuuugcucgugcauuguacccugcaggccggaccaggccccgccccugcaccagcuccggcccccgcuccugcagccgcggccccacccugcucaagugcagcuccuccagccggugggacacuaucccccgcugcaggaccugccagcccggagggcccaagggaaaagcagcugccccgacucauuaucucuaauuuucugaaggccaaacagaagccuggcgggacucccaaccuucaacagaaaaagucgcaggcucgcuuggcgccagagauagugucagcaagccaguaucggaaauucgaugaauuucaaaccgggauucugaucuacgaguuacuccaccagccuaaucccuucgagguaagagcccagcugagggaacgugacuaccgccaggaggaucuuccaccgcugccugcuuugucccucuauagucccggucugcaacagcuagcccaucugcuccuggaagcagacccaaucaagcggauuagaaucggcgaggccaagaggguccuucaguguuugcugugggggccccgacgggaauuagugcaacagccuggaacgucugaggaggcucucugcggcacccugcacaacuggauugauaugaaacgcgcgcuuaugaugaugaaguuugccgaaaaagcaguugacagaaggcgggguguggagcuggaagauuggcuauguugccaguaccucgcuagcgccgagccaggggcacuguugcagucccugaaguuacuccaacugcuuuga

SEQ ID NO: 62425 - RNA, 1104 nt, Artificial Sequence
  derived and/or modified sequence opt3 from SGK2__Homo_sapiens__NP_001186193
augaacagcucccccgccggcaccccuucuccacagccgucaagagcuaaugggaacaucaaucugggacccagugcaaacccuaaugcccaaccaacagacuucgauuuucucaaggugauugguaaaggcaacuacgggaagguccuucuggcgaaaaggaaaagcgacggagcuuucuaugccguuaaaguguugcagaagaaguccauauuaaagaagaaagagcagucucacaucauggcagaacggucgguacugcuaaagaaugugcgccaucccuuucucgucggccugcgauacucauuccagacuccugagaaacuuuauuuugugcuggauuacguuaacgguggggaauuguucuuucaccuccaacgugagagaagguuccuggaaccacgggcccgcuuuuaugcugcagagguggccagcgcuauuggauaccugcauagucucaauaucauuuauagagacuuaaagcccgagaacauccugcuugauugccagggccacgucguguugacggacuucggccuguguaaggaagggguagagccugaagauaccacauccacuuuuugcggaaccccagaguaccuagccccggagguucucaggaaagaacccuacgaccgggcgguggauugguggugucugggugcaguccuuuaugagaugcugcauggcuugccuccauucuacucucaggacgugagccagauguaugaaaauauacuccaccaaccccugcagaucccugggggacgcacaguggccgcuugcgauuuacugcagucccuccuucacaaggaccagcgacaaagacugggcucaaaagccgacuuuuuggagauuaagaaccaugucuucuucaguccaaucaauugggaugaccuauaccacaaaaggcugacucccccguuuaacccuaauguuaccggucccgcagaucucaagcauuucgacccagaauuuacacaggaggcugugagcaaaucuauuggguguaccccugauacgguagccuccucaagcggagcgaguucugccuuccugggcuuuuccuaugcacccgaggacgaugacauccuugauugcuga

SEQ ID NO: 62426 - RNA, 1491 nt, Artificial Sequence
  derived and/or modified sequence opt3 from SGK3__Homo_sapiens__NP_001028750
augcagagagaccacaccauggauuacaaggagagcugccccuccgugucuaucccuucaagugacgaacauagggagaaaaagaaacgguucacagucuauaagguucuggugagcguaggccgcuccgaaugguuuguguuccgacguuacgccgaguuugauaaacucuauaacacucuuaagaagcaauucccagcuauggcacugaaaauuccggccaagagaauauuuggggacaauuucgaucccgacuuuaucaaacagaggcgggcgggauugaacgaguucauucagaauuuaguccgcuacccugaacuguauaaccacccagaugugagagcuuuucuacagauggacucucccaagcaucaaucggauccuucagaggacgaagaugagaggagcagucagaaacuccacuccacgucucagaauaucaaccuggguccaagcggcaauccccaugccaagccuaccgacuucgauuuucuuaagguuauugggaaaggauccuucggcaaggugcuguuggcaaaacggaagcucgacgguaaauuuuacgccgucaaggugcugcagaaaaagaucguacugaaccgcaaggaacaaaaacacauaauggcugagcgaaauguucucuuaaagaacgugaaacacccauuccuggucgggcuucauuauucauuccagacaacugagaaguuguacuuugugcuggacuucgugaauggaggcgaacuauuuuuccaccuccagagagagaggaguuuuccggaacaucgggcacguuucuacgccgcugagaucgccagcgcgcugggcuaucuucacucuauuaaaaucgucuaccgcgaucugaagcccgaaaacauuuugcucgacuccguugggcacgugguacugaccgauuuuggauuauguaaggaggguaucgcaauaucagacacaaccacuacauucugcggcaccccugaguaucuggccccagaagugauuagaaaacagcccuacgauaauacggucgacugguggugucucggggcugugcuuuaugagaugcuguacggauugccuccauuuuauugcagggauguugccgaaauguacgacaacauccuacauaagccccugagccuccggccgggcgugagucugacugcauggucuauucuugaggaacuguuggagaaagaucgacaaaaucgccucggugcuaaggaggacuuccuggaaauccagaaccaccccuuuuucgaguccuuaagcugggccgaucugguccagaaaaagaucccuccaccuuuuaaccccaauguggcggggccagacgacauuagaaacuucgauaccgccuucacagaagagacuguacccuacucgguuugugugucuuccgacuauucaauagucaaugcaagugugcuagaagcugaugacgccuuugucggauucagcuacgcuccuccauccgaggaucucuuucuguga

SEQ ID NO: 62427 - RNA, 1242 nt, Artificial Sequence
  derived and/or modified sequence opt3 from SGMS1__Homo_sapiens__XP_011537885
augaaggagguggucuacuggagccccaaaaagguugccgacuggcugcucgaaaacgcuaugccugaguauugcgaaccacuugagcacuucaccggccaggaucugaucaauuugacacaagaagacuuuaaaaagccgcccuuauguagaguguccucugauaacgggcagaggcugcuagacaugauugagacucucaaaauggagcaucaccuggaagcacauaagaauggacacgccaacggucaucuuaauauaggcguagauaucccuacgccagacgggucauucaguauuaagaucaaacccaacggaaugccuaauggcuaccggaaggagaugauuaaaaucccaaugcccgaacuggagcgcagccaguauccuauggagugggguaagaccuuuuuggcguuccucuacgcucuguccugcuuugugcugacaacugucaugauaucugugguucacgaacgagugccaccgaaagagguccagcccccucucccagauaccuucuuugaccacuucaaccgugugcaaugggccuuuucgaucugugaaauuaaugggaugaucuuaguaggacuguggcuuauucagugguugcugcuaaaguauaagucaaucauaagcagaagguucuuuugcauuguuggcacacucuaccuguaucgguguaucaccauguacgugacuacacuucccgucccuggcaugcauuucaacugcaguccaaaacuguuuggggauugggaggcacaguugcgcagaauuaugaagcucaucgccggagguggccuguccaucaccgggucucacaauauguguggagacuacuuauauagcggccauacggugaugcugacucucaccuaccuuuucauuaaagaauauucccccaggcggcuguggugguaccacuggauaugcugguugcuaucaguggucgguaucuucuguauucugcucgcucacgaucauuauacaguugacgugguaguggcauacuauaucacuacccgccuguuuuggugguaccacacaauggccaaccagcaaguccuuaaggaggcuagucagaugaaucuguuggcccgaguguggugguacagaccguuccaguauuuugagaaaaacguucaggggauagugccuaggagcuaccauuggcccuucccauggccugucgugcaccucucucggcaaguaaaguauucccgucugguuaaugauaccuga

SEQ ID NO: 62428 - RNA, 1098 nt, Artificial Sequence
  derived and/or modified sequence opt3 from SGMS2__Homo_sapiens__NP_001129730
auggacaucauugagaccgccaagcuggaggagcaccucgaaaaccagcccagcgauccuacaaauacuuacgcuagaccagcagagccgguggaagaggagaacaaaaauggcaacgggaagcccaaaucccuuucuucaggacugaggaaggguacgaaaaaguauccugacuacauacaaaucgccaugccaaccgaaagucggaauaaguuccccuuggagugguggaaaacaggcauugcguuuaucuaugcugucuucaacuuaguucugacuaccgugaugauuacaguagugcaugaacgcgucccuccaaaggagcuaagcccuccccucccagauaaauuuuucgacuacaucgaucgagugaagugggccuuuuccguuucugagauaaaugggaucauucuggugggacuuuggaucacccaguggcuguucuugcguuauaaaucgauugucggcagaagguuuugcuucaucauagguacucucuaccuguaucgguguauuacaauguacgugaccacgcugccgguacccgggaugcacuuucagugcgcaccuaagcucaacggagacucacaggccaagguucaacgcaucuuaagacugauuagcggcggcgggcuuaguaucacuggaucccauaucuuguguggugauuuccuguuuucuggccacaccgugacacuaacucucaccuaccuguucauuaaagaauauagcccaaggcauuuuuggugguaccaccuuauaugcuggcuguuguccgcugcagggaucauuuguauccucgucgcccacgagcauuauacaauagacgugauuaucgcuuacuauaucaccacgcggcuguucuggugguaccacucaauggccaaugaaaagaacuuaaaagugaguagccagacuaauuuccugucucgcgcguggugguuucccauuuucuacuuuuucgagaagaacguccagggauccaucccuugcuguuuuucauggccacucagcuggcccccgggcugcuucaaaaguucuuguaagaaauauucccgaguucagaagauuggugaagauaaugaaaagagcacauga

SEQ ID NO: 62429 - RNA, 1584 nt, Artificial Sequence
  derived and/or modified sequence opt3 from SGOL1__Homo_sapiens__NP_001012409
auggccaaggagagaugccugaaaaagagcuuccaggacucccucgaagauaucaaaaagaggaugaaagagaagcggaacaagaaucuugcugaaauuggcaaacgccgaucuuuuauagcagcccccugucaaaucauuaccaacacaucaacucuguugaagaauuaccaggacaacaauaaaauguuagugcuggcgcuagagaacgaaaagaguaaagucaaggaggcucaggauaucauucuccagcugcguaaggagugcuauuaccuuacgugucaacuguaugccuugaaagggaagcucaccagccagcagacaguugaaccugcacagaaucaagagaucugcuccucuggaauggacccaaacucggaugacucaagcagaaaucuguucgugaaagaucugccgcagauaccccucgaagagacugaguuaccuggucagggcgaaaguuuucagaucgaggaccaaauuccaaccaucccccaggauacacuggggguagacuucgauuccggagaagccaagucuaccgacaacgugcuuccuaggacugucagcgugcgguccucauugaaaaagcacuguaauaguauuugccaguuugauagccuggacgacuucgagacaucucaucuagcuggcaaauccuuugaguucgaacgcguugguuuucucgauccacuggugaacaugcacauccccgagaauguccaacauaacgcaugucaguggucaaaggaccaggugaaucuuagcccuaagcugauacagccagggaccuucacgaaaacuaaggaagauauuuuggagaguaaaucugaacaaaccaaguccaaacagagagacacacaggagaggaagcgggaagagaagcgcaaagccaaccgaagaaagagcaaaaggaugucgaaguacaaagagaacaagucugaaaauaagaaaacuguaccgcagaagaaaaugcacaaguccguuucaaguaacgaugcuuauaauuuuaaccucgaggaaggagugcaucugacccccuuccggcaaaaagucagcaaugacuccaaccgugaggaaaauaacgagucugaggugagcuuaugcgaaucaaguggcuccggcgaugacagcgaugaccuguaccucccuacauguaaguauauccagaauccaaccucuaacucagaucgccccgugacgagaccucuugccaagagggcgcugaaauacacugacgagaaggaaacagaggggaguaaaccaaccaagacucccacaaccacgccgccugagacccagcagagcccccacuugucccuaaaagacauuacaaaugucucucuguacccaguugugaagauccggcgacucucgcugagcccuaaaaagaacaaggcaucccccgccguagcccuuccaaaacgcagaugcacugcuucagugaauuauaaggaacccacccuggcaaguaaauugaggcggggagauccuuuuacagaccucuguuuccugaacucuccaaucuucaagcagaaaaaggauuuacgcagaagcaagaaauccaugaagcaaauucaguga

SEQ ID NO: 62430 - RNA, 1707 nt, Artificial Sequence
  derived and/or modified sequence opt3 from SGPL1__Homo_sapiens__XP_011538619
augcccagcaccgaccugcucaugcuuaaggccuucgagccuuaccuggaaaucuuggagguguauuccacaaaagcuaagaacuacgucaauggccacugcacuaaauaugaaccauggcaguuaauugcauggucuguuguguggacgcugcuaauaguauggggguacgaguuuguguuccaaccggaaucacucuggaguagauuuaagaaaaaguguuucaagcugaccaggaaaaugcccaucauuggacggaagauccaggauaaacuuaacaagacaaaagacgauauuagcaagaauauguccuuucugaaggucgacaaagaguaugugaaggccuugccuucucagggucucucgucaagcgcgguucuggagaaacugaaggaauacaguuccauggaugcuuucuggcaggagggccgcgccucugggacuguguauagcggagaagagaaacucaccgaguuacuggucaaggcauacggcgacuuugccugguccaacccacuucaucccgauaucuucccugguuugcgaaaaauagaagcugagaucgugcguauugcaugcucacuguuuaaugggggaccagacaguuguggcugcguaacaagcggcgggaccgaaucuauccuaauggccuguaaggcuuacagagaucucgccuucgagaagggaauuaaaacucccgaaaucguugcgccucaauccgcacacgccgcuuuuaacaaggccgcaucauauuucgguaugaaaauagugagggucccacugacaaagaugauggagguggacgugcgggcuaugcgcagagccauuagcaggaauaccgcgaugcuugucugcaguacgccgcaguuuccccauggcguuaucgauccugugccagagguagccaaacuggcagugaaguacaagauucccuugcacgucgacgcuugucucgggggauuccugaucguguucauggaaaaagccggcuauccuuuagagcauccauuugauuuccggguuaagggugugacuucuaucuccgcugacacccacaaauacggguaugcccccaagggaagcucgcugguccucuacucugacaaaaaguaucgcaacuaccaguuuuucguggauacagacuggcagggcggcauuuacgcauccccgacuauagccgggucacgaccuggagguaucagugcugcgugcugggcagcccuuaugcacuuuggcgaaaauggguauguagaggcuaccaagcaaauuaucaaaacagccagauuccugaaaagcgaauuggagaacauaaagggaauuuuuguuuucggcaauccccagcuauccgugaucgcacuggguucuagggauuuugacaucuaccggcucagcaaccugaugaccgccaagggguggaaucuuaaccagcugcaguucccaccuucaauucauuuuuguaucacguugcuccacgcucguaaacgcgucgccauucaauuccugaaggauauaagagagagugugacucagaucaugaagaaucccaaagcaaagacaaccggcaugggagcgauuuauggcauggcucagacuacagucgacaggaacaugguggccgaauuauccagcguuuuucuggauucucuauacucaaccgacacggugacccaagggagucagaugaacggaagcccaaaaccccauuga

SEQ ID NO: 62431 - RNA, 1326 nt, Artificial Sequence
  derived and/or modified sequence opt3 from SGPP1__Homo_sapiens__NP_110418
augagccugagacagaggcucgcccaacuugugggccggcugcaggacccccagaaggucgcucgcuuccagcgauugugcgggguugaggcaccuccacguagauccgccgauaggcgggaagacgagaaagcggaagcuccguuagccggagauccccgccugagagguaggcaaccuggcgcaccagggggaccccagccuccaggcucugaccggaaccagugucccgccaagccugauggugggggagcuccaaauggcgugcgcaacggccuagcagccgagcucgggccggcuucacccagacgagccggagcgcugaggcggaauagucuuaccggugaagagggccagcuggcacguguaagcaacuggccuuuguacugccucuuuuguuucgggacagagcugggaaaugaacuguuuuauauccucuucuuuccauucuggauuuggaacuuagacccccuggugggccgcagacuugucgugauauggguuuuggugauguaccugggucaaugcacuaaagauaucauuagguggccucggccagccagucccccggucgugaagcuagagguauuuuauaauucugaauacucgaugccuucaacgcacgcuaugagcgggaccgccauccccauuaguaugguucuccugacauauggacgauggcaguacccacuuaucuauggccugauauugaucccuuguuggugcucccucgugugucugucucgcauuuacaugggcaugcauagcaucuuagacauuaucgcaggguuccuguacacuauacucauucuugcugucuuuuaucccuucguggaucugaucgacaacuuuaaucagacccacaaauacgccccauucauuaucaucggauugcaucuagcgcuggguauauuuuccuucacacucgauaccuggucaacuuccagaggcgacacagccgagauucuggggagcggagcaggcaucgcuugcgguucucacgugaccuauaacauggggcuuguccuggaucccuccuuggacacgcucccucuggccggcccaccgauuacuguuaccuuauucggaaaggcuauccugaggauacuaauuggcaugguguuuguacucaucauccgggacgugaugaagaaaauuacaaucccccuggccuguaagauuuucaauauaccuugcgaugacauccgcaaagcaagacagcauauggaggucgaacuuccauacagguauauuacuuacgggauggugggauuuucaaucaccuucuuuguucccuauaucuucuuuuucauugguauaagcuga

SEQ ID NO: 62432 - RNA, 1200 nt, Artificial Sequence
  derived and/or modified sequence opt3 from SGPP2__Homo_sapiens__NP_689599
auggccgagcugcucagaagccuucaggacucccaacugguggcuagguuccagcggcgcugcggcuuguuucccgcaccugaugaagggccacgagagaacggagccgacccgaccgaacgugcggcuagaguccccgguguugagcacuuaccugccgcaaauggcaaagggggagaagccccagcuaacggccugaggcgggcagccgcucccgaggccuacgugcagaaguauguagugaagaauuacuucuauuacuaucuauuucaguucucugcggcacucggucaagaggucuuuuacaucacauuccugccuuuuacucauuggaacauugauccauaucuuucacgcagacugauaaucauuuggguguugguuauguacaucggucagguggccaaagacguccucaaguggcccaggccuaguagcccaccggugguaaaacuggaaaagcggcugauugcugaguacggaaugcccuccacgcacgccauggcagcuaccgccaucgcguucacacucuuaauaucuacuauggaucgcuaucaguacccuuuuguucugggccuugugauggccgucguguucucgaccuuggugugucugucacgacuauauacaggcaugcauaccguccucgacguucuugggggagugcugaucacugcacuguugauuguacucacauacccagcuuggaccuuuaucgauugccuggacagcgccagucccuuauucccugugugugucauugugguuccauuuuuccugugcuauaauuaccccguguccgauuauuacucuccgacgagagcugacacuaccacaauccucgccgcaggggccggcgucacuauaggguucuggauuaaccacuuuuuccagcuugugagcaagccugcugaaucccugcccguaauccaaaauauuccaccuuugaccacauacaugcuaguucugggacucaccaaauuugcggugggcaucguccugauccuucuggugaggcaguugguccagaaccucucauuacaggugcuguauaguugguucaagguugugacgcggaauaaagaggcacgucgcagacuggagauugaaguacccuacaaguuugucacuuauacaagcguggguauaugugccaccacuuucguuccaaugcuacauagguuucucgggcugcccuga

SEQ ID NO: 62433 - RNA, 1509 nt, Artificial Sequence
  derived and/or modified sequence opt3 from SGSH__Homo_sapiens__NP_000190
augagcugccccgugccugccuguugcgcucugcuccuuguccugggcuuguguagagcaaggccacggaacgccuuacugcuacucgcggacgaugggggauucgaguccggugcuuacaauaacucugccaucgcaaccccgcaccuggacgcccuugcucgccgaucacuguuguuucguaaugcauucacaaguguuagcuccugcucucccucgagagccucacuccugacuggccugccucagcaucaaaacgggauguauggacuccaccaggaugugcaucacuuuaauagcuucgacaagguaaggaguuuaccacugcuuuugucccaggcuggcgugcggacggguauuauagggaaaaagcaugucggacccgaaaccguguacccuuuugauuucgccuauacagaggaaaacggcucuguucuacaggugggccgcaauaucacuagaauuaaacugcucgucaggaaguuucugcaaacccaggacgaucggccauucuuucuuuacguggcguuccacgacccccaccgcugugggcauagccagccucaguauggaacauuuugcgagaaauucgguaacggcgaauccgggaugggacgaaucccagauuggaccccgcaagcauacgacccccuggauguauugguuccuuauuuugugccaaauacucccgccgcuagagccgaccucgcagcucaguacacaaccgucggcaggauggaucaggguguggggcugguguuacaggagcugcgggacgccggaguccucaacgacacgcuuguuauuuucacuucagauaauggcaucccuuucccaaguggccguaccaaccuguacuggcccgggacagcggagccguugcuagugagcucuccugaacaccccaagcgcuggggacaaguauccgaggccuaugugucacugcucgaccugacuccaaccauacuugauugguuuagcaucccuuaccccaguuaugcaauuuucgguucuaagacaauccaucugaccggcagauccuugcucccagcucuggaagccgagcccuuaugggcuacggucuuugggagccagucgcaccacgaggugacuaugucuuacccuaugagguccguucagcaucggcacuuccgacuggugcauaaucuaaacuuuaaaaugccauucccgauugaccaagauuuuuaugucucacccacauuccaggaccuccugaaucgcaccacugccggacagccuacaggcugguacaaggaucuuagacacuauuacuacagggcacggugggaauuguaugaccgcaguagagauccacaugagacccagaaccuggccacggaccccagguuugcucaacuccuggaaaugcuucgugaucagcuggcgaaauggcagugggagacccacgacccuugggugugugcaccagacgguguauuggaagagaagcucagcccccagugccaaccgcugcacaacgaguuauga

SEQ ID NO: 62434 - RNA, 3021 nt, Artificial Sequence
  derived and/or modified sequence opt3 from SGSM2__Homo_sapiens__NP_001091979
augggcagcgccgaggacgcugugaaggaaaaacugcucuggaacgucaagaaagagguuaagcagaucauggaagaggcagugaccagaaaauucguacacgaagauuccucucauauuauagcccuuugcggggcgguggaggcuugucuguugcaccaauuaaggcggcgcgccgcaggauuucugcgaucagacaagauggccgcucuauucacaaaggucgguaaaacuugccccguggcaggcgagaucugucauaagguucaggaacuccagcagcaagccgaggggcguaaaccuaguggagugagccaggaagcucugagaaggcagggcuccgccucugguaaggcgccagcacuuucgccgcaggcccugaaacacgucugggugcggacggcuuugauugagaagguacucgauaagguugugcaauaccuggccgagaauugcucaaaauauuacgaaaaggaggcacugcucgcugaccccgucuuugggccuaucuuagccagccugcuugugggaccaugugcguuggaauauaccaaacugaagacagccgaucauuacuggacugaccccagugcagaugagcuagugcagcgccacagaauuaggggcccuccaacccggcaggacucccccgcuaaacgcccugcccucggcauccgaaagagacacucuagcggguccgcuucagaagauaggcuggccgcaugcgcccgggagugugucgagagucuucaucagaacagccguacacgccuguuguaugggaaaaaucacguucucgugcaaccaaaggaagacauggaggcuguaccggguuaccugucuuuacaucaguccgcggaaucacugacccucaaguggacucccaaccagcuuaugaauggcacacugggggauagcgaguuggaaaaaucuguguauugggacuacgcccuagucgugccuuucucucaaguugugugcauacacugucaccagcagaaguccggaggcacccugguccucgugagccaggaugguauccaaagaccaccccugcauuuuccucagggaggacaccuucugucguucuugucuugccucgagaacggccuguuaccaaggggccagcuggagcccccgcuauggacgcagcaagggaaaggaaagguauuuccuaaacuccggaagcgauccucaauucgcaguguugacauggaagagauggguacuggcagagcaaccgacuacguguucaggaucauuuaucccgggcaucggcacgaacauaaugcuggagauaugaucgagaugcagggcuuugguccaagccugccugccuggcaccuugaacccuuguguucccaggggucuagcugccugucaugcaguuccagcaguucaccacacgcaacacccagucauuguagcugcauaccugaccgccucccacugagacuucugugugaguccaugaagaggcagauugucucucgugccuucuacggcugguuggcucacugccggcaucucucgacugugcgaacccaccugagcgccuuaguccaccauuccgugaucccgcccgauagaccuccaggagcaucagcgggccugacaaaagacguuuggaguaaguaucaaaaagauaagaaaaacuacaaggagcuagaacuccugcgccagguguauuacgggggaauugagcacgaaaucaggaaggacguauggcccuuucuuuugggucauuauaaauucggcaugucuaagaaagagauggagcaggucgaugcugugguugccgcacgguaccagcaagugcuggccgaauggaaggcuugugaggucgugguaagacagagggaacgcgaggcccacccugcaacccgaacgaaauuuagcuccgggucaagcaucgacucucaugugcagcggcucauucaccgugauuccacuauaaguaaugacguuuucaucagcgucgaugaccuggaaccacccgagccgcaagacccugaggauucuagaccaaagcccgaacaggaggcuggaccuggcacacccgguaccgccgugguggaacagcagcacuccgucgaguucgacucaccagauaguggguuaccuagcucgaggaacuacuccguugcgucuggcauucaaagcucacuggacgaaggacagagugugggcuuugaggaggaagaugggggaggugaggaaggcuccucugggcccggaccagccgcucauacucuucgcgagccgcaggacccuagccaggaaaagccccaagcaggcgaguuggaggccggugaggaacucgcugccgugugcgcagcggccuauacaaucgaacugcuagauaccguagcucugaaucuccaccggauagacaaagauguccagagaugugacaggaacuacugguauuucacgccacccaaucuggagcgacuucgcgaugugaugugcuccuacguuugggagcauuuggacgugggguauguccagggcaugugugaucuguuagccccucuccuggugacccuugacaacgaccagcuggcauacucaugcuuuagccacuugaugaagcggaugagucaaaauuucccaaacggaggcgcuauggauacacauuuugccaacaugagaucucucauucagauccuggacuccgaacuauucgagcugaugcaccagaauggggauuauacucacuuuuacuucuguuacaggugguuucuccuggacuucaaacgugaacuuuuguaugaggauguuuuugcagugugggaaguaaucugggccgcucgccauauuagcucggagcacuucguccuguuuaucgcguuagcccucguggaggcauaccgggaaauuauaagagacaacaauauggauuucaccgacaucauuaaguucuuuaacgagagggcugaacaucacgaugcccaagagauccugcgaaucgcccgggaccuugugcacaaaguccagaugcugauugaaaauaaguga

SEQ ID NO: 62435 - RNA, 2250 nt, Artificial Sequence
  derived and/or modified sequence opt3 from SGSM3__Homo_sapiens__NP_056520
augagcggcucccacacccccgccugcgggccuuucucugcucugacaccaucaaucuggccgcaggagauucucgcaaaguacacucaaaaagaagagagugccgaacagcccgaguuuuauuacgacgaguucggauuuagaguguauaaggaggagggugaugaaccuggcagcucccuucuggcgaacucuccauugauggaggacgcuccccagagguuacgguggcaggcccaucuggaguucacgcacaaucaugaugucggggaccuaaccugggauaaaauagcaguuucgcucccucgcucagaaaagcugcgaagccuugugcuggccggaaucccacacggcaugcguccccaauuguggaugagacucaguggugcucugcagaaaaagaggaacuccgagcugucuuaccgggaaauuguaaagaauagcuccaacgacgagacaaucgcagccaaacagauugaaaaggaucucuuacgcacuaugccuucaaaugcuuguuuugccaguauggggagcaucggagugccaagacugaggcggguccuucgcgcguuggcauggcuguauccggagauaggcuacugccagggcaccgggaugguggccgcuugucuacuccuguuccuugaagaggaggacgccuuuuggaugaugucugcaaucauugaagaucuguugcccgcuuccuauuucucaacaacccuccugggaguucaaacugaccagcgaguguuaagacaucugaucguccaguaccucccuaggcuugauaaacuguugcaggagcacgacauugaacuaagccugaucacacuccacugguuucugaccgccuucgcgagugugguagauauaaaacuucuguugcggauuugggaccucuuuuucuacgaggguucucguguucuguuucaauuaacgcugggcaugcuacaucucaaagaagaggagcugauccaguccgaaaacagcgccucgauuuucaauacucuuucugacaucccaucccagauggaggaugcagaauugcugcucgggguggcuaugcgccuggccggaucacuuaccgacgucgcuguggagacacaaagaaggaagcaccuggccuauuugaucgcagaucagggccagcuccugggugccgggacuuuaaccaaccugagucaggugguccggcgacgcacacaaagacgaaagagcaccauuacggcucuacucuucggagaagacgaucuggaggcgcuuaaagcaaagaauauaaaacagacugaguugguugccgaccugcgggaagcuauccuccgcguggccagacauuuucagugcacagaucccaagaacuguuccguagagcugaccccugacuacucuauggaaagccaccagagggaucacgagaauuauguggcaugcucacguagucaucggaggagagccaaggcuuuacuggacuucgagaggcacgaugacgacgaacuuggcuuucgcaagaacgauauuaucacuauagucucccaaaaagacgagcauuguugggugggcgaauugaaugggcuccggggaugguucccagccaaguuuguugaggugcuggaugaaagaagcaaggaguacucuauugcgggugacgauucagucacagagggcgugaccgaccuaguaagggggacgcugugccccgcacucaaagcucuguucgaacacggacuuaagaaaccgaguuugcugggcggugccugucauccuugguuauuuaucgaggaagcagccgggcgcgagguugaacgagauuucgcuagcguguauucccggcucguccugugcaagaccuuucgucuugacgaggauggcaaagugcugacacccgaggaauugcucuacagagccguccagucugugaacguuacucacgacgcagugcacgcucagauggauguaaagcugaggucgcuaaucugugucggacugaaugaacaggugcuccaucuguggcuugaaguuuugugcagcucccugccaaccguggagaagugguaucaaccuuggucauucuuacgcagucccggcuggguccagauuaaaugcgaacuccgggugcuguguugcuuugccuucucucuuagccaggacugggagcugccagcgaagagagaggcccagcaaccccuaaaagaagggguaagggauaugcucgugaagcaccaucuguuuuccugggacguugacggauga

SEQ ID NO: 62436 - RNA, 942 nt, Artificial Sequence
  derived and/or modified sequence opt3 from SGTA__Homo_sapiens__XP_011526480
auggacaacaagaaaagacuggccuacgcuaucauucaguuccuccacgaucaacuuaggcauggcgggcugagcuccgacgcacaggagucuuuggaaguggccauacagugcuuagagaccgcguuuggagucacaguugaagauucagaccuggcucuaccccagacucucccugagaucuucgaagccgcagccacggguaaggagaugccacaagaucugcggaguccggcucgcacacccccuagcgaggaagacuccgcagaggccgaacgacuuaaaaccgagggcaaugagcagaugaagguggaaaacuuugaggcugccguacacuucuaugggaaagcgauugaacugaauccagcaaacgccguguacuuuuguaaucgugcugccgcauauucuaaguugggaaacuacgcuggcgccguccaggauugcgagagagcgaucuguauugaccccgccuauucgaaggcauacgguaggauggggcucgcucugucaagccugaauaaacauguggaagccguugcuuauuacaagaaagcccucgaguuagauccugacaacgagacuuacaagaguaaucugaaaaucgcagaacuuaaguugcgggaggccccaucccccaccggaggcgugggcucuuucgauauagcugggcugcuaaacaauccuggauuuaugagcauggcguccaaccucaugaauaacccacagauccaacagcugaugucagguaugauuaguggcgggaauaacccgcuuggaacacccggcaccagcccuucucagaacgaccuggcauccuugauccaggccggucaacaguucgcucagcaaaugcagcagcagaauccagaacucauugagcaacugcgcucacagaucagaagcaggacucccagugccucuaacgaugaccagcaggaauga

SEQ ID NO: 62437 - RNA, 2271 nt, Artificial Sequence
  derived and/or modified sequence opt3 from SH2B1__Homo_sapiens__NP_001139267
augaacggcgcccccagcccugaggacggggcuuccccaucuucaccgccccugccuccacccccuccacccaguuggagagaguucugcgaaagccacgcaagggccgcggcucuggauuuugcccggcgcuuccgacuuuaccuggcaucccauccucaguaugccggaccaggugcugaagcagccuuuucucguagauucgcugaguuguuuuuacaacacuucgaagccgagguggcgagggcaucgggcucacugagcccgcccauccuagccccucucaguccaggggcugagauuucuccccaugaccugucccuugaaagcugucgggucggaggcccucuggccguuuuggguccaucccgcucaagugaggaucucgcagggccccugccgagcucuguguccucaagcaguaccacaucuuccaagccuaaacugaagaaaagauuuagccucaggucgguaggacggucugugcgcggcuccguccgaggcauauuacaguggagagggacuguggaucccccaucaagugcuggaccucuggaaacgagcuccggucccccaguucuuggcggaaauucuaacagcaauucaagugggggcgccgguaccguggggaggggauuggucuccgacggcacaagccccggcgagcgguggacucaccguuucgagcgccugagacuaucuaggggagggggugcgcucaaggacggcgccgggauggugcagcgggaggaacugcuuucauuuaugggagcagaagaggcugccccugauccagcuggcguaggucgagggggcggaguugccggcccgcccagugggggagguggccagccucaauggcagaaaugccgccuguugcucagaagcgaaggggagggaggcgguggguccaggcuggaguucuuugugccacccaaggcaucucggccucgcuuaucgaucccauguagcuccauuaccgacgucagaacaaccacugcccuggaaaugcccgauagggagaacacauucguggugaaggucgaaggcccgucagaguacaucauggaaaccguugacgcucagcaugugaaagcguggguaagugauauucaggagugccucucuccuggaccaugucccgcaacgagcccucgucccaugacucuuccacuggccccuggcaccuccuuuuugacacgggagaauacugacucacuagaacugagcugccucaaccacucugagucccugcccagucaagaucuucuguuggggccaagcgaaucuaaugaccgacucucccagggagcuuaugguggccugucagacagaccgagugccagcaucucgccuuccucugcaagcauagccgcuucacacuucgauaguauggaguuacugcccccagaacuacccccuaggaucccaauugaggaggggcccccuaccggaacagugcauccgcucuccgccccauaucccccucuggacaccccagaaacggcaacuggcucuuuccuuuuucagggugagcccgaagggggcgagggagaucagccuuugagcggcuacccgugguuccacgggaugcugucccgccucaaggcggcucaacugguccuuacaggaggcaccgguucacaugggguguuucugguucggcagagcgagacuagaaggggagaauacguguugacauucaacuuucagggcaaagccaagcaccuccgccugaguuuaaaugaggaaggucaaugucgaguccagcaccugugguuccagucuaucuuugacaugcuagagcauuuccgggugcaccccauuccacucgaauccggcgggagcucggauguaguucuggugucauaugucccuucuagucagcgucaacaggagcccaccacgucccaugacccaccucagcccccagagccgccuagcuggaccgaucccccacagcccggagcagaagaggccucuagagcuccugaaguggccgcagcugccgcggccgcugcaaaagagaggcaagaaaaggagaaggccggcgggggaggcgucccagaggaacuugugcccguuguggaguugguaccugucguggaacuggaggaagcuaucgccccggguagcgaggcacagggggcgggauccggcggugacgccggcguuccacccauggugcagcuccagcaaucaccucucgggggagauggcgaggaagggggacacccccgcgcuauaaacaaucaguacaguuuugucuga

SEQ ID NO: 62438 - RNA, 2028 nt, Artificial Sequence
  derived and/or modified sequence opt3 from SH2B2__Homo_sapiens__NP_066189
auggaccccagcuacugcccugcccacggcuucccaucccaggauccgcuguggccccucucuucacaacaguggaguagcgcucauuauuccgagccugcagccgggggaugugacgguaccgaagcgaugaacggcgcugggccaggacccgccgcagccgcuccugugccaguccccguuccugugccagauuggagacaguuuugcgagcuucacgcacaggccgcugccguagacuucgcgcauaaguuuuguagguuccugcgggauaauccggcauacgacacacccgaugccggcgcuucuuuuucgcgccacuucgccgcaaacuuuuuggacguguucggugaagagguccgacguguguuaguugcugggccuacuacgagaggagccgcggugucagccgaagcaauggagccagagcuggcugauaccagcgcccuaaaagcugcccccuauggccauaguagguccucugaagacgucagcacacacgcagccacuaaggcucgggugcgcaaaggcuuuucccucagaaauaugucacugugcguaguugauggggugagggacauguggcaccggcgcgcgaguccugagccagaugcagccgcugcaccccgaaccgccgaaccgagagacaaguggacaaggcggcuucgucugagccgcaccuuggccgcuaaagucgagcucguggacauccaaagagagggagcccugagguucaugguggcagaugacgcggcugccgguucuggcggguccgcacaguggcagaagugucggcugcucuuacgacgcgccgucgcugaagagagauuuaggcuggaguucuuuguuccucccaaggccucacggccaaaagugagcauuccucuuagugcaauaaucgagguacgcacuacaaugcccuuggaaaugccagagaaggauaacaccuucgugcugaaagucgagaauggagcugaauacauucuagagacgaucgacucucuccagaagcauuccuggguggccgauauucaaggcugcguugaccccggugauagcgaagaggacacugaacugucguguaccagagggggaugccuugcgucuaggguggccuccuguucaugcgagcuguugacagaugcugucgaccucccucguccaccggagacuaccgcagugggcgccguaguuacagcuccccacagucggggccgagaugccgugagagaaagccugauccaugucccuuuagagaccuuccugcagacgcucgaauccccagggggaucugguagcgacucaaacaauacuggcgagcagggggcagaaacagaccccgaggcggagccugaacuugagcugagugauuauccaugguuucacggaaccuuguccagggugaaagccgcucagcuaguccuggccggcgguccccgcaaccacggccucuucgugauacggcaaagcgaaacuagaccgggggaguacguucugacauuuaauuuccagggaaaggcaaagcaucuuaggcugucuuugaacggccacgggcagugucaugugcaacaccucugguuucagucaguacuggacauguuacgccauuuccacacccacccuaucccacuggagaguggagguagcgcugauauuacgcuacgauccuauguccgggcccaggaucccccucccgaaccaggcccuacacccccagcagccccggcuucuccugcgugcuggucggacagccccgggcagcauuacuuuuccucacucgccgcagcugccugcccacccgccaguccuucugacgcugcaggagccagcuccucaagcgcgucuuccaguagcgcugccucuggcccagcacccccucguccgguggagggucaacuguccgccagaucaaggaguaauagcgcugaacgccuuuuggaggcaguugccgcgaccgcugccgaagaaccacccgaggcagccccugggcgggcuagagccguggaaaaccaguacucguucuauuga

SEQ ID NO: 62439 - RNA, 1122 nt, Artificial Sequence
  derived and/or modified sequence opt3 from SH2B3__Homo_sapiens__NP_001278353
augggcuuccccgugcugugcagaggguggaggcggaccuggccuggaugugccagcuggcucggugcuccaccgccccagaagccucuucuguccccauuguuacugaaccaccgaucuucaaaaaguagccgccccaagcuacaagcagccugcuccucuauccaggagguccguugguguacaagacucgaaaugccugacaaucuguacacuuuuguucuuaaagugaaggauaggacggacauuauauucgagguaggcgaugaacagcagcugaacucguggauggcggaguugucagaaugcaccgggcggggacucgagagcacagaggcugaaaugcauaucccaagugcccuggagcccuccacuucuagcuccccucgcggcucaaccgacagucugaaucaaggugcaagcccagggggacucuuagauccggccugucagaaaacagaccacuuucugucuugcuaucccugguuccauggcccuauuuccagagugaaggcugcacagcuuguccaguugcaaggcccagaugcccacgggguguuucugguuaggcagucagaaacccggcgcggagaguacgugcuaacuuucaacuuucaggguaucgcuaagcaucuccgacugagccuuacagagagaggccaguguaggguccaacaucugcacuuccccagugugguagacauguugcaccacuuucagcggucuccuauuccacucgaaugcggggccgcgugugauguucgucuguccagcuauguggucguggugucgcagcccccgggaucuugcaauaccgucuuauucccuuuuucccugccccauugggacucagagagucucccacacuggggcagcgaacuuggucugccucacuuguccucuagcggguguccccgcggacuaucaccagagggccugcccggcagaaguuccccuccagaacaaaucuuccaucucguuccgagccccgaggagcuggcaaacucucuucagcaccuggaacaugagccugugaauagggcccgggauucagacuacgaaauggauaguagcucccgaucucacuugcgcgcuauagacaaccaguauacgccacucuga

SEQ ID NO: 62440 - RNA, 378 nt, Artificial Sequence
  derived and/or modified sequence opt3 from SH2D1A__Homo_sapiens__NP_001108409
auggacgccguggcugucuaccacggcaagaucagcagagagaccggggaaaaacugcuccuugcaacaggacuggaugguuccuauuuguuaagggacucugagucaguucccggcguguacugccuguguguacuauaucauggguacauuuauacuuaccgggugagucagacggaaaccggaagcugguccgccgagacagcgccuggcguccacaagcgcuauuuccgaaaaauaaagaaccucaucucugcuuuucaaaaaccagaucaggguauugugaucccgcugcaguaccccguugaaaagaagucgucagcccguagcacucaggggauuagagaggacccugaugugugccuuaaagcaccauga

SEQ ID NO: 62441 - RNA, 1200 nt, Artificial Sequence
  derived and/or modified sequence opt3 from SH2D2A__Homo_sapiens__NP_001154913
auggaguucccccuggcccagaucugcccucaaggcagccacgaggcuccaauuccgaccuuuuccacauuccagauaacugacaugacgagaaggucuugucagaaccucggguacaccgcagccucaccccaggcgccugaggcugccaguaauacaggaaacgcagaacgggccgaggaagugccaggugagggcagccuuuuucugcaagcugagacucgcgcaugguuccagaagacccaggcccauugguuguuacagcacggggcugcccccgcgugguuucauggauucaucacacgacgugucagaccuccacuguccguuacccacagggaagcagagcggcuacucgaacccaaaccucaaggcugcuaucuggugcgcuuuucugagucggccguaacuuucgugcuuacauacagaucaaggaccuguugccggcauuuucuguuggcucagcuccgcgauggucgacacgucgugcugggggaggacagcgcccacgcaagacugcaggaucucuuacugcauuauacggcucacccacuuaguccguacggagaaacuuugaccgagccccuggccaggcagacaccugaaccagcgggccuaucccuccggacugaggaaucuaauuucggcagcaagucccaagaccccaacccucaguauucaccaauuaucaaacaggggcaagcccccguuccgaugcagaaggagggagcaggcgagaaagaaccuagucagcugcuucgucccaagccaccuauucccgcuaagccacagcugcccccugagguguacaccaucccagucccgcgccauagacccgccccuaggccaaaacccagcaauccuauauauaacgaaccagaugagcccaucgcuuuuuacgccaugggccgggggucuccgggagaagcaccuuccaauauuuacguggagguagaggacgaaggcuugccagccacacucggucaccccguucugcgaaagucauggagccgcccugugcccgggggacaaaacaccggcggcagucaguuacacucugaaaauuccgucaucgggcagggaccaccucugccccaucagccaccgccugcuuggagacacacgcucccccauaaccuuagcaggcaagugcugcaggaucggggucaggcgugguugccacuaggucccccucaguga

SEQ ID NO: 62442 - RNA, 1731 nt, Artificial Sequence
  derived and/or modified sequence opt3 from SH2D3A__Homo_sapiens__NP_005481
augcaagugccccaggacggcgaggaucuggccgggcagccuugguaccacggacuccuuagcagacagaaggcugaagcacuguugcagcaaaacggugacuucuuagucagggccuccggcucucgcgggggaaauccaguuaucucaugccgguggcgaggcagugcgcugcauuuugagguguuccguguagcucuaagaccgaggcccggucggccuaccgcccucuuucagcuggaagaugagcaguucccaagcauucccgcacuugugcacuccuauaugacagggcgcagaccucugucucaggccacuggagcugucgugucgaggccaguuacguggcaaggccccuugcggcgcucauuuagcgaagacacccucauggauggcccugcacgaauagagccacugagagccaggaaauggaguaacucccagccggcugaccuggcccauauggggcggucucgugaggaucccgcgggaauggaagcaagcacaaugccuaucuccgcccucccacgcacuucaagugaccccguguuacugaaggcuccugccccacuugguaccgucgcagauagcuugagagcuucugacggccagcugcaggccaaagcgcccacaaagccgccuaggacccccuccuucgagcuaccagaugccucagaacggccucccacuuacugugagcucgugccacgaguacccagcguucaagggacaaguccuucucaguccugcccagagccggaagcacccuggugggaggcugaagaggacgaagaggaggaaaaucgcuguuuuaccagaccucaggccgagauuagcuucugcccacacgaugcucccucgugucugcuuggaccucaaaacaggccacuggaaccccagguguugcauacgcuccggggccuguuuuuagagcaccacccggguucuacugcccugcaucuccuucuggucgacugccaggcaaccggguugcuaggagugacacgcgaccagagaggcaauaugggcguguccucagggcuggaacuccugacucuuccucacggacaucaccugagguuggagcuccuggagcgucaccaaaccuuagcccuggcuggugcgcuagcaguccucggcuguagugggccacuggaggaacgggccgcugcccuucgaggauugguugaacuggcacucgcccugagacccggcgcugccggugaucuuccugggcuggcagcggugaugggcgcuuugcucaugccccagguaagcaggcuggagcauacauggcgccaguuacggagaucccacaccgaagccgcacuggccuucgagcaggagcuaaaaccacucaugagggcucuggacgaaggagccggcccuugcgaucccggggagguggcacuuccacaugucgcuccgauggugcgcuugcuggaaggagaggagguugccgguccucucgacgaaucuugugagcgacuguuacggacgcugcacggcgcgcgucauauggugagagaugcccccaaguuuaggaaggucgcugcacaacgccuucggggguucagaccaaaccccgaauugagggaggcccucacuacaggauuugugcgacgccugcuauggggcagccggggugcuggggccccuagagcagaaagguucgagaaauuccagcguguacugggcguucucucacagcgccuggagccagaccgguga

SEQ ID NO: 62443 - RNA, 2109 nt, Artificial Sequence
  derived and/or modified sequence opt3 from SH2D3C__Homo_sapiens__NP_001136005
augaccgagagaugcagccugugguccgcccucucugcugcagccuguugcuucuacaggggcucauuugugcagguccaauucaguaaggaaaaauauauccuugacagcucccccgagaagcugcacaaagaauuggaggaagaguuaaagcugucuucgacagaucuacggucacaugcgugguaccacgggcgcauuccucgagagguuagcgaaacucucgugcagcguaacggagacuuucugauaagagauagucuuacgucccugggugacuauguauugaccuguagguggcggaaucaggcucuccauuucaaaaucaacaagguggucgugaaggccggcgagucuuacacacacauucaguaucuguuugaacaagagagcuucgaucauguuccagcacuggugcgcuaccacgucggguccagaaaagccgugucagagcagaguggagcuaucauuuauugcccgguaaauaggacuuuuccccuccgguacuuagaagcaagcuacggccugggucaggggucuuccaagccugccucaccaguuagccccaguggaccuaaaggcucucacaugaagcgccgauccgugaccaugacagacggccuuaccgcugauaaagucacuagaagcgacggguguccaacaucgaccucuuugcccaggccucgggauuccauccguucaugcgcccugaguauggaccagauaccagaucuacauagcccgaugucccccaucucugagagcccuucaaguccagcguauuccacggugacucgcgugcacgcagcccccgcugccccuagcgcaaccgcucucccagccucucccgucgcgagaaggucaagugaaccgcaacuguguccuggaagcgcccccaagacacauggugaguccgacaagggcccacacacuucuccuucgcacacccuugggaaagcaagccccuccccaucacugaguucuuacagcgaucccgacuccggacauuauugccaguugcagccuccaguucggggcucacgagaaugggcugccacagagaccagcucucagcaagcucgcuccuacggugagagacucaaggaacugagugagaacggggccccggaaggagacuggggcaaaacguucacugugcccauuguagaggugacaagcucuuuuaauccugcaaccuuccaguccuuacugaucccaagggauaaccggccccucgaagucggccuucugcgcaaggugaaagaguugcuagccgagguugacgcuagaacucuggcgaggcacgugacaaaggucgauugucucguggcacguauucuggggguaaccaaagaaaugcagacgcuuaugggaguucggugggguauggagcuguugacccucccucauggccgacaacugagauuagaccugcuagaaagguuucacacaaugucaaucaugcucgccguggauauacuggggugcacuggaagugcugaggaacgcgccgcacuuuugcauaagaccauucagcuggccgcugagcuccggggcacaauggguaauauguucagcuuugccgcagucaugggggcgcuggacauggcucagaucucgagacuugagcagacuugggugacccugaggcaacgccacacagaaggcgccauuuuguaugagaagaaacucaagccauuccugaaauccuuaaacgaaggaaaggaggggcccccgcugucuaauaccacuuucccucacguccuaccacucaucacgcugcuugagugugauagcgcacccccugaaggccccgagccauggggaucaacagaacaugguguggagguuguguuggcccaccuggaagcugcccgaaccguagcacaucacggcgggcucuaccacacuaacgcugaggucaaacugcagggauuucaggcccggccugaguuacuggaaguguucaguaccgaguuucagaugcgucuuuuguggggcucccaaggugcgucuagcucccaggccagaagguaugaaaaguucgacaagguucucacagcucugucacauaaacuagagcccgcagugcgcagcagugaacuguga

SEQ ID NO: 62444 - RNA, 1365 nt, Artificial Sequence
  derived and/or modified sequence opt3 from SH2D4A__Homo_sapiens__NP_001167630
augcugaagcagauccucagcgagauguacauugaccccgaucuucuggccgaauuguccgaggaacaaaaacagauauuauucuuuaagaugagagaggaacagaucaggcgguggaaagagcgcgaggcugcaauggaacgaaaggagucucugccugugaaaccacguccgaagaaggaaaacggcaaaucaguccacuggaagcuaggggccgacaaagagguuuggguguggguaaugggagagcaucaccucgauaagcccuaugacgugcugugcaaugaaauuaucgcggagagagcuaggcuuaaagccgaacaggaggcagaagaaccucggaagacccauagugaggaguucacaaacagccugaagacuaaaucccaauaccacgauuugcaggccccagacaaucagcagacgaaggauauuuggaaaaaggucgcugagaaagaagaacucgaacaagguucucgccccgcaccuacccuggaggaggaaaagaucagaucgcugucaagcaguuccaggaacauacagcagaugcucgccgacucuaucaaucggaugaaggcuuaugccuuucaucagaaaaaggagagcaugaaaaagaaacaagaugaagagauuaaccagaucgaagaggagcgcacaaagcagauuuguaaauccuggaaggaagacucagaguggcaagcgaguuuacgaaagagcaaagcagccgaugaaaagagaaggucucuggcuaaacaggcccgggaggacuacaagcgucuuuccuugggcgcacagaaagggcgcggaggcgagagacugcagucaccacuaagggugccccaaaagccugaacggccaccgcugcccccuaagccacaguuccucaauagcggugcuuauccccagaaaccucuucgaaaccaggggguugugcgcacucugaguucuuccgcccaagaggauaucauaagaugguuuaaggaggagcaguugccacucagggcgggauaccagaaaaccagcgacacaauugcccccugguuccacggcauccugaccuuaaagaaagcaaaugaacugcuccuuucgacuggcaugccggggucuuuucugauucgggucuccgagcgcaucaagggauaugcuuugucauaccuaagugaggacgguugcaagcacuuccugaucgaugccagcgcugacgccuacuccuuucucggcguggaucagcugcaacaugcaacacuugccgaccugguagaauaucacaaagaggaaccuauuaccucuuuggggaaggagcuccuguuauaccccuguggacagcaggaucagcugccagacuaucuagaacucuucgaguga

SEQ ID NO: 62445 - RNA, 930 nt, Artificial Sequence
  derived and/or modified sequence opt3 from SH2D4B__Homo_sapiens__NP_001139191
augcugcccgaggacagcggcggguccccugaugccgcugcaucugacaagcacauccaguggcuccuuggagccgauggugaagugugggucuggauuaugggcgaggggccaggagacaaaccguacgaagagauaucagaagaacugaucgcggagagagcuagguugcaagcccagcgggaagcagaggaauuauggcgccagaaggaggccgagauuaccaaaaaguuccgagaugcucuggcaaacgaaaaagcccguauccuagcugagaaguggaagguugaaauggaggacagaaaagccgcgaaggugcucgaagagaggauucaugaggaauuuaaacggaaggaggaagaggaacgcaaaagaggcgaggagcagaucaggcugcaagaagaacagcgggcaaaggaacuuuauuggacacugaagcaggcccaguugcacugccaagcuagugagaaagaggagcgcgagugggaggagcagcuccgaagaagcaaggccgcagaugaagagaggucccggcgugcucagcgcgccagagacgaguacaggcaucacucucugcgggcgauacagaaagguacuguagccgggcugucgucaauguuccgagaacucggacaaagccaugagcaggaagcacgcuuauaucaccaucugcccgauccuggccuuccacagcccuuggcucugccugugaguagaacgugggagaggccacuacggcccgucucccgcgacgugaucguuagaugguuuaaggaggaacaacucccuaggcgugccggcuucgagcggaauaccaaauuuauugcuccaugguuccacgggggaaacuaccacuguuuucgaagaagggugacaucugguacucugcgcaccgaaggccagccgacacggcuucccagcgucguguga

SEQ ID NO: 62446 - RNA, 387 nt, Artificial Sequence
  derived and/or modified sequence opt3 from SH3BGR__Homo_sapiens__NP_001001713
augagagagaacgugcccggcgaaaagaaaccucagaaugggaucccacugccgccccaaauuuucaacgaggaacaguacugcggagacuuugauagcuucuuuuccgccaaggaggaaaauauaaucuauucuuuccucggucuugcuccuccacccgacucaaaaggcagugagaaggcagaggaagggggagagaccgaagcccagaaagagggcagcgaggaugucgguaaccugccugaagcgcaggagaagaaugaagaggaaggggagacagcuacugaggaaacggaggaaauugccauggagggagcagaaggcgaggccgaggaagaggaagagaccgcugaaggcgaggagccaggggaagacgaggauuccuga

SEQ ID NO: 62447 - RNA, 324 nt, Artificial Sequence
  derived and/or modified sequence opt3 from SH3BGRL2__Homo_sapiens__NP_113657
auggugaucagagucuucauugccagcuccucuggcuuuguugcuauaaagaaaaagcagcaagacgugguaagguuccuggaggcaaacaaaaucgaauuugaggaaguggauauuaccaugucagaggaacagcggcaguggauguacaagaaugugcccccugagaaaaagccaacacaggggaacccgcuucccccucaaaucuucaauggagaccgcuauugcggugauuacgacagcuuuuucgagaguaaggaauccaacacugucuuuucuuuccucggccugaaaccacgauuggccucgaaggcggagcccuga

SEQ ID NO: 62448 - RNA, 345 nt, Artificial Sequence
  derived and/or modified sequence opt3 from SH3BGRL__Homo_sapiens__NP_003013
auggugaucagagucuacauugccagcuccucuggcucaaccgcuauaaagaaaaagcagcaagacguucugggguuccucgaggcaaacaaaaucggauuugaagagaaggauauugccgcgaaugaagagaacaggaaauggaugcgggaaaaugugcccgagaacagucgcccugcuacagguuauccacuuccgccccagaucuucaaugagagccaguaccgaggcgacuaugaugccuuuuucgaagcacgugagaacaaugccguauacgcuuuucugggguugacugcaccuccaggauccaaggaagccgaggugcaggcuaagcaacaggccuga

SEQ ID NO: 62449 - RNA, 2106 nt, Artificial Sequence
  derived and/or modified sequence opt3 from SH3BP1__Homo_sapiens__NP_061830
augaugaagagacagcugcacaggaugcggcaacucgcccagaccggcagccuugggcgcacacccgagacugcugaguuccugggagaggacuuguuacagguggaacagcgacuggagccugcaaaacgugccgcgcauaacauccacaagagacuacaggcuugccuccaaggucaguccggcgccgauauggacaaaagggucaagaaacugccacuuauggcacugucuacgaccauggccgaaucauuuaaggaguuggauccggacaguagcauggggaaggcucucgagauguccugugcaauucagaaucaacuggcccggauacuggcugaguucgaaaugacacucgaacgcgauguuuuacagccccugucuagacuuucggaggaggaauugccugccauccugaaacauaagaaaucacuacagaagcucgugagcgacuggaacacucugaaaaguaggcuuucccaggcgaccaaaaauucuggaagcucccaaggccugggugggucaccaggaagucacagccauacaaccauggcaaacaagguagagacuuugaaggaagaggaagaggagcucaagcggaaaguggaacagugccgcgaugaguaccuggccgacuuauaucacuuugucacaaaggaagauucuuacgcuaauuauuucauucgacugcucgagauccaggccgacuaccacagaaggucccuuucaagccuggauaccgcauuggcugaacuacgggagaaccauggccaagccgaccacagucccucuaugacggcgacucauuuuccucguguguauggcguuucccuggccacccaccuccaggagcuggggcgcgaaauugcacuuccaaucgaggcuugugugaugaugcuguugagcgaaggaaugaaagaggaaggucucuucagacuggccgcuggcgccucggucuuaaagaggcugaaacagacaauggcaucugauccccacucccuagaggaguuuugcucagacccucaugccguggcuggggcgcucaagaguuaccugcgggaacuuccagagccguugaugacuuucgaccuguaugaugacuggaugcgagcagccagccucaaggaacccggagcucgccugcaggcccuucaagagguauguuccagacugccuccagagaauuugucuaaccucagguaccugaugaaauuuuuagcacggcuggccgaagaacaggaaguuaauaagaugacccccagcaacauagcuaucgugcuaggcccuaaucuccuguggccacccgagaaagaaggugaucaggcccagcuugacgcagcgucagucaguuccauucaaguggugggggucguugaggcuuugauccagagcgccgauacacuguucccgggagacauuaacuuuaaugugucuggccucuucucagcaguaacccugcaggauacggugagugaccgcuuagccagcgaggaacugccuuccacugcuguccccacaccagccaccacuccugcacccgcuccagcccccgcgccugccccagcuccggcacuugccucugcugccacaaaggagagaaccgaaucggaggugcccccuaggccagcaagccccaaaguuacgcguuccccuccagaaaccgcggcccccguggaggauauggcucggcgaacaaagagaccggccccugcaaggccaacuaugcccccuccccaggucucaggcagucgcucuagcccuccagcucccccauugccgccuggguccggaucacccgguaccccacaagcccucccccggagacuggugggcagcucucuaagggcaccuacaguaccacccccucugccgccaacucccccucagccagcccgccgacagucccggcguagucccgcuagcccuucuccggcgucccccgggccagccucaccuagucccguuagccucucgaacccagcacagguggaccugggagcugccaccgccgagggcggugcuccugaagcaaucuccgggguccccacaccaccggccauaccuccccaaccaagacccaggucucuugcgagcgagaccaauuga

SEQ ID NO: 62450 - RNA, 1770 nt, Artificial Sequence
  derived and/or modified sequence opt3 from SH3BP2__Homo_sapiens__NP_001139327
auggccagccugggccccagaaccccugcuccauccaggucucgggggcgccgagcaaugugcugggugucaacaaucaguuucauggccgcggaggaaaugcacuggccgguccccaugaaggcuauuggagcccagaaccuccuuacuaugccugguggcguugcaaaagccggguaccugcauaagaaaggaggcacgcaauugcaguuacugaaguggccacuacguuuugugauaauccacaaaagauguguauauuacuucaagagcuccaccucugcuucgccccagggugcauuuucacucagcggguauaauagggugaugcgggccgcugaggaaacaacuagcaacaaugucuucccuuuuaagauuauccauauuuccaaaaagcaccgcaccugguucuuuucugccagcuccgaggaagagagaaaaucauggauggcgcugcuuaggcgggagaucggacauuuccacgaaaagaaagaccugccauuggauacaagugacaguucuuccgauaccgacucauuuuacggcgcaguggagcgccccguugauauaagccucaguccuuauccaacugacaacgaagauuacgagcacgacgaugaggacgauucuuaucuggaaccggacucccccgagccuggccgacuggaagaugcccucaugcauccacccgcuuacccuccacccccggugccuacacccagaaagccagccuucagcgacaugccuagggcacacucguuuaccucuaaggggcccggaccauuacugcccccuccaccgcccaaacauggucuuccugacgucggcuuggcugccgaggauuccaagcgggacccacugugcccccgucgcgcggaaccuuguccaagagugcccgccacgccgaggcggaugucagauccuccacuaaguacuaugcccaccgcaccugggcuccgaaaacccccaugcuuccgcgagagcgcuuccccuucucccgagccauggacaccgggacacggcgccuguagcacuucaagugcugccaucauggcaaccgccacauccagaaauugcgacaagcugaaaucuuuucaccuuagcccuaggggucccccaaccucagaacccccuccaguacccgcuaacaagccuaaauuccugaagauugcggaggaagauccgccacgggaggcagccaugcccggguuguucguuccuccaguggcuccccgcccuccggcccucaagcugcccgucccagaagcaauggccagaccugcuguguuacccaggccagagaaaccucagcugccccaucuccaacguaguccaccggacggacagagcuuucgguccuucucuuuugagaagccucgacagcccucgcaggccgauacgggcggcgacgauagcgacgaagauuacgagaaagugccacuucccaauuccgucuucguuaacacuacagaaucaugugagguggaaagacuguuuaaggcaaccaguccuaggggagagccacaagacggguuguauugcauccgcaauucuagcacuaaauccgguaaggugcuaguagucugggacgagacaucaaacaaggugcggaauuacagaauuuucgaaaaagauagcaaguuuuaucuggagggcgaaguucucuucgugucugucggguccaugguggagcacuaccauacccacguacugcccagucaucagagccuucuguugaggcacccuuauggauacacgggcccgcgcuga

SEQ ID NO: 62451 - RNA, 2892 nt, Artificial Sequence
  derived and/or modified sequence opt3 from SH3BP4__Homo_sapiens__XP_011509196
auggccgcucagagaaucagggcagccaacagcaauggccugccccggugcaaguccgaggggacccucauugaccuuucugaaggauucucagagacaaguuuuaacgauauaaaagugccuagcccauccgcgcuguuggucgacaauccgacucccuucgguaacgcuaaggaaguuaucgccauuaaagauuacuguccuacgaauuuuaccacauuaaaguucucuaaaggcgaccaccuguaugugcuagauacuucgggaggagaguggugguacgcacauaacaccacagaaaugggcuauaucccaucaagcuacguacaaccccucaauuaucgcaacaguacccuguccgacucugguaugauugauaaucuuccugacagcccagaugagguggccaaggagcuggaauugcucgggggauggacugacgauaagaaaguccccggccgaauguacuccaacaauccuuuuuggaacggcgugcagacaaauccauuccugaacgggaauguuccggugaugcccucacuggacgagcucaacccuaagaguaccgucgauuuacugcuuuuugacgcuggaacgagcucuuucacugaauccucaagcgcaaccacaaacaguacugguaauaucuuugacgaguugccagugaccaacggccugcacgccgagcccccuguacguagagauaauccauucuuuaggucuaaacgguccuauagccuaucggaacucucuguucugcaggcuaaguccgacgcccccacaucaaguagcuucuuuaccgggcuuaaauccccggcgccugagcaguuccaaucucgcgaagauuucagaacggcauggcugaaccauaggaaguuggcccggagcugccacgaccucgaucuguuaggacagucacccggcuggggucagacucaggcuguggagacaaauauagucuguaagcuggacaguuccgggggagccgugcaacucccagauaccagcaucucuauucaugugccugaaggccacgucgcacccggcgagacucagcagaucucaaugaaagcccuucuggacccacccuuggagcuaaacagugaucgcagcugcuccauuucuccuguucuggaagugaagcucucgaaucuggagguaaaaacaagcaucauacuugaaaugaagguguccgcugagauuaaaaacgaccuguuuucaaagaguaccgucggguugcagugucuccgaucugauagcaaagaaggaccauacguguccguuccgcugaauugcucauguggugacacggugcaagcgcaguuacacaaccuggagcccugcauguacgucgccgugguagcacauggcccuagcauccuauauccaucuaccguuugggacuucauuaauaagaaggugacagucgggcucuacggacccaaacacauccauccuuccuuuaagacuguggucaccaucuucggccacgauugugcuccaaaaacacugcuugugagugagguuacuagacaggcccccaacccggcuccuguggccuugcaacugugggguaagcaccaguuuguacucagcaggccacaggaccugaaagucugcauguucucuaauaugaccaacuaugaagugaaggcauccgagcaggccaagguugugcggggguuucaacuuaaacugggcaaggucucacguuugauuuuccccauaacaagucagaauccuaacgaacucagcgauuuuacccugcgcgugcagguaaaagacgaucaggaggcuaucuuaacucaauucugugugcagacgccccagccaccucccaagucggcgauuaaaccauccggacagagaagguuucugaagaagaacgaaguuggcaaaaucauacuaucuccguucgcaacaaccacuaaguacccuaccuuucaagaccggcccgucagcucacucaaauucgggaagcugcuuaaaacaguggugcgacagaauaagaaccauuauuugcuggaguacaagaaaggagaugguauugcccuccugagugaggaacgcgucagauuaaggggccagcuguggaccaaggagugguauaucggguacuaccagggacggguuggccuugugcacacuaaaaauguguugguagucggucgcgcuagaccaucccucugcucugggcccgaacugagcacauccgugcuacuggagcaaauccucaggccuugcaaguuccugacguauauuuacgccucaguucguacccuuuugauggagaacaucagcaguuggcggucuuuugcagacgcccugggcuaugugaauuuaccacucacuuucuuuugucgagcugaacuggauuccgagcccgaaagagucgccagcgugcuugagaaacugaaggaagacugcaacaauacagagaacaaagagaggaagucguuccagaaggaauugguuauggcacuccugaaaauggauugucaggggcuagugguacgccugauucaagacuuuguccuccugaccacagcgguggagguggcucagcgguggagagaacuugccgagaaguuggcaaaagucucaaagcagcagauggaugccuacgaaucuccucauagggaccgcaauggcguuguggacagugaggcuauguggaaaccggccuaugauuuccuguuaacuuggucccaccaaauaggggacagcuaccgagauguaauccaggagcuccaucugggacuugacaagaugaagaacccaauuaccaaacgguggaagcaccugacggguacccuaauccucgucaauucucuggauguguugcgugcagcugccuuuagccccgcggaccaggaugacuucgugaucuga

SEQ ID NO: 62452 - RNA, 897 nt, Artificial Sequence
  derived and/or modified sequence opt3 from SH3BP5__Homo_sapiens__NP_001018009
augcugaaccacgccacccagagagugauggaggcugaacaaacaaagacuaggagcgagcucguccauaaagaaacggcagcccgguacaaugcggcuaugggccgcaugcgacagcuugagaagaaacugaagcgugccaucaacaaauccaagcccuauuucgaauugaaggcaaaauacuauguucaguuagagcagcugaagaaaaccguggacgaucuacaagccaagcucacacuggcuaaaggggaguacaagauggcacuuaagaaucuggaaaugauuucugacgagauacacgaaagaaggcggucaagugccaugggaccucgcgguugcggcguaggggcugagggaagcuccacuucuguggaggauuugccaggcucgaaaccggaacccgacgccaucucagucgcgagcgaggcauuugaagaugacaguuguuccaacuucgugucugaggaugacagcgaaacccaguccguuucaaguuuuagcucugguccuacauccccaucagagaugcccgaucaguucccugccguggucagaccagggagccucgaccugcccaguccugugucucuguccgaguuuggaaugauguucccaguacucggcccgaggagcgaaugcucgggcgcuucuucccccgagugugaaguugagcgcggggaucgggccgaaggagcagagaauaagaccucagacaaagcuaacaauaaccgagguuuaaguagcuccucuggcagcgggggaucaaguaagucccagagcucuacuucaccugagggccaagcccuggaaaauagaaugaaacagcuuaguuugcagugcagcaaggguagggaugggauuaucgcggacauuaaaauggugcagaucggauga

SEQ ID NO: 62453 - RNA, 2373 nt, Artificial Sequence
  derived and/or modified sequence opt3 from SH3D19__Homo_sapiens__NP_001009555
augaacaucaugaauaccgagcagagccaaaacuccauugugucuagaauaaaggucuucgaaggccagacaaauaucgagacuucagggcugcccaaaaagccugaaauuacgccaaggagucucccgcccaaaccuaccguuagcuccggaaagccaucuguggcccccaaaccugcugcaaaccgggccucgggugagugggacucaggcacagaaaaucgccuuaagguaacuagcaaggaggggcugaccccauaucccccuuugcaggaggcgggaaguaucccagugacaaaaccggaauuacccaagaaaccuaacccaggccugauucgauccgucaaucccgagaucccuggucgugggccacuagcugaaucuagcgauuccggaaagaaagugcccaccccggccccuagaccccuccugcuuaagaagucaguuaguagcgagaacccaacuuacccuucugcaccccugaaaccagugacagugcccccuagguuggccggcgcuucccaggcaaaggccuacaaaucacucggcgaggggccaccggcuaaucccccugucccaguacugcaaagcaagccccugguugacauagaucucaucaguuuugacgaugacguguuaccuaccccaucuggaaaccuggccgaagaguccgucgguagcgaaauggugcuugaucccuuccaguugccggcgaaaacggagccuauuaaggaacgggcagugcagccagcccccacucgcaaaccuaccgucaucaggauucccgcuaagccaggcaagugccugcacgaggacccucagucgcccccaccgcuaccugccgagaaacccaucgggaauacauuuucuacuguuuccggaaagcucucaaacguggaaagaacccggaaucuggagaguaaccauccaggccaaacagguggguucguacgcgugcccccucgacuuccacccagaccugucaauggaaaaaccauaccgacgcagcagccacccacuaaggugccuccagaaaggcccccuccgcccaaacugagcgcaacacggcguuccaacaagaaguugccauuuaaccgcucuagcucagauauggaccuccagaaaaagcaaaguaaucuggcuaccggcuuauccaaagccaagagccagguuuucaaaaaccaggauccugugcugcccccaagaccuaagcccggccacccacucuauucuaaguacaugcuuucagucccgcaugggauugcgaaugaggacaucgugagucaaaacccuggagaacugagcuguaaaaggggugauguauugguuaugcuaaagcagacugagaauaacuaucuggagugccagaaaggcgaagacacagggcgggugcaccucucccagaugaagauuaucacaccccuggacgagcaucuucgaucucgcccaaaugaucccucgcacgcccaaaaaccugucgacagcggagcaccacacgcugugguccugcaugauuuucccgccgaacagguggacgauuugaaccucacguccggcgagaucguuuaccuguuagaaaagauugacaccgauugguauagagguaauuguaggaaccagauagggaucuucccugcuaauuacgugaagguaauuaucgacauaccggagggcggaaacggcaaacgggagugcgucucaagucacugugugaaggggucucgcugcguugccagauuugaauacauuggagagcagaaagaugaacugagcuucuccgagggugagaucaucauucuaaaggaauaugugaaugaggaaugggcaaggggcgagguccgugggcggacaggaaucuuuccacucaacuucguggaacccguagaggacuacccuacuucaggcgccaaugugcugagcaccaaaguuccccuuaagaccaaaaaggaggauucugguuccaacagucaagucaacagcuugccagcugaauggugugaggcgcugcauucuuuuacugcagaaaccuccgacgaccucucauucaagcgaggggauaggauucagauacuggagagacuugacagugauuggugccgcggccggcugcaggacagagaaggaaucuucccugccguguuugugaggcccuguccagcugaggccaaaagcauguuggcaauugucccuaagggccgcaaagccaaggcucucuaugauuuccgaggggagaaugaagacgagcugucguuuaaagccggagauaucaucacagaauuagaguccguugacgaugacuggaugucuggugaacugaugggcaagagcgggauuuucccgaagaacuacauacaguuucuacaaaucucauga

SEQ ID NO: 62454 - RNA, 963 nt, Artificial Sequence
  derived and/or modified sequence opt3 from SH3GL1__Homo_sapiens__NP_001186872
augagcguggccggccugaagaaacaguucuacaaggcuucccaacucgucucugagaaaguugggggagcagaagguaccaaacuugacgaugacuuuaaggagauggaaaagaagguggauguaacaucaaaagccgugacugagguccuggcgagaacgaucgaauauuugcagcccaacccuggcgacgcuuuacuggaugccggggagaguaugaagaggcuagcagaggugaaagacagccucgauauugaaguuaagcagaauuucauagacccacugcagaaccuuugcgagaaagaucugaaggaaauccaacaccauuugaagaaacucgagggacggcgccuggacuuugauuacaagaaaaagcgacagggcaaaauuccggacgaggaacugcgucaggcccucgagaaguucgaagaguccaaagaaguggcugagaccucuaugcacaauuuacuggagacagauaucgaacaggucucgcaacuuucagcauugguggacgcccagcuggacuaucauagacaggcuguacagauucuagaugagcucgccgaaaagcugaagaggcggaugcgcgaggcgagcaguagacccaaaagggaauacaagccuaaaccacgggagcccuuugaccuuggugagccugaacaauccaacgggggauucccauguacuaccgcacccaagaucgccgcuucuagcuccuuucgcucaagugauaaaccuauacgaacaccaagcagaucuaugccgccccuggaccagccuuccugcaaggccuuguaugauuucgagccagaaaaugacggcgagcucggcuuucacgaaggggauguuaucacccugacuaaccagauugacgagaauugguacgagggaauguuagauggucaaucaggcuucuuuccccugagcuauguggaaguccucgugccucuuccacaguga

SEQ ID NO: 62455 - RNA, 1059 nt, Artificial Sequence
  derived and/or modified sequence opt3 from SH3GL2__Homo_sapiens__NP_003017
augagcguggccggccugaagaaacaguuccacaaggcuacccaaaaagucuccgagaagguugggggagcagaagguacaaaacucgacgaugacuuuaaggagauggaaagaaagguggauguaacuucuagggccgugauggagaucaugacgaaaaccauugaauaccuucagcccaacccugcgucacgggcuaagcugaguaugauaaauacaaugagcaaaauccgcggccaggagaaggggccaggauauccgcaggccgaggcauuguuagccgaagcuaugcugaaauucggccgagagcuaggugacgauugcaacuuugggcccgcacucggagaagucggcgaggccaugcgugagcuguccgaagugaaggacucucuugauauugagguuaagcaaaauuucaucgacccucugcagaacuugcaugauaaagaccucagagaaauucagcaccaucugaagaaacuggagggcaggcggcucgauuuugacuacaagaaaaagcgccaggggaaaaucccagaugaagaguuaagacaagcucuggagaaguucgacgaaucgaaggagauagccgaaucaagcauguuuaaucuuuuggagauggacaucgaacaggugagucagcuguccgcgcuaguccaggcacaacucgaguaucacaaacaggccgugcagauucugcaacagguaacuguuaggcuugaggaacggauccgccaggcuucuagccagccccgaagagaguaccaaccuaagccaaggaugucccuggaguuccccaccggagauucaacacagccuaacgguggcuugagucauaccgggacuccaaaaccgagcggagugcagauggaccagcccuguugccgggcccucuaugauuuugaaccugaaaaugagggcgagcuggguuucaaggaaggggacauuaucacauuaaccaaccaaauagaugagaauugguacgaaggaaugcugcacggccacucuggcuuuuucccaauuaacuaugucgagauccucguggcacuuccccauuga

SEQ ID NO: 62456 - RNA, 1068 nt, Artificial Sequence
  derived and/or modified sequence opt3 from SH3GL3__Homo_sapiens__NP_001288038
auggacggcaucuucgccgggauuauaugcaaccaggcuaauagaugucugaccuggacaagccaacagcucuuuuccgagaagaucucuggagcagaagguacuaaacuugaugacgaguuccuggauauggaaaggaagauugacgugacgaacaaagucguugccgagaucuugucaaagaccacagaauacuuacagcccaauccugcguaucgggcuaaacugggcaugcuaaacacugugaguaagauucgcgggcagguaaagaccacaggauacccacaaaccgagggccuccugggugauugcaugcuuaaauaugggaaggagcugggagaagacagcacuuuuggcaaugccuugaucgaggugggcgaauccaugaaacucauggcagaggucaaggauucucuggacauaaacgugaaacagacauucaucgauccgcugcagcucuuacaggacaaggaucugaaggagauugggcaccaucuuaaaaaguuggaaggacgacgucuggacuacgauuauaaaaagaaaagaguugguaagauccccgacgaggaagugaggcaagccgucgagaaauuugaagagucgaaggagcuagcugaacggucaauguucaauuuucucgagaacgacguggaacagguaagccagcuggcaguuuucauugaggccgcucuugauuaccaccgccagaguaccgaaauccugcaagaguugcaguccaagcuccagaugagaauaucugccgcgagcuccgugccuaggcgggaguauaaaccacgccccgucaagcgaucaaguagcgaacugaauggcgugucuacgacuuccguggucaaaaccacagggucaaacauuccuauggaccaaccauguugcagaggauuauacgauuuugagcccgaaaaucagggcgagcuggguuucaaggaaggggacaucauuacucucaccaaccagaucgaugagaauugguacgagggaaugauccauggcgaaagcggcuuuuucccuauuaacuauguugaggugauaguaccacuuccgcaguga

SEQ ID NO: 62457 - RNA, 1887 nt, Artificial Sequence
  derived and/or modified sequence opt3 from SH3KBP1__Homo_sapiens__NP_001019837
auggaggugagcgccgcuaaggcacccuccgccgcggaccugucugaaaucgagauuaaaaaggaaaugaaaaaggauccucucaccaacaaagcuccagagaagccgcuucacgaaguccccucaggcaauagucuguugagcuccgagacaauauuaagaacuaacaagaggggagagcggcgccgacguagaugccagguugccuucucuuaccugccucaaaaugacgaugaacuagagcucaaagugggggacaucauugaaguagugggugaggucgaggaaggcuggugggagggggugcugaacggaaagacgggcauguuuccaucgaauuucaucaaagaacuuucaggugagagcgaugaacuggggauuagucaggacgagcaguuguccaagucuagccucagggagaccacaggauccgaaucagauggcggcgacaguagcucuacuaaauccgagggggcaaacggaaccguugccacagcugcaauccagcccaagaaggugaaaggugucggcuuuggggauauauucaaggacaaaccuaucaagcugcggccacgcucaauugaaguggagaaugauuuucugcccguagaaaagaccaucggaaagaaacucccugccacuacagcuaccccagacagcaguaagacggagauggauucuagaacuaaguccaaagacuauuguaagguuauuuucccguacgaggcccaaaacgacgaugaauuaaccaucaaagagggcgacauagugacacugauuaauaaggauugcaucgacgucgguuggugggaaggggagcuuaacggaaggcggggcguguuucccgauaauuucgugaaauugcugccuccagacuuugaaaaggagggcaaccgccccaagaaaccuccacccccgagcgcgccugucauuaagcagggggcaggaacuaccgagcgaaaacaugaaaucaagaaaauucccccagagagaccugaaaugcuacccaauaggacagaggagaaggaacggccagagcgugaacccaagcucgaucugcagaaaccuucgguuccagccaucccgcccaagaaaccucgcccacccaagaccaacucucuuuccagaccuggugcucugccacccaggcggccggagcgaccugugggcccauugacgcacacucgcggggacucacccaaaauagaucucgccggaaguagccuguccggcaucuuagacaaggaucugucugacagaagcaaugacauugaucucgaagguuucgacucaguagugaguuccacagagaaacuuagccauccuaccacuucuaggcccaaagcaacagggcggcgcccaccuucacagagucugaccagcuccucuuugucgagccccgauaucuuugacuccccaucaccggaggaagauaaggaggaacacauaagucuagcucauagaggcgucgacgccucuaaaaagacgagcaaaaccgugacaauuucccaaguuucagauaacaaggcgagccugccucccaaaccaggaacuauggccgcaggcgggggaggucccgcuccucucucuuccgccgcuccaaguccccugucuagcucccuuggcaccgccgggcacagggcaaacucaccuagucuguucggaacagagggcaagccgaagauggaaccagccgcuagcucgcaggcggcaguggaggaguugcguacucagguccgggaacuccgauccaucaucgagaccaugaaagaccagcaaaagagagaaauuaaacagcuguuaucugagcuggaugaagagaagaaaaucaggcuacgccuccagauggaggugaaugacauuaagaaggcccugcaaagcaaauga

SEQ ID NO: 62458 - RNA, 3318 nt, Artificial Sequence
  derived and/or modified sequence opt3 from SH3PXD2A__Homo_sapiens__NP_055446
augcuggccuacugcgugcaggacgcuaccgucguugauguggagaagagaaggaaccccagcaaacacuauguauacaucauuaaugugacaugguccgacucuacuucacaaacgauauaucggcgcuacaguaaguucuuugaucuccagaugcagcuucuggacaaauucccuaucgaaggcgggcagaaggauccaaaacaacgaauuaucccguuuuugcccggaaagauuuuauuccguagaagccauaucagggacgucgcagugaagcggcugaaaccuauagaugaguauugucgcgcccuaguuagacucccaccccacaucucccagugcgacgaaguguuuagguucuuugaggcgcggccugaagaugucaacccacccaaggaggacuacgguucuucgaaacgcaagucaguguggcugagcaguugggcugaguccccuaaaaaggauguaaccggcgccgacgcaacagccgaaccaaugauucuugagcaguauguuguggucucuaauuacaagaaacaggaaaacagcgagcuguccuugcaagcuggggaggugguggaugucaucgaaaagaaugagucaggauggugguucguuaguacuagcgaagaacagggcugggugccggcaaccuaccucgaagcccagaacgguacacgagacgacucugauauuaauaccuccaaaacuggggaggaggaaaaguauguaacagugcagcccuacaccucacaaagcaaagacgagaucggauuugaaaagggcgucacgguggagguuauaaggaaaaaccuggaaggcuggugguauauuagguaccuggggaaggagggaugggcuccugccaguuaucucaagaaagcgaaggaugacuuaccaacucggaaaaagaaucuggcaggucccguggagaucauuggcaacaucauggaaaucucuaaucuuuugaacaaaaaggccuccggggauaaggagaccccuccagcugaaggagagggccaugaagcccccauugcuaaaaaggagauaagccugccgauccuauguaaugcaucgaacgguucugccgucggggugccugaccguacaguaucccgccucgcgcagggaucacccgccguugcaagaauugcuccacagagggcccaaaucaguagcccuaaucugcggacucgacccccaccccgcagagaguccucucuuggcuuccagcugccuaaaccaccggaacccccuagcguggaggucgaauacuauaccauagcugaguuucagucaugcauuagugauggcaucuccuucagagggggacagaaggccgaggugaucgacaaaaacagcgguggcuggugguacguccaaauuggggaaaaggagggaugggcaccagccucuuacaucgauaagcggaaaaagcccaacuugucacgcagaacaaguacccucacgaggccuaaagugccacccccggcuccuccaagcaagcccaaagaagcggaggaaggcccuacuggugcauccgagucucaggacucgccccguaagcugaaguaugaggaaccagaguacgauauuccugccuuuggguucgacagcgaacccgaguuauccgaggagccaguugaggaccgggcuucaggcgaacgaagaccggcccagccucacaggcccaguccagcaucuagccugcagcgcgcccgguucaaagugggagaguccucagaagauguagcucucgaggaagagacaauauaugagaaugaaggcuuuagacccuacgccgaggacacccuuagcgcaagggggucuuccggagauagugacagcccugguucuuccucacugaguuugacucgcaagaacagcccaaaaucgggcucccccaagucuagcucacuacugaaacucaaggcggagaaaaaugcucaagccgaaauggggaagaaccauaguuccgcaucuuucagcuccucaaucacaauuaauaccacguguugcagcaguucuuccagcucgucaucuagucuguccaagaccagcggagaucuuaaaccucgaucugccagcgacgcuggcauccgggguacaccgaagguccgugccaaaaaggaugcagacgcuaacgccgggcugacuuccuguccaagagcgaaacccucagugaggccuaagccauuuuugaaucgcgccgagagucagagccaggaaaagauggauaucucuacccuccggagacagcugaggcccacaggccaauuacgaggaggccugaaaggguccaagucagaggacagugaacuaccuccgcagacugcuagcgaggcacccuccgaaggaucucgccggucgagcucagaucucauuacccugccagccacaaccccucccugcccaacuaaaaaggagugggaggguccugcuacguccuauaugacauguagugccuaccagaaaguucaggacucugaaaucagcuuccccgcaggcguggagguccaagugcuugaaaagcaggaguccggguggugguauguaagauuuggagaauuggagggcugggcgccaucacacuaccuggugcucgaugagaacgaacagccggacccuucugguaaggagcuggacaccguucccgccaaagggaggcaaaaugaaggcaagagcgauagucuugagaaaauagaacgucgcguccaggcucugaacacugugaaucaguccaagaaagccaccccacccauuccuagcaagccacccggaggcuucgggaagacaucuggaaccccugcagugaaaaugcggaacggcgucagacagguugcugugaggccgcaaucaguguuuguauccccacccccuaaggacaauaacuugaguugcgcccuccgacggaaugagagccugacugcaacagaugguuuacgcggggucagaaggaacucgucuuucuccacggcccggagcgcugcggccgaggcaaaaggacgacuggcugaaagagccgccucacagggcagugacucuccccuacucccagcucagcgcaacuccaucccugugagccccguuaggccaaagccuauugagaaaucacaguuuauccacaauaaccugaaggauguguacgucaguauagcagacuaugaaggugaugaggagaccgccggcuuccaagaaggggugagcauggagguucuugaacguaauccgaacggauggugguacugucagaucuuggacggcgugaaacccuuuaagggguggguaccauccaauuaucuggagaagaaaaacuga

SEQ ID NO: 62459 - RNA, 2736 nt, Artificial Sequence
  derived and/or modified sequence opt3 from SH3PXD2B__Homo_sapiens__NP_001017995
augcccccuagaaggagcaucguggaggucaagguucuggacgugcagaaacggcgcguaccaaacaagcacuacguguauauuauacgagucaccugguccucuggcucaacagaagccaucuaccguagauauaguaaauucuuugaucuccaaaugcagaugcuugacaaguucccgauggaagggggacagaaagaucccaagcagaggauuaucccuuuucugccagguaagauuuuguuccggcgcagccauaucagagacguggcuguuaaaagguuaauacccaucgaugaauacugcaaggcacugauucaacuaccuccauauaucucccagugugacgaggugcuccaguuuuucgaaacucggcccgaggaucugaauccuccaaaagaggaacacauuggcaagaaaaagucugggggagaccagacgucggucgauccgauggugcuugagcaauacguaguuguggccaacuaucagaagcaggaaucaagcgagaucagucuguccgucggccaggugguggacauaauugagaaaaaugaaucugguuggugguuugucagcaccgcggaggaacaaggguggguucccgcuacaugcuuggagggacaggauggcgugcaggacgaguucucccuccaaccugaggaggaagagaaguacacuguaaucuacccauauaccgcccgcgaucaggacgaaaugaaccuggagcgaggcgcaguggucgaagugauucagaaaaaucuggaggggugguggaagaucagauaccagggaaaagaggguugggcccccgcuucauaucucaagaaaaacaguggcgaaccuuuaccacccaagccggggccuggaagccccucucauccaggcgcacuggaccuugaugguguuuccaggcaacagaaugccguggggcgggagaaggaauugcugucaagccagcgugacggacgcuuugagggcagaccuguccccgauggcgacgcuaaacagaggaguccaaagaugcggcaacgacccccuccacgcagagauaugacaaucccgagggggcuaaaccuccccaaaccuccaauucccccucagguggaagaggaguacuauaccauagccgaguuccagacuacaaucccagacggaauuucuuuucaggcgggucugaagguagaaguuaucgagaaaaaucuuuccggcuggugguacauacaaauugaagauaaggaggggugggcacccgccaccuucaucgacaaguauaaaaagacgagcaacgcuucgcggccgaauuuucuggccccuuugccacacgaagugacucagcuccgccugggagaggcagcugccuuagaaaacaauaccggcucugaggcgacaggucccuccagaccucugcccgaugccccacauggggucauggacucaggccucccuuggaguaaagauuggaagggaagcaaagacgugcuuaggaaggcauccucugacaugagcgcuucagccggcuacgaagagaucagugaucccgacauggaggaaaagccaucccugccgccucguaaagagagcauuaucaagucugaaggggaguugcuagaacgggagcgagagagacagaggacugaacagcugcgcggacccaccccaaaacccccuggugucauucucccaaugaugcccgcuaagcacauaccuccggcccgggauucaagaaggccagagcccaaaccugacaagagucgccuguuccaacuuaagaacgauaugggccuggaaugugggcacaaaguguuggcaaaggagguuaaaaagccaaaucuccgacccaucagcaaauccaagacagaccugccugaagagaaaccggaugccacgccccagaacccauucuuaaagucucggccucaggugcgucccaagccagcuccuucgcccaaaaccgagccaccgcaaggagaagaccagguagauauuugcaaccugagaagcaagcuaaggccugcgaaaucccaggacaagucacuccuggauggcgaggguccccaggcagucgggggccaagacguggccuuuagucgcucuuuccuuccaggagaaggccccgggcgggcucaggauagaacuggaaaacaggacgguuugagcccuaaggagaucuccuguagggccccaccccgaccugcaaagacaaccgacccgguuucaaaaagcgugccagucccccugcaggaggccccucaacagcgccccgugguaccaccucggagacccccaccuccgaagaaaacuucuuccaguagcaggccccucccagaagugcguggcccucagugcgaggggcaugaaucucgcgcugcccccacaccaggacgggcacugcuuguuccucccaaggcgaaaccguuucuguccaauucauugggcggucaggaugacaccagagggaagggcagucucggaccauggggcacggggaagaucggagagaacagggaaaaagcugccgcagccagcgucccuaaugcugauggccugaaggacucguuauacguggccguggcagauuucgagggugacaaagauaccuccucuuuucaagaggggacagucuucgaaguucgagagaagaacagcucaggauggugguuuugucaggugcugaguggcgcucccuccugggaagguuggauuccaucuaauuaucuacggaaaaagcccuga

SEQ ID NO: 62460 - RNA, 2667 nt, Artificial Sequence
  derived and/or modified sequence opt3 from SH3RF1__Homo_sapiens__NP_065921
auggacgagagcgcccugcucgaucuucuggaaugccccguguguuuggagagauuagacgcuuccgcaaagguccugccuugccagcacaccuucuguaaaaggugccuacucggcaucguugggucucggaacgaacugcgcuguccagagugccgaacacuugugggaucagguguagaagaacugccgaguaauauuuugcucgugcgucugcuggauggcauaaagcaaagacccuggaaaccugggccaggaggcgguagcgggacuaacuguacgaaugcccucaggucccagucuucgaccgucgcgaacugcucaagcaaggacuuacagaguucccagggaggccaacagccccgggugcagucuuggagcccuccaguucgcggcaucccccagcugccuugugcuaaagcccuuuacaauuaugaggggaaggaaccaggagauuugaaguuuuccaaaggugacauuaucauucugagaaggcaaguggaugagaacugguaccauggcgaagucaaugggauccacggauucuuuccgacaaacuucgugcagauaaucaagccccuaccucagccacccccucagugcaaagcacucuaugacuuugagguaaaggauaaagaggccgacaaggauugucugccauucgcuaaggacgauguucuuacugugauucggcgcgucgacgaaaauugggcagagggcaugcuggccgacaaaaucgguauuuuucccaucucauacguggaguucaacagugcugccaagcaauugauagagugggauaaaccgccugugcccggggucgacgcgggagaaugcagcucugcagccgcucaguccucaaccgccccaaagcauagcgauacuaaaaagaauaccaaaaagcgacacaguuuuacuucucucacaauggcaaacaaguccagccaggcuucgcaaaauagacauucuauggagauuuccccucccguucugaucucaaguagcaacccaaccgccgcggccaggauuuccgaguuaucuggccugagcugcucagcacccagucaggugcacaucuccacgacuggccucaucguaaccccuccaccgagcucucccgugacaacugggccuucauucaccuuuccaagugacguccccuaucaggcugcccuuggaacacugaauccuccauugcccccgccuccacuacuggcugccaccgugcucgcaagcacgcccccuggugccacugcugcggcagccgcugccggcauggggccccggccaauggcaggauccacagaucagauugcccaucugcguccucaaacccgccccucuguuuacguggcuauauauccauacacuccgagaaaagaagacgagcuugaacugaggaagggcgagauguucuuggucuuugaacggugucaggaugguugguucaaagggacaucgaugcacaccagcaagaucggcguguucccuggaaacuacguagcccccguuacgcgagcagugaccaacgcgucccaggcuaaagucccaaugucaacagccggccagacaagucgcggggugaccauggucucucccagcacagcaggagguccugcccaaaagcuccagggcaaugggguggcuggauccccaucaguugugcccgccgcaguagucagcgcugcccacauucagacuucuccucaggcgaaggugcuguuacauaugaccggccaaaugacaguuaaccaggccagaaaugcugugaggaccgucgcagcccacaaccaggagcggccgacugcugccgugacgccaauccagguacaaaaugcagcgggucugucccccgccaguguggggcuaagccaccauucucucgcuuccccucagccagcaccccugaugccuggcucagccacacacaccgcugccauaaguauuagccgcgcaucggccccgcuugcuugcgcggccgcagcucccuugacuuccccaucuaucaccagcgccucacuggaggccgaaccuaguggaagaaucguuacaguccuccccggccugccaaccuccccugacucugcuagcuccgcaugugggaacucaagcgccacuaaacccgauaaggacaguaaaaaggagaaaaagggacuucugaaguugcucucuggugcguccacaaaaaggaagccacgugugagcccgccugcuucgcccacgcuggaaguggaguuaggcucagccgaacugccacuacagggggcagucggacccgagcucccuccaggcggugggcauggccgggccggaucuugccccguugauggcgacgggccugugaccacugcuguggcaggagccgcgcuggcucaagacgccuuucaccgaaaagcaaguucccuugauagcgccguaccgauugcuccacccccuagacaggccuguucuagcuugggccccguccugaaugaguccaggccagugguuugcgaacgccaucggguggucgugucauauccuccccagagugaggcagaacucgagcugaaggagggugacaucguuuucgugcacaaaaagagagaagaugggugguuuaagggaacauuacagaggaacggcaaaaccggucuguucccaggcagcuuuguagagaauauuuga

SEQ ID NO: 62461 - RNA, 2649 nt, Artificial Sequence
  derived and/or modified sequence opt3 from SH3RF3__Homo_sapiens__NP_001092759
augcugcucggcgccagcuggcuuugcgcuuccaaggcagccgcggcugccgcacagucugagggggacgaagauagacccggagagaggcggcgccgacgugccgcugcaaccgccgcuggugccggcgaagacauggaugagucaagucuguuggacuuacuggaauguagcgugugccuagagagacucgauacaacugcgaaaguccugccuugucaacacacguucugcaggcggugucuugaguccaucguuugcucucgccaugaacugagauguccagagugcaggauuuuggugggguguggaguagacgaacucccggcaaacauacugcuggugcggcucuuagauggcauccgccagcgacccagagccgguaccucgccugggggaucaccacccgcuaggccuauuccaggccagagcgccgcacccacacuggcuggcgggggagguggcgccgcggggaguacuccuggauccccagucuuucuuucugccgcagcuggcagcaccgccgguuccuugcgggagcuggcuacaucacguaccgccccggcagccaagaaucccugccuacucccuuacgggaaagcucuguauaguuacgagggaaaggaaccaggcgaccuuaaauucaacaagggcgauaucauugugcugcgcagaaagguugacgagcagugguaucacggggaauugcauggaacucaagguuuucuccccgcgagcuacauccaguguauacagccucugccacacgcacccccgcagggcaaagccuuauaugauuucgagaugaaggacaaagaucaagacaaggacugccugacauuuaccaaagaugaaauccucacggugcuuaggcgggucgacgagaauugggcugaggggaugcugggagauaagauuggcaucuucccuuugcuauacguggaacugaacgacucugccaagcagcucauugagauggauaaacccugcccagcagccgcuuccucauguaaugccagccugccuagugacucuggugcaguagcguccguugcucccagcccaacucuuucgucuuccggggccgugucagcauuucagcgacgcgucgauggcaagaaaaacaccaagaaaagacauaguuucacagcccugagcgugacucacagguccucucaggcugccagccaccggcauucaauggaaaucagugcacccguguugauauccagcucugacccucgcgcugccgcgagaauuggagaucucgcccaccugucaugcgcugcaccaacccaagacgucaguagcuccgccggcucuacaccgaccgcuguucccagggccgcaucggugagcggggagcagggaacgccuccaaagguacaguuaccccugaauguguaucuagcgcucuacgccuacaaaccucaaaaguccgaugaacuggagcuucauaagggugagauguaucgugucuuggaaaaaugucaggacggcugguuuaagggggcuucacugcggacuggagugaguggcguuuucccagguaacuacgugacacccgucucucgagugccggccgggggcgcaggaccuccaagaaauaacguaguuggcgggagcccccucgcuaaaggaaucaccacuacaaugcacccugguuccggcucacugagcucucuugccaccgcaacgaggcccgcccugccaauuaccacaccucaggcucacgcgcagcaucccacugccuccccaccgaccgggaguugcuugcgccacagcgcacaaccuacagcuucucaggcccgguccacuaucucaaccgccgcucauagugcagcccaggcgcaggacagacccacagcuaccgugagcccacucaggacucaaaauucgcccucccgccugccugccacgucuuuacgaccacacagcgucgugucaccccagcauagucaccagccuccgguccagauguguccacggcccgcaaucccucugacauccgccgcuucugcaauuaccccacccaacgugagcgccgcgaaucuaaacggagaggcuggcggugggccuauaggcguucucuccacuucaagcccgaccaauacaggaugcaagcuggaugaaaagaagagugagaagaaagaaaagaaaucuggccuuuugaagcugcucgccggggcauccaccaaaaagaaaagccguucgcccccaucagugucuccuacucacgacccccaaguagccgucgaugcucuguuacagggagccgugggcccagagguuaguucccugagcauccaugguagagcagggucuuguccuauugagagcgaaaugcagggagcuaugggcauggagccccuucacaggaaagccgguuccuuggaccucaacuuuacaucaccaagucgccaggcgccgcugagcauggccgcaauccggccugaacccaagcuacugccaagagagagguaucgaguggucgugucuuaucccccucaauccgaggcugaaauagagcucaaagaaggcgauauuguauucgugcauaagaaacgcgaggacgggugguacaagggaacgcugcagcggaacggcagaaccgggcuuuuuccaggaucauucguugaaaguuucuga

SEQ ID NO: 62462 - RNA, 3867 nt, Artificial Sequence
  derived and/or modified sequence opt3 from SH3TC2__Homo_sapiens__NP_078853
augggcgggugcuucuguauccccagagagaggagccugacccggggaccugguaaggaaacaccauccaaagacccgacugugucuucagagugcauugccaguagcgaauacaaggagaaauguuuucucccccagaacauaaauccugaucuuacgcuguccuucugcgucaagucucgcucgcgacguuguguuaacggcccauugcaagaagcugcaagaaggcgguuaugggcccuggagaaugaggaccaggaagugcgcaugcuauuuaaagaucucucagcgagacugguaagcauccagagucagagggcucaauuccuuauuaccuuuaagacaauggaggaaaucuggaaguucuccacuuaucugaacuugggguacgugucuaugugccucgagcaccuucuguuugaccauaaauauuggcucaauuguauuuuagucgaggauaccgaaauccaggugagcguugacgauaagcaccuggagacaauauaccuuggauugcugauccaggaaggccauuucuuuugccgggcccuauguuccgugacucccccugcagagaaagaaggugagugccucacccuguguaagaacgagcuuauuucagucaaaauggccgaagcugggagugagcuggaaggagugagcuugguaacaggccagcgcggccucguucuggugucugcauuagagccacugccccucccuuuccaccaaugguuucuuaagaauuauccaggguccugcggacugucacgaaagagagacuggaccgguagcuaccagaucggcagggggcggugcaaagccuugacgggauaugaaccgggcgagaaggaugagcuaaacuucuaccagggugaaaguauugagaucauaggguuugucauucccggacugcagugguucaucggcaaaucuacuuccagcggccaagugggguucgugccuacccguaauauugacccagauucguacucucccaugucccgcaacucagcuuuucucagugacgaagagagauguagccugcuugcccugggauccgauaagcagacagaaugcucuagcuucuugcauacucucgcgaggaccgacaucacaucagucuaucggcugagugguuuugaguccauccagaauccuccaaacgacuuaagcgcaucucaacccgagggcuucaaagaaguucgaccggggcgcgccugggaggaacaccaggcugugggaucaagacagaguagcuccucugaggauucgagccuggaggaagaacuacucuccgccaccucagacaguuacaggcugccugaacccgaugaccuugaugacccagaguugcugauggaucucucuacgggccaggaagaggaggcagaaaauuuugcuccuauucuggccuuccuugaccacgaggguuaugcggaucauuuuaagagccuguacgacuucuccuuuucauucuugacuagcucuuuuuauuccuucagugaagaggaugaauuuguagccuaccucgaggcaagccggaaaugggcuaagaagucucacaugacaugggcccaugcucgccuguguuucuuacuggggagacuauccauaaggaaagugaagcucucacaagcccgugucuauuucgaggaagcaauccacauucugaacggcgccuuugaggaccuuaguuugguggcuacccuguacaucaaucucgcggcaauauaccugaaacagcgguuacgacacaagggaagcgcccugcuugaaaaagcuggcgccuugcucgcaugccugcccgacagagagucguccgccaagcaugaacuagauguuguggcuuauguccugaggcaggggauugugguaggaucuagcccacucgaggcccgcgcauguuuccuggcgauccggcuuuugcugucauuagguagacacgaggaaguucuccccuuugcugagaggcugcagcuucugaguggccauccuccagccuccgaagcaguggccucugucuugagcuuccucuacgacaagaaauaucugccgcaccuagcuguggccuccguccaacagcaugggauccagucagcacagggaaugagccugcccauuuggcaagugcaccucguucugcagaacacuacaaagcuguugggcuuuccuaguccagguuggggcgaggugucugcucuggccugccccauguuacgccaggcgcucgccgcuugugaggaacuggcagaucgauccacccagcgggcccuuugccugauccuaagcaaaguauaccucgagcaccguucgccugacggggcuauucauuaucugucacaagccuugguccugggacaguuacucggcgaacaggagucuuucgaaaguucccugugucuugcaugggcguaccuguuggccagccaagcuaagaaagcccucgaugugcuggagccacuacugugcucucuuaaggagacggaaagccucacccagagagggguuauauauaaccuguugggacuggcauuacagggugagggcagggugaaucgcgcugccaaguccuaccuccgggcacugaacagagcccaggaagucggggacgugcacaaucaagcuguagcgauggccaaccuuggacaucugucauugaaaaguugggcacagcaccccgcuaggaauuaccuccugcaggccgugcgacuauauugugagcugcaggccagcaaggaaacagauauggagcuuguucaagucuuucucuggcuggcucagguguuggugucuggccaccaguuaacucauggucugcucugcuacgagauggcacugcuuuucgggcugcgccaccggcauuugaaaucccagcuacaagccaccaagucacugugccacuuuuauaguagcgucuccccgaacccugaagcguguaucacauaccaugagcacuggcucgcucuggcccagcagcuuagagacagggaaauggagggccguuuacuggaaucucucggacaauuguaucgcaaucugaacacugcacggucgcucagaaggagccugaccugcauuaaagagucacuucgaaucuucaucgaucugggcgagacagacaaggccgcugaagcaugguugggggccggacggcuacacuaccugaugcaggaggaugaacucguugaguuaugucugcaggcggcuauucagaccgcccuuaaguccgaggaaccacugcucgcauugaaacuguaugaggaagccggcgacguguuuuucaaugguacucgccauagacaccaugcuguggaguacuacagggccggggcaguaccccucgcucggcgacugaaggccgucagaacggaacuucgcauauuuaacaaacuaacagagcugcaaaucaguuuggagggauaugaaaaggcguuagaguucgccacccuggcagcuaggcucucuacugugaccggcgaucagcgucaggaacugguugccuuccaccggcuugcuacaguguacuauagccugcauauguacgagauggcagaagacugcuaucucaaaaccuugucccuguguccucccuggcuacagucaccaaaggaggcccuguacuaugccaaagucuacuacagacucgguaggcuuacuuuuugccaacugaaggacgcucacgaugcgacagaguauuucuuauuggcacuggccgcugccgugcuccugggcgacgaggagcuucaggauacgauucgcucucgacuggacaauaucugucagagcccucucuggcacaguagacccuccgggugcagcucugaacgggcaaggugguugucaggaggcgggcuggccuuauga

SEQ ID NO: 62463 - RNA, 972 nt, Artificial Sequence
  derived and/or modified sequence opt3 from SH3YL1__Homo_sapiens__NP_001153069
augaacaaucccaucccuagcaaccugaaguccgaggccaaaaaggcugcaaaaauucucagagaguucaccgaaauaacaucuaggaauggcccagacaagaucauuccggcccacgugaucgcgaaagcuaaggggcuugccauucugucagucaucaaggcaggauuuuugguuacugcccgggguggcagugggauagugguagcucgcuuacccgauggaaaauggagcgcaccuuccgccaucggcauugcuggucuagggggaggcuucgaaaucggcauugaggugucugaccuggucaucauacucaacuacgaucgagccguggaagcguuugcaaaagggggaaaucugacgcuugguggcaaccugaccguugccguggggccauugggacguaaucucgagggcaacgucgcucugagaucgucagccgcaguguucacauauugcaagagcaggggucuguuugcugggguaagucucgagggauccuguuuaauugaacggaaggagacuaaucgcaaauucuacugccaggacaucagagccuaugauauucuguuuggcgacacccccaggccugcgcaagccgaagaucuuuacgagaucuuggacucuuucacagagaaguaugaaaacgagggccagcggaucaaugcacgcaaggcugcccgagaacagagaaaaagcuccgcuaaggagcugccacccaaaccucuaucaaggccacagcaaaguagcgccccgguucagcucaacucugggucccagucaaaucugaaccagcccauugaagugaccgcacuuuacagcuuugagggacaacagccuggugaucugaauuuccaggccggcgaccggauaacugucaucaguaagacagauucucauuuugacuggugggaggggaaauugcguggacagaccggcauuuucccagcuaacuaugugacgaugaacuga

SEQ ID NO: 62464 - RNA, 6486 nt, Artificial Sequence
  derived and/or modified sequence opt3 from SHANK1__Homo_sapiens__XP_006723296
augacccacucccccgccacauccgaggacgaagagaggcauucugcuucagaaugcccugagggcgggagugaauccgauuccucuccagacggcccggguaggggcccccgggggacucgcggacagggcucgggugcaccugggucacuggccagcgugcgaggacuccaaggccguaguauguccgucccagaugacgcgcacuucucuaugaugguuuuuagaaucggcauucccgaucuucaucagacgaagugucugagguucaacccugacgcuaccauauggacagccaaacaacagguguugugcgcauuaagcgagucccugcaagauguacuuaauuacgggcucuuucagccagccacuucaggacgggacgcuaacuuccuggaggaggaacgccuucugagagaauauccccagaguuuugagaagggugugccuuacuuggaguucagguauaaaacccgggucuacaagcagacaaaucucgaugaaaaacaacuggcaaagcugcacaccaagacuggccucaaaaaguuuuuagaguaugugcagcuggggacaagcgacaaaguugcccgccuuuuggauaagggacuggacccaaacuaccaugauucugacuccggcgaaaccccgcuaacgcucgcugcccagacugaggguucaguggaagucauccgaacccugugucuugggggagcgcacauugacuucagagcaagggauggcaugacagcccugcacaaagcugccugcgcacggcauuguuuggcucucacugcccuguuagaccugggcgggagccccaauuauaaggaucgucgcggacucaccccucuuuuucacacagcgaugguggguggcgacccaagaugcugugagcuguugcuauucaacagggcccagcuggggaucgcagaugagaauggauggcaagaaauucaucaggcuugccagcggggccacagucaacaccucgagcaucugcuauuuuacggugccgaacccggggcucagaacgccucuggcaauaccgcacugcacaucugugccuuguacaacaaggagacgugcgcucgaauacuccuguaucgcggagcggacaaagauguaaagaauaacaauggccagacuccuuuccagguugcagugaucgccgggaacuuugaauuaggagagcugauuagaaaucauagggagcaagacgucgugccauuccaggaaucccccaaauacgcugcccggcgcagagguccgccuggcacagggcuaaccgugcccccagcacuccugagggccaacagcgauacuucgauggcacuuccugacuggauggucuucucugcccccggagcagcguccucaggcgcuccaggucccacaagugggagccagggccagucccaaccuucugccccaaccacgaaguugagcucaggaacccugcguagugcauccagcccgcggggcgcccgagcuagaucucccucaagggggcgccacccugaggaugccaaacggcagccaagaggaaggcccaguagcuccgguacaccucgcgaaggcccagcagggggaacuggcgguucugggggccccggaggcucgcucgggagccgaggacggcguagaaagcuguauuccgcuguuccgggcaggucauuuauggccgugaaaaguuaccaggcgcaggccgagggugaaaucucucuuagcaagggggagaagauuaaaguacuguccaucggagagggcgguuucugggaaggccaagugaaggggcgcgucggaugguuuccuucagacuguuuggaggaaguggcuaaccggagccaggagucuaaacaggaguccagaagugacaaggcaaaaagacucuuccgacauuauaccguuggcagcuacgauucuuuugacgccccaucccugauggaugggauaggacccggcucagacuauauuaucaaggaaaagacaguguuacugcagaaaaaggauagugaggguuucggguuuguccuacgcggagcuaaagcccaaacuccuauugaagaguucacccccacaccagcauuuccugcgcuccaguaccuggaaagcguggacgagggcgguguagccuggcgggcuggccuuagaaugggggauuucuugaucgagguuaauggacagaacguggucaaggugggccacaggcaagucgugaauaugauccgucaagggggcaacacccugaugguuaaagugguaauggucacucgccaccccgacauggaugaagccgugcauaagaaggcaccacagcaggcuaaacggcucccgccucccacgauuucgcugagauccaagucuaugacaagcgaguuagaagagauggaauacgagcagcagccagcccccguuccuucaauggagaaaaagaggaccguguaucagauggcacugaauaaacuugacgaaauauuggccgcugcgcagcaaacuaucagugccuccgagucuccaggccccggugggcucgcaagccugggaaagcaccgaccuaagggcuuuuucgcuaccgaauccucauuugauccgcaucaccgggcccagccaagcuacgagcgccccaguuuccuaccuccaggucccggccugaugcucagacagaaaucuauuggggccgcugaagacgauaggccuuaucuggcaccgcccgccaugaaguucucccggagccuuucggucccaggaucagaggacaucccucccccaccuacaaccucucccccagagccgccuuacaguacucccccagugcccuccagcucuggccgauugacaccuagcccaagagggggacccuuuaacccuggcuccggugggccgcugccagcgucaagucccgcuagcuucgacggaccuucucccccagauacgcgcguaggcuccagggaaaaaucauuauaucacaguggcccucugcccccagcccaucaccauccuccgcaccaucaccaccaucacgcacccccaccucagccccaucaccaucacgcccacccaccucaucccccggagauggaaaccgggggaagcccagacgauccucccccacgucucgcucuugguccccaaccuucccugcggggcuggagagggggaggcccgucucccacuccaggugcaccuucgcccagccaccaugggucagccggaggcggcgggggauccagucaggguccugcguugagguacuuucagcucccaccccgcgcugccucugcagccauguaugugccugcucgaagcggcagagggcggaagggaccacugguuaaacaaacaaaggucgagggcgagccccagaaaggugggggacuaccgccugccccaucccccaccucaccagccucuccacagcccccgccugcuguggccgcgcccagcgaaaagaauaguauaccaauuccuacaaucaucauuaaggcccccuccacuuccucuucaggcagguccagucagggcagcucgaccgaggcagaaccacccacgcaaccugagccaaccgggggagguggcgggggaggaucuuccccgagccccgcuccugccaugucaccagugcccccuaguccaucucccgucccuacaccggcuuccccaagcggucccgcaacucuggacuucaccucacaguuuggggccgcccucguuggagcugcgcgccgugaaggcggcuggcagaacgaggcaagacggaggaguacacuguuccuuagcacugaugccggggacgaggauggaggugacggcggguugggaaccggcgcugccccugguccccgccugcgacacuccaaaucuaucgaugaagggauguuuagcgcagagccauacuuaagacucgaauccgccggaucaggcgcuggcuacgggggauauggugcgggcucucgggccuacgggggaggcggugggaguucggcauucacgagcuuucugccucccaggccacuugugcacccgcugacaggcaaggcucuagacccugccagcccccucggacuggcauuggccgcucgcgagagagcccugaaagaaucuucagagggcgggggagcgccacagcccccuccaaggcccccuagcccgcgguaugaggcaccacccccuaccccacaucaccauagcccccacgcccaucacgaaccuguguuacgucucuggggugcuagucccccagauccggcccgccgagagcugggcuacagagcugggcuuggaucucaagaaaagagccugccugcaucacccccagccgcuaggcgguccuugcuccaccgccugccucccacugccccaggcguagguccucuacugcuucagcucgggacagagcccccggcaccacauccuggcgucaguaaacccuggagaagcgcggccccagaggaacccgagaggcugccuuugcacgugcgguuccuggaaaauugccagccgcgagcuccaguuaccucuggaagaggacccccuuccgaggacgggcccggagugccaccucccucaccacgcaggagcgucccuccgucgcccacuucuccacgggccagugaagagaacgguuuaccucuccuggugcuucccccuccugcucccuccguugauguggaggacggcgaauuucuguucguagagccguugccaccuccccucgaauuuagcaauucauucgagaagccagaaagcccccugaccccugggcccccacauccucuaccggacacacccgcuccagccacgccucugcccccagucccucccccggcaguggccgcugcgccuccaacccuugauucuacugccagcagucucacauccuaugacagcgagguggcaacccugacacagggagcuucugccgcccccggcgauccucacccacccgguccuccagcacccgcugccccggcgccugcugcaccccagccagggcccgacccuccacccggcacugauucaggaauugaggaagucgacagucguuccagcucugaucacccuuuggagaccauaucgucagcaagcacguuauccagucugucugccgaaggcgggggaagcgcuggcggugggggaggcgccggugcaggcguugcguccgggccagagcuccuggacacauacguggcuuaucuugauggacaggccuucggcgggucaaguaccccgggacccccuuacccaccccagcugaugacuccuucuaaguugagaggcagggcacuaggugccagcgggggacugcgcccaggccccuccgguggccuccgggacccgguaaccccuacaucaccaacugugagcgucaccggggcuggaacagauggccugcuugccuuacgagcaugcucugggcccccuacggcuggaguggccggcggucccguugcgguggaaccagaggucccgccugugccccugccaaccgccuccagucuccccagaaaauugcugccuugggaggaagggccaggacccccuccaccgccccucccuggcccacuggcacagccccaagcuagcgcccuugcaacuguuaaggcuucgaucauuuccgagcugucuucaaaauugcagcaguuuggcgggagcagugccgccggaggugcgcuaccuugggcuaggggcggguccggaggcgguggggacucucaucacggaggcgcaagcuacgugccagaacgcacaucaucccugcaacggcagagacucagugacgauagccagucuucauuacuguccaagcccgucagcucucuuuuccagaacuggccuaaaccgccccugccaccucuccccaccggcacugggguaaguccaacagccgcugccgcaccuggagccaccucgcccuccgcuagcucaucuagcacguccacucgucauuugcaagguguggaguuugaaaugaggccaccgcugcuccggcgcgcgccuagucccucacugcuuccagccucugagcacaagguuagccccgcaccucgaccauccagucuacccauccugccuagcggcccguuguaucccggguuauucgacaucagaggauccccaaccggcggugcugggggaucugccgauccuuuugcacccguguucgucccaccucaucccggcauuucaggcgggcugggaggugcccucagcggcgcuucgaggucccugaguccaacacggcuucugucucucccgccugacaagcccuuuggggccaaaccauugggauucuggaccaaguuugauguggcggacuggcuggaguggcuaggccuggcagaacaccgcgcccaguuccucgaucacgagauagacgguagccaucuuccugcucugacuaaagaagauuacguagacuuaggggugacaagagucggacacaggaugaauaucgaucgagccuugaaguuuuuccuggagcgguga

SEQ ID NO: 62465 - RNA, 5550 nt, Artificial Sequence
  derived and/or modified sequence opt3 from SHANK2__Homo_sapiens__NP_036441
augccccggagcccuaccuccucugaagacgaaauggcccagucauucagugauuacagcgugggcuccgagucugacucgucaaaggaagagacuaucuaugauacuauuagagcuacggcagaaaaaccagggggagcccggaccgaggagagccaggguaacacacuggucauccgcguugugauccacgaccuccagcagacuaagugcauucgauuuaauccggaugcgaccgucuggguggcuaaacagcguauccuuuguacacugacccaaaguuugaaggacgucuuaaacuacggccuguuccagcccgccuccaaugggagagauggaaaauuucuagacgaagagaggcuccugcgggaauauccucagccagugggcgaggguguucccucucuugaguuccgcuacaagaagagaguguauaaacaggccagccuggaugaaaagcaauuggccaaacuccauacuaagacaaaccugaaaaagugcauggaccacauucagcauaggcuggucgagaagaucaccaaaaugcucgaucggggguuagacccuaauuuucacgauccagaaacgggagagacuccccugacccuugcugcacaguuggacgacuccguggaaguaauaaaggcccugaaaaacggcggcgcucaucuagauuuccgcgccaaggacgggaugacagcgcuccacaaagcagcccgagcuagaaaucagguugcccugaagacucuucuggaguugggagcaucaccugauuacaaagacaguuauggucucaccccacuguaccacacagcuaucgugggcggggauccguacuguugcgaguuacugcuccaugaacacgccaccgucuguugcaaggacgagaacggauggcaugaaauucaccaagcguguagguauggccacgugcagcaucuugagcaccuguuguuuuacggugccgauaugagcgcacagaaugcuucugggaacacggcccuacauaucugcgcucuguauaaucaagacuccugugcccgggugcuccuguuccguggaggcaacaaggaacuuaaaaauuacaacucacagacucccuuucaggucgcaauuaucgccggcaauuucgagcuggcugaguauauaaagaaccacaaagaaacagauauuguuccuuuucgcgaggcgccagcauacagcaacagaaggcggcgacccccuaauaccuuggccgcuccacgcgugcuccugagaaguaacucugacaauaacuuaaaugccuccgcacccgauugggccguaugcagcacugcuacaucgcauaggucucuguccccgcagcuacuccaacagaugccuucaaagcccgaaggggccgcaaaaaccaucggaaguuaugugccagguccucggagccgcucccccucucugaacagacuuggcggggcgggagaggacggcaagaggccacagcccuuguggcacgucgguagcccuuucgcucugggggccaauaaggacucacucagugcauuugaauacccaggcccgaaacguaagcuguacuccgccgugcccggacggcuuuucguugcugugaaaccuuaucagccacaagucgauggcgagauuccccugcaccgaggggacagagugaagguauugagcaucggagaggguggcuucugggaagggucugccaggggacauaucggcugguuuccugcagaguguguugaagaggugcagugcaaaccacgcgauucacaggcugagacgcgggccgacagaaguaagaaacucuucaggcacuacaccgucgguagcuaugauuccuuugacacaucuucggauugcauuauagaagagaaaacugugguccugcagaagaaagacaacgaaggguucggcuuuguguuacgcggagcgaaggccgauacccccaucgaggaguucacaccgacuccugcuuuuccagcacugcaauaccuagagagcguugacgagggcgggguggccuggcaggcuggacuccgaaccggugauuuccugauugaaguaaauaacgagaaugucgugaaaguuggccauagacagguggucaacaugauccgucaagggggcaaucaccuuguguugaagguagugacaguuaccagaaaccuggaccccgaugacacugccaggaagaaagcaccucccccaccuaagcgcgcgcccacgacagcccucacccugcgguccaaaucaaugacaagugaauuagaggaacuggucgacaaggcuucugugaggaagaagaaagauaagccagaggagauagugccggccagcaagccuuccagggcagcugaaaauauggccgucgagccccgaguugcaaccauuaaacagcgcccaucaagccgguguuuucccgccggcucugacaugaacuccguguaugaaagacaggguaucgcugugaugacaccuaccguaccagggagucccaaggcgccuuuccuuggcaucccgaggggaacuaugcgucgccagaaaagcauugauucucggaucuuuuuguccggcauuacagaggaagagagacaauuccucgccccacccaugcugaaguuuacgaggucacuaaguaugccugacaccagcgaggauauaccacccccuccgcagucgguaccaccauccccucccccaccuucucccacuacauacaacugcccaaaaagcccgaccccucgaguguaugggacaaucaagcccgcauucaaucagaacucagcugccaagguuaguccagccacucgguccgacaccguggcuacgaugaugcgcgaaaaaggaauguacuucagaagggagcuggaucgguacucucucgacagcgaagaucuguauucccgaaaugcaggcccccaggccaacuuuagaaauaagcgcggucaaaugccugagaacccauacucagaggucgggaaaauugcgagcaaggcuguguauguucccgccaaaccugcaaggcguaagggaaugcuugugaagcagaguaauguagaagacucuccggagaaaaccuguuccaucccaauccccacaauuauagucaaggaaccuagcacuucgucaucuggcaaaaguucccaggguagcucuauggagaucgauccccaggccccagaaccucccagccaauugcggccagacgagucccugaccgugucaaguccuuucgcugcagccauugcgggcgcugugagagauagggagaagcgcuuagaagcccgaagaaacagcccggcauuucucucuacagaccugggggacgaggaugucggacuuggacccccagccccucggacuaggcccuccauguucccagaagagggggacuuugcugaugaagacucagccgagcagcugaguagcccuaugcccuccgcaaccccgcgcgagccagaaaaucacuucguuggaggcgcugaggccucugcgccuggugaagccgggcgucccuugaacucgacgagcaaagcacagggaccagagucaucccccgcugugccuagugccucuagcggcacagcugguccgggcaauuacguacauccccucaccgggagacugcuagauccauccucaccucuggcacucgcccugucugcccgggacagggcuaugaaggaaagccagcaaggacccaagggcgaggcgccuaaagcagaucuuaacaagccauuguauaucgacacuaaaaugcgccccagucuggaugccggguuuccuacagugacccgacagaauacuagaggaccauuacggaggcaggagaccgaaaacaaguacgagacagaccucggccgcgauagaaaaggugacgacaagaaaaauaugcugauugauaucauggacacgucccaacaaaagagcgcugggcuucugaugguccacaccguggaugccacuaagcuagacaacgcacuccaggaagaggaugagaaagccgaaguugagaugaagcccgacucuucaccguccgaagugccugagggagucagugaaacagagggcgcucugcagauaagcgcggccccagagcccaccacagugccugguaggacuaucguugcagugggcucgauggaagaggcugucauuuugccauuccggauacccccgccuccccuggccucuguagauuuagacgaagauuuuauuuucaccgagccacucccucccccacuggaauuugcaaacuccuucgacauccccgaugaccgugccgcuagcgugccugcccuuucagaucugguuaaacaaaagaaaagugacacgccacagucuccguccuugaauagcucacagcccacaaacagugcggacagcaagaagccugcaucccucucuaauugccugccagccagcuuucuacccccuccagaguccuucgaugcuguggccgacucagggauagaggaagucgauucucgcaguucgagcgaccaucaccuggagaccacuuccaccauuucuacagugucaagcaucuccacucuuaguucugaaggaggcgagaacguagauaccuguacaguguaugcugacgggcaggcauucauggucgauaaacccccuguuccgccaaagcccaaaaugaagccuauuauccauaaaagcaaugcccucuaccaagacgcucugguggaagaggauguggacucauuugucauacccccucccgcacccccaccgccucccggauccgcacagccaggcauggcgaagguguugcagccccgaacgaguaagcuguggggugauguuaccgagaucaaaagcccuauuuuaucugggccaaaggccaacguaaucuccgaacucaauucaauucugcagcaaaugaacagagagaaacuugcuaagcccggagaaggccuggacagcccuaugggcgccaaaucggcaucuuuggcuccgaggaguccagagaucauguccacuauaagcgggacacggucaaccacugugacauucaccguccgccccggaacgucccagccuauuacucuccagucuagaccacccgauuacgagagcaggaccagugguacacggcgagccccuucccccgugguuagcccaaccgaaaugaauaaggagacucugccggcaccucuaucugccgcuacagcgucacccaguccagcccuguccgacguguuuagccuuccuucucagcccccaucgggcgaccucuucgggcugaacccugcaggaagaucacgcagccccuccccgaguaucuugcaacagccaaucucuaauaagccuuuuaccacaaaacccguccacuuauggacuaagccagauguggcugacuggcuggaaagccucaaccugggcgagcacaaagaagccuucauggauaaugagauugacgguucccaucuucccaaccugcagaaggaggauuugaucgaccuagggguaaccagggucggacaccggaugaauauugaacgugcccugaaacaacuccuggauagauga

SEQ ID NO: 62466 - RNA, 5196 nt, Artificial Sequence
  derived and/or modified sequence opt3 from SHANK3__Homo_sapiens__NP_277052
auggacggccccggggccagcgcuguggucguucgcgugggaaucccugaucugcagcaaaccaagugccucaggcuugacccagcagccccgguaugggcggcuaagcagcgggugcugugugccuugaaccacuccuuacaggaugcacugaauuacggucuuuuccagcccccuucucgcggccgagccgggaaguuucucgacgaggaacgucugcuucaagaguauccacccaaccuggauacaccuuugccauaccucgaguucagauauaaaaggcgggucuacgcucagaaucugauugacgauaagcaguuugcaaaacugcauacuaaggccaaccucaagaaauucauggacuaugugcaguuacacucaacggauaagguugcucgccugcuugacaaaggauuggaucccaauuuucaugacccugauaguggcgagugcccacugagcuuggccgcgcaacucgacaacgcaaccgaccugcuuaaggugcugaaaaaugguggggcccacuuggauuucagaacaagggacggacucacugcuguccauugugccacccggcagcgcaacgcagcugcccugacaaccuuacuggaucucggcgcguccccggacuacaaggauucucgaggccuuacuccccuguaucacucggcccuaggggguggggacgcacuaugcugugaacugcuccugcacgaucaugcucagcuuggcauaacagacgagaauggguggcaggagauccaccaagccugcagauuuggacaugugcagcaccuggaacaccucuuguucuacggcgcugauaugggugcccagaacgcaucagggaauaccgcccugcauauuugugcuuuauacaaccaagagagcugcgcgaggguacugcuauuucggggagcaaaucgugacguucgcaacuauaauagucagacggccuuccagguggcuaucauugccggcaacuuugaacucgcagaggucaucaagacucacaaagauuccgacguggugccuuucagagagaccccaucuuacgccaagaggcggcgacuggcuggccccagcgggcuugccuccccucgcccauugcagagaucagcaagugacauaaaccugaaaggagaagcgcaacccgcugccagcccggguccuucucucaggucccugccccaucagcuucuguugcagcggcuccaggaggaaaaggaucgcgacagagaugcagaccaagagucaaauaucagcggcccacuggccgggagggcuggacagaguaaaauuucuccuuccggccccggugggccaggccccgccccuggaccaggcccggcacccccugcuccacccgccccuccaccccgugggccgaagcggaaauuauauagcgcggucccuggacgaaaguuuaucgccguuaaggcucacucgccacagggugaaggcgagauuccccugcauagaggggaggcagugaaaguacuaucuaucggagaaggcgguuucugggaggggacagugaagggcaggacuggaugguucccugccgauugugucgaagaggugcagaugcgccaacacgacacccggcccgaaacaagagaggauaggaccaaacgccucuuucgacacuacacgguuggcuccuaugacucacugacaagucauagcgauuacgugauagacgauaaggucgcugugcuucagaaacgggaccacgagggguucggauuuguauugcguggugccaaggcagaaacaccaauugaggaguucaccccuacucccgcguuuccagcccugcaguaucucgaguccguugauguggaaggcgucgcuuggagagccgggcugaggacaggagacuucuuaaucgaggugaacggcgucaaugugguuaaggugggucauaaacagguagucgcacugauucgccaagggggcaaccggcuugugaugaagguugugucugucaccagaaaaccggaggaagacggagcuaggcgacgcgccccucccccacccaagcgggcaccuagcacgaccuugacacucagaucaaaaaguaugacugccgagcuggaagaauuggcuuccaucaggcgucgcaagggcgagaagcuggaugaaaugcucgcggccgcagcugagccaacccugcggcccgacaucgccgaugccgacagcagagcugcaacagugaaacagaggccuacuucucgacggauuaccccggccgaaauaucaagucuuuuugagcgccagggguugccaggacccgaaaagcugccuggcagcuuaagaaaagguaucccaaggacaaaguccguaggggaggaugagaaacucgcgucucugcuugaaggacgguucccccgaucgaccagcaugcaagacccugugagagagggccgcgguauuccgcccccaccucagacugcucccccaccucccccagccccguacuacuuugauuccggcccucccccagcauucucacccccuccacccccugggagggccuaugacacgguucguaguucuuuuaagccgggacuggaagcucgguugggcgcaggggccgcgggacucuacgagccaggcgcugcccuggguccccuaccuuaucccgaaagacagaagagggcacgcagcaugaucauacugcaggauuccgccccagagucaggggacgcuccucgacccccgccugccgcaacaccgcccgagagaccaaaacggaggccuagacccccaggaccugauagccccuacgcuaaucucggcgccuucucugcgucccuguuugccccgaguaagccacaacguagaaaaagcccucuugucaagcagcuacagguggaagacgcacaggagcgggcugcccuggcuguggguucucccggcccagggggaggcuccuucgcaagggaacccucaccuacccaccgcgggccgcgacccggaggcuuagauuauggugccggggacggaccaggccucgccuucgguggcccugggcccgcuaaagacagacggcuggaggaaaggcgcagaaguacugucuuucuuagcguuggagcgauugagggcucggcaccuggggccgaucugccaucccuacaacccucuaggagcaucgacgagcggcuccugggaaccggcccuacagcuggucgugauuugcuguuaccaucacccgugagugcccucaagccgcugguguccgggccuucucuuggaccaagcggcuccaccuucauccacccccugacuggcaaaccuuuggacccaucaagcccccucgcacuggcccuagcugcgcgcgaacgagcccuggcaagucaggcuccgucuagauccccuacacccguacauagcccagaugccgacaggccugggccccuuuuugucgaugugcaggcacgggacccagagcgcggaucgcucgccucacccgcuuucucuccuagaaguccagccuggauuccgguucccgcgaggcgggaagcagagaaggugccucgagaggaaagaaaguccccagaggauaaaaagagcaugauccugucugucuuggacacgagccugcagcgccccgccgguuuaauugugguucacgcuaccuccaacggccaagaaccuucaaggcucgggggagccgaggaagaacggccaggcacucccgagcuggcuccugcaccgaugcagagugccgcuguggccgaaccacuucccagcccucgugcacagcccccaggugggacuccugcggaugccggacccggccaaggaucuuccgaggaggaaccagaacugguauuugcugucaauuugccgccugcccagcucucaaguagcgacgaggagaccagagaggaacuggcaaggauagggcuagugcccccacccgaagaguucgcuaacggagugcugcuugccacaccucucgcagguccaggccccuccccuacuaccgucccgucuccagccucggggaaacccagcucagaaccuccacccgcuccugaguccgcggccgacaguggaguugaggaagcagauacgcgcucuagcuccgacccccaucuggagaccacaucaacuaucucuaccgugagcaguauguccacauugagcucugaaucaggcgaguuaacugauacccacacguccuuugcugacggucauacauuccugcucgagaagccaccgguaccucccaaaccaaagcugaagaguccucuugggaaaggacccgugaccuuucgggauccacuguugaagcagagcucggacucugaacuaauggcccagcaacaccacgccgcauccgcuggccuggccagcgcggcuggcccugcccgacccagauaccucuuccagaggcgcucaaaacuguggggagauccggucgagagucggggacuuccagguccugaagacgauaagcccacugugauuucugaguuauccagcagacugcagcagcucaauaaagacacacguucauugggcgaggaaccaguugggggacugggcagucuccuggaucccgccaaaaagagcccuaucgcagcugcaaggcuauuuuccucucugggugaguugagcuccaucucagcccaacggucuccagggggcccaggcggcggggcgaguuauucggugcgccccagcggacgauacccugucgcuagaagggcccccuccccagugaaaccugcaucucuagaacggguugagggucugggcgccggggcuggaggcgccggucgccccuucgggcucaccccaccuacuauuuuaaagucaagcucccugaguauaccgcaugaacccaaagaggugagauuugucguaaggucugugagcgcacgaucacgguccccaaguccuagcccccuuccaucuccugcuuccggacccggcccgggcgccccagggccucguagacccuuccagcagaagccacugcagcucuggucaaaauucgacguuggagauugguuggaaagcauccaccugggugagcaucgcgacagguuugaggaccacgaaauugagggcgcgcaucuccccgcccugaccaaggaugacuucguggaacuuggggucacacgggugggacacagaaugaacaucgagcgcgcacuaaggcaacuggauggcucguga

SEQ ID NO: 62467 - RNA, 1164 nt, Artificial Sequence
  derived and/or modified sequence opt3 from SHARPIN__Homo_sapiens__NP_112236
auggcucccccugcuggcggggcagccgcggcugccagcgaccugggauccgcagccgugcuccuugcuguccacgcagccguuagaccacugggugcuggcccggaugccgaggcgcaguugaggcgguuacaacugucugcagaccccgaacgcccugggcgauuccgucuagagcuccugggagccggcccaggugcugugaaccuugaauggccccuggagucaguaaguuacaccaucagagggccuacacagcaugaauugcagccacccccuggaggcccaggcacucucagccugcacuuucugaauccgcaggaggcccaaaggugggcagugcucguccgcggggcuacgguggagggacagaacgguuccaagucuaauucgcccccugccuuaggcccagaagcgugccccguuucacugccuagcccacccgaggccaguacccuuaaagggccgccucccgaagcagauuugccacgguccccuggaaaccugacagagagagaggaacuagcuggcucucucgccagggcuauugccgguggggacgagaagggagcagcccagguggcugcgguccuggcacagcaucggguggcccuuagcguacaacugcaggaagccuguuuucccccaggccccauacgcuugcagguuacucucgaggaugccgcauccgccgcuucagccgcaaguagcgcgcacguggcucugcagguccauccucacugcaccguggccgcauuacaagaacagguguucucugagcugggcuucccaccggccguccagcgauggguuaucgggagaugucucugcgugcccgagaggucccuugcuucauauggaguacggcaagacggugauccugccuuucuguacuugcuaagcgcaccacgugaagcucccgccacaggcccuaguccacagcacccccagaaaauggacggggagcugggacgccucuucccgccuucucugggccuuccacccgguccucagcccgcggccuccagccugccaucgccuuugcaacccucuugguccuguccaucaugcaccuuuauuaaugcuccggauagaccugggugugaaaugugcaguacucagaggcccuguacaugggacccacucgcagccgcuagcaccuga

SEQ ID NO: 62468 - RNA, 1155 nt, Artificial Sequence
  derived and/or modified sequence opt3 from SHBG__Homo_sapiens__NP_001139751
auggagagcagaggcccccuggccaccuccaggcuccuucuguuguuacugcuacuccugcuucggcacacacgccaggggugggcucugcgaccuguguugccaacucaaucugcacaugacccgcccgccguccaccucucaaacggaccuggucaggaaccaaucgcgguuaugacguucgaucugaccaagauuacaaaaaccaguagcuccuuugaggugcguacuugggaccccgaaggcguaauauucuacggggauacaaauccuaaggacgauugguuuaugcugggacucagagacggcaggccagagauccaguuacauaaccacugggcucagcugaccgugggugccgggccccggcuugaugacggacgcuggcaucaagucgaagugaaaauggagggcgauucuguuuugcuggagguggacggcgaagagguccuaagacucaggcaagugucggggccucugacuucaaagcggcacccaauuaugcgcaucgcacuuggaggucuguuguucccggccagcaaucuccgacugcccgcugaaauuagugcauccgccccuacaucuuuaagaagcugcgauguagaguccaacccaggcaucuuucugcccccugggacccaggcugaguucaaucucagggacauaccacagccccacgccgaaccgugggcguuuucacuugaucugggauugaaacaggcagccggcaguggucaucuacuggcucucgggacgccugagaaccccagcuggcugucucuucaccuucaggaccagaagguuguguuguccucaggaagcggcccaggccucgaccugccuuuaguccuggggcuaccccuccagcugaagcugaguaugucucgggugguguugucccaaggaagcaaaaugaaggcccuggcacucccaccccugggucuugcuccucuguugaaucucugggccaaaccacagggccgucuguucuuaggggcgcugccgggagaagauucgucuacuuccuuuugucuaaacggccucugggcccagggucaacgccuggacgucgaucaggcacuuaauagaucacaugagaucuggacccacaguugcccccagagcccugggaacggcacagacgcuucccacuga

SEQ ID NO: 62469 - RNA, 1530 nt, Artificial Sequence
  derived and/or modified sequence opt3 from SHB__Homo_sapiens__NP_003019
auggccaaguggcugaacaaauacuucagccucggcaauuccaagaccaaaucucccccucagccaccgagacccgacuauagggagcaacggcgccgaggggaacguccuucacagccaccccaggcugugccucaggcaaguagcgccgcguccgcuucuugcggaccagccacagcaucguguuuuucagccagcagugguucccuucccgaugacucuggcagcacuuccgaucugaucagagcuuacagggcacaaaaggagcgggacuucgaagauccuuauaacgggccaggaucaaguuugcgcaaauuaagagccaugugcaggcuggacuacuguggcgguagcggggagccgggaggcguccagcgggcuuuuucugccuccucagcgagcggcgcagccgggugcuguugcgcuaguucuggagccggugcagcugccuccagcucgucuuccucaggcaguccccaccuauaucgcagcuccucugaacgaagaccugcgacgccagccgagguuagguacauuagccccaagcaucggcucauaaagguggagucagcagcugggggaggcgccggugauccucuugggggagcuugugccggcggccguaccuggaguccaacagcaugcgggggaaagaaacugcugaauaaaugugccgcuuccgcggcagaagagagcggugccggcaagaaagacaagguaacuaucgcugaugacuauucugaucccuucgacgccaagaacgauuugaaaucaaaggcagggaaaggagaaagugccggcuacauggagccguacgaggcucagcgcauuaugaccgaauuucagagacaagagagcgugaggucccagcacaaggguauccagcucuaugacacaccuuacgaacccgaggggcagucugucgacucggauagcgaauccaccgugucaccacggcugcgagagaguaaacugccucaagacgaugaccgccccgccgaugaguaugaccagccaugggaauggaauagaguuacuauucccgcacucgcggcucaguucaacggcaaugagaagaggcaaucuagcccuuccccaucacgggaucgcagaaggcaguuacgugccccgggaggcggguuuaaacccaucaagcauggaagcccugaguucugcgguauacugggcgaacggguggacccagcagucccccuugaaaagcagaucugguaccacggggccauuucucgaggagaugcugagaacuugcugagacuauguaaagagugcuccuaucucgugaggaauagucagacaagcaagcaugacuacucucugucccuucgcucaaaccaaggcuuuaugcacaugaaacuggccaagaccaaagaaaaguauguauugggucagaauaguccuccauucgauagcguucccgaggugauccacuacuacacgacucggaagcucccgauuaaaggggcagaacaucugucguuacuguauccugucgcugugagaacccucuga

SEQ ID NO: 62470 - RNA, 1755 nt, Artificial Sequence
  derived and/or modified sequence opt3 from SHC1__Homo_sapiens__NP_001123512
auggaccugcugcccccuaagccaaaauacaacccgcuuagaaaugagagccuguccucuuuggaagagggcgccucagggaguacacccccugaagaguuaccaagccccuccgcuucuucgcugggaccuauccuaccaccccucccuggugaugacucaccaaccacucugugcagcuucuuuccgaggaugaguaaccuucggcuggcaaaucccgccggcgggcgcccuggauccaagggcgaaccaggucgagcggcugaugacggggagggaauugugggcgccgcaaugcccgauucuggcccuuugccacuccugcaggacaugaacaaacugagcgggggagguggccguagaacgagggucgaagggggacaacucggcggugaagaguggacccggcacggguccuucguuaauaagcccacacgcggaugguuacauccgaacgauaaagugaugggcccuggcguaucauaucuggugagauacauggggugugucgaagugcuucagaguaugagggccuuggacuuuaauacucggacccagguuacacgcgaggcuauaagccuggugugcgaggcaguccccggagccaagggugcuacccgaagaaggaagccauguucucggccucuauccucaauccucggccguagcaaccugaaauucgccgggaugcccauuacucuuacagugaguaccucuucccugaauuugauggcggcagauugcaagcagaucauugccaaccaccauaugcaaagcaucucguuugcuucuggaggcgacccagauacggccgaauauguagcauacguugcuaaagaccccgugaaucagcgcgccugucacauacucgagugcccugaaggucuggcgcaggaugucaucuccacuauugggcaggccuucgaguuaagauuuaagcaauaucugaggaacccaccgaaacucgugacaccccaugaccggauggcaggcuucgacggaucagcuugggaugaagaggaggaggagccuccagaccaccaguacuauaaugauuuucccggcaaggaaccuccacuugggggaguggucgacaugcgacugcgcgagggugccgcucccggcgccgcaagaccgaccgccccuaacgcucagacuccaagucacuugggggcgacccuacccguuggacagccugugggcggugaucccgaaguaaggaagcaaaugccaccucccccaccguguccugcagggcgggagcuguucgacgaucccagcuacgugaauguccagaaccucgacaaagcccgccaggcugugggcggagccggcccacccaacccugcaaucaauggguccgccccaagagaucuguuugacaugaagcccuucgaggaugcucuuaggguuccuccgccaccccaaucugugagcauggccgaacagcugcguggagagccuugguuucaugguaaauugucacggcgagaagcagaggcgcuccugcaguuaaacggcgacuuccuggucagagaaaguacaaccacgccagggcaguacgugcuaacuggacuccaauccggccagcccaagcaccuccuuuugguagacccugaggguguugugaggacaaaagaucaucgcuucgagagcgucucucaccugauuucauaucacauggacaaucaucucccgaucauaagugcugggagcgaacugugccuucagcagcccguggagcggaagcuguga

SEQ ID NO: 62471 - RNA, 1749 nt, Artificial Sequence
  derived and/or modified sequence opt3 from SHC2__Homo_sapiens__NP_036567
augacccagggccccgggggcagagccccuccagcuccgcccgcaccuccagagcccgaagccccuacaacuuucugcgcgcugcucccaaggaugccccaauggaaguuugcugccccugguggcuuccuugggcggggaccagcagccgcucgcgcagccggcgcuagcgguggggccgacccgcagcccgagccugcgggaccaggcggcgugcccgcacuggccgcugccgucuugggggcaugugaaccucgaugcgcugccccaugucccuuaccggcgcugucccguugcagaggagccgguucuaggggcucacgcgggggacggggcgcagcugguaguggggaugccgcugccgcagccgaguggaucagaaaagggagcuuuauucacaagccugcucauggcuggcuacaccccgacgcgaggguucucggcccagggguguccuacguagugcgguauaugggauguauagaaguccugcgcucuaugcgaucgcuugauuucaacacgagaacccaggugacaagggaggcaaucaaucggcugcaugaggccguuccuggugugcguggcucauggaaaaagaaagcucccaacaaggccuuggcaagcguccucgggaagaguaaucugcgcuuugccggaauguccauuucuauccacauuagcacugacggccugucccucucagugccagcuaccagacagguaaucgccaaccaucacaugcccaguaucagcuucgcaucugguggggauacagacaugaccgauuacguugcguauguggcuaaagacccuauaaaucaaagggccugccacauuuuagaauguugcgagggccuggcacaguccaucauuucaacugucggacaggccuuugaacuucgguucaagcaguacuugcauagcccaccgaaaguggcucugcccccugagcgacuagccggcccagaggaaagugcauggggagaugaggaagacucucucgagcacaacuauuacaauuccauccccggaaaggaaccuccacuggguggccuuguggauagccgccuggcuuugacacaacccugugcccucaccgcgcuggaccaggggccgucgccuucuuuaagagaugccugcucccugccaugggacgucggaucaacgggcacugcucccccuggugacggguauguucaggcagaugccaggggacccccagaccaugaggagcaccucuacgugaacacccagggacuugaugcuccugaacccgaggacagucccaaaaaggaucuguuugacaugcggccguucgaagaugccuugaagcuacacgaguguagcguagcagcgggcgugacagccgcuccucugccccucgaagaccaauggccauccccaccuacucgcagagccccagucgcacccaccgaggagcagcugaggcaggaaccuugguaccaugggcguaugucucggcgagcugccgagagaaugcuuagggcagauggagacuuucuggugcgcgauagcguuacaaauccgggucaauauguguugaccggcaugcacgccgggcagccaaaacaucuccuguuagucgaccccgaaggagugguacggacgaaggacguucuguucgagucaauaagucaccuaauugaucaucaccuccagaacggccagccuaucguggcugcggaauccgagcugcaccuuagaggugucgugagcagggagccauga

SEQ ID NO: 62472 - RNA, 1785 nt, Artificial Sequence
  derived and/or modified sequence opt3 from SHC3__Homo_sapiens__NP_058544
augcugcccagaaccaaguacaacagguuccggaaugacagcgugacauccgucgaugaccuccuucacucucugucaguuaguggcgggggagguaaagugagcgccgcucgcgcaacuccugccgcggcuccauauuugguauccggcgaggccuuacgaaaggcaccggaugacgggcccggaucucugggccaucuacuccacaaagugucgcaucugaaacuuucaagcaguggucugcguggguuguccucugccgcuagagaaagggcaggagcccggcucagcggcuccugcucagcuccuagucuggccgcgccagauggcagcgcacccucugccccucgcgcuccagccauguccgcagcuagaaaggggaggcccggagacgagccucugccacggccgccccgcggugccccucacgcgucagaucagguccucggcccaggggugacguacguugugaaguauuuaggauguaucgaaguccugcgaagcaugagaagucuugacuuuucuaccaggacacaaauuacucgggaggccauaucccgugugugcgaagcaguacccggcgcuaagggugccuucaaaaagcgcaaaccuccaagcaagauguugucgucuauccuggggaaauccaaccuacaguuugcuggaaugucaauuagucucaccaucagcacagccucccugaaucuuagaacccccgauucuaagcagauuaucgcaaaccaucacaugaggagcauaucauucgccaguggcggcgacccggauacuacagacuacguugcuuauguggcgaaggauccugucaaucggcgagcaugucacauccuggagugcugugacggguuggcccaggacgugauuggauccaucggucaggcuuuugagcuccgcuucaaacaauaccugcagugccccaccaagauuccagccuuacaugauagaaugcagagccuggacgaaccuuggacggaggaagagggcgaugggucugaccaccccuauuacaacucaaucccaaguaaaaugcccccuccaggaggcuuucucgauacuaggcuuaagccgcggccccaugcaccugacaccgcccaauucgcugguaaagagcagacauacuaucaggggcgccaccugggcgauacuuuuggagaagacuggcagcaaaccccauugagacagggcagcuccgauauauacucuacacccgaggggaagcuacacguggccccuaccggagaagcaccaacguaugucaauacucagcaaauucccccgcaggcguggccugcugccguuucgagcgcagaguccucaccaaggaaagaccuguucgauaugaagcccuuugaagacgcccucaagaaccagccucugggucccgugcuuaguaaagcugccucuguagaguguaucagcccaguguccccucgugcacccgacgcuaagaugcuggaggaauugcaggccgagacaugguaccaaggcgaaaugucacggaaagaggcggaagggcuccuggagaaggauggagacuucuuaguccgaaaaagcaccacuaauccaggcucuuuugugcugacagguaugcauaacgggcaggccaagcaccuacuccugguugauccggagggcaccauuagaacgaaggacaggguguucgauuccaucagucaucuuaucaaucaccauuuggaaagcucucugccuauugucuccgcuggaucagagcucugccugcagcagcccguggaacgcaaacaauga

SEQ ID NO: 62473 - RNA, 1893 nt, Artificial Sequence
  derived and/or modified sequence opt3 from SHC4__Homo_sapiens__NP_976224
augagagagaggggccaggacagccuggccgggcucgugcuuuacgucggacuguucggucaccccggcauguugcaucgggcuaaguauucccgcuuucgaaacgaaucuaucaccucauuagaugaggggaguagcggaggcuccguugguaauaaagggucuccucaaccaccgcaccccgcacuggccccucaucuaccaacagaagacgcgacucuccccucgcaggagucaccuacgccacugugcacccuuauuccccguauggcuagcaugaagcuggccaacccugcaacauugcucagucugaaaaauuucugucugggaacuaaggaagugccaagacucaaauuacaggaguccagggauccgggcucuagcggccccuccucaccugagaccagucugagccggucugggacagccccacccccucagcaagaccuuguaggacaccgcgcuaccgcauugacuccagauuccugcccccugccggguccuggcgaacccacacuaagaucaaggcaggaccggcauuuucuccagcaccuucuugggaugggaaugaacuacugugugcgcuauaugggcugcgucgaggugcugcagagcaugcgaaguuuggauuucgguaugagaacccaaguuacgagggaagccauaucucggcucugugaggcugugccaggggccaauggagcgaucaagaagcguaaaccucccgucaaguuucuguccacuguguuaggcaaaagcaaccugcaguucucgggcaugaauauuaagcucaccaucucuacaugcucccuuacucugaugaacuuggacaaucagcagauuaucgcaaaccaccauaugcaaucaauaaguuuugccagcgggggagauccagacaccacagauuacguagcuuauguugccaaagaccccgugaaucagcgcgcaugucacauccuagagugccauaacgguauggcucaggaugucauuuccaccaucggccaagccuucgaacugagauuuaagcaguaccucaagaauccuucucugaacacgagcugugagucagaagaggugcacauugacagucacgcggaagagagggaggaccaugaauauuacaaugagaucccagggaaacagccgcccgugggaggcgucuccgauaugcggauaaagguucaggccacugaacaaauggcauacugcccuauucagugugagaaacuuugcuaucugccagguaacagcaaguguucuucaguguacgaaaacugcuuggagcagagucgagcuaucgggaauguacacccccgcggcgugcagagccaaagagacacaucccuccugaaacauaccugcagggucgauuuauucgacgauccuuguuauauuaacacucaggcccugcagucuacaccaggaucggcuggcaaucagcggagcgcccaaccccuaggguccccguggcacugcggaaaggcaccugagaccgugcagccaggugccacggcucagcccgcgucaagucauucucucccucacaucaaacagcaacuguggagcgaagaguguuaccacggcaagcugucccgcaaggcagccgaaucauugcugguuaaagacggggauuuucucgugagagagagcgcuaccucucccggacaguauguccuguccggccuucagggugggcaagccaagcaucuguugcucguggacccagaaggcaaaguaaggacaaaggaucacguuuucgacaacgugggacaucugauccguuaccacauggauaauaguuuaccuauuauaagcucuggcuccgaggucucacugaaacagcccgugcggaaggacaacaauccagcacuacuccacaguaacaaguga

SEQ ID NO: 62474 - RNA, 2019 nt, Artificial Sequence
  derived and/or modified sequence opt3 from SHCBP1__Homo_sapiens__NP_079021
auggccgacggcagccugaccgggggaggucucgaggcugcagccauggcgcccgaaagaacaggcugggcuguggagcaggaacuugccucccuggagaagggguuguuccaagaugaagacucuugcucagauuguaguuacagggacaaaccuggaagcuccuuacagucuuuuaugccagagggcaagacuuucuuuccggagaucuuccagacgaaccagcugcuauuuuaugaacgguuccgcgcauaccaagauuauauucucgccgacugcaaggcuucggagguccaggaauuuaccgcagaguuccuggagaagguucuugaacccucagguuggcgagccguguggcacacaaauguauuuaaagugcuggucgagauaacugauguggacuucgcugccuugaaggcgguugugcgucucgcagaaccuuaccugugugauagccaggucaguaccuuuacaauggagugcaugaaggaacugcucgacuuaaaagagcauagacugccacuucaggaguugugggugguauucgaugacuccgggguuuuugaucaaaccgcccuggcuaucgaacacgugagguucuucuaucagaacauuuggcggucuugggacgaggaagaggaagacgaguacgauuauuuuguccgcuguguggagcccagacuaaggcuccauuacgacauccuggaagaucgggugccuagcggacuuauugucgacuaccacaaucuguugucccagugcgaggaaucauaucgcaaguuccucaaccugcgaaguagcuuaucuaauuguaacuccgauucagagcaggaaaauaucagcaugguugagggccugaaacucuacagugagauggaacaacuuaagcagaaacugaaguugauagagaacccacuacugagauauguguuuggcuaccagaaaaauucuaacauccaagccaaagggguaagguccagcggacagaagauuacucauguggucucgucuacaaugauggcaggucuccugcggucccuucugaccgaccguuugugccaggaacccggcgaggaggaacgcgagauccaguuccacucagauccucucagugcuauuaaugccuguuuugaaggggacacggugaucguuugcccaggacacuaugugguccauggcacuuucagcauagcggauuccauugagcuggaagguuacggguuaccggacgauaucgugauugagaaaagaggaaagggcgacaccuuuguagacuguacaggcgccgauaucaaaaucucugggauuaaguucguucaacacgacgcaguggagggaauacugaucguccauagggguaaaacuacccuagaaaacugcgugcuccagugcgagacaaccggcgucacggugcggacuagcgcugaauuucugaugaaaaauucagaucuuuauggggccaagggagcuggcauugagaucuaccccgguagucaguguacauuguccgacaacgggauacaccacugcaaggaaggcauucugaucaaggauuuccucgacgagcauuacgauaucccuaaaauuagcaugguuaauaacaucauucacaacaaugagggauauggcgugguacuggucaagccaaccauauuuucugaccuucaggaaaacgccgaggaugggacugaagagaauaaagcacugaagauccaaacaucaggagaacccgacguggccgagcgaguugauuuggaggaacucauugagugugcuaccgguaagauggaacugugcgcgcgcacggacccuagugaacagguggagggcaacugugagaucgucaaugaguuaaucgcagccagcacccagaaagggcagauuaagaaaaagagacuguccgaacuaggaauaacacaagcugaugacaaccucaugucucaggagauguucgugggcaucguagguaaucaguuuaaauggaacgggaagggcucguucggaacuuuccuguuuuga

SEQ ID NO: 62475 - RNA, 1326 nt, Artificial Sequence
  derived and/or modified sequence opt3 from SHF__Homo_sapiens__NP_001288097
augcugcucagcggcgcucccccugccggguccagaccaggaccgaggacccaggguucugcaggcgggggacccggcgguucacggcgcggggccggaggcgcgggcgcugggccuggagguggcgggaguggaggcguggccaaguggcuucgagagcaccuggguuuccgugggggaggcggcgggggagguggcagcaaaccagcacccccugaaccagacuacagacccccugccccauccccggcugcacccccugccccacccccugauaucuuggcugccuauagguuacaacgggagcgcgacuuugaagauccauacucugggggaucgucaggcagcgcggcacuggccacacccgucgcuccggguccuacucccccaccuagacaugggagucccccacacaggcuaauucggguugagacgcccggcccuccagccccgcccgcagacgaacgcauauccggaccuccagcuucuagcgaucgacucgccauccuggaggacuaugcggaucccuucgacgugcaggagaccggcgaaggguccgccggagcaucaggugcuccugagaagguaccagaaaacgauggcuacauggagcccuaugaggcccagaaaaugauggcugaaauuagagggaguaaggagacagccacucagccgcuuccucuguacgacaccccauaugaacccgaggaagauggagcaacaccugagggcgagggugcccccuggccaagggaaagccgguugccugaggacgaugaacgucccccagaggaauacgaccaaccgugggaguggaaaaaggagcgcaucucuaaggcuuuugcggcacaguucgaagggccugagaaauccugccucucacccggcagagaagagaagggaaggcugccaccccggcugagcgccggcaauccuaaaagugcuaagccacucucuauggaacccuccagcccuuuaggggaguggaccgacccggcccugccacuugagaaccaggugugguaccauggagcaauuucgcgaacugaugccgaaaauuugcugcgccuauguaaagaggcuucuuaucucgucagaaacuccgaaacaucaaagaaugacuuuagucugagccuuaaguccucucaggguuucaugcacaugaaacugagcaggaccaaggagcauaaauacguguugggccaaaacucacccccuuuuaguuccguuccagagaucgugcaccacuaugccagccggaagcuccccauaaaaggggcagaacauaugucucuguuauacccugucgcgauccgcacgcuguga

SEQ ID NO: 62476 - RNA, 213 nt, Artificial Sequence
  derived and/or modified sequence opt3 from SHFM1__Homo_sapiens__NP_006295
augagcgagaagaaacagcccguggaccugggccuccuugaagaggaugacgaguucgaagaauuuccugccgaggauugggcugggcuggacgaggaugaagacgcacacgucugggaggauaacugggacgaugacaauguugaagaugacuucuccaaccaauugagagccgaguuagagaagcauggauacaaaauggaaaccucuuga

SEQ ID NO: 62477 - RNA, 1389 nt, Artificial Sequence
  derived and/or modified sequence opt3 from SHH__Homo_sapiens__NP_000184
augcugcuccuugccagaugccuguuguuagugcuggucagcucccuacucguuuguucuggccuggcuugcgggcccggaagggguuucggcaagcggcgccacccuaaaaagcuaaccccacuggcauacaaacaguuuaucccgaacguggccgagaagacauugggggcgucaggacgauaugaaggcaaaauuagucguaauagcgagagauucaaggaacucacucccaacuacaauccugacauaaucuuuaaggaugaggaaaacacgggugcugacaggcugaugacccaacgguguaaagauaagcugaaugcccucgcaauuuccguaaugaaccaguggccaggggugaaauuacgcgucacagagggaugggacgaggauggccaucacucugaagagucgcugcauuaugaaggcagagccguggacaucacuaccucagauagggaccggagcaaguacgggaugcuugcucgcuuggcaguugaggccggauucgauuggguguauuacgagaguaaagcucacauucauugcuccgucaaggccgaaaauucuguggcggcaaagagcgguggcuguuuucccggguccgccacaguacaccuggagcagggaggcaccaaacuuguuaaggaccucucaccuggugaucgagugcuggcugccgacgaucaggggagacuucuguauagugacuucuugacuuuucucgacagggaugacggagccaaaaaggucuucuacgugaucgaaacacgggagccacgugaacgccuguuacugaccgcugcccaccuccuuuuuguggcgccccauaacgauagcgccacgggcgagccugaggcaucuuccggcucagggccaccgagcggaggugcucugggccccagagccuuguucgcuaguaggguccggccugggcaacgaguuuacgugguagccgaacgcgacggagauagaaggcuacugccagcagccgugcacucugucacucucuccgaggaagcugcgggcgcauaugcaccccugaccgcucaggguacaauacuuaucaaucgggugcuggccagcugcuacgcaguuauugaggaacauucgugggcccaccgcgcuuuugccccuuucagauuggcacacgcgcuccuggcugccuuagcaccagccaggacugaccgugggggcgauucuggaggcggggaccggggagguggcgggggacgaguggcucugaccgcccccggcgcagcugaugccccgggugcgggggccacagcuggcauccauugguauucccagcuacucuaccagauuggaaccuggcugcuugacucagaggcauugcacccucugggcauggccgucaaaaguagcuga

SEQ ID NO: 62478 - RNA, 888 nt, Artificial Sequence
  derived and/or modified sequence opt3 from SHISA2__Homo_sapiens__NP_001007539
auguggggcgccagaaggagcuccgugucuucaaguuggaacgcugcaagccugcuccagcuucuguuggccgcguuacuggcugccggggcacgggccuccggagaguacugccacgguuggcuagacgcucaaggcgucuggcgcaucggguuccagugucccgaacgauuugauggaggcgacgcaaccauuugcugugguucuugcgcccuccguuauuguugcucgucagcugaggccagacuggaucaagggggaugugacaaugauaggcagcagggcgcgggcgaaccugggcgggcagacaaggauggaccagacgguagcgccguuccgauauacgugcccuuccuuaucguaggcaguguguuugucgcuuucauuauccugggguccuugguggccgcaugcuguugccgcugucucagaccuaaacaggauccacagcagucuagggcucccggaggcaaccggcugauggagacaauuccuaugaucccaagcgccuccacuucacgcgguaguagcucucgacaauccucaacggcggccagcaguucuuccagcgcaaauucgggggcuagagcucccccuaccaggucucagacaaacugcugccugccagaaggaacuaugaauaacguuuaugugaauaugccgaccaacuuuuccguccucaauugucagcaggccacacaaauagugccccaucagggccaguacuuacacccuccauauguaggcuacaccguucaacaugacucagugcccaugacugccgucccuccauucauggaugggcugcagcccggauaucggcagauccagaguccguuuccucacacaaacagcgagcaaaagauguaccccgcagugaccguguga

SEQ ID NO: 62479 - RNA, 717 nt, Artificial Sequence
  derived and/or modified sequence opt3 from SHISA3__Homo_sapiens__NP_001073974
augagagcccugcucgcucuuugccuguuguuaggcuggcugaggugggggcccgcaggagcccagcaaagcggugaguacugucacggcuggguggacguccaggggaacuaucaugaaggauuccagugcccugaggauuuugacacccuagaugcgacaaucuguugcggcuccugugcucuccgguacugcugugccgcagccgacgcucgccuggaacagggugggugcacuaaugaucgacgugagcuugaacacccaggaauuacggcacaaccgguuuaugugcccuuccugauaguaggcucuaucuuuauugccuucaucauuuugggcucaguggucgcuaucuacuguugcaccugucucagaccuaaggagccaagucagcagcccauaagguuuagccugcgguccuaucagacagagacucugccuaugauccucaccucuacaucgccacgcgcccccucaagacaaagcaguaccgcgacuuccucuagcuccacagggggaucaauuaggcgguucaguuuugcacgcgccgaaccugguugcuuagugccaagcccgcccccuccauacaccacgucucauuccauccaccuggcucagcccucaggcuuccuuguuagcccucaguauuuugccuacccauugcagcaagagcccccgcugccugggaaaaguugccccgacuucucuuccagcuga

SEQ ID NO: 62480 - RNA, 1503 nt, Artificial Sequence
  derived and/or modified sequence opt3 from SHISA6__Homo_sapiens__NP_001166932
auggcccugagaaggcuccuucuguuguuacugcuaagccucgagucccuggaccuucugcccucugugcacggcgcucgggggcgcgcagccaaccgaaccuugucagcgggaggugcugccgucggcgggcguagagcaggaggcgcccucgcuaggggugggcgggaacugaauggaacagcacgcgccccuggcaucccagaggcuggcaguagaagggggcagccggccgcggcaguugccgcugccgcaagcgcugccgugacuuacgaaacgugcuggggauauuacgauguauccggucaauaugacaaggaguucgaauguaacaauucugagucgggcuaccuguauugcugugggaccugcuacuaucgguuuuguugcaaaaagcgccacgagaaacucgaucagcgacaguguacaaacuaccagucacccguguggguccaaacuccuagcaccaaggugguuaguccaggacccgaaaauaaauacgacccugagaaggauaagacaaacuucaccguguauauuacuugcggcgucauagcguuugugaucguagccgguguuuucgcaaaaguguccuacgacaaggcucacagaccacccagggaaaugaauauucaucgggccuuagcugauauccugcgucagcaggggccuauuccaaucgcccacugugagcgcgagacaauaucugcaaucgacaccagcccgaaagaaaacacgcccgucagauccucaaguaagaaucauuauacuccugugaggaccgccaaacagacaccagagaagccccggaugaacaauauucuuacuagcgcuaccgaaccuuacgauuugucuuuuucccgaucauuccaaaaccuggcgcaccuaccacccagcuaugagagugcagugaagacaaauccgucuaaauacuccagccucaagcgccugaccgacaaagaagccgaugaguauuacaugagaaggcggcaccuuccugaccuggcugcccgcggaacguugccccucaacgucauccagaugucgcagcagaagccacugccuagagagaggccccgucggccaauucgagcaaugucucaagauagaguuuuaucccccgacaggggccugccugacgaauuuucaaugccauacgaucgcauccucagugacgagcagcuucugagcacugaacgguugcauucccaggauccgcuacugucucccgagagaacagccuucccugaacaaagccucucaagggcuauaagucacaccgacguguuuguauccacuccagugcuggaucgcuaucgaaugagcaaaaugcauucucaccccucagccaguaauaacagcuacgcaacacuuggccagucccagaccgcggcuaagcggcacgccuucgcaucucguagacauaacacggucgagcagcugcacuauauuccugggcaucauaccugcuacacagccucgaaaacugaggugaccguuuga

SEQ ID NO: 62481 - RNA, 1275 nt, Artificial Sequence
  derived and/or modified sequence opt3 from SHISA9__Homo_sapiens__NP_001138676
augagaagggugcugcggcuccuucugggcugcuucuugaccgaguuaugugcccgcgucugccgagcucaggaacgugcagggcacggacaacuggcccagcuagguggcguucuccugcuugcugggggaaacagaagcggcgcggccuccggugaggcaucugaaggggccgaggcuucagacgcacccccuacaagggccccaacuccggauuuuugucggggauacuucgacgugaugggccagugggaucccccuuuuaauugcaguagcggcgacuucaucuuuuguugcgggacguguggauuccgcuuuugcuguaccuucaagaaaagaaggcugaaccaguccacaugcacuaauuaugauaccccauuguggcucaacacagguaagcccccugcucggaaagacgauccacugcaugaccccaccaaggauaaaacuaaucugauuguauacauaaucuguggcguggucgccgugaugguucucguggggauuuuuacaaaguuaggacuggaaaaggcgcaccgcccucaacgagagcauaugucuagagcacuugccgacgucaugaggccacagggccacugcaacaccgaucauauggagcgggacuugaauaucgugguacacguucagcacuaugaaaacauggauacgcguacuccgauuaauaaccugcaugcuacccagaugaauaacgccgugcccacaucgccucuacuccaacagaugggucacccacauucauaccccaaucuggggcagaucagcaacccuuaugagcagcaaccacccggaaaagaacuuaauaaguacgcaagucugaaagcugucggcuccucugacggcgacugggccgugagcacuuugaaguccccgaaagcggauaaggugaacgacgauuucuauaccaagcgcagacaccucgccgagcuggcagcuaaagggaacuuaccucugcaccccgucaggguugaggacgaaccacgggccuuuucaccugagcauggacccgcuaagcagaauggucagaaaagucgaacaaacaagaugccaccccacccucucgccuacaccagcacgacuaauuucaaaggcugggauccaaacgaacaaucucuucgcagacaggcauacuccaauaaggggaaacugggaacagccgagaccggcucaagcgacccguuggguacuaggccccagcauuauccuccaccccagccuuacuuuauaacaaacaguaagaccgaagugacgguauga

SEQ ID NO: 62482 - RNA, 1038 nt, Artificial Sequence
  derived and/or modified sequence opt3 from SHMT1__Homo_sapiens__NP_001268715
augggccuggaccuccccgaugggggacaccuuacccaugguuucaugacagacaagaaaaagaucagcgccacuuccauuuucuucgagucuaugccuuacaaagugaacccagauacgggcuauauaaauuacgaccagcuggaagagaacgcuagauuguuucacccgaaguuaaucauugcagggaccucaugcuauaguaggaaucuggaauacgcccggcuacgcaaaaucgcggaugagaacggagcuuaucucauggccgacauggcacauauuagcggccuggucgccgcugguguugugcccuccccuuucgaacacugucauguagugacaacuaccacacacaagacccuucgagggugccgugcaggaaugaucuuuuacagaaagggcgucaaaucuguggauccaaagacuggcaaagagauacuguauaauuuggagucgcucaucaacucagccguuuuccccgggcugcaaggagguccucacaaucaugcuauugccggcguggcggucgcacugaagcaggccaugacacucgaauuuaaaguguaccagcaccagguaguugcuaacuguagggccuuaagcgaggcacugaccgaacuuggguacaagaucgugacgggaggcagugacaaucauuugauucuggucgaucuacgguccaaggguacugacgggggacgcgcugagaaagugcucgaggccugcucuaucgcguguaacaagaauaccugcccaggcgauagaagcgcccugaggcccuccggccuucggcuggggacuccugcauugacaucacgcggacuccuggaaaaagacuuccaaaagguggcucacuuuauacaccgagguauugaguuaacccugcagauccagagugauacaggcgucagagccacccucaaagaauuuaaggagaggcuugcuggggacaaauaucaggccgcaguucaagcccugcgggaagagguggagagcuuugcuucuuuguucccacuaccgggacugcccgacuuuuga

SEQ ID NO: 62483 - RNA, 1485 nt, Artificial Sequence
  derived and/or modified sequence opt3 from SHMT2__Homo_sapiens__NP_001159828
augcuguacuucagccucuuuugggccgcuagaccccuucagaggugcggccaacuggugcggauggcaauccgcgcccagcacuccaacgcggcucagacccagacaggggaggccaaucgaggauggacuggucaagaaucuuugucagacagugauccugagaugugggaauuacugcagcgugagaaggacagacaguguaggggccuagaacucauugcaagcgagaacuucugcucccgggccgcucuggaggcacuugggucuugucugaauaacaaauauucggaaggauacccaggcaagcgcuauuacgguggggccgaggucguugaugaaauagaguugcucugccagagaagggcucuggaggccuuugaccuggauccggcgcaauggggagugaauguacagcccuauucaggcagcccugcaaaccucgccguguacacggcuuuacugcagccacaugaccggaucaugggccuugauuugcccgacgggggacaccugacccaugguuauaugagugaugucaaacgcauuuccgccacaucuaucuucuuugaaagcaugccuuacaagcuaaaucucgcacugacugcucgacuuuucagaccaaggcugauuaucgccggcaccuccgcguacgcccgguugauagacuaugcacguaugcgcgaggugugugaugaaguuaaagcucaccuccuggccgacauggcucauaucucaggguuaguggccgcaaaggucauucccaguccuuuuaagcacgccgauaucgugacaaccacuacacacaaaacccugagaggagcuaggagcggccucauuuucuaccggaaggguguaaaagcgguugacccaaagacggggcgagagaucccguauacuuuugaagaccgcauaaacuucgcaguguuucccucucuucagggaggcccucauaaucacgccauugcugccgucgcaguggcccugaaacaggcuugcaccccaauguucagagaguacucccuucaagugcuaaagaacgccagggcaauggcggaugcucugcucgagcggggcuauucacuggucagcgggggaacagacaaucaucuuguucugguggauuugcgccccaagggucucgacggcgccagagcagaaaggguacuggaguuagugaguaucacugccaacaaaaauaccuguccuggggaucguucugcuauuacaccaggaggccugcggcuaggugcccccgcacucaccucccgacaguuuagagaagacgauuucaggcgcgucguggacuucaucgaugaggggguuaacaucggccuggaagucaagagcaaaacggcuaaguugcaagacuuuaaaucguucuugcugaaggauucugagacuucccagcggcucgccaaucugagacagaggguggagcaguuugcgcgcgccuucccgaugccuggauuugacgaacacuga

SEQ ID NO: 62484 - RNA, 1611 nt, Artificial Sequence
  derived and/or modified sequence opt3 from SHOC2__Homo_sapiens__NP_001255968
augagcuccucucugggcaaggagaaagacucaaaggaaaaagaucccaaggugccuagugccaaagagagagaaaaggaggcuaaggcaagcgggggauucgguaaagaauccaaggagaaagagccaaagaccaaaggcaaggacgccaaggaugggaaaaaggacucuucggcggcucagccgggagucgccuuuucaguugauaacacaaucaaaaggcccaauccugcaccaggcacucggaagaaaagcaguaacgccgaagugauuaaggagcucaauaaaugccgcgaagagaacuccaugcgacuugaccugucuaagcguagcauacacaucuugcccuccucaauuaaggaguuaacgcaacugaccgaacuauaccucuauaguaauaaacugcagagccuuccugcugagguagguugucuggugaacuugaugacacucgcacugucugaaaauucccugacuucacucccagauagcuuagacaaccugaagaaacuuagaauguuggaucugaggcauaauaagcuacgggagauccccagugucguguaccgccucgacucucugaccacacuuuaucugagauucaacaggauuaccacuguugaaaaagauaucaagaauuuguccaagcucagcaugcugucgauacgggagaacaaaaucaagcaguuaccugccgagauugggaaucugucuucccucucacgccuuggacugcgauacaacagauugagugcuaucccaaggagccuagccaaaugcuccgcgcuggaggaacucaaucuggaaaacaacaauauuucuacacuuccggagagccuguugucaagucucgugaagcugaacuccuuaacccuggcacggaauuguuuucagcuauaucccgucggcggcccuagccaauucucuacgaucuacucacucaacauggaacacaaucguauaaacaaaauuccauuugggaucuucagucgcgccaaggugcugagcaaacuuaauaugaaagacaaccaguugacuucccugccccucgauuuuggaaccuggacaucuaugguagagcugaaucuugcuacuaaccagcugaccaagauuccugaggacguuucggguuuggugagccucgaaguccugaucuuauccaauaaccugcuaaagaagcucccacauggccuggggaaucuuagaaaauugagggagcuggaccucgaagagaacaagcuggaaucauuacccaaugagaucgccuaucugaaggaucuucagaaauuggugcucacaaacaaccaacugaccacgcuaccgcggggaauuggccaccugacuaaucucacacaucugggucuuggggagaacuugcugacccacuuaccugaagagauaggaacucucgaaaaucuggaggagcuuuaccugaacgacaaucccaacuugcacagucucccauucgaacuggcacuaugcucuaagcugagcaucauguccauugagaauuguccucucucacaucugcccccacagaucguggcuggcggccccagcuuuauaauucaguuccuuaaaaugcaggggccuuaccgagccauggucuga

SEQ ID NO: 62485 - RNA, 960 nt, Artificial Sequence
  derived and/or modified sequence opt3 from SHOX2__Homo_sapiens__NP_001157150
auggaggaacugaccgccuucgugagcaaguccuuugaccagaaagucaaggagaaaaaggaagcuaucacauacagagagguucucgaaucuggcccccuuaggggagcaaaagagccuacugggugcacggaggccggucgggaugaccgcucaaguccagcggugcgagcugccggcgggggaggcggugggggaggcggcgggggagguggcgggggaggcggugggguaggaggcggcggggcaggagguggcgccgggggaggccguagcccggugagagaacuggauaugggugcugcagagaggucccgggaacccgggucuccucgcuugaccgaggucucgccagaguuaaaggacagaaaggaagaugccaaaggcauggaggacgaaggacaaacaaagauuaaacagaggcggucacgcacuaacuucacccuggagcagcuaaaugaacucgagcgacuguuugaugagacacacuaucccgacgcuuucaugagagaggaacuuagccagaggcugggcuugagugaagcccgggugcaaguuugguuucagaaccgucgcgcgaaguguagaaaacaggagaaucagcuccauaagggggugcugauaggagcagccucccaauucgaagcaugcagggucgccccuuacgugaacguaggugcacugcggaugccauuucagcagguucaggcucaacuccaguuagauucugccguggcgcacgcccaucaccaucugcacccccaccuugcagcucaugccccuuauaugauguucccagcuccgcccuuuggcuugccucuggccacccuagcagccgacagcgcuuccgcggcaucagucguggccgcugccgcagccgcuaagacuacaaguaaaaauagcucuaucgccgaucuccgacugaaggcuaaaaagcacgcggcugcccuugggcuguga

SEQ ID NO: 62486 - RNA, 879 nt, Artificial Sequence
  derived and/or modified sequence opt3 from SHOX__Homo_sapiens__NP_000442
auggaggaacugaccgccuucgugagcaaguccuuugaccagaaaucuaaggauggcaacgggggagguggcgggggaggcgguaaaaaggacucaaucacauacagagagguccucgaaagugggcuugcuaggagccgggagcugggaacuuccgauucuucguugcaagacauuacggaaggcggcgggcacugccccguucauuuauucaaagaucacguggacaaugauaaggagaagcugaaagaguuuggaaccgcacgcguagccgaagguauauaugaguguaaggaaaaacgagaggacgugaagucagaggaugaagacggccagacaaaacuaaagcagcguagaagcaggacuaacuucacccucgagcagcugaaugaacuugagcggcuguuugaugaaacacauuacccugacgcguucaugcgcgaggaguugagucaaagacucgggcuguccgaagcuaggguccaggugugguuucagaaccggcgcgccaagugccgaaaacaggagaaucaaaugcacaagggaguuauccugggcaccgcaaaccaucucgaugccuguagaguggcuccauaugucaauaugggugcauuaaggaugccguuccaacaggugcaggcccagcugcagcuugaagggguagcucacgcccacccccauuugcacccucaucuggcggcacacgccccauaccuaauguuucccccuccacccuucggacucccuauugcuucucuggccgagagcgcauccgcugccgcgguuguggccgcagcugccaaaucaaacaguaagaauagcucuaucgcugaccuucggcugaaagcccguaagcacgcagaagccuugggccucuga

SEQ ID NO: 62487 - RNA, 1437 nt, Artificial Sequence
  derived and/or modified sequence opt3 from SHPK__Homo_sapiens__NP_037408
auggccgcuagacccaucacccugggcauugaccucgggacaacuagcgugaaggcagcccuucugagggcggcuccugaugacccauccggauucgccgucuuggcaucuugcgcccgggcugcacgcgccgaggcugccguugaaucagcgguggcagguccgcagggccgagagcaagauguaagucguauauuacaggcccugcacgaaugucuagcugcccuccccagaccucagcugaggagcguggucgggaucggaguguccggccagaugcaugguguuguguuuuggaaaacggggcaaggaugcgaguggaccgaaggcggcauuacaccagucuucgagccccgggcagugucucaccuuguaacuuggcaggacgggcgcuguucgucagaguuucuggcuagcuugccucagccaaagagucaucucuccguugccaccggauucgguugcgcgacaaucuuuuggcugcugaaauacagacccgaguuccucaagucuuaugaugccgcaggcaccauucacgacuacguggucgcuauguuaugugggcugccuaggccacuuaugagcgaucagaacgccgcuuccuggggauauuuuaauacucaaucacagaguuggaacguggaaacauugcggagcucuggcuucccggugcaucugcuacccgacaucgccgaaccugguuccgucgcagggcgcaccucacacaugugguuugagauaccaaaaggaacgcagguuggcguggcccucggcgaucugcaggcuagcguauacaguugcauggcgcaacgaacugacgcagugcuuaauaucucuaccuccguccagcuggccgcuagcaugcccucgggguuccagccugcccaaacaccagaucccacugcaccgguggccuauuuuccuuacuucaacagaaccuauuugggaguugcugccucucucaaugguggcaacgugcuggcaacauuuguccacauguuagugcaguggauggcggaccuggggcucgagguagaagaguccaccguuuacucaaggaugauucaggcugccgugcagcaacgggauacgcaucuuacuaucacacccaccguccugggagaacgucacuugccagaccagcuagcaagugugacucgcauuagcuccucugaccugagccucggccaugucacaagagcccuguguagggguaucgugcagaaucuucacucaaugcugccuauacagcaauugcaggaguggggcguugaacgggugauggggaguggauccgcucucagccgaaacgauguacugaagcaggagguccagcgcgccuuccccuuaccaaugucuuucggccaagacguggaugcagcuguuggggccgcgcuggugaugcuaagaaggcaccucaaucagaaggagucauga

SEQ ID NO: 62488 - RNA, 5052 nt, Artificial Sequence
  derived and/or modified sequence opt3 from SHPRH__Homo_sapiens__NP_001036148
augagcuccagaaggaagcgggcccccccugugcgcgucgacgaggaaaaacgacagcaacugcacuggaacaugcaugaggaucguagaaaugaaccaaucauuauaucugacgaugacgagcagccgugccccggcucagauaccaguagcgcucacuacaucauucucuccgacucucuuaaggaagagguugcacauagggauaaaaagcgguguucgaaagugguaucauucagcaagccuaucgagaaggaagagacaguggggauuuuuaguccacuguccgucaaauugaacaucgugauaucucccuaucacuucgacaauagcuggaaggccuuuuuaggagaacugacucuacagcuccugccugcgcagucccuuaucgagaacuucucagagcgcaguauuacgcugaugagcucugaauccucaaaucaauuuuugaucuacguucauagcaaaggugaggauguggaaaagcagaaaaaggagccaaugaguauuugcgacaagggcauccucgucgaaucuuccuucagcggggagaugcuggaggaucugggauggcuccagaaaaagagaaggauaaaauuauaucagaagcccgaaggcaaccacauuaucaaaguggguauuuaccugcuugaggcuggguuggccaagcuggacuuucuaucggaugcaaauucucggaugaaaaaguucaaccaacucaugaagaaaguaauggaaaagcugcacaauuccaucaucccugacguucuugaggaagacgaggaugacccagagucagaaccggagggacaggauauugacgaacuguaucauuuugugaaacagacccaccagcaagagacacagaguauacaggucgaugugcaacaucccgccuugaucccugugcuccgcccauaccagcgagaagcugucaacuggaugcugcagcaggaguguuucagaagcucccccgcaacugagucugccuuacacuuucuguggagggaaauuguuaccagcgagggccucaagcuuuauuacaauccuuacacaggcugcaucauacgggaauauccaaacucagggccccaacuguugggagguauucuagcugacgagaugggccuggggaaaaccguggagguacucgcccugauccuuacucacacacgucaggaugugaagcaggacgcgcugaccuugccggaaggaaaggucgugaauuacuucaucccuagucauuauuuuggcgguaaacucaagaaaacggagauucagaacaucgaauucgagcccaaggaaaaaguucaauguccaccuacucgcgugaugauucugaccgcagucaaggagaugaaugggaagaaaggaguguccauauuaagcaucuacaaguauguaucuucaauuuacagauaugauguucagaggaaccggagucugcuaaaacgaaugcucaagugccugaucuucgagggccuugugaaacagaucaagggccacggguuuagcggaacauucacuuuggguaagaacuacaaagaagaggacauuugugauaagaccaaaaagcaggccgucggcuccccccgcaaaauacaaaaggaaacaagaaaaucugggaauaaggacaccgacucggaguaccugccaagcgauacguccgacgaugacgaugaccccuauuacuauuacuauaagucaaggcggaaccgcaguaaacucagaaagaaacuggugccuucuacuaagaaaggaaagagccagccauuuaucaauccggauucccagggccauugccccgcuacaucagacagcgguauuaccgaugucgccaugucuaaguccacuuguaucagugaauucaaccaggagcacgagacagaagacugcgcagagagccuuaaucaugcugauucugacgugccuccauccaacaccaugucacccuuuaauacgagugauuacagguucgaauguauuugcggggagcuggaccaaaucgaccguaaaccucggguucagugcuugaagugucaccucuggcagcacgccaaaugcgugaacuaugaugaaaagaaucugaaaauaaagccauuuuacuguccccauugcuuaguagcgauggagccggucagcacccgagccacacugaucauuucgccuuccucuaucugucaccaauggguggacgagauuaacagacauguuaggagcucaagucuacgcgugcucgucuaccagggcgugaagaaagauggauuccugcagccacacuuucuugcagaacaggacaucguaauaauuacuuaugauguguugcgguccgagcugaauuacguugacaucccccacucuaacagcgaagauggcagaaggcuccgcaaucaaaagcgauauauggcuauuccuuccccccuggucgccguggagugguggcggaucugcuuagacgaggcucagaugguggaauguccaaccgucaaagccgcagagauggcccagcgucugucagggauaaacagauggugcaucagcggaacaccuguucagaggggucuugaagauuuguucggccucgugguguuucuggggauugagcccuacuguguaaagcauugguggguccgccuacuguaucggccauacugcaaaaagaauccgcaacaccucuauaguuucaucgcuaagauucuguggagaucugcgaaaaaggacgugaucgaucagauacagauuccuccccagacugaagagauccauuggcuucacuuuuccccaguugagaggcauuucuaccaccgacaacacgaaguguguugccaggacgucgugguuaaauugcgcaagaucagcgauugggcacugaaauuaucgucacucgaccggagaaccgugacaucuauucuguacccccuucugagguugcgucaggccugcugucauccucaagcuguacgcggagaguuccucccacugcagaagaguaccaugacuauggaagagcuacugacgucccuccagaaaaagugcggcacagaaugugaggaggcccaccggcagcuggucugcgcacuuaacgguuuggccgggauccauauuauaaagggcgaauaugcucuggccgcagaguuauacagagaagugcucaggagcucugaggaacacaaaggaaagcugaaaaccgacagccuucaacgacugcaugcgacucacaaccuaauggagcuccugaucgcucggcaccccggcauuccuccgaccuugcgcgaugggagacuggaggaagaggccaagcaguuaagggaacauuauauguccaaauguaauacagagguggcagaggcccagcaggcucucuacccaguccaacagaccauccacgaacugcagcggaagauucauucaaacagucccugguggcuuaauguuauccaccgagccauagaguuuacuaucgacgaagagcuggugcagagaguacgcaacgaaauuacaagcaauuauaagcaacagacgggaaaauugucuauguccgagaaguucagggauugccguggucuccaguuucugcuaaccacucagauggaggaacugaacaaaugucaaaagcuugugcgggaggcagucaaaaaucucgaaggcccuccaucaagaaacgugaucgagagugcuacaguuugccaccugaggcccgcccgcuugccucugaauuguugcguguucuguaaggcggacgaauuauuuaccgaguacgagagcaagcucuucuccaacacagucaaagggcagacugccauuuuugaagagaugaucgaagaugaggaaggacugguggacgaucgagcuccgaccacgaccagaggccuuugggcaauaucugagacagagcggucgaugaaggccauucugagcuucgcuaaaucacauagguuugacguugaauucguggaugaggguuccacuaguauggacuuguuugaagccuggaagaaagaguauaagcuccugcacgaguacuggauggcacuacgcaaucgugucucugcgguagaugaacuggccauggcuaccgagagacuucgggugagggacccccgcgaaccaaagccuaaccccccaguucuccauaucaucgagccucacgaaguggagcagaaucgaauuaaacuguugaacgacaaggccgucgcaacaagccaauuacagaaaaagcuggggcagcuccuguaccuuacuaaucuggagaaaucccaggauaagaccucaggcggagugaaccccgaaccaugcccgauaugcgcuagacaauugggcaagcagugggccguacuaacgugugggcauugcuucuguaacgagugcaucucuauuaucauugaacaguauagcgugggaagucaccgguccagcaucaaaugugcaauaugcaggcagacaaccucucacaaggagaucucauacgucuuuacuuccgaaaaagccaaucaagaggaggacauuccuguuaagggcagucauagcacaaaaguggaagcugugguccgcacccugaugaagauccagcucagagaucccggugcgaaagcccugguguucucgacuuggcaggacguucuugauauuaucucuaaggcauuaaccgacaacaauauggaguucgcucagauauccaggguaaagacauuucaagaaaaccugagcgccuucaaacgggauccacagauuaauauccucuugcugccccuccacacggggucaaacggacugaccaucauugaggccacucaugugcuucuggucgaaccuaucuugaauccagcucacgagcuacaggcaauaggccgugugcaccgcauuggucaaacaaagcccaccaucguucaucgauuucugauuaaagccacaaucgaggaaagaaugcaggcgaugcucaagacugcugagaggagucacaccaacucuuccgccaaacauagcgaagcaucaguguuaacggucgccgaccuggcugaucuuuucacaaaggagaccgaggaacuggaguga

SEQ ID NO: 62489 - RNA, 1734 nt, Artificial Sequence
  derived and/or modified sequence opt3 from SHQ1__Homo_sapiens__NP_060600
augcugacccccgccuucgaccucagccaggauccugacuuucuuacaaucgcuauuagagugccauacgcaagggucuccgaguucgauguuuauuuugaaggcucugacuucaaguuuuacgccaaaccguauuuccugcgguugacuuuacccgggcgcauaguggagaacggaucagaacaagguaguuacgaugcggacaagggcaucuuuacgauucgacugccuaaagagaccccagggcagcacuucgaaggacuaaauaugcucacagcucugcuugcaccccguaagagcagaacugccaaaccucugguagaggagaucggcgccuccgaaauuccagaggaaguggucgaugacgaggaguuugauugggaaaucgagcagacccccugcgaagaggugucugaaucggcuuugaacccucagugucauuaugguuucgggaaucucaggucaggaguucugcaacggcugcaggacgagcucagcgaugugauagacaucaaggauccagacuuuacaccggcagccgagcgcagacagaagagguuagcugccgaacuggcgaaauucgaccccgaucacuaccuugcagacuuuuucgaggaugaagccauugagcagaucuugaaguauaacccuugguggaccgacaaauacaguaagaugauggcuuuccuggaaaaaucccaagagcaggagaaucaugccacucuagucucuuuuagcgaagaggaaaaguaccagcuccggaaguucgugaacaaauccuaucugcuugauaagcgcgcaugccgacagguauguuacucacugauugacaucuugcucgcuuauugcuacgagacaagaguuaccgaaggcgagaaaaauguggagagugccuggaacauaaggaagcugagcccaacguuauguugguuugaaacuuggaccaauguccacgauauuauggugucuuucggccggcgugugcugugcuauccccucuaccgccauuuuaaacuugucaugaaggcguauagagacacaaucaaaauucugcaauuggggaaguccgccguucuaaagugucugcucgauauccacaaaaucuuccaggagaacgacccugcauacauucugaaugaucuuuacauaucagacuauugcguguggauccagaagguaaaaagcaagaaacuggcugccuuggcugaagcccucaaggaggugagucugacuaaggcacaauuaggacuggagcuagaggaacucgaagccgcugcgcugcuuguccaggaggaagagaccgcauugaaagccgcucacucuguguccggucagcagacacuguguagcucgucugaggccuccgacucagaagauagugacagcuccguuucuagcggcaacgaggauucagggagugacuccgaacaagaugagcucaaggacagcccaucugaaaccgugucaagucugcagggacccuuucuugaggagagcuccgcauuccugauugucgauggcggugugaggcggaauacggccauccaggaaucugacgcuucgcaggggaaaccguuggccagcuccuggccucucggaguaucaggcccccugauagaggaauuaggcgagcaacugaagacuacaguucaggugagugaaccaaaagggaccacugcagucaaccgaucuaauauucaggagcgcgauggaugccagacaccuaacaacuga

SEQ ID NO: 62490 - RNA, 4851 nt, Artificial Sequence
  derived and/or modified sequence opt3 from SHROOM2__Homo_sapiens__NP_001640
auggagggcgccgaacccagagcuaggccugagcggcuggcagaagccgagacccgcgcggcugacgggggacgacucguggaaguccagcuuagcgguggcgccccauggggguucacacugaagggaggccgugagcacggugagccguugguuaucacuaaaauugaagagggguccaaggcagccgcuguggauaaauuacuggcaggagacgaaauaguaggcaucaacgauauuggccuaucuggguuuagacaagaggccaucugccucgugaagggaucacauaaaacgcugaaacuugucgugaagaggcggagugagcuggguuggcgcccccacagcuggcaugcuaccaaguucuccgacucucacccugaauuggccgcgucgccauuuacaucaacuagcggcugucccaguugguccgggagacaucacgcaucuagcuccucacacgaucucaguagcucuugggagcagaccaaucugcagaggacacuggaccauuucuccucacucggaagcguugauaguuuagaccacccuucuucccggcugagcguggccaagucgaacucuuccauugaucaucuuggcucacacaguaaacgcgacagcgcuuacgguuccuuuucuaccagcucaaguacuccagaucacacauuguccaaggccgacaccagcucugcagaaaauauccuguauacggucgggcuaugggaggcuccccgacagggaggcagacaagcccaggcggccggcgauccucaggggucagaagagaaacucaguugcuucccaccgagggugcccggagacagcgguaagggcccucggccagaguacaacgcagaacccaagcuggcugccccugggcguuccaauuuuggaccaguaugguauguucccgacaaaaagaaagcuccgucuucgccucccccaccucccccaccccuucgcagcgauuccuucgccgcaacuaagucacaugagaaagcccagggcccuguguuuagugaagcugcggcagcccaacacuucaccgcucuggcccaggcacagccaagaggugacaggcggccggaguugacagaucgacccuggcgcucugcccauccugggagccucggcaagggauccggcgggccaggauguccccaggaagcucacgccgacgguucauggccuccaagcaaagauggcgcaucuuccagacugcaagcgaguuuaagcagcuccgacgucagguuuccccagucaccgcauagugggcggcacccuccacuguacagcgaucacucgccccucugcgcugacucccuuggacaggagccuggcgccgcaucuuuccaaaacgauucucccccacaggugcgcggucugucaaguugugaccagaaguugggguccggcuggcagggaccuagacccugcgugcaaggcgaucuacaggccgcucagcugugggccggguguuggccaucugacacugcacucggagcucuggagagccuuccgccucccaccgucggucaguccccaaggcaucaucugccccaaccugaaggcccacccgacgcccgugagacagggcggugcuauccuuuggauaagggagcggaaggcuguucagccggugcucaggagccgccacgagcaagcagagccgaaaaagcuagucagaggcucgccgcaucuauaaccugggcggacggggaguccagccgcaucugcccccaggagacgccucuguuacacucgcugacucaagaaggcaagcggagaccagagucaucucccgaagauagugccacaaggccuccgcccuuugacgcucacguuggaaaaccaacccgccgauccgaucgguucgccacuacacuacguaaugagauucagaugcacagagcaaagcuccagaaaagcaggucuaccguggcucugacggccgcaggcgaggccgaagacgggaccggacgcuggcgggcuggccuuggugggggaacacaggagggcccuuuggcggguacuuacaaggaucaucugaaggaagcccaagcaagaguacucagggcuaccagcuucaaacgacgcgaccuggaucccaacccaggcgaccuuuauccugagucccuggaacaccggaugggggaucccgacacagugccacauuuuugggaggccggauuggcccagccgccuucaaguacuagcggcgggccccacccacccagaaucggaggcaggcgucgcuucaccgcugagcagaagcucaaaucuuacuccgaaccugagaagaugaaugaagucggucugacacggggguacucaccacaucaacaccccagaaccagugaggauacugugggaacguuugcagacagguggaaauucuuugaagagacaagcaagccuguuccgcagcgaccagcccagaagcaggcguuacacggcauuccccgggacaaaccugagcgccccagaaccgcugguaggacuugugaaggcaccgagccauggucccggacaaccucucugggggauucgcuaaacgcccauagcgcagccgaaaaggcuggaacuucagaccucccucgaagacugggcacauucgcagaguaucaagccuccuggaaagaacagcgcaagccccuugaggcgaggaguucugggcguugccacagcgcugaugacaucuuggaugugucccuggacccacaggagcggccucagcauguccacggaagaucaaggucuagcccgaguacggaucauuacaaacaagaagccuccguggagcuccgccgacaggcaggcgaccccggugaaccaagagaggagcugccuagcgccguacgggcugaagaggggcagucuacccccaggcaggccgaugcacaaugccgcgaaggaucaccaggcucccagcagcacccucccagucaaaaggcuccgaauccaccuacuuuuagcgaguuaucgcacugucguggugcccccgaacugccaagagagggccgggggagggcgggaacacuuccccgcgacuaucgauacucugaggaauccaccccugccgauuugggcccgagagcacagagccccgggucaccacuccaugcucggggacaggacaguuggccuguuucuuccgcccugcuaagcaagaggcccgcuccucagcgcccacccccuccaaaaagagagcccaggcgguaucgugcaacagauggcgccccggccgacgcuccuguggguguccuggggcgcccauuccccacuccuucaccagcgagucucgacguguacgucgcacgacugagccuuucccacucucccagcguguuuuccucagcccaaccgcaggauaccccuaaggcuacgguuugcgaaagaggaucucagcaugugaguggcgacgccucgaggcccuugccagaggcacuguuaccucccaaacagcaacaccuccggcugcagaccgccacaauggaaacuagccgcuccccaucuccccaguucgcuccucagaaacuuaccgauaagccaccgcuguugauacaagacgaggauucaacaagaauugagaggguaauggacaacaauacuaccgucaagauggugcccaucaaaauuguucacagcgaaucccagccugagaaggaaagucggcagucucucgcguguccagccgagcccccugcacugccacauggccuagaaaaggaucagaucaaaacgcugagcacaucagagcaauuuuauucccgauucugccucuacaccagacagggggcugagcccgaagccccucaccgcgcacagccggccgagccacaaccccugggaacucaggugccucccgaaaaggacagguguacaaguccaccuggucuuagcuacaugaaagcuaaggagaaaaccgucgaggauuugaagucugaagaacuggcccgggaaaucgugggcaaggacaaauccuuagcggauauucucgaccccucaguaaagauaaaaacuaccauggaccugauggaggggaucuuuccaaaggaugaacaucuucuggaggaggcacagcagcguagaaaacuacucccgaagauuccuagccccaggucgacagaagaacgcaaggaggagccaucugugcccgccgcuguuagucuggccacgaacuccaccuauuacagcacuucagcuccuaaagcagaauugcugaucaagaugaaagacuuacaagagcagcaggagcacgaagaggauuccggaucugaccucgaucaugaccugagcgucaagaaacaggaacuuauagagaguauuucccggaagcugcaaguguugcgagaagccagagagagccuccuggaggaugugcaggcuaauacaguccuaggcgccgaaguugaggcaaucgugaagggugugugcaaaccaucugaguucgacaaguucaggauguuuaucggggaucuggacaaaguagucaaccuucuccugucauugaguggacgccuggcgcggguggagaacgccuuaaauaaccucgaugacggcgcuucccccggcgauagacagagccugcuugagaagcagcguguucugauucaacagcacgaagacgccaaagaguugaaggaaaaucucgacaggcgggagcgcaucguguucgauauucuggcaaacuaucuaucugaagagucgcuggcugacuacgagcacuuugucaaaaugaagucagcccuuauaaucgaacagcgagagcucgaagauaagauucaucugggggaggaacaauugaaauguuuacuggacagccuccagccugagagaggaaaguga

SEQ ID NO: 62491 - RNA, 5991 nt, Artificial Sequence
  derived and/or modified sequence opt3 from SHROOM3__Homo_sapiens__NP_065910
augaugagaaccacugaggacuuccacaagcccucggccacucugaacuccaauacggcuaccaaaggcagguacaucuaucucgaagccuuucuugaagguggggccccuuggggguucacccugaagggcggguuggaacauggagagccauuaauuauaucuaaaguggaagagggcgguaaggcggauacucugucaaguaaacuccaggcuggggacgaggucguucacaucaacgaagugacccucuccuccucucggaaggaggccguaucgcuggugaagggaucauacaaaacacuucgccuggucgugcgacgugauguuugcaccgacccgggccaugcagauacuggcgccagcaauuuugugagucccgaacacuugaccuccgggccucaacauagaaaggcugcauggucuggaggugucaaacucaggcugaagcaccggcgcagcgagccagccggcagaccccacuccuggcauaccacgaaaucaggggagaagcagccugacgcuaguaugaugcagauuagccagggaaugaucggcccacccuggcaccaaucuuaucauuccucaagcaguacuucugaucuguccaacuacgaccacgccuaucucaggcggagcccugaucaguguucgucucaggguuccauggaaucauuagagccaaguggggcguacccgcccugccaccugagcccugcaaaguccaccggaucuauugaccagcuuagccauuuccacaauaaacgcgauucagccuauaguuccuuuagcacaucuucaaguaucuuggaauacccacaucccggcauaagcggccgagagagauccgggucuauggacaacacuucggcuaggggaggucugcuagaaggcaugcggcaagccgauauccguuacgugaagaccguguaugacacacgcagagggguuagcgcagaguacgagguaaauuccucagcucuccugcuucagggaagggaagcccgggcgagugccaacggccaggguuaugacaaauggucuaauauuccucgagggaagggcgucccacccccgagcuggucccagcaauguccuucaagccuggagaccgcaacggauaacuugcccccaaaagugggagcuccucuaccaccagcccgcucugacuccuacgcugccuucagacacagggaacggcccaguagcuggucuucccuggaucagaagcgcuuaugcagaccucaggcaaauucacugggcagucucaaaagcccauuuaucgaggaacaacuucauacugugcuggagaagucgccggagaacucucccccugucaagccaaaacacaauuauacacagaaggcccagcccgggcagccuuugcuaccaaccagcauuuaccccguuccgagccuggaaccucacuucgcucaagugccacagcccucaguaaguuccaacggaaugcucuauccugcgcuggcaaaagagucugguuacaucgcaccccagggcgcuuguaauaagauggccacuauagacgaaaacgggaaccagaauggaagcggcaggccagguuuugcauucugccaaccucuugagcaugaucuguugucccccguggagaaaaagccagaggccacagcuaaguacgucccgucaaaagugcacuuuuguagcguuccugagaacgaagaggacgccagucucaagcgucaucugacacccccacagggaaauucuccccacuccaacgaacggaaaagcacgcacucgaauaagccuucaucucauccacacaguuuaaaaugcccccaggcacaggcguggcaagcuggcgaggauaagcgauccagcagacugucugagccuugggaaggagacuuccaggaggaucauaacgccaaucuauggaggcgccucgaacgggagggccuggggcagagccuuuccggaaacuuugguaagaccaaaucagcauucaguagcuugcagaauauuccggaaucucugagaaggcacuccucacucgagcugggccgcgggacacaagagggauauccaggcggucgacccacuugugccgugaacaccaaggcugaagacccugggcggaaagccgcaccagaucuuggcagucaucuggaccgucaggucagcuaccccagaccugagggaaggacaggcgcuuccgccucuuucaauucgacugacccgagccccgaggaacccccugcgcccucacacccacacaccuccaguuuggggcgccggggaccuggccccgguucugccagcgcucuccagggguuucaauauggaaagccacauugcuccgugcuggaaaaaguaucaaaguucgagcagagagagcagggcucucagaggccgagcguugguggcaguggguuuggacacaacuaccgaccucaucgcacaguguccaccagcucuacuucaggcaaugauuucgaagagacgaaggcacacauccgguuuuccgaaagugccgagcccuuagggaacggagaacaacauuucaaaaauggcgagcugaagcuagaggaagcuagcagacagccauguggucagcagcucagcgggggagccucugacuccggcagggguccccaacguccugaugcacgccugcuucggagccagucaacauuucaguugaguucugagccagaaagagagcccgaguggagggaccgaccuggcuccccggaaagcccacugcucgaugcgcccuucucacgggccuaucgcaacaguauuaaagacgcucagagcagaguccugggggccaccuccuuuaggcggcgagauuuagagcugggagcaccuguggcuucuagaagcuggcgccccaggccauccucagcccacgucggccuucguucuccugaagcaagugccucggcuagcccccacacuccacgggagagacauuccgugaccccugcggaaggggacuuggccaggccgguucccccagcagcucgccgaggagccagacggaggcucacaccugagcaaaagaaacgcucuuacucagagcccgaaaagaugaacgaggugggcaucguagaagaggccgaaccagcuccucuggguccccagcguaaugggaugagauucccggagagcuccgucgcagaucggaggcgccuauuugagcgagacggaaaagccugcaguacccugucucucagcggcccagaacugaagcaguuccaacagucagcgcuugcugauuauauccagagaaagacugguaaacggccuacauccgccgcaggcugcaguuugcaggagcccgggccacugagggaacgcgcccaaagcgcuuacuuacagcccggaccugcagcccucgagggcucugggcuggcguccgcuucaagccuuucgucucugagagaaccgaguuugcagcccaggcgggaggccacgcuccugccagcaaccguggccgagacucagcaagcuccucgugaccgcuccagcucauuugccggaggccgaagacuaggugaaaggcggcgcggggaucugcucuccggagcaaacggcggcacaagagggacccagaggggagacgagacaccccgggaaccuucuagcuggggugcucgagccggcaagaguauguccgcggaggaccugcuugagagaagcgauguuuuggccgggccagugcacguccgcucuaggucaagucccgcaacugcugacaaacggcaggaugugcuguuaggacaggacuccggcuucggucucguaaaggauccuuguuaccuggccgggccaggaagccguucucuuucgugcucagaaagaggccaagaggaaaugcugccccuauuccaucaccucaccccgagguggggcgggagcggauguaaagcuauuggugacuccagugugccuucugagugcccaggcacgcuggaucaccagcgccaggcaagccggacccccuguccucgaccacccuuggccgggacacagggacugguuacugacaccagagccgcuccguuaacaccuauaggcacuccccucccauccgcgaucccuucagguuauugcagucaagaugggcagaccggaaggcagccccugccacccuacacgccugcaaugaugcaucgcucuaauggccacacacuuacccaaccaccgggcccccgggggugugaaggagacgguccugagcauggcgucgaggaagggacuagaaagcgugugagccugccacaguggcccccuccauccagggccaagugggcucacgccgcacgggaggauucauugcccgaagagagcucugccccugacuuugcuaaccucaaacauuaucagaagcagcaaucccugccgagucuaugcagcacaucggauccagacacaccccugggagcgccuuccacucccggccgcauuucucuucgaaucucagaaagcgugcucagagacaguccaccuccccacgaggauuacgaggacgaagucuucguuagggauccacacccgaaagccaccuccucuccuacauuugagccccugccacccccuccacccccuccgccaagccaggaaacgcccguguauucaauggacgauuucccuccacccccuccccauaccgugugugaggcacaguuggacuccgaagauccagaggguccgcggccuaguuuuaauaagcugagcaaaguaacuauagcucgcgagagacacaugcccggggccgcacaugucgugggaucucagacauuagccucaaggcuccaaaccuccauuaagggcagcgaagcugagucuacaccaccuaguuucaugucgguucacgcccagcuggcgggcucccuugggggacagcccgcaccaauccagacucaaagccugucacacgacccugugucugguacccagggcuuggaaaagaaagucagccccgauccgcagaaguccagugaggacauccgaacggaggcccucgcuaaagaaauugugcaucaagauaagucacuggccgacauccuagacccagauucucggcugaaaacaaccauggaccuuauggaggggcucuuuccucgugauguuaaccuguugaaggaaaauagcgugaagagaaaagcuauucagcgcacuguauccaguagcggaugcgagggcaagaggaacgaagacaaagaggcagucuccauguuagugaauugucccgccuacuauucugugucagcuccaaaggccgagcugcucaacaaaauaaaggaaaugcccgcagaggucaaugaagaggaggaacaggcggauguuaacgagaaaaaggccgaacugaucgguagccuuacccacaagcuggagacauugcaggaagcuaaagggucgcuacugacugacauuaagcucaauaacgcccugggagaggaaguggaggcacuuaucuccgaguuaugcaaaccuaaugaguucgauaaguaccggauguuuaucggcgaccuggauaaaguagugaaccucuugcugagucucucuggcagacuggcucgcgucgagaacgugcuuagcgggcugggagaagacgccucaaaugaggagagguccucuuuguacgaaaagcgaaagauucuagcaggucaacaugaggaugcccgggaacugaaagagaaccucgacagaagggaacgcguuguguuaggcauacuggcuaauuaucuuagugaggagcagcugcaggauuaccagcacuucgucaagaugaaaagcacccucuugaucgaacaacguaagcuggacgacaaaauuaagcucgggcaggaacaggugaagugccugcuugaaucccuaccgucagauuuuaucccaaaagcgggagcccuggcauugcccccuaacuuaacaagcgagcccauuccagcuggcgguuguacguucucugggaucuuuccuacccugacaaguccccucuga

SEQ ID NO: 62492 - RNA, 4482 nt, Artificial Sequence
  derived and/or modified sequence opt3 from SHROOM4__Homo_sapiens__NP_065768
auggagaacagacccggcagcuuccaguacgugccuguccaacugcagggaggagccccaugggguuuuacccucaagggcgggcuugaacacugcgagccgcugacaguuuccaaaaucgaagacggaggcaaggcugcauugucucagaaaaugaggacuggugaugaguuagugaauauuaacgggacgccccuguauggaucacggcaggaagcccuaauacucaucaagggcaguuuccgcauucugaaacuuaucguacgacguagaaaugcgccugugagcaggccacauuccuggcacgucgcuaagcuguuggagggcugucccgaggccgcaaccacaaugcauuuuccuucugaagccuucucgcucucauggcacagcgggugcaacacuucagacguguguguucaauggugcccacugucccggcauuguucuaccgaaaagagcuccucaauuggaaguauggaaagccuggagcagcccggucaggcuacauacgagucucaccucuuaccuaucgaucagaauauguauccaaaccaacgcgacuccgcauacaguagcuuuagugccucuuccaaugcuagcgauugcgcccugucgcuuagaccggaggagcccgcgucuaccgacuguauaaugcagggcccugggccaacuaaagcacccuccggaaggccuaacguggccgaaacaucaggcgguagucggcgcaccaaugggggacacuugacgccaagcucccagaugucuagccgaccccaggagggcuaucaaucaggcccggcuaaggccgucagagggccuccccagccaccugugaggcgggauagucugcaggcaucccgugcucaacuacucaacggagaacagcgcagagccagcgagcccguaguuccacugccccagaaagagaaacuuucucuggaaccuguguugccagcgaggaauccgaaccgguucugcugucucucaggucaugaccaggucaccagugagggccaccaaaauugcgaauuuagccagcccccugaguccucucagcaggggucggaacaucuguuaaugcaagccagcacuaaagcagugggauccccaaaggcuugugaucgagccucaaguguggacucuaacccccugaaugaggcuagcgccgagcucgcaaaggccuccuucggccgcccuccacaccuuaucggucccacagggcacagacauucagcuccggaacagcuguuggcgagccaccuacagcauguccaccuggauacuaggggcucuaaaggaauggagcucccuccaguucaggacggccaucaauggacccugucaccccuucacaguagccacaaggggaaaaagucuccuugucccccaacaggagguacccaugaucaguccucaaaagaacggaagacgcgccagguggacgacagaagucugguauugggccaccagagccaaucguccccuccccauggggaggcagauggacacccaucugaaaaaggcuuucucgacccgaacaggacuagccgugccgcuucagagcuggccaaccagcagccuagugcauccgguucuuuagugcaacaggccacagauugcagcuccaccacuaaggcugccucagggacagaggcaggcgaagagggagacagcgaacccaaggagugcagucggaugggcgggcgaagaucuggagguaccaggggccgcuccauucagaaucggagaaaaagcgagagguucgcgacgaaccugcgcaaugaaauccagcgacggaaggcucaacuacagaaaucgaaggggccacucucacagcugugcgauaccaaagagcccgucgaagagacacaggaaccuccagagucucccccucuuacugccaguaacaccuccuugcugagcucuuguaagaagccgccaagcccccgugacaaacucuuuaauaaguccaugaugcugagagcaaggucaagugagugccuuagccaagccccugaaucucacgagucccgcacaggacuggaaggccggauuucaccaggucagagacccgggcagaguagcuugggccucaacacuugguggaaagcuccugauccguccucuucggaccccgagaaggcccaugcacacuguggagugaggggcgggcauuggcgauggagcccagaacacaauucacagccucugguugcugccgcgauggagggacccuccaacccaggcgauaauaaagaguuaaaggccaguaccgcucaagccggugaagacgcaauccugcuaccuuucgcugaucgccggaaguuuuucgaggaaucuagcaaaucccucucaacaucucaucugcccgggcuuaccacucacagcaacaagacguucacacagagaccaaaaccgauagaccagaauuuucaaccuaugaguuccagcugcagggaguugcgucgccaccccauggaccagucuuaccauucagccgaucagccauaucacgcaaccgaccaguccuaccauaguaugagcccccugcaaucggaaacuccuaccuacucugaguguuucgcguccaagggacucgagaacagcaugugcuguaaaccacugcacugcggcgauuuugacuaucaucggacauguucauacaguugcucugugcagggugccuuaguccacgaucccugcauuuauuguuccggcgaaaucugcccugcucugcuuaagagaaauaugaugccgaacuguuacaauuguaggugccaccaucaccagugcauucgauguagcgugugcuaucauaacccacagcacucagccuuggaggacaguagccucgcacccgggaacaccuggaagccucggaaacugacuguacaagaguuccccggagauaaguggaauccaaucacaggcaaccgcaaaacgucccagucugggagagaaauggcucacagcaagaccuccuuuucaugggccacuccuuuccaucccugucuagagaauccagcacuggaccucucuaguuacagggccaucucgagccuggaucuuuugggagacuuuaaacacgcucugaagaaauccgaagagacaucuguuuaugaagagggcuccagcuuagcguccaugccucauccgcuccggagucgagccuucucugaaagccacauuucacuggcaccccaguccaccagagcuuggggucagcaucgcagggagcuuuuuaguaagggggaugagacacaaagcgaccuguugggagcccguaagaaagccuucccaccuccccggccaccucccccgaacugggaaaaguacagacucuuuagggcugcacagcagcagaaacaacagcagcaacagcagaagcagcaagaggaagaggaagaggaggaagaggaagaggaagaggaggaagaggaagaggaggaagaggccgaagaggaagaggaggaacugccaccucaguacuucucuuccgagacuucaggcagcugcgcgcuaaaucccgaagaggugcuggaacagccacagccccucucguuuggucaccuggagggcucucgccaagggagucaguccgucccugcugagcaggagagcuucgcccuucacucauccgauuucuugccgcccauacgaggacaucugggcucucagccagaacaagcacagccucccuguuauuacgggaucggaggcuuauggagaaccagcggucaggaagccacggagagugcuaaacaagaauuucagcacuucuccccuccaagcggggcacccgggauuccuaccucuuauucagccuacuauaacaucaguguggcgaaggcugagcuccugaauaaacuuaaagaccagccagagauggccgaaauaggccugggugaggaagaggucgaccaugagcuagcacagaagaaaauucaacucaucgaauccaucagccggaagcugucuguguugagggaggcccagcgcggccuguuagaagauauuaacgcuaauucggcccucggggaggaaguugaggcaaaccugaaagcugugugcaagucaaaugaguuugaaaaguaccaccuuuucguaggagaccuggauaaagucgugaacuugcuccugagccuauccggccgucuggccagaguugagaaugcgcuuaacaguaucgacucugaagccaaucaggagaagcucgugcugauugaaaagaagcagcaauugacagggcagcuggcagaugcuaaagaguuaaaggagcacgucgaccggagggaaaagcucguguuuggaaugguaagccgcuaucugccccaggaucagcuucaagacuaccagcauuucgugaaaaugaaguccgcccugauaaucgagcagcgagaauuggaggaaaagauuaagcucggcgaggagcagcugaaaugccuaagagaaucacugcuucucgguccgaguaacuuuuga

SEQ ID NO: 62493 - RNA, 1467 nt, Artificial Sequence
  derived and/or modified sequence opt3 from SIAE__Homo_sapiens__NP_001186851
auggugcugcagaaggagcccgccggcgcugucaucuggggguucggaaccccuggugcaacaguuacugugacgcucagacaaggccaggaaaccauuaugaaaaagguaacaagcgugaaagcccacuccgacacuuggauggucgugcuugauccaaugaagcccgggggaccguuugagguuauggcgcagcagacccuggagaaaauaaacuucacauugagggugcaugacgucuuauuuggcgauguguggcugugcucuggucaaucaaauaugcagaugaccguacuacagaucuucaacgcuacucgggaacucaguaauacagccgcauaccagagcguucgcauucuguccgugucuccuauccaagccgaacaggagcuugaggaccuggucgcuguggauuugcaguggucgaagccaaccucagaaaaccucgggcacggauauuuuaaguacaugagcgcaguguguuggcuguucggccgacaucuguaugacacgcuccaguaccccauuggcuuaaucgccaguuccuggggagggacuccuauagaggcuuggucuagcggucguucccugaaagccugcggcgucccaaagcaagggucaauccccuaugauaguguuaccggaccuagcaaacacucugugcuuuggaaugcgaugauucauccauuguguaacaugacacugaagggcguagugugguaccagggugaauccaauaucaacuauaauacugaccuauacaacugcaccuuuccggcacucauugaggauuggagagagacauuccacagggggucacagggacaaaccgaacgguuuuuccccuuuggccugguccagcuuagcagugaccugucuaaaaaguccagcgaugacggcuucccucagauccgcuggcaccagacggccgauuuuggguacgugccaaaucccaagaugccuaacacuuucauggcuguugccauggacuugugugacagagauucgccauucggaucuauacaucccagggacaaacaaacaguggcauaucggcuccaccugggugcucgcgccuuagcguacggcgagaagaaucugaccuuugaagggccgcucccugagaaaauugaacuucuggcccauaagggauugcuaaaccugacuuauuaccagcagauccagguccagaaaaaggauaauaaaauuuucgagaucuccugcuguucagaccaccgaugcaaguggcuccccgcaaguaugaacacagugagcacccaaucccugacgcuugcuaucgauucuugucacggcaccguaguugcccugagauaugcuuggacaacuuggccaugcgaguacaagcaguguccuuuguaucaucccagcucagcccucccagcacccccuuuuauugccuucauaaccgaccaggguccagggcaccaaaguaacguggcuaaauga

SEQ ID NO: 62494 - RNA, 942 nt, Artificial Sequence
  derived and/or modified sequence opt3 from SIAH1__Homo_sapiens__NP_001006611
augaccggcaaggccacacccccuagccuguacuccuggagaggggugcuuuucacuugccuuccagcugcaaggacgcggaaacgcaaggagaugucucgacagaccgccacagcgcugccgacuggaaccucaaaaugucccccuagucaacgugucccagcuuugacagguaccacugccagcaacaaugacuuagcaucccuguuugaaugccccguuuguuucgauuaugugcuaccuccaauccuccagugccagucuggccaccugguauguucgaacugcagacccaagcucacauguugcccuaccuguagggggccacugggaucaauucggaauuuggccauggagaaaguggcuaacagcguccucuuuccgugcaaguacgcaaguuccggcugugaaauaacgcugccccauacugagaaggccgaccacgaggaacugugcgaguuccgcccuuauucuugcccaugucccggugcuagcugcaaauggcaggggucccucgaugccgugaugccucauuuaaugcaccaacauaagucaaucaccacacugcagggagaagacauuguuuuucuugcgacugauaucaauuugccaggcgcaguggacugggucaugaugcagaguuguuucggcuuucacuucaugcuggugcuagagaaacaggaaaaguacgaugggcaccaacaguuuuucgccauuguacagcucaucggaaccagaaaacaggcugagaacuuugccuauaggcuggagcuuaauggucaucggcgccgacugacaugggaagcaacccccagaagcauacacgagggcaucgcuacggccauuaugaacucugacugcuugguuuucgauacuuccaucgcgcaacucuuugccgaaaaugggaaccugggaauuaaugugacaaucucaauguguuga

SEQ ID NO: 62495 - RNA, 975 nt, Artificial Sequence
  derived and/or modified sequence opt3 from SIAH2__Homo_sapiens__NP_005058
augagcagacccuccucuaccggcccuucagccaacaagccaugcaguaaacagccgcccccucaaccacagcacacacccagcccugcugcaccacccgccgcggcuacuaucuccgccgcagggccuggaucuucggccgugccagcugcagccgcugucauuucagguccgggcgggggaggcggugccgggcccguuagcccucagcaucacgagcugacgagucucuucgaauguccagugugcuuugacuacguacuucccccuauacugcagugucaagcgggacauuuggugugcaaucaguguaggcagaaguuauccugcuguccaaccugccggggcgcacugacacccucuauccgcaaccuagccauggagaaagucgcuagcgccguucucuucccguguaaguaugcaacuaccggcugcucccugacacuucaccauaccgaaaaaccugagcacgaagauauuugugaguaccgacccuauucaugcccaugcccuggggcuaguuguaaguggcagggaagccuggaggccgugaugucucacuugaugcaugcgcacaaguccaucacuacacuccaaggugaagacauuguguuucuggccaccgauaucaaucugcccggcgcagucgacugggugaugaugcagucaugcuucgggcaucacuuuaugcucguauuagagaaacaggaaaaguacgagggacaccagcaauucuuugcuauaguucugcuuaucggcacgcguaaacaggccgagaacuucgcuuauagauuggaacugaaugguaacaggcggcgccuaacuugggaggccaccccaagaagcauucaugaugggguggcagccgcuaucaugaauagugacugucucgucuuugauacagcgauugcacaccuguucgccgacaacggaaaucuuggcaucaacgugacuauaucuaccugcugucccuga

SEQ ID NO: 62496 - RNA, 2484 nt, Artificial Sequence
  derived and/or modified sequence opt3 from SIDT1__Homo_sapiens__NP_060169
augagaggcugccugaggcucgcccuucugugugcuuugcccugguuacugcuagcagccagcccugggcacccagcgaaguccccgcggcagcccccugcuccacgccgagaccccuucgaugccgcacguggagccgacuuugaucauguguacucuggugucguuaaccucucaaccgagaauaucuauaguuucaacuacacaagccaaccugaccaggugacugcuguaagaguguaugucaauuccucuucggaaaaccugaauuacccagugcuuguuguggucaggcagcagaaagaggugcugucauggcaaguacccuugcucuuucagggccuguaucagcggagcuacaacuaucaggaaguuagucgcacgcugugcccuuccgaggcaaccaaugaaacagggccacuccaacaguuaauuuucguggaugucgccucuauggcuccgcugggagcccaguacaaguuguuggugacuaaacugaagcacuuucagcuaagaaccaacguggcguuccauuuuacagcaagccccucccaaccucaguacuuccucuauaaauuuccaaaggacgucgauucaguuauaaucaaggugguaagugagauggccuaccccuguagcguggucucugugcagaauauuaugugcccuguuuaugaccuggaucacaacguggaguucaauggcgucuaccaauccaugaccaaaaaggcugccaucacucuucagaaaaaggacuuuccaggugaacaguucuuugugguauucguuauuaaacccgaggauuaugcaugugggggaucauucuuuauccaggaaaaggagaaccaaacauggaaucugcagaggaagaaaaacuuggaggugaccauagucccgagcaucaaggaaaguguguacgucaaaucuucccucuucagcguguuuauuuuccugucguuuuauuuaggcugccugcucguuggcuucgugcauuaccuucgguuucagcgcaagucuaucgacggguccuucggaucaaaugaugguaguggcaacaugguagcuagccacccuauugccgcguccacgcccgaggggucuaacuacggaacuaucgacgaaagcucaaguuccccaggccgacagaugaguucuucagacggugggccucccggacaaagugauaccgacagcuccgucgaggaaucugauuuugacacaaugccagauauagagucggacaaaaauauuaucagaacuaagauguuccuguauuugagcgaucuauccaggaaagaccggcguauugugucaaagaaguacaaaaucuauuuuuggaacaucauuaccauagccguuuucuacgcacugcccgugauccagcucgucauuacauaucagaccgugguaaaugugacgggcaaccaggauaucuguuacuauaauuuucugugcgcucacccucuuggcguucugagugccuucaacaauauauugucuaaccucgggcauguccuguuaggauuccuguuucuacucauugugcugcgcagagacauccuucacaggcgggcuuuggaggccaaggauaucuucgcaguggaauacgguauuccaaaacauuuuggccuguucuacgccauggggaucgcucucaugauggagggaguccugagcgcguguuaucacguuugcccgaauuacuccaacuuucaauucgacacuucauuuauguauaugauugcaggccuuuguaugcugaaguuguaccagacacgacaccccgacauaaaugccagcgcuuauucugccuacgcauccuucgccguggugaucaugguaaccguccucggugugguuuuugggaaaaacgaugugugguucugggucauuuuuagugcuauccaugugcuggccagcuuagcacugucuacucagaucuauuacaugggccgcuucaagauugaccuaggaauauuuagaagggcggcuaugguuuucuacacagauugcauccagcaaugcucccggccucucuauauggaccgcauggugcugcuuguagucggcaauuuggugaacuggucauucgcccuguuugggcucauuuacagaccaagggauuucgcaaguuauaugcugggaaucuuuauuuguaauuuacugcuuuacuuggccuucuauaucauaaugaagcuccguagcucggaaaaagugcugcccgucccucuauuuugcaucguugcuaccgccgugaugugggcagcugcccuguacuucuuuuuccagaaccucuccucuugggaggguacgccagcggaaagccgggagaagaaccgagaguguauucugcuugacuuuuucgaugaccacgauaucuggcauuuucuuucagccaccgcucuguucuucagcuuuuuaguacuccugacacuugacgaugaccuggauguggucagaagggaccagauucccguguucuga

SEQ ID NO: 62497 - RNA, 1233 nt, Artificial Sequence
  derived and/or modified sequence opt3 from SIGIRR__Homo_sapiens__NP_001128526
augcccggcgugugcgacagagccccugauuuccugagcccauccgaggaccagguccucaggccggcucuugggucuucaguugcacugaacuguaccgccugggugguaaguggaccccacugcagcuugccuuccgugcaaugguuaaaggauggucugccacuaggcaucgggggacauuacucucuccacgaauauucgugggucaaagcgaaucugucagaggugcuuguuagcagugugcugggcgucaacgugacauccacugaaguauacggugcuuuuacguguucuauucagaauaucagcuucuccucauuuaccuugcagcgggccgggcccacaagucauguugcagccgugcucgcuagccugcugguccucuuagcacugcuuuuggccgcucugcuauaugugaagugccgccucaacgugcugcuuugguaccaggacgccuauggagaggucgaaauaaaugauggcaaacuguacgacgcguauguuucuuacuccgauuguccugaggaccgaaaguucgugaacuuuauuuugaaaccacaacucgagcguagaaggggcuacaagcuguucuuagaugaccgggaucugcucccccgcgcagaaccuucagccgaccuucugguaaauuugagcagaugcaggcggcuaaucgugguccugagugaugcuuuucucucucgcgccugguguucccacagcuuccgagaggggcugugcagacuucuggaauugacuaggcggccaauuuuuaucaccuucgagggacagcgucgcgacccggcacaucccgcucucagacuguuaaggcagcaccggcaccuggugacacuacuccuguggcgaccugguucgguuaccccaucuuccgacuuuuggaaggaggugcagcuugccuugccccgcaaaguccaauauagaccuguggaaggcgauccacagacucagcugcaggacgauaaggaccccaugcucauacugagggggcggguaccggagggacgcgcgcuugauucagaaguugacccugaucccgagggcgaccugggugugagagggccagucuucggagaaccuagugcacccccacauacaagcggcguguccuugggcgagucuaggagcucagaggucgaugugagugaccucgggucccguaacuacagcgcccggaccgauuuuuauugucugguuucuaaagacgacauguga

SEQ ID NO: 62498 - RNA, 1809 nt, Artificial Sequence
  derived and/or modified sequence opt3 from SIGLEC11__Homo_sapiens__NP_001128635
auggugcccggccaggcccaaccucagagcccagagaugcugcuccuuccgcuguuguuacccguccugggggcuggaucccuaaacaaggacccuucuuacucacuccagguucagagacaagugccaguacccgaaggucugugcgugaucgucaguuguaaucuuagcuauccuagggauggcugggacgaguccaccgcagccuacggguauugguucaaaggacggacaucuccaaagacuggcgcgcccguggcuacgaacaaucagucgcgcgaaguugagaugucaacccgagaucguuuucagcugacaggugacccugggaaaggaagcugcaguuuggugauuagagaugcccagagggaagacgaggcaugguacuucuuucgggucgagcgcggcuccagagugaggcacucuuuccucagcaacgccuuuuuccugaagguaacugcucugaccaaaaagccagauguuuauauaccggaaacacucgagcccggccaaccugugaccgucaucuguguguuuaauugggcauucaagaaaugcccagcccccuccuuuucauggacuggggcugccuuaaguccucggcgcacacgaccaagcaccucucauuucuccgugcugucauuuacgcccagcccgcaggaccacgauacugaccuuaccugucaugucgauuucaguagaaagggaguuucugcgcagaggacagugcgguugcguguagcauacgccccuaaagaccugauuaucuccauuagccacgauaacacuucggcucuagaacuccaggguaaugugaucuaucuggagguccaaaagggccaguuucuucgccuguugugcgccgcagacucucagcccccagcuacccucuccugggugcugcaagacagaguuuuaucaaguagccauccuugggggcccaggacacugggacucgagcuucggggcgugcgagccggugauuccgggcgcuacaccuguagagcggaaaacaggcugggaucucagcagcaggccuuggaccuaagcguccaauacccacccgagaaucugcgggugaugguaucacaggcaaaccgcacgguucucgaaaaucugggcaacggcacaagucuuccugugcuggaggggcaguccuugagacucgucugcgugacucacagcucuccaccggcuaggcugucauggacccguuggggacagacugucggucccagucaaccuagcgauccaggcguguuagaacugcccccuauacagauggagcacgagggggaguucacaugucaugcccagcacccacuaggaucccagcauguuucucucucgcugagcgugcacuggaaacuugaacacggcgguggguugggccugggagcugcccucggcgcagggguagccgcucugcuugcguucugcuccugucuggucguguuucggguuaagaucugccgaaaggaagcaagaaaaagggccgcugccgagcaagacgugcccucaaccuugggaccgauuagucagggucaucagcacgaaugcucugcaggcagcucccaggaucauccuccacccggggccgcuacguauaccccuggaaagggcgaggagcaagaacuccacuacgccucacugagcuuccaggguuuacgccugugggagcccgcagaccaggaagcgccaucuacaacugaguauuccgaaaucaaaauucauaccgggcaaccucuacggggccccggauuuggccuccagcuggagagagagaugagugggauggucccaaaguga

SEQ ID NO: 62499 - RNA, 1191 nt, Artificial Sequence
  derived and/or modified sequence opt3 from SIGLEC14__Homo_sapiens__NP_001092082
augcugccccuccuucuguugccuuuacuguggggcgggagccuacaggagaagccaguguacgaacuccaaguccagaaauccguuaccgugcaggagggacugugcguacuugugccguguucuuucucauaucccuggagaaguugguacagcuccccuccacuguaugucuacugguuuagggacggugaaauccccuauuacgccgaggugguugcuacaaacaauccugaucggcgcgugaagccagaaacucagggccgauuccguuugcucggggacguccagaaaaagaacugcucucugucgauuggagaugcaagaauggaggacacgggcucauacuuuuucaggguggagcggggucgcgauguaaaauauagcuaccaacagaauaagcugaaccucgaaguuaccgccuuaauagagaagcccgacauccacuuucuggaaccucuugagagugggagaccaacaagguuguccuguucucugccgggaagcugcgaggcggggcccccucuaacuuucuccuggaccggcaaugcucucucaccacuggaucccgaaacaacccggaguagcgagcuuacucugacaccucgcccagaagaccauggcaccaacuugacgugucaggugaaacgacaaggagcccaggucacuaccgagagaacagugcagcucaaugugucuuaugcaccccagaaccuggccauuuccaucuuuuucaggaaugguacuggcaccgcuuuacggauucugucaaacgggaugagcgucccgauccaagaaggacagagucucuuucuugcaugcacaguugauucuaauccucccgccucccugagcugguuccgugagggcaaggcuuugaacccaucgcagaccucuauguccgguacgcuagagcugccuaauauaggggcccgcgaaggaggcgaguuuacuuguagagugcaacacccccucggcucacagcaucugaguuucauccuuagcguacagagguccucuagcucaugcauuugugugacagaaaaacagcaagggaguuggccacuggucuugacccucauccggggagcgcugaugggugcaggcuuuuuacugacuuacgggcuaacauggauuuauuacacccgaugcggaggcccccagcagucccgcgccgagagaccugguuga

SEQ ID NO: 62500 - RNA, 5130 nt, Artificial Sequence
  derived and/or modified sequence opt3 from SIGLEC1__Homo_sapiens__XP_011527630
augggcuuccugcccaagcuccuucuguuggccucauuuuucccugcugggcaggccuccuggggagugucuucaccacaagacguccaggguguuaaaggcaguugcuuacugaucccguguauauuuucauuccccgccgauguggagguaccugacgggauuaccgcgaucugguacuaugauuacuccggacagagacagguggucucucacucggcugacccaaagcuaguggaggccagguuucggggccgcacagaguucauggguaaccccgaacaccgaguuugcaaucuccugcuuaaagaucugcaaccugaggacucagggagcuauaacuuucguuucgaaauuagugaggugaauagaugguccgaugucaagggaacuuuggugacgguaaccgaggaaccaaggguucccacaaucgcaucuccuguggagcuccuggaaggcacugaggucgacuuuaacuguagcaccccauacgugugccugcaggaacaggugcggcuccaguggcaaggccaggauccggcccgcuccgucacauucaauucacagaaauuugaacccaccgggguuggacacuuagagacucugcauauggcuaugaguuggcaggaccacgguaggauucuuaggugucaauugagcguggcaaaccaucgggcccagucugaaauccaucugcagguaaaguaugcuccuaagggcgugaaaauacuacucuccccaucagggcgcaauauccugcccggagagcuugucacacugaccugccaagugaacagcaguuacccugccguuucuuccauuaagugguugaaagauggcgugcgacuccagacgaagacugguguccugcacuuaccacaggcggcauggagcgacgccgggguguauaccugucaggcugaaaauggaguaggcucgcugguuucucccccgaucucccuccauauuuucauggccgaggugcaagucucuccugcgggccccauccuugagaaccagacagugacucuggucugcaauaccccaaacgaagcuccuagugauuugagauacagcugguacaaaaaucacgugcuacuggaggacgcccauucccacacacucaggcugcaccuugcgacccgggccgacacgggguuuuauuucugugaaguucagaacgugcauggaucugagcguagcggucccguaucagucgugguuaaucacccaccccugacuccuguguugacagcauuccucgaaacccaggcuggccuggucgggauauuacauugcagugugguauccgagccacuggccacucuagugcucagccacggaggccauauucuggcuucuacaucaggugauagugaccacagcccgcgcuuuuccgggaccucuggccccaacucgcuuagauuggagaucagggaucuggaagagacggacagcggagaauacaaguguuccgccaccaacucacucggcaaugcaacaaguacucuggauuuccacgccaacgcugcgcggcuucugauuucuccugcagccgagguugucgaagggcaagcugugaccuugagcugccgauccggacucucaccaacacccgacgcccgcuuuagcugguaucugaauggugcauuacugcaugagggcccugggucuucccuacuccugccagccgcuaguagcacugaugccggaucuuaccacugcagagcaagggacggccauuccgcgucaggucccaguagcccggcugugcuuaccgucuuguauccuccacggcagcccacauucaccacucgccuggaucucgacgccgcaggggccggcgcuggaagaaggggccuguuacugugucguguugauucggacccucccgcccggcuucaguugcuccacaaggaccgagugguggcaacgucccugccaucugggggagguugcagcacauguggcgggugcucaccuagaaugaaaguaaccaaggcucccaaccuacugagggucgagauccacaauccacuccuggaagaggaaggacuuuacuugugugaggccaguaacgcgcugggcaaugccuccacuucugcuaccuuuaacggucaggcaacaguguuagccaucgcuccgagccauacccuccaagaggggacugaagccaaucugacaugcaacguuucccgcgaggcagcgggcagcccugccaauuucagcugguuucggaacggagugcuuugggcucagggcccccuggaaacggucaccuugcucccaguggccagaacugaugcagcucuguaugccuguaggauucuaacagaggcaggggcccagcugaguacccccguucuccugucugugcuuuacccuccagaccgccccaaauuguccgcucuguuagauaugggacagggccacauggcacucuucauaugcacaguagacagccgaccucuggcccuucuggcacuauuucauggugaacaccuccuggcuacuucguuggggccgcaagucccaucacauggacgguuccaggccaaggccgaggcuaauucucugaaauuagaggugcgugaacucggccugggugauaguggcuccuacagaugugaggcaaccaacgugcuugggagcucuaauacgagccuguuuuuccaggucaggggagccuggguucaagugucccccucaccugaauugcaggagggccaggcgguagugcucaguugccagguccacaccggggugccagaaggaacaagcuaucgcugguaccgggacggccaaccccugcaggagucuacuuccgcuacccuaagauuugccgcaaucacacugacucaggccggugcuuaucacugucaggcacaagccccugggucagcgaccacgagucuugcugccccgauuagccuccauguuuccuacgcacccaggcacgugacacugaccacuuugauggauacaggaccaggccgacuggguuuacuccugugccgcgucgacucugauccucccgcccagcuucggcuguugcauggcgacagacucguggcuucgacccugcaggggguuggaggcccagaggggagcucaccuaggcuacacguggccgucgcacccaacacucugcgucuugaaauccauggagcuaugcucgaggaugaaggcguauauauaugcgaggccuccaacacccugggucaggcgagugccucugcagacuucgaugcucaagccgugaauguucagguguggccaggggcuacaguccgcgaaggacaguuggugaacuuaacgugucugguauggaccacucacccggcacaacucacauacaccugguaucaggacggccagcagcggcuggacgcccacagcauuccucuucccaaugugacagucagagaugccacuuccuacaggugcgguguuggcccacccgggcgagcuccucggcugucacgcccaaucaccuuggacgugcuauacgcgcccagaaaccugaggcucacguaucugcuugagucucauggaggccaauuagcacuggugcucuguacagucgauagccggccuccggcccaguuggcucugagucacgccgggcgacuccuggcauccagcaccgccgcuucugugccaaauacucuuagacuggaguugcgcggaccccagccuagggacgaaggcuucuacucaugcuccgcgcguaguccccuaggucaggccaacaccagccuggagcuccgguuagaagggguuagaguaauccuggcaccagaggcugccgugccugagggagcacccauuacagucacuugugccgauccagcugcccaugcgccuacccuuuauacaugguaccacaauggcagauggcugcaagaaggcccggcagccucgcucagcuuuuugguggcuacgcgcgcccacgcuggggcauauuccugccaggcccaggacgcucagggaacccgaagcucaagacccgccgcacugcaaguucucuacgcgccacaggaugccgugcugaguucuuuccgggacuccagggcucgcagcauggccgucauccaguguacuguggauucagagccucccgcagaacuugcucuaagucaugacgguaagguacuggccacaagcuccggcguccacucuuuggcaagcgggaccggacaugugcagguugcccguaacgcuuuaagacugcaagugcaggaugucccagcgggcgacgauacuuaugugugcacagcccagaaucuccuggguuccauuucaaccauagggcggcuucaaguugagggagcaaggguggucgcugaaccuggccuggacgugcccgagggcgccgcccucaacuugucuugucgccugcuagggggaccggguccaguaggcaauaguacguuugcaugguucuggaacgaccgaagacugcacgcugagccugugcccacucucgccuuuacccauguugcgcgggcucaggccgggauguaccacugccuugcagaacugccaacaggagccgcugcaucggcccccgucauguuaaggguguuguacccuccgaaaacccccacuaugaugguguucgucgagccagaaggcggucugcgcgggauccucgauuguagaguagacagcgagccucuggcgucccuuacacugcaccucggaucuagguugguggcuucaagccagccccagggcgccccugcagaaccacauauucacguucuggccucccccaaugcuuuacggguggauaucgaggcccuacguccuagugaccaaggcgaguauaucugcucugcaagcaacguccuggggucagcuuccaccaguacauacuuuggagugcgcgcccuccaucgacuucaccaguuccagcagcuguuguggguucugggucuccuggugggccuucuccuguugcuguuagggcuaggagcgugcuauacuuggagaaggcggcgcgucuguaagcaaagcaugggcgaaaauucuguggagauggccuuucagaaggaaaccacgcagcugauugauccagacgcagcuacaugcgagaccuccacuugugcacccccgcucgguuga

SEQ ID NO: 62501 - RNA, 1656 nt, Artificial Sequence
  derived and/or modified sequence opt3 from SIGLEC5__Homo_sapiens__NP_003821
augcugccccuccuucuguugccuuuacuguggggcgggagccuacaggagaagccaguguacgaacuccaaguccagaaauccguuaccgugcaggagggacugugcguacuugugccguguucuuucucauaucccuggagaaguugguacagcuccccuccacuguaugucuacugguuuagggacggugaaauccccuauuacgccgaggugguugcuacaaacaauccugaucggcgcgugaagccagaaacucagggccgauuccguuugcucggggacguccagaaaaagaacugcucucugucgauuggagaugcaagaauggaggacacgggcucauacuuuuucaggguggagcggggucgcgauguaaaauauagcuaccaacagaauaagcugaaccucgaaguuaccgccuuaauagagaagcccgacauccacuuucuggaaccucuugagagugggagaccaacaagguuguccuguucucugccgggaagcugcgaggcggggcccccucuaacuuucuccuggaccggcaaugcucucucaccacuggaucccgaaacaacccggaguagcgagcuuacucugacaccucgcccagaagaccauggcaccaacuugacgugucagaugaaacgacaaggagcccaggugacuaccgagagaacaguccagcucaaugugucuuaugcaccccagacuauuaccaucuuuaggaacgguauugcccuggaaaucuuacaaaauacauccuaccugccggugcucgagggccaggcccuucggcuguugugcgaugcaccuucaaaucccccagcccaccuaagcugguuccaggggaguccugcucugaacgccacccccauaucuaacacgggaauccucgagcugcgucgcgucagauccgcggaagagggcgguuuuacuuguagggcacaacauccacuuggguuccugcagaucuuuuugaaucucagcguuuauucgcugccccaguuacugggaccuucuugcuccugggaagccgagggccuacacugucggugcucauuccgagcucgcccagccccgagucucuguuggagacuggaagagaagccccuugagggcaacagcucccaggggucuuuuaaagugaauagcucaagugcaggaccuugggcuaacuccagcuugauucugcaugguggccucucuucagaccugaagguaaguugcaaagccuggaacauuuacgggagccaauccggaucugugcuucuguugcagggcaggucgaaucucgguacaggggucgugccagcggcccugggcggagcaggcguuauggcuuuacugugcaucugucuaugccucauauucuuccugauugugaaggcccggcgcaagcaggcugccgggagacccgagaaaauggaugacgaagauccuaucaugggaaccauuacuagcgguuccaggaagaaaccauggcccgacucaccgggcgaccaggcaaguccuccaggggaugcucccccucuugaggaacaaaaggaauugcacuaugcuucucugagcuuuuccgagaugaaaucacgugagcccaaggaccaggaagcgccaagcacaaccgaguacucugaaaucaaaacguccaaguga

SEQ ID NO: 62502 - RNA, 438 nt, Artificial Sequence
  derived and/or modified sequence opt3 from SIGLEC7__Homo_sapiens__NP_001264130
augcugcuccuucuguuguuaccccugcuauggggcagagagaggguggaagggcagaaaagcaaccggaaagacuacucccucaccaugcaaucuucagucacaguucaggagggaaugugcgugcacguacgcuguaguuucagcuauccuguggauucccagacugacucugauccaguccacgguuacugguuucgagccggcaaugacaucucguggaaggcuccgguggcaacgaacaaucccgccugggcgguucaggaagagacccgugauagauuccaucugcuuggggacccucaaacaaagaacugcacucugucaauuagggaugcucggaugagcgacgccggacgcuacuuuuucagaauggaaaagggcaauauaaaauggaacuauaaguaugaucaguugagugugaaugucaccgguuga

SEQ ID NO: 62503 - RNA, 1500 nt, Artificial Sequence
  derived and/or modified sequence opt3 from SIGLEC8__Homo_sapiens__NP_055257
augcugcuccuucuguuguuacugccccuacucuggggcaccaaggggauggagggagacagacaguacggugauggcuaucugcuucaagugcaggaacuggucacaguucaggagggguugugcgugcacguaccuuguagcuucuccuacccacaggacggauggacugauucugacccggugcauggcuauugguuuagggccggugaucggcccuaccaagacgcuccugucgcaacgaacaauccagaucgcgaagugcaggccgagacccaggggcgauuccagcuccugggagacaucuggucaaacgauugcagucugagcauucgugacgcgagaaaaagggauaagggcuccuacuuuuuccggcucgaacgcggcucuaugaaauggucguauaagucacaauuaaauuauaaaacaaagcagcugagcguuuuugugacugcucuuacccacagacccgacauauugauccuggggacacuagagaguggacauuccaggaaccucaccuguucugucccuugggccugcaagcaggguacuccacccaugauuagcuggaucggcgcauccgugucaaguccugggccaacaaccgcccggagcucuguacugacgcuuacuccgaaaccccaggaucacggaaccucccugacaugucaaguuacuuugccuggcaccggugugacaaccacgucaacuguccgccucgacgugagcuacccacccuggaaucugacaaugaccguguuccagggggacgcuacugcaaguacagccuuaggaaacgggucuucccugagcguccucgagggccagucgcuucgacugguuugcgcuguaaauucuaacccuccagccagauuguccuggaccaggggcucacuaacgcugugucccagucggagcuccaauccgggacuccuggaacuuccucgugugcaugugcgcgaugagggugaauuuaccugcagagcgcaaaacgcacagggcucucagcacauuagccugucauugagucuccagaaugaggggacaggaacuuccaggcccgucagccaagugacccuggccgcuguuggcggugccggggcaacagcuuuagccuuccugucuuuuuguaucauauucaucauugugcggucaugccgaaagaaaagugcgcgcccagccgcaggcgucggagacacuggcauggaggaugcuaaggccaucagagggagcgcuucccagggaccucuaaccgaaucuuggaaagacgguaacccccucaagaagccacccccugccguggcaccaucgagcggcgaggaaggggagcugcacuacgccacacuuuccuuucauaaaguaaagccgcaggauccccagggacaagaagcuaccgacucagaguauagugagauuaaaauccacaagagggaaacugcggagacgcaggcauguuugcggaaucauaacccuucuagcaaagaaguucgcggcuga

SEQ ID NO: 62504 - RNA, 1440 nt, Artificial Sequence
  derived and/or modified sequence opt3 from SIGLEC9__Homo_sapiens__NP_001185487
augcugcuccuucuguugcccuuacuguggggcagagagagggccgaagggcagaccagcaagcuacucacaaugcaauccucugugacuguccaggagggacugugcguucacgugccuuguucauucaguuacccaagccaugguuggaucuauccgggccccguagugcacggguacugguuucgggaaggagcuaacacggaccaggaugcaccugucgccaccaauaacccagcgcgcgcugugugggaggaaacacgagaccguuuccaucuucugggcgauccccacacuaaaaauugcaccuuguccauuagagacgccaggcggucugaugcaggucgcuauuucuucagaauggagaaggggucgauaaaauggaacuacaagcaucacaggcucucaguuaaugugacagcccugacccaccggccuaacauccugauuccaggaacucucgagagcggcuguccccagaauuuaacaugcagugucccuugggcuugugaacaaggcaccccaccgaugaucuccuggauugggacgucugugagcccccuggacccuuccacuacccgcucaaguguacuuacauugaucccacagccccaggaucauggaacuagccugaccugccagguuacauuuccuggugcaucugugaccacgaacaaaacuguccaccuaaauguguccuauccaccccaaaaccucacaaugaccguguuccagggcgacgggacugucucaacaguucugggaaauggcagcagucuuucucugccggagggucaguccuugcgacucgugugugccguagaugcuguggacagcaacccucccgccagacugucguuaucuuggagggggcugacccucugcccaucccagccuucaaaucccggaguccuugaacugccaugggugcauuugcgggaugcggcagaguuuacgugucgugcccaaaacccccuaggcagucagcagguuuaccugaaugugagccuccaauccaaggcuaccucuggcgucacacagggggugguaggaggugccggcgcaacugcucugguuuuccuuagcuuuugcgugauauucgucgugguccgcucauguagaaagaaaagugccaggccugcggccggggugggagacaccggcaucgaggaugcaaacgcuguucgggguuccgccagccagauucugaaccacuuuaucggguucccaacauuuuugggccucggauucgaauuucuguuaaaucugcgagaccuaugcugccacccggacucugaguuuuauguguaccauuucucacacuuucgccucauuaagaacaucgcuggcgaaauaguauggagucuggaggggaaaauucuuugguugcuggaugucagcgacuucuuucauugguucuuucucaucugugugggauga

SEQ ID NO: 62505 - RNA, 612 nt, Artificial Sequence
  derived and/or modified sequence opt3 from SIGMAR1__Homo_sapiens__NP_001269136
augcagugggccgugggcagaaggugggcuugggcagcccugcuccuugcggucgcugccguucugacccaagugguaugguugugguuagggcuggaccacgagcuagcauucagccggcucaucguggaacugcgccgacuucaucccggacacguccugccugaugaggaauugcaguggguguuuguuaacgccgguggcuggaugggggcuaugugccuccugcaugcaucccugucugaguacgugcucuuauucggaacagcccugggcucacguggucacagugggagauauugggcugaaauuagcgacacuauaaucuccggaacguuucaucaguggagggagggcaccacaaagucugaggucuucuacccaggcgaaacugugguacacgggccgggagaggccaccgcgguugaauggggucccaauacauggaugguggaguauggccgcggggucauuccuucgacccuugcauuugccuuggcugauacuguguucucaacacaggacuuucugacccuauucuacacgcuccggagcuaugccagaggacugaggcuugagcugacuaccuacuuguuuggccaagauccauga

SEQ ID NO: 62506 - RNA, 5484 nt, Artificial Sequence
  derived and/or modified sequence opt3 from SI__Homo_sapiens__NP_001032
auggccagaaagaaauucagcggccuggagaucucccucauugugcuuuuugucauaguuaccaucauugcuaucgcacugauugugguauuggccacaaagacucccgcgguggacgaaaucucugauucaacgaguaccccugcuacaacuagggucaccacaaacccaagcgacuccgggaaaugcccgaauguguuaaacgaucccguuaaugugcggauaaacuguaucccugagcaguucccaaccgaaggaauuugcgcccaacgcgguuguugcuggcgacccuggaaugacucucugaucccuugguguuuuuucgucgauaaccacggcuacaaugugcaggacaugacuacaaccucgauugggguagaggcaaagcuaaaccguaucccaucacccacgcucuuuggaaaugauauaaacagcguucuguucacuacccagaaucagacaccuaacagauuuagguucaaaauuacugacccaaauaaccggcgcuaugaagugccgcaucaauacgucaaggaguuuaccggccccacagugagugauacccuuuaugacgugaaggucgcccagaauccuuucuccauccagguuauuagaaaaucuaacgguaagacgcuguuugauacuagcaucgggccauugguguacuccgaccaguaucuccaaaucucaacaaggcugcccagugauuacauuuauggaauaggcgagcagguacacaaacgguuccgccaugaccugagcuggaagaccuggccuaucuuuacucgagaccagcucccaggcgauaacaauaacaauuuauacgggcaccagacauucuucaugugcauugaagacaccucuggaaaauccuuugguguguuccugaugaacucaaaugcuauggagaucuuuauacaacccacgccgauugucaccuacagagugacaggcgggauccuugauuucuauaucuugcugggagacacuccugaacagguugugcagcaauaccagcagcuagucggccuccccgcaaugccagccuauuggaaccuggguuuucagcuuagcagguggaauuacaagagucuggaugugguaaaggagguugugcggcguaaccgcgaggcugggauuccuuucgacacccaagucacagauaucgacuauauggaagauaaaaaggacuuuacuuacgaucagguggccuucaauggauugccccaguuuguccaggaccuccaugaccacggccaaaaauaugugauuauacuggauccagcgaucucuauuggcagaagggcaaacgggaccacauacgccaccuacgagcggggaaauacucagcacguuuggaucaacgaauccgacgguagcacgcccaucauuggcgagguguggccuggguuaacaguauauccagauuucaccaauccgaacuguauagacuggugggcuaaugaaugcucgaucuuucaucaggagguccaguacgauggacuguggauugacaugaacgaggugucuuccuucauccaaggcucaacuaaggguuguaacguuaauaaacucaacuaucccccuuuuaccccagauauucuugacaagcugauguacaguaaaacaaucugcauggaugccgugcagaauugggggaagcaguaugacguccacagcuuguacggcuauuccauggcaauagcuaccgaacaggccgugcaaaagguauuccccaacaaacgaucuuucauccuaacucgcagcacauuugcgggaucaggcagacaugccgcacacuggcugggggauaauacggcuaguugggagcagauggaaugguccauuaccggaaugcucgaguucagccuguuugguaucccucuugugggcgccgacauuuguggguucguugcugaaacuacagaggagcugugcaggcgguggaugcaguugggagccuuuuacccauucucucgcaaccacaauucagauggcuacgaacaucaagaccccgcauuuuucggucagaacagucuccuggucaagagcuccagacaguauuuaaccaucagguacacacugcuaccguuucucuauacucuguucuacaaagcccacguguuuggggagaccguggcucguccuguccuucaugaauucuaugaggacacgaauucuuggauagaagauaccgaguuuuuguggggcccagcgcugcucauuacacccguucugaagcagggagcagacacugugucggccuacaucccugaugcuauuugguaugacuacgagagcggcgccaaacggcccuggcgaaagcaaagaguggauauguaccuuccagcagacaagaucgggcugcacuugaggggagguuauauaaucccuauucaggaacccgauguaaccacaacugccucccgcaaaaacccacucggccugaucgucgcuuuaggggagaauaacaccgccaagggagacuucuucugggaugacggcgaaacgaaagauacaauucagaaugguaacuacauccuguauaccuuuucagugaguaauaacacucuagacauaguuugcacacauucuagcuaccaggaggggaccacucucgcauuccaaaccgugaagauucugggccuuacagauuccgucacggaggugcggguugcggaaaacaaucagccgaugaacgcucacucaaauuuuaccuaugacgccagcaaccagguguugcugaucgcagaccucaaacugaauuuaggaagaaacuucucuguacaguggaaucaaaucuuuuccgagaacgaaagguucaauuguuacccugaugccgaccuggcuacugagcagaagugcacacagcgcggcugugucuggcgaaccgggaguagccuuucuaaggcccccgaaugcuauuuuccacggcaagauaacuccuacucagugaauagugcacguuacagcucgaugggaauuacagcugacuugcagcucaacacugccaaugcgagaaucaaacugcccuccgauccuauuucuacccuaaggguggaggucaaguaucacaaaaacgacaugcugcaguucaagauauacgauccacagaaaaagcgcuaugagguucccgugccucucaauaucccgacgacaccaauuagcaccuacgaagaccggcuguaugauguagagaucaaggaaaaccccuuuggcauucaaaucagaaggcgaucaaguggucgcgugauaugggacuccuggcuuccuggguucgccuuuaacgaucaguucauccagauuucuacucgguugccaagcgaguacaucuauggauucggcgaagucgagcauaccgcuuuuaaaagagaccugaauuggaacacaugggguauguucacuagggaccagcccccuggcuacaaguuaaauuccuacggguuucacccguauuacauggcacucgaggaagagggaaacgcccauggcguguuccugcuuaauucaaacgcuauggauguuaccuuucaacccacaccagcccugacguaucguaccguggggggaauuuuggacuucuacauguuucucggcccuacucccgaagucgcaacaaaacaguaucacgaggugaucggucacccaguuaugccugcguacugggcccugggguuccagcuaugucgcuauggauacgcuaauaccagcgaagugcgggagcuguacgaugccauggucgcagcuaacauacccuaugacguacaguacacugauauugacuauauggagagacaacucgauuuuacaaucggcgaagccuuccaggaccugccacaguuuguggauaagaucaggggugagggcaugcgauacauuauaauccuugacccggcaauuagugggaaugaaaccaaaacguauccugccuucgagcggggacagcaaaacgauguuuuugugaaguggcccaauacuaacgacaucugcugggcuaaagucuggccagauuugcccaauauuaccaucgacaagacacugaccgaggacgaagcggugaacgccucucgcgcacauguagcuuucccugauuucuuuagaacuuccacagccgaguggugggccagggaaauaguggacuucuacaaugagaagaugaaauuugauggcuuauggaucgacaugaacgaaccaagcucguucgucaaugggaccacaacuaaccagugucggaacgaugagcucaauuaucccccuuacuuuccggagcugaccaagcgaacggacggacuucacuucagaacaauuugcauggaagcugagcagauccugucagauggcaccucuguucuacauuacgacgugcacaaccucuaugguuggagucaaaugaaaccaacucaugaugcacugcagaagaccacagggaaacgcggaauugugaucuccaggagcacuuaccccaccucuggccguugggguggccacugguugggggacaauuaugcccggugggauaacauggacaagagcauaauuggaaugauggaauuuucccuguucggcaugucauacacgggggcggauaucuguggauuuuucaauaacagugaguaucacuuaugcacaagauggaugcagcucggcgcuuuuuacccuuauagcaggaaucauaacaucgccaauacccgccgacaggaccccgcaucuuggaacgaaacuuucgccgagauguccagaaauauucugaacauccgguacacacuucugccauacuuuuauacccaaaugcacgagauacaugcuaauggugggacugucauuaggccuuugcuccacgaauucuucgacgagaagcccacaugggauaucuuuaaacaguuccuguggggaccagcauuuauggugaccccuguucuagaaccguacguacagacggugaacgccuauguccccaaugcgcgcugguucgacuaccauacuggcaaggauauuggcgugcgugggcaguuucaaaccuucaacgcuucauaugacacaaucaaccugcacguuagaggaggucacauacuuccaugucaggagccugcccagaauaccuuuuacagucggcagaaacauaugaagcucauuguggcagccgaugacaaccaaauggcucagggcagccuguucugggaugacggggaauccaucgauacauaugagagggacuuguaccugucuguccaguuuaauuuaaaccaaacuacccucacgucgacaauccugaaacgcggauacauuaauaagagcgagacucgacuuggcucacugcacgugugggguaaggggaccacacccguaaacgccgucaccuugacuuauaauggaaacaaaaauucccucccauucaacgaagauaccacaaauaugauccugagaauugaccuaacgacucauaacgugacccuggaggaaccuauagagaucaauuggaguuga

SEQ ID NO: 62507 - RNA, 2352 nt, Artificial Sequence
  derived and/or modified sequence opt3 from SIK1__Homo_sapiens__NP_775490
auggugaucaugagcgaguucuccgccgaccccgcuggccaggggcaaggacagcagaagccucugagagucgguuuuuacgauauugaaaggacccucggcaaagggaacuucgcaguugugaaacuugcccggcaccgcguaacaaagacucagguggcgauaaagaucauugacaaaacgcgacuggauucuucaaauuuggagaagaucuaucgugaaguccaauuaaugaagcugcuaaaccauccacacauuaucaaacucuaccaggugauggagaccaaggacaugcuguauauaguuacagaauuugcuaaaaauggagagauguucgauuaccuuaccaguaacggccaucugagcgagaaugaagccagaaagaaauuuuggcagaucuuguccgcaguggaguauugccacgaccaucacauuguccacagggaucucaagacugaaaaccugcugcucgacgguaauauggauaucaaguuagccgacuucggguuuggaaacuucuacaaaucuggcgagccgcugucgacaugguguggcucacccccuuaugcugcaccagagguguuugaagggaaggaguacgaaggaccccagcuugauauuuggagcuuggguguaguucuguacgugcuagucugcggcagucucccuuucgacgggccaaaucugcccacccuucggcaacgcgugcuggagggaagauuuaggaucccuuucuuuaugucccaggauugugaaucuuugauacggcgcaugcucguggucgacccagcccgaagaauuacuaucgcucagauuaggcagcaucgguggaugcgugccgagccgugccugcccggcccugcguguccagcauucagcgcccacuccuauacaucaaacuuaggugacuacgaugagcaagcucuggggaucaugcagacccucggaguugaccgccagagaacgguggaaagucuucaaaauagcucuuauaaccauuucgccgcaaucuacuaucuguugcuagagaggcugaaagaauaccggaaugcucagugcgcccgacccggcccugcgcgccagccaagacccagguccucagaucucagcggccuggagguaccgcaggaagggcuuaguacugacccuuuucggcccgcccuguuguguccacaaccucagacccucgugcagucuguccugcaggcagagauggauugcgaguuacaauccagccugcaguggccccuauucuuuccaguggacgcuucguguucuggaguuuuccgccccagaccuguguccccaucaagucuccuggauacagccauuagcgaagaggcuaggcaggguccgggccuugaagaggaacaggacacucaagaguccuugcccucuagcaccgggcgucggcacacacuggccgaggucucaacccgacucaguccucugacggcaccaugcauagugguaucccccagcacuacagccucuccugcugaaggaaccucaagugauagcugucuuacuuuuuccgcgucuaagucgccagcaggccugagcgguacacccgccacccagggguugcucggcgcuugcuccccgguuagacuggccucaccuuucuuaggaagucagucugcaacgccagugcugcaggcccaaggcgggcuaggaggugcuguccuccugcccgugagcuuucaggagggcaggcgcgccuccgacaccucacuuacacagggguugaaagcauuccggcaacagcugagaaagacuaccaggacaaaaggauuucucggccugaacaagaucaaggguuuagcgcgccaggucugccaggcuccugccagccgagcaucucgugggggccugucccccuuccacgccccagcucaaaguccuggacuucauggcggggccgcaggaagccgggaagguuggucuuugcucgaggaggugcuggaacagcagagacuacugcagcuccaacaccaucccgcugccgcgccaggcuguucccaggccccgcagccugcucccgcaccauuuguuauugcccccugcgaugggccuggagcugccccacugcccucaacucuuuugaccaguggccugccuuuacucccgccaccccugcuucagacaggugcaagcccuguggcgucggccgcucaacuguuggacacccaccuccauaucgggacuggcccaacggcccugcccgcaguaccuccgcccaggcuagcucgccuggccccaggaugugagccucucggccugcuucagggggacugcgaaauggaggauuugaugcccuguucccugggaacauucgucuuagugcaguga

SEQ ID NO: 62508 - RNA, 2781 nt, Artificial Sequence
  derived and/or modified sequence opt3 from SIK2__Homo_sapiens__NP_056006
auggugauggccgacggccccagacaucugcagagggggccuguccggguuggauucuacgauaucgaggguacccucggcaaggggaacuuugcugugguaaaacuuggacgccaccgaauuacaaagacugaaguggcaauaaaaaucauugacaagagccaacuggaugccgucaauuuggagaaaaucuaucgugaagugcagauuaugaagauguuagaccacccacauaucauaaagcuguaccagguuauggagacgaaauccaugcuauaucucgugaccgaauacgcgaagaacggcgagaucuucgauuaucuggcuaaucacgguagacuuaacgagucugaagccaggcggaaauuuuggcagauucugucagcagucgacuacugccaugggcgcaagaucgugcacagagauuugaaagccgagaaucuccugcuggacaacaauaugaacauuaagaucgcugauuucggauuuggcaauuucuuuaagaguggcgaacucuuagcaacauggugugggagcccgcccuaugccgcuccugagguauucgagggacaacaguacgaagguccacagcuggacauaugguccaugggcguugugcuuuacgucuuggugugcggggcccugcccuuugauggaccuacucuaccaauucucaggcagcgggugcuggagggccgcuuccgaauccccuauuuuaugucugaagacugugagcaccuuauuagaaggaugcuggucuuggauccuucgaaacggcucaccaucgcgcaaaucaaggaacauaaauggaugcugauugagguuccagugcagcguccgguauuauacccccaggagcaggaaaacgagccuucaauaggugaguucaaugaacaagugcugcgccucaugcacagccuugggaucgaccagcagaagacaauugaaagucugcaaaacaaauccuauaaucauuuugcagccaucuacuucuugcuagucgagagacugaagucucacaggagcuccuucccaguggagcagcggcucgacggacgacagcgcagacccucaaccauagcugaacagacuguugccaaagcacaaacagugggccugccugucaccaugcacaguccaaacaugaggcuucugcggagcgcuuugcucccccaggccucuaauguggaggcguuuuccuucccggccucaggcugccaggcagaagcugccuuuauggaggaagaguguguagauacgccuaagguuaacgggugccuguuagaccccgugccaccuguccuggugcgcaagggaugucagagccuacccaguaacaugauggagacuucuauugaugaaggucucgagaccgaaggcgaggcugaggaagacccagcccaugcauucgaggccuuucaauccacaagaagcgggcagaggcgucacacucugucggaagucaccaaucagcuugugguuaugcccggagcuggcaaaaucuucucuaugaacgauuccccuucauuggacaguguggauagcgaguaugacauggguuccguacagcgggaucugaauuuucucgaagacaacccaucucugaaggauaucaugcuugcgaaucaaccgagcccccgaaugacaucaccuuucauuagucugagaccaaccaaccccgcaaugcaggccuuguccagccagaaaagggagguccauaaucgcucuccugugucauuucgggaggggagaagggcuagugacacgagccucacucagggcaucguugccuuccgccaacaucugcagaacuuagcacgaacaaagggaauuuuggaacuaaauaaagugcagcuccuguacgagcaaauaggcccagaagccgaccccaaccuugcuccggccgcaccucaguugcaggaucuggcguccucuugcccacaggaggaagucucgcaacagcaggagagcguguccacccuccccgcuucaguacacccucagcugaguccccggcaaucuuuagagacucaguaucugcagcaccgucuucagaagccaagccugcucuccaaggcccaaaauacaugucagcuguacugcaaagaaccucccagaucacuagagcagcaacugcaggaacacaggcuccagcagaagcgccuguuucuucaaaaacagagccaguugcaggcauacuucaaccaaaugcagaucgccgagucuuccuauccacagccgagucagcaacugccuuuaccccggcaggaaaccccacccccuagccagcaggcuccacccuuuucucucacgcaaccucuguccccggugcuugagccaucaagugagcagaugcaguacagccccuuccugucgcaauaucaggaaaugcaguugcagccucucccauccaccucugggcccagagccgcaccuccgcugcccacacaacuacagcagcagcaaccaccucccccaccucccccaccgccucccaggcagccaggagcugcccccgcgccucugcaguucagcuaccagacuugugagcucccaucagccgcuagucccgcaccugacuauccgaccccaugccaauaccccguugauggugcccagcaguccgaccugacaggcccugauugcccccgaucuccagggcuucaagaagcuccuagcuccuaugaccccuuggcccugucagaguuaccaggacucuuugauugugagaugcuggacgcagucgauccucagcauaauggcuacgugcuugugaacuga

SEQ ID NO: 62509 - RNA, 3786 nt, Artificial Sequence
  derived and/or modified sequence opt3 from SIK3__Homo_sapiens__NP_001268678
auggccgcugcagccgcgagcggcgcugggggagccgcaggagccggcaccgggggagcuggccccgcagguagacugcucccuccaccggcccccggguccccugcugccccagcggcagugucucccgccgcuggacagccuaggccacccgccccugcaucacggggcccaaugccggcucgcaucggcuacuaugagauugaccgaacaauagggaagggaaacuucgccgucguuaaacgugcgacucaccuugugacgaaggccaaaguagcaaucaagauuaucgauaaaacccaacuggacgaagagaauuugaagaagauuuuuagagaagugcagaucaugaaaauguuaugccauccccacauaaucaggcuguaccaggucauggagacagaacggaugauuuaucuagugacugaguacgcuagugguggcgagaucuucgaucaucucguugcccacgggcgcauggcugaaaaggaggccagaaggaaauuuaagcagauugugaccgcagucuauuucugucauugccggaacaucgugcaccgcgaccugaaagccgaaaaucuucuguuggaugcuaaccucaauauaaagauugcggacuuuggauucagcaaccuguuuacaccuggccaacugcucaagaccuggugugguuccccacccuacgcagccccugaguuauucgaggggaaagaauaugauggaccaaagguagacaucuggucucugggcguugugcuuuacgucuuggugugcggcgcucugcccuuugaugggucgacucuacagaaucuccgagccagagugcugucaggaaaauucaggauuccguuuuucaugagcacagagugugaacaccuuauccggcauaugcuggucuuggacccuaacaagcgucucaguauggagcagaucugcaaacacaaguggaugaaacugggugaugcagaccccaauuuugaucgcuuaauugccgaaugucagcaacugaaggaggagagacagguugacccacucaacgaagacgugcuucuggcuauggaggauaugggcuuggacaaggaacagacccuacaggccgagcaagcagggacggcgaugaauauauccguaccucaggugcagcugaucaaccccgaaaaucaaauugucgagccagauggaacucucaaccuggacucugaugagggcgaggaacccagcccugaagcucuugugagguaccuguccaugcggcgacauaccguugguguggccgacccacgcacagaggucauggaagauuugcagaaacuccugccgggguuccccggcgugaauccucaggcaccauucuuacagguagcccccaacguuaacuuuaugcacaaucugcuaccuaugcaaaaccuccagccaacuggacagcuggaguauaaggagcagucacuuuugcaacccccgacccugcagcuccugaauggcauggggccucuuggaagaagggcuagugacgguggcgccaacauccagcugcacgcacagcaauugcucaaacggccacgcgggcccagcccucuggugacaaugacccccgcugucccagccgugacgccugucgaugaagagucuuccgacggagaacccgaucaggaggcggugcagagauacuuagccaauaggucaaagcgucauacucuggcuaugacaaacccaaccgcagagauaccgccugaccuacagcggcaacucggccagcagcccuuccgaagcagaguuuggccaccccaccuggugccugaccaacauaggaguacuuauaaagauucuaauacacuucacuugccaaccgaacgcuuuucccccguacggagauucagcgacggugccgcuucgauucaggccuuuaaggcacaucuggagaagauggggaacaauucuuccaucaaacagcuccagcaagaaugcgagcagcugcagaagauguacggcggacagaucgaugaaaggacguuagagaaaacccaacagcagcacaugcuguaucagcaagagcagcaccaucagauucuucaacagcagauccaggacucaauuuguccuccgcaaccaagucccccuuugcaggcggccugcgaaaaccagccagcucuccugacacaccagcuacaacgccugcgaauacagcccagcuccccuccgcccaaucauccaaacaaucaccucuuccggcagccuucuaacucacccccaccuaugagcagugccaugauccagccccacggcgcagcuuccagcucucaauuucaggggcugccaucacguagugccauuuuccagcagcaaccggagaauuguagcuccccucccaacgucgcacuuacuugcuugggaaugcagcagccagcccaaucucaacaggugaccauccagguucaggaacccguggauaugcugucgaacaugccugguacagcugcgggcagcuccgggagaggaaucucaauuaguccaucugccggccagaugcagaugcagcauaggacuaauuuaauggcaacccucagcuacggucaccgcccccuguccaagcaacuuucagcugacagcgccgaggcccauucugcucaccagcagccuccgcauuauacaaccuccgcacugcagcaagccuugcucaguccaacucccccugauuacacgcggcaccagcaggucccccacauacugcaagggcuacugagcccaagacauucucucacaggccacuccgacaucaggcugccucccaccgaauuugcgcagcuuauuaaacgacagcagcaacagcgccagcagcaacagcagcagcaacagcagcaggaguaccaagaguuguuccggcauaugaaccagggagaugcuggcucacuggccccaaguuuagggggacagagcaugacugaaagacaagcacucucguaucagaaugccgacuccuaccaccaucacaccucuccucagcaucugcuucagaucagggcucaagagugcgugagccaggcaucaaguccgacacccccacacggcuaugcccaccagccugcgcugaugcauuccgaaucuauggaggaagauuguagcugcgagggugcuaaggacggguuucaggauuccaagucaagcaguacccuaacuaaaggaugucacgacucuccccuccuguuguccacaggcgguccaggcgacccugagagccuguuagggacgguaucgcacgcccaagaacucgguauucaucccuacggccaccagccgaccgcagccuucucaaagaacaaagugccaucucgugagccuguuaucgggaauugcauggaucgcaguucccccggacaggcugucgaacugccagaccauaacggccuugguuaucccgcccggccuagcgugcacgagcaucacagaccgagggcacugcagcgacaccauacuauacaaaauucugaugacgcuuacgugcaguuggauaaccuccccgggaugagccuggucgccggaaaggcgcuauccucagcccggaugagugacgcaguucugagccagucuucccuuaugggcucacaacaguuucaggauggugagaaugaagaguguggcgcuagucucgggggacacgaacauccagaccugagcgauggcucccagcacuugaacucuucgugcuauccuagcacauguaucaccgacauucuguuaucauacaaacaccccgagguguccuucaguauggaacaagccgggguguga

SEQ ID NO: 62510 - RNA, 1386 nt, Artificial Sequence
  derived and/or modified sequence opt3 from SIL1__Homo_sapiens__NP_071909
auggcuccccagagccugccuuccucuagaauggccccacucggcaugcuucugggguuguuaauggcagccugcuucaccuuuugucugucacaccaaaaccuaaaggaguucgcgcucacaaauccggagaaaaguagcacuaaggaaacggaaaggaaagagaccaaggcugaagaggagcuggacgccgaagugcuugaggucuuucaucccacacacgaauggcaggcacugcagccuggacaggccguuccagcugguucccaugugcgguugaaccuccaaacuggcgagcgcgaggcaaaacugcaguacgaagauaaguuccgaaauaaccugaaggggaaacgucucgacaucaauaccaacacauauaccucucaggauuuaaagucggcccuggcuaaauuuaaggagggagccgaaauggagucaagcaaagaagacaaggcgagacaggcagagguaaagaggcuuuuccggcccauugaggaauugaaaaaggauuuugacgagcugaauguggucauagaaacugauaugcaaaucauggugcgccuaauuaacaaauucaauaguuccucuagcucccucgaggaaaagaucgccgcucuguuugaccuugaguacuauguucaccagauggauaacgcccaggaccuguugucauucggcggucuccagguggucauuaaugggcugaacaguacagagccuuuagugaaagaauacgcagcuuuuguacugggagccgcguucagcucuaauccaaagguucaaguggaggccaucgaaggcggcgcacuccagaaacuucuggucauauuggcuaccgagcagccccuaacggccaagaagaaagugcuguuugcucucugcucccugcuuagacauuucccuuaugcccaaaggcaguuccugaagcucgggggacuccaggugcugcggacuuuaguccaggaaaaagguaccgagguucuggcagugcgcguagugacacuacucuacgaucuggucacugagaagauguuugccgaagaggaagcugagcuuacccaagagaugucaccagaaaaauugcagcaguaucgacaggugcaccuguugccgggccugugggagcaaggguggugugaaaucacagcgcaccuucuggcauugcccgagcaugacgccagagaaaagguucuccagacccugggaguguuacugacgacuugcagggaucgguaccgucaggacccucagcuaggccgcacacucgcuagccugcaagccgaguaccagguccuugcaaguuuggagcugcaggacggugaagaugagggguauuuccaggaacuccugggaucugugaacuccuuacugaaggagcuuagauga

SEQ ID NO: 62511 - RNA, 2301 nt, Artificial Sequence
  derived and/or modified sequence opt3 from SIM1__Homo_sapiens__XP_005267157
augaaggagaaaagcaagaacgccgcuagaaccaggcgggaaaaagaaaauuccgaguucuacgagcuggcaaagcuccuuccccugccuucugccaucacaucacaguuggacaaagcgaguauuauacgcuuaacuacgagcuaucugaagaugcgaguggucuuuccagaaggccuaggggaggcuuggggacacuccucucguaccucgccgcucgauaacguugguagagagcugggcucacaucuucugcaaacauuggacggguucaucuuugugguagcccccgauggaaagauuauguacaucagcgaaacugcaagugugcaccucggccugucccaggucgagcugaccgguaauucuauuuaugaauacauccauccugccgaccacgaugagaugacagcugugcucaccgcacaucagccauaucacagccacuucguucaggaguacgaaauagagagguccuuuuucuuacggaugaaaugcgugcuggccaagcgcaacgcugggcuuacuuguggaggcuauaaagucauccauugcucaggcuacuugaagauuagacaauacagucuggacaugagccccuuugauggguguuaucagaaugugggacugguagccguuggucacucucucccuccauccgcggugacagaaaucaaacugcauucaaacauguucauguuuagggcaagccuugacaugaagcugauuuucuuggauagucgggucgccgagcucaccggcuacgaaccccaggaccugaucgagaagacguuauaucaccacgugcaugggugcgauacuuuucaccuacgcugugcucaucaccuccuucuggugaaaggacaggucaccacaaaguacuaucgauucuuggccaaacauggcgguuggguuugggugcaaucuuacgcaacuauaguacacaauuccagaagcucgaggccucacugcauugugucugucaacuaugugcuaaccgacacagaguacaaggggcugcagcucucccuggaucagaucucagcuaguaaaccagccuuuagcuacaccuccucuagcacgccgacuaugacagacaaucggaagggagcgaaaucacgucuuaguuccagcaagucuaagucacgcaccagucccuauccucaguacagcggcuuccauacugaaagauccgagucugaccacgauucgcaauggggcgggagcccacugacagacaccgccucaccccaguugcucgauccugcagacaggccaggaucccagcaugaugcuaguugugccuaucggcaauucucugaccgaagcucccugugcuacgguuuugcuuuagaucacucacgccugguugaagagagacacuuccauacgcaggccugugaaggcgggaggugcgaggcaggacgguauuuucuaggcacaccccaggccggucgcgagccguggugggggagcagagcugcgcucccucugaccaaagcaucucccgaauccagggaggccuacgaaaacaguaugccacacauugcuagcgugcaucguauccacggccggggacauugggacgaggauucugucguguccucaccugaccccggcagugccagcgaaucgggggaucgauauagaacugagcaguaccaauccucuccacacgagcccagcaagaucgaaacccuuauuagggcaacacagcagaugauaaaagaggaagagaaucgcuugcagcugcggaaggccccuucagaccaacucgcuaguaucaacggagccgguaaaaagcacucccuguguuucgcaaauuaccagcagccaccgcccacuggcgagguaugccaugggucugcgcuugcuaacaccagcccuugcgaccacauucagcaaagagaaggaaagaugcuguccccacaugagaaugauuaugacaacucacccacagccuugagcaggaucaguucuccuaacuccgaucgcauaagcaaaucgucacucauucuggcaaaggacuacuuacacucugauaucaguccacaucagaccgccggcgaccaccccacuguuuccccgaauuguuuugguagccaccgacaguauuucgauaaacaugcuuacacgcugacaggguaugcccuagaacaccucuacgacucugagaccauccggaacuauagccugggcugcaauggaucccauuuugaugugacuucacaccuucguaugcagccugacccagcacaaggccacaaggggaccagugucauuaucacaaacggaagcuga

SEQ ID NO: 62512 - RNA, 2004 nt, Artificial Sequence
  derived and/or modified sequence opt3 from SIM2__Homo_sapiens__NP_005060
augaaggagaaaagcaagaacgccgcuaaaaccagaagggaaaaggagaauggcgaguucuacgagcuggcaaaacuccuuccccugccuuccgccaucacaucucaguuggacaaggcgucaauuauacgguuaacuacgaguuaucugaagaugcgcgcuguguuuccagaagggcuaggagaugccuggggucaaccgagccgagcaggcccccucgacggggucgccaaagagcugggaucccaccuucugcagaccuuggauggcuucguuuuugugguagcuucugacgguaagaucauguacauuucggagacagcaucagugcaucucgggcugagccaggucgaacugacuggaaacaguaucuaugaguacauucacccuuccgaucaugacgaaaugaccgccgugcucacagcucaccagccauuacaucaccaucugcuucaagaguaugagaucgaacguucuuucuuuuugagaaugaaaugcguucuggccaagaggaaugcgggccuaaccuguagcggcuacaaagugauacacugcuccggguaucucaagauccggcaguacaugcuggauaugucacuuuacgacaguuguuaucagauugucggacugguggcaguaggucagagcuugcccccuucugccaucacugagauuaagcucuacuccaacauguucauguuucgcgcuucacuggauuuaaaacugaucuuccucgacagcagaguuacagaagugaccggcuaugagccacaagaucuuauagaaaagacgcuguaccaccauguccacgggugcgacguguuucacuugagguaugcccaucaccuacugcucgugaaaggacaggucacuaccaaguacuaucggcugcuuaguaaacgcggcgguuggguuugggugcagucuuacgcaacaguagugcauaauucccgaagcucgagaccccacuguauugucucugugaacuacguucugacugagaucgaguauaaggaauugcagcucucccuggagcaagugucaaccgcuaaaagucaggauagcuggaggacagccuuauccaccucucaggaaacgcggaagcuggucaagccuaaaaauacuaagaugaaaacaaagcuacguaccaacccauacccgccccaacaguauagcucauuccagauggacaaacucgagugcgggcagcugggaaauuggcgcgcgaguccuccagccuccgcagcugcucccccugaacuucaaccacauagcgagucuucagacuugcuguacacucccaguuauagccucccguuuuccuaccacuauggccacuucccucuggauucucauguguuuucgagcaagaagcccaugcuuccagccaaauucggccagccucaggggucccccugugagguagccagauucuuucugucaacauugccagcaaguggagaaugccaguggcacuacgccaacccccucguuccuucuagcuccucaccagcuaagaauccgcccgagccuccagcgaacaccgcaaggcauagccuggugcccucuuacgaagccccugcugccgcaguccggcgauucggugaggacacggccccacccuccuuuccgaguuguggccacuaucgcgaagaaccugcuuuagggccagccaaagcagcgagacaagcugccagggauggagcacggcuggcccuagcucgcgccgcacccgagugcugugcuccucccaccccagaagccccuggcgcgcccgcccagcucccauucgugcugcuuaauuaccacagagucuuggcuaggcgugguccgcucgggggcgcagccccugcugccagcggacuggcaugcgcgcccggcgggccagaggccgcuacaggagcccugcgguuacgacaucccucuccugcagcuacuuccccacccggugccccucugccgcacuaucuuggcgcaucagugauuaucaccaacgggagauga

SEQ ID NO: 62513 - RNA, 3822 nt, Artificial Sequence
  derived and/or modified sequence opt3 from SIN3A__Homo_sapiens__XP_006720530
augaagagaaggcuggacgaucaggagagccccguguacgccgcucaacagcggcgcaucccuggcuccaccgaagcauucccacaccagcaucgaguccucgccccggcgcccccuguuuaugaggcugugucugaaacaaugcagucagccacugggauucaauacaguguaacgccaagcuaucagguguccgcaaugccccagucuucgggaucacacgguccugccauagcugcaguccauagcagucaccaucacccaaccgccgugcagccccacggcgggcaaguugugcagucccaugcucacccugccccaccggucgcgcccgugcagggacagcaacaguuucagcgucuuaaaguagaggacgcacugucuuacuuggaucaaguuaaguuacaguucggcagccagccucagguguauaacgacuuucuggauaucaugaaagaguucaagucccaaucaauugacacaccaggugucaucaguagagugagccagcuauuuaaagggcaucccgaucucauuaugggauucaauacuuuucugccuccaggcuacaagaucgaagugcagaccaacgacauggucaauguuacaacccccggccaggugcaccaaauaccgacucacgggauccagccucagccccagccaccuccccaacauccaucucagcccuccgcccagucagcuccugccccagcacagccggcuccccaaccuccacccgccaagguaagcaaaccuagucagcuucaggcgcacacaccagccucucaacagacgcccccgcugccuccauaugcaucccccaggagcccucccgugcagccacauaccccugucacuauuucguugggaaccgcucccucucuccagaacaaucaaccaguggaguucaaccacgccaucaauuacguuaacaagauuaaaaaucgguuucagggucagccggauaucuacaaggcuuuccuggaaauacugcauacauaucagaaagagcaacgcaacgccaaggaagcaggcgggaauuacacuccugcccucaccgagcaggagguguaugcucaggucgcgagauuauuuaagaaccaggaagaccugcuuuccgaguucggacaauuuuugcccgaugcaaauucaagugugcugcuaagcaaaacaaccgccgaaaagguagacuccguuaggaacgaucacggcgguacggugaaaaagccacagcucaauaacaaaccccagcggccuucucaaaacgggugccagauucgccgacacccaacuggaacaacucccccugucaagaaaaagccgaagcugcuuaaucugaaagacagcucaauggcugacgccaguaagcauggcggcgggaccgaguccuuguucuucgauaaagugagaaaggcacucaggagcgccgaggcuuacgaaaacuuucugcgguguuuagucaucuucaaucaggaggugauuucucgugccgaacugguucagcucgugucaccauuucuuggaaaauuccccgagcuguuuaacugguucaagaauuuucuugguuauaaggaaaguguacaccuagagacauacccuaaagaacgcgcaaccgagggcaucgcgauggagaucgacuaugcuagcugcaagagacugggguccucuuacagggcccucccaaaaucguaccaacagcccaaguguacgggacggaccccucugugcaaagaaguccuuaacgauacaugggugagcuucccguccuggucagaggacaguacuuuuguuucuagcaagaagacccaguaugaggaacauauuuaccgaugugaagaugagcgcuucgagcuggacguggucuuggaaacaaaucucgcaacuauaagagugcuggaggccauccagaaaaaguuauccaggcugucagcugaggaacaagccaaauuucggcuagauaacacccucggcgguacaagcgagguaauucaccgcaaggcacugcagagaaucuaugcugacaaagccgcggauauaauugacgggcuuaggaagaaucccucuaucgccgugccaaucguuuugaagcgucugaaaaugaaggaagaggaauggcgggaggcucagcgaggcuucaacaaagucuggagagaacagaaugagaaguacuaucucaaaucccuggaucaccaaggaauuaacuuuaagcagaaugacaccaaagugcuuaggaguaagagccuguugaacgagaucgaaucuauuuacgacgagcgccaggaacaggcaacugaggaaaaugccggcgugccugucgggccccaucucucccuggcuuaugaggauaagcaaauauuagaggacgccgcagcgcugaucauucaccauguuaaacggcagacgggaauccagaaggaagauaaauacaagaucaaacaaauuaugcaccauuucauaccagaccuacucuucgcccagagaggugaucugucagacguggaggaagaggaagaggaggaaauggauguggacgaggcuacaggcgccguaaagaagcacaacggggucggaggcaguccucccaaaagcaaguuguuguuuucgaacaccgcagcucagaaacugagggguauggaugaaguguacaaucucuucuauguuaacaauaacugguacaucuuuaugcgccugcaccagauuuuaugccugcgacuuuugcggaucuguucccaagccgagcgucagauugaggaagagaauagagaaagggagugggaacgcgaggugcucgggaucaagcgggacaaaucugauagcccagcaauacagcugagacuaaaggagccgauggacgucgauguggaagacuauuacccugccuuccuggacaugguuaggucacuccuggauggcaacaucgacaguucccaguaugaggauucucuucgagaaauguuuacuauucaugcuuacaucgcguucaccauggacaaguugauucaaagcaucgugcgccagcugcagcacauaguauccgaugagauuugcguccaggugacagacuuauaucucgccgaaaauaacaauggagcaaccggcgggcaacugaacacucaaaauucacggagccuucuggagaguacauaccagagaaaagcugagcaguugaugucugaugaaaacuguuuuaagcucauguucauccagucccagggacaggugcaacugacgauugagcuacuggacaccgaagaggaaaauagcgaugaccccgucgaggccgagagguggucggauuacguugaacguuauaugaacucagacacuacaucuccagagcuccgcgaacaucuggcccagaaacccguguuucuuccucggaauuugagaaggauccgaaagugccagcggggucgcgagcagcaagagaaagaaggcaaggaggggaacaguaagaaaaccauggaaaacguagauucccuggacaaguuagaguguagauucaaacucaauagcuacaagaugguguaugucauaaaaucugaagacuacauguauaggcggacagcucugcuucgagcacaccagagccaugagagaguguccaagcgccugcaccagagguuucaggccuggguugauaaauggacuaaggagcacgugccacgugaaauggcggcugagaccucaaaguggcuaaugggagaaggccucgagggucugguccccugcacgaccacaugcgacacugaaaccuugcauuucgugaguaucaacaaauaccggguuaaguaugggacaguguuuaaagccccuuga

SEQ ID NO: 62514 - RNA, 3393 nt, Artificial Sequence
  derived and/or modified sequence opt3 from SIN3B__Homo_sapiens__NP_001284524
auggcccacgcuggcgggggaagcgguggcuccggggcaggaggccccgccgguagagggcugucuggagcgagguggggccggucaggcagugcugggcaugagaagcucccugugcacgucgaagacgcccuuaccuaccuggaucagguuaaaauccgcuucggaagcgacccagcaacauauaacgguuucuuggagauuaugaaggaauuuaaaucccaaucuauagauacuccgggcgugauccgacguguaucgcaguuauuucaugagcaccccgaccugauugugggguucaaugccuuucuaccucucggauacagaaucgauauuccaaagaacggcaaacugaauauccagucaccccuuacgagccaggaaaacagucauaaucacggugacggggcugaggauuucaagcaacaggucccuuauaaggaggacaaaccacaggugccccuggaauccgauucuguugaguuuaacaaugcaauaagcuacgugaacaagaucaaaaccagguucuuggaccacccugaaauuuaucgguccuuucucgagauccugcauacauaccagaaggagcaacugaauacucgcggaagaccauucaggggcaugucagaagaggaagucuuuaccgagguggccaaccucuuccggggccaggaagauuuacugagugaguuugggcaguuccuuccggaggcuaaacgcagcuuguucacaggaaauggucccugcgaaaugcacucuguacagaagaacgagcaugacaagaccccugaacacucccgaaaaagaucaaggccaagccugcuacggcccguuagugccccugcgaagaaaaagaugaaacuccguggcacuaaggaucugucuauugcagccguggggaaauauggaacacuucaagaguuuuccuucuuugacaagguccgcagaguguuaaagagccaggaaguguacgagaauuucuugagguguaucgcucucuuuaaccaggagcuggucucgggcucugaauuacugcaacucguuuccccauuccuugguaaauuucccgagcuguucgcccaguuuaagucauucuugggggugaaagaacuaaguuuugcaccgccuaugagcgaccgguccggcgauggaauaucucgagagauugacuacgcuagcugcaagcgcaucggcucaaguuauagagcccugcccaaaaccuaccagcagccaaaguguuccgggaggacggcgauuugcaaggaaguacucaaugauacuugggugagcuucccuucuuggucagaggacaguaccuuugucagcuccaaaaagacacccuaugaggaacaacugcaccggugugaggaugaacgcuucgagcuugacgugguucuggagacuaacuuggccaccaucagagugcucgaaucuguccagaaaaagcugucgaggauggcaccagaggaucaggaaaaauuccguuuagacgauagccugggagguacauccgaggugauccagcggcgagcuauuuacagaauauauggcgacaaggcccccgaaaucauugagucacuaaagaaaaacccuguaaccgcuguuccagugguccucaagaggcugaaagccaaggaggaagaguggcgcgaagcacaacagggguuuaauaaaaucuggcgggagcaguacgaaaaggccuaucuuaagaguuuggaucaucaggcugugaacuucaaacaaaaugacacgaaggcgcugagaucuaaaagccuccugaacgagauagaguccgucuacgacgaacaccaggagcagcauucagaaggaaggagcgcaccgucuuccgagccccaccuuauuuuuguguacgaagaucgccagauccuggaggacgccgcugccuugaucaguuauuacguuaagcgacaaccugcaauucagaaagaggaucagggcacuauccaucaacuccugcaccaguucgugccaagccuguuuuucucucagcagcuggaccuaggugccuccgaagagucagcugaugaagaccgggauaguccccaagggcagacaaccgacccuagcgagcguaagaaaccagcccccggcccgcacucguccccuccagaggaaaagggagcauuuggcgaugcgcccgcuacugagcagccuccccucccaccucccgccccacauaagccgcuggacgauguauauucucuuuucuuugcaaauaacaauugguacuucuuuuugagacugcaccagacacucugcagcaggcuguuaaaaauuuaucgccaagcccagaagcagcugcuugaauaccggaccgagaaagaaagagagaaguugcucugugaggggaggcgagaaaaaggaucagacccugcuauggagcugcgccuaaagcagcccagugaagucgagcuggaagaguauuacccagccuuccucgauauggugcggucccugcuugaggguucuauagaccccacgcaauacgaagacaccuugagagagauguuuacaauccaugcauauguuggcuucacuauggauaagcuggugcagaacauugcuaggcaguuacaccaccucgucagcgacgaugugugccugaaaguaguggaacuuuaccugaaugagaagaaacguggggccgcgggaggcaacuuguccucacgcuguguucgggccgcuagagaaaccagcuaucaauggaaggcagagaggugcauggccgacgagaauuguuucaaagucauguuucuccagcgaaagggucaggugaucaugacaaucgaacugcuagauacugaggaagcucagaccgaggacccuguggagguccaacaucuggcccgguacguugaacaguauguggggacagagggcgcaaguucuuccccaaccgaaggauuccuccugaagcccguguuucuucagcgcaacuugaaaaaguucagaaggcgguggcagagcgagcaagcgcgagcccugagaggcgaagcucgcucgucauggaaaagguuaguaggggucgagucugccugcgauguggacugccguuuuaagcucaguacucacaaaaugguuuucauugugaacuccgaggauuacauguaucggagaggaacgcuguguagggcaaagcagguccagccucuugugcugcuacgccaucaccagcauuuugaagaguggcacagccgauggcucgaagacaauguuacaguggaggcugccucucugguacaagauugguugaugggcgaagaggacgaggauauggucccgugcaagacccugugugaaacugugcacgugcaugguuuaccagucaccagauaccggguucaguacagcaggcgccccgcauccccuuga

SEQ ID NO: 62515 - RNA, 3129 nt, Artificial Sequence
  derived and/or modified sequence opt3 from SIPA1__Homo_sapiens__NP_694985
augcccaugugggccggcggggugggaagcccuagaagggguauggcuccagcauccaccgacgaucuguucgcccggaagcuccgccagccggcgcgacccccucuuacaccacacacuuuugagccccguccugucagaggcccacuguugaggucugggucagacgcuggagaagcccggcccccuacgccagcaaguccgcgcgccagagcucauagccacgaggaagcauccaggcccgccgcuaccucuacacgguuauucacugauccucuggcccuacucggccugccagcggaggaacccgagccugcauuuccacccguucuugagccgcgcugguucgcccauuacgacgugcaaucgcuguuguuugauugggcuccucgaucacaggguauggggagccacagugaagccuccucuggaacccucgcaagcgcugaggaccaggccgcguccucagaucugcugcauggcgcccccggcuucguaugcgaacucgggggagagggugaguuaggccucgggggaccagcaaguccucccgugccacccgcuuugccuaacgccgcugucagcaucuuggaggaaccacagaauagaacaucugccuauucccuggaacacgcagaccuaggcgccgguuacuauaggaaauacuuuuaugggaaggagcaccaaaacuucuuuggaauggaugaaucacucggcccgguggcuguuagccugcggcgugaggagaaagaaggcagugggggagguacccuucauucuuaccgcgugauugucagaacuacacagcugaggaccuugcggggcacgauauccgaggacgcgcugcccccugggccaccccgaggacugagcccucgcaaguuacuggaacacguggcaccacagcucucgcccucuugucuuagacugggcuccgccucaccgaaaguaccuaggacuuugcuaacccuggaugagcagguucucaguuuccaacggaagguggguauccuguauugccgcgcugggcagggcagcgaagaggagauguacaauaaccaggaagccggaccagcauuuaugcaguuccuuacacuguugggcgacgucgugagacucaagggguuugaguccuacagggcccaacuggauacuaaaaccgacucuacaggaacccauagcuuauauacgacuuaccaggaccacgaaauuauguuccacgugucaacaaugcugcccuauaccccuaauaaccagcaacagcuacuccguaagcggcauaucgguaaugauauugucacuaucguuuuccaggagcccggcaguaaaccauuuuguccuacaaccauacgaucccacuuccagcauguguuucugguagugagagcucacacgcccugcaccccacauacaacuuacagggucgccgugagccgcacccaagacacaccggcauucgggccugcgcuucccgcuggaggcgguccauuugccgcaaacgccgauuuccgggcuuuucuucuggccaaggcacucaauggggaacaggcugccggccacgcgagacaguuccacgccauggcuacuaggacccgccagcaauaucugcaggaccuugcaacaaacgagguuaccacuacgucucuggauucagccagucgauuuggauugcccagccucggcgggcggcguagagcugccccuaggggaccaggugcagagcugcaggcggccggcuccuuaguguggggaguccgcgcugcccccggggcacggguggcugccggcgcacaggccucugguccugaagggaucgagguaccgugucugcuaggcauuucggcugaagcgcucguucugguggccccaagagacggaagggucguguucaauugcgcaugucgagauguccuugcuuggacauuuagcgagcaacaguuggaccuguaccauggccgcggggaggccaucacccuccgguucgauggaucccccggccaggccgugggugaaguuguggcuagacugcaguuaguaucaagggggugcgagacucgugaacuggcacuuccucgcgacggacaaggccgguuggguuuugaggucgaugccgaaggcuucgugacccacguugagagauucacauuugcggagaccgcugggcucaggccaggagcccgacugcuacggguguguggccagacucugcccagucuccgcccugaagcagccgcucagcugcuuagaucugcaccgaaagucugcgugacaguauugcccccagacgagagcgggaggccucggcgauccuucucagaacuguauacguuaagccuccaagagcccucuagacgcggagccccagacccugugcaggaugaaguucagggcgucacccugcuucccacuacaaagcagcuguugcaucucugucugcaagacgguggguccccaccgggaccuggcgaucuagcggaggagaggaccgaauuucugcacagucagaacagccucucuccccguuccucacugagugacgaggcuccagugcuucccaauacaacuccugauuugcuguuagccaccacggcaaagccaagcgugcccucggccgacuccgaaaccccucucacacaggaucggccggguucuccaagcggcucagaggacaaagggaaccccgcuccugaacugagagccaguuuccuucccaggacucugucccuacgcaauucuauuagccgaaucauguccgaggcaggaucaggcacccucgaggaugaauggcaggcuauaagcgagauugccaguacaugcaacacuauccuggaaucuuuguccagagaggggcaaccaauuccugagagcggagaccccaagggcaccccaaaaucggaugcggaaccugagccggguaaccugucagaaaaggucucucacuuagagaguaugcuccggaaacugcaggaagaccuucagaaggagaaagccgauagggcagcucuggaggaagagguucgcuccuugcgucauaauaacagacggcuccaggccgaaagcgagucugcugcaacgaggcugcuacuggccagcaagcaacuugggucccccacagccgaccucgcuuga

SEQ ID NO: 62516 - RNA, 5169 nt, Artificial Sequence
  derived and/or modified sequence opt3 from SIPA1L2__Homo_sapiens__NP_065859
augagcgaccccagacagucccaagaagaaaagcacaaacugggcagggcaucuucaaaguucaaagauccuccacggaucaugcagagugacgauuacuuugcucgcaaguucaaagcaauuaaugggaauaugggaccgacaacaagccucaacgccuccaauucuaacgagacugguggcgggggacccgcgaauggcacgccugcugugccaaagauggguguccgagcccguguuucggaauggcccccuaagaaagacugcucaaaggagcuuacauguaaagcacugugggaaagcagaagucagacauccuaugagucuauaacuagcguguugcagaacgggcaauccgaucagucagagggacagcaggacgaacaauuagaucuggacuuuguagaggccaaguacaccaucggcgauauuuucgugcacaguccacagaggggccuacaccccauccggcagcgcagcaauucugacgucacaauuuccgauaucgacgcugaagaugugcucgaccagaacgcaguuaauccuaacaccggggccgcucugcauagagaguauggaucaacuagcaguauagacaggcaaggucuuucuggcgagaacuuuuucgccaugcugcggggguaccgcguggaaaacuaugaucacaaagcgauggucccauuuggauucccggaguuuuuccgaugcgaccccgcaaucuccccuagcuugcaugccgcugcccagauuucgagaggcgaauuugugaggaucucuggucucgauuacguagacuccgcacugcugauggggcgggaucgugacaagccauucaagcgcagacucaaaucagagaguguugaaaccagcuuauuuaggaagcugcggaccgugaaauccgagcacgagacguucaaguucacuucugaacuugaggaaagccgauuggagcgcggaauuagacccuggaauugucagaggugcuuugcucacuaugauguccaaucaauccuguucaacauaaaugaagccauggcgacccgggccaacgugggcaaacgcaagaacauuacaacuggcgcaagugcugccucccagacccagaugccuacagggcagaccggaaauugugagagcccacuagguucuaaagaggaccucaacucaaaggaaaaucuggaugcugacgagggcgaugggaagaguaacgaccuugugcugagcugccccuacuuuagaaaugaaacgggaggcgagggugacaggcguaucgccuugucccgggcaaacucuucgagcuucuccucaggggaaaguuguucuuuugagagcucccucucaagccauugcacuaaugccggcgucucuguucuggaggugccgcgagaaaaccaaccuauucacagagagaaaguaaagagguacaucaucgaacauauugauuuaggagcuuauuacuaucgcaaauucuuuuacggcaaggagcaccagaauuauuucgggauagacgagaaccugggacccguggcggucuccauccggagagaaaaaguggaggaugcaaaggaaaaggaggguagucaguuuaauuacaggguugccuuccgcacaagcgaacucaccacucuucgaggcgcuauucuggaggacgccaucccaucuacagcacggcacgggaccgcccguggauugccucuaaaagaggugcuggaauaugucauacccgagcucuccauucagugucugagacaggcuucaaacaguccaaaggugagcgaacagcuucugaaauuggaugagcagggccucucguuucagcauaagaucgguauccuguacugcaaagccgggcaauccacggaagaggagauguacaauaacgaaaccgcaggccccgcguucgaggaauuuuuagaccugcuaggacagaggguacgccucaagggcuucucuaaguaucgggcucagcuggauaauaaaacagacagcacugggacccacucacuuuacacaacuuauaaggauuacgaguugauguuccauguuaguacccugcucccuuauaugccaaacaacagacagcaacugcuuaggaaacgacacauuggaaaugacaucgugacaauugucuuucaggaaccgggugcccugcccuucaccccuaaguccauacgcucucauuuucagcacguguucgucaucgugaaaguucacaacccauguacugagaaugugugcuacagcguaggcgucucccggucaaaggaugugcccccuuuugggccacccauuccgaagggaguuacguucccuaaaagcgcaguguuuagagacuucuugcucgccaaggucaucaacgcugagaaugccgcacauaaaagugaaaaguuuagggcuauggccacacguacccgccaagaguaucugaaagauuuagcggaaaacuucgugacuaccgccacaguagacaccucugugaaguuuuccuucaucacucugggcgcuaaaaagaaggagaaaguuaagccacggaaagacgcacaccuauuuagcauuggugccauaauguggcaugucaucgcuagagauuucgggcagucggccgacauugagugccuccugggcaucucaaaugaguucauuaugcuuaucgagaaggauucuaaaaacgugguguuuaauuguaguugcagggacgucauaggauggacauccggcuugguuagcaucaagguguucuacgaacgaggggagugugugcugcucucuagcguagauaacugcgcagaagacauucgggagaucguccagcgccuggugauuguuacgagaggaugugagaccguggaaaugacuuuaaggcggaauggccugggucagcuuggguuucacgucaacuucgagggaaucguggcggauguugaacccuuuggcuucgccuggaaggcugguuugcgacaaggcuccagacucguggagauaugcaaaguagccgucgcaacacugacccacgaacagaugauugaccuacugcgcacaucagugacugugaaggucguuaucauucagccucaugaugacgggagucccaggcguggauguagcgagcucugccggaucccaaugguggaguacaaacuggauucugaaggcaccccuugugaguauaagacgcccuuuagaaggaauaccacauggcaccgcguaccaacuccggcccuucaaccuuugucccgagcuucacccauaccagggacccccgacagacugccuugccaacaguuacuccagcaggcacaagccgcuaucccacggaguaccagcuucgauaggaaacugcccgacggaacucgcuccucuccuucgaaccagagcucauccagugacccgggcccaggugggucuggacccuggcguccucaggugggcuacgaugguugucaaagcccacuucuguuggaacaucagggcuccgggccccucgagugcgacggagcgagagaacgggaggauaccauggaggccucaaggcacccugaaacgaaguggcauggcccgcccucuaagguccuggggagcuauaaagagcgcgcacuacagaaggacggaaguugcaaagauuccccaaauaagcugagccacauuggcgacaaaucuuguucaucccacaguagcucgaacacacucucuuccaacaccagcucaaauagugaugacaagcauuuugguucuggggaucugauggacccugaacuuuugggacugacuuacaucaagggcgcuuccacagauagcgguauugacaccgcccccugcaugccagccacuaucuuaggcccugugcaccucgcugggucacgaagucugauacauagcagagcagagcagugggccgacgcggcugauguuuccggacccgacgaugagccagccaaacuuuauucugugcacggcuacgcaagcaccauuuccgccgggucagcugcagaaggaucuaugggcgaccugagugagaucucgagccauuccucugguucacaccacagcggguccccgagugcccauuguucuaagagcucaggaucccuagauaguagcaaagucuauaucgugucucacuccucaggccaacagguuccuggcagcaugucgaagcccuaccaucggcagggggcggugaacaaauacgucauuggauggaagaaaucugaagguaguccacccccugaggaaccagagguaacagagugccccggcauguauuccgaaauggacgugaugagcacggcuacccagcaccaaacuguugugggggaugccgucgcagagacacagcacgugcucucaaaggaagacuuccugaaguugaugcugccugauuccccguuaguagaggaaggaaggcgcaaauuuucuuucuacggcaaucucagcccaagaaggagucuguaucggacccuuuccgacgagagcaucuguucuaaccgucgcgguucaaguuucggguccagccgaucuucggugcuggaucaggccuugcccaaugacauucucuuuucaacaacuccucccuaccauagcacccugccaccuagagcucaccccgccccauccaugggaagucuaaggaacgaguucugguuuucugauggcagccuguccgacaagucaaaaugcgcagacccuggccuuaugccgcuccccgauacggcuacagggcuggacuggacccauuuggucgaugccgcgcgggccuucgaaggacuggacagugaugaggaauuaggucuccugugucaccauacuucuuaucuugaccagcgcguugccagcuuuugcacccugacagauaugcaacacggccaggacuuggagggggcucaggaacucccacuguguguggauccuggauccggcaaggaguucauggacacuaccggugagagaucacccagcccacuaacagggaaagugaaucagcuggaacuuauacucaggcaacugcagacggauuugcggaaggagaagcaggacaaagccgucuuacaagcugaagugcagcaucugcgacaggauaacaugagacuccaggaggagucucaaaccgcaacugcccagcugcgcaaguuuacagaaugguucuuuaccacuaucgacaaaaaguccuga

SEQ ID NO: 62517 - RNA, 5346 nt, Artificial Sequence
  derived and/or modified sequence opt3 from SIPA1L3__Homo_sapiens__NP_055888
augaccacauacagagccauccccagcgacggcguggaucuggcugcauccugcggggccagggucggagacguucucccugguccacacacuggcgauuaugcgccgcuuggguucugggcucagaacggaucuaugucacaaccccugggcgagaguccugccacggcaaccgccacagcuacugcaaccacacggccaagccccaccacuccugccaugccaaagaugggugugcgcgcucgaguagccgacuggcccccuaaacgugaagcguugagagagcauuccaauccaucuccgucgcaggauacagacgggaccaaggcaacgaaaauggcccacucaaugaggagcauucagaacggacagcccccuacuaguaccccagcuuccucuggcagcaaggccuuucaucgguuaucccgcagaaggucaaaagauguggaauuccaagacggcuggccccggaguccugggcgcgcauuucugccacuacgacacagaagcucuuccgagauaacacucucagaaugugaugcugaggacgccggagagcccaggggugcgcggcauacuggcgcccugccgcuuuuccgugaauacgggagcaccaguucuaucgauguccagggaaugccugagcaguccuuuuucgacauucugaaugaauuucgcagcgagcagcccgaugcaagaggcugccaagcuuugacagagcuccugagggccgacccagguccucaccugauggggggaggcggcggggcuaagggagacucgcacaacggucagcccgccaaggauucucucuuaccacugcagcccaccaaagaaaaggagaaagcacggaagaaaccugcccgaggccuugggggaggcgacacgguggauuccucaaucuuccgcaaguugagaaguagcaagccagaaggugaggcugggagguccccgggcgaagcggacgagggacggucucccccugaggcaagccgcccauggguuugucagaaaucauuugcccauuucgaugugcaaaguaugcuguuugaccuaaaugaagcugccgcaaacagagucuccgugagccagaggcguaauacuacaaccggcgccucugcugccucagcagcgagugcuauggccagccucacugcaucccgggcccacucucuggggggacuugaucccgcuuucacaucgaccgaggaccugaacugcaaggaaaauuuggagcaggaucucggugacgauaacagcaaugaccuguuacuguccuguccucauuuucgaaacgaaauuggcggggagugcgagagaaauguaucauucaguagggccucuguuggaagcccauccucaggcgaaggucaccucgcagagcccgcucuuagcgccuaucgcacgaacgcgucuaucuccgugcuggaagucccgaaagagcaacagcggacccagaguagaccuaggcaguacagcauagaacacguggacuugggggcccgcuauuaccaagauuauuucgugggcaaggagcaugcuaauuacuuuggagucgacgagaaacuaggcccaguugcagugucuaucaagcgagaaaaacuggaggaucacaaggaacaugggccccaguaccaguaucggauuaucuuccguacaagagagcucauuacucugaggggauccauccuugaggacgccaccccuacagcuacuaagcacgguaccggccgcgggcugcccuugaaagaugcccucgaauacguaauaccagagcugaacauucauuguuuacggcuggcacuaaacacaccuaaggugaccgaacagcuccugaaacuugacgagcaaggauugugcagaaagcacaaagucggcauccuguauuguaaggcgggucagucaagugaagaggagauguacaauaacgaagaggccgggcccgcuuuugaagaguuccucagccugauuggcgaaaaggugugccuuaaaggauuuacuaaguaugccgcacagcuggauguuaaaacggacucgacaggcacccacuccuuguacacuauguaucaggauuacgagaucauguuccaugugucuacccuccugccauacacaccgaauaacaggcaacaguuacugcgaaagcgccacaucgggaaugacauugucaccauaaucuuucaggagccuggagcucuacccuucacuccaaaaaacauucggagccauuuucagcacguguucaucauaguaagaguucacaaucccuguacagauaacgugugcuauucaauggccgucacgaggaguaaggacgcaccuccauuuggccccccuauuccguccgguaccacuuuccguaagucugauguguuucgcgacuuccuccuggccaaagucaucaaugcugaaaacgcggcccauaagagcgacaaauuccacacaauggcaacccggacaagacaagaguaccuuaaggauuuggcugaaaauugcguguccaacacuccaaucgacucaaccgggaaauuuaaucugauuagccucacgaguaagaagaaagagaagaccaaagccagggccggagcugaacagcauucugcaggcgccaucgcguggcgaguuguggcucaggauuaugcccaagguguagagauugacuguauacugggcaucuccaacgaguucgucguguuacuggaucuucggacaaaggaaguuguguuuaauugcuacuguggggacgucauuggauggacucccgauagcucgaccuugaaaaucuucuauggccgcggggaccacaucuuucuccaggcaacagagggaucaguggaagauauuagagagauaguacagaggcugaaggugaugacuucuggcugggagaccguugacaugacgcuacggcgaaacggucuggggcagcucggauuccaugucaaauacgauggcacaguggccgaaguggaggacuaugguuuugcuuggcaagcaggccugagacaggggagucgccuugucgaaaucugcaagguugccguggugaccuugacucacgaucagaugauugaccuguuaaggacauccguaaccgucaaggugguuaucauuccuccauucgaggacggaacuccccgucggggcuggccugaaaccuacgauaugaacacaagcgagccgaaaacggagcaggaaucuaucacccccgggggaagaccaccuuacaggagcaaugcgcccuggcaaugguccggcccagcuucacacaacagucucccugccagcaagugggcaacucccacaaccccaggucaugcccagucucugucccgcccgcuuaaacagacaccuauagugcccuuucgagagucacagccacugcacaguaagagacccgucagcuucccugaaacuccauauaccgugucccccgcuggggccgaccggguuccuccguacaggcaaccaucuggaucguuuagcacgcccggcucagcaacauaugugcgcuacaaaccuucccccgagcguuauaccgcugccccacauccuuugcucagucuggauccccacuucucucaugacgguacuagcuccggcgauucaucuagcgggggacuaaccagucaggaauccacaauggagagacagaagccagagccucuguggcacguaccggcgcaagcccggcucagcgcaaucgcuggcucuucagggaauaagcaccccuccaggcaggacgccgcuggaaaagauaguccaaaccgccauagcaagggcgaaccucaguacucgucucacuccagcucaaauacucugaguucuaacgcauccagcucacauagugacgaucgaugguuugacccccuugauccauuggagccugaacaggacccccugagcaaagguggguccucugacagcggaauugauaccacauuauauacguccucaccgucuuguaugagucucgccaaggccccaagaccugcuaaaccccacaagccacccggcucgaugggccugugcgggggaggucgggaggcggcaggcaggagccaccaugccgaccgcagaagggaagucuccccugcuccggccguggcagggcaaucuaagggauaccggcccaaacuuuacucaagcggcuccaguaccccaacuggucuggccgggggaucucgugauccuccccgccagccuagcgacaugggcucacgagugggcuauccagcucaggucuacaagacagcguccgccgagacccccagaccuagucagcuagcacaaccaagccccuuccagcucucugcuuccguuccgaaaucauucuuuagcaagcagccugugaggaauaaacacccaacuggguggaagcggacagaggaacccccuccacgcccccugccguucucggauccuaagaaacagguagacaccaacacgaagaauguguuuggacaacccagauugagggccucucugcgggauuuacgaaguccaagaaaaaacuauaaguccacuaucgaggacgaucucaaaaagcugauuaucauggacaaucuugguccugaacaggagcgcgauaccggccagagcccccagaaagggcugcaaaggacauugucagacgagucccucuguucuggacggcgugaaccaagcuucgcaagucccgccggccuggagccuggucuaccauccgauguccuguuuaccagcacuugcgcuuucccgucuucaacacuucccgccagaaggcagcaucagcacccucauccacccguggggccuggagcgaccccagcagccggcaguggcuuucccgaaaagaaguccacaauaagcgcuucugagcucucgcuggccgacgggcgcgaccggccuuugcgaagacuggauccgggauuaaugccacuccccgacacugcugcaggucuggaauggucaagccuuguuaacgccgcuaaagccuacgaggugcaaagggcagucucccuguucaguuugaaugauccugcgcucucucccgacauuccaccugcccacagccccgugcacucccaucugucacuagagcgcggcccaccgaccccucggacgacacccaccaugagugaagagccaccccuggaucuuacugggaagguuuaucagcucgaagugaugcugaaacaguugcacaccgacuuacagaaggagaaacaagauaaggucguacugcagucugaaguggcuagccucagacagaacaaucagcgucugcaagaggagucccaggccgcaucagaacagcuuaggaaguuugcugagaucuucugucgggaaaaaaaggagcuguga

SEQ ID NO: 62518 - RNA, 1515 nt, Artificial Sequence
  derived and/or modified sequence opt3 from SIRPA__Homo_sapiens__NP_542970
auggagcccgccggcccugcuccagggagacugggaccgcuccuuugccuguuguuagcagccagcugugcgugguccgguguggcuggcgaagaggaacugcaggucauccaacccgacaagucuguucuaguggccgcaggggagaccgccacacucaggugcacugcuacgucacugauuccuguaggaccaauacagugguuccggggcgcaggucccgggcgcgaacuuaucuacaaccagaaagagggacacuuuccucgagugaccacagucagugaucugacuaagcguaauaacauggacuucagcauuagaaucggcaauauuaccccagccgaugcuggcacauauuacugugugaaauuuaggaaggggucccccgacgauguugaguucaaaucuggagccgguaccgaauugucggugcgggcgaagccuucagcaccagucgugagcggcccggccgcucgcgccacuccccagcauacaguaaguuuuaccugcgagucccacggguucucuccuagagacaucacgcucaagugguuuaaaaacggaaaugaacugagcgauuuccaaacuaacguugacccagugggcgaguccgucucauauaguauacauagcaccgcaaagguggugcugacaagggaggauguccacucucagguuaucugugaaguggcucauguaacucuccagggugaccccuuacgggggaccgccaaucuguccgagacaauucgcgugccuccaacccuugaagucacgcagcaacccgugcgagcggagaaccagguuaaugugacuugccaggucagaaaauuuuacccgcagagguugcaacugacauggcuagaaaacggaaaugugucacggaccgagacugccagcacaguaaccgagaacaaggauggcacguauaauuggaugaguuggcuccugguuaacgugucugcacaccgugacgaugucaaacuuaccugucagguggaacacgacggccagccugcugucuccaagagccaugaccugaaggugucggcccaccccaaagagcaagggucuaauacagcugccgaaaacacuggauccaacgagcgcaauaucuacauuguuguggguguagucugcaccuugcucguggcacuguuaauggccgcucuguaucucguuagaaucaggcagaagaaagcgcagggcucaacaaguagcacucggcuucaugaaccagagaagaacgcacgagagauaacccaggauacaaaugacauuaccuacgccgaucugaacuugccuaaagggaagaaacccgcuccacaagccgcagaacccaauaaccacacugaguacgccuccauccagacgucuccucagccagcuagcgaagacacacuaaccuaugccgaucuggacauggugcaccucaaucgcacuccgaagcagcccgcaccuaagccagagcccucauucagugaauacgcguccguccaagugccuagaaaauga

SEQ ID NO: 62519 - RNA, 546 nt, Artificial Sequence
  derived and/or modified sequence opt3 from SIRPB1__Homo_sapiens__NP_001077379
augcccgugccugccagcuggccacaucugccgucccccuuccuccuuaugacccuguuguuaggcagacugacaggggucgcuggagaggacgaacuacagguuauccaaccugagaaaucugugucaguagcagccggugaaagugcgacucucaggugcgcuaugacgagccugauuccagugggccccauaaugugguuucgcggggccggagcaggccgggagcuuaucuacaaccagaaagaaggucacuucccucgagucaccacaguguccgagcugacuaagcguaauaacuuggauuuuucuauuucgaucucaaauauuaccccagccgacgcugggacauauuacuguguuaaauucagaaagggaagccccgaugacguggaguuuaaaaguggcgcaggcaccgaacucuccgucagggaggccgcucuggccccuacugcgccacugcucguggcauuacugcuugggccgaaguugcugcuaguaguuggagugucugccaucuauauaugcuggaagcagaaggcuuga

SEQ ID NO: 62520 - RNA, 831 nt, Artificial Sequence
  derived and/or modified sequence opt3 from SIRPG__Homo_sapiens__NP_001034597
augcccgugccugccagcuggccacacccgcccggcccuuuccugcuccuuacccuguuguuagggcugacagaggucgcuggagaagaggaacuacagaugauccaaccagagaagcuccugcuuguuacuguggguaaaacggcaacccugcauugcacaguaacuuccuugcuccccgugggcccuguccugugguuuagaggggugggaccaggcagggaacugauuuacaaccagaaggagggucacuucccccggguuaccacagugucugaccucaccaaacgcaauaacauggauuuuucaauacgaaucaguagcauuacuccugccgacgucgggacauauuacugugugaaguuccguaaaggauccccagagaauguagaauuuaagucuggcccgggcaccgagauggcguuaggggcuaagcccucggccccuguugugcugggaccagcagccagaacgacucccgaacauaccgucucauucacaugcgagagccacgguuuuaguccuagggauaucacucuuaaaugguucaagaacggcaaugaguuguccgacuuucagaccaacguggauccaacagggcagucuguggcuuauagcauucgguccaccgcacgcgucguucuggaccccugggaugugagaucacaaguaaucugugaaguggcccaugucacgcuacagggagacccgcucaggggcacugcuaaucugagugaggccauacgggguccugcgagcucucuuacagcacuguugcucaucgccgugcuguuagggcccauuuacguuccauggaaacagaagaccuga

SEQ ID NO: 62521 - RNA, 1359 nt, Artificial Sequence
  derived and/or modified sequence opt3 from SIRT1__Homo_sapiens__NP_001135970
auguucgacaucgaguacuuuagaaaggaucccaggccuuucuuuaaauucgccaaggaaauuuauccaggccaguuucaaccgagccugugccacaaauucauagcucucuccgacaaggaggggaaacuucugcggaacuacacccagaauaucgauacauuggaacagguggcagguauucagcgcaucauucaaugucauggaucuuuugccacugcgucaugcuuaaucuguaaguauaaggucgacugcgaggcuguucgaggcgauauauucaaccaggugguaccccguuguccuagaugcccagccgacgaaccccuggcaaucaugaaaccugagauuguguuuuucggggagaaucuaccagaacaguuucacagggccaugaaguacgauaaagacgaggucgaucuccugaucgugauuggaaguagccuuaagguucggcccguggcucugaucccuuccucuauaccacaugaagucccgcagauuuugaucaaccgcgagccccucccucaucugcacuucgacguggagcugcucggcgauugugacguaauuaucaaugaauuaugccacagacuggguggggaguaugcaaaacuuuguugcaacccaguuaaguugucggaaaucacggagaagcccccuaggacccaaaaagaacuggccuaccuaucagagcucccacccacaccgcugcacgugagcgaggauaguuccucuccugaacggacuagcccacccgacuccucagucauugugacccuucuggaccaggcugccaagaguaaugaugacuuggaugugagcgagucuaaaggauguauggaagagaagccucaggaaguccagacaucccgcaacguugagucaauagcggagcaaauggaaaaucccgaccucaaaaacgugggcagcaguaccggcgagaagaaugaacgaacuucuguagcagggacagugagaaaaugcuggccaaacagggucgccaaggagcagaucucccggcgucuggauggaaaucaguauuuauuucugcccccuaaccgcuacauuuuccauggugcugaaguguacagcgacucggaggaugacguucucucuuccucaaguugcggcagcaauuccgauucugggaccugucaaagcccaucacuugaggaaccgauggaggacgaaagugagaucgaggaguucuauaacggacuggaagaugaacccgacgugccugagagagccggcggugcaggguuuggaacggacggcgaugaccaggaagcuauaaacgaggccauuuccgucaagcaggaggugacugauaugaauuacccaagcaacaaaucuuga

SEQ ID NO: 62522 - RNA, 705 nt, Artificial Sequence
  derived and/or modified sequence opt3 from SIRT2__Homo_sapiens__NP_001180215
auggacuuccugagaaaccucuuuagccagacccuuucccugggcucucaaaaggagagguuguuagaugaacugacacuagaggggguggcccgguacaugcagucagaacgcugccgacgugucaucugucucguuggagcugguauuaguacuagcgcaggcauacccgacuucagauccccuucuacggggcuguaugauaaucuugagaaauaccaucugccauauccggaagccaucuuugagauuucguacuucaagaaacaccccgagccauuuuucgcguuggcuaaggaacucuauccuggacaguuuaaacccaccaucugccacuacuucaugaggcugcugaaggacaagggccucuuacugcgguguuauacacagaacauugauacucuugagcgcaucgccgguuuggaacaagaggaccugguggaggcacaugggaccuuuuacacaucacacugcguaagcgccaguuguagacaugaauacccucuauccuggaugaaagagaagauauucucugaagugaccccaaaaugcgaggauugucagagccucgucaagcccgacaucguguuuuucggagaaucccugccugcuagguuuuucucaugcaugcagagugauuuccuuaaaguugaccuguugcucgugaugggcacuagccugcagggccggggguuagcaggauga

SEQ ID NO: 62523 - RNA, 774 nt, Artificial Sequence
  derived and/or modified sequence opt3 from SIRT3__Homo_sapiens__NP_001017524
auggugggcgccgggaucagcacccccuccgguauuccugacuucagaucuccaggaucaggccuguacaguaaccuccagcaauaugaucuuccguaccccgaggcuauauuugaacugccuuucuuuuuccacaauccaaagcccuuuuucacauuggcaaaggaguuauauccugggaacuacaagccaaaugucacucauuauuuucugaggcuacuccacgacaaaggacugcuucugcgguuguacacgcagaacaucgauggccucgaacgcguuagcgguauucccgccuccaagcugguggaggcgcaugggaccuucgcuucugccacaugcacuguaugucagcgaccuuuuccaggagaagacauccgugcagaugugauggccgacagagucccgaggugccccguguguaccggcguugugaaaccugauauugucuucuuuggcgagccacugccccagcgguuccucuuacacgugguagacuuuccuauggcugaucugcuuuugauccuggggacaucgcuagagguugaaccauucgcaucacucaccgaggccgugcgcagcaguguccccagacugcuuauaaauagggaccuggugggaccguuggcuuggcauccucggucccgcgauguggcccaacucggugacgucguucacggcguggaaucucugguagaguuacugggguggacugaggaaaugcgagaucucgugcagagagagacaggaaaacuugacggccccgacaaguga

SEQ ID NO: 62524 - RNA, 945 nt, Artificial Sequence
  derived and/or modified sequence opt3 from SIRT4__Homo_sapiens__NP_036372
augaagaugagcuucgcccugaccuuuagauccgcuaaagggagguggaucgcaaaccccucucagccuugcucaaaggccaguauuggccucuucgugccagcgagcccgccccuugacccugagaaagucaaggaacugcaacgguuuauaacauuguccaaacgcuuacugguuaugacuggagcugguaucucuacggagucgggcauuccagauuaccgaucagaaaagguggggcuauaugcccguaccgacagaaggcccauccagcacggagauuucguacggagcgcaccuauucgccagagauacugggccaggaauuuugugggcuggccacaguucaguucccaucaacccaacccugcucacugggcacucucuacaugggagaagcuggguaaacuuuauuggcuggucacucagaauguggacgccuugcauaccaaggcugggagccggcgccucacagaacugcacggauguauggaucgaguucugugccucgacuguggcgagcagaccccaagaggcguguuacaggagagguuucaaguccugaacccgacuugguccgccgaagcgcaugggcuugcacccgauggagacguguucuugucagaggaacagguacggaguuuucagguuccuacaugcgugcagugugguggccaccugaaaccagaugucguguucuuuggggacaccgugaaucccgauaaggucgacuucguucacaaacgugugaaggaggccgauagccuacucguagugggaucuucccugcaagucuacucaggcuaucgcuuuauccuuacggcuugggagaagaaacugccuauagccaucuugaacauugguccaacuagaagcgacgaccucgcaugccugaaguuaaauaguagguguggggaacugcucccccuuaucgauccgugcuga

SEQ ID NO: 62525 - RNA, 879 nt, Artificial Sequence
  derived and/or modified sequence opt3 from SIRT5__Homo_sapiens__NP_001180196
augagaccccugcagaucgugccuagcaggcucauuucccaacuuuacugcggccugaagccaccggccucuacccggaaccagauauguuugaaaauggcucgccccucaaguagcauggcagacuuccgaaaguuuuucgccaaagcgaagcacaucgucauuaucuccggggcuggaguuucugccgagucgggugugccuacauuucguggcgcagggggauauuggagaaaauggcaggcccaggauuuagcuacuccacuggcauucgcccauaaucccucaaggguaugggaauuuuaccacuaucggcgcgaggugaugggcagcaaggaaccuaacgcuggucauagagccauugcggagugcgaaacgaggcuagggaagcaaggacggcgcgucgugguuaucacccagaauauagacgagcuccaccgaaaagcaggcacaaagaaccugcuugagauccauggcagucuguucaaaacuagauguaccuccugcgggguggucgccgaaaauuacaagucuccaauuugucccgcuuugagcggaaaagguugcgaggaagccggcugugggggacuccugaggccucacgugguaugguuuggcgagaaccuggauccagcaauccucgaggaaguugaccgggaguuagcucacugcgaucugugucuuguggucgguacauccucagugguguauccggccgcgauguucgcaccccaggucgccgcucgugggguuccuguggccgaauuuaauaccgagacuacaccagcuaccaaccgcuucagauuucauuuccagggacccugcggcacgacuuugccugaagcccuggcaugucacgagaaugagaccguaaguuga

SEQ ID NO: 62526 - RNA, 987 nt, Artificial Sequence
  derived and/or modified sequence opt3 from SIRT6__Homo_sapiens__NP_001180214
augagcgugaacuacgccgcuggccugucccccuaugcagacaaggggaaaugcggacucccugagaucuucgauccaccggaagaacuugaaagaaaggucugggagcuggccagguugguuuggcagucuucaagugugguauuucacaccggugcgggcauuagcacagcuuccgggauacccgacuuccggggaccucauggcguguggacuauggaggagcgcgguuuagccccaaaauuugauacgaccuucgagucugcacgacccacacaaacucacauggcccugguccagcuagaacguguggggcuccugagauuucuuguuucgcagaauguggacggacugcaugucaggucaggcuucccucgggauaaguuggcugagcuccacggcaacauguuuguggaagagugugcaaaaugcaagacccaguacguacgcgacacaguuguggggaccaugggacugaaggccacugguagacuguguacagucgcuaaagccaggggccuccgggcgugccgcaaugcagauuuaagcaucacccuggggacgagucuucaaauucgaccauccggaaacuugccccuggccacuaagagaaggggcggucggcuagugaucgugaaucuccagccuaccaaacaugaccgucacgcugaucugcgcauucacggguaugucgacgagguuaugacaagacuuaugaagcaucugggauuggaaaucccagccugggauggcccgagggugcucgagcgggcacugcccccuuuaccacgacccccuacuccaaaacuggaacccaaggaggaaucuccgacccgcauaaacggcagcaucccugcugggcccaagcaggagccaugugcccagcacaauggauccgagccugcgucacccaaaagagaaaggccaacaagucccgccccucaucggccaccgaagcgcguaaaagcaaaggcugugcccagcuga

SEQ ID NO: 62527 - RNA, 1203 nt, Artificial Sequence
  derived and/or modified sequence opt3 from SIRT7__Homo_sapiens__NP_057622
auggccgcuggcgggcugagcagauccgagaggaaggcagccgaacgggugcgccgacuccgugaggaacagcaaagagagaggcuucggcaggucucucgcauccugagaaaagcggcugccgaaaggucagcagaggagggacgguuguuagccgaaagugcugaccugguuaccgagcuacagggucgcagccgaagaagggaaggccucaagcggcgucaggaggaggugugcgaugaccccgaggaacugcgcgggaaaguaagagaacuugcauccgccgugaggaacgcuaaguaccuggucguguauacaggagccggcauuucuacugcggcaucgauaccugauuaccgggguccaaaugggguuuggacguugcuccaaaaaggacgaucagugagcgccgcugaccugagugaggccgaaccgacccugacacacauguccaucacucgccuccaugagcagaaguuaguccagcacgugguaucucagaacugugauggccugcaucuuagaagcggcuugcccaggaccgcaauuuccgagcugcacgggaauauguauaucgaaguuugcacaucaugugugccuaaccgggaguacguccgcguguucgacgugaccgaaagaacugcucuacauaggcaccaaacaggacguaccugccacaagugugguacgcagcuccgggauacuauuguccauuuuggcgagcgagggacccugggacagccacuuaauugggaagccgcgacagaggccgcaaguagagcugacacuauccugugcuugggcagcucucucaaaguucugaagaaauaucccagguuaugguguaugaccaagccuccaucccgccggcccaaacuguacauagugaaccuccaguggacaccuaaggaugacugggccgcucuuaagcugcacgguaaaugcgaugacguaaugagauugcuaauggccgagcuggggcucgaaaucccagcauauucaagguggcaagauccgauuuucagccuggccacgccccuucgcgcuggagaggaaggcagucauucucgaaagucccugugucggagccgugaggaagcgccuccaggcgacagaggggcacccuugucgucugccccuauccucggagguugguuuggcagggggugcaccaaacgcacuaagcggaaaaaggugacauga

SEQ ID NO: 62528 - RNA, 591 nt, Artificial Sequence
  derived and/or modified sequence opt3 from SIT1__Homo_sapiens__NP_055265
augaaccaggccgaccccagacugagggcugugugccucuggacccuuacaagcgcagccaugucccggggcgauaauuguacugaccuguuggcguuagggaucccuucuauuacgcaggcuuggggacuguggguccuacucggugccguuacccugcuuuuccugauaucauuggcagcccaccucagucaauggacacgcggccgaagccguucccauccagggcagggaagaucuggcgagucgguggaagagguaccgcuguacgguaaccugcacuaucuccagacugggagguuaucacaagaucccgaaccugaccagcaggauccaacccugggaggccccgcucgggcagccgaggaagugaugugcuacacaagccuucaguugcgcccuccacaaggcagaauccccgggccuggaaccccagucaaguauagugaggugguucuggacuccgagccgaaaucucaggcuagcggucccgaaccugagcuauacgccuccgugugugcgcagacuaggcgggcacgcgccucauuuccagaucaggcuuaugccaauagucaacccgcagcuagcuga

SEQ ID NO: 62529 - RNA, 528 nt, Artificial Sequence
  derived and/or modified sequence opt3 from SIVA1__Homo_sapiens__NP_006418
augcccaagagaagcugcccuuucgccgacguggcuccacugcagcucaaagucaggguuucccaacgggagcuuucucgcggcgugugugcagaacgauacucacaggagguauuugaaaagaccaaacgucuguuguucuuaggggcccaggcguaucuggaucacgugugggacgagggaugcgcugucgugcaucuaccggaaagucccaagccugguccaacaggcgcccccagagcagccagggggcagaugcucaucggaccugauggccggcugauucgcagccuuggucaggcuuccgaggcagacccaucugggguugccucgauagcuuguucaagcugcgugagagccgucgauggaaaagcgguguguggccaaugcgagagggcacuguguggccagugcguacggacuuguugggggugcggaaguguugccuguacguugugcggucucguggacugcuccgauauguacgaaaagguccuguguaccucuugcgcuauguuugagacauga

SEQ ID NO: 62530 - RNA, 855 nt, Artificial Sequence
  derived and/or modified sequence opt3 from SIX1__Homo_sapiens__NP_005973
augagcaugcugcccuccuucggcuuuacccaggagcaaguggccugcgucugugaaguucuccagcaagggggaaaccuugagagacuggguagguucuuguggucuuuaccugcuugcgaccaccuucauaagaaugaaucagugcuaaaagcaaaggccguaguggcguuucaccggggcaacuuccgcgagcucuacaaaauccuggaaagucaucaguuuagcccacacaaucauccgaagcugcagcagcugugguugaaagcucacuaugucgaggccgagaagcuccgagggcguccccugggagcagugggcaaguacagaguuaggcggaaauucccucugccacgcacaauuugggauggugaagagacuuccuauuguuuuaaggaaaaaucuagaggggugcucagggagugguacgcccacaaccccuauccuucgccacgggagaagcgcgaauuagcugaggcaacgggacugaccacaacucaggucucaaauugguucaaaaaccgaagacagagggaccgggccgcugaagccaaggagcgugaaaauaccgagaacaauaacagcaguuccaauaagcaaaaccagcuuucucccuuggagggcggcaaaccucugaugagcuccucagaagaggaauuuaguccaccgcagagccccgaucaaaauucugugcuacuccugcaggggaacaugggacaugcgcgcuccucaaauuacagccuuccuggucugacagcaagucagccaucucacggcuugcagacccaucaacaccagcuccaggacucccuguuagggccccugacuagcucgcucguagaucuuggaucuuga

SEQ ID NO: 62531 - RNA, 876 nt, Artificial Sequence
  derived and/or modified sequence opt3 from SIX2__Homo_sapiens__NP_058628
augagcaugcugcccaccuucggcuuuacacaggagcaaguggccugcgucugugaaguucuccagcaagggggaaacaucgagagacuugguagguuccugugguccuugccugcuugcgaacacuuacauaagaaugagucugugcugaaagcaaaggccguaguggcguuucaccggggcaacuuccgcgaacuauacaaaauucucgagucacaucaguuuaguccacacaaucaugcuaagcugcagcagcuuuggcugaaagcccacuauauagaggcagaaaaguugcgagggcguccgcucggagccgucggcaaguacagagugaggcggaaauucccccugccucgcagcaucugggacggugaggaaacuuccuauuguuuuaaggagaaaucuagaucgguucugagggagugguacgcucacaacccauaucccucaccucgggaaaagcgcgagcucgcagaagccacgggguuaaccacaacucaggugagcaauugguucaaaaaccgaagacagagggaucgggcugccgaggcgaaggaacgugagaauaacgagaauaguaacuccaauucucauaacccacugaauggaagcggcaaguccguccuuggcucaagugaagacgagaaaacccccagcgggacaccugaucacucuuccucaagcccagcauugcugcuaaguccgcccccuccaggacuccccucucugcauucccuuggucacccuccaggccccagcgccgugccgguaccuguucccgggggaggcggugcugacccacugcaacaccaucacggguugcaggauucgauucucaacccuaugucugccaaucugguggacuuaggauccuga

SEQ ID NO: 62532 - RNA, 999 nt, Artificial Sequence
  derived and/or modified sequence opt3 from SIX3__Homo_sapiens__NP_005404
augguguucagaagcccccuggaccucuacuccucucacuuucuucugccuaacuucgccgauucacaucacaggaguaucuuguuagcuagcuccggcgggggaaauggugcaggcgggggaggcggugccgggggaggcucuggcgggggaaacggugcgggcgggggaggcgcugguggggccggaggcggcgggggagguggcucgcgggcaccaccggaggaacugucaauguuucagcuacccacccucaauuucagcccugagcaagucgccaguguuugcgaaacacuggaggaaacuggggacauugagcgccuuggacgauuucugugguccuugccaguggcucccggcgcaugugaggccauaaacaagcaugaaucuauccuccgugcuagagccguaguggcguuccacacggguaauuuuagggaucuguaucauauucuggagaaccacaaauucaccaaggaaagccacgggaaacuccaggcaaugugguuagaggcccauuaccaggaggcugaaaagcugcggggccgcccucuuggaccagucgacaaauauagagugaggaagaaguuucccuugccucggacaaucugggauggcgagcagaaaacucacugcuucaaggaacgcacccgaucccugcuaagagagugguaccuccaagacccauauccgaaucccaguaaaaagagggaacuggcccaggcaacagggcuuaccccuacucagguuggaaacugguuuaaaaaucggcgucagcgcgauagagcugccgcggccaagaacaggcugcaacaucaggcaauugguccaaguggcaugcggagcuuggcugagcccggguguccuacacacggaucugccgaguccccaucaaccgcugccagccccacgacuucagugucuucccucaccgaacgagcagacacaggcacuagcauccugucggucaccucuuccgauucagagugcgacguguga

SEQ ID NO: 62533 - RNA, 2346 nt, Artificial Sequence
  derived and/or modified sequence opt3 from SIX4__Homo_sapiens__NP_059116
augagcuccucuucacccaccggccagaucgccagugcugcagacauuaagcaagagaacgggauggaaagcgccuccgagggacaggaagcgcacagagagguggcugguggcgccgcagucgggcugucuccuccagccccggcucccuucccucucgaaccaggagaugcagccacagcugccgcgaggguuucgggcgaggagggugcaguggccgcugccgcagcuggggccgcggccgaccagguacagcuucauucagaacuguugggacggcaccaucacgcagcugccgcugccgcacaaacucccuuagccuuuagcccugaucauguggcuugcgucugugaggcgcugcagcagggcggcaaucuagaccgccucgcacgauuccuguggagucuuccacaguccgaucuguugcgugggaacgaaucucuccugaaagccagagcucugguggccuuucaccaaggaauauaccccgagcucuauagcaucuuagagucccacucauucgaaagugcaaaucauccucugcuucagcaguugugguacaaggccagguauacggaggcugaacgggcccgcgguagaccacugggcgcaguugacaaauacaggcuacggcgcaaguuuccgcucccccgaaccauuugggauggggaggaaacaguguauugcuucaaagaaaagagcagaaacgcgcugaaggagcuuuacaaacagaauagguauccuucuccagcugaaaagcggcaccuggccaaaaucacuggauugucccucacccaagucucaaacugguuuaagaaucgucgccagagagacaggaaccccagcgagacacagaguaaaucugaauccgauggcaauccuagcaccgaggacgaaucgucuaagggucaugaggaucuguccccacaccccuuaucaaguagcuccgacgggauuacuaaccugucucucagcucacacauggagccgguguacaugcaacagaucggaaaugcaaagauaagucuuuccagcucuggcguacuguugaacggcagucuaguuccugccucaacaagccccguguuccugaaugggaacuccuuuauccagggaccaucuggugucauucucaauggccugaacguggggaacacccaggcuguggcccuuaauccucccaaaaugucgagcaacaucgucuccaauggaauuucaaugacggauauccugggcaguacuucucaagacguuaaggaguucaaaguguugcagagcuccgcaaacucagcuaccacaacuagcuacucuccauccguacccgugaguuuuccuggucucauaccaagcaccgaggucaagcgggaagggauucagacaguggccucucaggacggcggauccguugugaccuucacgacuccgguccaaaucaaucaguauggcauugugcagauccccaacucaggggcgaauagucaguuucugaacggaagcaucgguuucucgccuuuacaacugccacccguauccguugccgcuucucagggcaauauuagcgugucaaguuccacaucugaugggagcaccuucacuuccgagucaacaaccguccagcagggaaaaguguuucuaagcagucucgcaccuucugccgucguguacacgguuccaaacaccggccaaacaauagguuccgugaagcaggaagggcuggagcgaagccuuguauucucgcaguugaugcccgucaaucaaaacgcucaggugaaugccaaccugucaucugagaauaucaguggcuccggacuccauccgcuggcaagcucucuuguuaacgugagcccuacucacaacuuuucccugucaccaaguaccuugcucaaucccacagaacugaaccgcgacauugcggauagccagccuaugucugcccccgucgcuuccaaaucaacugugaccaguguaagcaauacaaacuaugccaccuuacagaauuguucccugaucacuggccaagaccuacucucugugccaaugacgcaggcagcucugggggagauaguuccuacagccgaagaucaggucggacaucccucgccagcagugcaccaggacuucgugcaagagcauagacuugucuugcagagcguugccaacaugaaggagaauuuucugucaaacuccgaaaguaaggcuaccucuagccucaugaugcuggauuccaaaucaaaguacguguuagacgguaugguggauacuguaugcgaggaccuggaaaccgauaaaaaggagcuugcgaaauugcagacaguccagcucgacgaagacaugcaagaucuguga

SEQ ID NO: 62534 - RNA, 2220 nt, Artificial Sequence
  derived and/or modified sequence opt3 from SIX5__Homo_sapiens__NP_787071
auggccacccugcccgcugagccuagcgcaggcccagccgccgggggagaagcuguggccgcagccgcugcaacagaggaagaggaagaggaggccagacagcuccuucaaacucugcaggcugccgaaggugaggcggcagccgcugccggcgcaggggcuggagccgcggccgcaggcgcugaagguccggggucccccggagucccuggcucuccacccgaggccgcuucagagccuccaacgggcuugagguucagucccgaacagguugccugcgugugugaggcauuacugcaggccgggcacgcuggacggcuaagccgcuuucucggugcgcugccuccagcagaacgacuucguggcuccgacccgguacugagagccagggcuuugguggccuuccaacggggagaguacgcagaacucuaucgccugcuggagucuagacccuuuccugccgcucaucacgccuuccuccaggauuuauaccugagggcacgguaucaugaggcggaacgcgcucgagggagagcccuuggcgcagucgacaaguacagguugcggaaaaaguuuccacugcccaaaaccaucugggauggugaggaaacaguguauugcuucaaggagcguucgcgcgccgcucuaaaagccuguuacagagggaacagguauccuacuccagacgaaaagcggcgacucgcaacccugacaggacuuucacugacccagguuagcaauugguuuaagaaccgcagacagagggaucggacuggcgcuggcgggggagcccccugcaaaagugaguccgacgguaauccgacaaccgaggaugaaucuagccgcuccccugaggacuuggaaagaggcgcggcccccgugucagcugaggcagccgcucaagggaguauuuuccucgccggaacgggcccuccagcacccuguccagcgucuucuuccauacuggucaacgguucauuuuuagccgcuagcgggagucccgccgugcugcucaauggcggaccuguaaucauuaacggccuugcacugggggaagcuagcuccuugggaccacuacugcucacugguggcgggggagccccgcccccucagccaagcccccagggcgcaucggagaccaagacaucucugguucuugauccucagacuggugaggugaggcuggaagaggcccaauccgaagcuccagagaccaaaggggcgcaggucgccgcacccggcccggcuuugggagaggaagugcucggcccucuggcccagguggucccagggcccccuacagccgcuaccuuccccuuaccaccuggacccguuccagcaguggccgcgccgcaaguagugccucugucacccccacccgguuacccuacgggccuaaguccaacuagcccccuccugaaucuuccucaggucgugccgacaucccagguugugaccuugccacaggcugucgggccccugcaacuccuggccgcaggaccuggcucuccagugaagguagccgcugcagccggucccgcgaacguucaccuuaucaauagcggggugggcgucacugcucugcaguugccuucagccacagcaccgggaaacuuucuccuggccaaucccgugaguggcuccccaauugucaccgggguggcuguucagcagggaaaaaucauauuaacggccaccuucccuacaagcaugcuggugucucaaguacuacccccagcaccuggccucgcucugccccuuaagccagagacugccaucucagucccggaagguggguugccuguggcgcccaguccagcccugcccgaggcacaugcucucggaacccugagcgcccagcagccuccacccgcugcagccacaacuuccucuaccucguuaccuuuuagcccggacuccccaggccugcuucccaacuucccugcgcccccaccugaagguuugaugcucucacccgcugcgguuccaguguggagugcaggccuggagcuaucugccgggacagagggacugcucgaagcugagaagggccuggggacccaggccccucacacuguccuucguuugccggaucccgacccagaaggacuguuacucggcgcaacggccgguggggagguggaugaaggacuggaggcugaggcgaaaguacuuacacaacugcagagcgugccuguugaggaacccuuggaacucuga

SEQ ID NO: 62535 - RNA, 741 nt, Artificial Sequence
  derived and/or modified sequence opt3 from SIX6__Homo_sapiens__NP_031400
auguuccagcugcccauccucaacuuuagcccucaacagguggccggcgucugcgagacccuugaagaguccggggacguugaaagacugggaagguucuuguggucuuuaccaguggcuccggcagccugugaggcgcugaauaagaacgaaucaguacuacgggcucgcgccauuguggcauuucacgguggcaauuaccgagagcucuaucauauacuggagaaccacaaauucacaaaggaaagucaugccaaacuucaggcucugugguuggaggcacacuaccaggaagccgagaagcuccgugggagaccccugggaccugucgauaaauauagggugcggaagaaguuuccacugccccgcacuaucugggacggcgagcagaaaacgcauugcuucaaggaaagaaccaggcaccucuuacgggagugguaccugcaggauccuuauccaaaucccagcaaaaagcgcgaacuugcucaggccacagguuugacuccuacccagguugggaacugguuuaaaaaucgaagacaaagggaccgggcggcagccgcuaagaaccgucugcagcaacaggugcuaucccaaggaucuggccgcgcccucagagcagagggcgaugggacaccagaaguccugggaguggcuaccucgccggccgcgucacuuagcaguaaggccgcaacuuccgcuauuucuaucacaagcuccgacucagagugugauauuuga

SEQ ID NO: 62536 - RNA, 768 nt, Artificial Sequence
  derived and/or modified sequence opt3 from SKA1__Homo_sapiens__NP_001034624
auggccagcuccgaccuggagcagcucugcucucacgugaacgaaaagaucggcaauauuaaaaagacccuuucacugagaaacugugggcaagagcccacauugaaaacugucuuaaauaagauaggagaugaaaucauuguuaucaacgagcugcuaaauaaacucgaacuggagauucaguaccaggagcagacgaacaauagucuuaaggaacugugcgagagcuuggaagaggacuauaaggauaucgagcaucucaaagaaaacgugccuucccaucugccacaaguaaccgugacacagucuugugucaaggguucggaccuggauccggaggaacccauaaaaguggaggaaccugagccaguuaagaaacccccuaaggagcagaggucaaucaaggaaaugccauucauuacuugcgacgaguuuaauggcgugcccagcuacaugaaaagucggcucaccuauaaccagaucaaugaugucauuaaggaaaucaacaaagcugugauauccaaguacaaaauuuuacaccaaccuaagaaaucuaugaauagcguaacacgcaaccuguaucaccgauucaucgacgaggaaaccaaggauacuaaggggcguuacuuuauuguugaggcagacaucaaagaguucacaacccuuaaggccgauaaaaaguuucauguguugcugaauauccuaagacacuguaggcggcucuccgaaguccgcggaggcggucugacgagauaugugauuacuuga

SEQ ID NO: 62537 - RNA, 228 nt, Artificial Sequence
  derived and/or modified sequence opt3 from SKA2__Homo_sapiens__NP_001094065
auggccagcgaagugggccacaaccuggaaucccccgagaccccugggggagguggcuggacaagagucgaguucccaccgcccgcuccuaagggggcagccacuguuuggugccucaauaggcuuggaucucggaaacugucauugaucuggauuacguuuaacaccggcuggaauaugaagagucgcuuaauaauccugauucagcaagugagcugucaucacuga

SEQ ID NO: 62538 - RNA, 1080 nt, Artificial Sequence
  derived and/or modified sequence opt3 from SKAP1__Homo_sapiens__NP_003717
augcaggccgcugcacugcccgaggaaaucagauggcuccuugaggacgccgaagaguuccuggcggaaggcuugaggaacgagaauuuaagcgcuguggcccgggaucaccgcgaccauauucugcgaggguuucaacagauaaaggcacguuacuauugggauuuccagccucagggaggugacaucggccaagauuccucugacgauaaccacucagggacccuaggacucagucugacaagcgacgccccauuucuuuccgauuaccaggacgagggcauggaagauauugucaaaggugcucaggagcuggacaauguuaucaagcagggguauuuggagaaaaagucuaaagaucauucguucuuuggaucagaguggcaaaagagauggugcgugguaagcaggggccucuucuacuauuacgcaaacgagaagaguaaacagccgaagggcacuuuucugauuaaaggguauggagugcggauggccccucaucugcgcagagacuccaagaaagaaucuuguuucgagcucacgagccaggacaggcgguccuacgaauuuaccgcuacaucacccgccgaggcgcgcgauugggucgaccagaucaguuucuuacugaaggaucuuagcucuuugacuauaccauacgaagaggacgaggaagaggaagagaaggaagagaccuaugaugacaucgaugguuuugacucccccucaugcggcagccaaugucgaccuacaauucugccagggagugugggaaucaaagagcccaccgaagagaaggaagaggaagauauuuacgagguucuaccugacgaggaacacgaucucgaggaagacgagucuggcacuagaaggaaagguguggacuaugcauccuacuaucaggggcugugggauugccacggagaccagccagaugagcuuagcuuccaacggggcgaccugauccguauauugucgaaggaauacaauauguauggcuggugggucggggagcucaacucucuggugggaauuguaccgaaagaauacuuaacaaccgccuuugagguugaagaacgcuga

SEQ ID NO: 62539 - RNA, 564 nt, Artificial Sequence
  derived and/or modified sequence opt3 from SKAP2__Homo_sapiens__NP_001290397
augaacaauacccugagaaaggacggcaaaaaggauugcuguuucgagaucagcgcccccgacaaaaggauuuaccaguuuacagcugcauccccuaaggaugccgaagagugggugcaacagcucaaauucguccuucaggacauggaaucugauauaaucccagaggacuaugaugaacgcggggagcuguacgacgauguugaccacccguugcccauuucaaacccuuuaacgaguagccagccaaucgaugacgagauuuaugaggaacugcccgaagaggaggaagauuccgcgccugugaagguagaggaacaacggaagaugucucaggacucggugcaucacacuucaggagacaaaagcaccgauuacgcuaauuuuuaucagggucuaugggacugcacaggcgccuucagugaugagcucuccuuuaagcgaggggacgucaucuacauacugucuaaagaauauaaccguuacggauggugggugggcgagaugaagggugcaaucgggcuuguuccaaaagccuacauuauggagauguaugauaucuga

SEQ ID NO: 62540 - RNA, 1917 nt, Artificial Sequence
  derived and/or modified sequence opt3 from SKIL__Homo_sapiens__NP_001138569
auggagaaccugcagaccaauuucagccucgugcaaggcuccacaaagaaacuuaacgggaugggagacgaugguucucccccugccaagaaaaugaucacugacauucacgcuaauggcaagacgauaaacaaagucccaaccguuaagaaggaacaucuggaugacuacggggaggcaccgguggaaacagauggagagcacguaaaaagaacuugcaccucagugcccgaaacauugcauuuaaauccuagucugaagcacacccuagcccaguuucaucucagcucccagucuucgcugggcgguccagcggcuuucucagccaggcacagccaggagaguaugucccccacugucuuucuuccucugccaucuccccaaguguugccugggccacuccugaucccgagcgacuccucaacagagcugacccagacgguucucgaaggagagaguauuagcuguuuccaggugggcggcgaaaaacgguuaugccugccccagguccuuaacucuguguugcgcgaguuuacucugcaacagaucaauaccguaugugaugagcuauauauuuacugcucccgauguacaucagaccagcuccacauccugaagguucuugggauacugccuuucaacgcaccaagcugcggauugaucacucucaccgaugcccagcgucuguguaaugcuuuacugagacccaggacauuuccucaaaacgguagugugcucccagcaaaaucuucccuugcccagcugaaggaaaccggcagcgcuuucgaggucgaacaugagugcuuggggaagugucagggacuauuugcgccccaauucuaugugcagccggacgccccuugcauucagugucuggaaugcugcggcauguuugcaccccagacguucgugaugcacucgcaucggucuccagauaaacgcacuugucacugggguuuugaguccgccaaguggcacugcuaccuccaugucaaucaaaaauaucuggggacaccugaggaaaagaaacuuaagaucauucuggaggaaaugaaagagaaguucucaaugagaaguggaaagaggaaccagagcaaaaccgacgcucccuccggcauggaauugcagucuugguacccaguuaucaagcaggagggcgaucacgugagccaaacucauucauuccuccaccccaguuauuaccuguacaugugugacaaaguaguggccccuaaugucuccuuaacaagcgcagugucucagucaaaggagcugaccaaaacggaagcuaacgccaguauaagcaauaacuccaccucuaagcggaagucggagagcgcgacaugcaaccuaguucgcgacauuaauaaaguggggaucggacucgucgccgcagcuuccucaccacugcuugugaaggauguaauuugugaagacgauaaagguaagaucauggaggaaguuaugcgaacuuauuugaaacagcaggagaagcugaaccucauccugcaaaagaaacagcagcuucagauggaggugaagaugcugaguucuagcaaauccaugaaggaauugaccgaggaacaacagaaucuccagaaagagcuggagucauuacaaaacgaacaugcccagagaauggaggaauuuuacgucgagcagaaggaccuggaaaagaaacuagagcagauuaugaagcaaaaaugcacaugugauagcaaucucgagaaggacaaagaagcugaguaugccggccagcuggcagaacuuaggcagcgguuggaucacgccgaggcugaccgucaggaacugcaagaugagcuccgccaggagagagaagcgaggcagaagcuggagaugaugauaaaagaauuaaagcugcagauccuuaagucuuccaaaacugcaaaggaguga

SEQ ID NO: 62541 - RNA, 3129 nt, Artificial Sequence
  derived and/or modified sequence opt3 from SKIV2L2__Homo_sapiens__NP_056175
auggccgacgcuuucggcgaugagcuguuuagcguguucgaaggggacuccaccacagcagccggaacuaagaaagauaaggagaaagacaaggguaaauggaagggacccccugggucugcggauaaggcuggaaaaagauuugacggcaagcuccagucagaaaguacgaacaaugguaaaaacaagagggaugucgacuucgaggggaccgaugaaccaaucuuuggaaagaagccgcggauugaggagagcauaacagaagaccuuucccuggccgauuugaugccccgcguuaaggugcaaucuguagagacuguggaaggcugcacccacgaggucgcauuaccugccgaggaagacuaccugccacuaaaaccccgagugggcaaggcugcaaaagaguauccuuucauccucgaugccuuucagcgugaagcuauucaguguguugacaauaaccagucggugcuggucucagcccauacaagcgcggggaagaccgugugcgcagaguacgccaucgcucuugcccugagagaaaaacaaaggguaauuuucacaaguccaaucaaggcauuguccaaucagaaauaucgggagauguacgaggaauuucaggacguuggacucaugacuggugaugugaccauaaaccccacggcuucuugucuggucaugacuaccgagauccugcgcagcaugcucuauagaggcuccgaagugaugagggagguggccugggucauuuucgacgaaauccacuacaugcgggauucagagcgcgggguugugugggaggaaacaauuaucuuacugccugacaauguacauuauguguuucuuagugcgacuauaccaaacgcccgacaguucgcagaguggauuugccacuugcauaagcaaccgugucacgucaucuacaccgauuacagacccacaccucugcagcacuauauuuuuccagcuggaggcgacggucuacaucucgugguugaugaaaauggggacuucagggaggauaacuucaauaccgccaugcaagugcugcgggacgcuggagaucuugccaagggcgaccagaaaggccguaaagggggaacgaaaggucccagcaacgucuuuaagaucgugaaaaugaucauggaacgcaauuuccagccuguaauuauauuuucuuucuccaagaaggacugcgaggcauacgcccugcagaugacuaaauuggauuuuaacacagacgaggaaaagaaaaugguugaggaaguguucucaaaugcuaucgauugucucagcgacgaggauaagaaacugccacaggucgagcacguguuaccccugcucaagagaggcauugggauccaucacggaggccuucugccgauauugaaggaaaccauugagauccuauuuagugaaggucugaucaaagcgcuguucgcaacugagacauuugccauggggauuaacaugccugcuaggaccguccuguucacgaacgcccggaaguuugacggcaaagauuuccgauggaucucuuccggagaauauauucaaaugagcggccgcgcagggagaaggggaauggacgaucgggguauagugauccuuaugguugacgagaagaugucgcccaccauuggcaaacagcuguugaaggggucugccgauccacucaauuccgcuuuucaccugacauacaacaugguguuaaaucugcuacgcguagaggaaaucaacccugaguauaugcucgaaaagucauucuaccaguuccagcauuauagagccauccccggagucguggagaaaguuaagaauagugaagaacaauacaacaaaauugugauaccaaaugaggaaagcgucgugaucuacuauaagauuaggcagcagcuggcaaaacuuggcaaggagaucgaagaguacauucacaaacccaaguauugcuugccuuuucugcagccaggucgucucguaaaggugaaaaacgaaggggacgauuucggcuggggaguugucgugaauuuuuccaagaaaucuaacgugaagccgaauagcggcgagcuggacccccuuuacgucguugaggugcuguugcgguguucaaaagaaagucucaagaacuccgcgacugaggcugccaagccugcaaaaccagacgaaaagggggagaugcaagugguacccguccuggugcauuuacugagcgccaucucuucaguucgacuauauauaccuaaagaucucagaccaguggacaauaggcagaguguccucaagagcauccaggaggugcagaaacgcuuccccgauggcauuccgcuuuuggacccuaucgaugacauggguauucaagaucagggccugaagaagguuauccagaaaguggaggcuuuugagcaccggauguacucccauccacuccacaacgaccccaaucuggaaaccguauauacauuaugcgagaagaaagcccagauagcaauugauaucaagucugcuaaaagagaacugaagaaggccaggacuguccuucaaauggacgaguugaaaugucgcaagcgagugcuccggcgucugggguucgcgaccucgagcgaugugauugagaugaaaggaagagucgccugcgaaaucuccucagcugacgagcuacugcucacagaaaugauguuuaacggccuguucaacgaucuuagugcagagcaggccaccgcuuugcugucuugcuuuguuuuccaggaaaauagcuccgagaugccuaaguuaacugagcaacucgccgguccccugaggcagaugcaggaaugugcaaaacgcauagcgaaggugucagccgaggcuaaacuugaaaucgacgaggaaacguaccugagcucuuuuaagccacacuugauggacguaguguacacaugggccaccggggcaacuuucgcucauauuugcaagaugaccgaugucuuugagggcuccaucauucgguguaugagaaggcucgaggaacugcuacgacagaugugccaagccgcaaaagccaucggaaacacagagcuggaaaauaaguucgcugagggcauaaccaaaauuaagcgcgacaucguguucgcggccagucucuaucuguga

SEQ ID NO: 62542 - RNA, 3741 nt, Artificial Sequence
  derived and/or modified sequence opt3 from SKIV2L__Homo_sapiens__NP_008860
augauggagaccgaaagacuggugcucccuccuccagacccgcuugaucugcccuugagggccgucgaguuaggcugcacagggcacugggaacugcuaaaccucccuggagcuccagagagcucccugccccauggucuuccuccaugugcacccgaccugcagcaagaagccgagcaguuguuccucucuucacccgcguggcugccacugcacggcguugagcauagugcucggaaguggcagcgcaaaacugauccguggagccucuuagccgugcugggggcacccguaccuuccgaccuucaggcccaacgacacccaacgaccggacagaucuugggcuacaaggaagugcugcuagagaauacaaaccucucugcuacuaccucgcugucacuucguagacccccugguccagcaagccagagucugugggggaaucccacacaguauccguuuuggccuggaggcauggaugaacccaccauuacugacuugaacacaagggaggaggccgaagaggaaauagauuucgagaaagaccuccugaccaucccaccuggcuuuaagaaagggauggauuucgcucccaaggacugcccaacgcccgccccuggauuacugucccucucuuguaugcuugaaccacuggauuuggguggcggggacgaggaugagaaugaagcggucggacaaccgggcggucccagaggggacacugugagcgcauccccuugcucagccccacuagcucgcgccaguagccuggaggaccucguucugaaggaagcaucuaccgcuguguccacacccgaggccccugaaccacccucacaggagcagugggcgauuccggucgaugccacuagcccugugggagacuuuuacagacuuaucccacagcccgcauuccaaugggcuuuugagccugauguauuccagaaacaggccauucugcauuuggaaaggcacgacaguguuuuuguggcugcccacaccucugcaggcaagacagucguggccgaguaugcuaucgcgcucgcacaaaaacauaugacccggacgauauacacuucccccaucaaggcccugagcaaccagaaauuccgcgauuuucgaaauacauucggcgacgugggguuacugaccggagauguccagcuacacccagaggcuucgugucucauuaugacuacagagauccugagaucuaugcuuuauuccgguucagacguuauuagggauuuggaaugggugaucuuugacgagguacauuacauaaacgauguggagcggggcgucgugugggaagagguucugauuaugcucccugaccacgugaguaucauucugcuuagcgccaccguccccaaugcacuggaguucgccgacuggaucgggcguuugaagcgcagacagaucuaugugauuuccacgguaaccaggccaguuccgcucgaacacuaccuguucacaggaaacucuagcaagacucaaggcgaguuauuucugcuacucgauucacggggugcuuuccauaccaaaggguacuaugccgcaguggaagcgaagaaagagcgaaugaguaagcacgcucagacauuuggcgccaaacagccuacucaucagggaggccccgcacaagaccgcggggucuaccugucccuuuuggccagccugagaaccagggcucagcucccaguggucguguucacauuuucucggggacgcugcgaugaacaggccucaggucugaccaguuuagaccugacuacgagcuccgagaagucugaaauacaccuuuucuugcagagaugucucgcaaggcugcguggcucggaucggcaacuaccccagguucugcauaugagcgagcuccugaaucgagggcuuggagugcaccacuccggcaucuugccuauucugaaagagaucguagaaauguuauuuucaagaggucucgucaaggugcuguucgcuacagagaccuuugccauggggguuaacaugccagcgaggacuguggucuucgacaguaugcgcaagcaugauggcucuaccuuucgggaccuucugcccggagaauaugugcagauggccggcagagcugggaggcgcggauuggauccuacagguaccguaauacuccugugcaaaggccgagugccggagauggcagaccuacaccggaugaugauggggaagccaagccagcugcaaucccaguuccgucucacuuacacaaugauucugaaucuuuugagaguugaugcccugagggucgaagacaugaugaaacgcucauuuagcgaguuccccucucggaaggauuccaaagcucaugagcaggccuuagcagaacucacgaagagacugggagcgcuugaggaaccugacaugaccggccaacugguggaccuaccagaguauuacaguuggggugaagaacucacugagacacagcacaugauccagaggcgaaucauggaaagcgugaacgggcugaagucuuuguccgccggccgcgucguuguggugaaaaaucaggagcaccauaacgcucugggaguaauuuuacaagucucaaguaacagcaccucgcggguguucacaacucucguucugugugauaagccccuuucccaggacccucaggauagaggcccggccaccgcagaagugcccuauccagacgaucuggucggguuuaaauuguuccucccugagggacccugcgaccacacggugguuaagcugcagccaggcgauauggcugccaucaccacaaaagugcuaaggguaaauggugagaagauucuggaagacuuuucuaagcgucaacagccuaaauucaagaaagaucccccacuugcagccgucacuaccgcugugcaggagcuccugcgcuuggcgcaggcccauccggcagggccucccacacuggacccagugaacgauuuacaacucaaggacaugagcgucguugaaggaggccugcgggcuagaaaacuugaggaacugauacagggugcccagugugugcacucacccagguuuccugcccaauacuugaagcuccgagagcggaugcagauccagaaggagauggaacgccugagauuccuacugagugaucagucccuucuccuguugccagaguaccaucaaaggguagaaguguuacggacucugggcuaugucgacgaggcugggaccgugaaacucgcaggacgaguugccugcgcgaugucuagccacgaacugcuucugacggaguugauguuugacaaugcucuauccacacugagacccgaggaaauugccgcacuccugucaggccuugugugccagagcccuggggaugccggagaccaguuaccgaacacccugaagcagggcaucgagcgcgucagggcuguggcaaaacguaucggugaaguucaaguggccugugggcucaaucagacugucgaggaguucguaggagaauugaacuuuggccugguggagguuguguacgaaugggcgcgggguaugccauucagugagcucgcuggccugucugggacacccgaaggacuugucgugagaugcauucagaggcuggccgagaugugucgcuccuugcgaggcgcagcccggcuaguaggggagccugugcugggagcuaagauggaaaccgccgcaacucucuuacggagggauauagucuuugcugccagccuguauacccaguga

SEQ ID NO: 62543 - RNA, 2607 nt, Artificial Sequence
  derived and/or modified sequence opt3 from SKOR1__Homo_sapiens__NP_001244953
augauccccaagagccuggugcaggccgcugagacccaaagaggccucugcgaaccugggggaaaagguagggagggccgguccgggggaaagggcgaaacacgcccacgaggugucgggacucaggagggaaaaggcacgauuccgggcucuccccgugaaaagagaggggagaggggagagggugacccugcacuucugccagccgaagauuuguggcgguuacccggcucaaaagaccgccugagaaguagccuacucccuccacccgggccuccauccucugauucgggaccggggcccccuucaagccacagugguaagaccgcgcaggggccaaggacacugaacugggcucggaagcaguccgcccgcacuucuagcaaucuuugugcauggucccuggccauggcuaccaaaauggcagagauacccucaaguccuuacgaaccaggacaacgaggcaugaaggacacacagagaggcgaugcaccccagagggggagcccggagccucggaucuugcagcucgcucguguuggaaacguguaucugaaagaggaaucuucccgcucagguagacuggaggccaagaaauggauucccaccaaguuccucgaaaauuuaagcguaccacauguggaccugggcgggaaccaacuuuggaguggaggcauggaggcguugacuacacagcuggguccugggagggaaggcagcuccagccccaauucgaagcaggagcuacagccauacucuggauccucagcacucaaacccaaccaagucggcgagaccagucuguauggggugccuaucguuagccuugugauugauggacaggaacggcugugcuuggcccagaucuccaauacgcuccugaagaacuacucuuauaaugagauacacaaccgacgcgucgcuuuagguaucacuugugugcaaugcaccccaguacagcuggaaauucucagaagggccggcgcaaugccgaucagcucacggcgcugugggaugauuacaaaaagagaggcugaaaggcuuugcaagaguuuucugggagagcauaaacccccuaaguugccagagaauuucgccuuugacguugugcacgaaugugcguggggcucccgugguagcuucauccccgcccgguacaacucuucacgagcaaaaugcauaaaguguggguauugcaguauguacuuuagcccuaauaaguucauuuuucauucccacagaacuccagaugcuaaauacacccagcccgacgccgcuaacuucaauucuuggaggcgccaccuaaagcugucggauaaaagcgccacagacgagcucucccaugcaugggaagaucggggccugggacuugccaccggcgcuucagggccggcgggaccugguggcccagggggaggcgccggugucagaaguuaucccgugaucccugugcccucuaagggguuuggccuguugcagaaacucccaccuccccuguucccacacccguacggauuuccuacggccuucggcuuaugucccaagaaggacgacccaguccugggggcuggagagcccaaaggcgguagcuauguuuccgccuuuaggccugugguaaaggauacugaaucaauugcaaaacuauacgggagcgcccgcgaggcuuauggagccggcccagcacgaggucccggcccuggggcgggaucuggcggguacguguccccggacuuccucagugagggaucuucuuccuauaacucagcuaguccagaugucgacacagccgaugaacccgagguggacguugaaagcaaccgguucccugaugacgaggaugcacaagaggaaaccgagccaucggcccccuccgcuggcggugggccugacgccggacguccggcauuuggcgaucuggcugccgaagaccuugugagaaggcccgagcgcucuccaccuagcgguggcgggggauacgaauugcgggagcccugcggcccacugggcggaccugcgcccgccaaggucuucgcuccagagagagacgaacaugugaaaucagcagccguagcucucggcccggccgcaaguuacguuugcacuccugaggcgcacgaacccgauaaggaggacaaucacuccccagccgaugaccuggaaacaaggaagucuuaucccgaucagcgaagcaucucccagccuucaccagcuaacaccgaccgcggugaggaugggcuuacgcuggacgugaccggaacacauuuggucgagaaagauaucgaaaaucucgcccgggaggaacugcagaaguuacugcuagagcaaauggaacucaggaaaaagcuggagagagaguuucagagccuuaaagacaacuuccaggaucagaugaagcgugaauuggcauaccgcgaggaaauggugcaacagcugcagauuguccgggacacucucuguaaugagcuggaucaggagagaaaggcuagguaugccauacaacagaaauuaaaggaagcacacgacgcccugcaucacuuuaguugcaaaaugcuuacaccccgacauuguaccggcaacugcucuuucaagccuccguugcucccauga

SEQ ID NO: 62544 - RNA, 891 nt, Artificial Sequence
  derived and/or modified sequence opt3 from SKOR2__Homo_sapiens__NP_001032891
auggccagcucuccccugccuggcccaaacgacauccuccuugcuuccccgucaagugcauuccagcccgauacccugagccaaccuagaccagggcacgccaauuugaagcccaaccaggugggacaggucauuuuauacgguauaccuaucguuucccuggugauugacggccaggagaggcuaugccucgcgcaaaucucuaauacacugcuuaaaaacuuuucguauaaugaaauucauaaccggcgcguagcucuggggaucacuugugugcagugcacgccaguccaguuggagauacuccgacgugccggagcaaugcccaucucaagcagaagguguggcaugauuaccaagcgggaagccgagcgccugugcaaaaguuuccugggugaaaauagaccuccaaagcucccggauaacuuugcuuucgacgugucccacgagugugcaugggggugcaggggaucuuuuauccccgcccgguacaauagcucccgcgcuaaauguauuaagugcucauauuguaacauguacuucaguccuaauaaguuuaucuuccauagccaccgaacaccagaugccaaauauacucagcccgacgcggcaaacuuuaauucuuggagaaggcauuuaaagcugaccgauaaauccccucaagacgagcuuguuuucgccugggaagaugugaaggcuauguuuaacggcggcucacggaaacgugccuugccacagcccggggcacacccggcuugccacccucugagcaguauacgcacaagaucuauugccuucuccagccagacccuaaugcuccuggaggaaaucuuuggagagaaggaccaggaggauuacaugaggauuaaugaagacaacaucuggcuuuga

SEQ ID NO: 62545 - RNA, 483 nt, Artificial Sequence
  derived and/or modified sequence opt3 from SKP1__Homo_sapiens__NP_008861
augcccagcaucaagcugcaguccucugacggcgagauuuucgaaguggaugucgagauagccaaacaaucaguuaccaucaagacaaugcucgaagaccuugggauggaugacgagggagaugacgauccugugccacugccgaacguaaaugcugcaauuuugaaaaaggugauccaguggugcacucaccauaaagacgaucccccuccacccgaagacgaugagaacaaggagaagagaacggacgauauuccugucugggaccaggaauuuuuaaaaguggaccaggguacccuguucgagcuaauccucgccgcgaauuaccuggauauaaagggccuucuggacguuacauguaaaacuguggcuaacaugaucaaggggaaaaccccagaagagauuaggaagacauuuaauaucaagaacgauuucaccgaggaagaggaagcccaagucggaaguacucaguuuugcuuguga

SEQ ID NO: 62546 - RNA, 633 nt, Artificial Sequence
  derived and/or modified sequence opt3 from SKP2__Homo_sapiens__NP_001230049
auggaccagccccuggccgagcacuucagcacccucgcuaagaacuccaaucuugugagacugaacuugucuggcugcucaggguuuagugaguucgcauuacaaacacugcuaagcuccuguucuaggcucgaugaacugaaucuuucguggugcuuugacuucacugaaaaacauguccagguugccguggcgcacguaucagagacgaucacccagcugaacuugagcggauaccggaagaaucuccagaaaagugaucuguccacacuggugcgccgauguccuaaccucguccauuuagaccugucugauagcgugaugcuuaagaaugacugcuuucaagaguucuuucaguugaacuaucugcagcaccuaucccucucacguuguuacgauauuauaccagaaacucugcuugagcugggugaaaucccgaccuugaaaacacuccagguuuucggcauugugcccgacgggacccugcaauuacugaaggaggcucucccucaucuucagaucaauugcagucacuuuacuacaauugccagaccaaccaucggaaacaagaaaaaucaggaaauauggggcaucaaguguaggcugacguugcagaaacccagcugccuauga

SEQ ID NO: 62547 - RNA, 786 nt, Artificial Sequence
  derived and/or modified sequence opt3 from SLA2__Homo_sapiens__NP_115590
augggcagccugcccuccagaaggaagucucucccuucaccaagucuuagcuccucugugcaggggcaaggaccggucaccauggaggccgaacggucgaaagcuacagcaguugcccuggguucauuccccgcgggcgggccugcugaguugagcuuacgccugggagaaccacuaacuaucgugagugaggacggcgauugguggacgguacucuccgaagugucuggucgagaguacaacauucccagcguccacguggccaagguuucccauggguggcuguaugagggacuuucacgugaaaaagcagaggaacuguugcuccugccuggcaauccaggcggggccuuucugauaagagagagucagaccaggcggggaagcuacucucucuccgugcgcuuaucaagacccgcuagcugggacaggauccggcacuaucgcauucauugccuggauaacgguuggcuuuacaucaguccucgauugacauucccaucucugcaggcccuagucgaccacuauuccgagcucgcagaugacauuuguugccugcuuaaggaaccgugugugcugcagagagcuggccccuugccugggaaagauaucccacuccccguaacuguucaaaggaccccucugaauuggaaggaguuagacagcucgcugcucuuuucugaagccgcgacaggagaggaaucccuucugucagagggcuugcgggagagucugagcuucuacauaucccuaaacgaugaagcagugucucucgacgaugccuga

SEQ ID NO: 62548 - RNA, 831 nt, Artificial Sequence
  derived and/or modified sequence opt3 from SLA__Homo_sapiens__NP_001039021
augggcaacagcaugaaguccacccccgccccugcugagagaccacugccgaaucccgaagggcucgacucugauuuccuugcagugcugucagacuacccuaguccagauaucagcccucccauuuuuaggcggggagagaaauugcgcgucauauccgacgaagguggcugguggaaggccaucucuuuaucgacagggcgagagucauauauuccaggaaucugcguugcgcguguguaccacggcuggcuguucgaaggucuagggagagauaaagcugaggagcuccugcagcuucccgacacuaagguaggcagcuuuaugauuagggaaagugagacgaaaaagggauucuauucccugucugugcggcaucgccaagucaagcacuacagaaucuuuagguugccuaacaauugguauuacauaagcccacggcucaccuuccagugucuggaagaucuggugaaccauuauuccgagguugccgacggccucugcuguguguuaacaacuccgugccugacccagucaacagcagcccccgcuguccgcgcaaguagcucuccugugacccuucgacagaaaacuguagauuggagaaggguuucccgguugcaagaggacccagaagggacagagaauccccugggaguggaugaaucacuauuuagcuacggucuccgugagaguaucgccucuuaccugucccuuaccagcgaagacaacacgucguucgaucgcaagaaaaagucuauuucccugauguauggcgggucaaaaagaaagaguagcuuuuucuccucuccuccauacuuugaggacuga

SEQ ID NO: 62549 - RNA, 1746 nt, Artificial Sequence
  derived and/or modified sequence opt3 from SLAIN2__Homo_sapiens__NP_065897
auggaggacgugaacagcaaugucaacgccgaucaggaaguuagaaagcugcaagagcucgugaaaaagcuggaaaaacagaaugagcagcuuaggucccggucuggcgcuguacagggggcaggaucauugggucccggcaguccugugcgcgccggggcgagcaucccauccucuggagcugccucgccgcgaggcuuccccuuaggucugucagcaaagagcgggggaggcccuggcagugggccacguagaaccuccucugaggaacuaagggacgccacaagccuccuggcugcaggagaggguggccuucuggaugaagucgagcccuugcggccugacgaacucgagcgccuguccgggugggaggaagaggaagagucauggcuguacaguagccccaaaaagaagcucacucccaugcaaaaaucuguguccccuuuaguuuggugcagacaggugcuggauuauccaucaccggacgucgaaugugccaagaaaagccuuauucacaaguuggaucagacgaugagugcucugaaaaggcagaaccuauacaauaaccccuuuaauucuauguccuauaccagcccuuacucgccaaacgccucuucccccuauucaaguggauucaauagcccuuccucuacaccagugcggcccccgauaguaaagcaacucauccugccuggcaacagcgguaaucuuaagucaagugaccgcaacccaccacuguccccucagagcucuauugauucagaguugagugcgagcgagcucgacgaagauuccaucgggucuaauuacaaacugaacgacguuacugaugugcagauuuuagcacgaaugcaggaggaaucgcugagacaagaguaugccgcuaccacaagcaggcgguccucaggaaguucuugcaauagcacccgucgcggcacuuuuuccgaccaggaacucgacgcccagucacuugaugacgaggaugacaacaugcaucacgcagucuaccccgcugugaacagauucagcccaucucccaggaacuccccucggccaaguccgaagcaaagcccccgaaacucuccucgcuccagaucaccagccaggggcaucgaguacagucgggugagcccccagccuaugauaucgcgccugcagcagccaagauugucccuacaagggcaucccacagaucugcagaccucuaaugucaaaaacgaagagaagcucaggcguagccugccgaaucuuucacggacgaguaacacucagguugacuccgugaaaucuagccgauccgauucaaauuuucagguaccuaacggagguaucccaagaaugcaaccccaggcgagcgccauuccuagucccggcaaguucaggucuccagcagcuccuagcccccuggccuugcgccagccagugaaggcuuuuuccaaucacgggucgggaucaccgggcucucaggaaaucacccaacucacacagacuaccaguuccccuggucccccaaugguccagagcacagugucugccaaucccccuagcaauauuaacuccgcaacccugacgcggccagccgggacuacagcuaugagaucaggcuuacccaggccuagugcgccgagcgcaggaggcaucccaguuccccgcucuaaacuggcccagccugugcgacggucccuaccagcucccaagaccuaugggucaaugaaagacgauaguuggaaggacggauguuacuga

SEQ ID NO: 62550 - RNA, 1008 nt, Artificial Sequence
  derived and/or modified sequence opt3 from SLAMF1__Homo_sapiens__NP_003028
auggaccccaagggccugcucagccuuaccuucgugcuguuuuuguccuuagccuucggggcuucuuacggaacagguggcagaaugaugaacugcccuaaaauccugaggcagcuagggucaaagguccuccugccacuuacuuaugagcggauuaauaaaaguaugaacaagagcauacacaucguugugacgauggcaaaaucccuggaaaauucuguagagaacaagauugugucguuggauccgucagaagccggacccccucgcuaccucggcgaccgauauaaguuuuaccuggagaaucugacccucgguauccgugaaagcagaaaagaggaugaggggugguauuuaaugacacuggaaaagaacgucagugugcaaagguucugucuucaguugcggcuguacgagcagguuuccacuccagaaauuaaagugcuaaauaagacccaggagaacggaacaugcacccucauccugggcuguacugucgagaaaggcgaccauguggcguauucuuggagcgaaaaggcugggacacacccccuuaauccugccaacuccucacaucuguugagucucacccugggaccacaacacgcagauaauauauacaucugcacgguaagcaaccccauuucuaauaacucccagacuuuuucaccuuggccagguugucgcaccgacccgagcgagacaaagcccugggccguuuacgcuggcuuacucgggggagugaucaugauucugaucauggucgugauacuucagcugagaaggcggggcaaaacuaaucauuaucagaccacaguggaaaagaaaaguuugaccauuuacgcacaaguccagaagccugguccacuacagaaaaagcuggauucuuuccccgcccaggacccuugcacgacuaucuauguugcugccacagagccagugcccgaauccguacaagagaccaacagcauuacuguguacgcgucggucacacucccggagucuuga

SEQ ID NO: 62551 - RNA, 999 nt, Artificial Sequence
  derived and/or modified sequence opt3 from SLAMF6__Homo_sapiens__NP_001171643
augcuguggcuuuuccagagccuccuguuuguguucugcuuuggccccgggaacgucguuucccaaucuucauugaccccuuuaauggugaauggaauccugggugagaguguaacacuaccacucgaguucccggccggcgaaaaggugaacuuuauuacuuggcuguucaaugaaacgagccuugcuuuuauagucccccacgagaccaaauccccugaaauccaugugacaaacccaaagcaggggaaaagacugaauuucacucagucuuacucguugcagcucucaaaccugaagauggaggacaccggaagcuauagggcacaaauuaguacaaaaaccuccgccaagcugucuagcuacacucuccggaucuuacgccagcugcgaaauauucagguuacaaaccacucccagcuuuuucaaaauaugaccugugaguugcaucugacgugcucaguggaagaugcggacgauaacgucaguuuccguugggaggcucuaggcaauacucucagcucucagcccaaccugaccguguccugggacccuagaaucucaagcgaacaggauuauacauguauagccgagaaugcaguaaguaaccuuucuuuuuccguuagcgcccagaagcugugcgaggacgugaaaauccaauacacugauaccaagaugauuuuguucauggucucggguaucuguauuguguuuggguucaucauacuccuguuacuggugcucaggaaacggcgcgacucucuuucccugucaacacagagaacccagggaccagcugaaagugcaaggaauuuggaguaugucagcguuucccccacgaacaacacuguguacgccucuguaacacacagcaaucgggaaaccgagauuuggacuccucgcgaaaacgauacaaucaccauuuauucaacgaucaaucauaguaaggaguccaaaccaaccuucagccgagcuacagcccuagacaacguggucuga

SEQ ID NO: 62552 - RNA, 498 nt, Artificial Sequence
  derived and/or modified sequence opt3 from SLAMF7__Homo_sapiens__NP_001269517
auggccggcagcccuaccugccugacacucaucuacauucuuuggcagcugacuggguccgcugcaucuggacccgugaaggaguuggucgguucaguuggcggggccgugacguucccauuaaaaaguaagguaaaacaaguggacagcauagucuggaccuuuaacacaacuccgcuggugaccauccagcccgaaggaggcacaauuaucguuacccagaauagaaacagggagcggguggauuucccugacgguggguauucccuaaagcucucuaaacugaagaagaaugauucgggaauuuacuaugucggcaucuacucaagcagucuucagcaaccauccacucaggaauaugugcugcacguauacgagaacaaucccaaaggccgcucuagcaaguauggguugcuccauuguggaaacacagaaaaagacgguaaguccccucugaccgcgcacgaugcucgacauacgaaagccauaugccuguga

SEQ ID NO: 62553 - RNA, 858 nt, Artificial Sequence
  derived and/or modified sequence opt3 from SLAMF8__Homo_sapiens__NP_064510
auggugaugagaccccuguggagccuccuucugugggaggccuuguuaccuaucaccgucacaggcgcucagguucuguccaagguagggggaucugugcuacucguggcagccaggccaccggguuuccaaguccgggaagcgauuuggcgcucacuguggcccagugaggaacuucuggcuacguuuuuccgaggcagcuuggagacucucuaccacucccguuuucuggggagagcccagcugcauucuaaccucucguuagaacugggaccucuugagucaggcgacagcgguaauuucaguguguugaugguugauaccagggggcagccauggacacagacucugcaacuaaaaguguaugacgcagucccccggccugugguacagguuuuuauagccguggagcgcgaugcucagccauccaagaccugccaggucuuccucucuuguugggcacccaacaucagcgaaauuacauacuccuggagaagggagaccacuauggacuuuggaauggaaccucacucacuguucacagauggccaagugcuuaguaucagccugggcccaggggaccgggauguggccuauucuugcauugucuccaauccgguuucaugggacuuggcuaccgugacgcccugggauagcugucaucacgaggccgcgccuggaaaagcaaguuacaaggacguacuccugguggucgugccaguuucuuuacugcucaugcuugugacucuguuuuccgccuggcauuggugccccuguagcgguaaaaagaagaaagauguccacgcugaccgcgugggcccugagaccgaaaacccauugguacaggaucuacccuga

SEQ ID NO: 62554 - RNA, 813 nt, Artificial Sequence
  derived and/or modified sequence opt3 from SLBP__Homo_sapiens__NP_006518
auggccugcagacccaggagcccuccacggcaccagucccgcugugacggcgaugcuucuccgcccagcccugcacgauggagucuggggcguaagagaagggccgacggacggcgcuggagaccagaggaugcggaagaggcugaacauaggggugccgagcggcgccccgaaucauucaccacaccugagggcccaaaaccccgauccagaugcucugacugggcaucggccguggaggaagaugagaugaggacucgggucaacaaggaaauggcucguuacaaacgcaagcuccuuaucaaugacuuugggagagagaggaaaucaagcaguggauccucugauagcaaggaguccaugucaacgguuccugcagacuucgaaaccgaugagagugugcugaugcggcgacaaaagcagauuaacuauggcaaaaauacaauagccuacgaccgcuauaucaaggaaguaccaagacacuugaggcagccggguauucaucccaaaacuccuaacaaguuuaaaaaguacagccggcgcucuugggaucagcaaaucaaguuauggaaaguggcucugcacuucugggacccacccgccgaggaagggugugaucuacaggagauucauccugucgaccucgaguccgcggaaucaagcagugagccacagaccucuucccaggacgauuuugacguguauagcggaacacccaccaagguuagacacauggauucgcaaguggaagacgaguucgaucuggaagcaugccuuacugagccgcugagggacuuuucugccauguccuga

SEQ ID NO: 62555 - RNA, 1050 nt, Artificial Sequence
  derived and/or modified sequence opt3 from SLC10A1__Homo_sapiens__NP_003040
auggaggcccacaacgcuagcgcacccuucaauuuuacccugccuccaaacuucggcaagagaccgacagaccucgcccuuuccgugauccuggucuuuauguuguucuuuauuauguuaucucuggggugcacuauggaauuuucaaaaauaaaggcgcaucuauggaaacccaagggacucgcuaucgcccugguugcacaguacgguauuaugccucuuacggccuuugugcugggcaaaguauucagguugaagaauaucgaggcucucgcaauucuggugugugggugcaguccaggaggcaaccugagcaaugucuuuucccucgccaugaagggugauaugaacuuaucuaucgugaugaccacauguucgacuuucugcgcucuggggaugaugccccuuuugcuguauauauacucacggggaaucuaugacggcgaucuaaaagacaagguuccuuacaaaggcauugugaucagccucguccuggugcuuauuccauguaccaucgggauaguacugaagaguaaacgcccccaauauaugcgauacguuauuaagggagguaugaucauuaucuugcucugcuccguggccgucacagugcugucugcgaucaaugugggcaagagcauuauguuugcaaugaccccuuuacugauagccacuuccucacucaugccauucaucggguuucuucugggauaugucuugagugcucuauucugucugaacggccguugcagaaggacaguuagcauggaaaccgguugucagaaugugcagcucugcucuacgauucugaacguagccuucccgcccgaggugaucgggccucuuuucuucuuuccacuguuguacaugauauuccagcucggagaaggccuguuacugauugcaaucuuuugguguuacgagaaauucaagacucccaaagauaagaccaaaaugaucuauacagcugccacuaccgaggaaacaauuccuggcgcgcuagggaauggaaccuacaagggugaggacugcuccccaugcacggccuga

SEQ ID NO: 62556 - RNA, 1047 nt, Artificial Sequence
  derived and/or modified sequence opt3 from SLC10A2__Homo_sapiens__NP_000443
augaacgaccccaauagcugcguggauaacgccaccgucuguuccggcgcuucuugcguugugccugagucaaauuucaacaauauccugaguguagugcucagcacaguccuuacuauucuguuggcauuagugauguuuuccaugggguguaacguugaaauaaagaaauuccugggacacaucaagagaccaugggguauuugcgugggcuuucuaugucaguucgggaucaugccgcucacgggauuuauucugucugucgccuucgacauccuuccccugcaagcggugguaguuuugauaaucggcugcuguccuggugggaccgcuucgaauauucucgccuacuggguggauggagacauggaucugucagucagcaugacaacuugcaguacccugcucgcauuaggcaugaugccacugugucuuuugaucuauacaaaaauguggguggacuccggcucuauugugauccccuacgauaacauagggaccagccuggucgcccuaguugugccuguauccauuggaauguuugugaaucauaaguggccacagaaagcuaagaucauucucaagaucgguucaaucgcaggcgccauucugauaguccuuaucgcugugguugggggcauucuguaucagagugccuggaucauagcgcccaaauuguggauuaucggaacuaucuucccuguggcagguuacagccucggguuucuguuagccaggauugcuggacugccaugguaucggugccgcacagucgccuucgagaccggcaugcagaacacgcaacucuguucuacuaucgugcagcuuuccuuuaccccggaggaacugaauguaguuuucacauuucccuugauuuacucaauauuccagcuagcauucgcugccaucuuucugggcuucuauguggcguacaagaaaugccacgggaagaacaaagccgaaauuccugagagcaaggagaauggaacugaaccagagaguucuuuuuacaaggcaaacgguggcuuccagcccgacgaaaaauga

SEQ ID NO: 62557 - RNA, 1134 nt, Artificial Sequence
  derived and/or modified sequence opt3 from SLC10A6__Homo_sapiens__NP_932069
augagagccaacugcagcuccucuucagcuugucccgcaaauaguagcgaggaggaacugccugugggccucgaaguccacgggaaccuugagcugguuuucaccgugguauccacagugaugaugggauuguuaauguuuucucuggguugcucggucgaaaucaggaagcuauggucacauauucggcgcccauggggcauagccguggggcuccugugucaguucggacuuaugccguuuacugcguaccuguuggcuaucagcuucagucucaaacccguucaagccauugcagugcugaucaugggcugcuguccuggugggacgauuuccaauaucuuuaccuucugggucgacggagauauggaccugucuauaagcaugacaacuugcuccaccguggccgcucucggcaugaugccauuauguaucuaucuguacacauggucauggagucuucagcagaacuugaccauucccuaucagaauaucggcauuacucugguaugccuaacaaucccuguugcauuugggguguacgucaacuaucgauggccaaagcaaagcaaaauaauucucaagaucggagccgugguggguggcguccugcuucugguuguggcuguagccgggguggucuuggcgaaaggaucuuggaacuccgauauuacccuccugacgaucucauucaucuuucccuuaauuggccacgugacugguuuccugcucgcacuuuuuacccaucagagcuggcagcguuguagaacaauaagucuggagacuggggcccagaauauccaaaugugcauuaccauguugcagcuaucuuucacagcugagcaccugguucagaugcucuccuuuccucuggccuacggacuuuuccagcugaucgacggcuucuugauaguggcagcuuaucaaaccuacaagaggcggcucaagaauaaacauggcaagaaaaacagcggguguacggaagucugccacacucgcaagucgacaucuuccagagagaccaaugccuuucuggaagugaacgaggagggagcgauuacuccagguccgcccggcccuauggauugccacagggccuuagaaccaguagggcauaucacaucaugugaguga

SEQ ID NO: 62558 - RNA, 1023 nt, Artificial Sequence
  derived and/or modified sequence opt3 from SLC10A7__Homo_sapiens__NP_001025169
augagacugcucgagaggaugcggaaggacugguucauggugggcaucguccuugccauugcuggggcaaaacuggaacccagcauaggaguuaacgguggcccuuugaagccagagaucaccguguccuacauugccguagcgacaaucuuuuucaauucuggguuaucacugaaaacugaggaacuaacgagugcucucgugcaccugaagcuccaucuguuuauucagaucuucaccuuggccuuuuucccggcaacaauauggcucuuucugcaacugcucagcaucacucccauuaacgaaugguuacugaaaggacuucagaccgucggcugcaugccuccacccguguccucugccguuaucuugacaaaggcugugggugggaaugaggcagccgcuauuuucaacucggccuuuggaucauuccugggcaucgucauaaccccucuacuccugcuucuguuuuugggcagcaguuccucugugccauucacuagcaucuuuucccagcuuuucaugacaguaguugugccccugauuauugggcagaucguccgccgauauaucaaggauugguuagagcguaaaaagccuccauucggagcgauuucaaguagcgugcugcucaugauaaucuacaccacguuuugugacacuuucucuaauccgaacauugaucuugacaaauuuucccugguguugauccuauucauaaucuuuucaauucaacugagcuucaugcuccugaccuuuaucuucaguacaagaaauaacucugguuuuacucccgcagauaccgucgccauuaucuucugcuccacacacaagagccuuacccugggcauuccuauguugaaaauaguuuuugcugggcaugaacaccucucgcugaucucugugccauuacugauuuaucaucccgcccagauccuacucggauccguacuggugccuacgaucaagucauggauggucaguaggcagaagggcgugaaacuuacucggccaacaguuuga

SEQ ID NO: 62559 - RNA, 1653 nt, Artificial Sequence
  derived and/or modified sequence opt3 from SLC11A1__Homo_sapiens__NP_000569
augaccggcgacaaggggccccagagacugagcggauccucuuacgguucaaucaguagcccuacauccccaacuucuccgggcccccaacaggccccuccaagggagacguaucucucggagaaaauucccauaccugauaccaagccagggacauucucacuucggaaacugugggcuuuuacuggacccggcuucuugaugagcaucgcauuuuuagacccugguaacauugaaagugaucugcaggccggggcgguggcuggauucaagcuacucuggguccugcuuugggccaccguucugggcuugcucugccagcgccuggcagcccgacugggcgugguaacagggaaagaccucggagaagugugucacuuauacuauccaaaggucccgcguaccgugcuguggcuuacuaucgaguuggcuauuguugguuccgauaugcaagaagugaucggcacagcaauagccuuuaaucugcuaucugcugggagaaucccccucuggggaggcguccugauuaccaucguggacacguucuuuuuccuuuuucuggauaacuacgguuugaggaagcucgaggccuucuuugggcuguuaauuacuaucauggcgcugaccuucggauaugaguacguaguugcacggccugaacagggcgcccuccuucgcggccuguuuuugccaagcugccccggguguggacauccugagcuacugcaggcuguggguauagucggcgccauuaucaugccacacaauauuuaucuccauuccgcacuggugaaaucaagagaaaucgacagggcucggcgcgccgauauccgagaggcgaacauguacuuccuuauugaggccacaauagcacugagugugagcuucaucauuaauuuguuugucauggcuguuuucgggcaggccuuuuaccaaaagacuaaccaggcugccuucaauaucugcgcaaacucuucccuccacgacuaugccaaaauauuucccaugaauaacgcuaccguggcgguagauauuuaccagggaggcgugauccuggguuguuuauucgggccggcagcccuguauaucugggcuauuggccuacucgccgcaggacagucaagcacaaugaccggcacguacgccgggcaauuugucauggaaggauuccugagacuuagguggagucgguuugcucguguguugcugacucgcucuugcgccauccucccuacaguucugguggcagucuucagagaccuuagggaucuguccgguuugaaugaccuccugaacguguuacagagccugcuacuccccuuugcgguacugccaauucuuaccuucacuucgaugccuacauugaugcaggaguuugcuaauggccugcucaacaagguugugaccucuuccauaaugguccuggugugugccaucaauuuauauuucgucgugucauaccugcccagucuuccacaucccgcauauuucggguuggccgcucuccuggccgcagcuuaccuaggacugagcacguaccucguuuggaccugcugucuggcccacggcgcgacauuucuugcccacuccucucaucaccauuucuuguauggucuguuagaagaggaccaaaaaggggaaacuagcggcuga

SEQ ID NO: 62560 - RNA, 1686 nt, Artificial Sequence
  derived and/or modified sequence opt3 from SLC11A2__Homo_sapiens__NP_000608
auggugcugggccccgagcagaagaugagcgacgauuccgucucuggggaccacggagaaucagccagucucgguaacaucaauccugcuuacagcaacccaucccuuucucaaucgccgggcgauucagaggaauauuucgcaaccuacuuuaaugagaaaauuagcauacccgaagaggaguauaguugcuucuccuuuagaaagcugugggccuucacagggccuggauuuuugaugucuaucgcguacuuagacccaggcaacauugaaagcgaucugcaguccggugcuguugccggguucaaacuacucuggauccugcuucuggcaacuuuggugggacuccugcugcagaggcucgccgcucgguuaggcguagugacgggccugcaucuugcagaggucugucaccgccaguaucccaaggugccucgaguuauuuuguggcugaugguggaacuagccaucauagggucagacaugcaagaggucaucggaagugcuauugccaucaaucuccugagcgugggucguauuccacuuuggggcgggguacugaucaccauagcggauacauuuguuuucuuguuucucgacaaauacggacugagaaaguuagaggcauucuuuggcuuccugauuacuaucauggcccucaccuuugguuaugaauacgugacagucaagcccucucagucccaggugcuuaaagggauguucgugccuucaugcagcggauguaggaccccacagauugagcaagcugucggcaucguuggcgccgugaucaugccgcauaacauguaccugcacagugcauugguaaagucucgccaggugaaucggaacaauaaacaggaagucagagaggcuaacaaguauuucuuuauugaauccugcauagcccuauucgugagcuuuaucauuaauguuuucguggucucgguguuugcggaggccuucuuugggaaaacuaacgagcagguaguugaaguguguacaaauaccucuucaccccaugcaggacuguucccuaaggauaacuccacgcucgcugucgacaucuacaaggguggcgugguccuggggugcuauuuuggaccagccgcucuuuacauaugggccgugggcauucuggcagccggucaaaguagcacuaugaccgggacauauuccggccaguucguuauggagggauuuuugaaucucaaauggucuagguucgcucgggugguacugacucgcagcaucgcgaucauucccaccuuacuggucgcaguguuucaggauguugaacaccuaacaggcaugaacgacuuccucaacgugcugcaaucacuucaguugccuuucgcccugaucccaauucucaccuuuacgagucugcgacccgucauguccgauuucgcuaaugggcuuggauggagaauagccgguggcauccugguguugauuaucuguagcaucaacauguacuuuguagugguuuaugucagggaccucgggcacguggcacuguacguggucgccgcuguugugucuguggccuacuuaggauucguauuuuaucugggcuggcagugccuaauugcacucgguaugucauuccuggacugugggcauacugucaguauaagcaagggccuuuugacagaggaagcgacccggggauacgugaaauga

SEQ ID NO: 62561 - RNA, 3300 nt, Artificial Sequence
  derived and/or modified sequence opt3 from SLC12A1__Homo_sapiens__NP_000329
augagccugaacaauuccucuaacguguuccucgacucaguccccaguaauaccaacagauuucagguuagcgugaucaaugagaaccacgaauccucugccgcugcagaugacaauacagauccuccacauuacgaggaaacuucguucggcgacgaggcccaaaagaggcuucggauuucauuucgcccggggaaccaggaaugcuaugauaauuuccugcagagcggagagacggcgaaaaccgacgcuaguuuucacgccuacgauucccauacaaacacuuauuacuugcagaccuucggucacaauacaauggacgcaguacccaagauagaguauuaccgaaacaccggcucuaucagcgggccuaaagugaaucguccauccuuacuggaaauucaugagcaacuagccaagaacgucgcugugacucccucaagugcagauagaguugccaauggagacggcaucccuggugaugaacaggcugagaacaaagaggacgaucaggccgggguggucaaguuuggaugggugaagggcguacucguuagguguaugcugaacauuuggggcgugaugcuuuucauccggcugagcuggauagucggggaagcgggaaucgguuugggcgugcucauuauccugcugucuacaauggugaccuccauuacggggcucucaacuagcgcaaucgccaccaauggauuuguccgcggcgguggggcuuauuacuuaauaaguagaucucugggaccagaguucggcggcuccauugggcuuaucuuugccuucgcaaacgcuguugccguggcgauguacguagugggauuugccgaaacagucguggacuugcugaaagagagcgacucgaugaugguugaucccacuaaugacauuaggaucaucgguucuauuaccguggucauacuacucggcaucuccguggcagggauggaaugggaggcuaaggcccagguaauucugcuuguuauccuguugauagcuauugccaacuucuucaucggaacagugaucccuucaaauaacgagaaaaagagucggggcuuuuucaauuaucaagcaagcauuuuugccgaaaacuucgguccacgcuuuaccaaaggggagggcuucuuuuccgucuucgcuaucuuuuucccggcggcaacgggcauucucgccggagcuaauauaucuggggaucuggaagacccccaggaugccaucccucgaggaacuauguuagcaauuuuuaucacaaccguggccuaccugggugucgcuaucugcgugggcgccuguguugugagagacgcaacugggaacaugaaugauacaauuauaagcggaaugaacugcaauggcucagcggcuuguggucucggguaugacuucaguaggugccggcacgagccaugucaguacggccuuaugaacaauuuucagguaauguccauggucagcggauucggcccccugaucaccgccgggauuuucucugcaacguugucaagugcccuagcuagccugguguccgccccuaagguuuuucaagcacucugcaaggauaacaucuauaaagcucugcaguucuuugccaagggauacgguaaaaacaaugaaccacuucguggcuauauucugaccuucuugaucgcgauggccuuuauacucaucgcugagcugaacacaauugcacccaucauuucuaauuucuuuuuagccucguacgcucugaucaacuucagcuguuuucacgccuccuacgcaaagucaccgggguggcgcccugcguauggaauauacaauaugugggugagucuauucggcgccguccucugcugugcugugauguuuguaauuaacuggugggccgcagugaucacuuauguuauugaguucuuucuguacgucuaugugaccugcaaaaagcccgacgugaauugggguucuagcacacaggcucuuuccuacgucucagccuuggauaacgcacuggaacucacuaccguugaggaccaugugaaaaauuucagaccacaaugcaucgugcugacagggggcccuaugaccaggcccgcccuucuggacauaacucacgcuuucacgaagaacagcggauuguguaucugcugugaaguauuugucggcccacggaagcucugcgugaaagagaugaauagugggauggcgaagaaacaggccuggcugauuaagaacaaaaucaaggcauucuaugcugccguugccgcugauuguuuucgagacggagugcgcuccuuacugcaggcaaguggccuagguagaaugaagcccaauacacucgucauuggguacaaaaagaacuggaggaaagccccucugaccgaaaucgagaauuacgugggaauaauucaugaugcguucgacuuugagaucggcguugugaucguacggauuagccaggguuucgauaucucucaaguccuucaggugcaggaagaguuggaacgccuggagcaggagagacucgcucuggaagccacuauuaaggacaacgagugcgaagaggaauccggcgggauaaggggauuauuuaaaaaggcaggcaagcugaacaucaccaaaacaaccccaaagaaagaugggucaauuaauacuucucaaagcaugcacgugggagaguucaaccagaaacuugucgaggccucgacacaguuuaagaagaagcaggaaaaaggcacgaucgacguuuggugguuguucgaugacggugggcucacccugcuaauuccguauauccugacucuccguaagaaauggaaggauuguaaacugcggauauacgugggaggcaagaucaaucgaauugaggaagagaaaaucguaauggcuucccuuuugucuaaguuuagaauuaaguucgcagacauccacauaauuggugauaucaacaucaggcccaauaaagaaagcuggaagguguucgaggagaugauugaaccuuaucgccugcaugagucaugcaaagacuuaacaaccgccgaaaagcucaaacgggagacaccauggaagauaacugacgcggaacuggaggcugucaaggagaaaaguuacagacaagugaggcuuaacgaacuguugcaggagcacucccgcgccgcaaaucucaucguucugucucuacccguggcccgaaagggcagcauuuccgaucugcucuauauggcuuggcuggaaauccuuaccaaaaacuugccuccaguccuguuagugcgggggaaucauaagaacguucucacguuuuacucauga

SEQ ID NO: 62562 - RNA, 3591 nt, Artificial Sequence
  derived and/or modified sequence opt3 from SLC12A2__Homo_sapiens__NP_001243390
auggagcccagaccuaccgccccaagcuccggcgcuccggggcuggcaggagugggugaaacacccucugccgcggcucucgccgcagccagggucgagcuuccuggcacugcuguuccaucagugcccgaagacgcagccccugcuagucgggaugggggaggcguacgcgacgaggguccagccgcggcaggggauggacugggccgacccuugggcccuacgccaagccagucccguuuccaaguggacuuagucucugaaaacgccgggagagcugccgcagcugccgcggccgcagcugccgcugccgcagccgcuggagcgggugcaggcgccaagcagaccccggcugauggggaggccucgggagagucagaacccgcaaaaggcagcgaggaagccaaggguagguuucgggugaauuucguugacccugcugccaguuccucugcagaggauagccuguccgacgcggcuggggugggagucgauggcccaaacgugucauuucagaauggcggggacacaguacuaagugagggaagcucucuccacuccgguggcgggggaggcucaggucaucaccagcauuacuauuacgauacucacaccaacacauauuaccugcgcaccuucgggcauaauacuauggacgccguucccagaaucgaucacuauaggcacacagcagcccaacuuggcgaaaaacuguugcggccuagccucgcugagcugcaugacgaacuggagaaggaaccauuugaggacggauucgccaacggcgaggaaaguacccccacgcgcgaugcaguggucacuuacaccgcugagucuaaagggguggugaaguuuggauggauuaaggguguccucguucgaugcauguuaaauauauggggcgugaugcuguucaucagacuuuccuggauuguagggcaggccggaaucggcuugagcgugcuggucauuaugauggcgacagugguuacuaccaucacaggucuaucgaccucugccauagcuacgaacggguuugugaggggcggaggcgcauauuaccucaucucccggucacuggggccggaguucggaggugccauuggccuuaucuuugcuuucgccaaugcagucgcgguggccauguacguaguuggguuugcugagacuguggucgaacuguugaaagagcacaguauucucaugaucgacgagauaaacgauauucguaucauuggagccaucacaguggucauccuguuaggcauuagcguggcagguauggaaugggaggcuaaggcccagauaguucugcucgugauccuucuguuggcaauuggggacuucguaaucggcaccuucauaccucuagaauccaaaaagcccaaaggauuuuucggcuauaagucugagauuuuuaaugaaaacuucgggccagauuuucgcgaggaggaaacuuucuuuagcgucuucgccaucuuuuucccugcugcgacaggaauccuggccggcgcaaauauuucaggugaccucgcugauccccagagugccaucccaaaggggacccugcuugccauucugauaacgaccuugguguacguuggaaucgcuguguccgucggcagcugugugguaagagacgcaacagguaacgugaaugauacuauuguuaccgagcucacaaacugcacuucugccgcguguaaacugaacuuugacuucucaaguugcgaaagcucccccuguucuuauggcuuaaugaauaacuuucaagucaugucgauggugagcggguucaccccucugaucuccgcuggaaucuucucagccacacuaaguucugcacucgccagccugguguccgcuccaaagauuuuucaggcacuuugcaaagauaauauauacccggccuuccagauguuugcgaagggcuaugggaaaaacaaugagcccuugaggggauacauccugaccuuccucauugcucugggcuuuauccuuauugccgagcugaacgucaucgcaccuauaaucucaaauuucuuuuuggccagcuaugcucucauuaacuucucuguuuuucaugccucccuggcaaagaguccagguuggcggcccgcuuucaaauacuacaauauguggaucagcuuacugggggccauucuauguugcaucgugauguuugugauaaacuggugggcggcccuccugacuuauguaauuguccuuggauuguacaucuaugugacguacaagaagccugacguuaauugggguucuuccacacaggcacugaccuaucucaacgcucugcaacacucaauucgauuaaguggcguggaagaccacgucaaaaauuuccgcccacagugucuggugaugacuggcgcccccaacagcagaccggcucuuuugcaucucguucacgauuuuaccaagaauguggggcugaugaucugcggacauguacacaugggcccuaggcggcaggcaaugaaagagaugucgauagaccaagccaaguaccagcgcuggcuaaucaaaaacaagaugaaggccuucuaugcuccaguccaugcggaugaccugagagaaggggcacaguaccucaugcaggccgcuggacugggcaggaugaaacccaacacacuuguguuggguuucaagaaagauuggcugcaagccgacaugcgugauguggacauguacauuaauuuauuucacgaugcauucgacauccaguauggggucguugugauucggcucaaggagggacuggauaucucccaccuucagggccaggaagaacuguugucuagccaagagaaaucaccugguaccaaggacguaguggucaguguggaauacuccaagaaaucugaucucgacacuagcaagccccuguccgagaaaccaauaacacauaaggaaucaaaaggcccuauuguuccccuaaacguggccgaccagaagcugcucgaggcuagcacgcaguuucagaagaaacaagggaagaauaccaucgaugucugguggcuguucgacgauggaggccuuacuuugcugaucccauauuuacucacaaccaaaaagaaauggaaggacuguaaaauucgaguguuuaucgggggaaagauuaacagaauagaucacgacaggcgcgcgauggccacacugcuuaguaaguuccggaucgauuuuucugacauuaugguucugggcgauaucaauacuaaaccgaagaaagaaaacauuaucgcauucgaggagauaaucgaaccuuacagacuacaugaggacgauaaggaacaggacauugcugauaaaaugaaggaggacgaacccuggaggaucaccgacaaugagcucgagcuguauaagacgaaaaccuaccgccagauucgauugaacgaacuguuaaaggagcacuccagcacagccaauaucauagugaugucgcucccagucgcacggaaaggugccguaucaucugcucuguauauggccuggcuugaagcgcugaguaaggauuugcccccuauucuccuggugcgugggaaccaccaguccguucuaacuuuuuacagcuga

SEQ ID NO: 62563 - RNA, 3093 nt, Artificial Sequence
  derived and/or modified sequence opt3 from SLC12A3__Homo_sapiens__NP_000330
auggccgagcugcccaccacagaaacuccuggcgacgcuacgcucugcagcgggagauucaccaucuccacacuucugucuucagaugagccaaguccgcccgcagccuacgacagcucccacccuucucauuugacucacucgucaaccuuuuguaugaggacauucggauauaacaccauugauguggucccaacuuacgaacauuaugcgaauagcacacagcccggugagccucggaagguucgcccaaccuuagcugaccugcacaguuuucuaaaacaagaaggccgacaucuccacgcccuggcauucgauucccgucccucucacgagaugacggacgggcuuguggagggagaagccggcacuagcuccgagaagaacccugaggaaccaguaagauuugguugggugaaaggggucaugauaaggugcaugcugaauaucuggggagugauuuuguaccuccggcugccguggaucaccgcucaggcaggcauuguucugacauggaucauaauccucuuaucagugacugucaccaguauuacaggccugagcaucucugccauuuccaccaacgggaaggugaaaucaggagguacguauuuccuuaucagccgcaguuugggccccgagcugggaggaucuauaggccuaauuuuugcuuucgccaaugcgguagguguugcaaugcauacugugggguuugccgaaacagucagagaucuccugcaggaguacggagcuccuaucguggacccaauuaacgauaucaggaucauuggcguggucuccguuaccgugcuucuggccauaucauuggcaggcauggaaugggagucgaaggcucagguacucuucuuucuggugaucauggucucuuucgccaauuauuuaguggggacucugauucccccuuccgaagacaaggcgucaaaaggauuuuucaguuaccgggccgauaucuucguucaaaaccucgugccagacuggcgcggucccgauggcacauuuuucgggauguuuagcauauucuuuccguccgcaaccgggauucuugcuggcgccaauaucucuggugaccugaaggacccugcuaucgccauucccaaagggacguugauggcaaucuucuggaccacaauuagcuaccuagccauaucagcuacuaucggcaguugugucgugcgagaugcguccggaguacugaacgacaccguuacaccaggcuggggugcaugcgagggacucgccuguagcuaugguuggaauuuuacugagugcacccagcagcacucuugucauuacggccugauuaacuauuaccagacaaugucaauggugaguggguucgcuccucuuaucaccgccggaaucuuuggcgcaacucugagcuccgccuuggcuugccucgucucugccgcaaagguguuccaaugucugugcgaagaucaguuauauccccugauuggguuuuucgggaaaggcuacggaaagaauaaggagccagucagaggcuaucuacucgcguacgcuauagccguggcauuuaucauuaucgccgaacugaacacgauugcucccaucauaucgaauuucuuccuuuguagcuacgccuugaucaacuuuuccugcuuccacgcaucaauuacaaacaguccuggguggaggccaucuuuucaguauuacaauaaaugggcugcccuguucggagcgaucauuagcguugugaucauguuucuccugaccuggugggccgcucuuauagcaauugguguaguccuguucuugcuccuguaugugaucuacaagaaaccggagguuaacuggggcuccucagugcaggccgggagcuauaauuuagcucugucuuacuccgucggacuaaacgaaguggaggaccacauuaagaauuaucggccccaaugccucguacugacuggcccuccaaacuuucgucccgcccuuguggauuucguugguaccuuuacacgcaauuugagucugaugaucugugggcauguccucauaggcccucacaaacagagaaugccagagcugcaguuaaucgcaaacggacauaccaaguggcugaauaaaaggaagauuaaggcguucuacagcgacgugaucgccgaagaucuucggcgaggcgugcaaauuuugaugcaggcugccgggcucggacgcaugaaacccaacauccuggucguuggcuuuaagaaaaauuggcagucugcacacccggcuacuguggaggacuacauagguauucuacaugaugccuucgacuuuaacuauggggugugcguaaugagaaugagggaaggacugaaugucuccaagaugaugcaggcacacaucaacccuguguucgauccagccgaggacggcaaagaagcuagcgcgcggggugcccgccccaguguuagcggcgcacucgacccuaaggcucuggugaaggaggagcaagccacaacgaucuuccagucggaacaggggaaaaagaccauugauaucuacuggcuuuuugacgauggaggcuugacucuguuaauucccuaucuccuggggagaaaaaggcguugguccaaguguaaaauacgggucuucgugggaggccagaucaaucgaauggaccaagagagaaaggccauuaucucucuucugagcaaguuuagguuggguuuccacgaaguucauauucucccagauaucaaccagaacccucgcgcugagcacacaaaacgguuugaggacaugauagcacccuucagacugaaugauggguuuaaggacgaagccaccgugaacgagaugaggcgcgauugcccauggaaaaucucagacgaagagauuacaaagaaucgaguaaaaagucuacggcagguccgucugaacgaaaucgugcucgauuacuccagagacgcggcucugauugugaucacucuuccgauaggaaggaagggcaaguguccuucuagcuuguauauggccuggcuggagaccuuaucccaggaucuccggcccccagucauucugauccgcgguaaucaagagaacguucuuacguucuacugccaguga

SEQ ID NO: 62564 - RNA, 3240 nt, Artificial Sequence
  derived and/or modified sequence opt3 from SLC12A4__Homo_sapiens__NP_001139433
augccccacuucaccguggucccuguugacggcccaagaaggggagauuacgacaaccuggaggggcucagcuggguggauuauggugaacgggccgagcuugacgauuccgacggccaugggaaucaccgcgaaucuucaccguuucugagucccuuggaggcuagccgaggaaucgauuacuaugaccguaacuuagcacuguucgaagaggagcuagauauuagaccuaagguauccucucuccugggcaaacuugugucguacacaaaucugacucagggugccaaggaacaugaggaagcggagucaggggagggaacgaggcggcgcgcugccgaagcaccaagcaugggcaccuugaugggcgucuaucuccccugccugcaaaacauauuuggggugauccuguuccucagauuaacauggaugguuggaacugccggugugcugcaggcucuuuugauuguccugaucuguugcuguugcacccuacucacagcaauuaguauguccgccaucgcuaccaauggcgugguaccugccgggggaucuuacuuuaugauaagcaggucccugggcccagaguucgguggggcgguuggacuuuguuuuuaucugggcacuacauucgcagccgcuauguacaucuugggcgccauugaaauccuccugaccuacauugcacccccugcugccaucuuuuauccaucaggggcgcacgacacgaguaacgccacuuuaaauaacaugcggguguacggaaccauauuccugacauuuaugacucucgucguguucgugggugucaaauauguuaauaaguuugcaagccuuuuccuggcuugcgugauuaucucuauuuuguccaucuacgccggcgggaucaaaucaauuuucgauccgcccguauuuccuguguguaugcuaggaaaccgcacccugagccgagaccaguucgauauaugcgcuaagacagccgucguggacaaugagaccguugcaacgcagcucuggagcuuuuucugucauucuccaaaccugacuacagacuccugcgaucccuauuuuaugcuuaauaacgugaccgaaaucccuggcauuccaggugccgcugcggggguccugcaagagaauuuguggagcgcauaccucgagaagggcgacaucguggaaaaacacggacugcccucggccgaugcuccgucuuuaaaggagucccugccucuauauguaguugccgacauagcaacuucauucacagugcucgucggcaucuuuuuccccagugugaccgggauuauggccggaagcaacagauccggugaucugagggacgcucagaaaucuaucccagucggcacgauucuugccaucauuaccacaaguuugguguacuuuucaaguguugugcuguucggggcauguauagaaggaguaguccuccgggauaaguacggcgacggugugucccguaaccugguuguggggacucuugcguggccuagccccugggucaucgugauuggcucauuuuucucuaccugcggagcuggccugcagaguuugacaggggccccacgccuccugcaggcaaucgccaaagauaauaucauucccuuuuuaagaguauucggacacgguaaggugaacggcgagccuacuugggcucugcuacucaccgcccugauagcagaacuugggaucuugauugcuagccuggacaugguugccccaauccucuccauguucuuucugaugugcuauuuauucgucaaucuggcgugugccgugcaaacacuuuugaggaccccgaacuggcggccccgauuuaaguacuaucauugggcucucucuuuccugggaaugucgcuaugccuggcacucauguuugugagcuccugguacuaugcccuggucgcuaugcuuauugccggcaugaucuacaaauauauagaguaccagggugcagagaaggaauggggcgaugggauccgcggauugucacugagugcggccagauacgcuuuacucaggcuggaggaaggcccuccacacacuaaaaauuggcggccccagcuucugguuuugcucaagcuggacgaggaccuacaugugaaauauccucgccugcucacguucgccucucagcugaaggcagggaaaggacuuacaauugugggcagcguaauccaagguuccuuuuuggaaucauacggggaggcucaggccgcagagcagaccauuaagaacaugauggaaaucgagaaggucaaaggauucugucaagugguuguggccagcaaggucagagaaggccuggcucacuuaauacagucuugcggucucggcgggaugaggcacaauuccgugguucugggauggccauauggcuggcgucagagugaggauccccgggcguggaaaacuuuuauugacaccgugcgauguacaaccgccgcacaucuugcucugcuaguaccgaagaacaucgccuucuacccuagcaaucacgagagauaucucgaagggcauauugaugucugguggaucgugcacgacggaggcaugcugauguugcugccauuuuuacucaggcagcauaaaguguggcgcaagugccggaugagaauauucacugucgcccaaauggaugacaacucuauccagaugaagaaagaucuggcuguuuuucuuuaccaccugagguuggaggcagaacacaauuccgacauuucagccuauacauacgagcgcacgcucaugauggaacagcgaagucagaugcugcggcaaaugcgucuaaccaagacugagagagagagggaagcgcagcuggugaaagaucgccauagcgcccuucggcucgagucgcuguacuccgacgaagaggaugaaucugcuguaggugcagacaagauccagaugacauggaccagagauaaauauaugacagagacuugggaccccagccacgccccugacaacuucagggaguuggugcauauuaagcccgaucagucaaauguccgacgcaugcacaccgcugugaagcugaacgaaguuaucgugacgcggagucacgacgcaagauuaguccuccugaauaugccagggccucccaggaacuccgagggagaugaaaacuacauggaguuccuugaagugcugaccgagggcuuggagcguguucuccuggugcgcgguggcgggcgggaagucauaacaauuuauucuuga

SEQ ID NO: 62565 - RNA, 3420 nt, Artificial Sequence
  derived and/or modified sequence opt3 from SLC12A5__Homo_sapiens__NP_001128243
augagcagaagguucaccgugacaucccugcccccugccggcccagcucggucuccggaccccgagucacgccgacacagugucgcagauccucgucaucucccaggggaagacguuaagggagaugguaaccccaaagagagcuccccuuuuaucaauucuacugacacggaaaagggcaaagaguacgaugggaagaacauggcccuuuucgaagaggagauggacaccucgccaauggugucaagccuguugaguggauuagcgaauuauacaaaccugccccagggcuccagagaacacgaggaagcugagaauaacgagggugggaaaaagaagccuguacaagccccaaggaugggaacuuuuaugggcguguaccuaccgugccuccagaauauuuucggcgucauacuguuucuucggcugaccugggugguugggaucgcaggaauuauggaaucuuucuguaugguguuuaucugcuguagcugcacaauguugaccgccauuuccaugucagcuaucgcaacuaacggugucgugcccgccggcgggaguuauuacaugauaagccgcucucucggaccugaguucggcggugcuguagggcuguguuuuuaucugggaacaaccuucgccggcgcgauguacauccucggcacgauugaaaucuuacuggcauaucuuuuuccagccauggcuauuuucaaagccgaggaugcauccggggaagcugccgcgauguugaauaacaugagaguuuacggaacuugcgugcugaccuguauggccacagucguguuugugggugucaaguacguuaauaaauucgcucuaguguuccucggcugcguaauccugucaauacuugcaauuuaugccggggugaucaagagcgcuuuugaucccccuaacuucccaauuugucuguugggaaauaggacucucagucggcauggcuuugacgucugcgccaaacuggcaugggaggguaacgagaccgugacaacccgcuuaugggggcuguucuguucuucccgauuucucaaugccacgugcgacgaauacuucacuagaaacaacguuacagagauccagggcauccccggagcugcgagcggccuuauuaaggaaaaucuguggucgucuuauuugaccaagggggugauagucgagagguccggaaugacuucagugggucuagcagauggcacaccgaucgacauggaucacccuuacguauuuagugacaugaccagcuauuucacgcugcucguugggauuuacuuucccuccgugaccggaaucauggccggcucuaaccggagcggugaccugcgugaugcucagaaaucaauaccaacagggacuauucuugccaucgcaaccacaagugccgucuauaucuccagcgugguccuguucggcgcuugcauugaaggagugguuuugcgcgacaaguuuggcgaggccgugaaugggaaccucguagucggaacucuggcauggccuucucccugggugaucguuauugguucauucuuuaguaccuguggcgcgggguuacaaagccugacaggagcuccaagacuacuccaggccauauccagggauggcaucgugcccuuccugcaggucuucggucaugggaaagcaaauggcgagccuaccugggcccuuuugcugacugcuugcauuugugaaaucggaauccucauugccucucuggacgagguggcaccaauacuuucgauguuuuuccugaugugcuacauguuuguaaacuuggcuugugccgugcagacgcuccugcggacaccgaauuggcgaccccgcuucagauacuaucacuggacccugagcuuuuuaggcaugucccuaugccucgcgcugauguucaucuguucaugguacuaugcccuuguugcuauguugauugcagggcugaucuacaaguauauugaauacaggggagccgagaaagaauggggcgaugguauccgggggcucagucugucugcugcccgcuaugcauuacugagacuugaggagggaccuccacacacuaagaacuggaggccccaauugcucguccuggugcguguggaccaggaucagaaugucguucauccucagcuacugagccucaccucccaacugaaagcgggcaagggucuuacaauagugggcucaguguuggaagggaccuuucuggagaaccacccacaggcccagcgggcugaagagagcauccgaagauuaauggaggccgaaaagguaaaaggauucugccaagucgugauuucuuccaaucucagggacggcguuagucaucugauccagagcgggggacuuggcggucugcagcacaacacuguguuggucggguggccccgcaauuggcggcagaaggaggaucaccaaacauggagaaacuuuauugaacucgugagggagacgaccgcaggacaucuggcucuacugguuacuaaaaaugugucuauguucccgggcaacccugaacgcuuuuccgaggguucaaucgacguaugguggauaguccacgauggcgggaugcucaugcugcuuccauucuugcugcgacaucacaagguguggcggaaauguaagaugcguauuuuuacaguggcccagauggacgacaacaguauccagaugaagaaagauuuaaccacauuccucuaccaucugagaauuacugcagaggucgaaguuguggagaugcacgaaagcgacaucucggccuacaccuaugagaagacgcuuguaauggaacagaggucccaaauacugaaacagaugcaccuaaccaagaaugagcgcgagcgggaaauccagucuauuacagaugagagcagaggaucaaucaggcgcaaaaaccccgcuaauacucgacuccggcugaacgugccugaagagaccgcgggcgacagugaagagaagcccgaggaagagguccaguugauucaugaucaauccgccccaucuugcccuagcuccucacccagcccaggggaagaaccggagggagaaggcgagacagacccugaaaaggugcaccugacuuggaccaaagauaagaguguugcagagaaaaauaagggucccucuccaguguccagcgaagggaucaaagacuucuuuucgaugaagcccgagugggagaacuuaaaucagucaaacgucagaaggaugcauacggcugugcgucucaaugaaguuauagugaagaaaucucgcgaugccaagcugguccuucugaacaugccuggaccaccccggaauagaaacggcgacgagaauuacauggaguucuuggagguacucacagaacaccuggauagggugaugcuaguucgagguggcgggcgggaggugauuaccaucuauaguuga

SEQ ID NO: 62566 - RNA, 3276 nt, Artificial Sequence
  derived and/or modified sequence opt3 from SLC12A6__Homo_sapiens__NP_001035960
augagcgagauguccggcgccaccacaucucuggcuacuguggcacucgaucccccuucagacagaacgagucacccacaggacgucaucgaagaucuuagccaaaacuccauuaccggggagcauucucagcuguuggacgauggacacaagaaagccaggaaugcguacuuaaacaauucgaacuaugaagagggugacgaauacuucgauaagaaucuggcucuauuugaggaggaaauggacacacggccgaaaguuucaagccuccugaaccgcauggccaauuauacuaaccuuacccagggcgcaaaggagcaugaagaggccgagaauauaacagaagggaaaaagaagcccaccaaaacuccucagaugggaacauucaugggcguguaccugccaugcuugcaaaacaucuuugguguaauucucuuccugcgacugaccuggguggucgggacggcuggagugcuccaggcauuugccaucguuuuaauuuguugcuguugcacuaugcugaccgcuaucaguauguccgccauagcgacaaauggcgugguccccgcaggcgggucuuauuucaugaucagccgugcccuuggaccugaguuugguggcgcugugggguuguguuucuaccugggaacuaccuuugccgcagcuauguauauucuaggcgccaucgaaauuuuccucguauacaucguuccaagagcggccauauuucacuccgaugacgcacugaaggagucagcugccaugcuuaacaauaugaggguguacgguacagcuuuccuggucuugauggugcucguggucuuuauugggguucgguaugugaacaaauucgccagucuguucuuagcaugcguaaucgugagcauucuggccaucuacgcuggagcgaucaagucuuccuuugcacccccucauuucccagucuguaugcucggcaaucgcacccuuucaagcagacacauugaugugugcaguaaaacgaaggaaauaaacaacaugacuguuccgucuaagcuguggggcuuuuucuguaauuccagccaguuuuucaacgccacaugcgacgaguauuuugugcacaauaacgucaccucgauccaggggauucccggauuggcuucugguaucauaacugagaaucuaugguccaacuaccugccuaaaggcgaaauuaucgagaagccaucagccaaaaguagcgaugugcucgggucccugaaucaugaauauguacuuguugacaucacaaccucuuucacgcuguuggugggaauuuucuuccccagcgucaccggcaucauggcagguucaaacaggaguggggaccucaaggaugcccaaaaauccauuccuauaggcacaauccuggcuauuuuaacuaccagcuuuguguaccugucuaaugucgugcuauucggagccuguaucgagggcguugugcuccgggacaaguuuggggaugcaguaaaaggaaaccuggucguggguacacuuucauggccaagucccuggguuaucgugauuggcagcuucuucuccacuugcggggcgggauugcagucucugaccggcgcuccgcgccuccugcaggccauagcaaaggacaauaucauuccuuuucuucgagucuucggucacucgaaggccaacggggaacccacaugggcucuguugcucaccgccgcaaucgcugagcugggcauuuuaaucgccagccuggaucuaguggcgccaauacucuccauguuuuuccugaugugcuaucuuuuuguaaauuuggccugugcucugcagacucuccugagaacgccuaacuggaggccccgguuccguuacuaccauugggcauuaucauuuaugggaaugaguaucugccuggcccuuauguucauuucuagcugguauuacgcuaucguggccaugguuauugcaggcaugaucuauaaauacauagaguaucaaggggcggaaaaggaguggggagacgguauucgcggcuugucccucucagccgcuagauuugcccugcuaaggcuggaagaggggccaccccacacuaaaaauuggcggccucagcuccugguccuuuugaagcuggaugaagacuuacacgugaaacauccacgacuccugaccuucgcaagccagcuuaaggcuggaaagggccugacuaucguggguucugucauuguugggaacuuuuuggagaacuacggcgaggcccucgcagccgaacaaaccaucaaacaccugauggaggcugaaaaggugaaaggauucugucagcuagugguagcggccaagcugcgcgagggcauaucccaucucauccagaguugcgggcugggaggcaugaaacacaauacagucgugauggguuggccgaacggguggagacagagcgaggaugcaagggcuuggaagaccuuuauuggaacuguucgggugacaacggccgcccaucuugcuuugcuggucgcaaagaauaucucuuucuuccccuccaacguggaacaauuuucagagggcaauauugacguuugguggaucgugcacgaugguggcauguuaaugcuccugccuuuccuucugaaacagcacaagguauggcgcaaauguaguauaagaauuuuuaccgucgcccagcuagaagacaacagcauccagaugaagaaagaccucgcgacuuuccuguaucauuugaggaucgaggcugaaguggagguggucgagaugcacgauucggacauuuccgccuacacauacgaacguacccugaugauggagcaacggucucagauguuacgacauaugagacucagcaagacagaaagggaucgcgaggcacagcugguuaaggacagaaauucaaugcuucggcugacaaguaucggguccgaugaagacgaggagaccgaaacguaucaggagaaagugcacaugaccuggacaaaggauaaauacauggccucuaggggacaaaaggcuaaaagcauggaaggcuuucaggacuugcucaacaugcgcccagaucaguccaauguacgacggaugcacacugcagugaagcugaacgaggucauugugaauaaaucacaugaagccaagcuaguucugcuuaacaugcccgggccuccacguaaucccgagggagacgagaacuauauggaauuucucgaggugcugaccgaaggcuuggagagaguccuguuagugaggggugggggaagcgagguuauaacaaucuacaguuga

SEQ ID NO: 62567 - RNA, 3252 nt, Artificial Sequence
  derived and/or modified sequence opt3 from SLC12A7__Homo_sapiens__NP_006589
augcccaccaacuucacaguggucccuguugaggcccacgcugacggcgggggagaugaaacugcagagagaacggaagccccagguaccccggagggccccgaaccugagaggccaagccccggggacggaaauccucgggagaacuccccauuucugaauaacguggaaguagagcaggaaucuuucuuugagggcaaaaauauggcacucuucgaggaagagauggauucaaaccccauggugaguagccuucugaauaaauuggcuaacuacacaaauuuaucccaaggugucguggaacaugaggaagacgaggagucucgccgacgugaagccaaggcaccuagaauggggacuuuuaucggaguuuaucugccaugccuacagaacauucucggcgugauacuguuccuuaggcugaccuggaucgucggcguggccgggguauuggagucguuucucauuguugcuauguguugcacauguaccaugcugacugcaaucucaaugagcgccauugcuacaaauggaguggucccggccgguggcaguuacuauaugaucucccggucucuggggcccgaauuuggaggcgcggugggucucugcuuuuacuuagggaccacguucgcaggagccauguauauacugggcacuaucgagauuuuucuuaccuacaucagcccuggcgcugccauuuuccaggcagaagcugccgggggagaggcggccgcaauguugcacaacaugcgcguguaugguacauguacucugguccuaauggcucucguuguguuuguaggcgugaaauacgucaauaagcuggcccuuguguuccuggcuugcguuguguuguccauccucgccauauacgcaggggucauuaaaucagccuucgauccacccgacaucccugugugucuguuaggaaacagaacccugaguaggcggagcuuugaugcuugcguaaaggcguauggcauucauaauaacucugcaacauccgcccucuggggucuuuucuguaacgggucacagccaagcgcugccugcgacgaguacuuuauccaaaauaacguuaccgaaauccagggcauucccggagcagccaguggcguguuccuggagaauuuguggucuacguaugcucacgccggggcauuugucgaaaagaaaggagugccguccgucccuguggcggaggaaagccgcgcuucggcccuacccuacguucugacugauauagcagccucuuucacacuccugguggguaucuauuuuccauccguaaccggcauuauggcugggucaaaccgaaguggagaccuuaaggaugcccagaaaagcaucccuacuggcacaauacuggcaauugucaccacguccuucaucuacuugucuuguaucgugcucuuuggugcuugcauugaggggguugugcugagagacaaguucggcgaggccuuacagggaaaucuggucaucggcaugcuagcguggcccagcccaugggugauuguaauagggucauuuuucaguaccugcggagccggucuccaaucccugacaggcgcucccaggcuuuugcaggcaaucgcccgggaugggauugugccuuuucugcagguuuucggacauggcaaagcuaacggugaaccaacuugggcccuccugcuuaccguccugaucugugagacagggaucuugauugcaagccucgacucuguggcgccgauacugucaauguucuuuuuaaugugcuaucuguucgugaaucuagccugugcuguccagacucuccugcguacccccaacuggcgcccuagauuuaaguucuaccacuggacacuuaguuucuugggcaugagccugugccucgcccugauguucaucuguuccugguacuaugcauuaucugcuaugcugauugccggaugcaucuacaaguauauugaauacaggggcgcagagaaagaguggggcgacggaauccggggccuuucguugaaugccgcucgauaugcgcuccugcgcguugaacacgguccaccccauaccaagaacuggagaccucaagugcuagugaugcugaaucucgaugccgagcaggcaguaaaacacccaaggcugcuuagcuuuacuucccaguugaaggcugggaaaggacugacgauagucggcucaguguuagaagguacauaccucgacaagcauauggaggcccaacgggccgaagagaacauccgcagucugaugucuaccgagaaaacuaagggcuucugucagcuuguugugagcuccucacugagagaugggaugagccacuugauucagucugcuggacucggcgggcugaagcacaauaccguccuaauggcauggcccgccuccuggaaacaggaagacaacccguuuaguuggaagaauuucguggauacaguuagggacaccacugcggcucaucaagcccugcucguggcgaaaaacguagauagcuuuccucagaaccaggagcguuucggaggcggucacaucgacgucugguggauugugcaugaugggggaaugcugaugcuuuugccauuucuguuacggcagcacaagguguggcgaaaaugcagaaugaggaucuucacagucgcccaaguugacgauaauucuauacagaugaagaaggaccuccagauguuccuguaucaucuucgcauuuccgcugaaguggagguaguggaaauggucgagaacgacaucucagcauuuacguacgagcggacccugaugauggaacagagaagucaaaugcuaaaacagaugcagcucagcaagaaugagcaggaaagggaggcccaacugauucacgaucgcaacacugcgucgcacacagcugccgcagcccgaacccaggcucccccuacacccgacaaagugcagaugacuuggacccgggaaaaguugaucgccgagaaauaccguuccagagauacgucucugagcggcuucaaggacuuauuuucaaugaagccagaucaaaguaauguuaggcgcaugcauaccgcagugaaacucaacggugucgugcugaauaagucccaggacgcucagcuuguucuguugaacaugccugggcccccaaagaaucggcagggggaugagaacuauauggaguuccucgaagugcugacagaaggacuaaauagaguccugcuuguaaggggcgggggacgagaggugauaacuaucuacucuuga

SEQ ID NO: 62568 - RNA, 2145 nt, Artificial Sequence
  derived and/or modified sequence opt3 from SLC12A8__Homo_sapiens__NP_001182412
augacccagaugagccaagugcaggagcuguuccacgaagccgcucagcaggacgcacucgcccaaccccagccuugguggaagacacagcuuuuuaugugggagccaguccuguucggcacuugggaugggguuuuuacguccugcaugaucaacauuuucggagugguauuguuuuuaagaaccgguuggcuggugggcaauacagggguccuacucggaauguuccuggugucuuuuguuauacuuguggcgcuggucacuguguugucaggcaucgguguaggggaaaggaguagcauuggauccggcggcguuuacucuaugaucucgucagugcucgggggacagaccgguggcacaauugggcugcuguaugucuucggacaauguguggcuggcgccauguacaucaccgguuuugcagagagcauaagugaccucuuagggcugggaaacaucugggccgugcggggcauuuccgucgcuguucuuuuggcacugcuaggcaucaaucucgccggggugaaauggauuauccgccugcagcuucuguugcuguuccuguuagcuguaucuacucuggauuuuguggucgggagcuucacacaucucgacccggaacacgguuuuauaggcuauucccccgagcuucugcagaacaauaccuugccugauuacucaccaggggagaguuucuucacgguguuuggaguuuucuuucccgccgcgacuggcgugauggcagguuucaacaugggaggcgaccuacgagaaccugccgcuagcauuccacugggaucucucgccgcagucggcaucuccugguuucuguauauuguguucguauuucuucugggggcuaucugcacccgugaggccuugagauacgauuuccucaucgcggaaaagguuucacugaugggauuuuuauuccugcuaggucucuauauuagcagucuggccucuuguaugggcgggcuuuacggagcacccaggauauugcagugcaucgcucaagagaaagugauuccugcccuggcuugucucggccaggguaaggggccaaauaaaacaccggucgccgcaaucugccugacuucccuugugaccauggccuuugucuucgugggccagguuaacgugcuggcucccauaguaacaauuaauuuuauguugaccuacgucgcgguggacuauagcuacuucucgcucucuauguguuccugcucacugacgccuguuccagagcccguguuacgggaaggagcagagggccugcauuguagugaacaccuacuccuggagaaggccccuagcuauggguccgaaggaccagcucaacgcguccuugaggguacuuugcuggaguucacaaaggauauggaccagcuccugcaguuaaccagaaaacuggaaucuagccagcccaggcaaggcgaggggaaccggacuccggaaucacagaagcgcaaaaguaagaaagccacaaagcagacccuucaggauuccuuuuugcucgaccucaagagcccucccucuuucccaguggagaucucagaucgacuaccugcagccaguugggaaggacaagagagcugcuggaauaaacagacguccaagucugagggcacccagcccgaagguacauacggggagcagcugguaccagaacucuguaaccaaucggagagcuccggcgaagacuuuuuccugaaaucaagacuucaggagcaggacguguggaggcggaguacuucuuuuuauacccauaugugcaaucccuggguuagcuugcugggagcugucggcuccuuacucaucauguucgugauucaguggguguacacacuggucaacauggggguugccgcaaucguguauuuuuacauuggacgugcgucaccuggccuucaccuggguagcgcuucuaauuucuccuuuuuccgcuggaugagaaguuugcuccugccaagcugcaggucucuacgguccccgcaagagcagauaauccuggcccccucacucgcaaagguggauauggaaaugacucagcugacccaagagaacgccgacuuugcuacacgagaucgcuaccaccauaguagccuuguaaacagagaacaguugaugccucacuauuga

SEQ ID NO: 62569 - RNA, 1896 nt, Artificial Sequence
  derived and/or modified sequence opt3 from SLC12A9__Homo_sapiens__NP_001254741
auggccagcgaguccucuccccugcucgcuuacagacuucugggcgaagaggggguggcauugccugccaacggagcggguggcccagggggagcuucagccaggaaguuaaguaccuuccugggcgucguugugccgacaguacuaagcauguuuuccaucguggucuuccuccggauugguuuugugguugggcacgcaggacugcuucaggcccuggcuauguugcucguggcauauuucauacuggcccugacuguccucucugugugcgcuaucgccacgaauggcgcgguacaaggcgggggagcauacuuuaugauuucgcgcaccuuaggucccgaaguuggcgggucaaucggacugauguucuaucuugccaacguguguggcugcgcugucagcuugcugggucuaguggagagugugcucgacgucuuuggggccgaugcaacaggaccuuccggccugcgaguucuuccacagggcuacggguggaaucuguuguauggaucucuccuguuaggucuggugggcgggguauguacucucggagcuggccuuuacgcccgugcgagcuuccugaccuuuuugcuaguguccgguucacuggccaguguccucauuagcuucguggcaguugggcccagagacaucaggcugacaccucggccaggccccaacggaucuucccuuccuccacgcuuuggccauuucaccggguuuaauucaagcacucugaaagauaacuugggagcugguuaugccgaagacuacacaaccggcgcugugaugaauuucgccagugucuucgcagugcucuuuaacgggugcacgggaauaauggccggcgcuaauaugucuggugagcugaaggauccguccagagcgauccccuuagggacuauuguagcaguugccuacaccuucuuuguguauguccugcuauucuuucucagcucguucacaugugacaggacucugcuucaggaggauuacggcuuuuuccgggcuaucucuuuguggccuccacuggugcucauuggaaucuaugccaccgcacuguccgccucaaugaguagccuuauaggcgcuucccgcauucugcacgccuuggcacgagacgaucucuuuggggucauccuggcgcccgcuaaagugguuucuagaggagguaacccuugggccgcaguguuauacagcuggggccugguacagcuaguccuccuggccgggaaacuuaauacauuggcugccgugguuaccguguucuaucuggucgcauacgcugccguggaccucucaugccugaguuuagaaugggcguccgccccaaacuuuaggcccacguucagccuguuuucuuggcauacuugucuuuugggaguagcuucaugccuccugaugauguuccuaauuaguccgggcgcagccggugggagccugcuccugaugggccuuuuggcugcccuguuaacagcacggggaggcccuuccucuuggggguaugugucgcaagcgcuccuguuccaccagguucguaaauaccuucugcgcuuggaugucagaaaggaccaugugaaguuuuggaggccccagcuccugcuacuggugggaaauccacggggcgcccucccucugcuucgauuggcuaaccagcugaaaaaggguggguuauacguccucggacacguuacccugggcgaucuugacagccugcccuccgacccagugcaaccccaguauggugccuggcuaucacucguggaucgcgcacagguaaaggcuuucgucgaccugacuuugaguccuucugugagacagggcgcccaacaccuguuaaggaucagcgggcucgaguccggaacacugcuuccauggggcuuucggucauga

SEQ ID NO: 62570 - RNA, 1788 nt, Artificial Sequence
  derived and/or modified sequence opt3 from SLC13A1__Homo_sapiens__NP_071889
augaaguucuuuagcuacauccugguguauagaagguuccucuuugucguuuucaccgugcuuguacuguugcccuuaccuauugugcugcacacaaaagaggccgaaugcgcuuacacucuauuugucguggcaacguucuggcucaccgaggcccugccacuuuccguuacagcgcuguugccgucucucaugcugcccauguuuggcauaaugccuucaaagaaaguggcuagugccuauuucaaggacuuucaucugcucuuaaucggggucauuugucuggcaacuagcaucgaaaaauggaaccuucacaagcggauugccuugaagauggugaugaugguaggaguuaauccagcuuggcugacccuagguuucauguccucuacagcauuucucucgauguggcugucaaacaccagcacugccgcuauggugaugcccaucgccgaggcggucgugcagcaaauaaucaaugcagaagccgagguggaggcuacacagaugaccuacuucaacggcaguacgaaucaugggcuugaaauugaugaguccgucaacggacacgaaaucaaugagcgcaaagagaagacuaaaccuguuccaggcuauaacaaugacaccgguaagauuucuagcaaaguggaacuggagaagaacuccgggaugcgaacaaaguaccguacuaaaaagggacauguaaccagaaaauugacaugccucuguaucgccuauucaaguaccauaggcggccugacgacuauuacagggaccagcacuaauuuaaucuuugcagaauacuucaacacaagguaccccgauugccggugucugaauuucggaucuugguuuaccuucuccuuuccugcugcccucauuauccuucuguugucauggaucuggcuacaguggcuguuccucgguuuuaacuucaaggagauguuuaaaugcggcaagacgaaaaccgugcagcaaaaggcgugugccgaagucauuaagcaggaguaucagaaacuggggccaauacgcuaccaggagaucgugacacuuguucuguucauuaucauggcauugcucugguuuagcagagacccgggauucgugcccggcuggagugcucuguuuucugaauauccugguuucgccacugauuccaccgucgcuuuacugauagggcuacucuuuuuccugauuccagccaagacacuuacuaaaaccacacccaccggagagaucguggcauucgacuacagcccuuugaucacuuggaaggaauuucaaucguucaugccaugggauauugccauccugguaggcggcggguuugcucucgcggacggaugcgaggaaucuggucuguccaaauggauuggcaauaaacuuucaccccuggggaguuugccggcauggcucauaauccugauuagcuccuuaaugguuacgucucugacagagguggccagcaacccugcuaccaucacucuauuccuccccauccugucaccacuugccgaggcaauucacgucaacccuuuguauauacugauccccaguacccucuguacauccuuugccuuccuguuaccaguggcuaaucccccuaacgccauugucuuuagcuacggacaccugaaggugaucgauaugguuaaggcaggccuuggugugaauauuguaggggucgcggugguuauguugggcaucugcaccuggauagugccaauguucgaccucuauacuuacccgucuugggcucccgccaugucaaacgaaacaaugccuuga

SEQ ID NO: 62571 - RNA, 1926 nt, Artificial Sequence
  derived and/or modified sequence opt3 from SLC13A2__Homo_sapiens__NP_001139447
auggcuaccugcuggcaggcccugugggcauacagaagcuaucucaucguguucuuuguccccauucuucuguugccuuuaccaauacugguuccguccaaggaggccuacugugcguaugcuaucauucuaauggcccucuucuggugcacagaagcacugccccuugccgugacugcucuguuuccuuugauccucuucccaaugaugggcauuguagacgcaucugagaucauacaaaggcccuuuccuucaaguuucgaaagcccaggggagugucaguccgugggaaugucugucacggccucgcacaaccuggguggcaccgugggggauucacggguuuuucccccucugagccaugugaguacaugccaggucgcuguggaauaccucaaagacuccaauuuacuguucuuuggaggccuuuugguagccaucgcgguugagcacuggaaccugcauaagcgcauugcacuacgagugcuccugaucgucggugugcguccagccccgcuuauucugggguucauguuggugacugcuuuucucucuauguggaucagcaauaccgccacauccgcaaugaugguccccauagcucacgccguucuggaucaguuacauucaagucaagcgagcucuaacguggaggaaggauccaauaacccuaccuucgagcugcaggaaccaucaccccagaaagagguaacuaagcucgacaauggccaggcccuuccugugacaagcgcaaguucugagggcagagcucaccugucccaaaaacacuugcaucuaacccaguguaugagccugugcgucuguuauucggccucuauugggggaaucgcuacgcucacugguaccgccccaaaccuggugcuucagggccagauuaauucccuguuuccccaaaacgggaauguugugaacuucgcaucaugguucaguuuugccuucccgacaauggucaucuugcuccuguuagcuuggcuguggcuacagauccucuuucugggauucaauuuuaggaagaacuucggcauuggugaaaagaugcaggagcaacagcaggcggcauacugcgugauacagacugaacaccggcuuuuggggccuaugaccuuugccgagaaagcuaucagcauucuguucguaauccucguucugcuuugguuuacacgcgaacccggauucuuucugggcuggggcaauuuggccuucccaaacgcaaagggggaguccauggugucugauggaaccgucgccauauuuauugguaucaucauguucauuaucccuagcaaauuccccggccucacgcaagacccagagaaccccgggaagcugaaagcuccuuuaggacugcuagauuggaagacugugaaucagaagaugccauggaacauuguccuccugcuuggcgguggguaugccuuggcaaaaggcucagaaagaaguggacuguccgaguggcucggcaauaagcugacaccguuacagagcgugcccgcgccugcuauagccaucauucugucucuuuugguugcaaccuuuacugaauguacaucaaacguggccaccacgaccaucuuccucccaauccuggcuaguauggcccaggcaauuugccuacauccccuguacguaaugcucccuuguacacuggcuacuagccuugccuuuauguugccagucgcgacacccccgaaugccauaguguucuccuuuggggaccugaaaguuuuagauauggcuagggcaggauuccuccugaacaucauuggugugcuuaucauugcccuggcuaucaauucuuggggcauaccuuuguuuucgcuccacagcuucccauccugggcccaaucaaacaccacugcacagugccugcccagucuagcgaauaccacaaccccuucucccuga

SEQ ID NO: 62572 - RNA, 1668 nt, Artificial Sequence
  derived and/or modified sequence opt3 from SLC13A3__Homo_sapiens__NP_001011554
auggccguguacuggugcaccgaggcucugccccucagcgucacagcacuucugccuaucguuuuguucccauuuaugggcauuuuaccguccaacaagguguguccccaguauuuccuggacacuaauuuucuauuccucucugggcugauaauggccucagcgaucgaagaguggaaccuucacagaaggauugcucugaaaaucuugaugcucguaggagugcaaccugcccggcugauucuggguaugauggucacgaccaguuuucucagcaugugguuauccaauacagcaucuacugccaugaugcugccaaucgcuaacgcaauacuuaagucguuguucggccagaaagaagugcgcaaggaucccucacaggagagcgaagagaauaccgccgcuguucgacguaacgggcugcauacagugccuaccgagaugcaguuucuagccaguacugaagcgaaagaccacccaggagagacagaagucccccucgaucugccugcagacuccagaaaggaggaugaguacaggcggaauaucuggaagggcuuccuuauuucuaucccauauagcgccuccauuggugggaccgcuacgcugacuggaaccgccccgaacuugauccuccugggccaauuaaaaucauuuuucccccagugcgacgugguaaauuuuggcaguugguucauauuugcauucccucugaugcuccuuuuccuguuggcuggguggcuauggauuagcuuucuguacggaggucucucuuuccgcggcuggagaaagaacaaauccgaaaucaggacaaaugccgaggaucgggcgcgcgccguuauucgagaagaguaucagaaccuggggccaaucaaguuugcagaacaggcuguguucaucuuguuuuguauguucgccauucuguuguuuacuagagaccccaaauucauaccuggaugggcuucacucuuuaauccaggcuuccugagcgaugccgucaccgguguggcaaucgugacaauuuuauuuuucuuucccagucaaaggccgucucugaaguggugguucgacuucaaggccccuaacaccgagacggagccccuacucacuuggaaaaaggcucaggaaacagucccauggaauaucauacugcuucuugggggaggcuuugcgauggcaaaaggcugcgaggaauccgggcugagcguuuggauuggaggucagcuccauccucuggagaacgugcccccagcccuugcuguacuguugaucaccguggucaucgccuucuuuacugaguucgcaucgaacacagccaccauuaucauuuuucuccccgugcuggcugaauuagccauacggcugcguguucacccucuauaccucaugaucccaggcacggugggguguucuuucgcauuuaugcugccggucuccacacccccuaauucaauugcguucgcuaguggacaucuuuuggugaaggauaugguacgcaccggccugcucaugaaccugauggguguuuuacugcuuagcuuggccaugaauacuugggcacagaccaucuuucaacucgggacauucccagacugggccgauauguauuccgugaacgucacugcucugcccccuacccuagccaaugacacauuuagaacccuguga

SEQ ID NO: 62573 - RNA, 1569 nt, Artificial Sequence
  derived and/or modified sequence opt3 from SLC13A5__Homo_sapiens__NP_001137310
auggccagcgcucuguccuacgugucuaaguucaaaucauuugucauccucuucguuacuccccuucuguuguuaccucuggugauucuaaugccagcaaaguuuguaagaugcgccuaugugauaauccucauggcgauuuacugguguacagaggucaucccgcuggcugugaccagucuuaugcccguucuguuguucccucucuuucagauucuggacagcaggcaagugugcguccaguauaugaaagauacgaacaugcuguuccucggcggguuaaucguggccguagcaguugaacgguggaaucugcacaagcgcauagcccuucgaaccuugcugugggugggagcuaaaccagcacgucuaaugcucgguuuuaugggcgucacagcccugcuuuccauguggaucucuaacacugcuaccacagccaugauggugcccauuguggaggcgauccugcagcagauggaagcaaccucggccgcuacugaggccggguuggaacucgucgacaagggaaaggcaaaagagcugccuggcucacaaguuauuuucgaggguccaacauuagggcagcaggaagaucaggagagaaagaggcuguguaaagcuaugacccucugcaucuguuacgccgcgagcauaggaggcacggccacucuuaccggcacagggcccaaugugguacuguugggacaaaugaacgaacuauuuccugacaguaaggaucuggugaauuucgcauccugguuugcuuucgccuuuccaaacaugcucgucaugcugcuuuucgcuuggcugugguugcaguucguguauaugcgguuuaauuucaaaaagucuugggguugcggccucgagagcaagaaaaacgagaaggccgcacugaaaguuuuacaggaagaguaccgcaagcuggggccgcuauccuuugccgaaauuaaugugcucaucuguuucuuucugcuugucauuuugugguucucaagagaccccggauuuaugccuggcuggcugacuguggcuuggguagagggugaaaccaaauauguuagugaugcgacaguggcaaucuucgucgccacccuccuguuuaucgugccaagccagaagcccaaauucaacuuuaggucucaaacggaggaggaacggaagacuccuuucuacccacccccgcuucuggacuggaaggucacacaggagaaagugccuugggggauuguuuugcuccugggaggcggcuuugcuuuagccaagggguccgaagcaucaggacugagcguguggauggguaaacagauggagccccuacaugccguaccuccagcugccauaacccucauccugagucuuuuggucgcaguguucacugaaugcacaucuaauguugcgaccacgacccuguuccuccccauuuuugcuuccauggugaagacaggcgucaucaugaacauaauugggguguucuguguauuucuggccgugaauacuuggggacgcgcaaucuucgauuuagaccacuuuccagauugggccaacguuacccauaucgagacauga

SEQ ID NO: 62574 - RNA, 1338 nt, Artificial Sequence
  derived and/or modified sequence opt3 from SLC14A1__Homo_sapiens__NP_001122060
augaacggcagaucccugauugggggagccggugacgcuaggcacggccccguguggaaggauccuuucgggaccaaagcaggagacgccgcgcggcgcggcauugcucgacucucccuugcccuggcagaugguucucaggagcaagaaccagaggaagagauagccauggaagacucaccgacaaugguccguguugauagucccacuauggugagaggggagaaucagguaagcccuugccagggaaggcgguguuuuccaaaggcuuugggcuacgugacgggcgacaugaaagaguuagcaaaccagcugaaggauaaacccgucgugcuacaauucaucgacuggauucuccgcgggaucucccagguuguguuugucaauaacccugugucugguauucugauccuuguaggacuguugguucagaauccauggugggcccucaccggcuggcuggggacaguggucucgacucugauggcucucuuacugucacaggauagaagccuuauagccaguggauuguauggcuacaacgcgacccuggugggugugcuaauggcagucuucuccgacaagggggauuauuuuugguggcuccugcuucccguuugcgccaugucuaugacauguccuaucuucagcuccgcucugaacucaauguugaguaagugggaccucccaguguuuacccugccguucaauauggccuuaagcauguaccugucugcaacuggacauuauaaucccuuuuucccugcuaaacucguaauuccaaucacaaccgcccccaacauuuccuggucagaucuuagcgcgcuggaauugcuaaagaguaucccugugggcgucggccaaauauacgggugcgacaauccauggacgggagguauuuuucugggcgccauccuccugucuagcccccuuaugugucugcacgcagcuauuggguccuugcucggaaucgccgcuggccugucguuaucugccccguucgaggacaucuauuuuggucuguggggguucaacuccucacuagcaugcauugccaugggcggaauguucauggcucucacuuggcagacccaucugcuugcguugggcugugcacuguuuacagccuaccucggggugggaauggcuaauuucauggccgaaguuggucugccugcaugcacuuggcccuuuugucuugccacccuguuguuccucauaaugacaaccaaaaacaguaauaucuacaagaugccacugagcaaagugacguauccugaggagaacaggaucuuuuacuuacaggcuaagaagcggauggucgaaagcccccuguga

SEQ ID NO: 62575 - RNA, 2763 nt, Artificial Sequence
  derived and/or modified sequence opt3 from SLC14A2__Homo_sapiens__XP_011524518
augagcgacccccacuccucuccucugcucccagagccgcuuucaaguagauacaagcuguaugaagccgaguucaccagccccuccuggccuucuacaucgccagauacucaucccgcuuugccuuuacuggaaaugccagaggaaaaagaccuaaggucaagcaacgaggauagucacaucgugaagauugagaaacucaaugaacgguccaagcgcaaagacgauggcgucgcacaucgagacucugccgggcagcguugcauaugucugagcaaggcgguuggauaccuuacgggugauaugaaggaguauagaaucuggcugaaagacaagcacuuggcucuccaauuuauugauugggugcugaggggcaccgcccagguaauguucaucaacaauccccuguccgggcucauuaucuuuauaggauuacugauccagaacccuugguggacaauuacuggcggucuugggaccguggucucaacauugaccgcacuggcccuaggacaggaccggagugcuaucgcaagcggccuccauggcuacaaugggaugcuggugggacuucugauggccguuuucucugaaaaauuggauuauuacugguggcuccuguuuccagugacuuucacagcuauguccugcccggucuuaucaagcgcccugaacaguaucuuuucuaagugggaccuccccguguucacccuuccuuuuaauauugcgguaacgcuguauuuggcagccacuggucacuacaaccuauucuuuccaaccacacugguugagcccguguccagcgucccuaauauaacuuggaccgagauggaaaugccacuccugcuucaagcuauucccgugggcguggggcaggucuacggaugugauaacccguggacaggcgguguuuuccugguggccuuguuuaucucgucuccucucauuugccugcacgcagcuaucggguccaucguaggauuacuggccgcgcuaucaguggccacccccuucgagacgauuuauacuggccucuggaguuacaauuguguccugagcugcauagcaaucggcgggauguucuaugcucuuacauggcagacccauuugcuggcccucauuugugcucuguuuugcgccuacauggaagcagccaucuccaacauaaugucugugguuggagugccaccugguacuugggcuuucugucuugcgacaauuaucuuucuguugcucaccacgaauaaccccgcaaucuuccgccugccauuaagcaaagucaccuaucccgaggccaauagaauuuacuaucugacagugaagucaggcgaagaggagaaggcuccuagugggggaggcggugaacacccaccgacugccgggcccaaaguagaggaaggcuccgaggcaguucuaagcaagcauaggucuguguuucacaucgaauggucaaguauucggcgccgaagcaaagucuucggaaagggcgagcaccaggagagacaaaacaaagacccuuuuccauacagguaccggaagcccaccguggaacuccuggaccuugauacaauggaggaauccucugagauaaaagucgaaacuaacaucucgaagaccagcuggauucguuccucaauggccgcuagugggaagcgcgugucuaaagccuugagcuauaucacaggagagaugaaggagugcggugaaggccugaaagacaaguccccuguuuuccaguuuuucgauugggugcucagagggaccucacagguaauguuugucaauaacccacugagcggaaucuuaauuauacugggccuuuucauccagaaucccuggugggcaauuucugguuguuuggggacuaucauguccacgcucacagcgcugauucuaagucaagacaaaagcgcuaucgccgcaggcuuucauggauacaacggcgugcugguugggcuccugauggccguguucucugauaagggagacuauuacugguggcuuuugcugccggucauaaucauguccaugucaugcccuauuuuaaguagcgcucucgguaccaucuucucgaagugggaucugccaguguuuacucuucccuucaauauuaccguaacacuguauuuggccgcaaccggccacuacaaccucuuuuucccuacuacacugcuacagcccgcuuccgccaugccaaauaucacguggucugaggugcagguuccucugcuccugagggcgauacccgucgggauuggacaaguguauggcugcgacaacccauggaccggugggaucuuucuuauugccuuguucaucagcucaccgcugauauguuuacaugcugcaaucggcaguacuaugggaaugcucgccgcucugacaauugccaccccuuuugauuccaucuacuucggccuuugcggguuuaauucuacacuggcauguauugcgaucggaggcauguucuacgugauaacuuggcagacccaccuacucgccauugcuugcgcccuguuugcagcuuauuugggugccgcacuggccaacauguuaagcgucuucgggcugcccccauguacguggcccuuuugccucuccgcucuuaccuuccuguugcucacaacuaauaacccugcgaucuacaaacugccacuaucaaagguuaccuaucccgaagccaaucggaucuacuaucugagccaggagcgaaaccgcagagcaaguauuaucacaaaauaccaggcuuaugacgugucuuga

SEQ ID NO: 62576 - RNA, 2127 nt, Artificial Sequence
  derived and/or modified sequence opt3 from SLC15A1__Homo_sapiens__NP_005064
augggcaugagcaagucccacucuuucuuuggguacccccugucaaucuucuuuauuguggucaacgaguucugcgaaagauuuaguuauuacggaaugagggccauacucauccuuuauuucaccaauuuuauuagcugggacgauaaccuguccacagcuaucuaccauacuuucguugcauuguguuauuuaacgccuauucugggugcccuaaucgcggacucuuggcucggcaaauuuaagaccauagugucgcugucaaucguauacacaauugggcaggcugugacuagcgucaguuccaucaaugaucuuaccgaccacaaccaugauggaacaccagacucucugccggugcacguuguguugagccucauuggccuggcccugaucgcacucgguaccgggggaauaaaacccugcgucuccgccuucggcggcgaucaauuugaggaagggcaggagaagcagcggaaucgcuucuuuucaauuuucuauuuagcuaucaacgcaggaagucugcuuagcacuauuaucacaccuauguugcgagugcagcaaugugguauccauucuaaacaggccugcuacccacuggcuuucggcguacccgccgcgcuaauggcaguugcccucauuguguuuguccugggguccggaauguacaagaaguucaaaccucagggcaauauaauggguaagguggcuaaauguaucggguuugccauuaagaaccguuucagacacaggucaaaagcauuuccaaagcgggaacacuggcuugacugggcuaaggagaaauaugaugagcgccugaucagccagauaaagauggugaccagagucauguucuuguacauuccccucccuauguuuugggcccuguucgaccaacagggaaguagguggacguuacaggcgacuaccaugucuggcaaaaucggcgcccuggaaauccagccagaucaaaugcagacaguuaaugcaauucucaucgugauuaugguaccgauauuugacgcugugcuuuauccccugaucgccaagugcggguucaacuuuacuuccuugaaaaagauggcugucggaauggugcuagccagcauggcauucguuguggccgcuauuguccagguggagaucgauaaaacccugccuguauuuccaaaggguaaugaaguucaaaucaaggugcucaacauuggcaauaacacaaugaauauaucgcugcccggggagauggucacccuuggaccuaugucucagacgaacgcguucaugacuuucgacgugaacaaacugacacggaucaauauuuccucaccaggcagucccgucaccgcagugacugacgauuuuaagcagggucagcgccauacauugcucguuugggccccgaaccacuaccaagugguaaaagacgggcugaaucagaagccugagaaaggcgaaaacggaauccgauucgucaauaccuuuaacgaguuaauuacgaucaccaugagcggcaagguguaugcuaauauauccucuuacaacgccagcacauaucaguucuuucccucagggaucaagggauucacuauuaguuccaccgaaaucccaccucagugucaacccaauuuuaacacauucuaccuggaguuugguagcgcauacacuuauauuguucagaggaaaaaugauucuugcccagaagugaaggucuucgaggacaucucagccaacaccgugaauauggcucuacagauaccccaguacuuucuccugacauguggcgagguaguguucaguguuaccgggcuugaauuuagcuauucccaagccccuucuaacaugaaaucggucuugcaggcaggauggcugcucacuguggcggugggcaauauuaucguccugauuguugcuggugccgggcaguucagcaagcagugggcagaguacauccuuuucgccgcucuguugcucguggugugcguaauauuugccaucauggcaagauucuauacguacauuaacccagcugaaaucgaggcccaauuugaugaagacgagaaaaagaaccggcuggagaaguccaauccguauuucaugucaggcgcgaacagucagaaacagauguga

SEQ ID NO: 62577 - RNA, 2097 nt, Artificial Sequence
  derived and/or modified sequence opt3 from SLC15A2__Homo_sapiens__NP_001139470
augaaccccuuccagaagaaugagagcaaagaaacccuguuuuccccugugucuaucgaggaagucccaccgagacccccuucaccacccaagaaaccuaguccaacaauuugcggcagcaacuacccccucuccauagccuucaucguugugaaugaguuuugugaaagguucucuuauuacgggaugaaggcuguacuuauucuguacuuuuuguauuucuuacacuggaacgaggacacuucgacgucaaucuaucaugcauuuagcagucugugcuacuucaccccuauucuaggagccgcgaucgcugauuccuggcucgguaaauuuaaggugcugucucuuauaggccugagcuugaucgcccucgggacaggaggcauuaagccaugugucgcagccuucgguggggaccaauuugaggaaaaacacgcugaggaacggacucgcuauuucuccguguuuuaccugucaaucaaugcaggaagucugauuagcaccuucaucacaccgaugcuccgaggcgauguucagugcuucggcgaggacuguuacgccuuagcuuuuggggugcccggacugcuuauggucauagccuuggugguauucgcgauggguucuaagauuuauaacaaaccuccacccgagggcaauaucguugcacagguguuuaagugcauuugguucgccaucuccaaccguuuuaaaaauagaucaggggauaucccuaagaggcagcauuggcuggacugggcugccgaaaaguacccaaaacaacuaauuauggaugucaaggcacucacccgggugcuguuccuuuauauaccccugccgauguuuugggcuuugcucgaccagcagggaagccgcuggacucugcaggccaucagaaugaacaggaauuuaggcuucuuugugcugcaaccugaucagaugcagguccucaacccccuucugguuuugauuuucaucccacuauuugacuucgugauauaccggcugguaaguaaaugugguauuaauuuuucuucccuccgcaagauggcgguggggaugauccuggccugccuugcauucgcugucgccgcugccguggagaucaaaauuaacgaaauggcacccgcccagcccggaccacaagagguuuuccugcaaguguugaaucucgcugaugacgaagucaaggugacaguaguuggcaacgagaacaauagccuguuaaucgagucgauuaaaucuuuucagaagaccccucacuauuccaagcugcaucuaaaaacgaagucacaggauuuccacuuucaccucaaauaccauaaccugagucuuuauacugaacacagcgugcaggagaagaauugguacuccuuggucauacgagaagacggcaacucuaucagcucaaugauggugaaagacaccgagaguagaacaacuaaugggaugaccacagucagguucgugaacacccugcauaaggauguuaauauuucccucagcacggacacuucucugaacgugggagaagauuacgguguaucagcguaucggacaguccagcguggcgaguacccugcagugcacugucgcaccgaggacaagaauuuuagucuuaaccugggguugcucgauuucggagccgcuuaucuguuuguuaucacuaauaacacaaaucagggcuuacaagccuggaaaaucgaagacauuccagcaaacaagaugagcauagccuggcagcugccgcaguacgcucuagugaccgccggugaggucauguucuccgugacggggcucgaauuuucuuauucgcaggcacccagcuccaugaaaucaguacugcaagcggcuuggcuuuugaccaucgccgugggcaauauuaucguucuggucguggcacaguucaguggacucgugcagugggccgaguuuauucuguucucuugcuuacugcuugucaucuguuugauauuuagcaucaugggcuacuauuacguuccugugaagacagaagauaugagagggccagcugacaaacacauuccccauauccagggaaacaugauuaagcucgagacuaagaaaaccaagcuguga

SEQ ID NO: 62578 - RNA, 1734 nt, Artificial Sequence
  derived and/or modified sequence opt3 from SLC15A4__Homo_sapiens__NP_663623
auggagggcagcgggggaggugccggcgaaagagcuccccugcucggggcaaggcgggccgcggcugccgcagccgcugcaggagccuucgcuggccgccgagccgcgugcggugcagugcuucugaccgaguuguuagaacgugccgcuuuuuacgggaucacauccaaccugguccuauuccucaauggagccccuuuuuguugggagggcgcacaggcuucugaagcccugcuucuguucaugggcuugacuuaucucgggucaccauuuggagguuggcuggcggacgccagacugggcagggcacgggcuauucucuuaagucuggcccuuuacuugcuggggaugcuagcuuucccgcuccuggccgcacccgccacgcgcgcugcgcuuugcggaagcgcaagacuguugaacuguaccgccccuggcccagaugcugccgcaaggugcuguucccccgccacauuugcuggucucguucuggugggguuaggaguagccacugugaaggcaaauauaaccccuuucggcgcggaccaagucaaagaucggggcccagaggcuacacgccgauuuuucaacugguuuuauuggucuaucaaucugggggccauucucucgcuuggagguaucgcauacauucagcagaacgugucauucguuaccggcuaugccauccccacugugugcgucgggcuggcuuuugugguauucuuguguggacagagcguuuucauaacaaagccuccagacggcagugccuuuaccgauauguucaaaauccuaacguacuccugcuguucucaaaagagaagcggugagaggcaguccaauggggaaggcauuggaguguuucagcagucaaguaaacaaagccuguucgacucuugcaagaugucccacggcgggccguuuacugaggaaaaggucgaggaugugaaagcacucgugaagaucguccccguuuuccuggcucuuauuccuuauuggaccguguacuuucagaugcagacaacuuacguacugcagucauugcaucuccggaucccagagauaagcaacauuaccacaacgccccacacccugccugccgcgugguuaacuauguucgacgccgugcugauccuacuccugauuccacuuaaagauaaguuggucgaccccauccugcgucgccauggacuccugccgaguucucuuaaaagaaucgcuguggguauguuuuucguuauguguuccgcauuugccgcuggcauucuggaaagcaagagguugaaucucgugaaggagaaaacaauaaaccaaaccaucgggaaugucguguaucacgccgcagaucugucguuaugguggcagguaccucaguaccugcuaauuggaaucucugaaauauucgcguccauugccggccucgaguuugcuuauucagccgcacccaagaguaugcaaagcgcuaucaugggucuguucuucuuuuucuccgggguuggcucuuuugugggaagcggccuuuuggcccuggucucaaucaaagcaauuggguggaugaguucccauacugacuucggaaacaucaaugguugcuaccucaacuauuacuuuuuccuguuagccgcuauucagggcgcgacacugcuuuuguuucucauaaucagcgugaaguaugaucaccaccgggaccaucagcgaucucgcgccaauggggucccaaccucaagaagggcauga

SEQ ID NO: 62579 - RNA, 1548 nt, Artificial Sequence
  derived and/or modified sequence opt3 from SLC16A10__Homo_sapiens__NP_061063
auggugcugagccaggaggaacccgacuccgccagaggcaccucugaggcucaaccucucgggccagcaccgacaggagccgcgcccccuccaggucccggcccuucagauaguccagaagcugccgucgagaagguugaaguggagcuugcagggcccgccacugcugagccucacgaaccaccggagcccccugaaggaggcugggguuggcugguaauguuggcagccauguggugcaacgggagcguguucggaauccagaaugcuuguggcgucuuauuuguguccaugcuggagacguucggcucuaaagacgaugacaagaugguuuuuaaaaccgccuggguggggucgcuaucaaugggaaugauuuucuuuugcuguccaauagucagcguguucacagaucucuuugguugcaggaagacugcgguaguuggcgcagccgugggguucgucggacugaugaguuccucuuuugugagcuccaucgagccccuuuaccugaccuauggcauuaucuucgcuugugguugcucauuugccuaccagccuaguuuggugauucucgggcauuauuucaaaaagcggcugggacuggucaacggcaucguuacagcaggcagcucuguguuuaccauacucuuaccacugcuuuugcgcguacugaucgacuccguggggcuauucuacacucuccgaguccuguguauuuucauguuugugcuuuuccuggcuggauuuacauaucgucccuuggccaccucaacgaaggauaaagaaagcgguggcagugggucuucccucuucagcagaaagaaauuuucgccgccuaagaaaaucuucaauuuugcgauuuucaagguuacugccuacgcagugugggcugucggaaucccccuggccuuauuuggcuauuucgugccauacguacaccugaugaagcauguuaacgagagguuucaggacgagaaaaauaaggaagugguccucaugugcauaggugugaccucuggggucggccggcuucuguucggacgcauugcugauuacgugccuggcguuaaaaagguguauuugcaaguacuauccuuuuucuucaucgggcugaugucaaugaugauuccccucuguaguaucuuuggagcccugaucgcagucugccuuauuaugggucuguucgacggcuguuuuauaagcaucauggccccaauugcuuucgaauuggugggggcgcaggauguuucccaggcaaucggauuucuccugggcuucaugucuauacccaugacaguggguccuccaauugccggguuacugagagacaaacuaggcagcuacgaugucgcuuuuuaucucgccggagugccgccccugaucggcggggcaguacuuugcuucaucccuuggauucacucaaagaaacagagggagaucaguaagacuaccggaaaggagaaaauggaaaagauguuggagaaccaaaauucccugcucucuagcucaagugguauguuuaaaaaggaaagcgacuccauuauauga

SEQ ID NO: 62580 - RNA, 1416 nt, Artificial Sequence
  derived and/or modified sequence opt3 from SLC16A11__Homo_sapiens__NP_699188
augcccgccccucagagaaagcacaggcggggcggguucagccaucgcugcuuuccaaccccgcaaacagcuaugacuccccagccugcaggaccacccgacgguggcuggggguggguggucgccgcggcugccuucgcaaucaacggacuguccuacggccuccuucgaucucuggguuuggccuuuccugauuuagcugagcacuucgaccguucagcacaggauacggccuggauuagugcucuggcccuagcgguucagcaagcagccagcccagugggguccgcucucucuaccagauggggagccaggcccguagugauggucggcggcgugcuggcaucgcuuggguuuguuuucucagcuuuugccagcgaccuguugcaucucuaucugggacugggucucuuagcgggcuucgggugggcccugguguuugcuccugcacuuggaacauugagucgguacuucucccgcagaaggguccuggccgugggccuagcucucacugguaauggggccucuagccugcuucuggcaccagccuugcagcuccuguuagauaccuuuggauggcggggcgcucugcuccuucugggcgcgauaacauugcaccuaaccccguguggggcacugcuccugccccuuguacugccuggagacccacccgccccuccacgcucccccuuggcugcccucggucugucauuauucacuagacgagcauuuaguaucuucgcccugggcacagcucuaguugggggaggcuauuucgugccguacguccaucucgccccucacgcacuggauaggggucuugggggcuauggagcggcuuuggugguggccgucgcagccaugggcgacgcuggggcccggcugguuugcggauggcucgcagaucaggguugggugccccugccacgucuucuggcuguauuuggcgccuugaccgggcucggacuguggguggucggcuuagugccuguuguggguggggaagagagcuggggcggaccccugcuagcggccgcugucgcauacggccucucugccggguccuaugcuccacugguguucggaguacuucccgguuugguuggcgucgggggaguggugcaggccacgggccuggucaugaugcucaugucacuggguggguuacugggcccuccacuuagcggauuuuugcgcgacgaaacuggcgauuucaccgcaaguuuucuccugucugggucccuaauucugagcggaucguucaucuacauuggccucccgagagcgcugcccucuugugguccugccuccccacccgcuacaccuccacccgagacuggggaacuuuugccggccccucaagcagugcuguuaucaccaggaggccccgguaguacccucgacacaaccugcuga

SEQ ID NO: 62581 - RNA, 1551 nt, Artificial Sequence
  derived and/or modified sequence opt3 from SLC16A12__Homo_sapiens__NP_998771
augcccagcggcucccacuggaccgccaacucuucaaagaucauuacauggcugcucgagcagccugggaaagaagagaagagaaaaacuauggcuaaggugaauagggcacggaguacgagcccaccggacggagguuggggcuggaugauagucgccgggugcuuccuuguuaccaucuguacacgcgcggugacucgaugcauuuccaucuuuuucguagaauuucaaaccuacuucacacaggauuaugcucagaccgccuggauucauucuaucguggacugugucacuaugcugugcgcacccuugggaucggugguuucaaaccacuuaagcugucaggugggcauaaugcugggugggcuacucgccaguacaggacugauccuuuccucuuuugcuaccagccugaaacauuuguaccucacgcugggcguccugacuggccucggguucgcauuaugcuauuccccugccauugcuauggugggaaaguacuuuucacguagaaaggcccuggcguaugguaucgcaaugaguggcagcgggauuggaaccuucauccuugccccaguaguucaauugcugauagagcaguuuucuuggaggggcgcucuacucauucuggguggguucgugcuuaaucugugugucugcggagccuugaugcggcccaucacacucaaagaagaucacacuaccccugagcagaaccaugugugucgcacacagaaggaggacauuaaaagaguguccccauacucaagccugaccaaggaaugggcacaaacgugcuuauguugcugccugcagcaggaguauaguuuucuccuuaugucugauuucgucguucuggcuguguccguauuguuuauggccuacggcuguagcccccuauucguguaccuggucccuuaugcgcucucggugggcguuucucaccagcaagccgcauuccugauguccauccuuggggugaucgacauuauaggaaauaucacuuuugguuggcugacagauaggcggugcuugaaaaacuaccaguaugucuguuaccucuucgcugugggcauggacgggcugugcuauuuaugucugccaaugcuacagucacucccgcugcuuguacccuuuaguugcaccuucggauacuuugauggcgccuauguuacuuugauuccuguggucacaaccgaaaucguggguacgaccagccuguccucugcucucggggucguguacuuccugcacgccguuccauaccuugugucacccccuauagcaggccgccugguagacacaacuggaagcuauaccgccgcguuuuugcucuguggcuucaguaugaucuuuuccagcguccuguuaggguucgcucgacugauuaagagaaugaggaagacacaacuacaguuuaucgcaaaagagucugauccaaagcuccagcuguggacuaauggaucaguggccuacaguguugcucgggagcuugaccagaaacauggugaacccguggccaccgcagucccgggcuauagcuugacauga

SEQ ID NO: 62582 - RNA, 1281 nt, Artificial Sequence
  derived and/or modified sequence opt3 from SLC16A13__Homo_sapiens__NP_963860
auggccagaaggaccgagcccccugacggcggguggggauggguggucguucugagcgcuuucuuucaguccgcacucguguucgguguacuucggucuuuuggcguguucuuugucgaguucguggccgcguuugaagaacaagcugcccgcguuucauggaucgcaaguauugggauagccgugcagcaguucggaagcccagucggcuccgcucugucuacaaaguuugguccgcgacccgugguaaugacugggggaaucuuggcagccuuaggcaugcugcuagcuucguucgccacgucacucacccaccuguaccuuagcauuggccuguugaguggguccggaugggcgcucacauuugcaccuacucuggccugccugucuuguuauuucagccguagaaggucccucgcuaccgguuuagcccugacaggcguugggcuuucaaguuuuaccuucgcaccauucuuucagugguugcugagccacuacgcuuggcggggaucucuacuccugguguccgcccuuucacugcacuuggucgcgugcggcgcccuccugagacccccuagcuuagcagaggauccagcugugggugggccccgcgcccaacugacaagucuccuucaucacggaccuuuccugagguauacuguggcuuugacccuaaucaacacgggcuacuuuauuccauaucugcaucucgucgcccaucugcaggaccuugauugggacccgcugcccgcagccuucuugcucucuguuguggcuaucuccgaucugguaggccggguggucagcgggugguuaggagacgcggugccugguccaguuacucgccugcuaaugcucuggaccacacugacuggcgugucgcuugcauuguuucccgucgcccaggcuccuaccgcccugguggcacucgccguagcuuacggguucacaucuggagcccuggcaccacuugcguuuuccguucugcccgaauugauaggcacccgaagaaucuauuguggucucgggcuguuacagaugauugagucaaucggcggacugcuaggcccgccucucaguggguaccugagggaugugacgggaaauuacacugcuagcuucgucguggccggugcauuucuuuuguccggcucugggauucugcucacacugccccacuucuuuugcuucagcaccacuacaucaggaccacaagacuuagucaccgaggcccuggauacgaaagugccucuucccaaggaaggcuuggaggaagacuga

SEQ ID NO: 62583 - RNA, 1503 nt, Artificial Sequence
  derived and/or modified sequence opt3 from SLC16A1__Homo_sapiens__XP_011540329
augcccccugccgugggcgggccagucggauacaccccgcccgacgguggcugggggugggcuguugugaucggagcauucauuagcauaggcuuuuccuaugccuucccuaagucuaucacaguauuuuucaaagagauugaagguaucuuucacgcgacuacgucagaggugaguuggauuagcuccaucaugcuggcugucauguacgggggaggcccaauaucuucgauccucgugaacaaguauggcucaagaauuguuaugaucgucgggggaugccuuagcgguuguggccugauugccgcaaguuucugcaauaccgugcagcaauuguacguguguaucgggguaauaggaggcuuaggucuggccuuuaaccuaaaucccgcucucacaaugauugggaaauauuucuacaagaggcggccucuggcaaacggacuugccauggcuggcuccccaguuuuucugugcacuuuggcgccccucaaucagguguucuuuggcaucuucggguggcgcggaucuuuucugauucuggguggccucuuacugaacuguugcgucgccggggcacuuaugcgaccuaucggaccaaaaccgaccaaggccggcaaggauaaaagcaaggcuuccuuggaaaaagccgguaagucaggggugaaaaaggaccugcaugaugcaaauacagaccuaaucggccgucaccccaagcaggagaaaagaaguguguuccagaccauuaaccaauuccucgaucugacucuuuuuacacauaggggauuccuguuguaucucagcggcaaugucauaauguuuuucgggcuguuugcuccuuuaguuuuccugucuuccuacggaaagucacagcacuacagcagugaaaaaucugccuuucuccuuuccauccuggcguucguggacaugguagcccggccaagcauggguuugguggcaaacaccaagcccauucgcccuagaauccaguacuuuuucgcugccucggucguggcuaauggcguuugucauaugcuagccccacugucuacgacuuaugugggguuuugcgucuaugcaggauucuuuggcuucgccuucgguuggcucuccucagugcuguuugagacccuuauggaucugguagggccccagagguucaguagcgcuguuggcuuggugacaauagucgaguguugcccggugcuccugggaccucccuuacugggccggcuaaacgacauguacggggauuauaaauacacuuauugggcguguggagucgugcucauuaucuccgguaucuaccuguuuauuggcauggggaucaauuaccgccuuuuggcaaaggaacaaaaagccaacgagcagaagaaggaaucuaaagaggaggaaaccagcauugacguugcuggaaagccaaaugaggugacaaaagccgcagaaucaccugaucagaaggacaccgauggcggucccaaagaggaagagaguccaguauga

SEQ ID NO: 62584 - RNA, 1620 nt, Artificial Sequence
  derived and/or modified sequence opt3 from SLC16A2__Homo_sapiens__NP_006508
auggcccugcagagccaggcuuccgaggaagcaaagggccccuggcaagaggccgaccaggaacagcaagagccuguggggucuccagaaccggagucagagcccgaaccugagccagaacccgagccugucccaguucccccuccagagccgcagcccgaaccucagccacuccccgauccugcgccacuucccgagcuggaauuugagagugaaagagugcacgagccggagccuacccccacaguagaaacuaggggaacggcucgggguuuucagccaccugagggcggguucggauggguggucguguuugccgcaaccuggugcaacggcagcaucuucgguauucauaauuccguugggauauuguacucuauguuacuggaagaggaaaaagagaagaaccgccaaguggaguuucaggccgcuugggucggagcacuagccaugggcaugaucuucuuuuguucgcccauugugucaaucuucacagaccgacucggcugccguauuacugcuaccgccggggcggcaguagccuuuaucggacugcacacaagcaguuucaccuccucucuuagccugagauauuuuacuuacgguauauuguucggcugugggugcuccuuugcuuuccagccaucacucguuauccugggacauuauuuccagaggcggcugggccucgccaaugguguggucagugcagggagcucuauuuucuccaugucauuccccuuuuuaauccgcaugcugggagauaaaauuaagcuggcucaaacauuccagguguugagcaccuuuauguucgugcugaugcuacucagucugacguacagaccucuucugccaucuucccaggacacuccgagcaaaaggggcguccggaccuugcaccaacgcuuucucgcccagcugcgaaaguauuucaacaugagaguuuuuaggcagcggacauaccguaucugggcguucggcauagccgcagcugccuuaggguauuuugugcccuacguacaucugaugaaguacguggaagaggaguucucggaaauuaaagaaacuuggguccuccuuguguguaucggagcuaccucuggucugggccgcuugguuuccgggcacauuucagauaguaucccuggacuaaagaaaaucuaucuucaggugcucagcuuucugcuucugggcuugauguccaugaugauuccacucugcagagacuucggugggcugauagucguguguuuauuccugggccuaugcgauggauuuuucaucacaauuauggcccccaucgcauuugagcucguaggcccuaugcaagccucucaggcuauaggguaccugcuuggaaugauggcguugccaaugauugcaggucccccgaucgccggccugcucaggaauuguuucggggacuaucacguugcuuuuuacuucgccggagugccuccaaucauuggcgcagucauccuguuuuucgugccccuuaugcaucagcggauguuuaagaaagagcagcgagauagcucaaaggacaagaugcuggccccugaucccgacccaaacggugaauugcucccugggagucccaauccagaggaaccgauuuga

SEQ ID NO: 62585 - RNA, 1398 nt, Artificial Sequence
  derived and/or modified sequence opt3 from SLC16A3__Homo_sapiens__XP_011521909
augggcggggccguggucgacgagggacccaccgguguuaaggcuccugauggcggguggggaugggcagugcuguucggcugcuuuguaaucacagguuucagcuacgccuuuccaaaagcgguguccgucuucuuuaaggaacucauucaggaguucgggauaggauauucugacacugcuuggaucucaaguauucuucuggccauguuguacggcacgggcccguuauguagcgugugcguuaacagauuuggguguaggcccgugaugcuggucggaggucuauucgcaucccucggcaugguggccgcuucuuuuugccggucgaucauucaaguauaucugaccacagggguuaucacuggacuuggccuggcauugaauuuccagccuucacucauaaugcugaaccgcuacuuuagcaaacgacguccaauggccaauggucuggcugccgcggggagucccguguuccucugugcauuauccccucugggacagcuuuugcaggauagauauggcuggaggggcggguuucugauccuaggaggucuccugcuuaacugcugugucugcgccgcucugaugcggccauugguggugaccgcccaacccggcucugggccuccacgcccgagcagaaggcuccuggacuuauccgucuuccgggaucgcggauucguucuguacgcaguggcugccucaguaauggugcucggccuuuuugucccaccuguguucguugugaguuaugcgaaggaccugggugucccagauacaaaagccgcauuuuugcuaaccauucugggguucaucgacauuuuugcucgacccgccgcuggcuucguggccggacucggcaagguaagaccuuacagcguuuaccuguuuucuuucuccauguuuuucaaugggcuugcagaucuggccggaucaacugcuggugacuauggcggguugguggucuuuuguaucuucuuuggaauaagcuacggcauggugggugcgcuccaguucgaaguccugauggcaauuguggggacacacaaguucaguucugccaucggcuuaguucugcuaauggaggcuguggccguacucgucggaccacccuccggcgggaaacugcuugaugcaacccauguguauauguacguuuuuauuuuggccggagcugaagugcugacgagcucgcucauccugcuucuggguaacuucuuuugcaucaggaagaaaccgaaggagccucagcccgaggucgccgcagcggaagaggaaaaauugcacaagcccccugcugacucuggcguggaucuccgggagguagagcauuuccugaaggccgaacccgagaaaaauggggaagugguucacacuccagagaccuccgucuga

SEQ ID NO: 62586 - RNA, 1572 nt, Artificial Sequence
  derived and/or modified sequence opt3 from SLC16A6__Homo_sapiens__NP_004685
augacccagaacaagcugaaacucugcagcaaggccaauguguacacagagguccccgacggcggguggggaugggcuguugcaguguccuucuuuuucguagaaguguuuacuuaugguaucauuaaaacguucggcgucuuuuucaacgaucuuauggacucuuuuaaugagucaaacaguagaauaagcuggaucauuuccaucuguguguucguucugaccuuuucugccccuuuggcgacaguguuaucgaauagguucgggcaccggcuggucgugaugcuaggaggccuccugguaucaacugguaugguugcugccagcuuuagucaagaagugucccauauguacgucgcaauugggaucauaucuggacuuggcuauugcuucagcuuucugccaaccgugacaaucuugucccaguacuucggcaagcgccgaucaauugugaccgccgucgcuaguacuggggaguguuucgcaguuuuugccuucgcuccggccaucauggcgcucaaagaacguauuggauggagauauagccugcuguuugugggucucuuacagcugaacaucguaauauucggcgcacuuuugaggcccauuuuuauccgggggccugccucuccaaagauugugauccaggagaaucgcaaggaggcucaauacaugcuggaaaacgagaaaacaagaaccuccaucgauucaauugacagcggagucgaacuaacgaccagucccaagaaugugccuacucacacaaaccucgagcuggagccaaaagccgauaugcagcagguucuugugaagacuucucccaggccuuccgagaaaaaggcaccacuguuggacuucagcauacucaaggaaaaaucguuuaucugcuaugcucuguucggcuuauuugccacccuggguuucuuugcgccgucucucuacauuaucccccuugggauaucccugggaauugaucaggaccgggccgcauucuugcuaucaacaauggcuaucgccgaagucuuuggccgcaucggcgcuggguucgugcugaaucgagagccuauuagaaagaucuacauugaacucauauguguaauccugcuuaccguuagucuguucgccuuuacguucgcaacugaguuuuggggauugaugagcugcuccauuuucuuugguuucauggugggcacaaucgggggaacccauaucccacuccuggccgaggaugacgucgugggcauugagaaaaugucuagcgcugcgggugucuauauauuuauccaaucaauugcaggguuagccggacccccucuggcuggccuacucguggaucagaguaagaucuacuccagggccuucuauagcugugcagccggcauggcucuggccgcaguuugccuugcguuggugcggccauguaaaauggggcugugccagcaccaucacucuggagaaacuaagguagucucacaccgugguaaaacacuccaggacauucccgaagauuuucuggagauggaccuugcuaagaacgaacaucgcgugcacguucaaauggagccgguguga

SEQ ID NO: 62587 - RNA, 1437 nt, Artificial Sequence
  derived and/or modified sequence opt3 from SLC16A7__Homo_sapiens__XP_005269288
augcccccuaugccaagcgccccgcccgugcacccuccacccgacggcggguggggauggaucgucguuggugcugcauucauuuccauaggcuuuucuuacgccuucccuaaggcggugaccguauuuuucaaagagauccagcaaauuuuucauacaacuuauucagaaaucgcuuggauuaguagcaucaugcuggccgugauguacgcagggggaccagucuccucugugcucguuaacaaguauggcucgagacccguggucauagccggugggcuucugugcuguuugggaaugguguuagcuucauucagcaguuccguaguucagcuguaccuaacgaugggcuuuaucaccggccucgggcuggcauucaaucuucagccugcccugacaauuaucggaaaauauuuuuacaggaagcggccaauggcuaacgguuuggccauggcgggcucuccgguguuccucagcucccuggcacccuuuaaucaguaucuguucaacacuuuuggguggaaaggaucauuccucauuuuaggcagucugcuuuugaaugccugcgucgcugguagccugaugcgcccucuagggccaaaccaaaccacaucuaaguccaagaauaaaaccggaaagacugaggaugacucaagccccaaaaagaucaaaacaaagaagaguaccugggaaaaagugaacaaguaccucgauuucucucuguuuaaacaccgaggcuuccuuauauaccuguccggcaaugugauuauguuuuugggguucuuugccccuaucauuuuccucgcaccauaugcuaaggaccagggaaucgaugaguacagcgccgcguuucuguuaucggucauggccuucguugacauguuugcacgucccucugugggucugaucgcuaacuccaaauauauuagaccgaggauacaguacuucuuuucauucgccaucauguuuaauggcguaugucaucuccuuugcccucuggcucaggauuauacgaguuuggugcuauacgccgucuucuucgggcugggauuuggcagcguguccucuguucucuucgaaacucugauggaccuugugggugcaccccgguuuagcucagccgucgggcuggugaccauuguagaguguggcccaguuuugcucggaccuccccuggcuggcaaguuaguggaucugacaggggaguauaaauacauguacaugaguugcggagcgaucgucguggcagccuccgucuggcuacucauagguaacgcuauuaauuaucgccugcuugccaaggaaagaaaggaggaaaacgcaaggcagaaaacucgggagagcgagccauugucuaagucaaaacacagugaagacgugaauguuaaggugagcaacgcccaauccguaaccucugagcgcgaaacaaacaucuga

SEQ ID NO: 62588 - RNA, 1515 nt, Artificial Sequence
  derived and/or modified sequence opt3 from SLC16A8__Homo_sapiens__NP_037488
augggcgccgggggacccagaaggggugagggcccuccagacgggggauggggcugggugguccugggugcuugcuucguugugaccggguuugcauacggauucccgaaggccguaagcguguuuuuccgggcgcucaugcgcgauuuugacgcuggcuauuccgauacagccugggucucuucaaucaugcuugcaaugcuguacggcacugggcccgugaguagcauuuugguuacgcgauucggaugucguccugugauguuagccgguggccugcuagcuuccgcagggaugauacucgccucuuuugcuaccagacugcuugaacuguauuugacagccggaguccucacuggccugggucuggcgcucaacuuccagccaucguuaaucaugcuggggcuuuacuuugagaggcggcgccccuuggcaaauggacuggccgcugccggcucaccuguguuccuaagcgcacucaguccacugggccaacagcuucuggaaagauuuggguggaggggagguuucuugcuccugggcggguuacugcuccacugcugugcuugcggagccguaaugcggcccccuccaggcccggguccccgcccucgaagagacuccgcgggggauagggccggcgacgcaccaggagaggcugaagccgauggcgcugggcuucagcugcgggaggccucuccccguguucgcccuagaaggcgguugcuagaccuggcaguguguaccgaucgagccuuugcugucuaugcggugacaaaauuccucauggcacugggacuuuucgugccagccauucuguuggucaacuacgcuaaggacgccgguguucccgauaccgacgcagccuuucuccugagcaucgugggcuucguagauauuguggcucgcccggccugcggggcauuagcgggacuggcuagacuaaggccucauguccccuaucucuuuucccuggcccuuuuggcaaauggccugacugaccucucaagugcccgggcucgcagcuacggugcccugguggcauucuguguugcuuuugggcuuucuuacggcauggugggagcccugcaguucgaggucuugauggcggccgugggcgcuccaagauuuccuuccgcacucgggcugguauuacugguugaagccgcugccgugcuaaucggacccccaucagcagguaggcucgucgacgugcugaaaaacuaugagauaaucuucuaccuugcgggcagcgaagucgccuuggcugggguguuuauggccguugcaacaaauugcugucugcguugcgcuaaggccgcacccaguggaccuggcaccgaggguggggccucugauacggaggacgcugaagcggagggcgauuccgaaccacucccggugguagccgaggaacccggaaaccuggaggcauuagagguccugagcgcucggggcgaaccuacugagccagaaauugaggcccgacccagacuugccgcugaaucgguguga

SEQ ID NO: 62589 - RNA, 1530 nt, Artificial Sequence
  derived and/or modified sequence opt3 from SLC16A9__Homo_sapiens__NP_919274
auggagcugaagaaaagccccgacggcggguggggaugggugaucgucuucguuuccuuucucacccaguuccuuugcuacgguucuccucuggccgugggcguauuguauauugaaugguuagaugcuuuuggggagggaaagggcaaaacagcauggguggguucacuggccaguggggucggacuacucgcgagcccaguguguucccugugcguuucuucguucggcgcuagaccggugacuauauuuucaggcuucauggucgccgggggacuuaugcugagcaguuuugcacccaacaucuacuucuuguuuuucuccuaugguauugugguaggccucggguguggacugcuguacacggccaccguuacaaucacuugccaauauuuugacgauaggcggggccucgcuuuaggucugauuucuaccgggagcuccgugggacuuuucaucuacgcagccuugcagcgcaugcuggucgaauuuuauggccuagacggcugucuccugauagugggggcucuugcccugaauaucuuggcgugcggaucacucaugcgaccucugcagaguagcgauuguccauuacccaagaaaauugcaccugaggaccugccagauaaguacucuaucuacaacgaaaaggguaaaaaucucgaggagaacauuaauauccuugacaaguccuauucaagcgaagagaaaugccguauaacacuggccaacggcgauuggaagcaggacaguuugcuacacaaaaaucccaccgugacucauacaaaggaaccugagaccuacaagaaaaaggucgcugagcaaacguauuucuguaaacagcuggccaagagaaaauggcagcucuacaagaacuauugcggggaaacuguugcacuguucaaaaauaagguguuuucugcucuuuucauugccauccuguuguuugauauuggaggcuucccaccgucccuccugauggaggacguagcgaggagcucgaacgugaaggaagaggaauuuaucaugcccuuaaucucuauuauagguaucaugaccgccgucgggaaacugcuacucggcauucuggcagauuucaaguggaucaauacacuuuacuuguauguggcuacucugauaauuaugggacucgcccugugugcuaucccuuuugccaaauccuacguuacccuugcacuguugucaggcauccucggguuccugacaggaaacuggaguauuuuuccauacgugaccacgaagacugucgguaucgagaaauuagcccacgcuuauggcauucugauguucuuugcggggcuaggaaauagccucggucccccuauagugggcugguucuacgacuggacacagaccuaugacaucgcauuuuacuucuccggguucugcguacugcuuggcggauuuauuuugcugcucgccgcucugccaucuugggauacuugcaacaagcaauuacccaagccggccccuacaaccuuccuguauaaaguugcaagcaauguguga

SEQ ID NO: 62590 - RNA, 1404 nt, Artificial Sequence
  derived and/or modified sequence opt3 from SLC17A1__Homo_sapiens__NP_005065
augcagauggacaacagacugcccccuaagaaagugccaggcuucugcagcuuuagguacgggcucuccuuccuuguccacuguugcaauguuaucauuaccgcccaacgggcuugucugaacuugacaauggugguaauggucaauucuacugauccgcauggauuacccaacacgucaaccaagaaacugcuagacaauauaaagaacccuauguauaauuggaguccagauauccaggguauuauccucagcuccacaucuuacggcgugauuaucauacaggugcccguuggguauuuuucgggaaucuacucaacuaaaaagaugauuggcuucgcacugugccuuagcagugugcuguccuugcucaucccuccagccgcggguauuggggucgcuugggugguaguuugucgcgccgugcagggagcagcccaaggcaucgucgcuaccgcacaguuugagauauaugugaagugggcucccccucuggaacgaggccgucugacaucuaugagcaccuccggguuccucuuaggaccauuuauugugcugcuugucacugguguuaucugcgagucauugggcuggccgaugguguucuacauuuuuggggccuguggaugcgccguaugucugcuaugguucgugcucuuuuaugacgaucccaaagaccacccuugcaucaguaucagcgaaaaggaguacauuacaucuucccugguccaacaggugucaagcaguagacagucucuuccaauaaaagcgauccugaaguccuugcccguuugggcaauuagcaccggcucguucacguuuuucuggucucauaacaucaugacucucuacaccccuauguucauaaauuccaugcugcacgugaacauuaaagaaaauggguuuuuaucaagucugccauaucucuucgccuggaucugugguaaccuugcuggacagcugagcgacuuuuucuugacaaggaauauccuauccgucauugccgugcggaagcuguuuacugcagcuggcuuccuccugcccgccaucuuuggcguaugccuuccguaccugucuagcaccuucuauucaauuguuauauuuuugauccucgcgggggccacaggaaguuucugccuggguggcguguuuauuaacggguuagauaucgcaccucgcuacuucggauuuaucaaggcuuguuccacccugacgggcaugauuggugggcuaauagccagcacucucacaggccugauccuuaaacaggaucccgagucugcuugguucaagaccuucauuuugauggccgcaaucaaugucacuggacugaucuuuuaucucauuguggccacagcugagauacaggacugggcgaaagaaaagcaacauaccagacuguga

SEQ ID NO: 62591 - RNA, 1437 nt, Artificial Sequence
  derived and/or modified sequence opt3 from SLC17A2__Homo_sapiens__NP_001273052
auggacggcaagcccgccaccagaaaagggccugauuucugcagccugagguacggacucgcucuuaucaugcacuuuuccaacuucacaaugauuacucagcgggugucucugucaauagcaaucauugccauggucaauacgacccaacagcaggguuugaguaacgcgagcacagagggcccaguugcugacgccuuuaauaacuccucuaucucgauuaaggaguucgauacuaaagcaucaguguaucaguggagcccggaaacccaagggaucauauuuaguuccaucaauuacggaauuaucuuaacacugauucccucuggcuaucuagccgguaucuucggggcuaagaaaaugcucggagcaggccugcuuauaagcucccuguugacccucuuuacuccucuggccgcugacuucggcguaauucuggugaucaugguccgcacagugcaggggauggcccagggaauggcguggaccggucaguuuacgauuugggcaaagugggccccaccccucgaacgaucaaaguuaacuaccaucgcuggcagugggagcgccuucggaucuuuuaucauucuguguguuggcggucuuauaucccaagcauugucauggccuuucaucuuuuacauuuucgggagcacaggaugcguguguugccugcuaugguucacugucaucuaugaugacccaaugcaucaccccuguauaagugugcgugagaaagaacauauucucucuucccuggcucagcagccuagcucgccaggcagagccguaccgaucaaggcgaugguuaccugccuuccccugugggccaucuuuuugggcuucuuuucucacuucuggcucuguacaauuauccugaccuacuuaccuacguauauuuccacucugcuccaugugaacauaagggauucagggguccuuaguagccugccauuuaucgcagcugccuccugcacaauuuugggaggucagcuagcugacuuccugcucucucggaaucugcuucgccugaucaccgugagaaaauuguuuagcucacucggccuguuacugcccaguaucugugccguggcacuaccuuucgucgccuccagcuacguuauuacuauaauccuccugauucuuaucccagggacaucuaacuugugcgauucaggauuuauuaucaauacccuggacauagcucccagguacgcgaguuuccucaugggcaucagccgggguuuugggcugauugcaggcaucauuuccucuacggccaccggauuccuuaucucgcaagauuuugagagcggcuggcgcaacguguucuuccuguccgcugccguaaauauguuuggguugguguucuaucucacauuuggacaggcagagcugcaggacugggccaaggaacgaacuuuaaccagacuguga

SEQ ID NO: 62592 - RNA, 1497 nt, Artificial Sequence
  derived and/or modified sequence opt3 from SLC17A3__Homo_sapiens__NP_001091956
auggccaccaagacagagcugagccccacugcuagagaauccaaaaacgcacaggacaugcaaguggaugagacgcucaucccuaggaaggucccaucucuuugcucagcccgguacggcauugcgcugguuuugcacuucuguaauuuuaccacaauagcucagaacgugaucaugaauauuacuaugguagccauggugaacaguaccagcccgcagucccaguuaaaugacucuucggaaguccugcccguggauucauucgggggacuaagcaaagcaccuaagagucucccagccaaagcucccguuuaugacugguccccucaaauccaggguauuaucuuuggcgcagugggguacggaggcauacugacaauggccccaucugguuaucuugcugggcgcgucggaaccaagcgagugguaggcaucagccuguucgccacuuccuuuuugacacucugcauuccccuggcgaccgauuucggcaucguucugcucauugugacgcguaucguccagggguuaucacagaguagcauacugggaggucaauuugcaauuugggagaaguggggcccuccacaggaaagaucuaggcuuuguuccaucgccuugucagggaugcugcuaggaugcuucacugcuauucucaucggcgguuuuaucagcgagacccugggguggccguucguguuuuacauuuucggaggcgugggcugugucugcugucuucugugguuuguugugauauaugacgaucccguaaguuacccuuggaucucuacauccgagaaagaauauauuaucagcucguugaagcaacagguggggucuuccaaacagccacuccccauaaaggccaugcugcggucauuaccuauuuggaguaucugccugggauguuucagccaucaguggcucgucuccacuauggugguuuacaucccaaccuacauuucuagcguguaucacgucaacauccgcgacaauggucuucugucagcauugcccuucauuguggcuuggguaauaggcaugguugggggauaccuagccgauuuucugcucaccaaaaaguucagacugaucacagugaggaagauugcgacgauccuuggcagucugccguccagcgccuugaucgucucucucccuuaucugaacucagguuacauuacugcaacagcuuuacugacccuaaguugcgggcucagcacucugugucaguccggcauauauaucaaugugcuugacauugcuccccgguacucuucguuuuugaugggagccagccgcggcuucuccucaaucgccccagucauugugccuacaguuaguggguuucugcucucucaagaucccgaguucggauggcgaaacguguuuuuccugcuuuuugcaguaaaucuguugggucuccuguucuauuuaaucuuuggcgaagccgacguccaggagugggcuaaagagagaaagcugaccaggcuauga

SEQ ID NO: 62593 - RNA, 1494 nt, Artificial Sequence
  derived and/or modified sequence opt3 from SLC17A4__Homo_sapiens__NP_005486
augagcaccggccccgacgugaaggccacagucggggauaucuccucugacggaaaccugaauguugcucaggaggaaugcucaagaaaagguuucuguagugugaggcacggccucgcacuuauucugcaauugugcaacuuuagcauauacacucagcagaugaauuuauccaucgccauuccugcgaugguaaacaauacggcuccaccgucucagcccaacgccucgaccgagcggccuucaacagauagccaaggguauuggaaugaaacucugaaggaguucaaagcaauggccccagcuuacgacuggagucccgaaauccagggaauuauccuauccucucucaacuauggcagcuuucuggcaccuauaccauccgguuacguggccgggaucuucggagcuaaguaugucgugggcgccggccuuuuuauuucaaguuuccugaccuuguuuaucccccucgcggcaaaugccgggguugcucugcugauugugcuccgcaucguccagggaauagcccaggugaugguauuaacaggucaauacagcauuuggguuaaaugggcaccuccacuggagcgaucucagcuuaccacuaucgcuggcuccgggucaauguuggggagcuucauugugcugcuagccggcggucuccugugucagacaaucggguggccguaugucuuuuacaucuucggaggcauuggcugcgcguguugcccccuuugguuuccucugauauacgaugacccagugaaccaucccuucaucagugccggggagaagcguuauauuguguguucuuuggcacagcaagauugcuccccuggauggagccucccaaucagagcuaugauaaagucgcugcccuuaugggccauucuggucucuuacuuuugugaauauuggcuguucuacaccaucauggcuuauacgccgacuuacaucuccucaguucuucaggccaaucugagggacagugguauuuugagcgcacuaccuuucgugguaggcugcaucuguauuauacugggaggacuccuggccgauuuucuucugucccggaaaaucuugcgccucauuaccaucagaaagcuguucacagcuaucggcguguuauuucccucugucauucuggugagccuaccauggguuaggucaagucacuccaugacuaugaccuuccucgugcugagcucugcgauaucaaguuuuugcgagagcggugcacuugucaacuucuuggacaucgccccucgguauacaggguuucugaaaggccuccuccagguguucgcucauauugccggagcaaucucccccaccgccgcuggcuuuuucauuucucaagauucggaauuuggguggcgcaauguauuccuucugagcgccgcaguuaacaucuccggauugguguuuuaccucauauucggucgagcggacguccaggauugggcuaaggagcagacguucacucaccuguga

SEQ ID NO: 62594 - RNA, 1488 nt, Artificial Sequence
  derived and/or modified sequence opt3 from SLC17A5__Homo_sapiens__NP_036566
augagaagccccgugagggaccuggcccggaacgauggcgaggaauccaccgaccgcacaccucuccuuccaggggcuccgcgagcagaggccgcgcccgucugcuguucugcucguuacaaucuggccauuuuggcauucuuuggauucuuuauuguuuaugccuuaagagugaaccugucaguagcucuaguggauauggucgacaguaauacuacgcucgaagauaacaggaccagcaaggcaugcccugagcacuccgccccaauaaaagugcaucacaaucagacagguaagaaauaccaaugggacgcugaaacucagggcuggauccuggggucuuucuuuuauggauacauuaucacccagauucccggcgguuauguugccucgaagaucgggggaaaaaugcuucugggcuucggcauauuggggacagcggugcucacccuguuuacuccuaucgcagccgaucugggagucgguccacucauuguguuacgggcucuggagggccuuggggagggaguaacauuccccgccaugcaugcaauguggucaagcugggcuccuccauuggaacgcaguaagcugcuauccaucucuuacgccggcgcgcagcucgguaccguuauuagccugccgcuuuccgggaucauauguuauuacaugaacuggacguacguguuuuauuucuuuggaacuauuggcaucuucugguuucuguuguggauuuggcucgucucagacacaccccaaaagcacaaaagaaucagucauuacgagaaggaauauauccugagcucuuuaaggaaucagcuguccucacagaaaagcgugccuugggugccaauucucaagagucuuccccugugggccauagucguugcacacuucucuuacaacuggaccuucuauacuuugcuaacccugcucccuacauacaugaaagagauccugcgguuuaaugugcaggagaacggcuuccuuuccagccugccauauuuggggucguggcucugcaugauucugucuggacaagcugccgauaauuuacgcgcuaaguggaacuuuuccacccuguguguacgaagaaucuucucacuaauagguaugauuggccccgccguguuucucgucgcagccggguucaucggaugcgacuacagucuggcuguggcguuucuuacgaucagcacuacauugggcgguuucuguuccucuggguuuagcauuaaucaccuggauaucgcaccgucauacgccggcauucuccugggaauaaccaacacuuucgcuacaaucccuggcaugguugggcccgugauugccaagagucuuaccccagacaauacggucggagaauggcagaccguguuuuauaucgcagccgcuaucaacguauucggugccaucuuuuucacacuguucgcaaaaggcgagguucagaacugggcguugaaugaucaucacgggcauaggcacuga

SEQ ID NO: 62595 - RNA, 1749 nt, Artificial Sequence
  derived and/or modified sequence opt3 from SLC17A6__Homo_sapiens__NP_065079
auggagagcgugaagcagagaauccuggcccccggcaaagaagggcucaagaacuucgcuggaaaaucccuuggucaaauuuacaggguccuggagaagaaacaggacaccggcgaaacaauagaguugacugaagaugggaagccuuuagagguuccagagcggaaggcaccgcugugcgacuguacgugcuuuggacuaccccgccgauauaucauugccaucaugucuggccucgguuucuguauuucauuugggauccguugcaaucugggaguggcgauaguagauauggugaacaauaguaccauccacagaggcggcaaagucauuaaggaaaaagcuaaguucaacugggacccugagacaguggggaugauccaugguagcuuuuucuggggauacauuaucacucagauaccaggcggguauauugccuccaggcuugcagccaaucggguuuuuggagcugcaauccuguugaccucuacacucaacaugcugauucccucggccgcucgcgugcacuacggcugugucaucuucgugagaauccugcagggucucguagaagggguuaccuauccugccugccauggaauuuggucaaaaugggcgccacccuuagagaggagccggcuggcaacuacaaguuuuuguggcuccuacgccggcgcugugauagccaugccucuugcagggaucuugguccaauauaccggauggucuagcguguucuacguguacgguuccuuuggcauggucugguauauguucuggcugcuaguuucauacgagaguccagcuaagcacccgacgauuacugaugaggaacgccgauauaucgaagagagcauaggggaaucugccaaucuccugggagcgauggagaaguuuaaaacccccuggagaaaguucuucacauccaugccuguguacgccauuaucguagcaaacuuuugcaggucauggacuuucuaucuucuguugaucagccagccagcuuacuuugaggaaguguucggcuuugagauuaguaaagucgguaugcucucugccgugccccaucugguuaugaccaucauugugccuauagggggccagaucgcugacuucuuacgguccaagcagauucugagcacaaccacgguccguaaaaucaugaauuguggaggcuuugggauggaagccacucuccuucuggugguaggauauucgcacacacgcgguguugcaaucucuuucuuggugcuagccgucggcuuuuccggguucgcuauuucaggauuuaacgugaaucaccuggauauagcgccaagauacgcaaguauccucaugggcauuagcaacggugucgggacccuguccggcauggugugccccaucauuguuggagccaugacuaagaauaaaucuagggaggaauggcaauacguguuccuuaucgcugcccugguacauuauggcggggucauauuuuacgcaaucuucgccagcggagagaagcagccgugggcugacccugaggaaacaucagaggaaaagugugguuucauucacgaggaugaauuggacgaggagaccggcgauaucacgcagaacuauauuaauuacgggaccacaaaaaguuauggagccacuacccaggcaaacggcgguuggcccuccgggugggaaaagaaagaggaauuugugcaaggcgagguucaggacagccauucuuacaaggaucggguggacuauucauga

SEQ ID NO: 62596 - RNA, 1683 nt, Artificial Sequence
  derived and/or modified sequence opt3 from SLC17A7__Homo_sapiens__NP_064705
auggaguucagacaggaagaguuuaggaagcuggccggccgggcucucgggaaacuucaccgccuguuggaaaagcgacaagagggagcagaaaccuuagagcugagcgccgacggucgucccgugacaacucagacgagagauccuccagucguugacugcaccuguuucggccuaccgaggcgguacaucauugcgauaauguccgggcucggauuuugcaucucuuucggcauucgcuguaaccuggguguggcuaucguaucaauggugaauaacaguacaacucauagagggggacacgucgugguucagaaagcccaguuuagcugggaucccgagaccgugggccuuauucauggcuccuucuuuuggggguauaucgucacacaaauaccuggagguuucaucugccagaaguuugcagccaauaggguguucggcuuugcuauuguagcaaccucuacucugaacauguugaucccaucggccgcucggguucacuacgggugugugauuuucguccgcauccuccagggacugguggaaggcgugacauaucccgccugccaugguauauggucaaaaugggcgccuccacuggagcgaagcagacucgcaaccacggccuuuugugggaguuacgcuggagccgucguugcaaugcccuuagcuggcgugcugguacaguauuccggcuggucuagcguguucuacgucuauggguccuucggaaucuuuugguaccuuuucugguugcuggugucauacgaaaguccugcccuacacccaagcauuucugaggaggaaaggaaguauauugaggacgcgaucggugaauccgccaagcucaugaauccgcugacuaaauuuucaacccccuggcggcguuucuuuacaagcaugccuguuuacgcaaucauuguggcuaacuucugccgcaguuggacuuuuuaucuucuguugauaucucaaccagccuacuucgaggaagucuuuggcuucgagaucuccaagguggggcucguaagcgcucugccccacuuaguuaugaccauuaucgugccuauaggaggccagauugccgauuuucugagaucgaggcggaucaugucuacaaccaauguccgaaaacucaugaacugugguggguucggcauggaggcaacgcuucuguugguggucggauauucccauucaaagggcguggccaucaguuuucuaguucuggcugugggguucagcggauucgcgauuuccgguuuuaauguaaaccaccucgacaucgcaccacgcuacgccucuauucugaugggcauaagcaauggggucggaacucuuucaggcauggugugccccaucauuguuggugcuaugacaaaacauaagaccagagaagaguggcaguauguguuccugaucgccaguuugguccacuacgggggcgugaucuuuuacggaguauucgcauccggcgaaaagcagccgugggccgagccugaagagaugagcgaggaaaaauguggguuugugggacacgaucaacucgcugguucugacgauucagagauggaagacgaggccgaacccccaggcgcaccucccgcgccacccccuaguuauggggcuacucauagcacauuccagccaccgaggcccccuccacccguucgggauuacuga

SEQ ID NO: 62597 - RNA, 1620 nt, Artificial Sequence
  derived and/or modified sequence opt3 from SLC17A8__Homo_sapiens__NP_001138760
augcccuucaaggccuuugacaccuucaaagagaagauccugaaaccuggcaaggaaggggugaaaaacgcugucggagauagccucgguauucuucagagaaagauagacggcacaacugaggaagaggauaauaucgaacugaacgaggaggggaggccaguucaaacgucccggccgucucccccuuugugcgacugucacugcuguggauuaccaaagcgcuacauuaucgcaauuaugucaggccuggguuuuugcaucaguuucgggauacgauguaaucuaggaguggccaucguagaaauggugaacaauagcaccgucuauguggauggcaaacccgagauucagacagcgcaguuuaacugggacccugaaacuguuggccucauccauggguccuucuuuuggggauacauuaugacccagaucccagguggcuucauaucuaauaaguuugcugccaaccguguguucggggcagccauuuuucugacaucgacccuuaauauguucauccccucagcugcaagaguccacuauggaugcgugauguguguaaggauucugcaaggcuugguugagggugugacuuacccugccugccaugggauguggagcaaaugggcuccaccgcucgagcggagucgccuggccacaaccuccuuuuguggaucuuaugcgggcgcagucguggccaugccccuggcuggcgugcucguccaguacaucggguggagcuccguuuucuauaucuacggaauguucgguauuauaugguacauguuuugguuacugcaggccuaugaaugcccugcagcucacccaacgaucucaaacgaggaaaagacuuacauugagaccaguaucggcgaaggggccaaugugguaagccuuucugugggauugcuguccgcggucccccauauggugaugacaauaguugugccuauuggcggucagcuagccgauuaucucagaucaaggcaaauccugacuaccacagcaguccggaaaaucaugaacugugggggcuucggaauggaggcuacccuucuguuggugguaggcuuuagccacacgaaggggguugccauuaguuuccucgugcuggcugucggauuuucugguuucgccaucuccggcuuuaaugugaaccacuuagacauugcaccacgcuacgccagcauacugauggggaucucgaauggagucggcacucucucugguauggugugcccccuuauuguuggggcuaugacacgacauaagaccagagaggaauggcagaacguguuccugaucgcggcauugguacacuauuccggcgucaucuuuuacggaguguucgccucaggcgagaaacaggaaugggcugauccggagaaccuaagugaagagaagugcgggauuauagaccaggaugagcuggccgaagagaucgaacucaaucaugagagcuuugcauccccuaaaaagaaaaugucuuauggagccacuagccaaaacugugaaguucagaagaaagaguggaagggucagaggggcgcuacacuggacgaggaagaacuuaccucauaccaaaaugaggagcggaacuucaguacgauuuccuga

SEQ ID NO: 62598 - RNA, 1578 nt, Artificial Sequence
  derived and/or modified sequence opt3 from SLC18A1__Homo_sapiens__XP_011542926
augcugagaaccauccucgacgcuccccagaggcuucugaaggagggccgggccagccgccaauugguguuagucguuguguucguagcacugcuacucgauaacaugcuguuuacaguggucgugccuauuguuccaacuuuccuuuacgacauggaauuuaaagaggucaauuccucucugcacuuggggcaugccggaucaaguccgcacgcgcucgcuagccccgccuucuccacgauauuuucuuucuuuaacaauaacaccguggcaguggaagagucgguaccuucagguaucgccuggaugaaugauacagcuagcacuauuccacccccugcaaccgaagccaucagugcucauaagaacaauugccugcagggcacaggguuccuggaggaggaaauuacccgaguuggagugcucuuugccuccaaagcggucaugcaguuacuggugaacccauucgugggcccccuuacuaaucguaucgguuaucacauaccuauguuugcaggguucgucaucauguuuuugucuacaguuauguucgccuucagcggaaccuacacgcugcuauuuguggcuagaacucuccagggcauuggcuccucauucaguagcguagccgggcugggaaugcuugcaucuguguauaccgacgaucaugagaggggucgggcuaugggcacagcccugggaggguuggcgcucggccuguuagucggugccccauuuggguccgugauguacgaguucguuggaaagucagcaccguuucugauccucgcuuuccuugcccuguuggacggcgcucuacaacuguguauucuccagcccagcaaagugaguccugaaucugccaagggcacuccacuguuuaugcuucugaaggaucccuauaucuuggucgcagccggguccauaugcuucgcuaacaugggaguggcgauucucgagccuacccugccaaucuggaugaugcagacaauguguagccccaaauggcaguuaggucuggcauuucuaccggccucgguaucuuaccucauuggcaccaaucuguucgggguucuugcuaacaagaugggacgcugguugugcucccugaucggcaugcucguggucgguacgucacugcuuugugugccucuggcccacaauaucuuuggguugauuggccccaacgcaggacucggccuggccauagggauggucgacaguagcaugaugccaaucaugggacacuuaguggaucugagacauacuuccguuuaugguucuguguacgcuauugccgacguagcauucugcaugggcuuugcgaucgggccuagcacaggaggcgcuauagucaaagccauugguuuccccuggcuaauggugaucaccgggguuaucaauauuguguacgcaccacucuguuauuaccugaggucacccccugccaaggaagagaaacuugcuaucuugagucaagauugcccaauggaaacucggauguaugccacacagaagccgaccaaggaguucccccugggcgaagacuccgaugaggagccugaccacgaagaguga

SEQ ID NO: 62599 - RNA, 1545 nt, Artificial Sequence
  derived and/or modified sequence opt3 from SLC18A2__Homo_sapiens__NP_003045
auggcccugagcgagcucgcucuugugagauggcugcaggaauccaggcggucucgcaaguugaucuuauucauugucuuucuggcacuacuccuggacaacaugcuucugaccguugugguacccauaaucccuucauacuuguauaguauuaaacacgagaagaaugccacagaaauccaaacugcgcgaccagugcauacggcuagcauuuccgauucuuuccagucgaucuuuucauacuaugacaacagcaccauggucacaggcaaugccacucgugaucucacccugcaccagacagcaacccagcauauggugacuaacgccagugcuguuccguccgacugccccucugaggauaaagaccugcucaaugaaaacgugcaagucggguuacuguucgcaagcaaggccacagugcagcuuauaaccaauccuuuuaucggauugcugacgaacagaauugguuacccaauccccauuuucgcuggcuuuuguaucauguucguauccacuauaauguuugccuucucaaguagcuaugcguuucuacucauugcaaggucucugcaggggaucggauccucaugcagcaguguugccggcauggguaugcuugcuucuguguacaccgaugacgaggagcgggggaaugucaugggaauugcccugggcggcuuggcaaugggggugcucgugggaccuccauucgguuccguccuguaugaauuuguuggcaaaacagcucccuucuuagugcuggccgcgcucguacuucuggauggggccauccaguuguucgugcuacaaccuagccgcguccagccagagucgcagaagggaacuccgcugaccacacuccugaaggaccccuacauccuuauugcagcuggcucuauauguuuugccaacauggguaucgcuaugcuggaaccugccuugccaauuuggaugauggagaccaugugcuccagaaaauggcagcucgggguggcauuccugcccgccucaaucaguuacuuaauaggaacgaauauuuuuggcauccuggcucacaagauggggagguggcuaugugcgcuccugggcaugaucauuguuggagugagcauccuuugcauuccuuucgccaaaaacauauaugguuugaucgccccaaauuuuggcgucggguucgcuauuggaaugguggauuccucuaugaugcccaucaugggcuaccugguagaccuccggcauguuagcguguaugguucagucuacgccaucgcagauguggccuuuuguaugggguaugcuauuggcccgagugccggaggcgcaauagcgaaggcuaucggguucccuuggcugaugacuauuaucggaauuaucgacauacuuuuugcaccccugugcuucuuuuugcgcuccccuccagcaaaagaggaaaagauggccauccucauggaccacaacugucccauuaagacaaaaauguacacccaaaauaacauccagagcuauccaauuggugaggaugaagagucugaaucagacuga

SEQ ID NO: 62600 - RNA, 1599 nt, Artificial Sequence
  derived and/or modified sequence opt3 from SLC18A3__Homo_sapiens__NP_003046
auggagagcgccgaacccgcuggccaggcaagagccgcggcuaccaagcuguccgaggccgugggggcagcccuccaagaaccuaggcggcagcgccgacuuguccugguuaucgugugcguagcuuuguuacuggacaacaugcuauacauggugauugucccaauagugccggauuauaucgcacacaugcguggagguggcgaggggcccacaagaacuccugaaguuugggagccaacgcucccccugccuaccccagccaaugcuucugccuacacagcgaacacuucagcaagucccaccgccgcuuggccugccggaagcgcacuuaggccacgguauccgacagaguccgaagacgugaaaauuggcguccuguucgcuucuaaggccaucuugcagcuccuggugaauccccugucggguccuuuuauugaucgcaugucauacgacguaccacucuuaaucgggcugggaguuauguucgcgagcaccgugcuuuuugccuucgcagaggauuaugcuacuuuguuugccgcuagaagucugcagggccuaggcuccgccuucgcagacacaucugggauagccaugaucgcugauaaauaccccgaagaaccugagaggagccgggcgcucggagucgcacuggccuuuauuuccuucgguucacuuguggcuccacccuuuggcgggauccuguaugaguucgccggaaagcgcgugccguuuuugguccucgcagccguuagucuguucgacgcuuuacugcuccuugccguggcaaaaccuuuuagcgcggcugcccgagcaagagccaaccugcccguaggcaccccaauucauagguugaugcuagauccuuacaucgcuguggucgccggugcacugacgacuuguaauauaccccucgcuuuccuggagccaaccauugccacauggaugaagcacacuauggcggccucugaaugggagauggggauggcuuggcuucccgcauucgugccucauguucugggaguguacuugaccguccggcucgccgcucguuauccacaucugcaaugguuauacggcgcccugggccuagcagugaucggggcguccucaugcauuguaccggccugucgcagcuuugcuccccucguugugagucugugcggacuuuguuucgguaucgccuuggucgacacagcacugcucccuacccuggcuuuucuuguggaugucagacacgugucuguuuauggcuccguguacgccaucgcagacauuagcuauucgguagccuacgcucuggggccaauagucgcgggacacaucgugcacucuuugggcuucgaacagcucucccuggguaugggguuagccaaccugcuauaugcacccguucuccugcuuuugaggaaugugggccugcucacgcggucacgaagugagcgcgauguccuguuagacgagccuccacagggacuguacgacgcugugagacuuagggaacggcccguaagcggccaggauggggagccgcgcuccccuccaggacccuuugacgccugcgaagaugacuacaacuauuacuauacuagaucuuga

SEQ ID NO: 62601 - RNA, 1470 nt, Artificial Sequence
  derived and/or modified sequence opt3 from SLC19A1__Homo_sapiens__NP_001192135
auggugcccagcuccccugccgucgagaagcagguuccaguggaaccgggccccgacccugagcugagaucuuggaggcaccucguaugcuaccuuuguuucuauggguuuauggcucaaauccggccaggagaaucauucauuacccccuaccuguuggguccugauaaaaacuuuacacgcgaacaggugacuaaugaaauaacgccagucuuaaguuauagcuaccuggcagugcuaguucccguguuccuccugaccgacuaucuucgauacacaccuguccuguugcuccagggccuguccuuugugucuguauggcugcucuuacugcuugggcauucgguugcccacaugcaguugauggagcuguucuauucagugacuauggcggcucguaucgccuacagcaguuacaucuuuucccuagucagaccagcaagguaucaacggguggccggauacucucgcgcugcagugcuccugggcgucuucaccagcuccguucuuggucagcuguuggugacaguagggagagugucauuuaguacccucaacuauauuagccuggccuucuuaacuuuuucugucgugcuggcucucuuccuuaagaggccgaaacggucccuguuuuucaaucgcgaugaccgaggaagaugcgagacaucagccagcgaauuggagaggaugaaccccggcccuggcgggaagcuaggacaugcgcugcggguugcauguggugauagugugcucgcccguaugcugcgcgaacuuggcgacucucugagaaggccacaguugcggcucuggucccuguggugggucuucaauagcgcuggguacuauuuagugguauacuauguucacauucuguggaacgagguggaucccaccacuaauucggcccgagucuacaacggagcagcugacgccgcgucuacgcuacucggcgccaucaccuccuuugcagcugguuucgugaaaauacgcugggccagauggucaaagcugcuuaucgcuggggucacagccacucaggcaggauugguguuucugcucgcccauaccaggcacccuaguagcauuuggcugugcuacgcugcguucguucuuuuucggggcuccuaucaauuccuggugccaaucgcaacauuucagauugccucuagcuugucaaaggagcucugugcucugguauucggcgucaauaccuuuuucgccacgaucgugaaaacuauaauuacauuuaucguuagugaugugcgcggguuaggacugcccgucagaaagcagaacgaggagcuacacguggcaucccucagccuguggaaaucucaucuuagguuggccgcugacacccugucaagugaagguagcuccggcucugggccgcguucgugguuccucagcccuacucugcgggccgcauuacacggacccguaugcccauccgagguguguccuucauga

SEQ ID NO: 62602 - RNA, 1494 nt, Artificial Sequence
  derived and/or modified sequence opt3 from SLC19A2__Homo_sapiens__NP_008927
auggacgugcccggcccugucagcagaagggccgcugcagccgcggcuaccguucugcuccggacagcccgcgugcgacgugagugcugguuccuuccaacugcacuguugugugccuacggguuuuucgcuuccuuaagaccgucugaacccuuucugacgccuuaucuacucggaccagauaagaaccugaccgagagggaaguauucaaugagaucuaccccguguggacauauucauaccuuguccuguuguuuccuguguuccucgcaacugacuaucugcgguacaaaccaguugugcugcuccaggguuuaagucugauugucaccugguuuaugcuuuuguaugcccaaggccugcuagcuauacaguuccucgaauuuuucuacgggaucgccacagcgaccgagauugcauacuauagcuacaucuauuccgugguagaucugggaauguaccagaagguuacuucuuauugccgcucggccacacuugugggcuuuaccgucgguucagugcuggggcagauuuuggugagcgucgcuggauggagucucuucucccugaacguuaucucuuuaacgugugugagcguagccuuugcaguggcuugguuccugcccaugccucaaaaaucccucuucuuucaccauauaccaucaacuugccagagagucaauggcaucaaggugcagaacggcgggauuguuaccgacacaccggccaguaaucaccuucccggaugggaggauaucgaaagcaaaauuccucugaacauggaggaaccacccguggaggagccugaaccaaagcccgacagguugcuaguccugaaggugcucuggaaugauuuccugauguguuacucuucccggccgcuucugugcuggucaguauggugggcguugagcacuugugguuauuuucagguugugaacuacacccaaggccucugggagaaagucaugccuagucgcuacgccgcaaucuauaaugggggaguggaagcugucucuacacuguuaggcgccguggcuguuuucgccguggguuacauaaagauuuccuggagcaccuggggagagaugacgcugucgcuauuuucucuccugaucgcagccgcuguauauauuauggacacugucgggaacaucugggugugcuacgcguccuauguuguguuccgaaucauuuacaugcuuuugauaacaaucgcaaccuuucagauugccgcuaaucugucaauggaaagauaugcccucgucuucggcgugaacacuuuuaucgcacuggcccuucagacacuguugacccucauaguaguggaugcuaguggccugggguuagagauuacgacccaguuccugaucuacgccagcuacuuugcacuaaucgcgguugucuuccucgcuuccggagccgugucugugaugaaaaaguguaggaaacuggaggacccccaaagcucaagucaggucacaacuuccuga

SEQ ID NO: 62603 - RNA, 1479 nt, Artificial Sequence
  derived and/or modified sequence opt3 from SLC19A3__Homo_sapiens__XP_005246931
augaacccccugggcagcgccuccagagcuaccguggaccagcucacagaucuuccuucuaaggagcaacugucaugcgucguuuucgcauuguggccaccggccuuuaguagcaauuuauccgaccccggggugaaaaucacuaacgaaauuuucccuguauggacguacucuuaucuggugcuacuccugccagucuuugugcuuaccgauuacguuagguauaagcccgugauaauccugcagggaauuucguucaucauuacaugguugcuccugcuguuuggucagggcgucaaaacuaugcaagugguagaguucuuuuacgggaugguuaccgcggcugaaguggccuauuacgcauauaucuacucagucgugagcccugagcacuaccagcgggugaguggauauugucgcuccgucacacucgccgcuuacaccgcaggcucuguuuuagcccagcugcuugugagcuuggcuaauauguccuauuucuaccugaacguaauaucacuagccagugugagcgucgcguuucucuucucucuguuucuuccaaugcccaagaaauccauguucuuucaugcaaagccuucacgagaaaucaagaaaagcaguucugugaauccaguucuggaggagacucacgaaggugaggccccggggugcgaggaacagaagcccacauccgagauuuugagcaccucgggaaaacucaacaagggccaguuaaauucucugaaaccuuccaacgugacggucgacguguucguacaaugguuccaggaucugaaggaauguuauucaaguaagcgucucuuuuacuggagccuuuggugggcuuucgccacugcaggcuuuaaucagguucugaacuaugugcagaucuugugggacuacaaagcuccaucccaagauucuagcauuuacaauggggccgucgaggcgaucgccaccuucggaggugcaguggcugccuuugcugucggcuaugugaagguuaacugggaccuacugggggaacucgcccuggugguauucucagucgugaaugcaggaagucuuuuucugaugcauuacacagccaacauaugggcuugcuaugcgggcuacuugauuuucaaauccagcuauaugcuccugaucacuauugcaguuuuucagaucgccgugaauuuaaacgucgagagauacgcucugguguucgguaucaacaccuuuauugcccuaguaauacagacaaucaugaccgugauuguugucgaucaaagggggcucaaucugcccgugucuauccaguuccuuguguauggaucauacuuugcagucauagccggcauuuucuugaugcggaguauguacaucacguauagcacuaagucccagaaagacguucagucuccugcuccaucggaaaaccccgaugugagccacccggaggaggaauccaauaucauuaugucaacaaagcuguga

SEQ ID NO: 62604 - RNA, 1575 nt, Artificial Sequence
  derived and/or modified sequence opt3 from SLC1A1__Homo_sapiens__NP_004161
augggcaagcccgccagaaaagggugcgaguggaagagguuccugaaaaacaauugggugcuccuuagcaccgucgcugcaguugugcugggaaucacaacugguguauuggugcgggaacacuccaacuuaucuacgcuggagaaguuuuacuucgccuuuccuggcgaaauucuaaugcgcaugcucaaacugauaauccuuccacugauuaucucaaguaugauuaccggggucgcggcuuuggacagcaauguguccggaaagaucggccuccgagccguuguguauuacuucuguacaacucugauagcagucauccuggguauugugcucguaguuucuaucaagccgggggugacccagaaagucggagagauugcccguacaggcucgacccccgaagugucaacuguggaugcuauguuagaccugaucagaaacauguuuccugagaaucuuguccaagcaugcuuccagcaguauaagacaaaaagggaggaaguuaagccacccagcgauccugagaugaacaugaccgaagagaguuuuacggccgugaugacuaccgcuauauccaaaaauaagacaaaggaguacaaaauuguaggcauguauucugacgggaucaacguguugggacugauugucuucugucuaguguuuggucucguuaucggcaagaugggggaaaaaggacagauccugguggauuucuuuaaugcccuuagcgacgcgacuaugaagauuguccaaauaaucaugugcuacaugccacugggcauuuuguuccucaucgcagguaaaauaauugagguggaagauugggagaucuuucggaagcugggguuauauauggccaccguacugacaggacucgcuauccauuccauuguuauccuuccccugauuuacuucauagugguccgcaaaaacccuuucagauuugccaugggcauggcacaggcuuugcuaaccgcccugaugaucucaaguagcucugcgacgcucccagugacuuucaggugugccgaagagaauaaccaggucgacaagcggauuacacgcuuugugcugccgguuggcgcaaccaucaauauggaugggacugcucuuuacgaggccguggcugccguauucaucgcacagcugaacgacuuggaucucggaauuggucaaauaaucacaauuuccaucaccgccacgucagcuagcauuggcgcggcaggggucccccaggccggacuggugaccaugguuaucguguuaagugcugucggccugccugccgaagacgugacacuaauaaucgcaguagauuggcuccuggaccgauuuagaacuauggugaauguucuuggugacgccuucgggaccggcauugucgagaaguugucuaaaaaggaacuggagcagauggauguguccagcgaagugaacaucgucaacccauuugcucucgagucgacaauucuggacaaugaggauucugacacuaaaaaguccuauguuaacggaggcuucgccguggauaaaucagacaccaucaguuuuacacagaccagccaauucuga

SEQ ID NO: 62605 - RNA, 1698 nt, Artificial Sequence
  derived and/or modified sequence opt3 from SLC1A2__Homo_sapiens__NP_001182657
augcccaaacagguggaggucagaaugcacgacagccaucugggcuccgaagaaccuaaacacaggcaucucgggcuucggcugugcgauaaguugggaaagaacuuacugcuaacccucacaguuuucggugugauccugggcgccguaugugggggacuucugcgcuuggcuucuccaauucacccggacguggucaugcucauagcauuucccggcgauauccugaugcgaaugcugaagaugcucauuuuaccucugaucauuucaagucuuaucacugguuugagcgggcuggacgccaaagcguccggacgucuaggcacgagagcuaugguguacuauaugucuaccacaauaaucgccgcaguucucggcgugauucugguccuugccauccauccagggaaucccaagcugaagaaacaauugggaccugguaagaaaaacgaugaagugucgucacucgacgcuuuccuggauuuaauuaggaaucuguuuccagagaaccucguacaggcaugcuuccagcagauccaaacuguuaccaagaaagugcuugucgcucccccuccagacgaagaggccaaugccacaagcgcgguggugagucuguugaacgagaccgucacugaaguuccggaggaaacaaagauggugauaaagaaaggccuagaguuuaaggaugggaugaauguacugggacucauuggcuucuuuaucgcauucgguauugccauggggaaaaugggagaccaggcuaagcugaugguggacuuuuucaacauccuuaaugagaucgucaugaaacuggugauuaugauaaugugguacucccccuugggcaucgccugucucauuugcggcaagaucauagcaauuaaagaucuggaaguuguggcucggcaguuagggauguauauggucaccgugaucaucggacugauuauccacgguggcauuuuucuaccucucauauacuucguaguuacgcgcaagaacccauuuucuuucuucgccgggaucuuucaggcguggauuacugcccugggaaccgcaagcuccgcuggcacacuucccgugacuuucagauguuuggaggaaaaucuggguaucgauaagagggucacccgguuugugcucccugucggggccacaaucaacauggacggcaccgcucuguaugaggccguggcagccauuuucauagcucaaaugaauggaguugugcuugacggcgggcagaucguaacggucucacugacugcgacauuggcaagugugggagccgcuagcauuccaucugccggucucguuaccaugcuguuaauccugacugcagugggccuacccacagaagauauuucccuccuggucgccguggacuggcuuuuggaucgcaugcgaaccucaguaaacgugguuggggacagcuuuggagcuggcaucgucuaccaccugaguaaaucugagcucgauacgauagacucccagcauagagugcacgaggauaucgaaaugaccaagacacagagcauuuaugacgauaugaaaaaucauagggagucgaacucuaaccaaugcguguacgccgcacacaauuccgucaucguugacgaauguaaggugacucuggcggcuaacgguaaaucagccgauugcaguguggaggaggagccguggaagcgggagaaguga

SEQ ID NO: 62606 - RNA, 1494 nt, Artificial Sequence
  derived and/or modified sequence opt3 from SLC1A3__Homo_sapiens__NP_001160167
augaccaagagcaacggcgaggaacccaaaaugggagggagaauggagagguuccagcaaggugugcggaagcgcacacugcucgccaaaaagaaaguccagaauaucacuaaggaagacguuaaguccuaccuuuuucgaaacgcuuucgugcuguugacgguaaccgcagugauugucggcacaauauuaggguuuacucugcguccuuauagaaugucuuacagggaggugaaauauuucucauuuccaggagaacuacucaugcggaugcugcagaugcuuguucugccguugaucauuaguagccucgugaccggcauggccgcgcuggauuccaaggcuucugguaaaauggggaugcgcgccgucguguacuauaugacaaccacuaucauugcaguaguuaucggaauaaucauugugaucauuauccaccccggcaagggcacaaaagagaauaugcauagagaggggaagauagucagggugaccgccgcugacgcauuccuggaucucauucggaacauguuuccuccaaauuuaguggaagccugcuucaagcaguuuaaaacgaacuacgagaagcgcucguucaaaguccccauccaagcuaaugaaacucugguuggagccgugauuaacaauguaucagaggcgauggagacccuuacacgaaucacugaagaguuggugccugucccagguagcgugaacggcguuaaugcacuggggcuaguggucuuuaguauguguuucggauuugugaucggcaacaugaaggaacagggucaggcccucagagaguucuucgacucccugaaugaagcuauuaugaggcuuguagccguuauaaugugguaugcacccguggggauccuguuuuugauugcuggaaaaaucgucgagauggaggauaugggcgugauaggcgggcagcucgccauguacaccgucacagugauuguuggacuguuaauccacgcggugaucguacugccucuccuuuacuuccuggucacccggaagaacccauggguguuuauugguggcuugcuacaagcccugaucacggcacucgggacuucuagcuccucagcuacacugccgauuaccuucaaaugccuugaagagaauaacggaguugacaagcgugugacucgcuuuguccugcccgugggcgccacaauaaacauggaugguaccgcuuuguaugaagcccucgcagccaucuucauugcucagguaaauaacuuugagcugaauuucgggcagaucaucacgauuagagacagguuacggaccacaacuaacgugcugggcgauagucuaggagcgggcauaguugaacaucucagccgacacgagcugaagaaucgcgacgucgagauggggaacucugugaucgaagagaaugaaaugaaaaagccuuaccagcuuauugcacaagauaacgagaccgaaaaaccaaucgacuccgagacaaagauguga

SEQ ID NO: 62607 - RNA, 705 nt, Artificial Sequence
  derived and/or modified sequence opt3 from SLC1A4__Homo_sapiens__NP_001180422
augaacauccugggccucgugcuuuucgcccuggucuuggggguugcuuuaaagaaacugggaagcgagggugaagaccuaauuagauuuuucaauucccucaacgaggcaaccauggugcugguaucuuggauaaugugcucagccacacuucccaguaugaugaaguguaucgaagagaauaacggcguggauaaaaggauuagccgguuuauccugccuauuggggcgacugucaauauggacggagcugccaucuuccagugcguggcagccguuuuuauagcucaauugaacaauguggaacucaacgcaggccagaucuucacgauucuggucaccgccacagcuuccucugugggugccgcggggguaccagcaggaggcguucugacuaucgccauuauccucgaggcuauaggcuuaccgacccacgaucugccccuuauuuuggccguggacuggaucgucgaucgcacaaccacuguggugaaugucgagggggacgcacugggagcugguauucuacaucaccucaaccagaaggccaccaaaaagggcgaacaggagcuggcggaaguuaagguggaggccaucccuaauuguaaaucggaggaagagacaucaccacuuguaacgcaucaaaaccccgcagggccuguggcuagcgccccagaacuggagaguaaggaauccgucuuguga

SEQ ID NO: 62608 - RNA, 942 nt, Artificial Sequence
  derived and/or modified sequence opt3 from SLC1A5__Homo_sapiens__NP_001138616
augaacauccugggccucguggucuucgccauuguuuuugggguggcucuuagaaagcugggacccgagggugaauuguuaauaagguucuuuaauagcuucaacgaggcaaccaugguacugguguccuggaucaugugguacgccccugucggcauuauguuucuaguggcggggaaaaucguugaaauggaggacgugggacuccuguucgcucggcuuggcaaguauauucugugcuguuugcucggucacgccauccaugggcugcugguccucccauuaauauacuuucuguucacacgcaaaaauccguaucgauuucuuuggggaaucgugacucccuuggcaacggccuucggcaccucuucaaguagcgcuacacugccucuaaugaugaagugcguagaagagaacaauggcguugcaaaacacauuucccguuuuauccucccaauuggggccacugugaacauggauggagcugcccuguuccagugugucgcggcaguguuuaucgcccaacuuucucagcagucgcuggacuucgugaagauaauuaccaucuuggucacagcuaccgccucaagcguuggugcagcuggcauucccgccgggggagugcucacucuggcgaucaucuuagaggccguaaaucugccuguggaucauauuagucucauacuugcagucgacuggcugguggauagauccugcacaguuuugaacguggaaggcgacgcucuaggugccgggcugcuccagaauuacgucgauaggaccgagucucggagcacggaaccagagcugauccaagugaaguccgagcuuccccuggacccuuugccaguaccgacugaagagggaaacccccuccugaaacacuaucgcggcccugcuggcgaugccaccguugcaucagaaaaggagagugugauguga

SEQ ID NO: 62609 - RNA, 939 nt, Artificial Sequence
  derived and/or modified sequence opt3 from SLC1A6__Homo_sapiens__NP_001259017
augagcucccacggcaacucucuguuccucagagagucagggcagaggcuuggacggguggguuggcugcaacgcuugcaggaaaguuuacagcagcgagcccugcguaccagacuaaggcuccaaacaaugacucuggagcauguccuucgguuucugcgcagaaaugcuuucaucuugcucacgguuagcgcagugguaauuggcgugucccuggccuuugcgcugaggcccuaccagcucaccuaucggcagauaaaguacuucucuuuuccuggggaauuacugaugcgcaugcuucagauguugguccugccacuaaucgugucgucacucguuacaggaauggcuagccuggacaacaaagccacuggccgaauggguaugagagcagccguguauuacauggucaccacaauuaucgcuguguucauugggauccuuaugguaaccauaauccacccgggaaagggcaguaaagagggccugcauagggaagggcggauugagacuauccccacagcagaugccuuuauggacuugauucguaauauguucccuccaaaccucguugaggcuugcuuuaagcaauucaaaacccaguauuccacgcgcguggucacuagaaccauggugaggacagaaaauggaucugagcccggugccagcaugccuccacccuuuuccguggaaaacggcacuucauuccuggagaaugucacccgggcguuagggacacugcaggagaugcucaguuuugaagagaccguuccugugccaggaagcgcaaacggcaucaaugcccuuggucugguaguguucucugucgcuuucggguuggugauaggaggcaugaagcacaagggccgaguucuacgcgacuuuuucgauucccugaacgaagccauuaugagacucguggggaucauuaucugguga

SEQ ID NO: 62610 - RNA, 2040 nt, Artificial Sequence
  derived and/or modified sequence opt3 from SLC20A1__Homo_sapiens__NP_005406
auggccacccugaucacaagcacuacggcugcaaccgccgcguccggcccccucguggacuaccuuuggaugcugauuuugggguucauaaucgcuuuugucuuagccuucucuguuggagcaaacgauguggccaauucauuugguacagcuguaggcagugggguggucacucugaagcaggcaugcauucuagccagcaucuucgagaccgugggauccguucuccugggcgcuaaagugucugaaacaauuagaaagggucuuaucgacgucgagauguauaacucgacccaagggcuguugauggccggaucagugagcgcgauguuuggcagugcaguauggcagcucguugccuccuuccugaaacugccuauaucuggcacucacuguaucgugggggcuacaauuggauuuagccucgucgccaagggucaggaaggcgugaaaugguccgaguuaaucaagauugugaugucaugguucgucaguccacugcuuagcgggaucaugucuggaauauuguuuuuccugguuagggcauuuauucuacauaaggcugauccggugcccaauggccuccgggcccugccuguauucuacgcgugcaccguggguaucaaccuguuuuccauuauguauacgggggccccacuuuugggauucgacaaacucccccuguggggcacuaucuuaaucucagucggcugugcaguguucugcgcucugauuguuugguuuuucguguguccucgcaugaagcgaaaaauagaacgugagaucaagugcagcccaagugagucuccccucauggaaaagaaaaauucccuuaaggaggaucacgaagagaccaaacugagcgucggggacauugagaacaagcauccugugucggaaguaggaccagccacaguuccguugcaggcuguggucgaggaaagaacugugucuuuuaaacuaggugaucuggaggaagcccccgagagggagcggcucccuuccgucgaccugaaggaagagaccucaaucgauaguacagugaauggcgcaguucaacuuccaaacgggaaucuggugcaguucagccaggccguauccaaccagauaaauucuagcggacacuaccaauaucauaccguccacaaagacucaggcuuguacaaggaacuccugcacaaauuacaucuggcuaaggugggugauuguaugggggacaguggcgauaagccccuacgcagaaacaauuccuauacgagcuacacuauggcgauuugcggaaugccucucgacucuuuuagggcaaaagagggcgaacagaagggggaggagauggaaaaacugacauggccaaacgccgacucaaagaaacggauccgcauggauaguuacaccagcuauuguaaugcuguuuccgaccuucacucugccucggagaucgauaugagcgugaaggcagaaaugggauugggugaccgaaagggcuccaacgggucacuggaggaaugguacgaucaggacaaacccgaggucagucuccuguuccaguuucuucaaauucugacugccugcuucggaucuuuugcucauggcgguaacgaugugagcaaugccaucgggccguugguagcacucuaucugguguacgacacaggcgauguuuccucaaaggucgcgaccccuauuugguuacugcuauauggaggcguggggauaugugugggacucugggucugggguagaaggguuauccagacgaugggcaaagaccugacccccauuacaccaagcucuggguucuccaucgagcuugcuagugccuugacuguggugaucgcaagcaacauuggacugccuauaucuaccacacacugcaagguaggcuccgucgugucaguugguuggcuccggaguaaaaaggccguggauuggcgucuguuucgcaauaucuucauggcuugguuugucacugugcccauuagcgggguuaucucggccgcaauuauggcuaucuucagauacgugauauuaaggauguga

SEQ ID NO: 62611 - RNA, 1959 nt, Artificial Sequence
  derived and/or modified sequence opt3 from SLC20A2__Homo_sapiens__XP_005273670
auggccauggacgaguaccuguggauggugauccucggcuucauuauagcuuuuauccuugcauucagcgucggggccaacgauguugcgaauagcuuuggaaccgcuguggguucuggcguagugacacugagacaggccugcauuuuggcaucaaucuucgaaacuacggggagugucuuacugggagccaaggugggcgagaccauuaggaaagguaucauagacguuaaccuauauaaugaaacaguggagacucucauggcuggggaagucagcgcaauggugggauccgccguauggcaacugaucgcuucuuuucuucggcugcccauuucgggcacccacuguaucguuggcucaacaauuggguucagcuugguggccaucggaaccaaggguguccaguggauggagcucgugaaaauaguggcgaguugguuuauuuccccucugcugucuggcuucaugagcgggcucuuauuuguccugauccgcauuuucauccuuaagaaagaggauccaguuccgaacggauugcgagcacugcccguguuuuacgccgcuacuaucgccauuaauguauucuccauaauguauacaggcgcaccugugcuaggucucguccugccaaugugggcuaucgcccuuauuucauuugggguggcgcuguuguucgccuucuuuguuuggcuguucgugugccccuggaugcguagaaagaucaccggaaagcuccagaaagaaggcgcauuaaguagggucagcgacgagucucuguccaaggugcaggaagcugagucaccuguauuuaaagagcucccaggcgccaaggcuaacgaugacagcacgauaccccuuacuggggccgcaggagaaacccuggguacaagugagggcacuucugccgggucccauccucgggcugcguacggacgcgcauugagcaugacccacggcucgguuaaaucuccaauuuccaaugguacauucggguuugauggccauaccagaucagacggacacguguaucauacgguccacaaggauaguggccuauacaaggaccugcuccacaaaauccauaucgauagggggccggaagagaagcccgcccaagaaagcaacuaucggcugcuucgccgaaauaacuccuacacuuguuacacagcugccauuugcggacugccugugcacgcaaccuucagagccgcugacucuagcgccccagaggauucagagaaauuggucggugacacugugaguuauuccaagaaaaggcuccgguacgacagcuauucuucauacuguaaugcaguugcggaagcugagaucgaagccgaggaaggcgggguggagaugaagcuggcaagugaguuagccgaucccgaccagccucgugaagauccagcugaggaagagaaagaagagaaggacgcccccgagguacaucugcuauuucacuuccuccagguccugacagcaugcuuuggauccuucgcucacggcgguaacgauguguccaaugccauugggccgcuuguugcguuguggcugauauauaagcagggcggagugacccaagaagccgcuacgccugucuggcuccuguuuuacggcggggugggaaucuguaccggucuuuggguauggggccgcagagugauucagacaauggggaaagaccugacucccaucaccccaucuucgggauucacaaucgaguuggcaagcgccuuuacuguugucauugcuuccaacauaggccucccugugucaaccacacauugcaagguggguagugucguugccgugggguggaucaggucucggaaagcaguggauuggcgacuguuccgcaauauuuucguagcgugguuugucaccgugcccguugccggcuuauucagcgcugccgugauggcacugcuaauguauggaauccucccauacgucuga

SEQ ID NO: 62612 - RNA, 1653 nt, Artificial Sequence
  derived and/or modified sequence opt3 from SLC22A11__Homo_sapiens__NP_060954
auggccuucagcaagcugcucgagcaggcuggcggggugggacuuuuucagacccugcaggucuugacauucaucuuacccugccugaugauuccuucccagaugcuacucgaaaacuuuucugcagccauaccaggucacagauguuggacucauaugcuggacaauggcucagcgguuaguacgaacaugaccccgaaagcccuucugacaaucagcauucccccugggccaaaucagggaccccaccaaugcaggcgguuccgccagccucaguggcaguugcucgauccaaacgcuacugcaaccuccuggucugaggccgacacagaacccuguguggauggcuggguauacgaccgaucgguguuuaccucaacuaucgucgcuaagugggaucuggugugcagcagucaaggucugaaaccucucucccagucuauuuucaugagcgggaucuuaguuggauccuuuauauggggccugcuuucauaucguuucggcagaaagccaauguugaguugguguugccugcagcuagcaguggccgggacaagcaccaucuuugcuccgacguucgucauuuacuguggacucagguuuguggccgcguucgguauggcaggcaucuuucugucuucccuuacucugaugguagaguggaccacaacuucacggcgcgccguuaccaugacaguggucgggugcgcuuucagcgccggacaggcagcuuugggcggucucgccuucgcgcugagagacuggaggaccuuacaacuggccgcaagugugcccuuuuucgcuauuucucucaucuccugguggcuuccugaaagcgcccgguggcugauaauuaaagggaagccagaucaggcuuugcaggagcuacgcaagguggcccgaaucaauggacauaaagaggcaaagaaccugacgauugaaguccucaugucgucuguuaaagaggaaguggccuccgcuaaggagcccagaucaguacuggaccuguuuugugugccuguccuuagguggcggaguugcgcgauguuggugguuaauuucagccuccugaucuccuauuacggcuuaguguuugaucugcaaucucuaggccgugacaucuuccuccugcaggcacuuuuuggggccgucgauuucuugggacgcgcuacuacagcccugcuccugagcuuucuugguagaaggaccauucaggcaggcucacaggccauggcugggcuggccauauuggcaaacaugcucgugccacaagaccugcagacuuuacggguaguuuucgcggugcugggaaaaggcuguuuugguaucagucuaacaugccucaccauuuauaaggcugagcuguuccccacgccgguccgaaugaccgccgaugggauccuucacacagugggccgcuugggagcaaugaugggcccucugauacucauguccagacaggcccugcccuuacugccaccucuuuuguacggggucauuagcaucgcuucuucacucgugguucuguuuuuccuacccgaaacucagggacugccacuccccgacaccauccaagaccuggagagucaaaagagcacagccgcacaggguaauaggcaggaagcugugacuguagaguccaccucucuuuga

SEQ ID NO: 62613 - RNA, 1560 nt, Artificial Sequence
  derived and/or modified sequence opt3 from SLC22A12__Homo_sapiens__NP_001263255
auggccuucagcgagcugcucgaccuugugggcgggcugggaagauuucaggucuugcaaaccauggcuuuaaugguuuccaucauguggcugugcacacagucuaugcuagaaaacuucucagcagccgugcccagucacagguguugggcgccucuccuggauaauagcacugcucaggccuccauucuugguucucugucgccagaggcauugcucgccauaucaaucccgcccggcccuaaccagcggccacaucaaugccgccgauuucgucagccccaguggcagcugcuggacccuaaugcuacggcaaccagcuggagugaagccgauacagagccauguguagacggguggguguacgauagauccauuuucacuucuaccaucgucgcuaaguggaaccucgugugcgacagccacgccuuaaaacccauggcgcaauccauuuaucuggcaggaauccuuguuggcgccgcugccugugguccugcaucagauagguuugggcggcgcuuggugcugacauggaguuaccuacagauggcugucauggugauggaauggaccgccgcgagagccaggccacucguaaugacucugaauagccuuggauucucuuuuggccauggccugacagcagcuguugccuauggggugcgggacuggaccuugcuccagcuggucguguccgugccguucuuuuuaugcuuccuguacucaugguggcucgcugagagcgcccgcuggcuucugacgacuggacgauuggauuggggucuacaggagcuguggagagucgcagccauaaacggcaagggggcuguucaagacacccucacacccgaagugcugcuuagugcgaugagggaggaacugucuaugggacagccuccagcauccuugggcacucuccugcggaugcccgguuuacguuuucgcaccuguaucagcacacugugcugguucgccuuuggguucaccuucuuuggacuagcucucgaucugcaggcccuuggcucgaauauuuucuugcugcaaauguuuaucggcguaguggacauuccugcaaaaaugggggcccuccugcuucugucucacuugggaagaaggccaacgcucgcugccucccuguuacuggcaggucuauguauccucgcgaacacucuggucccccaugagaugggcgcccuucggucagcuuuggcagugcuggggcucggaggcguuggugccgcuuucacaugcauaaccauuuauaguagcgagcuguuuccgacuguguuacgaaugacagccgucgggcugggccagauggcagcucgcggaggcgccauccuugggccuuuggugagacuccugggaguacacggucccuggcuaccacugcucguuuacggcaccgugccuguccuguccgggcuugcggccuugcuguuacccgaaacgcagucucucccacugcccgauaccauucaggacgugcaaaaucaggcugucaagaaagcaacacacggaacucuuggcaacagcgugcugaagucaacccaguucuga

SEQ ID NO: 62614 - RNA, 1656 nt, Artificial Sequence
  derived and/or modified sequence opt3 from SLC22A13__Homo_sapiens__NP_004247
auggcccaguucgugcaaguccuggcugagaucggcgacuuugggagauuccagauucagcuccuuauacuguugugcguuuuaaacuuucugagccccuucuacuuuuucgcacacguguuuaugguacuagaugaaccucaucacugugccguggcgugggucaagaaucauaccuucaaccucuccgcugccgagcagcuggugcuuucuguuccacuggacacagcaggacacccggaacccugcuugauguuuaggccuccacccgccaaugcuucacuccaagauauccugagucaucgguucaacgagacucagccuugugacauggguugggaauauccagagaaucgccugcccagccucaaaaacgaguuuaauuuagugugcgaucgaaagcaccugaaagacacgacccaguccgucuucauggcaggccuuuugguggggacacugauguuuggaccucuaugugaucguauuggcagaaaggccacuauccucgcucagcugcuucuguucaccuugauuggucucgccacagcguucguaccaucuuuugaacuguacauggcauuaagguucgccguugcuaccgccguggcagggcugucguuuucaaacgucacucuccuuacagagugggugggaccgagcuggcggacccaagcugugguccuggcccagugcaauuucaguuugggccagaugguucuagcgggccuggccuauggguuucgcaacuggagacuccugcagaucacgggaacugcacccggucuucuguuguucuuuuacuucugggcucucccugaauccgccagguggcuguuaacccggggccgcauggacgaggcuauacaacugauccagaaagccgcaucugugaaucgaagaaagcuaagcccagagcucaugaaccagcugguacccgaaaagacagggccuuccggaaaugcccuugauuuguuuaggcacccacaacugcggaaagugacucucauuaucuucugugucugguuuguggacucacugggcuauuacggucuuagucugcagguuggggauuucggauuggacguguaucucacccagcugauuuuuggcgcugucgaggugcccgcgcguugcagcucuaucuucaugaugcagcgcuucggcagaaaguggucccaauuagggacacugguacuaggaggucucauguguauaauuaucauuuuuaucccggcagaucugccuguuguggucaccaugcuugccguggucggcaaaauggcuacggccgcagccuucacuaucucauacguguacagcgcugaauuguuucccacaauucugaggcagaccgggaugggacucguuggcauauucagucggaucggugggauucugacuccauuagugauccugcuuggcgaguaucaugccgcauugccuaugcucauauacggaucucugcccauuguagcgggccuacugugcacacuccugccagaaacccacgggcagggacuuaaggacacguugcaggaccuggaguuagguccccauccucgauccccaaaaagcgucccgucggagaaggaaaccgaggcuaagggccgcacaucuucccccgggguggccuuuguuucaaguacuuauuucuga

SEQ ID NO: 62615 - RNA, 1785 nt, Artificial Sequence
  derived and/or modified sequence opt3 from SLC22A14__Homo_sapiens__NP_004794
auggccggcgaggaaaacuucaaggaggaacugagaagccaggacgcuuccaggaaucucaaccaacacgagguggcagggcauccccacucuuggucacuugaaaugcuguugcggcgcuuacgagccguccauaccaaacaggaugacaaguuugcgaaucugcuagaugcuguuggagaguucgguacauuucagcagcgucucguggcccugacuuucaucccuaguauuaugagcgcauuuuucauguuugccgaccacuucguauuuacggcucaaaaaccauacugcaacaccuccuggauacuugcagugggcccgcaucugucuaaggccgagcaguugaaucucacaaucccccaggcuccuaacgggucguuccugacuuguuuuauguaucugccaguccccuggaaucucgauucaauuauccaguucggauuaaacgacaccgauacaugccaagacggcuggauuuacccugaugccaaaaagagaagccugaucaaugaauuugaccuugugugugguauggagaccaagaaagauacugcgcagauaauguucauggcaggguugccaaucggaagucugauuuucaggcuaaucacagacaagaugggccgguaucccgccauucuccugucccuucugggcuugaucauauuuggguucggaaccgcuuuuaugaacucuuuccaccucuaccuguuuuuccgcuuugguauuagccaguccguugugggcuaugccaucucaaguauuagcuuagcaacggaauggcuggucggggagcacagagcucaugccaucauccucggacacugcuucuuugcggugggcgccguacuucugacugguauugcauacucuuugccucauuggcagcuacuguuccucguugggggaauacuggugaucccauuuauuuccuauaucuggauacuuccggagucacccagguggcugaugaugaaaggcaaggucaaagaagcuaagcaaguguuguguuacgccgcuagcgugaauaagaaaaccauuccuaguaaccuccuggaugaguuacagcugccacggaagaaagucacacgcgccucuguucuagacuucugcaagaaucgacagcucuguaaagugacucugguaauguccugcgugugguuuaccgucagcuacacauauuucacccuuucguugagaaugagggaacugggcgugucuguucacuuccggcacgugguccccuccaucauggaggugccugcacgucucuguugcaucuuucugcuucaacagauugggcgcaaguggucacuggccguaacguugcuccaggcuaucauuuggugucuguuacugcuauuccucccagaaggagaggacggucugagacuuaaauggcccaggugcccggcgacugaguugaagaguaugacaauacugguucucaugcugcgggaauuuagcuuagcagccaccgugacugucuucuuucuguacacagcugagcuuuugccuaccgugcuccgagccacgggccuggggcuagucucccuggcaucuguggccggagcuauccucagccugaccauuaucucacagacacccagucuuuugccaaucuuccugugcuguguuuuagccauuguggcauuuucccucagcucucugcuuccugaaacucgcgaucaaccccugucagagaguuugaaccauagcucccagauaagaaauaagguaaaagacaugaagaccaaagaaacaucuucggaugacgucuga

SEQ ID NO: 62616 - RNA, 1734 nt, Artificial Sequence
  derived and/or modified sequence opt3 from SLC22A16__Homo_sapiens__NP_149116
augggcagcagacacuucgaggggaucuacgaccaugugggacacuuugguagguuccagcggguccuguauuuuauuugcgccuuccaaaacauauccuguggcauccauuaccucgcuucuguuuuuaugggggugacaccccaccauguaugccgcccuccaggaaaugugucacaggucguguuccacaaccacaguaauuggagccuugaagauaccggcgcacuguuguccucuggucagaaggacuauguuacugugcaguuacaaaacggggagauuugggaacugucgcgauguucacguaauaaaagagagaacacgagcagucuaggauacgaauauaccggcuccaagaaagaguuuccgugcgucgauggcuacaucuaugaccagaauacauggaagucuacugccgugacccaguggaaccucguaugugauaggaaauggcuggcgaugcuuauucagccccuguucauguuugggguuuugcucggaagcgugacauucgguuacuuuuccgaccggcugggccgcagagucgugcugugggcuaccucaaguagcauguuccucuuugggaucgccgcagccuucgcuguggauuacuauacuuucauggcagccagguuuuucuuagcuauggucgccucuggauaccugguugugggcuuuguauaugugauggaguucauagguaugaagucccggacaugggcgucaguccaucuucacagcuuuuucgcaguggggaccuugcugguugcccuaacgggauaccucgugcgcacuugguggcuguaucaaaugauccuuaguaccgucacagugccuuuuauucugugcuguuggguauugccagaaacucccuucuggcuccugucugagggccgauacgaagaggcucagaagaucguugacauuauggccaaauggaauagagcauccagcugcaaguuaucggagcugcucucucuugaucugcagggcccuguguccaacucaccaaccgaaguccagaaacauaauuugaguuaucuauuuuacaacuggagcaucacaaagaggacccugacgguguggcucauaugguucacugggucccugggauuuuacucuuucagccuuaauucagucaaccuggguggcaaugaguauuugaaccucuuucuguuaggggugguugaaauucccgcuuacacauucguguguaucgccauggacaaaguaggacggcguaccguccuggcguauagucuauucugcuccgcccucgcauguggcgugguuauggugauuccucaaaagcacuacauccugggugucgugacugcuaugguagggaaguuugccaucggcgcugccuucggacuuauuuauuuguacacagcagagcuguauccaaccauagugcgcagccucgccguuggcucugggucaauggucugcagacuggcuaguauccuugcgccguuuagcguggaucuguccucuauuuggaucuucauaccccaguuguuugugggaacgauggcacuccugucgggugucuuaacccugaaacuaccugaaacacucggcaagaggcuggccacuaccugggaggaggcugccaaacuugaaagcgagaacgaauccaagucaaguaaauugcugcucacaacuaauaacucugggcuggagaagaccgaagcaauuacaccacgggacagcggauuaggcgaguga

SEQ ID NO: 62617 - RNA, 1563 nt, Artificial Sequence
  derived and/or modified sequence opt3 from SLC22A17__Homo_sapiens__NP_057693
auggccagcgaccccaucuucacccuggcuccuccacuccacugccauuacggcgcauuuccgcccaacgccuccgggugggagcagccuccaaaugcgucuggagugucagucgcuagugccgcacuugccgcuagcgcagccuccagaguugcuacaucuacugaucccucguguucagguuucgccccuccagacuuuaaccacugccugaaggauugggacuauaauggcuugcccguguuaacgaccaacgcgauugggcaaugggaucugguaugugaccuaggauggcaagugauacucgaacagauccuguucauucuuggcuuugcaagcgguuaccuguucuugggguauccugccgauagguuuggacggcgcggcaucguccuccugacacugggccucguggggccaugcggaguugguggcgcugccgcagggaguuccacuggagugauggcuuuacgauuccugcuuggcuuuuugcuggccggugucgaccuagggguguaccucaugcgucuggagcuuugugauccgacccagagacugaggguagcguuggccggagaacucguuggcgugggcgggcauuuccuguuuuuaggacuggcacucgucucuaaagacuggcgguuccuucagcgcaugauuacagcucccugcauccuguuuuuguucuaugguuggccuggccuauuccuggagagcgccagauggcucauagugaagaggcagaucgaagaggcucaguccgugcugcggauucuugccgagcgcaaucgaccacacgggcagaugcugggagaagaggcacaagaagccuugcaggaucucgagaacaccuguccccugccugcuacuucaaguuuuagcuucgcgucuuuacugaauuacagaaacaucuggaaaaaucuacucauucugggcuuuacaaacuucaucgcacaugccauaaggcacugcuaucagccagucggugggggcggaucccccucagacuuuuaccuuuguagcuugcuggcuaguggcaccgccgcacucgccugcguuuuccugggggugacgguagaucgguuuggacgucgcgguauucuucuguugucuaugacucucaccggcaucgcuucccugguguuacuggggcuaugggacuaccucaaugaggccgcaauuacaacuuucagcguccugggauuguuuucgucucaggcggcugccauccuuuccacccugcucgcagccgaagugaucccgacaaccguuagaggcaggggucugggguuaauuauggcucugggcgcccuuggaggcuugucagggccugcacaacggcuccacaugggacauggugcuuuccugcagcacgugguccuagccgcgugugcccugcucugcauacugaguaucaugcuuuugcccgagacgaagcgaaaacuguuaccagaagugcuccgcgacggcgagcugugcagaaggccuagccuucugcggcagcccccacccacucgcugugaucauguaccuuugcucgcuacaccaaacccggcacuguga

SEQ ID NO: 62618 - RNA, 453 nt, Artificial Sequence
  derived and/or modified sequence opt3 from SLC22A18AS__Homo_sapiens__NP_001289791
augagaugcgccgagggcgcuuggugguucagccccgacgggccugcaggauccgccgcgucuaucuggccagcugaaggugccgagggccugccggggcagcucggaagggaucggcuugaaguggucuacucaguucccgacaacgugccuggccaaaaugguagucgccgaccacugguauguaagauuaccgggaaaugcuugagcguguguuccgaggaaaacgcaaaggccggaggcugcucugcuuuucccuuacugcuaucgcagcucggcgcacguaugacagggagagagcacgcccauaaaggaccugagcugacuacgccagauucaggucuucccaggccuccaaauccggcucuggccggcuuccgggcguuggcacagcacagucccccucucgggaccagcacaccauccgccguccugcugucugcugccacuuga

SEQ ID NO: 62619 - RNA, 1275 nt, Artificial Sequence
  derived and/or modified sequence opt3 from SLC22A18__Homo_sapiens__NP_899056
augcagggcgccagagcucccagggaccaagggcggagcccuggacgcauguccgcacugggucgaucuucagugauccuccuuaccuacguccuggccgcgacagaguugacuugcuuauucaugcaguuuaguauuguuccauaucugagccguaagcuaggccucgauuccauagcuuucggguaccugcagacgaccuuuggagugcuucagcuguugggcgguccgguauucgggagauuugccgaccaaaggggagcacgggccgcucucacacugucuuuccuggcagcccucgcuuuauaucugcuuuuggccgcggcaucgucacccgcccugccuggcguguaccuacucuuugcuagccgccugccaggcgcccuuaugcacacucugcccgcagcucagauggucaucaccgauuugagugccccugaagagagaccagcggcccucgggaggcugggauuauguuucggugugggcguuauucuggggucccuccuuggaggcacacuggugucugcauaugguauccagugccccgcuauuuuggccgcucuagccacccugcucggggcaguccugagcuuuacuuguaucccugccuccacaaaaggagcuaagaccgacgcgcaggcaccacuuccgggcggcccccgggccucaguguucgaucugaaagcuauagccaguuugcuccgccugccugacguaccacgaaucuuuuuaguuaagguggcaagcaacugccccacggggcuguucauggucauguuuucuauuaucuccauggauuucuuccaacuagaagccgcucaggccggauaccucaugucauuuuucggucugcuucagauggugacucagggcuuggugauugggcaacugagcagucauuuuucugaggaaguccuccugagagcauccguucuuguguucaucguagugggacuggcgauggcuuggaugagcucggucuuucacuucuguuugcucgugccuggccugguuuuuaguuuaugcacccugaauguggucacagacuccaugcuaauaaaagccgugucaacuucugauaccgguacaaugcucgggcugugugcaagcguacagccacuuuugaggacccugggccccacgguuggaggccuccuguaucgguccuucggggugccggucuuuggacaugugcaggucgccauuaacacuuuagugcugcuuguuuuguggcguaagccuaugccccaacgcaaggacaaagugagauga

SEQ ID NO: 62620 - RNA, 1665 nt, Artificial Sequence
  derived and/or modified sequence opt3 from SLC22A1__Homo_sapiens__NP_003048
augcccaccguggacgauauccuggagcaggucggcgaaagcgggugguuccaaaagcaggccuuucucauucuuugccuguuguccgcugcauucgccccuauauguguuggaaucguguuuuuagguuucacaccagaccaccauugccagucuccgggcguagcggagcugucacagagauguggguggagucccgcugaagaacuaaacuacacugugccuggacucggcccagccggugaagcauuucuggggcaaugcaggcgguaugaggucgauuggaaucagagcgcccuuuccuguguggacccccuggcuucuuuggcaacgaaccgcucgcaccucccucugggaccaugccaggauggcuggguuuacgacacccccggcucaagcauugugacagaguucaaucuggucugugccgauaguuggaaacucgacuuauuucaguccugccugaacgcuggguuccuuuuuggaucuuugggugugggcuauuucgccgaucgauuugggcguaagcugugucuacucggaacuguacugguuaaugcggugagcggcguccuuauggcauucuccccuaacuacaugucaaugcuguuguuuagacuccugcaagguuuagugaguaaagggaauuggauggccggauauacccugaucacagaguucgugggcagcggcucuaggcggaccgucgcuauuauguaccagauggccuucacuguugggcucguggcacuuacaggacuggcuuaugccuugccacauuggcgcuggcuacagcuggcgguaucccucccgaccuuucuguuccuucuguacuacuggugcgugcccgagucaccuagaugguugcucagccagaagaggaacacggaagccaucaaaauaauggaccacaucgcacaaaagaaugguaagcugccacccgcugauuuaaaaaugcugagucuagaggaggacgucacugaaaagcucucuccuuccuuugccgaucuguuccggaccccacgccuucgaaaaagaacauuuauuuugauguaucugugguucacugacagcgugcucuaccagggccugauccuucauaugggggcuaccucgggaaaccuguauuuggacuuucucuacucugcccugguugagauucccggcgcauucaucgccuuaauaacaauugauagggugggucggaucuauccgauggcuauguccaaucugcuagcgggggcagccugucucgucaugauuuuuaucucaccugaccugcacuggcuuaacaucauuauaaugugcgugggccguaugggaaucaccauugcuauccagaugauaugcuugguaaaugccgaacuguaccccacguucguucgcaaccucggcgugauggucuguaguagccugugcgauauugggggaaucaucacuccauuuauuguguucagauuaagggaggucuggcaagcacugccucuuaucuuguuugccgugcucggucugcuagcugccggcguuacacugcuccugcccgaaaccaaggggguggcacuuccagagacuaugaaagacgcggagaauuugggacggaaggcuaagcccaaagaaaacacaauuuaucugaagguacagaccuccgagccuucuggcacguga

SEQ ID NO: 62621 - RNA, 1086 nt, Artificial Sequence
  derived and/or modified sequence opt3 from SLC22A23__Homo_sapiens__NP_001273385
auggccaucgacagaaggcgggaggcugcaggcgggggacccggucgccagccugccccagcggaagagaacggcagccugccgcccggggaugcugccgcauccgccccucucggaggccgagcugguccagggggaggcgcagaaauucagccccuuccuccacugcaccccggcgggggaccucauccaucuugcuguucagccgcugccgcgccgaguuuguuacugcuagacuacgaugguagcgugcuccccuuccugggcgggcuuggaggcgguuaucagaagacccuggucuugcucacauggauaccugcacuguuuaucggguucucccaguuuucugacucguuccugcucgaucagccaaauuuuuggugccguggagccggcaaaggcacugaguuagcugggguuacgaccacaggaagagguggcgacauggggaacuggacuucacugcccaccacaccuuucgccaccgcaccaugggaagcugccggaaauaggagcaacaguuccggcgcggaugguggggacacucccccgcuuccuucucccccagauaagggcgacaaugccagcaacugugauugccgggcaugggacuacggcauucgcgcuggauuggugcaaaauguaguguccaaaugggaucuggucugugacaacgccuggaaggugcacaucgcuaaauuuucacuacucguugggcugauuuucggauaucuuaucacagguugcauagccgacugggugggcagaaggccuguccuguuguuuaguaucauuuucauccucauuuuugggcugaccguggcauuaagcguaaauguuacgauguucucuacucugcgguuuuucgagggauucugucucgccggcaucauacuuacccuguacgcuuugcgcauugagcuaugucccccagguaagcgauuuaugaucacaaugguggcguccuucgucgcaauggccgggcaguuucugaugcccggccucgcugcccugugcagagauuggcaagugcuucaggcacugauuaucugcccuuucuugcucaugcuguuauauuggucauga

SEQ ID NO: 62622 - RNA, 1659 nt, Artificial Sequence
  derived and/or modified sequence opt3 from SLC22A24__Homo_sapiens__NP_001129978
augggcuucgacgugcugcucgaucaggucgggggaauggguagauuucaaaucugccuuauugccuucuuuuguauaaccaacauccuguuguuccccaauauuguuuuagagaacuuuacagcuuucacuccuagccacaggugcugggugccacugcuagacaaugauacgguauccgacaacgauaccggcacacucucuaaggacgaucugcuucggaucucaauuccgcuggacaguaauuugcgcccccagaaaugucagcgauuuauccauccucaguggcaacuccugcaccugaacgggacuuucccaaauaccaacgaacccgauacagagccuugcguggacggaugggucuacgaucguagcuccuuucucucuaccauagugacugaaugggacuuaguuugugagucgcagucacuuaagagcauggugcagagucuguucauggcaggcuccuugcugggugggcuaaucuauggacaucucucugauagagucggcaggaaaauuaucugcaagcuguguuuucuucagcuggccauuagcaauacaugcgcggcuuucgccccaaccuuuuugguguacuguauccuccgguuccuggcaggcuucuccacgaugacuauauuagggaacaccuuuauucugucacucgaauggacacuuccccgcaguagaagcaugacuaucaugguacuguugugcucuuauuccguuggacaaaugcuacuggguggccucgccuucgcuauucaggacuggcacauccugcagcuuaccgugucaacaccuaucauuguccuguuuuugagcaguuggaaaaugguggagucugcaagguggcucauaaucaauaaccagcuggacgagggguuaaaggaacugcggcgcguggcccauauuaauggaaagaaaaacaccgaggaaacgcuaacuacagagcucguccgauccaccaugaagaaagagcuggaugcuguuagaaucaagacuagcauauucucgcuuuuuagggccccaaaauugcggaugcguguguucggccuguguuuuguacgcuucgcgauuacagugccguuuuacggucucauccugaaucuucaacaccuggggucuaacgucuccuuguuccagauccucugcggagcagugaccuuuacggccagaugcguuucacuguuaacccugaaccacaugggcaggcggauuagucagauccuauucacauuucccgugggccucuucauucuggucaauacuuuccuuccucaagaaaugcagauauugcgagugguacuggcuacccucgggaucggaagcguuuccgccgcaucuaacagcgcuucagugcaucacaaugagcuggucccaacaauuuuacgcaguacuguggccgguaucaacgcggucuccggcagaaccggggccgcacuggcuccccuuuugaugacacucauggccuauagcccucaucugccauggaucucuuacggaguguuucccauucuagcuguuccggugauacugcuccugccugaaaccagggaccuucccuugccaaauacuauccaggauguagagaacgaccggaaggauucacgcaauauuaagcaggaagacacguguaugaaagucacacaauucuga

SEQ ID NO: 62623 - RNA, 1668 nt, Artificial Sequence
  derived and/or modified sequence opt3 from SLC22A2__Homo_sapiens__NP_003049
augcccaccacaguggacgauguccuggagcacggcggggaauuucauuucuuccagaagcaaauguuuuuccuccuugcccuguugagcgcuacuuuugcaccuaucuacguuggaauuguguucuuagguuuuacgccagaccacagaugcagguccccgggcguagccgagcugucucuacgguguggguggucacccgcggaggaacucaacuauaccgugccuggaccaggccccgcuggugaagccaguccucgccagugccgacguuacgaggucgauuggaaucagagcacauucgacuguguggauccacuggcaucccuugacacuaacagaucuaggcugcccuuggggccuugccgggauggauggguuuaugagaccccaggcucgucaauagugacagaauuuaaucucgucugugccaacagcuggaugcuggaccuguuccagaguuccgugaauguaggcuuuuucaucgggucuaugagcauuggauacaucgcugaucgcuuugguagaaaacucugcuuacugaccacuguucuuauuaacgcagccgcuggcguguugauggccaucuccccgacauauaccuggaugcugauauucaggcuaauccaagggcucgucucaaaggcgggauggcugauuggcuacauccuuauuacggaguucgugggucggcgcuaucgaagaacuguggggaucuuuuaccaggucgcauacaccguuggacuguuggugcucgccggcguagcuuaugcccugccccauuggaggugguuacaguucacagugagucugccuaacuuuuucuuucuccuuuacuauugguguauaccagaaagcccccgguggcugauuucucagaauaaaaaugcagaggcuaugcguaucauuaagcacaucgccaaaaagaacggcaaguccuugccugcgucacuacaacgccugagacucgaggaagagacugggaaaaagcugaaucccagcuuccuugaccuggucaggaccccacagauccggaaacauacaaugauuuugauguacaacugguuuaccaguucugugcucuaucagggacugauaaugcacauggguuuagccggcgauaauaucuaccuggacuucuuuuauuccgcucuaguugaguucccggcagccuuuaugauuauccucacgauagaucgaauugggcgcagauacccuugggcugccagcaacaugguggcaggagccgcuugccuggcgucggucuucauccccggcgaccuucagugguugaagaucauuaucucuugucuggguaggauggggauuacuauggcauacgaaauagugugccucguaaaugccgaacuguauccaacauuuauccggaaccuuggcguucacauuuguuccucaaugugcgacaucggaggcaucauuaccccuuuccugguguaccgcuugacuaacauauggcucgagcugcccuuaauggucuucggggugcugggucuagucgcuggaggccucgugcugcuuuugccagagacaaaagggaaggcccugcccgaaaccaucgaggaagcagagaauaugcaaagaccuaggaagaacaaagaaaagaugauuuaucuccagguucagaaacuggauaucccauuaaauuga

SEQ ID NO: 62624 - RNA, 1671 nt, Artificial Sequence
  derived and/or modified sequence opt3 from SLC22A3__Homo_sapiens__NP_068812
augcccagcuucgacgaggcccugcagagagugggcgaauuugggagguuccaacggcgcgucuuucuccuucugugcuugaccggaguuacauucgcauuuuuauucguggguguaguguuucugggcacucagccugaucacuacuggugucgagggccauccgcugccgcgcuagcugagcguugcggauggucuccggaagaggaauggaacagaacggcccccgcaucaaggggcccugagccacccgagcggcgcgguagaugucagagguaucuccuggaagccgcuaaugacagugcaagcgccaccuccgcucuuucuugcgccgauccucuggcggcauucccaaaccggucggcccccuuggucccuugucgcgggggauggcgauacgcucaggcccauucaacaaucgugagcgaguuugaccucguuugcgugaaugcauggaugcuggaucugacucaagcuauucucaacuuaggcuuccugaccggcgccuuuacacuuggguaugcggccgacagauacggaaggauagucaucuauuugcugaguugucuaggugugggcguaaccgggguuguggucgcauucgcuccaaauuuuccgguguucgugauuuuccgguuucuccagggagucuucggcaaggguacuuggaugacaugcuacguuaucgugaccgaaauuguaggguccaaacagcgucgcaucgugggaauagucauccagauguuuuucacgcugggcauuaucauucuucccggcaucgccuauuuuauaccuaacuggcaagggauucagcuggcuaucacuuugccaucuuuccucuuucuguuauacuacugggugguucccgagagcccuagauggcugauuaccaggaagaaaggagauaaggcccuccagauccuucggcgaaucgcaaaauguaaugguaaguaucuguccucaaacuacagugagauuacagugacugacgaagaggucagcaauccaucuuucuuggaucuagugcgcacaccccagaugagaaagugcacccugauacucauguuugccugguucaccuccgcuguaguuuaucaaggccuggugaugaggcuugggaucauuggaggcaaccuguacaucgacuuuuucauaucaggugucguggaauugccgggggcgcuccugauuuuacugacgaucgagcggcuaggccgcagacucccuuuugcagccagcaauaucgucgcuggaguggccugucugguuacugcauuccuucccgaaggcauugccugguugaggacaaccguggcuacucuggggcgucucggaaucacaauggccuucgagauuguauaucuggucaacagugagcuuuacccaaccacgcugcggaauuuuggugugucuuugugcuccggccucugcgauuucgggggaauaaucgcaccuuuucuguuauuccgacuggcggcuguuuggcuagaacucccccugauuaucuuuggcauccuugccagcauuugugguggguuggugaugcugcucccagagaccaaaggcauagcacugcccgaaacagucgacgauguggagaaguuaggaucgccucacucuugcaaauguggcagaaacaagaaaacuccaguauccaggucacaucuguga

SEQ ID NO: 62625 - RNA, 1656 nt, Artificial Sequence
  derived and/or modified sequence opt3 from SLC22A4__Homo_sapiens__NP_003050
augagagacuacgaugaggugaucgccuuccugggcgaaugggggcccuuucagaggcucauuuucuuucuucugagcgcuuccauaaucccuaacggauucaaugguaugucugucguuuuucuggcaggcaccccagagcaccggugccgcgugccggacgccgcgaacuuaucaagugcuuggcgaaauaacagcguaccccugcgucuaagagaugggagggaagugccucauuccuguucucgguaucgccucgccacaauugcaaauuucucggcccugggacuugagccaggcagagacgucgaucugggucaauuggaacaggagucaugccucgacgggugggaguuuagccaggauguguaccugaguacuguugugacggaauggaaccuggucugugaggacaauuggaaggugccccucaccacauccuuauucuuuguaggaguucugcuuggcucuuucgugagcggccaguuguccgauagguuugggcggaaaaacguccuguucgcuacuauggcagugcaaaccggauuuucauuccuacagaucuucaguauuagcugggaaauguuuacagugcucuuugucaucguugguaugggccagauaucuaauuaugugguagccuuuauccuggggaccgagauucuuggaaaguccgugcgcaucauuuucucaacucugggcgucugcacauuuuucgcuguggguuacauguugcucccucuguuugccuauuucauccgagacuggagaauguuacugcucgcgcuuaccguuccaggggugcuguguguccccuuguggugguuuauaccugagagcccaagguggcuaauuagucagcggcguuuccgcgaagcagaggauaucauucaaaaagccgcuaagaugaacaauaucgccgugccggcaguaaucuuugacucuguugaagaguugaacccccucaaacagcagaaggcuuucauucuggaucuuuuuagaacgaggaauauagccaucaugacuauuaugucccuguugcucuggaugcugaccagcgugggauacuucgcguuaucgcuggacgccccuaaccuacacggcgacgcauaucucaauugcuuccugucugcucuuaucgaaauaccagccuacauuacagcuugguugcugcuccggacucugccccgacgcuacaucaucgccgcaguccuuuucuggggcgggggagugcuguuguucauucagcucgucccuguggauuauuacuuucuguccaucgguuuaguuaugcugggcaaguucgggauuaccucagccuuuaguaugcuauauguguucacagcugagcucuacccaacccugguaagaaacauggcggucggagugacgagcacugcauccaggguuggcucuauaaucgcccccuauuuuguguaccuuggugcuuauaaccggauguugccguacauugucauggggagccugacagugcucaucggcauccugaccuuauucuuuccugagucacugggaaugacucuucccgaaacauuggagcaaaugcagaaaguaaagugguuccgcaguggcaaaaagaccagagacuccauggaaacggaggaaaauccaaaagugcucauuaccgccuuuuga

SEQ ID NO: 62626 - RNA, 1674 nt, Artificial Sequence
  derived and/or modified sequence opt3 from SLC22A5__Homo_sapiens__NP_003051
augagagacuacgaugaggugaccgccuuccugggcgaaugggggcccuuucagaggcucaucuucuuucuucugagcgcuuccauuauaccuaacggauucacagguuugucuucagucuuuuuaaucgcaacuccagagcaccggugccgcguuccggacgccgcgaaucugaguagcgcuuggcgaaaccauacggugccccuacgucucagagauggcagggaaguaccucacuccugucggcgcuauagacuggccaccauugcaaauuucucugcccuugggcuggagccaggaagggacguggauuugggccaacucgaacaggagucgugccuggacgguugggaguuuucacaggaugucuaccugagcacaaucgugacugaauggaaccucguuugugaggacgauuggaaggcucccuuaaccauuagucuguucuuuguggggguccuuuugggauccuucaucucuggccagcugagcgaccgguuuggccgcaaaaaugugcuauucguaacaauggggaugcaaaccggauuuuccuuccuccagauauucucaaagaacuuugaaauguucguugugcuguuuguccuuguggguaugggccagaucaguaauuauguggcagccuucguccuggggacugagauuuugggaaaaagcguucgaaucauuuuuagcacacucggcgugugcaucuucuacgcuuuugguuauaugguacugccuuuauucgccuacuuuauaagagauuggaggaugcugcucguggcgcuuaccaugccagggguccuguguguggcauuguggugguucauucccgaguccccucgguggcuaaucucacagggacguuuugaagaggccgaaguuauuauccgcaaggcugccaaagcaaacggcaucguggucccaagcacgauuuucgacccgagugagcugcaagaucucucuuccaagaagcagcagagccauaauauacuggaccuucugagaacuuggaacaucaggauggugaccauuaugucgaucauguuguggaugacaauaucuguaggcuauuuugggcucucccuggacacucccaauuuacacggagauauuuucguuaacugcuuccugucagcuaugguggaagucccugccuacgugcuagcguggcuccugcuucaguacuugccacggcgauauaguauggccaccgcacuguuucucgguggcagcguccugcuuuucaugcaacuggugcccccugacuuguacuaucucgcuacaguucuggugaugguagggaaauuuggagucaccgccgcuuucuccaugguguacguuuauacggccgaguuauacccaacugugguccgcaauaugggcguggguguaucuagcacagcaucaagacuggggaguauccuaucccccuauuuuguguaccucggcgccuacgauagguuccugccguauauccuuaugggaucuuugaccauucugacugcuauccucacacuguuuuuaccugagucuuucggcacgccccugccagacaccauugaucagaugcuucggguuaaggggaugaaacaucgcaagaccccuucacacacaagaauguugaaagacggacaggaaaggcccacuauacucaagaguaccgcguuuuga
